United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 115

SEQ ID NO: 223195 - DNA, 8739 bp, Artificial Sequence
  Description of Artificial Sequence: Synthetic coding sequence
atgggaagacggcgacgactgtgtctccagctctattttctgtggttggggtgcgttgtgctgtgggctcagggcacagccggtcagccacaaccaccacctcctaagccccctaggccacagccaccccctcagcaggtgagatctgcgacggcgggtagcgaggggggttttctcgccccagaatacagagaagagggcgcagctgtggcttcccgggttagacgcagaggtcagcaggacgttcttcggggtcctaacgtgtgtggctctcgtttccatagttactgctgtcctggctggaagacacttccgggaggcaatcagtgtatcgtgccaatctgccgcaactcatgcggtgacggcttttgctcaaggccaaacatgtgtacctgctcttctgggcagattagctcaacatgcggttccaaaagtatccagcagtgttcagttcgctgtatgaatggaggtacctgtgcagacgatcactgccagtgtcagaaggggtatattggaacctactgtggccagccggtgtgtgagaacggctgccagaatggcggacggtgcatcggcccaaatcggtgcgcatgcgtgtacggctttacaggtccgcagtgtgagagggattacagaactggcccttgttttacacaagtaaataatcagatgtgtcagggccagctgaccggcatcgtgtgtacgaagactttatgctgtgccacaatcggacgggcatggggtcatccatgtgaaatgtgccccgctcagccgcagccctgcagacggggattcataccaaacatcagaacgggtgcctgtcaggacgtcgacgaatgtcaagctatccccggtatttgccagggtggcaattgtatcaataccgtagggagtttcgagtgccgatgcccagcaggacacaaacagtcagagacaacccagaaatgcgaagatatagacgagtgttccattattccgggaatttgcgagactggtgagtgctccaacactgttgggtcctatttttgtgtttgcccacgcggatacgtgaccagtacagacgggtctcgctgtatcgatcagagaaccggcatgtgtttctccgggctggtcaatgggagatgtgcacaggaacttcctggacgaatgaccaaaatgcaatgttgctgcgaacccggacgatgttgggggataggcacaatccccgaggcatgccccgtgcgaggatccgaagagtacaggaggctgtgcatggatggcctgccgatgggaggaatacctggtagtgccggaagccgcccaggcggaacagggggaaatggcttcgctcccagcggcaacggtaatgggtatgggcctggtggaaccggatttatccccattcctggagggaacgggttcagccccggtgtgggcggagctggcgtgggggcaggtggccaaggccctatcattacggggcttaccattctcaaccagaccatcgacatctgcaagcatcatgccaatctgtgcctcaacggccgatgtattcccaccgttagtagctatcgctgtgaatgtaacatgggctacaagcaggacgctaacggcgattgtattgatgttgacgaatgtacgtcaaacccttgcactaacggtgactgcgtgaacactcctggcagttattactgcaaatgtcacgccggattccagagaacccctacaaaacaggcttgcatagatatcgacgagtgcatccagaatggggtgctgtgcaagaatggccgttgcgtcaataccgatggaagcttccagtgtatttgcaatgccggtttcgaactgaccacggacgggaagaactgtgtggatcatgacgagtgtacaaccacaaacatgtgccttaacggcatgtgcattaacgaggatggttcgtttaaatgtatttgtaagccgggattcgtgctggcgcctaacgggaggtactgcaccgatgtcgacgaatgccagacgcctggaatctgcatgaatggacattgtatcaacagcgagggctcctttaggtgtgactgccctcctgggctggccgtggggatggatggaagggtgtgtgtggatacccacatgcgctccacctgttatggtgggattaagaaaggagtatgcgtgaggccctttccaggggctgtcacgaagtctgaatgctgttgcgctaatcccgactatgggtttggagagccttgccagccctgtcccgctaagaactccgcggaattccacggtctatgctcctcaggagtcggaataaccgtcgacggtcgagacattaacgagtgcgcacttgatcccgacatctgtgcgaacgggatatgtgaaaatcttagggggtcctaccgatgcaactgcaactctgggtacgagcccgatgcttcagggcgaaactgcatcgatatcgatgagtgcttggtaaatcgattgctctgcgacaacggcttgtgcagaaacacccctggcagctatagctgcacgtgcccccctggctatgtgtttcggacagagacggagacctgtgaagacatcaacgagtgcgagtccaatccgtgcgtgaatggtgcctgcaggaataatctgggctctttcaactgcgagtgttcacccggaagtaaattgtcctccaccgggctgatttgcatagactctctgaaagggacttgttggcttaatatccaggactcccgttgcgaagtcaacatcaacggtgcaacactcaaatcagagtgttgcgcgaccctaggtgctgcctggggctcaccttgtgagcggtgcgagcttgatacggcatgcccaagaggcctggccaggattaaaggggtgacttgcgaggatgtgaacgagtgtgaggtattccctggggtgtgccccaacggaaggtgtgtgaattccaaaggatcatttcattgtgagtgccctgaaggcctgactctggatggtaccggacgagtctgtctcgatatcaggatggagcaatgttacctgaaatgggatgaagacgagtgcattcatcctgtccccggaaagtttcgaatggatgcctgttgctgtgccgtgggcgcagcatggggaacagagtgtgaagagtgtccaaaacccggtacgaaggaatacgagactctctgccctcgcggagccggttttgccaatcggggagacgtgcttaccggacggccattctacaaggatattaatgaatgtaaggcctttcccggtatgtgtacgtacggcaaatgccgaaacactatcggctcattcaaatgtaggtgtaattccggcttcgcactggacatggaagaaaggaattgcaccgatatcgatgagtgtcggatttctcctgatctgtgtgggtcaggcatatgtgtgaacacgcctgggtccttcgagtgtgagtgctttgagggatatgagtccggattcatgatgatgaagaattgtatggatatcgatgagtgcgagcgtaatccactcctttgcaggggaggtacatgtgtgaacacagaagggagcttccagtgcgattgccctttaggacatgaacttagcccaagccgagaggactgtgttgatattaacgagtgctccctgagcgataacctatgtcgcaacggaaaatgtgtgaacatgatcggtacctatcagtgctcttgcaatccgggttatcaggcaacgcctgaccgccaaggatgcactgatatcgacgaatgtatgatcatgaacggcggatgcgatacccagtgcactaactcagagggttcgtatgagtgcagctgctccgagggctacgctttgatgcccgatgggagatcttgcgcggacatagacgaatgtgagaataaccctgacatttgcgatggcggtcagtgcacaaacatcccaggggagtatcgttgcctgtgctatgacggctttatggccagtatggatatgaaaacttgcatcgatgtcaacgaatgcgacttgaattcgaacatatgtatgttcggagagtgtgaaaatacaaagggatccttcatctgccattgtcaattgggctatagcgtgaagaaggggacaaccggctgcactgacgtggacgagtgcgagatcggcgcacataattgtgacatgcatgcatcatgcctgaatatccctggcagctttaaatgcagttgccgagagggctggattggcaatgggatcaagtgcatcgatctggatgagtgcagtaacggtacgcaccagtgctccatcaacgctcaatgcgttaatacccccggttcttatcggtgtgcttgctccgagggcttcaccggcgatggtttcacatgctctgacgtggatgagtgtgcagaaaacatcaatctttgcgaaaacggccagtgcttaaatgtacctggagcatatagatgcgagtgcgaaatgggtttcacccccgcatcggactcccgatcatgccaggacatcgacgaatgttcattccagaacatctgcgtcttcggcacctgcaataatcttcctggcatgttccactgtatttgcgatgatggctacgagttagatagaacaggtggtaactgtactgatatcgacgaatgtgctgatcccattaattgcgtgaatgggctgtgcgttaataccccgggacgttatgagtgtaattgcccccctgactttcagctcaaccccaccggtgtggggtgcgtggataatagggtagggaactgttatctgaaatttgggccaagaggggatggttccctcagctgcaacactgagatcggagtgggagtgtcccgaagctcttgttgttgttccctgggaaaagcttgggggaacccctgtgagacctgcccccctgtgaattccacggagtattatacgctgtgccccggaggtgaagggttccgcccaaacccaatcaccatcatactggaggatattgacgaatgccaagagctgcccggtctgtgtcagggtggcaattgtataaacacttttggctcgttccagtgtgaatgtcctcagggatactatctgtctgaagatacccggatttgtgaggacatagacgagtgttttgcacatccaggtgtttgtggaccaggtacgtgctacaacacactcggcaattacacctgcatctgtcccccagagtacatgcaggtcaatgggggtcataattgtatggatatgcggaaaagtttttgctaccgtagttacaacggcactacatgcgagaacgagcttccatttaacgtgactaagcgcatgtgctgctgtacctacaacgtgggaaaagcatggaacaaaccctgcgagccctgcccgactccaggaaccgcggacttcaaaactatttgtgggaatattcctgggttcacgtttgatatacacacggggaaagccgtggatattgacgagtgtaaggaaatccccggaatctgtgctaacggcgtgtgtataaatcagattgggtccttcaggtgcgagtgcccaacgggattctcctacaatgacctgctactggtgtgtgaggacatagatgaatgctccaacggcgataacctttgccagcggaacgctgactgcatcaattcaccaggatcataccggtgtgaatgcgccgcaggcttcaagctctcccctaacggcgcttgtgtcgaccgcaacgagtgcctggaaatcccaaacgtctgcagtcacggcctgtgtgtggacttacagggatcctatcaatgtatatgccacaacggctttaaggcttctcaggaccagaccatgtgtatggacgtcgacgaatgcgagcgccacccatgcgggaacgggacatgtaagaacaccgtcggatcctacaattgcctgtgttacccaggttttgagctaacccacaataatgattgtctcgatatagatgagtgctctagcttctttggccaggtgtgtcggaacggacggtgttttaatgaaatcggtagttttaaatgcctttgcaacgagggttatgagctgacaccggatggaaagaattgtatcgataccaatgagtgcgtggccctgccgggaagttgctcaccaggcacctgccaaaatctagaaggaagcttccgttgcatttgtcctcccggttacgaagtgaagagtgaaaactgtattgatatcaacgaatgcgatgaagaccccaatatttgcctgtttgggtcatgcacgaacaccccaggcggttttcagtgcctgtgtccaccaggcttcgtcctgtctgacaacgggaggcgttgcttcgatacacgacagagcttctgttttaccaacttcgaaaacgggaaatgctcagttcctaaagcattcaacactaccaaggctaagtgttgctgtagcaagatgcctggcgagggctggggcgatccatgtgagctatgcccaaaggatgacgaggtggcattccaggatctctgtccatatgggcacggtaccgttccatctctccacgatactcgcgaagatgtaaacgagtgcctggagagccccggtatctgttcaaatggccagtgcattaatacagacggaagcttccggtgcgaatgccccatgggctataacttggattataccggcgtgcgctgcgtcgataccgatgagtgctccattgggaacccatgcggcaacggcacgtgcaccaatgtgatcggttcctttgagtgtaactgcaacgagggattcgagcccggaccgatgatgaattgcgaggacattaatgagtgcgcacagaatccgcttctgtgtgcctttcgctgcatgaatacctttggcagttatgagtgtacttgccctatcggttacgccctgagagaagaccaaaagatgtgtaaagacctggatgaatgcgctgagggactgcacgattgtgagtctagggggatgatgtgcaagaaccttatcgggaccttcatgtgtatatgccccccaggtatggccaggagacctgatggggaaggatgcgtcgatgagaacgagtgcaggactaaaccaggtatttgtgaaaacggccgatgtgtaaacattataggatcctacaggtgtgagtgtaatgagggtttccagtcgagtagcagtggcaccgagtgccttgacaatagacaggggctctgcttcgctgaggtcctccaaacgatctgtcaaatggcatcatctagccgcaatctcgtcacaaaaagcgaatgctgttgcgacggtggacggggttgggggcatcagtgcgaactgtgtccgctgccaggtacagcccagtataagaaaatatgtcctcacgggcctggatataccaccgatggacgcgacatcgacgagtgtaaggttatgcctaacttgtgtaccaatggccagtgcattaataccatgggctctttccgatgtttctgtaaggtcggatacaccaccgatatttcaggaacatcttgcatcgatctcgatgaatgttcacagagtcccaaaccttgcaattatatttgcaaaaataccgagggaagttaccagtgctcctgcccacgaggctacgtgctgcaagaagacggtaaaacgtgtaaagatcttgacgagtgtcagactaaacaacacaactgccagtttctttgcgtgaacacactggggggtttcacatgtaagtgccctcccggattcactcagcatcacaccgcctgcatagataataatgagtgtgggtcccaaccttccctctgcggggctaaaggaatttgccaaaacactcccggaagcttcagctgtgagtgtcagagaggctttagcctcgatgcaacagggttaaactgcgaagacgttgacgaatgtgatggcaaccaccgctgtcagcatggttgtcagaacatcctggggggataccgctgcggatgcccacaaggatacatacagcattaccagtggaatcagtgtgtagacgagaatgagtgcagcaatccaaatgcatgtgggtccgcctcctgttataatactctcgggtcctataagtgtgcgtgtccttccggtttctcttttgaccagttctcttccgcgtgccacgatgttaacgagtgttcttcgagcaaaaatccctgcaattacggctgtagcaacacagagggcggttatctgtgcggatgtccacctgggtattaccgagtcgggcagggacactgcgtcagcgggatgggattcaataaaggtcagtacctgagtctagatacagaggttgatgaagagaatgctctgtcaccagaagcgtgctacgagtgcaagatcaatggttatagcaagaaagactcccgacagaaaaggagtattcacgaaccagatcccaccgccgtcgaacagatttcccttgagagcgtggacatggattcacccgtaaacatgaaatttaacctgtctcatcttggttccaaggagcatatcctcgagctccggccagccatacagcccctgaataaccacataagatacgtgataagccagggcaacgacgattcagtgtttcggattcaccagcgaaatgggctgagttacctccacactgcaaagaaaaaactaatgcccggtacatacacactggagataacctccatccccctgtacaagaaaaaggagctgaagaaattggaggagagcaatgaggatgattatctcctcggagagctgggggaggccctacgcatgcgtctgcagattcagctttactat

SEQ ID NO: 223196 - DNA, 8738 bp, Artificial Sequence
  Description of Artificial Sequence: Synthetic coding sequence
atgggcaggaggcgacgtctgtgcctccagctctattttctatggctgggttgcgtggtcttgtgggcccagggcactgcaggccagcctcagcctccccctcctaaacccccaagacctcaaccgcctccccagcaggtccggagcgcaacagctggttcagagggtgggtttctggcgcctgaatatcgggaagaaggcgcagctgtggctagccgtgtacgacggagaggtcagcaggacgtgttgaggggcccaaacgtgtgtggaagcagattccatagctactgctgccccggatggaagaccctcccaggcggaaaccaatgcattgtgcctatttgcaggaatagttgtggagatggattttgttcccggcctaatatgtgcacatgctcatctggccagatcagttccacttgcggtagtaagtccatccagcaatgcagtgtccggtgcatgaacgggggaacatgcgccgacgaccactgtcagtgccagaaaggctacatcggaacttactgtggccagcccgtatgtgagaatggctgccagaacggcggacggtgtatcgggcctaaccggtgcgcctgtgtctatggttttaccggccctcagtgtgagagagactaccgcacgggtccctgcttcacgcaggtgaataatcagatgtgccaggggcagttgacgggcatcgtttgtaccaaaaccttatgttgtgccacgattggcagagcctggggacacccttgcgaaatgtgccccgctcagccccagccatgccggaggggattcatcccaaacatccgcactggcgcatgtcaggatgtggacgaatgtcaggctatcccgggtatttgtcagggaggcaattgtatcaatactgtggggtcttttgaatgtcgatgccctgcagggcataagcaaagcgaaaccacccaaaaatgcgaggacatcgatgagtgctcaataatcccaggcatctgtgaaaccggggaatgcagcaataccgtagggtcttatttttgcgtctgccccaggggatatgttaccagcactgatggcagcaggtgtattgatcagcgtactggaatgtgcttttctggactggttaacgggcgatgtgcgcaagaactccctggaagaatgacaaaaatgcagtgttgttgcgaaccagggaggtgttgggggatcggtacgattcctgaagcctgtccagtgaggggcagcgaggaatacagaagattgtgtatggatggcctccctatgggcggtattcccggttccgcaggttcaaggccgggtgggacagggggtaacggatttgccccatccggcaacggcaacggttatggacccggaggcacgggctttatcccgatcccgggtggcaacgggttcagccccggagtcggcggtgctggcgtcggtgccggagggcagggtccgatcattaccgggctgactattctgaaccagaccatagacatctgtaaacaccacgctaatttatgtctgaatggacgctgcataccgactgtgtcatcataccggtgtgaatgtaacatggggtataagcaagacgcaaacggtgactgcattgatgtagacgagtgtactagtaacccctgtacaaacggtgattgcgtgaacacacccggatcctactactgtaagtgtcacgcgggatttcagaggacacctacgaagcaggcatgcatcgacattgatgagtgcattcaaaatggcgtgctctgcaaaaatggcaggtgcgtgaacaccgatggatcatttcagtgtatatgtaacgctggtttcgagttaacaaccgatggaaagaactgtgtggaccacgacgagtgcacaactacaaacatgtgtctaaatggcatgtgcattaatgaggacggtagctttaaatgcatctgtaagccaggatttgtgctggccccaaatggccgatattgcaccgacgtggacgagtgccagactccagggatttgcatgaacggtcactgcataaacagcgagggctcctttagatgtgactgcccgccaggcttggcagtcggaatggatggacgtgtctgcgtggacactcacatgcgctccacttgctatggcggaattaagaaaggcgtttgtgtaagaccttttcctggagccgttactaaaagcgagtgctgctgcgcgaatcctgactacgggttcggggaaccgtgccagccgtgccctgcgaagaacagtgccgaatttcacggcttatgtagctccggcgtggggatcactgtcgacggaagggacataaatgaatgtgccctcgacccagatatatgcgccaatggaatctgcgaaaacctgcggggatcttatcgttgcaattgtaacagcggatatgaacccgacgcctccggaagaaattgcatcgacatcgatgaatgtcttgtcaaccgcctattatgtgacaatggactgtgccggaacacacctggctcttactcctgtacttgccctcctggttacgtgtttcgcactgagaccgaaacatgtgaggacattaatgagtgcgagtctaatccctgcgttaatggagcctgcagaaacaaccttggaagtttcaattgtgaatgttctccagggagcaaactctctagcacaggcctcatctgcatcgatagcctgaaaggtacatgttggctgaatatccaagactcgcggtgtgaggtgaacatcaacggggctacactgaagagcgagtgctgtgctactttaggcgctgcctggggatctccctgtgaacgatgtgaactggataccgcatgtccacgaggccttgcacgtatcaaaggcgtcacatgcgaggacgtgaacgaatgtgaggtcttcccgggagtgtgtcccaacggaagatgtgtgaactcaaaaggatcattccattgtgagtgcccagagggcctgaccctcgacggaactggcagggtctgcctggatatccggatggaacagtgctaccttaaatgggacgaggatgagtgcatccatcccgtccctggcaaattcagaatggatgcctgttgctgcgccgtcggcgcagcatgggggacagaatgcgaggaatgtccgaagcctgggacgaaggagtatgagaccttgtgcccccgtggcgctggatttgctaaccgcggagatgtgctcactggacgcccattttacaaggatatcaacgagtgcaaagcttttccagggatgtgtacgtatgggaagtgtcgaaatacaattggcagctttaaatgccggtgtaactcgggattcgcgctagacatggaagagagaaactgtacagacattgatgagtgccgcatttctccggatctgtgcgggtcagggatttgcgttaacacacctggctcttttgaatgcgaatgctttgagggctacgagtctggctttatgatgatgaagaactgcatggacatcgatgagtgtgagagaaacccacttttatgtcgcggaggtacttgcgtgaacactgaagggtccttccagtgcgactgcccattaggccatgagctatcccctagcagggaagactgcgtggacataaacgagtgttcgctctctgataacttgtgcagaaatgggaaatgcgtgaacatgatcggtacctaccagtgctcatgtaaccccggataccaggccactcccgaccgacaagggtgcaccgatattgatgagtgcatgattatgaatggcggttgtgacacacagtgcactaatagcgaaggctcttacgagtgcagctgttctgagggctacgctttgatgccggatggcaggagctgcgctgacatcgacgagtgcgagaacaacccggacatttgtgacggcggtcagtgtaccaatatccctggggagtacagatgtctgtgttacgatggcttcatggcctcgatggatatgaagacttgcatcgatgtgaacgagtgcgatctcaactctaacatttgtatgtttggggaatgcgagaacaccaagggctcattcatctgtcactgccaactcggctattccgtgaagaagggaacgactgggtgcaccgatgtggatgaatgtgagattggcgcacataattgtgacatgcacgcatcttgcctcaacattccaggcagctttaagtgcagttgtagagagggatggataggcaatgggatcaagtgtatcgaccttgacgagtgtagcaacggcacccaccagtgttctatcaatgcacaatgtgttaacacgcctgggagctacaggtgcgcgtgctctgaaggctttacaggcgatggcttcacctgtagtgatgttgacgaatgcgccgagaacattaatctgtgtgagaatgggcagtgcctgaatgtacccggtgcgtatcggtgtgaatgcgaaatgggttttacaccagcctctgactcacggtcatgtcaagatattgatgagtgcagctttcagaacatttgcgtgttcggcacctgtaacaatcttcccggaatgttccactgcatatgcgacgacggatacgaattggaccgcacaggagggaactgcaccgacatcgacgaatgcgccgatccaattaactgtgtgaatggcctgtgcgtgaatactccagggcgatacgagtgcaattgtcctcccgacttccaactgaatcccactggcgtgggttgtgtcgataatagagtggggaattgttatctgaaatttggtccgcgtggagacgggtcactgagttgcaacactgagattggagtgggtgtgtctagatcttcttgttgttgtagcctcgggaaagcatgggggaacccttgtgaaacgtgtccccctgttaacagtacggagtactacaccttgtgtcctggtggcgaaggattccgccctaacccgattaccatcatcttggaggatattgatgaatgccaggaactgcctgggctctgccaaggcggaaattgtatcaacaccttcggctcattccaatgtgagtgcccacagggctattatctgagtgaagatacaagaatttgcgaagatattgacgagtgtttcgcccatcctggtgtctgtggaccgggaacatgctacaatacccttggcaattacacatgcatttgccctcccgaatacatgcaagtgaatgggggtcacaactgtatggacatgcggaagtcattttgctatcgttcctacaatgggactacctgtgaaaacgaactgccctttaacgtgaccaagcgaatgtgctgctgtacttacaatgtcggaaaggcatggaacaagccctgcgaaccatgtcctacccccggaaccgcggatttcaaaaccatttgcggaaatattccagggtttacattcgacattcacacggggaaggctgtcgacattgatgaatgtaaggaaatcccaggaatttgtgctaatggcgtgtgtattaaccagattggtagtttccgttgtgagtgtccaacaggcttctcatacaacgatctgttgctcgtatgcgaggatatagacgagtgctcaaatggcgacaatctttgtcagagaaacgccgattgcattaattctcctgggtcctatcggtgcgagtgtgctgctggttttaagcttagccccaatggtgcctgcgttgatcgaaacgagtgcctggaaataccgaacgtttgttcccatggattatgtgttgatctccagggctcataccagtgcatttgccataacggcttcaaagctagtcaggaccagaccatgtgtatggacgtggacgaatgtgagcgccatccctgtgggaacgggacctgtaaaaacacggtgggcagttacaattgcctgtgttacccaggtttcgaactgacacacaacaatgactgtctagatatcgacgagtgttcatctttctttgggcaggtttgtagaaatgggaggtgtttcaacgagatcggctcctttaagtgtctgtgtaatgaggggtacgaacttactcctgacggcaaaaattgcatcgataccaacgagtgcgtagcactgccaggctcctgtagtcccggtacttgtcaaaacctggaaggcagcttccgttgcatttgtccccctggctatgaagtgaagagtgaaaattgtatcgatataaacgagtgtgacgaagatccaaacatctgtctcttcggttcctgtactaacacccctgggggatttcagtgcctctgccccccaggctttgtgctaagtgacaatggcagaagatgtttcgatacaagacaatcattttgctttacaaacttcgaaaatggtaagtgctcagtgcctaaggcatttaacactaccaaggctaagtgctgttgtagcaagatgcccggagaaggatggggggatccatgcgaactgtgtccgaaagacgatgaagtcgcctttcaggacttgtgcccatatggacacggaaccgttccatccctgcacgatactcgggaggacgttaacgagtgcctagaatctcctgggatatgtagcaacgggcagtgcattaacaccgatggctccttccgctgcgagtgccctatgggttacaacctggactacaccggagtgcgctgcgtggacaccgacgagtgctccatcgggaacccctgtggcaatggtacttgtaccaatgtgataggctcttttgagtgcaactgcaatgaggggtttgagccaggtccaatgatgaactgtgaagacattaatgagtgtgctcagaaccctctactctgtgcctttcgatgtatgaacaccttcggctcctatgagtgcacttgtccaattggctatgcattgagagaagatcagaagatgtgtaaagaccttgacgaatgcgctgaaggcttacatgactgcgaatcccgcggaatgatgtgtaagaatctgataggtaccttcatgtgcatctgccccccaggaatggcccgaaggccggatggcgaaggttgtgtggacgagaacgaatgccggaccaaacccggtatctgtgaaaatggtcggtgtgtgaatatcatcggctcctacagatgcgaatgtaacgaagggtttcaaagtagctccagtggaacagaatgcctcgacaaccgtcagggcctgtgctttgccgaagtccttcagaccatctgccagatggcatcctcaagcaggaatctggtgacgaagtctgaatgttgctgtgatggtgggaggggatggggacatcaatgcgagctgtgtcctctgccaggcacagctcagtacaaaaagatttgccctcatggacccggatatactaccgatggaagagatattgatgagtgcaaagtgatgccaaatctgtgtaccaacggccaatgtatcaacaccatggggagcttcaggtgcttttgtaaggtcgggtacaccaccgacatttccggcacgtcatgcattgacctggacgaatgttcacagtcccccaagccatgtaattatatttgcaaaaataccgagggctcttaccagtgtagctgtcctcgtggctatgtcctgcaagaagatggcaagacctgcaaagacctggacgagtgtcaaaccaagcaacataattgccaattcctatgcgtcaacaccctgggaggctttacatgcaagtgcccccctggctttacccagcaccataccgcgtgtatcgataacaatgagtgtgggagccaaccgagcctttgcggcgcaaagggcatatgtcagaatacccccggatcattctcctgtgagtgtcaacgcggattcagtctggatgccacaggcctgaactgtgaagacgtggatgaatgtgatgggaatcacaggtgccagcatggttgccagaacatcttaggcggatatcggtgcggttgtccccagggatatattcagcactatcaatggaatcagtgcgtggacgagaatgaatgttcaaatccgaacgcttgcggaagcgctagctgttacaataccttaggctcatacaagtgcgcctgtccatcggggttctctttcgatcaattttccagtgcctgccatgacgtgaacgaatgcagttcttcgaaaaatccatgtaattacggctgctcgaacactgaaggtggctacctgtgtggttgtcctccaggctattatagggtgggtcagggccactgcgtctcaggaatgggcttcaacaagggacagtacctttccctggatactgaagttgacgaagaaaacgccctgtccccagaagcatgctacgaatgtaaaatcaatggctattctaaaaaggatagcagacaaaaaaggtcaatccacgaaccggacccaactgctgtggagcagatttctcttgagagtgtggacatggatagcccagtgaacatgaagtttaacctaagccacttgggcagcaaggaacacatactagaactgcgccctgcaattcagccactcaacaaccacatcaggtacgtcatcagccaggggaatgatgattcagtgtttcgcattcaccagcgcaatggcctcagctacctgcatacggctaagaaaaaattgatgccgggaacctacacccttgagatcacttccatcccactgtataagaaaaaggaacttaagaagttggaagagtcaaacgaagacgactacctgctgggagagctgggagaggccctaaggatgaggctgcagatacagctatatta

SEQ ID NO: 223197 - DNA, 597 bp, Artificial Sequence
  Description of Artificial Sequence: Synthetic coding sequence
atgggactgcggaaaggacacgggaccctcggacagggtctgagtgcgctgcaatccgaacaaggcaggcttatccaactcttgtccgagtctcaaggtcatatggcccatttggtcaactccgttagtgatatccttgacgctctacagcgcgacagaggattgggacggcctcgcaataaagctgaccttcagagagccccagcccgtgggacccgacccaggggctgtgccactgggtcacgtccacgcgactgtctcgacgtcctcctatctgggcagcaagacgatggcgtatactctgttttccctactcactaccctgccggatttcaggtgtattgtgatatgcgcacagacggcggtggctggaccgtctttcagaggcgcgaagatggtagtgtgaattttttcagaggatgggacgcttatagggacggcttcggcaggcttaccggggagcattggctcggcccattagactggtgcactctgtctctcgcgttactggtgcctgtggctccaagccccactcctccgcacagtttcgttaacgtcctgcatccgccagtgcctggaggacctaccctgcagtag

SEQ ID NO: 223198 - DNA, 912 bp, Artificial Sequence
  Description of Artificial Sequence: Synthetic coding sequence
atgggtttgcgcaaggggcacggcacgctggggcagggactgtctgcgctgcaatctgagcaaggacggctcatccagctgctgtcagaatcccaaggccacatggctcaccttgtgaactccgtgtcagatatcctagatgctctgcagcgcgacaggggcctgggaaggcccaggaataaggctgatcttcaacgggcaccagcgaggggtacacgtcctagaggatgtgctactgggtcccggccaagggactgtctggacgttctactgtctggccagcaggacgacggtgtctatagtgtgttccctacgcattaccctgcgggattccaggtctattgtgacatgagaacagacggaggtggatggaccgtgtttcagaggagagaggacggaagtgtgaacttcttcagaggctgggatgcttacagagacggctttggcagactcacaggcgagcattggcttgggctgaagcgaatccatgcattgacaacacaggcagcgtacgaactgcacgttgatctcgaagacttcgagaatggaacagcctatgcccgttacggtagcttcggggtgggcttatttagcgtcgaccccgaggaagatgggtatcccctcactgtggccgattattctggcaccgccggagactcacttcttaagcactctggtatgagattcaccacgaaggacagggatagcgaccactccgagaataactgcgccgcattttataggggagcttggtggtacaggaattgccatactagcaaccttaacgggcaatacttgcgtggggctcatgctagctacgccgacggtgttgagtggagctcctggactggatggcagtacagcctgaaattcagcgaaatgaagatccgaccagtgcgggaagatagatag

SEQ ID NO: 223199 - DNA, 1386 bp, Artificial Sequence
  Description of Artificial Sequence: Synthetic coding sequence
atggtgaacgatcgttggaagaccatgggcggtgctgcccaacttgaagatcggccacgggataaaccacaaaggccatcttgcggctacgtcctatgcaccgttctgttggcactcgctgtgctactggctgttgccgtcactggggctgtcctcttcctcaaccacgcccatgctcctggcactgcccctcctccagttgtgtcaacgggcgcagccagcgccaactccgccctagtaaccgtggagagggcagattcttcacacctgagcatccttattgatcccagatgccccgatctgacagacagtttcgcaagattggaaagtgcacaagcgagcgtcctccaggcgcttactgaacatcaagcacagcccagactggtgggcgatcaggaacaggaattgctcgatacacttgccgatcagcttccaaggttgctggcaagggcgagcgaacttcagaccgagtgtatggggttgcgcaaaggccacggcacccttgggcagggcctctcggcactgcaatcagaacaggggagactcatccaactcctctcagagtcgcagggccacatggcccacctcgtgaattccgtctccgacatcctcgatgccttacagcgcgatagagggctgggcagacctaggaacaaggctgacctccagagagcaccggctcgcggaacaagacccaggggatgcgctacagggtctaggcccagagactgtttggatgtcctgctttcaggacaacaggatgacggcgtttatagcgtctttcccacgcattatccggcagggtttcaagtgtattgtgatatgagaacagacggcggaggctggacggtttttcaaagaagagaggatggatccgtcaacttctttcgcggatgggacgcgtatcgagacggctttggacgcctgactggtgaacactggctggggctcaagcggatccacgctctcacaacacaggcagcttatgagctccatgtggatctggaggactttgaaaatggaacggcctacgcacggtatgggtcttttggggtaggactttttagcgttgacccagaggaggatgggtacccattgaccgtcgccgactactctggcaccgccggagattctcttcttaagcacagcggcatgagattcaccactaaggaccgcgacagcgaccacagtgaaaataactgcgccgcattctaccggggagcatggtggtatcgaaattgtcatacctccaatttgaacggccagtaccttcgcggagcgcacgccagctacgccgatggagttgagtggtcatcttggaccggatggcagtactctctgaaattttcagagatgaaaatcaggccggtccgggaagacagatag

SEQ ID NO: 223200 - DNA, 933 bp, Artificial Sequence
  Description of Artificial Sequence: Synthetic coding sequence
tgaactggcgcagttctgtttctgaaccacgcccacgcccctggtactgcccctccacctgtcgtgtccacaggagccgcatcagctaactcagcattagtcactgtggaaagggccgattcttcacatttatctatcttgattgatcccagatgtcctgatttgacagacagcttcgccagactcgaatccgcccaggcttccgtcctgcaggccttaacggaacaccaggcacaaccgcgactcgtaggcgatcaagagcaggaattgttggataccctagctgatcagctacctagactgttggctcgagctagcgaactgcagaccgagtgtatgggtctgcgtaaaggacatgggactcttggccagggactctccgccttacagtctgagcagggaagactgatccaattgttaagcgagtcccaaggccacatggcacacttggtgaactccgtgtctgatattcttgacgccctgcagagagacaggggcctcggtcgccctcggaacaaagcagatctgcagagagctcccgcacgaggaactagacccaggggttgcgctacaggctccagaccgagagactgtctggacgttctcttaagtggacagcaagatgatggtgtatacagcgtcttcccaacccattatcccgcagggttccaggtgtattgtgacatgaggactgacgggggaggatggactgtgttccaaaggagagaggacggctccgtaaacttttttagagggtgggacgcttatcgcgacgggtttggaaggttgacaggagaacactggctaggtccattggattggtgtacactgagcctcgccctgctggtcccggtggccccttcccctacgccaccgcactcctttgttaatgtgctacatccacctgtccctggcggaccaaccttgcaatag

SEQ ID NO: 223201 - DNA, 1386 bp, Artificial Sequence
  Description of Artificial Sequence: Synthetic coding sequence
atggtcaatgaccggtggaagactatgggcggagcagcccagcttgaggatagacctagagataagccacagcgcccaagctgcggctatgtattatgtacagtgctgcttgccttagcagttctcctagccgtggccgtcacaggggctgtcctgtttctcaaccacgcccacgcacctggcacagcaccacccccagtggtgagcacgggtgccgcttcggccaacagtgcactggttacagtcgaacgcgctgactcgagccacctctccattcttatcgacccgaggtgtccagacctcaccgacagctttgccagactggagtctgctcaggcatcagtcctacaggcattaacggaacatcaagcccagccacggctcgtgggagaccaggaacaggaattgttggacactctagcagatcagctgccaagactgctggccagagccagtgaactccagacagaatgcatgggtctgagaaaaggccatggcacgcttggccagggactctctgccctccagagcgagcaaggcagacttatccagttgctgtctgagagtcagggtcatatggcccaccttgtcaacagcgtgagcgatatcctggacgcgttgcaacgggacagagggctgggacgtcctcggaacaaggcagacctgcagagagccccagcccgaggaaccaggccaaggggctgcgcaacaggcagccgccctcgcgactgtctcgatgtgctcctgtctggccagcaggatgacggcgtttactccgtttttcccacccactacccagccggatttcaagtctattgcgatatgcgaactgatggaggtgggtggacagtgtttcagagacgagaagacgggtcagttaatttctttagggggtgggatgcctaccgcgatgggtttggaaggctgaccggggagcactggctcggtcttaagcgcattcacgccctgactactcaggcagcttacgaactgcacgtggacttggaggacttcgagaatggaaccgcatacgcgagatacgggagttttggggtgggtcttttcagcgtggaccccgaagaggacggataccctctcaccgtggccgattacagtggcaccgccggagacagcctactgaagcattctggcatgcgctttaccacgaaggatcgcgacagcgatcacagtgagaataactgcgccgctttctatcgcggagcatggtggtatcgtaattgccacactagtaatctcaatggccagtatctgaggggagcccacgcgtcctatgctgatggagtggagtggagctcctggacggggtggcagtactctttgaagttctcagagatgaagatcagacccgttagagaggaccgttag

SEQ ID NO: 223202 - DNA, 870 bp, Artificial Sequence
  Description of Artificial Sequence: Synthetic coding sequence
atggtgaatgatcggtggaaaaccatgggaggagccgctcagctggaggatcggcctagagacaagccgcagcgaccctcttgcggctacgtgctgtgcaccgtactacttgctctcgccgtgctgcttgcagtggccgtgacaggagctgtactgtttctgaaccatgctcatgcccctggcacagctcctccaccggttgttagcactggcgcagcttccgcgaatagcgctctcgttacagtagagcgcgctgactcctcacacctgagcatcctgatagatccccgatgtcctgacttgaccgactcattcgcgaggctcgaatcagcccaagcttctgtcctccaggccctcaccgagcatcaagcacagccccgtcttgtaggagaccaggaacaggaactcctcgatactctggccgatcagcttccgagattgttagccagagcctccgaacttcagacagagtgtatgggcctgcggaaaggccatggcactttgggccaggggttaagcgccctgcaaagtgagcagggtaggctaatacaattactctccgagagccaggggcatatggcccatttggtgaacagtgtgtccgatattctcgacgcgttacagagggatagagggctgggcagacctcggaataaggccgacttgcagcgggctcccgctagggggacacgaccccgtggatgcgctactgggtctcgaccacgggattgcctagacgttctgttatccgggcaacaggacgatggcgtatattccgtatttccgacccattatcctgcgggattccaggtgtattgcgacatgcgcacagacggcggaggttggaccgtgttccagcgcagggaatag

SEQ ID NO: 223203 - DNA, 540 bp, Artificial Sequence
  Description of Artificial Sequence: Synthetic coding sequence
atggtgaacgaccggtggaaaactatggggggagccgctcagcttgaggatcggcctcgcgacaagccccaggctcgtaagctgcgattaagagagaggccaagttgtggttacgttctctgtacggtgctgctagccctggccgtgctgctggctgtggcagtgactggtgctgtcttattcctgaaccacgcacacgcgccagggaccgcccctccacctgtcgtgtctaccggcgcagcaagcgccaattcagctctcgtgacggttgagagagccgattccagtcatctcagcattctgatagacccgagatgtccagatctgacagactcgttcgctcgactggaatccgcccaagccagcgtcctccaagcactgaccgaacatcaggcgcaacctcggctcgtgggcgaccaggagcaggagctgctcgacacattggccgatcagcttccacgcctgctggctagagccagtgaattgcagaccgaatgcatgggtctccggaagggtcatggcactcttggtcagggatag

SEQ ID NO: 223204 - DNA, 1170 bp, Artificial Sequence
  Description of Artificial Sequence: Synthetic coding sequence
atgaggagagtgactctctttctgaacggctctccaaagaacgggaaagtggtagccgtgtatggcactcttagcgacttgctgtccgtagcgtcttccaagttggggatcaaggcaactagcgtttataacgggaaggggggtttgatcgatgacatcgcactaatcagagacgacgacgtcttgtttgtctgcgagggtgaaccattcattgacccacagactgattccaaacccccagagggcctgctcgggttccacacggactggctgaccctcaatgtaggtggcaggtatttcacaactactcggtcaactctggtaaacaaggaaccagattccatgttagctcatatgttcaaggacaagggcgtgtggggaaacaaacaggatcacagaggtgcttttctcatcgaccgctcacctgagtacttcgaacccatcctcaactaccttaggcacggccaactgatcgtcaatgatggtattaacctcttgggagtcctggaagaggccagattcttcggcatcgactctctgatagaacacttggaggtcgcgattaaaaactcccaaccacctgaggatcatagtcctatatccaggaaagaatttgtcagattcctgcttgccacaccgactaaaagtgaactgaggtgtcaagggctgaacttctcaggggcagacctgagtcggctagatttacgctatattaatttcaaaatggcaaatctgagccgttgtaaccttgcgcatgccaatctctgttgtgccaatttggaaagggccgacctttctggttccgtgctggattgtgctaatttgcagggggttaaaatgctttgttcgaatgctgagggagctagtcttaaattgtgcaattttgaagacccttccgggctgaaagccaacctggagggtgctaacttaaagggcgtagacatggaggggtctcagatgacaggcataaatctccgcgtggctaccctgaagaacgcaaagctgaagaattgtaatctgcgtggagccacactggctggaacagacctagaaaactgtgacctcagcggatgcgacctgcaagaggcaaacttgcgaggatcaaacgtgaagggggcaatctttgaggagatgctcaccccactgcacatgtcacagtctgtgaggtag

SEQ ID NO: 223205 - DNA, 939 bp, Artificial Sequence
  Description of Artificial Sequence: Synthetic coding sequence
atggcgaaggtttttagtttcatcctcgtcacaacggcattgaccatgggaagggagatctctgcgcttgaagattgcgcccaggaacagatgagactgcgagcacaggttcggctcctcgagaccagggtgaaacagcagcaagtcaagatcaaacaactgctccaggagaacgaggtccaattcctcgacaagggggacgagaataccgtcatcgatctggggtccaagaggcagtatgctgattgctccgagattttcaacgacggctacaagctcagtggattctataaaattaaaccacttcagagtccagctgagtttagtgtctactgcgatatgagcgatggcggaggctggactgtaattcaacgaagatcagacggctccgagaacttcaatcgcggatggaaagattacgaaaatggctttggcaatttcgtgcagaaacatggtgagtactggctgggcaataaaaatttgcattttctgacaacgcaggaggattacactctcaaaatcgatttggcagatttcgaaaaaaattcaaggtacgctcaatacaaaaacttcaaggtcggcgacgagaagaatttctacgaactgaacattggcgaatactccggcacagcaggggacagtctggccggtaacttccacccagaggtgcaatggtgggccagccaccagagaatgaagtttagcacctgggaccgagatcacgataactacgagggcaactgtgctgaagaggaccagtcaggttggtggttcaacaggtgtcattctgccaatttgaacggcgtctactatagcgggccatacaccgcaaagacagataatggcattgtgtggtatacttggcacggctggtggtactctctcaaatccgtcgtgatgaagattcggccaaacgatttcattcccaacgtcatctag

SEQ ID NO: 223206 - DNA, 939 bp, Artificial Sequence
  Description of Artificial Sequence: Synthetic coding sequence
atggccaaggtctttagctttattctggtgacaacagccctgactatgggcagagagatatcagcattagaagattgtgcccaggagcagatgcggttgcgcgctcaagtgcggctcttggagacacgcgtgaagcagcagcaggtgaaaataaaacagctgttacaggaaaatgaagtccagtttctggataaaggcgatgagaatactgtgattgatctggggtcgaaaaggcagtatgcagattgctcagagattttcaacgatgggtacaaattgagcggcttctataaaatcaaacccctccagtctccagcagagttctccgtatactgcgacatgtctgacggcggaggatggactgtcattcagaggcggtcggacggcagcgaaaatttcaacagagggtggaaggactacgagaatggcttcgggaatttcgtgcagaagcacggtgagtattggcttgggaacaagaacctgcacttcttgacgactcaagaagactacactttgaaaattgacttagccgatttcgaaaaaaattctcggtatgcacagtataagaatttcaaggtcggggacgaaaagaatttttatgagctaaacatcggggagtacagtggcacagctggtgactctctcgcgggaaactttcaccctgaggtccagtggtgggcttcccatcagagaatgaaattcagtacatgggacagagaccacgacaactacgaaggcaattgcgcggaagaggaccaatccggatggtggtttaatcgatgccatagcgccaatttaaatggagtgtactactcaggaccctataccgccaagaccgacaacggcattgtgtggtatacatggcatgggtggtggtactcactcaaaagcgtggtcatgaaaattcgccctaacgactttattccgaatgtaatttag

SEQ ID NO: 223207 - DNA, 939 bp, Artificial Sequence
  Description of Artificial Sequence: Synthetic coding sequence
atggccaaggtattcagtttcatactggtaactaccgcattaaccatgggcagagagatcagcgcactcgaagactgcgctcaggagcagatgagacttcgcgctcaagtacgtctcctggaaacccgcgtgaaacaacagcaggtaaaaatcaaacagttgctccaggagaatgaagtgcagtttctggacaagggcgatgagaataccgtgatagaccttggatcaaaacgccagtatgccgactgctccgaaatcttcaatgatggatacaagcttagcggcttctacaaaataaagccactgcagtccccggcagaattcagcgtttattgcgacatgagcgacggagggggttggaccgtcatacaacgcaggtcggatggaagcgagaattttaaccggggatggaaagactatgaaaatgggtttggcaactttgttcaaaaacatggggagtactggctgggaaataaaaatctccatttcctgacaacgcaggaagactacacattaaagatagatctggccgactttgaaaagaactctaggtacgcccagtataagaatttcaaggtgggtgacgaaaaaaacttttatgaactaaacatcggtgaatatagtggaactgctggcgattctttagcaggcaactttcaccccgaggtgcagtggtgggcttcccatcaaaggatgaagttctcaacctgggaccgcgaccatgataattacgagggcaactgtgccgaggaggatcagagcgggtggtggtttaaccgttgccattccgccaatttgaacggggtatactactccgggccatacactgccaagaccgataatggaattgtctggtacacttggcacggatggtggtacagtctcaaatctgttgtgatgaagataagacctaacgacttcatccctaatgtcatttag

SEQ ID NO: 223208 - DNA, 939 bp, Artificial Sequence
  Description of Artificial Sequence: Synthetic coding sequence
atggccaaggtcttctcatttattctggtgaccactgccctcactatgggaagagagatcagtgccctagaagattgtgcacaggagcaaatgaggttaagagctcaggtccggttgttggagactagggtgaagcagcagcaggtgaagattaagcagcttctgcaggagaacgaagtgcaatttctggacaagggcgacgagaacacggttattgacctaggatccaaaagacagtatgcggattgctccgagatctttaacgacggttataaactaagtggtttctataagattaagcctttacaaagtcctgcggaattctctgtatactgtgatatgagtgatggaggaggatggacagtaatacagcgacgttctgatgggtctgaaaatttcaatagaggatggaaagattacgaaaatgggtttggaaactttgtgcaaaagcatggcgagtactggctgggcaataagaacttgcactttttgacaacccaggaagactatactctgaaaatcgacctggccgacttcgagaagaactcccggtacgcccaatataagaattttaaggtcggagacgagaagaacttttacgaacttaacatcggcgagtacagcggaaccgctggcgactccctggcaggcaactttcaccccgaggtgcagtggtgggcctctcatcaacggatgaaatttagtacatgggatagagaccacgacaattatgaagggaactgcgctgaggaggaccaaagtggctggtggttcaatcggtgccatagcgcaaatcttaacggggtgtattactcaggcccatatactgctaaaacagacaacggaattgtctggtatacctggcacgggtggtggtactctctcaagtccgtggttatgaagatccggccaaacgacttcattcccaatgtcatatag

SEQ ID NO: 223209 - DNA, 939 bp, Artificial Sequence
  Description of Artificial Sequence: Synthetic coding sequence
atggcaaaggtcttctcttttatcctggtgacaaccgctcttactatgggtcgcgagatttccgctctggaggattgtgcccaggaacagatgcggctccgcgcacaggtgagattgctcgagacgagagttaaacagcagcaggttaaaataaaacagctgctgcaagaaaacgaagtacaattcttagacaaaggcgatgagaacaccgtgatcgatctgggctctaagcgccagtacgctgactgttcagaaatcttcaacgacggatataagctctccggcttctataagatcaaacccctgcaatctcccgctgagttctccgtgtactgtgatatgtccgatggagggggttggacagtcattcagcgcagaagcgacgggagcgaaaacttcaaccgtgggtggaaagactatgaaaatggttttggcaatttcgtgcaaaagcacggcgagtactggctcggaaacaagaatctacattttctgacaacgcaggaggactatactcttaagatcgacctggccgacttcgagaagaattccaggtacgcacagtacaaaaattttaaggtgggagatgagaagaatttttatgaactcaatattggcgaatacagtggcacggctggagactctctggctggtaattttcacccagaggtgcagtggtgggcgtcacatcaacgcatgaagtttagtacatgggaccgggaccacgataattacgaaggaaattgtgcagaagaagatcaaagtggctggtggtttaataggtgccactccgcaaacttaaatggcgtgtactacagcgggccttacaccgctaaaaccgataacgggattgtgtggtacacctggcatggctggtggtactctctcaagagtgtcgtcatgaaaatccggcctaacgacttcatacccaacgtcatctag

SEQ ID NO: 223210 - DNA, 939 bp, Artificial Sequence
  Description of Artificial Sequence: Synthetic coding sequence
atggccaaagtgttcagttttatattagtgacgactgccctcacgatgggtcgcgagatctccgctcttgaagactgcgctcaggaacagatgcggctgagggcccaggtcaggctgttggaaactagagtgaaacaacagcaggttaagatcaagcagctcctccaagagaatgaggtccaatttttggataagggggacgagaatactgtgatcgatctagggtctaagaggcaatacgctgactgttctgaaatctttaatgacggctacaagctgtcgggcttctacaaaattaagccactgcagtctcctgcagagttcagtgtatactgcgacatgtctgatggagggggttggacagtcattcagcggcgaagtgacggctcagaaaactttaacagggggtggaaagattacgagaacggatttggtaacttcgtgcagaaacatggggagtactggttgggcaataagaacctgcactttctgacaacccaggaggactacactctaaagatcgatctggcggatttcgaaaagaactcaaggtatgcgcagtataagaactttaaagtgggcgacgagaaaaatttttacgaactgaacattggcgagtattccggaaccgcgggtgattctctcgcaggaaacttccatccagaggtccagtggtgggcaagtcatcagcgcatgaagttctccacatgggacagggaccatgataactatgaaggaaactgtgcggaggaggaccagagtggttggtggtttaatagatgccactcggctaacctgaacggagtatattacagcggtccctataccgccaaaaccgataacggcattgtgtggtacacgtggcacgggtggtggtactccctgaagagcgtggtgatgaaaataagaccaaacgatttcattcctaatgttatttag

SEQ ID NO: 223211 - DNA, 849 bp, Artificial Sequence
  Description of Artificial Sequence: Synthetic coding sequence
atgaggttgcgcgctcaagtgcggctgttagaaaccagggtgaaacagcaacaagttaaaatcaagcagttactgcaagaaaatgaagtccagttcttggacaagggagatgaaaatacagtgattgacttaggatctaagcggcaatatgccgattgcagtgaaatcttcaatgacggctataaactgtccgggttctacaaaataaagccacttcagagtccagctgagttctcagtgtattgcgatatgtctgacgggggtgggtggactgtgatccaacgtcgaagcgacgggagtgagaattttaaccgcggttggaaagattacgaaaatggcttcggcaatttcgtgcaaaagcatggcgaatactggcttggcaataagaacctgcattttcttacaacgcaggaggattatacacttaagatagatcttgccgattttgaaaaaaatagtaggtatgcccaatacaaaaactttaaagtgggagatgagaaaaacttctacgagctgaatattggcgagtacagtgggacggccggtgacagtctggccggaaactttcaccccgaggtacagtggtgggctagtcaccagaggatgaaattctcaacttgggatagagaccatgataattacgagggcaattgtgccgaggaagatcaatccggctggtggtttaaccgatgtcactcagctaacttaaatggcgtttactattcaggcccatacaccgcgaaaacagacaatggaattgtgtggtatacatggcacggatggtggtacagcctaaaaagtgtggttatgaagatacgcccaaatgactttatcccaaacgtaatctag

SEQ ID NO: 223212 - DNA, 939 bp, Artificial Sequence
  Description of Artificial Sequence: Synthetic coding sequence
atggcgaaagtgttttcatttatactggtgaccaccgccctgacaatggggcgtgaaattagtgcccttgaggactgtgcgcaagaacagatgcgtcttcgcgcacaggttcgactgctcgaaacccgagtcaaacagcaacaggtcaaaataaagcagctgctccaggagaatgaagtgcagtttctggacaagggggacgagaataccgtaatcgacctgggctctaagcgccagtacgccgattgttctgaaattttcaatgacggctacaagctctccggcttctataaaatcaaacccctgcaaagccctgctgagttctccgtgtactgtgatatgtcagacggtggcggttggactgtcatacagcgacggtcagacggaagcgagaactttaatagaggttggaaagactacgaaaatggcttcggtaatttcgtacagaagcacggggaatactggctgggaaataaaaacctccattttctgacaacccaggaggattacacgctaaaaatcgacctggctgactttgagaagaattccaggtatgctcagtataaaaatttcaaggtaggtgatgagaagaatttttatgagcttaacattggggagtacagtgggactgccggagattcactcgcagggaattttcatccagaagtgcaatggtgggcttcccatcagagaatgaagttttcaacctgggatcgggatcatgataattacgaaggcaactgcgccgaggaggaccagagtggttggtggttcaatagatgtcactccgctaaccttaatggagtatactatagtggaccgtatacagcgaaaactgacaatgggatcgtgtggtatacgtggcatggatggtggtattccctgaagtccgttgtgatgaaaattcgcccaaacgactttattcccaacgtgatctag

SEQ ID NO: 223213 - DNA, 1320 bp, Artificial Sequence
  Description of Artificial Sequence: Synthetic coding sequence
atgaagctcgctaattggtactggctaagctcagctgtgttggcaacctacggcttcctggtggtggccaataatgagacagaggaaatcaaggatgagcgcgctaaggatgtctgtcccgtgcgcctggaatcgcgaggtaagtgcgaagaggcgggagagtgtccctatcaagtgagcctccccccactgactatacagcttccaaagcaattttcaagaatcgaggaggtgttcaaagaggtgcagaatctgaaggagatcgtcaattctctgaagaagtcttgtcaggactgtaagctccaagctgatgataacggtgatcctggacgcaatggtctccttctgccgtccaccggcgcaccgggtgaagtaggagacaatcgcgtgagagagctggagtctgaagtgaataaacttagctctgagctaaaaaatgccaaggaagagattaacgtgctccacggacgtctggaaaagctcaacctggtgaatatgaataacattgaaaactacgtcgatagcaaagtcgccaacctcaccttcgtggtgaacagtctggacggtaagtgtagcaagtgcccaagccaagagcaaatacagagcagacccgtccagcacctgatctacaaagactgtagtgactactatgccatcgggaagagaagttcagaaacttacagagtgacacccgatcccaagaatagctcgtttgaagtgtactgcgatatggagacaatgggcggtggttggaccgttttgcaggccaggctggatggttcgaccaatttcactcgcacctggcaggactataaggccggttttggaaatctgagaagggagttctggttgggtaatgataagattcacctgctgactaaatctaaggaaatgatactgcggattgatcttgaagattttaatggagtggaactgtacgctctctacgaccagttttatgttgcgaatgaattccttaaatatagattacacgtggggaattacaacgggaccgccggagatgccctaaggttcaacaagcactacaaccacgatctaaagttttttacaactcctgataaggacaacgataggtatccttcaggcaactgcggtttgtactacagctcgggttggtggtttgacgcctgtcttagtgcaaacctcaatggaaaatactaccaccaaaagtaccggggagtccggaacggcatcttctggggcacctggcccggagtatctgaagcacacccgggtggctacaaaagctcattcaaagaggccaaaatgatgatccgtccaaaacactttaaaccctag

SEQ ID NO: 223214 - DNA, 1095 bp, Artificial Sequence
  Description of Artificial Sequence: Synthetic coding sequence
atgacctctgaacttgacatttttgtgggcaacactaccctcatcgacgaggacgtctataggctatggctggatggctattctgtcacggacgcagtggcgcttcgcgtccggtctggtatcttggaacagaccggcgcaaccgctgcagtgctccagagcgacactatggatcactatcgcacgtttcatatgctcgagagactcctccacgccccaccgaagctgctgcaccaacttatctttcagatcccaccatcccgacaggccctgctgatagagcgctactacgcgttcgatgaggcgtttgtcagagaggttctcgggaaaaagctctctaagggaaccaaaaaagatcttgatgacattagtaccaagacagggattacattaaaatcatgccggagacagtttgataattttaagcgggtattcaaagtggttgaggagatgagaggaagtttagtcgataacatccaacagcacttcctgctttctgataggctcgccagggactatgccgcaattgtgttttttgccaacaatcgatttgaaacgggaaaaaagaaattgcagtacctaagcttcggcgattttgccttttgcgcagaactcatgattcagaactggactttaggagccgtgggggaagctcccacggaccctgattcacagatggacgacatggacatggacctggacaaggagttcctgcaagatctcaaggagctaaaagtgttggtggccgataaggatttgcttgatttgcataagagcttggtgtgtacagctctcagaggtaagttgggggtattcagtgaaatggaggccaatttcaaaaatctatccaggggactcgtgaacgtcgccgctaaacttacccacaacaaggatgtacgtgatctgttcgttgatctggtggagaaattcgttgaaccctgccggagcgaccactggcccctaagtgacgtcaggttttttctgaatcagtactcggcctcagtgcactctctggatggattcaggcaccaggccttgtgggacaggtacatgggcacccttagaggatgtctgctcaggctttaccacgactag

SEQ ID NO: 223215 - DNA, 1074 bp, Artificial Sequence
  Description of Artificial Sequence: Synthetic coding sequence
atgacctctgagctggacatcttcgtgggcaacaccacactgatagatgaagacgtctacagactgtggctggacggctattcggtaacagacgcagtggccctgcgggttcggtcaggcattctcgagcagactggcgcaactgcggctgtgcttcaaagcgatactatggaccattaccgcacattccacatgctggaaaggctgctccacgctccgccaaagcttctgcatcagctgatcttccagatccccccatctaggcaggctctcctcatcgaacggtattacgcattcgatgaggcgttcgtgcgcgaagtgctggggaagaaactttcgaagggtaccaaaaaggacctggatgatattagcactaagaccggaattacgctaaagagttgccgccgacaatttgacaatttcaaacgcgtgtttaaggtcgtagaggaaatgcgcggtagccttgtggacaacatccagcagcatttcctgctgagcgacaggctggccagagattatgcagcgatcgtgttttttgcaaacaaccggtttgagaccggcaaaaagaagttgcaatatttaagcttcggggatttcgcgttctgcgccgaactgatgattcagaactggacgctcggtgccgtcgattcacagatggatgacatggatatggacctggacaaagagttcctgcaggatctcaaagaactgaaggttctagttgcagataaagaccttctcgatctgcataaaagccttgtctgcacagcgcttcgcggaaaactcggcgtgttctctgaaatggaagccaacttcaaaaatctgagccgaggactcgttaatgtggctgcaaagttgacacacaacaaagacgtccgggatctgttcgtggacttagtagaaaaattcgttgaaccttgtcggtccgaccactggccactcagtgacgtaagattcttcttgaatcagtacagcgcctctgttcactccctcgatggttttcgccatcaggcactgtgggaccggtacatgggcactctccgcggatgtctgctgaggctgtatcatgactag

SEQ ID NO: 223216 - DNA, 1989 bp, Artificial Sequence
  Description of Artificial Sequence: Synthetic coding sequence
atgtggagctggaaatgcctgctattctgggctgtccttgttaccgccacactgtgcaccgctcgcccaagtcccacactgccggaacaggcccagccttggggagccccagtggaggtggaatcatttctggtccatccgggagaccttctgcagctccgctgtcgtctccgggacgatgtgcagtccataaactggctaagggacggagtgcagttagctgagtctaatcggacgcgaattactggggaagaagtggaagttcaagactccgtgccggctgactccggtctgtacgcatgtgttactagtagcccctcagggtccgatactacttacttttcagtcaacgtgtccgacgccctgccatcttctgaggacgatgatgacgatgacgacagtagcagcgaggagaaggagaccgataacacgaagcccaatcggatgcctgtggccccatactggacatcacccgagaagatggagaagaagctgcacgccgtacccgctgccaagactgtcaagtttaaatgcccatcttccggaactcctaaccccacactgagatggctgaaaaatggtaaagagttcaagcctgatcatcggatcggcggttataaggtgagatatgccacttggagcataattatggacagtgttgtcccctcagacaaaggcaactacacatgcatagtggaaaatgaatatggaagtatcaaccacacgtaccagctggacgttgtggagcgttctccacacagaccaattctgcaggctggcttgcctgcgaataaaactgtggcacttgggtctaacgttgagttcatgtgtaaagtctatagcgatcctcagccccacatccagtggcttaagcacatcgaggttaacggttcaaagatcggccctgataacttaccgtacgttcagattttgaaaaccgctggtgttaatactaccgataaagagatggaagtgcttcatttgagaaacgtaagcttcgaggatgccggtgagtatacctgtctagccggaaacagcattgggcttagccatcacagcgcatggttgactgttttagaagccttggaggaacgcccagccgtcatgacatcacctttgtatttagagataataatttactgcacaggcgcttttctgatatcctgcatggtaggatctgtgatcgtgtataaaatgaagtcaggcacgaaaaaaagcgacttccactcccagatggccgtccataaacttgccaaatccattccgttgcgccgacaggttaccgtgtctgctgactcgtccgcttctatgaacagcggagtcctgctcgtacggccttccaggctctcttccagtgggactccaatgctcgccggagtaagcgagtacgagctgcctgaggatcctaggtgggaactccctagagatcgcctggtactgggcaagcccctgggagaaggctgtttcggacaggtggttctggctgaagctataggcctcgacaaggacaagccaaaccgggtcaccaaagtcgcggtcaagatgctgaagtctgatgccacagagaaggatttaagcgacctaatcagcgaaatggagatgatgaagatgatagggaagcacaagaacatcataaacctactcggagcctgcacacaggacggccctctgtatgttatcgtggaatatgcaagtaagggcaacctccgtgaatatctgcaggcccgacgccctccaggactcgagtactgctacaatccatctcacaatcctgaggagcaactttctagtaaagatttagtgtcttgcgcttatcaggttgcacgaggaatggaatatctggccagtaagaaagtgtggaatcttaaggcacctttagtacacaccccaagacccggatctcaggaatgtccgggtgatcgaggtcagtgcgatgaggactcccggctgtggcctcgaacagggcatagcccacatagactgctgtag

SEQ ID NO: 223217 - DNA, 1104 bp, Artificial Sequence
  Description of Artificial Sequence: Synthetic coding sequence
atgtggagctggaagtgcctcctgttttgggcagtactcgtgacagccacattatgtacagctaggccatcaccaaccttaccggaacaggcacagccctggggtgccccagtcgaggtggagtcttttctggtgcatcctggtgacctgctgcagctgcgctgcaggctgagagatgatgtgcagagtattaattggctgcgggatggtgtgcagctcgccgagagtaacaggacccggatcacaggggaagaggtggaagtgcaagactccgtgcccgctgactcaggcctgtatgcctgtgttacaagctccccctctggaagcgacacaacctactttagcgtgaacgtgtcagtcccaatcgatgcgttacctagcagcgaggacgacgacgatgacgacgactcgagttcggaggaaaaggagaccgacaatacaaagccgaaccccgttgccccatattggaccagccctgagaaaatggagaagaaactgcacgcagtgcctgcagcaaagactgtaaaatttaagtgtcctagctccgggaccccgaaccctactctcagatggttgaaaaacggaaaagagttcaaacctgaccaccgcattggtggatacaaggtgcggtatgctacctggtccataatcatggacagcgttgtgccatccgataagggaaactacacatgtatcgtggaaaatgagtatggcagtatcaatcacacttaccagctggacgtagtcgagagatctccgcatcgaccaattcttcaggccggtctgcccgctaataagactgtggctttaggcagcaacgttgagttcatgtgcaaggtctattccgacccgcagcctcacatacagtggctgaaacatatagaagtaaatgggagtaagattggtcctgacaaccttccttatgttcagattctgaagcactcaggaattaattcttcggacgcagaagtgctaaccctcttcaatgtgaccgaggcacagtcgggggaatacgtgtgtaaggtcagtaactacatcggggaagctaaccagtccgcgtggctcactgtgacgagacctgttgccaaggattgctggagctag

SEQ ID NO: 223218 - DNA, 2196 bp, Artificial Sequence
  Description of Artificial Sequence: Synthetic coding sequence
atgtggagctggaaatgcttgcttttctgggctgtgctggtcactgctacactctgtactgcacggccttctccaacactgcccgagcaagatgccctgcccagctctgaggacgacgacgatgatgatgattccagcagcgaagagaaggagactgacaacaccaaaccgaatccggtggccccttactggaccagtcccgagaaaatggagaaaaaactgcacgccgtgccggcagccaaaacggtgaagttcaagtgcccatctagcgggactccaaatcccactctcagatggttaaagaacggtaaggagttcaagcctgaccacaggattggaggctataaggtgcgatacgcgacctggtcaatcatcatggactctgtggtcccgtcagataaggggaactacacgtgcatagttgagaacgaatacggaagtataaaccacacttaccagcttgatgtcgttgagcggtccccgcacaggcccatcttacaggccggtctgcccgctaataagacggtggccctcgggtctaacgtggagtttatgtgcaaggtgtactcagatccgcagcctcatatccagtggctcaaacacattgaagtgaatgggagcaagatcgggcctgataacttgccgtacgtgcaaatccttaagacagcaggggttaacaccaccgataaagaaatggaagttctgcatcttcggaatgtatcgttcgaggatgcaggagaatatacttgtctggctggcaacagcatcggtttaagccaccacagcgcttggctgacagtactcgaagcccttgaggaaagacccgctgtaatgacctccccgctgtacctagaaattattatatactgtacgggcgcttttctgatcagttgcatggtggggtccgtgattgtatacaaaatgaagtccggaactaagaaatccgacttccactcacagatggctgtccacaagctcgccaagtcaataccactgagacggcaggtaaccgtctccgctgactcctccgcctcaatgaatagcggagtgctgctggtccggcctagcagactcagtagctctggcacaccaatgctggctggagtaagcgagtatgagttgcctgaggacccaaggtgggagctgcctcgggatcgccttgtcttaggtaagccactgggcgaagggtgttttggacaggttgttctcgctgaggccattgggctcgataaagataagcccaacagggtgacaaaggtggccgtaaagatgcttaagagcgacgcaacagagaaggacttaagcgaccttatcagcgagatggaaatgatgaagatgattggcaaacacaaaaatataatcaatttgttgggtgcctgtactcaggatggccctctgtatgtgattgttgagtatgccagtaagggaaacctgagggagtatttacaggcccgtcgcccacctggactcgagtattgttacaatccttcccataaccccgaggaacagcttagcagcaaggatctagttagctgcgcgtatcaggtggccagaggcatggagtacctcgcatcaaagaagtgcatacaccgtgacctggccgctagaaatgtgctggtcacagaggacaatgtaatgaagatcgcagatttcgggctggctcgtgatatacaccacatcgactattataagaagactacaaacgggaggctgccggttaagtggatggcacccgaggctctgtttgacaggatctacacccaccaaagcgacgtgtggtcgtttggggtgctattgtgggagatttttacactgggaggtagcccctatcccggagtaccagtcgaagaactgttcaagctactgaaggagggacacaggatggataaaccttctaactgtaccaacgaattgtacatgatgatgagagattgctggcacgccgttccctcccaaagacccactttcaaacagctggtggaggatttagaccgcatcgtggcgctgacatccaatcaggaatacttagacttaagcatgcctctcgaccaatacagtcccagcttcccagacacgcggtcctcaacttgctcttccggagaagactctgtgttcagccatgagccattgcccgaggaaccgtgccttccccgacacccggcacaacttgctaatggaggacttaagaggcgctag

SEQ ID NO: 223219 - DNA, 2439 bp, Artificial Sequence
  Description of Artificial Sequence: Synthetic coding sequence
atggcggctgtcacacgcgatttcggagagatgttgctgcatagcgggagagttttgccagccgaggctcagccatggggggctcccgtggaagtggagagcttcttagttcacccaggagacctgcttcagctgagatgtcgtctgcgtgatgacgtgcagagtataaactggctgagagatggcgtgcagcttgccgagtccaaccggacacgcatcaccggagaggaggtagaggtccaggacagtgtgccagctgattctggcttatacgcatgtgttacgtcttctcctagtggcagcgataccacatacttctcagtgaacgtcagtgacgccctgcccagtagcgaagacgatgacgacgatgatgactctagcagcgaagagaaggaaaccgacaacacaaaacccaatcgcatgcccgtcgccccatattggacctctcctgagaagatggaaaagaaactgcacgccgtgcctgccgctaaaaccgtaaaattcaagtgtccatcgtccgggaccccaaatcctacacttcggtggcttaaaaatggtaaggagtttaaacctgaccacagaattggaggctacaaagtccggtacgcaacgtggagtattataatggactcagttgtcccgtctgataaaggcaactacacctgcatcgtggagaacgagtatggcagtatcaaccacacctatcagctggatgtggtcgaacggtctccccatcggcctatactgcaggccggtctacccgctaataaaacagttgcactggggtcaaatgtcgagtttatgtgtaaggtttactccgatcctcagccacacattcagtggctgaagcatattgaggtaaacgggtctaagatcggccctgacaacctcccgtatgtgcagatactgaaaaccgccggagttaatacgaccgataaagaaatggaggtgctacacttgcgtaacgtcagcttcgaggacgctggcgaatacacctgcttggctggcaattcgatcggactttcacaccacagtgcctggttaacggtcttggaggctctcgaagagcgaccagctgtgatgaccagtcccctttacttggagataatcatttactgcacaggggctttcttgatttcgtgcatggtggggagcgttattgtgtacaaaatgaagtctggcacgaagaagagtgactttcactcgcagatggctgtgcataagctggctaagtccatcccactcaggcggcaggtctccgcggactcttcagcgtctatgaattctggcgtactccttgttcgaccctctcggctgtcctccagcgggacaccgatgctggctggtgtatcagaatatgagctccccgaggatcctaggtgggagctgcccagagatcggctggtgctgggcaagcccctaggagaggggtgttttggacaagttgtgctggctgaagccatcggactagataaggacaaacctaatagagtaacaaaggtcgccgtgaaaatgcttaagtccgacgcaaccgagaaggatctgtctgatctgatatccgagatggagatgatgaagatgattggaaagcataaaaacatcatcaacctactgggagcatgcactcaggacggccctctatatgtcatcgttgagtacgctagtaagggcaatttacgcgaatacctgcaggctagaagacccccaggactagaatattgttacaatccttcacacaatcccgaggagcaactgtcatctaaagatctggtgagttgcgcctatcaggttgctcggggaatggagtacctggccagcaaaaagtgcattcatcgggatctagccgctaggaatgtgttggtgactgaggataatgtgatgaagatcgctgatttcggactggccagggacatccaccatatcgattattataaaaagactacaaatggacgcctccccgttaagtggatggctcccgaggctctgttcgacagaatttacacacatcagtctgatgtttggtcatttggggtacttttatgggagattttcacacttggcggttccccctatcccggagtgccagtggaggaactgttcaagctgcttaaggagggccatagaatggataagccctccaactgcacaaatgagttatacatgatgatgcgcgattgttggcatgcagtgccctcgcagcgtccaaccttcaagcagctggtggaggacttggaccgaatagtggcccttaccagcaatcaggagtaccttgacctttctatgcctcttgatcaatattctccctctttcccagacacccggtcaagcacttgctcaagcggggaggacagtgtcttctcgcacgaaccccttcccgaggaaccgtgcctccccagacatcctgcccagctggcaaatggaggccttaagcgtagatag

SEQ ID NO: 223220 - DNA, 2469 bp, Artificial Sequence
  Description of Artificial Sequence: Synthetic coding sequence
atgtggtcatggaaatgcctcttattttgggctgtcctagtcactgcaactttgtgtacagccaggccttcacccactctgcccgagcaagcccagccctggggagctccagttgaggtggagagcttcctcgtgcaccccggagacttgctgcagctgagatgcaggcttagagacgatgtccagagcattaattggttgagggacggagtgcagctcgcagaatctaacagaactcggattaccggcgaagaagtggaggtacaggactccgtccccgcagattcgggcttatacgcatgtgtcacttcctccccatcaggatccgataccacatatttttccgtcaatgttagcgtcccaatcgacgcccttccctctagtgaagacgacgacgatgatgacgatagtagctcagaggagaaagaaaccgataacactaagccaaaccccgtggcaccctattggacaagccctgagaaaatggaaaagaagctgcatgcagtgccggcagctaagactgtgaagtttaagtgtcccagctcgggaacccccaaccccactctgagatggctgaaaaatggcaaagaatttaagccagatcaccgcatcggcggatataaagtccggtatgccacctggtcaattattatggactccgtcgtaccttctgataagggaaactacacatgcatcgtcgagaatgaatacggttctatcaaccatacctatcagcttgacgtcgtggagcggtccccccatagaccaatcctccaagctggtctccctgccaacaaaacagtggcccttggctctaacgtggagtttatgtgtaaagtgtattccgatccacagccacatatccaatggctgaaacacattgaggtcaacggctcaaagatcggcccagacaatctaccttatgtgcagatcctgaagcattctgggattaactcatcagatgcagaggtgctcacgttgttcaatgtcaccgaagctcaatcaggtgagtatgtttgcaaagtttccaactacatcggggaggcaaaccaaagcgcatggctgacggtgacacgaccagtgctagaggaaaggcctgcagtaatgacttcacccctttatctcgaaataattatctattgtactggtgctttcctaatttcttgtatggtgggctctgttatcgtctataaaatgaagagtggaacaaagaaaagtgatttccactctcagatggccgtgcacaagcttgcaaaatccattcccttaaggcgccaagtcactgtgtcagcagacagctccgcatctatgaactccggggtcctgctggtcagaccctcccgcttgtcatcttctggtactcccatgcttgctggagtgtcggagtatgagctgcccgaggatccccgttgggagttaccgagagaccgactcgtacttggtaaacccttgggggagggatgctttggtcaggtcgtgctggccgaggccattggactggacaaggacaagccaaacagagtcaccaaagtggcggtcaagatgctcaaaagtgatgccacagagaaagacctgagcgacttgatctcagagatggaaatgatgaagatgatcggcaagcacaaaaacattattaatctccttggagcttgcacacaggacggacccctgtatgtgatcgtcgagtacgcctctaagggaaacctgcgtgagtacttacaggcccgtagacctccaggcctggagtactgctataatccaagtcacaaccctgaggaacagttatcttccaaggatttagtgtcttgcgcctaccaggtggcaagaggtatggaataccttgcttccaagaaatgcatccaccgtgatctggctgcgaggaacgtcctggtgactgaggataatgtgatgaagatcgctgattttggtctcgccagggacatccaccacattgattattataagaaaactacaaacggacgcctcccagtaaagtggatggcacccgaggccctatttgacagaatttacacccaccagagcgacgtctggtctttcggcgtgctcctgtgggaaattttcactctcgggggaagcccatatcccggagtgccagttgaggagctgttcaagctccttaaggaggggcaccgcatggacaagccctctaattgcaccaatgagctgtacatgatgatgcgtgattgctggcacgccgtcccaagccagagaccaacttttaaacaactggtggaggatctcgacagaatcgttgccctgacctcaaatcaggagtatctggacttgtccatgccgctggaccaatattctcccagcttccctgacacgagaagctccacatgcagcagtggcgaggattccgttttcagtcatgagcctctgcccgaagaaccatgtctgccacgccatcctgcccagctggcaaatggcggattgaaacggaggtag

SEQ ID NO: 223221 - DNA, 2202 bp, Artificial Sequence
  Description of Artificial Sequence: Synthetic coding sequence
atgtggtcttggaagtgcctgctgttctgggccgtactggtcaccgcaaccctgtgcacagcacgcccatcgcccaccctgcccgagcaggacgccctcccttcctcagaagacgatgatgacgacgatgatagttcaagcgaagagaaagaaacagacaacactaaaccgaatcggatgcctgtggccccatattggactagccccgagaagatggagaaaaagctgcacgctgttcccgctgccaaaacagtgaaattcaaatgtccgtcaagcgggacgccaaatcctaccctgagatggctgaagaacggcaaggaattcaaaccagatcaccgtatcggtggatacaaagtccgctacgccacttggagcattataatggacagtgtagtcccaagcgataaaggaaattacacatgcatagtcgaaaatgagtatggttccattaaccacacctatcagctcgatgtcgtggaacgctctccgcatcgtccgatcttacaggcgggtctgccggcaaataagacagttgccttagggtctaatgtggagttcatgtgtaaggtctactccgacccacagcctcacatacagtggctgaaacacatcgaagtgaacgggagtaagattgggcctgataatctaccttacgttcaaatacttaagactgctggcgtaaacaccaccgataaggagatggaggtgttgcacctgaggaatgtgtccttcgaggatgcaggtgagtacacatgcctggccggaaatagcataggtctctctcatcatagcgcctggctcaccgtgttggaggcccttgaagagaggccagccgttatgactagtcccctgtacctggaaattatcatttattgcaccggcgcattcctgatttcttgcatggttggctccgtgatcgtctataagatgaagagtgggacaaaaaagtccgattttcattctcagatggctgtccacaagttggctaagagtattcctttgaggcggcaggtcactgtaagcgcggattcctcggcctccatgaatagtggcgtacttctcgtgagaccctcccgactttcatccagtggtaccccaatgttagccggtgtctccgagtacgaactgccagaggatccccgttgggagctaccacgagatcgcctcgttctagggaaacccctgggcgagggctgctttggccaggtggtactggctgaagccatcggcctggataaagacaagcctaatagggtcacaaaagtagcggttaaaatgttgaaatctgatgccactgagaaggatttgtccgatctgatctctgaaatggagatgatgaagatgatcggcaagcacaaaaatattatcaatttgctaggagcatgcacacaagatggacctctctacgttattgtggaatacgccagtaagggtaatctaagggagtatttacaagcacgtaggccacccggactcgagtactgctacaatccatcccataatccagaagagcagctgagtagcaaagatctggtcagctgcgcctaccaagtggcccgtggcatggagtacttggccagtaaaaagtgcatccaccgcgatctcgccgctaggaacgttctggtgacagaggacaacgtgatgaagattgctgactttggactggctagagatatccaccacatcgactactataagaagactactaacggacgtttgcctgtgaaatggatggccccagaagctctctttgatcggatttacacacaccagtccgatgtctggtctttcggtgtcctcctgtgggagatctttacacttgggggaagtccatatcccggagtacccgtggaggagctatttaagctgttaaaggaagggcaccggatggacaagccatcaaactgtaccaacgaactgtacatgatgatgagagattgctggcatgcagtgccatcgcagaggccaaccttcaagcagcttgtcgaggacttggaccgcatcgtggctcttacatcaaaccaggagtatctcgatctgagtatgcctttggaccagtactcaccttcgtttcccgacacaagatctagtacttgttcctccggggaggacagcgtgttttcccatgaacctctgccagaggagccatgtctccctcgccacccagcgcagctggctaacgggggtctgaaacggaggtag

SEQ ID NO: 223222 - DNA, 2463 bp, Artificial Sequence
  Description of Artificial Sequence: Synthetic coding sequence
atgtggagttggaagtgtctgctattctgggccgtcttggtgactgctactctgtgcactgcaaggccgtccccgactctgcccgagcaagcccaaccctggggtgcccctgtggaggtggaatcatttctggtgcatcctggggatctcctccagctccgctgcagactgagggacgacgtgcagtccatcaattggctgcgcgacggcgtccagttagcagaaagcaatcgcactagaatcacaggggaagaggttgaggtgcaggactccgtgccggcagattcaggcctttacgcatgcgttacctccagccccagtggatccgacactacttactttagcgtgaatgtcagcgatgccctaccgagcagcgaggacgacgacgatgacgacgactctagctcagaggagaaggaaaccgacaacaccaagccgaaccctgtggcgccatattggactagcccagagaagatggagaaaaagcttcacgcagttccagctgccaagaccgttaagttcaaatgtccctcttcagggacacctaatcccacactgagatggctgaaaaacggcaaggaattcaagcccgaccaccgcatcggtggctacaaggtcaggtacgctacatggtcaatcattatggactctgtcgtgccgagtgacaaaggcaattacacatgcatcgtggagaacgagtatggctccatcaatcacacctaccaactggatgtagtcgagcggagccctcacaggcctattctgcaggctggactgccagccaacaagaccgtggccctgggatccaatgtggaatttatgtgtaaagtctattccgacccccagccccatatccagtggctgaaacatattgaggtgaatggatccaagatcggcccagataatctcccttatgtgcagatacttaagaccgccggagtgaacaccaccgacaaagaaatggaggtgttacatctcagaaacgtgagctttgaggacgcaggtgaatatacatgcctcgcaggcaacagcattgggctgtcacaccactctgcttggctaacggtcttagaggctctggaggaaaggcccgctgtaatgacctcaccactataccttgaaatcattatttactgcaccggcgcattccttatttcttgtatggttggctccgtgattgtgtacaaaatgaagtcaggaaccaagaaatccgactttcattctcagatggccgtgcacaaactggccaagagtattccactcaggcgccaagtgactgtctccgccgatagctccgcaagcatgaattccggggttctactggtgcggccatctagactgtccagctccggcacgccaatgctcgctggggtgtcggaatacgaattgccagaagacccgaggtgggaactaccacgcgacagactggtgctggggaagcccctcggcgaagggtgttttgggcaggtcgtgctggctgaggcaattgggctcgataaggacaagcccaaccgagtgaccaaggtcgcggtaaagatgctgaaatccgatgccaccgagaaagacctctccgacctcatctctgagatggagatgatgaagatgatcggcaagcacaagaacattataaatctcctgggcgcttgcacccaggacggacccctgtatgtgatagttgagtacgctagcaagggcaacctgagagagtatttacaagcgcgtaggcctccaggccttgaatactgctacaatcccagccataatccagaagaacaactttcaagtaaagacctggtctcatgcgcttaccaagtggctcggggaatggagtacctagcctccaaaaaatgtatacaccgggatcttgccgctagaaacgtccttgtgacagaggataatgtaatgaaaatagctgatttcggcttagcacgagacatccatcacatagactactataaaaagaccacaaatgggagactgcctgtaaagtggatggctccagaggctctgttcgacagaatctacacccatcaatctgacgtttggtctttcggagtgttactttgggaaatcttcacactgggtggcagcccttaccctggggttcctgtcgaggaactgttcaagttgctgaaggaggggcatcggatggacaaaccgtctaactgcaccaatgaactgtatatgatgatgcgggattgttggcatgctgtcccctcccagaggcctactttcaagcagttagttgaagatctggacaggattgtggcactgacatccaatcaggaatatctcgacctctctatgcccctcgaccagtattccccctctttcccagatacccgtagcagtacctgtagctccggcgaagacagcgttttctcacatgaacctcttccggaggagccttgcctgcccaggcaccccgctcaactggctaacggaggactgaagcgacgctag

SEQ ID NO: 223223 - DNA, 2202 bp, Artificial Sequence
  Description of Artificial Sequence: Synthetic coding sequence
atgtggtcttggaagtgcctactgttctgggcagtgctcgtgaccgctaccctttgtacagcccgaccgtcgccgaccctacctgagcaggatgctctgcccagctccgaagatgatgatgacgatgacgacagtagtagcgaggagaaagagactgataacactaaaccaaacccggtggcgccttactggacttcccctgagaagatggagaagaagctgcacgccgtccccgcagccaagacggtgaagttcaagtgtccatcttccggtacacccaaccctaccttgagatggctcaaaaacggcaaggaattcaagcctgatcaccgcattgggggatataaagttaggtacgccacttggagcattatcatggactctgtggttccctccgataaggggaactatacttgtatcgttgagaatgagtacggcagtattaaccatacgtatcagctggatgttgtggagagaagcccccacagaccaatcctgcaggctgggctgcctgctaacaagaccgttgcacttggttctaacgtggaattcatgtgcaaggtgtacagcgatcctcagccccatatccagtggctgaaacatatcgaggtgaacgggagcaagatcgggccagacaacttgccgtacgtacagatcttgaaacactccgggatcaattctagcgacgctgaggtcttaactctgtttaatgtgaccgaggcacaaagcggcgaatacgtatgtaaggtttctaactatatcggagaagctaaccagtccgcatggctgaccgttacgaggcccgtggcaaaagccctggaggaacggccagctgtcatgaccagtcctttatacttggaaatcatcatctactgcactggggcttttctaatcagctgtatggtcggatccgtcatcgtgtacaagatgaaatctggcacaaaaaaaagtgacttccattcccagatggctgtccacaaactggctaagtcaatccccctacgcaggcaagtgacggtcagcgccgactcttcagccagcatgaactccggcgtactgctggtacggccatctcgcctctcgagctctgggactccaatgcttgccggtgtctcggagtatgagctgcccgaggaccctagatgggagttacccagggaccgactagtcctcggcaagccacttggagagggttgcttcggacaagtcgtgctagccgaagcaatcggcttggacaaagacaaacctaaccgcgtgaccaaagttgcagtgaaaatgctgaagtccgacgccaccgaaaaagacctcagtgacctgataagcgaaatggagatgatgaagatgataggcaaacacaaaaatataataaacctcctcggtgcatgcacccaggacggccctctgtatgttatcgtggaatacgctagcaagggcaacttaagggagtatttgcaggctaggaggccccctggcttagagtactgctataatccttcgcataacccagaggagcaattgtcatccaaagatctagtgagctgtgcctatcaggtggcaaggggaatggaatatctggccagtaaaaaatgtatacatagggatctggccgcaagaaatgttctcgtgaccgaagacaatgtgatgaaaattgccgatttcggtctggcacgggatatccaccacattgactactacaagaaaaccacgaatgggcgtctgccagtgaagtggatggcacccgaagccctctttgatcggatttacacacaccaatctgacgtctggtcattcggggttctgctgtgggaaatctttactctgggtggcagcccctacccaggagtgccagtggaggaactgttcaagctccttaaggagggccatcgaatggacaaaccttcaaactgcaccaacgaactgtatatgatgatgagggattgctggcacgccgtccctagtcagaggccaacattcaagcagttggtggaggacctcgatcgcattgtggctcttacaagtaaccaggagtacctcgatctcagcatgcccctggaccagtacagtccctcctttccagacacacggagcagtacatgctcatcaggcgaggattcggtcttctctcacgagccactgcccgaagagccgtgccttcccaggcaccctgctcagctggctaacgggggtttaaagcgccgttag

SEQ ID NO: 223224 - DNA, 2463 bp, Artificial Sequence
  Description of Artificial Sequence: Synthetic coding sequence
atgtggtcctggaaatgcctactgttctgggccgttctggtgactgcgactctgtgcactgcacgaccctctccaaccctgccggagcaagcacagccttggggggcacccgtggaggtggaaagtttcctcgttcaccctggcgatctgctccaactcaggtgcaggctcagggacgatgtacagagtattaactggcttagagatggagttcagttggcagaatcaaaccggacacggattaccggcgaggaagttgaggtacaggactctgttccagccgatagtgggttatacgcctgcgtaacaagcagcccgtccgggtctgacacgacctatttttccgtgaatgtgagcgacgccttgccttcctccgaagatgatgatgatgatgatgatagtagctcagaagagaaggagaccgataacaccaagccaaaccccgtggcgccttactggacatcaccagagaaaatggagaaaaaactccacgccgttccagccgcaaagactgtgaaatttaagtgcccgtccagtggcactcctaatccaactctccgatggctgaagaacgggaaagaattcaaacctgatcaccgtatcggcggatacaaagtcagatacgctacgtggagtattatcatggacagtgtggtgccttctgataagggcaattacacctgtatcgtcgagaatgagtatggatctataaaccacacctatcagcttgatgtggttgagagatctccacatagacccattttacaggccggactcccagccaataaaaccgttgcgcttggttccaatgtcgagttcatgtgcaaggtctacagcgatcctcagcctcatatccaatggctcaaacatatcgaggttaatgggagtaagattgggcctgataatctcccatacgtacagatccttaagactgccggagtcaatacgacagacaaggagatggaggttctccacctacggaatgtcagcttcgaggatgcgggagaatatacctgtcttgctgggaattcgatcgggttaagtcatcattcggcctggctaacagtgctggaagccctagaggaacggcctgcagttatgacctcccccctgtacttagagatcatcatttactgtacaggcgctttccttatctcctgcatggtggggtctgtgatcgtgtacaaaatgaaatctggcaccaaaaagagcgattttcacagccagatggccgtgcataaactggcaaagtcaattcccctgaggcgccaggtgaccgtgagtgcggattcatctgcgagtatgaactcaggcgttcttctggttaggccctcccgactctcatcctcaggaactcctatgttggccggtgtgtctgaatacgagctgcctgaggacccgaggtgggaactgcccagggacaggttggtgctagggaagcccctcggggaggggtgcttcggacaggttgttttagcagaggctattggactggataaagacaagccaaatagggttaccaaagtggcagtgaagatgctgaaatccgatgccacagagaaagacctcagcgacctgattagtgagatggaaatgatgaagatgatcggaaagcacaaaaatatcatcaatctgcttggcgcttgtacccaggacggtcccctctacgtaatcgtggaatacgctagtaaggggaatttgagagaatatctgcaggcacgccgaccgccaggtctcgaatactgctataaccccagccacaatcccgaagaacaactgagcagcaaggatctcgtatcttgtgcgtaccaggtagcacgcggaatggagtatcttgcaagcaaaaagtgtatccatcgggatcttgcagctagaaacgtgctggttacagaggataacgtgatgaagatcgctgatttcggactggctcgcgacatccaccacattgactactataagaaaacaacaaacggaagacttcctgttaagtggatggcacccgaggccctgttcgatcgaatctacacccatcagtcagatgtgtggagctttggcgttctgctgtgggagatttttacactagggggttcaccataccctggcgtcccggttgaggaactgttcaaattgctcaaggagggccatcgtatggataagccttccaactgtactaacgagttatatatgatgatgagagattgctggcatgccgtgccctctcagcggcctactttcaagcaactggttgaggatctcgaccgaatcgtcgcgctgacatccaaccaggaatacctggacctgtcaatgcccctggaccagtattcacctagttttcctgacacgcgatcatcaacgtgtagctctggcgaggattccgtcttcagtcatgagcctctgccagaggagccttgcctccctaggcaccccgctcagctcgccaacggaggcctgaagaggagatag

SEQ ID NO: 223225 - DNA, 2463 bp, Artificial Sequence
  Description of Artificial Sequence: Synthetic coding sequence
atgtggtcatggaagtgcctcttattctgggccgtgttggtgaccgctaccttatgcaccgcccgaccaagtcctactttgcccgagcaggcccaaccctggggggcaccagtggaagtggagagctttctcgttcaccccggtgatctgctccagctgcgatgcagactgagggatgatgtgcagagcattaattggctgcgtgacggcgtccagcttgcagaaagcaatagaactcggatcactggcgaagaagttgaggtccaggattccgtccccgcagatagcgggctttatgcctgcgtgactagttcgcccagcgggagcgacaccacatacttttcagtgaacgtgtcggacgcccttccttcttccgaagacgacgacgacgacgacgactctagctcagaggagaaagagaccgacaatacaaaaccaaacccagttgcaccttactggaccagcccagagaagatggaaaagaaacttcatgccgtgccagccgcaaaaacggtcaaatttaaatgccccagctccgggactcccaatcccaccctccgctggctgaagaacgggaaagagttcaaaccagatcataggattggagggtataaggttcgatatgctacatggtctattatcatggacagtgttgttcctagtgataagggaaactacacttgcatcgtggagaatgaatatgggtccattaatcacacataccagttggacgtagtggaaaggagcccgcatcgcccaatcctgcaggcagggctgcccgctaataagacagtcgctttgggctcaaacgtggaattcatgtgcaaagtctattccgaccctcagccacacatccaatggttgaagcacattgaggtaaatggatccaaaatcggtcctgataacttgccctacgttcagatcttgaaaactgctggagtcaacacaaccgataaggaaatggaggtgctccacctgagaaatgtttcgttcgaagacgccggagaatacacttgcctggctgggaatagcatcggactttctcaccattccgcctggctgacagtgttagaagcactggaggagaggccagccgtcatgacctcacccctgtacttggaaattattatctattgtactggcgcattcctgatttcatgcatggtaggcagcgtcatcgtgtacaaaatgaagtccgggaccaaaaaaagcgatttccactcccagatggccgttcacaagctggctaaatccatcccgctcaggagacaggttacagtgtctgccgactcctcagcaagcatgaattccggcgtcctgctcgttcgcccttcgaggctctcgagctccggcactcctatgctggccggtgtgtcagagtacgagctccccgaagatccccgttgggagctgcctagggaccgcctcgtgctcggcaaaccactgggcgaggggtgctttggccaggtcgtgctggccgaagcaattgggctggacaaagacaagccaaacagggtgaccaaggtggccgtgaagatgttgaagagcgatgccacagaaaaagatctgagtgacctgatctcagagatggaaatgatgaaaatgataggcaagcataaaaacataatcaatttactaggggcttgcacccaggatggccctttatatgtcatcgtggaatacgccagtaaggggaacctccgagaatatctccaggccagaaggccgcctggtttggagtattgttacaacccatctcacaaccccgaagagcaactcagctccaaggatctggtatcctgcgcctaccaagttgcacgcggtatggaatatttggcgtcgaagaaatgtatccatcgagaccttgccgcaagaaacgtgctggtgaccgaggataatgtgatgaagattgctgacttcgggctggcccgagacattcatcatatcgactattacaagaagaccaccaacggcaggctcccggttaaatggatggccccagaagccctatttgacaggatctacacgcaccaatcagacgtctggtcctttggcgtgttactgtgggagattttcactctgggtggctcaccataccctggtgtgcctgtggaggagctcttcaaactcttaaaggaggggcacagaatggacaagcctagcaactgcaccaatgaactgtacatgatgatgagggactgctggcacgctgtgcccagccagagacctactttcaaacaactggttgaggatctggatagaatcgttgcgctgacaagcaaccaagagtatctggacctgtctatgccactggatcagtattctccgtctttccctgatactaggtcatccacatgttcttccggcgaagactctgtgttttcacacgaacccctgcccgaggagccctgtctgccccgtcaccctgcacagctcgcaaacggtggactgaagcgacgctag

SEQ ID NO: 223226 - DNA, 324 bp, Artificial Sequence
  Description of Artificial Sequence: Synthetic coding sequence
atgtggagttggaagtgcctcctcttttgggccgtgttggtgacagcaacactgtgcaccgctaggccttcccccaccttgcccgaacaggcccagccatggggcgcaccggtcgaggtcgagagtttcctcgttcatccaggtgatctgcttcagttaagatgtaggctgcgagatgatgtgcagtccatcaattggctcagagacggcgtgcagctggctgagagcaaccggactagaatcaccggcgaggaagtggaagtgcaggactctgtaccagctgactctggattgtacgcatgcgtcaccagctccccatcatag

SEQ ID NO: 223227 - DNA, 2562 bp, Artificial Sequence
  Description of Artificial Sequence: Synthetic coding sequence
atggaagcccgagtgtctctgaaacgcaggatcgagctgaccgtggagtatccttggcgctgtggagccctatcccctaccagcaactgccggacaggaatgtggtcttggaagtgcctgctgttctgggccgttcttgtcaccgccactctctgtaccgcccgacccagcccgactttgccagaacaggcgcaaccatggggagctccagtcgaggtggagtcgttcctggttcaccccggtgacctgctgcagctgaggtgtcgactgcgcgatgacgtccagagcatcaactggctgcgagatggagtacagcttgctgagtctaacagaacaaggataacgggtgaggaagtggaagtccaggactctgtgccagccgacagcggcctgtatgcctgtgtgacatccagtccctccggctccgatacgacatattttagtgtaaacgtctccgacgctttgccaagttccgaagatgatgacgatgacgacgacagttcttccgaggagaaagaaaccgataatactaagccaaaccccgttgctccatactggacaagtccagaaaagatggagaagaagcttcacgcggtgccagctgcaaaaacagtaaagttcaagtgcccttcaagtggaacacctaatcccaccttgcggtggctgaaaaatgggaaggaattcaagccagaccataggatcgggggatacaaagtacgctacgctacctggtcaattattatggacagtgtggtcccatcagacaagggaaattatacatgcattgtggaaaacgagtacggctcaatcaaccacacatatcagcttgacgtggttgaacgctctccacacaggcccatcctgcaggccggattgcctgctaacaagacagtcgcgctgggctcgaacgtagagtttatgtgtaaggtctactcagatcctcagccacacatccagtggcttaaacatattgaggtgaacggctcgaagatcggacctgacaacctgccatatgtgcagattctgaaaactgcaggtgtaaacaccactgacaaggaaatggaggtgctccacctgcgcaacgtcagctttgaggacgctggggagtatacgtgcttagctggaaattcaattggcctctctcaccattctgcctggctgaccgtcctagaagcattggaggaaaggcctgcagttatgacgtcaccactgtacctcgagatcatcatttattgtacgggggctttccttatttcgtgcatggtagggagcgttattgtgtacaaaatgaagtcaggcactaagaaatccgactttcattctcaaatggccgtccacaagcttgccaaatcaatcccgctccgaagacaagtcaccgtgagtgctgattcaagcgcctcaatgaactctggcgtgctcctggttcgtccctcgcggctgtccagctccggtacaccgatgttggcaggggttagcgagtatgagctaccagaagatcccaggtgggagctgccacgggatagattagtactgggcaagcccctcggggaagggtgcttcgggcaagtggttctcgcagaagccatagggttggataaagacaaacccaatcgcgtgactaaggtggccgtaaagatgctgaagtctgatgctacggaaaaggatctttctgacctgatcagtgaaatggaaatgatgaaaatgatcgggaagcacaaaaatatcattaatttattgggcgcttgtacacaggacggaccactgtacgtgatagtggaatatgcttccaaagggaatctcagggagtaccttcaggcaagacggcctccaggtctggagtactgttacaatcctagccacaacccagaggaacaacttagtagcaaggatcttgtctcctgcgcctaccaggtggctagggggatggagtatttggcctcaaagaagtgtattcaccgggatctcgccgctcgcaacgtcctggtgacggaagacaacgtcatgaaaatcgccgacttcggtctggctcgcgatatccaccacatagattattataagaagacaaccaatggtaggttaccagtgaaatggatggccccagaggcactcttcgaccgtatttatacgcatcagtctgatgtgtggtccttcggcgtgctgttatgggagatcttcacgttgggcggatcaccgtatccaggcgttccggtcgaggaactgttcaaactgctgaaggagggccatcggatggacaagccctccaactgcacaaatgagctgtatatgatgatgcgcgactgctggcacgccgtcccctcccagcgcccaacctttaaacagcttgtcgaggatctggaccgaatagtggcactgacaagtaaccaagagtacctggacctatcaatgccactggatcaatactcaccctcttttcccgacactcgaagttccacttgtagttccggggaagattcagtcttctcccacgagcccctcccggaggagccctgtcttcctagacaccccgcacaactagccaatggcggactgaaacgcagatag

SEQ ID NO: 223228 - DNA, 168 bp, Artificial Sequence
  Description of Artificial Sequence: Synthetic coding sequence
atgtggtcctggaagtgtctgctcttttgggcagtactggtaacggccaccctgtgtaccgctaggcctagcccaaccctgccggagcaagacgcactgccgtcatccgaggatgacgacgacgacgacgacagctccagtgaggagaaagaaaccgacaatacctag

SEQ ID NO: 223229 - DNA, 6 bp, Artificial Sequence
  Description of Artificial Sequence: Synthetic coding sequence
atgtag

SEQ ID NO: 223230 - DNA, 2469 bp, Artificial Sequence
  Description of Artificial Sequence: Synthetic coding sequence
atgtggtcatggaagtgtctgcttttctgggccgtcctggttaccgcaactctatgcaccgcgagacccagccctactctgccggagcaagcccagccttggggggcacccgtggaggtggaaagctttctcgtgcaccccggtgatctgcttcaattgagatgtcgcctccgcgatgatgtacaaagtatcaactggctgagggatggtgtacaactggctgagagtaataggacccgcattacgggcgaggaagtggaagttcaggactcggttcccgcagacagcggtctgtacgcctgcgtgacgagctctcctagcggatccgacactacttactttagcgtcaacgtgagcgatgctcttccctctagcgaggacgacgatgacgatgatgactcctccagtgaagagaaagagacagataatacaaagcctaaccgtatgccagtggcgccatactggacgtctcccgaaaaaatggagaagaagctccacgcagtgccagccgctaagaccgtgaagtttaagtgtccttctagcgggacaccaaatcctacccttcgctggcttaagaatggcaaggaatttaagcctgaccatcgcattggaggatacaaagtgaggtatgctacatggagtattattatggattcggtcgtgccgtcagataaggggaattatacctgtatcgttgaaaatgaatatgggtctataaaccatacatatcaactggacgttgtagagcgatcgcctcataggcccattctgcaggctgggcttcccgcaaacaagactgtcgcactaggctcaaatgtcgagttcatgtgtaaggtttactctgacccccagccacatatccagtggctaaaacatattgaggtaaatggctctaaaatcggaccagataaccttccttatgtgcagatcctgaagactgccggagtcaacacaaccgacaaagagatggaagtgctgcatctaagaaatgtctcttttgaagacgcaggtgagtacacctgccttgcgggaaactcaatcgggttaagtcaccactctgcctggctaactgttctcgaagctctggaggagagacccgctgtcatgacatcacccctgtacctggaaattatcatctactgtaccggcgcttttctgatttcatgcatggtgggttccgtgatcgtgtacaagatgaagtctggaacaaagaaatcagactttcatagccaaatggccgtgcataagctggctaaatcaatcccattgaggagacaggtgaccgtgagcgcagactcttccgcgtccatgaacagcggtgtgctgctggtgagaccaagccgcctcagcagttccggcactcctatgctggctggcgtaagtgagtatgaactcccagaggaccccaggtgggagctccctcgagatagacttgtactcggaaaacccctgggcgaggggtgctttgggcaggtggtgctggccgaagcaataggactagataaagataaacccaatagagtgacgaaggtggcagttaagatgctcaagtccgatgcaacggagaaggatctcagtgatttgattagcgaaatggagatgatgaaaatgattgggaagcacaagaatatcataaacttgctgggagcctgcactcaggatgggcctttgtacgtcattgtcgaatatgcgagcaaagggaatctgcgtgaatacttgcaggccaggagaccgcctgggcttgaatattgctataatcctagccataaccctgaagagcagctgtcttcaaaggacctggtttcctgtgcctatcaggtggcacgagggatggaatacctggcaagtaagaaatgtatacaccgagacctggctgccagaaacgtcttagtcaccgaagacaacgttatgaagattgctgattttggcctcgcaagggacattcaccatatcgactattataagaaaacaactaacgggagactcccagtgaagtggatggcgccagaggccctcttcgatcgtatctatactcaccagtctgacgtgtggtcattcggcgtcctgctgtgggaaattttcacattaggcggaagcccttatcctggcgtgccagtcgaggagctgtttaaacttctgaaggaagggcaccggatggataagccgagtaattgcactaacgaactgtacatgatgatgagggattgctggcacgccgtgccatcccaaagaccaacatttaagcaacttgtcgaggatttggatagaattgtggcgctcacatctaaccaggagtacctggacttatcaatgcccctggatcagtacagcccttccttcccagacacgaggtcctcaacatgctctagcggtgaagatagcgttttctcgcacgaacccctccccgaagaaccctgtctcccccgacacccagcacaactcgctaatggcggtcttaagcggagatag

SEQ ID NO: 223231 - DNA, 897 bp, Artificial Sequence
  Description of Artificial Sequence: Synthetic coding sequence
atgtggagttggaagtgtcttctgttttgggctgttctagttaccgccactctctgtactgcccgacctagtcctactttgcctgaacaagctcaaccctggggagctccagtggaggtggaatctttccttgttcatcctggtgatttgttgcagctgagatgccgtctcagagatgatgtccagtcaatcaattggctgcgcgatggagtgcagttagctgagagtaataggacacggattacaggtgaagaggtagaggtgcaggattccgtcccggcagacagtggactttatgcctgtgtaacttcctcaccaagtggatctgacactacctatttcagtgtgaatgtctctgatgccctcccaagttcagaggatgacgacgacgatgatgactcgagctcagaggaaaaagagaccgataacaccaaacccaatcgcatgcccgttgccccatattggactagcccagagaaaatggagaaaaaactccatgctgtgccagctgcaaagacagtgaagttcaagtgtccgtctagcggaacacctaaccccacacttcgttggcttaaaaacggcaaggagtttaaacctgaccatagaatcggcggttataaagtaagatatgccacttggagcataatcatggatagcgttgtgccgagtgataaaggaaattatacctgtatcgtggaaaatgaatacggatccattaatcatacttaccagttggatgtggtcgaacgatccccacaccggcctattctccaggcaggactgccagcaaataagacagtcgctctgggctccaatgtggagttcatgtgtaaggtctactccgatccacagccacacatccagtggttgaagcacatcgaggttaatggctcatag

SEQ ID NO: 223232 - DNA, 438 bp, Artificial Sequence
  Description of Artificial Sequence: Synthetic coding sequence
atgtggagttggaagtgcctgctgttctgggccgttcttgtcacagctacactgtgtaccgccagaccctcccccactctccctgaacaggatgccttgccttctagcgaagatgatgatgatgacgatgatagtagttctgaggagaaagaaacagacaataccaagccaaatcctgtggctccttactggacctcccctgagaagatggagaaaaagctgcatgcagttccagcggcaaaaacggtgaaatttaaatgtccatcatccgggacgcccaatccgacccttcgatggctcaaaaatggcaaggaattcaagccagatcaccgaatcggaggatacaaagtgagatacgctacctggtcaatcatcatggactctgttgtgccgagcgacaagggcaattacacctgcatcgtcgagaacgaatactag

SEQ ID NO: 223233 - DNA, 429 bp, Artificial Sequence
  Description of Artificial Sequence: Synthetic coding sequence
atgtggagctggaaatgtctgttattctgggccgtgctggttaccgccaccttatgtacagcccgaccatcccccacgctgccagaacaagacgctctgccttccagcgaagacgacgacgatgatgatgattccagttcagaggaaaaggaaaccgataacactaagcccaatagaatgcctgttgccccatactggacaagcccagaaaagatggagaaaaaactccacgcagtgccagcagccaagaccgtcaaattcaagtgtccatcttcaggaactcccaacccgacccttagatggctgaagaacggaaaggaattcaagccggaccaccggataggaggctataaagtcaggtacgctacgtggagcatcataatggacagtgtagtcccatccgacaaaggtaattacacctgcatttag

SEQ ID NO: 223234 - DNA, 258 bp, Artificial Sequence
  Description of Artificial Sequence: Synthetic coding sequence
atgtggtcctggaagtgtctcctcttttgggccgtgctggttacagcaacgctgtgcacagcacgcccttctcccactcttccagagcaggacgctctgcccagctccgaagacgatgatgatgatgatgacagtagctcagaagagaaagaaaccgacaacacaaagccgaaccctgtggcaccttattggaccagccctgagaaaatggaaaaaaaactgcatgccgtgcccgcagccaaaaccgtcaagttctag

SEQ ID NO: 223235 - DNA, 2463 bp, Artificial Sequence
  Description of Artificial Sequence: Synthetic coding sequence
atgtggagctggaaatgcctgctgttttgggccgtcctggtcacagcaactctatgtacagcacgccctagtcccaccctccccgaacaggcacaaccatggggagcaccagttgaggtcgagagtttcctggtgcaccccggagacttgctgcagcttcggtgtcgcctgagggacgatgttcagtccataaactggctccgagatggcgtccagctagcagaatctaatcggacacgaattacgggcgaggaggtggaggtacaagactccgttcctgccgatagtggcctctatgcctgcgtgacttccagcccctcaggctctgatacaacttattttagcgtaaacgtctcagatgcgctcccttcgtccgaggacgacgatgacgatgacgattctagcagtgaggagaaagaaacagacaatacgaaacctaaccggatgcctgtggccccatattggacatctcctgaaaaaatggaaaaaaagcttcacgctgtcccggctgccaagactgttaagtttaagtgtccctcttccgggacaccgaacccgacactaaggtggctgaaaaacgggaaggagttcaagcccgatcataggatcggtggctacaaagtgcgttacgcaacatggagcatcatcatggatagtgtggtgccttctgataaagggaattacacttgtatagtggagaacgagtacggaagcataaatcacacctaccagcttgacgttgttgaacggagcccacacagacccatcctgcaggcaggccttccagcaaataaaactgtcgcgctgggctccaacgttgagtttatgtgtaaagtgtatagtgacccccaacctcacatccaatggctcaagcacatcgaggtaaatggttccaagatcggccctgacaacctcccatatgtccagattctaaagacagctggcgtgaacactacagataaggaaatggaggtcctgcacctgcgaaatgtgagtttcgaagacgccggagaatatacctgcttagctggaaattcaattggactgtcacaccatagtgcctggctgaccgtgctggaagccctggaagaacgccctgccgtgatgacatctcccctatacctggaaattattatctactgtaccggagccttcctcatttcctgtatggtgggcagcgtgattgtatacaaaatgaagtctgggactaagaagagcgacttccactctcagatggccgtccacaagcttgccaagagcatcccactcaggcgacaggtgagtgccgacagctctgcctcaatgaactctggagtgctgctggtgcggcctagcagattgagctcttccggcaccccgatgctagctggagttagcgagtatgaactgcccgaggacccgcgttgggagctgccaagagaccggttggtgttggggaagcctctcggtgagggatgtttcgggcaagtcgtcttagccgaggcgatcggcctcgacaaagacaaaccgaatagagtgacaaaggttgcagtgaaaatgctaaagtcagatgcaacagagaaagatctcagtgatctgatatctgaaatggaaatgatgaagatgattggcaagcacaaaaacataatcaatctgttgggtgcatgtacgcaggatgggccactgtacgtaatcgttgaatacgcaagcaaaggaaatctccgggaatatctccaggcacggagacccccaggccttgaatattgttacaaccccagtcataatcctgaggagcagctttcgtcaaaagatttggtttcttgcgcttaccaagtcgctcggggaatggaatatcttgcgtcgaaaaagtgcatccacagggacctagcggcaaggaacgttctggtgactgaagacaatgtgatgaagatcgccgacttcggcctcgcaagagacattcatcatatcgattattataaaaaaaccaccaatggtcggcttccagtaaagtggatggctcccgaggcccttttcgacagaatttatacacatcagtcggacgtgtggtcttttggtgtgctgctgtgggaaattttcaccctgggcggatcaccataccccggtgtgcctgtggaggagctcttcaagctcctaaaggagggtcatcgcatggataagccctctaattgcacaaacgagttgtacatgatgatgcgcgattgctggcacgccgtgcctagtcagagaccgacatttaaacagctcgtagaggacctagatagaatagtcgcgctaacgtccaatcaggaatatcttgacttatccatgccacttgatcagtactctcccagttttcccgacaccaggtcttctacctgtagctccggagaggatagtgtgttctcacacgagccactgccggaggaaccatgtctgcccaggcacccagcccagctggcgaatggcggtctgaagaggcggtag

SEQ ID NO: 223236 - DNA, 2010 bp, Artificial Sequence
  Description of Artificial Sequence: Synthetic coding sequence
atggtaagctgggggaggtttatatgtctcgtggtagtgacaatggcaacgctgtcactcgcccgtccaagcttttcacttgtggaagacaccaccttagaaccagaggacgccatctcttctggggacgacgaagatgacacagacggcgcagaggacttcgtctccgaaaattccaacaacaaacgtgccccatattggactaacactgagaagatggaaaagcggcttcatgccgttccagccgctaacaccgtgaaattcaggtgcccagccggtgggaatccgatgcccactatgcggtggctgaagaatggtaaagaattcaagcaggagcataggattggtggatataaagttcgaaatcagcattggtctctcataatggaatctgtggtccccagtgacaaggggaactatacctgcgtggttgagaatgaatacggatcgatcaatcacacttatcacctggatgtggtggagcgttctcctcacaggcctatattgcaggccggtctgccggcaaatgcgtcgaccgtcgtcggcggtgatgtagaattcgtgtgtaaagtgtactctgatgcacagccccatatccagtggatcaagcacgtggagaaaaacggctctaagtacggaccagatgggctgccgtacctcaaagtgctgaaagccgctggagtgaacactacagacaaagagatcgaggttctctacatcagaaacgtgacttttgaagacgccggtgagtatacctgtcttgctggcaacagtataggaatatcctttcattcagcatggcttacagtgttgcccgctccaggcagggagaaggagattactgcgagtcctgactatcttgagatagcgatttactgcattggagtgtttctgatagcatgcatggtggtgaccgtcatcctgtgtaggatgaaaaacactaccaaaaaaccagatttttccagccagccagctgtacataaattgaccaagcgcatccctctgagaaggcaggtcagtgccgaatcatctagtagtatgaatagcaacacacccctggtaagaattaccacacgcctgtcctcaactgcagacacacccatgctcgccggtgtgagcgaatacgaactccctgaagacccgaaatgggagttcccacgtgataaacttactcttggcaaacctctgggcgagggatgttttggccaagtggtgatggcagaagccgttgggatcgacaaagataaaccgaaggaggccgtgaccgtggctgtgaagatgcttaaggatgatgccaccgagaaagatctgtccgatctggtttcggagatggaaatgatgaaaatgattgggaagcacaagaacatcatcaatctgttgggcgcatgcactcaagacggccctttatatgtgattgtcgagtacgccagtaaaggcaacctccgcgaatacctgcgcgctcggagacctccaggaatggagtactcatatgacatcaaccgggtgcctgaagagcagatgacttttaaggatctcgtaagctgtacatatcagctcgcccgaggaatggaataccttgcaagtcagaaatgtatccaccgagatctggctgctcgaaacgtgctggtcaccgaaaacaatgttatgaaaatcgctgactttggcctggcccgagatattaataacatagactactataagaagacgaccaacggaaggttacctgtgaaatggatggctcctgaggcacttttcgatagagtttatacccatcaaagtgacgtgtggtccttcggcgtcttgatgtgggaaatttttactctcggaggatcaccatatccaggcattccagtcgaagaactgtttaaactgctgaaggaaggccacaggatggataaacctgctaattgtaccaatgaactgtacatgatgatgcgcgattgctggcacgctgttccatctcagaggcccacctttaagcaactcgtggaagacctcgaccgcatctag

SEQ ID NO: 223237 - DNA, 2460 bp, Artificial Sequence
  Description of Artificial Sequence: Synthetic coding sequence
atggtttcctgggggaggtttatatgcctggtggtagtgacaatggctactctgagcctggccaggccttccttttcactggtggaagataccacgctggagcccgaagaaccaccaaccaagtaccagatctcccagcccgaagtctatgtggctgctcccggagaaagcctggaggtgagatgcctattaaaggacgcagccgtaatctcttggactaaggacggcgtccatctgggtcctaataaccggaccgtgctcattggagaatatctacaaatcaaaggtgctacgcccagggatagcggactgtatgcttgcacagcctcaagaacagtggacagcgaaacttggtacttcatggtgaatgtgacagatgctatcagctctggtgacgacgaggatgataccgacggcgctgaagatttcgtgagtgagaatagcaataataaacgcgcaccctattggacgaatacagaaaaaatggagaaacggctccatgctgtcccagctgctaacacagtcaagttcaggtgtcccgcagggggaaatcctatgcctacgatgcgttggctcaaaaatggaaaggaattcaagcaggagcatcgtatcggaggctataaggtaagaaaccagcactggagtctgattatggaatcggtggttccttcagacaaaggaaattatacatgcgtggtggagaatgaatacggctcaattaatcacacctatcacttggatgtcgtcgagcggtcccctcatcggccaattctccaggcaggtctacctgccaatgccagtactgtggtgggaggggacgtcgagttcgtctgcaaggtttacagtgacgcccagccacatatccagtggatcaaacacgtggagaagaacggttctaagtatgggccagatgggctgccgtatctgaaggtccttaaagcagccggtgtaaatacaactgacaaggaaattgaggtcctctacataaggaatgtgacatttgaagatgctggggagtacacatgtcttgccggtaatagcataggcatatcattccatagcgcgtggctgacggtgctccccgctccagggagagaaaaggaaatcaccgcatcaccagattacctggaaatcgccatctactgtatcggagtgtttctgatagcttgcatggtagtgacagtgattctttgtcggatgaagaacacaaccaagaagcctgatttctccagccagccggctgtacacaagctgaccaagcggatacccctccgcagacaagtgagcgcggagtccagctcaagcatgaacagcaacacacctctcgtcagaatcacaacgcgcttgagtagtactgccgatactcctatgctcgcaggcgtctctgagtacgaactgcccgaagatcccaaatgggagtttccccgtgacaaattaacactcggcaaacccctgggtgagggttgtttcggccaagtggtgatggcagaagcagtcgggattgacaaagacaaacctaaggaagccgtgacagtggccgtcaaaatgcttaaggacgatgccaccgaaaaagacttgtccgacctggtgagcgaaatggaaatgatgaagatgattgggaaacacaagaatataattaatctgctaggggcttgcacgcaggacggaccactgtatgtcatagtggaatacgcttctaagggaaacctgcgggaatacctcagggcccgacgccctcctgggatggagtacagctacgatattaaccgagttcccgaggaacagatgacattcaaggacttggtgagttgcacataccagctggcgcgaggaatggaatatcttgcgtcccagaaatgcatccaccgagaccttgctgcaagaaatgtgctggtgacagagaacaatgtaatgaaaatagccgatttcggccttgccagggacataaacaatatagactactataaaaaaaccactaacggaagacttccagtaaaatggatggcgcctgaagctctgtttgatcgagtgtacacccaccagagtgacgtatggtcttttggcgttttaatgtgggaaatattcacactaggcggttccccctacccaggaatccctgtggaggagctgttcaaattactaaaagagggacacaggatggacaagccagccaactgtactaacgaactgtacatgatgatgcgcgattgctggcacgctgttccttcccaacgcccaacgttcaagcagctggtcgaagatctggacagaatcctaacactgacaaccaacgaagaatatctcgacctgagccagccattggaacagtacagcccgagctatccagatacgagatcaagttgctcatcaggcgatgactcagtatttagtccggaccccatgccctacgagccttgcctgccccagtacccccacattaatggttcggtcaaaacttag

SEQ ID NO: 223238 - DNA, 2358 bp, Artificial Sequence
  Description of Artificial Sequence: Synthetic coding sequence
atggtctcgtggggccgattcatttgtctggttgtggtaacaatggcaactctttctctcgcccgacccagtttctctctggtggaggatactaccttggagcctgaggaaccacctactaagtatcaaataagccagcctgaagtttatgttgccgctcctggtgaaagcctcgaggtccgatgtctcctgaaggacgctgccgtgatcagctggaccaaagacggggtgcacttgggcccaaataacagaactgtacttatcggcgagtacctgcaaataaagggcgctaccccgcgagattccggcctgtacgcctgcaccgcttcaaggacggtggactccgagacatggtatttcatggttaatgtaactgatgccatttcatccggggacgatgaagatgacaccgacggagccgaagacttcgtatccgaaaattctaacaataaacgtgccccatattggactaacactgaaaaaatggaaaagcggctgcacgccgtgcccgcagccaacacagttaaattcagatgtcctgctggtggtaatccaatgcccaccatgcgatggttaaaaaatgggaaggagtttaaacaggagcatagaatcgggggatataaggtgcgcaatcaacactggtccctcatcatggaaagtgttgtgccctctgataaggggaattatacgtgtgtcgtggagaacgaatacggaagtattaaccacacctaccacctggatgtagtggagagaagtcctcacagaccgatactgcaggctggactgcccgcaaatgcgtctaccgttgtcggcggagacgtagagtttgtgtgtaaggtgtacagcgatgcccagccgcatatccagtggatcaaacacgtagagaagaatggcagcaagtatggtccagatggcctgccctacctcaaggttttaaaggccgcaggtgtgaacaccactgataaggagatagaagtcctctatattagaaacgtcaccttcgaggacgcgggagaatacacttgcctggctggaaattctataggtatttcattccattccgcgtggctcacagtgcttccagccccaggcagagagaaagagatcaccgcctctcccgattacctggaaattgctatctattgtattggggtgttcctcattgcctgtatggtcgtgactgtgattctgtgccgcatgaagaacaccacaaagaaacctgactttagttctcagcctgccgtgcacaagctgacaaaacggattcctctccggagacaggtgtccgctgagtcctcctcatcaatgaactcaaatacccctctcgtgaggattaccactagacttagttcgacggctgatacacctatgctcgctggagtatcagagtacgaactgcccgaggatcccaaatgggagtttcctagagataagctgacactgggtaaacctcttggcgaaggatgtttcggacaagtagttatggccgaggccgttggcatagacaaggacaagcccaaggaagctgtgaccgtcgctgtaaagatgctcaaggatgatgcaactgaaaaagacttgagtgacctggtcagcgaaatggagatgatgaagatgataggcaagcacaagaacatcatcaatctgctgggagcatgcacgcaagacggaccactgtacgtgatcgttgagtatgcatcgaagggtaatctgagggaatatttaagagcaagaagaccgcctggaatggaatattcctatgacatcaaccgagtgcccgaggaacagatgacattcaaggatctcgtgagctgcacctatcagctagctcggggaatggagtatttggcttcccagaagtgcattcacagggatctggccgctaggaatgtgctggttacagagaataatgttatgaagatcgcagatttcgggctggctcgggacattaataacatcgactattacaagaagacaacaaacgggagactgccagtgaagtggatggctcccgaagctctcttcgaccgtgtgtatacacaccagtcagacgtgtggagcttcggcgtgcttatgtgggaaatcttcaccctcggtggctctccgtaccccggaattcccgtggaagaactctttaagcttctgaaggagggccaccgtatggacaagcccgctaactgtaccaatgaactctacatgatgatgagggattgttggcacgccgtcccatcgcaaaggccgacctttaagcagcttgttgaggacctggaccgcatactcaccctcacaaccaatgaagagtatctggacctgtcacagccactggaaccatattctccctgttaccccgaccctagatag

SEQ ID NO: 223239 - DNA, 2115 bp, Artificial Sequence
  Description of Artificial Sequence: Synthetic coding sequence
atggtgtcctggggcagattcatctgcttagtggttgtgaccatggccacccttagcctggccaggccctcattttccttggtggaggacaccacgctcgagcccgaaggggcaccatattggaccaacaccgagaagatggagaaaaggctccacgccgtccctgccgcaaacaccgtgaaatttcgatgccctgccggagggaacccaatgccgacaatgaggtggctgaagaacggcaaagaatttaaacaggaacaccgtattggcggttataaagttaggaaccagcactggagtctgatcatggaaagtgtggtccccagcgataaaggtaattatacctgtgtggtggaaaatgaatatgggagcatcaaccatacctaccatctggatgtggtcgagagatctccccatagaccaattcttcaggcaggcctgccagccaacgcaagcacagtggtggggggagatgtggagtttgtctgtaaggtctacagcgacgctcagccccacatccagtggataaaacacgtcgagaaaaacgggagtaaatacggccctgatggtctcccctacctaaaagtgctgaaggcagccggagtgaacaccaccgataaggagatagaagtgttgtatatccgcaacgtgacatttgaagacgctggcgagtatacatgcctagctggtaatagtatcggcatatccttccattctgcctggctaactgttctccccgctccaggaagagaaaaggaaattacggcgtcaccggattacttggaaatcgctatttactgcatcggcgtgtttctgatcgcctgcatggttgtgactgtgatcttgtgccgcatgaagaacaccacaaagaagcctgacttcagcagtcagccagcagtacacaagttgaccaagagaattcctctgaggcgccaggtttccgctgaaagctccagcagcatgaattctaacaccccactggtaaggattaccacacgactgtcatcaacagccgatacccctatgctggccggtgtgtctgagtatgagctcccggaggatcccaaatgggaatttccacgcgacaaacttacactcggtaagccccttggtgaaggttgcttcggccaggtggttatggctgaagccgtaggcattgacaaggataagccaaaggaggccgtaaccgtggcagtcaaaatgctaaaggacgacgccactgaaaaagacttaagtgaccttgtgagcgaaatggagatgatgaagatgatagggaagcacaagaatataatcaatttacttggtgcctgtactcaggatggaccgctgtacgtcatcgtggaatatgcttctaagggtaatctcagggagtacttaagggctcgtcgtccgcctgggatggaatacagttacgatatcaaccgggtgcccgaggagcagatgacattcaaggatctggtgtcctgtacctatcaactcgctaggggcatggaatacctggcctctcagaagtgtatccaccgggacttagccgcaagaaacgtgcttgtcaccgaaaataacgtcatgaagatcgccgacttcggccttgcaagagatatcaacaatatcgactattataaaaagaccactaatggcaggcttcccgtgaaatggatggctccagaggcattgttcgaccgggtatacacccaccaaagcgacgtgtggtctttcggtgttcttatgtgggaaatattcacccttgggggaagtccctaccccggtattcccgttgaggaactcttcaaactacttaaggagggacataggatggataaacctgccaattgtactaacgaactgtacatgatgatgagagattgttggcatgcagtcccgtctcaacgccctaccttcaaacagttagtggaagacctcgatagaattcttacgctgaccactaacgaggaatatctggacctcagtcagccacttgagcagtattccccctcttacccagacactcgctccagctgcagttccggagacgactccgtattctcaccagatcccatgccatacgagccttgtttgccacaatatcctcacatcaacggctctgtcaaaacatag

SEQ ID NO: 223240 - DNA, 2124 bp, Artificial Sequence
  Description of Artificial Sequence: Synthetic coding sequence
atggtgtcttggggccgattcatctgcctggtcgtggtcaccatggcgaccttgagtttggccagaccatccttctcactggtcgaggatacgactcttgaaccggaagatgccatttcatctggggacgacgaggatgacaccgatggcgcagaagatttcgtgtcagaaaactccaataataagagggccccttattggactaataccgaaaaaatggaaaaacgcctacatgcagtgccagccgcaaacacagtgaaatttaggtgcccagctggcggaaatccgatgcccacgatgcgttggcttaagaacgggaaggaattcaaacaagaacacagaatcgggggttacaaagtgaggaatcagcattggagcttgataatggagtccgtagtgcctagtgacaaggggaattacacttgtgtagtagagaacgaatacggctctattaaccacacctatcacctcgatgtagtggaaagaagtcctcatcggccaattctgcaggccggtttgcctgcaaatgccagtacagtcgtcggaggcgatgtggagttcgtgtgcaaagtgtactctgatgcacagccacatattcagtggattaagcacgtggaaaaaaatggcagcaagtatggccctgatggactgccctaccttaaggtgctgaaggccgctggggtgaacactacagataaggaaatcgaagtgctctacatcagaaacgtcacttttgaggacgccggagagtacacatgcctggccggaaactccatcggcatctctttccacagcgcttggcttaccgtgctccctgccccaggacgggagaaggagatcactgctagtcccgattatctagagatcgctatctactgcataggggtgttccttatcgcatgcatggttgtgacagtgatactgtgccgcatgaagaatactaccaaaaagccggatttcagtagccaaccggcagtgcacaaactgacaaagaggattccgctgagacggcaggtgacagtgtctgctgagtccagttcctctatgaatagtaatacacctcttgttagaatcactaccaggctgtccagtaccgccgatacccccatgttggccggagtttctgagtatgaactgcctgaggaccccaagtgggagtttccaagggacaagctgaccctaggcaaacccctcggtgagggctgctttggtcaggtcgtcatggcggaagctgtaggtatagataaagataagccgaaagaggctgtgaccgttgccgtgaaaatgttgaaagacgacgcgacggagaaggacctgagcgacttagtgtctgaaatggagatgatgaagatgatcggaaagcataaaaacattatcaatctgttgggagcttgtacccaggacggccctctgtacgttattgtggaatacgcaagcaaaggcaacttaagggaatacctgcgggctcggaggccgcctggaatggagtactcatacgatatcaaccgcgtgccagaggagcagatgacctttaaagacctcgtttcttgtacttaccagttggcacggggaatggagtacttagcaagtcagaaatgtatacacagagatctggccgcacggaatgtgcttgttactgagaacaatgtgatgaaaatagctgactttggtctggctcgagacatcaataacatcgactactataaaaagaccacgaatggacgactgcctgtgaaatggatggccccagaggcattgttcgacagagtctacacccatcaatccgacgtgtggtccttcggggtgctcatgtgggagatctttactcttggtggatccccatatccagggattccagtcgaggaactctttaaactcttaaaggagggccatagaatggacaagcctgcaaactgcacaaatgaactgtatatgatgatgagggattgctggcacgcagtgccttcacagcgtcccacatttaaacagctggtcgaggatctggataggattcttacactcactaccaacgaagaagaaaaaaaggtctcaggtgccgtggactgccataaacccccatgtaatccatcccacctgccgtgcgtgctcgctgtcgaccagtag

SEQ ID NO: 223241 - DNA, 2466 bp, Artificial Sequence
  Description of Artificial Sequence: Synthetic coding sequence
atggtttcgtggggtaggttcatctgtctggtggtggttaccatggccacactcagcctggccaggccttccttctccttggtagaagataccactcttgagcctgaagagccacccaccaagtatcagatttcacagccggaagtttatgtggcagcgccaggggaaagccttgaggtacgttgcttgcttaaagacgccgctgttatctcctggacgaaggacggcgtacacctcggacccaacaataggacggtactgatcggggagtatctgcaaattaagggagcgactccaagggacagcgggctctatgcgtgtacagctagcagaactgtggactccgaaacttggtacttcatggtgaacgtgactgacgcgattagttctggagatgacgaggacgataccgatggtgcagaagacttcgtgtcagagaattctaataataagagagccccatactggaccaacacagaaaaaatggagaagagattgcatgccgtcccagcagcaaacaccgttaagtttagatgcccagcaggcggaaacccaatgcccacgatgaggtggctaaaaaatggcaaggagtttaaacaggaacataggataggcggatacaaggtgcgcaatcagcattggagccttatcatggagtctgttgtaccatctgacaaaggcaactacacttgcgtggttgagaatgaatatggatcaatcaaccacacctatcatctggacgtcgtggaaaggtcccctcatcgacctattctgcaggccggtctccccgctaatgctagtactgtggtaggtggcgacgttgaatttgtgtgtaaagtctactcagatgctcagcctcatatccagtggattaaacacgttgaaaagaacggatcaaagtacgggccagacgggctcccgtatctcaaggtgttgaaggccgcaggagtgaacacaacagacaaagaaattgaggtactttacattagaaacgtcacatttgaggatgctggggaatacacatgtcttgccggaaatagcatcggtatcagctttcactctgcatggctcaccgtgctgccggcaccagggagggagaaggaaatcactgccagccccgactacctggagatcgccatatactgtatcggggtatttctgatagcctgcatggtggtgactgtgatcttatgtagaatgaagaacacaacgaagaagccagatttttctagccagcctgcagtccataaattaacgaagcgtattcctcttcgcagacaagtcaccgtgagcgcagagagttcatcttcgatgaactctaatacgcctctggtccgcataacaacccggcttagcagcacagcggacacgcccatgctagccggagtgagcgagtacgagttgccggaagatcccaaatgggagtttcccagggacaagttgaccctggggaagcctctaggagagggatgttttggccaggtggtaatggctgaggcagttggcattgacaaagacaagcccaaagaggccgtcaccgtggctgtaaagatgcttaaagatgacgctacagagaaagatttgtcagacctggtgagcgagatggagatgatgaagatgatcggcaagcataaaaatatcattaacctactaggggcttgcacccaggatgggccactgtacgtgatcgtggaatacgcgtctaagggaaacctgcgggagtacctccgtgcacgcaggccaccgggtatggagtattcttatgatataaaccgggtgcccgaagaacagatgacttttaaggacctcgtttcttgtacatatcagctggccagaggaatggaatacctggcaagtcagaagtgtatccatagggacctcgccgctcggaacgtcttggtgacagagaacaatgtgatgaaaatagccgatttcgggctcgcacgagatatcaacaatatcgactactacaaaaagacaactaacgggaggctgcctgtgaagtggatggccccagaagcactttttgatagggtgtatacacatcagagcgatgtctggtcattcggcgtactcatgtgggaaatttttactctgggaggcagcccataccctgggattccagtcgaggagcttttcaaacttctgaaggagggccatcggatggacaagccggctaactgcaccaatgaattatacatgatgatgagggattgctggcacgcagttccatcacaaagacccacttttaagcaactcgttgaggatctggataggatcctcaccctcactactaacgaagagtacttggacttatcccagcccctggaacaatatagcccttcctaccccgatactcggagttcctgtagcagtggggatgattcagttttttccccagatcccatgccctatgagccatgcttaccacaatacccccacatcaatggcagcgtgaaaacctag

SEQ ID NO: 223242 - DNA, 765 bp, Artificial Sequence
  Description of Artificial Sequence: Synthetic coding sequence
atggtgagctgggggcgatttatttgcctggtggtcgtgacaatggccacactcagccttgccagaccgtctttctctctggtggaggacaccaccctcgaaccagaagaaccccctactaagtaccagatatctcagcccgaggtgtatgtggcggctcccggtgaaagcctcgaagtcagatgtctactgaaggacgccgctgtgatttcttggacaaaggatggtgtccatctgggacctaataatcggaccgtgttaatcggggagtacctccagatcaagggggctacaccccgtgactctggactctacgcctgcactgcaagtcgcaccgttgactctgaaacatggtattttatggtcaatgtaaccgacgccatttcatccggcgatgacgaggatgacaccgatggggcagaagacttcgtgtcagaaaatagtaataataagagagcgccatattggactaacactgagaaaatggagaagcgcctgcacgccgtcccagctgcaaatacagtaaaatttaggtgccccgcagggggaaaccccatgccaacgatgcgctggttaaagaatggaaaggaattcaaacaggagcacagaattggagggtataaagtgagaaatcagcattggtcactgatcatggagagtgtggtgcccagtgacaaggggaactatacttgcgtcgtggaaaacgaatacggcagcattaatcacacctaccaccttgacgtggtcggaagccaaggactctag

SEQ ID NO: 223243 - DNA, 2043 bp, Artificial Sequence
  Description of Artificial Sequence: Synthetic coding sequence
atggtttcgtgggggaggtttatctgtctagtggttgttacgatggctacacttagtttggcgcgaccttctttctccctagtcgaggacacaacgctggaaccggaggatgcaataagcagtggtgacgacgaggacgacacagacggagcggaggacttcgtcagtgaaaattccaataataagcgggcaccttattggactaacaccgaaaaaatggaaaagcggctgcacgccgttcccgctgccaacactgtcaagttccgctgtcctgccggaggtaatccaatgcctactatgcggtggcttaagaatggcaaggagttcaagcaggagcatcggattgggggttacaaggtaagaaaccagcattggtccctcataatggagagcgtggtcccctcagacaaaggcaattacacatgtgtggtcgagaacgagtacggttctattaaccacacttaccacttggacgtggtggagcgcagcccacaccggccaattttacaagctggactacccgctaatgccagtactgtcgtgggcggtgacgtggagttcgtgtgtaaggtgtacagcgatgcccagcctcatatccagtggatcaagcacgttgagaagaatgggagtaagtacggcccagacgggttgccttatttgaaggtcttaaagcactctggaataaactcgtccaatgctgaagtgttagctctgttcaacgtcaccgaagccgatgccggagaatatatttgcaaggtctctaactacatcggtcaggcgaatcagtctgcgtggcttacagtccttccaaagcaacaggcccctggtcgtgagaaggagattaccgcctcaccagactatctggagatcgctatctactgtatcggcgtctttctgatcgcctgcatggtagtgactgtcatcctgtgtaggatgaagaacactaccaagaagcctgacttcagctcacagcctgccgtgcacaagttgactaaacggatacccctgcgaaggcaggttactgtaagtgccgaatcctcttcatctatgaactccaatacacccctcgtccgtattaccacacggctcagctccactgccgatacacccatgctggccggagtctccgagtacgagctgccagaggatcccaagtgggaattccccagggacaaattgaccctgggcaaacccctgggagaaggatgcttcggccaggtggtaatggcagaggccgtcggtatcgacaaggataagccaaaggaggcagtgactgtagcagtgaagatgctgaaagacgatgctacagaaaaagatctgtctgaccttgtgagcgaaatggagatgatgaaaatgatcgggaagcataagaacataattaaccttctgggagcctgtacacaggatggcccactctatgtgatcgtcgagtatgcttctaaggggaatctaagggaatacctgcgtgctcgaaggcctcctggtatggagtactcttacgacatcaaccgtgttccagaagaacagatgacctttaaagacctggtctcctgtacttaccagctggcccgaggtatggagtacttggcctcccagaagtgcatccaccgggatctggctgccagaaatgtactggttaccgaaaacaacgtgatgaaaattgcagattttggactggcccgagacataaacaacatcgactactataaaaagacaacgaacggacgcctccctgtgaaatggatggcaccagaggctctcttcgaccgcgtgtacacccatcaatcagatgtgtggtcattcggagtccttatgtgggagattttcactttgggcggatctccatacccgggaattcctgtcgaggaactgttcaagttgctgaaagagggccatagaatggataagcctgcaaattgcaccaatgaactctatatgatgatgcgggactgctggcacgctgtgccgtctcagagaccgactttcaaacagctcgtcgaggacctcgatcgcatcctcaccctcaccacaaacgaaatctag

SEQ ID NO: 223244 - DNA, 2310 bp, Artificial Sequence
  Description of Artificial Sequence: Synthetic coding sequence
atggtgtcgtgggggcgatttatttgtctggttgtcgtgacgatggccacactctctcttgcacggccatcatttagtttggtggaagacactactctggaacctgaagagccgcctaccaagtatcagattagccaaccagaagtgtatgtggctgccccaggtgaatccctggaagtacgatgtctgctgaaggatgctgccgtgatcagctggactaaagatggggtccatctggggcctaacaacaggaccgtcctgatcggcgagtatctgcagattaagggggctactccaagagatagtggcttgtacgcatgtaccgcctctcggacggtcgatagcgaaacatggtacttcatggtcaacgtgacggacgcaatctccagcggtgacgatgaagatgataccgacggagctgaagactttgtgtccgagaactctaataacaagcgagcaccctattggacaaatacggaaaagatggaaaaacgattacacgccgtgccagctgccaacaccgtgaagtttcgatgtcctgccggaggcaatccgatgcctacaatgagatggctgaaaaacggcaaagagttcaagcaggagcacagaatcggcggatacaaggttaggaatcagcattggtcattgataatggagagcgtggtcccgtcagacaagggcaattacacttgtgttgtggagaatgaatatgggtccatcaaccacacttaccacctagacgttgtggaaaggtcaccacatagacctattctccaggccggactcccagccaatgccagcaccgtcgtcggcggagatgtggagtttgtgtgtaaagtgtacagcgacgcacagcctcacattcagtggattaagcacgtggagaaaaatggatctaaatacggccctgatggtctcccttacctgaaagtgctgaagcactcggggattaattccagcaatgcagaagttctggccctttttaatgtgaccgaggccgacgccggtgagtatatttgtaaggtatctaattatataggacaggcaaatcaatccgcatggctgaccgtcctgcccaagcagcaggcaccgggtcgagaaaaggagataacagccagccccgattacctggaaattgccatatattgcatcggcgtgttcctgattgcctgcatggtcgtcaccgtaattttatgccgcatgaagaacacgacaaaaaagccagactttagttcccaaccagccgtccataaactgacaaagaggattccactgcgacgacaagtgactgtaagcgcagaatctagcagcagcatgaatagcaatactcccctggtacgcatcacaactagattatccagcacggcagacacgcccatgctggccggagtgtctgagtacgaactccccgaagatccaaagtgggagtttcctcgggacaagctcacactcggcaaaccactgggcgaagggtgttttggtcaggtggttatggccgaagctgtgggcattgacaaggacaaaccgaaagaggctgtaacggtcgctgttaagatgctgaaagatgacgcaacagagaaggatctatccgacctggtcagcgagatggaaatgatgaagatgattgggaagcacaagaacatcataaatctcctaggcgcatgtacacaggatggcccactatacgtgattgtcgagtacgcttccaagggcaatttgagggaatatctgagggcaagacggccaccaggaatggaatacagctatgacatcaatcgagtcccagaggagcaaatgacgtttaaggatctggtgtcctgtacataccaacttgctcgcggtatggagtatctggcctcccaaaagtgtatccatcgggatctggctgctcgcaatgtgctggtgactgaaaataacgtgatgaaaatcgctgatttcggcctcgcccgtgatattaataatattgattattacaagaaaactaccaatgggagactgccagtgaagtggatggcacctgaggcattgttcgatagagtttatacccatcagagtgacgtgtggtcgttcggggttctaatgtgggaaatattcacgctaggaggaagcccctacccaggaatacccgtggaagagctcttcaagctcctgaaggaaggccatagaatggataaacctgcgaattgcaccaatgagctttacatgatgatgcgggactgctggcacgccgtgccctcccagcggccaacatttaagcagctcgttgaagacctagacagaattttgactctgacaactaacgagatttag

SEQ ID NO: 223245 - DNA, 2307 bp, Artificial Sequence
  Description of Artificial Sequence: Synthetic coding sequence
atggtatcatggggacgttttatctgtctcgtcgttgtgacaatggccacgcttagcttagcacgaccctccttctcactcgtggaggatacaactcttgaaccagaggagccccctaccaagtaccagatatcccaacccgaggtgtatgtagctgctcctggtgaatccctggaggtgcgatgtctgctgaaggatgctgctgtaatatcctggaccaaggacggtgtgcacttaggtccgaataatcgtaccgttctgatcggcgaatacttgcagatcaagggtgccacgccgcgtgactctggactgtatgcatgcacagcttctcgcacagtcgattccgaaacctggtattttatggtgaatgtcactgatgctataagctccggcgatgatgaggatgataccgacggagctgaggattttgtttccgagaattctaataacaagcgggcaccgtactggaccaatacggaaaagatggaaaaacgtctgcacgccgtccctgcagcgaacactgtcaaatttcggtgcccagccggaggaaatcctatgcccacaatgcggtggctaaaaaacggcaaggagttcaaacaggagcacagaatcgggggatacaaagtccggaaccaacattggagcctgatcatggagtccgtcgtgccttccgacaaggggaactacacctgcgtcgtcgaaaacgaatacgggtccatcaaccatacataccacctggatgtggtggagcggagcccacataggcctatccttcaagccggtttacccgcaaatgcctctacagtggttggaggcgatgtggagttcgtgtgtaaagtttattctgacgcacaaccacacattcagtggatcaagcacgtggagaagaacggttccaaatatggacccgacgggctcccgtatttgaaagtgttgaagcattcgggaatcaattctagcaacgccgaggttctggcgctgttcaacgtgaccgaagcagatgctggagagtatatctgtaaggtttccaactacatcggccaggctaaccagagcgcatggcttacagttttgcctaaacagcaagcaccaggcagagaaaaagagattaccgctagtcctgattacctggaaatcgctatctactgtataggcgttttcctgatcgcttgtatggtcgttaccgttatcctgtgccggatgaagaacaccacgaagaagccagacttttctagccagcccgctgtgcacaagttaacaaaaagaattcctctcagacgccaggttactgtgtccgctgagtcatcatcctcaatgaatagcaataccccgctcgtacggatcaccacccgactctcctccaccgcagatactcctatgctcgcgggagtctccgaatatgaactgcccgaggatccaaaatgggagtttcccagggacaaacttaccctgggaaagccccttggcgaggggtgcttcgggcaggtcgttatggctgaggctgtgggaattgacaaggacaagcccaaagaggccgttaccgtcgccgtgaagatgcttaaggatgatgctactgagaaagatctttccgatctagtcagcgagatggaaatgatgaagatgattgggaagcataagaatatcatcaacctgttgggcgcttgtactcaagatggcccactctatgtgatcgtggagtacgcatctaagggaaacctgagggagtaccttcgcgctcgcagacctccaggaatggagtactcgtacgatattaacagggtgcccgaagagcagatgacatttaaagacctggtctcctgtacttaccaactcgccaggggcatggagtatctggcatcccaaaaatgcatccacagggatctcgcagcgcgaaacgtgttggtgaccgagaataacgtgatgaagatcgctgattttgggctcgctcgcgacattaacaatatagactactacaaaaagaccaccaatggtcgactgcctgtgaaatggatggcccctgaggccctgttcgacagggtgtacactcaccagagcgatgtatggtcgtttggagtcctgatgtgggagattttcaccttgggagggtccccctatcccggaatccccgttgaagagctcttcaagctgctcaaagagggccaccgcatggacaagccagcaaactgtaccaatgaactttacatgatgatgcgggactgttggcacgctgtgccctctcagagacccactttcaagcaacttgtggaggatctggatcggatccttactcttacaacaaacgaatag

SEQ ID NO: 223246 - DNA, 2124 bp, Artificial Sequence
  Description of Artificial Sequence: Synthetic coding sequence
atggtcagttggggtcgatttatctgcctcgttgtcgtcacgatggccacactgtcccttgcccgacccagttttagtctagtggaagatactacactggaaccagaaggtgctccttattggactaatacagaaaagatggagaaacgcctgcacgctgtgcccgcagctaatacagttaaatttcgatgtcccgctggtgggaaccccatgccgaccatgaggtggcttaagaatggcaaggagtttaaacaggaacatcgaatcgggggatacaaggttaggaaccagcactggtccttgattatggagtccgtcgtgccctcggacaaaggaaactatacctgcgtagtggaaaatgagtacggctccataaatcatacttatcacctggacgtggtggagcggagcccgcaccgtcccatcttgcaggctgggcttccggctaacgcgtcaacggtcgtgggcggagacgtggagtttgtgtgcaaagtgtacagtgatgcacagcctcatatacagtggattaagcacgtggaaaagaatggcagcaagtatggcccagacggcctgccctatctaaaggttctgaaacatagtggcatcaattcgagcaacgcagaggtcttagccctctttaacgtcaccgaagcggatgccggtgagtatatctgcaaggtctcaaactacattggtcaggccaaccagtccgcctggctgaccgtgttaccaaagcagcaagcacccggacgggaaaaagagatcacagcctcacccgactacctggaaattgccatctactgtataggagtgttcctcatcgcctgcatggtggtgaccgtcatcctttgtcgaatgaagaacaccactaagaaacccgatttttcctcccaacccgctgttcacaaactcaccaagcgcatccctctccgaaggcaagtcaccgtctctgcggagagcagctcttccatgaacagtaacacgccactagtgagaatcaccaccagactgagtagcaccgccgacacaccaatgctcgccggagtctcagaatacgagctgcccgaagatcctaagtgggagtttccaagggacaagctcaccctgggcaaacccttgggagagggctgcttcggacaagtggtgatggctgaggccgtcggcattgataaagacaaacctaaagaagcagtcacagtggccgtgaagatgctgaaagacgatgccacggagaaggatctgtccgatcttgtctccgaaatggaaatgatgaagatgattggcaaacacaaaaatatcattaaccttctcggcgcttgtacacaggacgggcctctctatgtgatcgtagagtacgcttcaaagggcaatctgcgtgaatacctacgcgctaggcggccacctgggatggagtattcatatgatatcaacagggtgccagaggagcagatgacatttaaggatctggtgagctgcacctatcagctcgccagggggatggagtatttggcatctcagaagtgtattcatcgggacctggctgccaggaacgtactggtaacagaaaacaacgttatgaaaatagccgatttcggtctggcgagggatatcaacaacatagactattacaaaaaaaccacgaacggccgactgcctgtgaaatggatggctcccgaggccctgtttgaccgcgtctatacacaccagtccgacgtgtggtctttcggcgtactcatgtgggaaatctttaccctgggcggaagcccatatcctgggatacccgtcgaggagcttttcaaactgctgaaagaggggcaccgcatggacaagccagcaaattgcacaaacgaactatacatgatgatgagagactgttggcacgctgtcccctcccagcggccaaccttcaaacaactggtagaggatcttgacaggatcctcactctgacgacaaatgaggagtatttggacctttcccaaccgctggagcagtattcacctagctatcctgacacaagaagttcttgtagctctggggacgacagcgttttttcccctgatcctatgccgtacgaaccatgcctgccacagtacccccatatcaacggctcagtcaagacctag

SEQ ID NO: 223247 - DNA, 2118 bp, Artificial Sequence
  Description of Artificial Sequence: Synthetic coding sequence
atggtcagctggggaaggttcatttgcctggtcgtggtgacgatggcgacactgagcctggcaaggcccagcttttctctggtggaagatacaacactggagcctgaggagccacctactaaatatcaaatttctcagcctgaggtatacgttgccgctcctggcgagagcctcgaggtacgctgcttactgaaagatgctgctgtgatctcctggactaaagacggagtacacctgggtcctaacaatcgtactgtgcttatcggcgaatacctgcaaatcaaaggagctacacctcgggattccgggctctatgcttgcactgcgagcagaaccgtggattccgagacatggtacttcatggtcaatgtaaccgacgctatttcatcaggggatgacgaggacgacaccgatggggctgaggatttcgtctcagagaattccaacaataagcgagcgccttactggactaataccgagaagatggaaaaacggctgcacgcagtgccagctgccaatactgtgaaatttcgatgcccagcagggggaaaccctatgccaacaatgcgttggctgaagaacggaaaggagttcaagcaggagcatcgcattgggggttacaaggttcggaatcaacactggtcattaataatggaaagcgtggtgccctccgacaaagggaactatacctgcgtagtggaaaatgagtacgggtccatcaaccacacttatcacctggacgttgtcgaaaggtcccctcaccgcccaatcttgcaagcgggattgcctgcaaacgcttccaccgtggttggcggagacgtagagtttgtctgtaaggtctattcagacgcccagccacatattcagtggatcaagcatgtggaaaagaatggtagcaaatacggtcctgacggactgccctacctgaaagtgctgaaagtgagcgccgagagttcttcaagcatgaactctaatacacctctggtgcggataacgacccgcctgtcctcgaccgctgatacacccatgcttgccggtgtgtctgagtacgaactgcccgaagaccctaaatgggagttccccagggacaaactgacgctggggaaaccattgggcgaggggtgtttcggtcaagtggtgatggcggaggccgtcgggattgataaagacaaaccaaaggaagcagtcaccgtcgcggtgaaaatgcttaaggacgatgcgacagagaaggacctgtctgatcttgtctcagagatggagatgatgaagatgattgggaaacacaaaaatatcattaacttgctgggggcttgcacccaggacggtcctctgtacgtcatcgttgaatacgcatctaaaggaaacttaagagagtacctgagggcccgaaggccccctggcatggaatatagttacgatatcaatagggtgcccgaggaacagatgacttttaaagacctcgttagctgcacctatcagctggctagggggatggagtacctcgcctctcagaagtgtattcatcgagacctggccgcacggaacgtgcttgtcacagagaataacgtaatgaaaattgctgacttcggtctggccagagatattaacaatatagactattacaagaagacaacaaatggcagactgccggtcaaatggatggcaccagaggcgttgttcgacagggtttatacacaccagagtgacgtctggtcgtttggggtcctgatgtgggagatctttacactcggcggatcaccttatcctggtatacctgtagaagagttgttcaaactgctgaaagagggacatcggatggacaagccggcaaattgtactaacgagctctatatgatgatgagagattgctggcacgccgtgccgtctcagaggcctacgttcaagcagctggtggaagacctggatcgcattttaacgctgacaaccaacgaggaatatctcgatctgagccagcctcttgagcagtattctccctcctaccccgatacaaggagttcgtgttcttccggagacgacagcgtgttttcccccgaccctatgccatacgagccatgcctcccacagtacccccacatcaacggttccgtgaaaacctag

SEQ ID NO: 223248 - DNA, 2130 bp, Artificial Sequence
  Description of Artificial Sequence: Synthetic coding sequence
atggtgtcttggggcaggtttatttgcctcgtggtcgtgacgatggccactctatctcttgcgaggccctctttctccctcgttgaggatacaacactggagccagaggaaccaccgaccaagtaccagatttcccagcctgaagtttatgtggcggcacctggggaatccctggaagtgcgatgtcttttgaaggacgccgcagttattagctggaccaaagatggagtgcacctggggcctaataatcggactgtactcattggcgagtacctgcagatcaaaggagctactcccagagatagtggcctgtatgcgtgcactgccagccggaccgtggactccgaaacctggtacttcatggtgaatgttacggatgcaatctcttcaggagatgatgaagatgatactgatggggctgaagactttgtgagcgaaaattctaataacaagcgggcaccctactggaccaatactgagaagatggaaaaacgactgcacgccgtgccggctgcaaatacagttaagtttagatgtccggctggaggcaatcccatgcccactatgaggtggctgaagaacggaaaggagttcaagcaggaacacagaattggcggttataaggtgagaaatcagcactggtcactgatcatggagagtgtggttccatctgacaagggaaactatacttgtgttgtggaaaatgagtacggctctataaatcatacctaccatctcgacgtggtcgcacctggacgcgagaaagagattacagccagcccagattacctggagatcgcaatctactgtattggcgtttttctgattgcctgtatggtcgtgacggtgattctgtgtcggatgaagaatactaccaagaaacctgattttagctctcagcctgctgttcacaagctgactaaaaggatcccccttcggaggcaggtgacggttagcgccgaatcctcaagctccatgaactctaatactccactcgtgcggattacaacccgactttcatcgactgctgatacacctatgctggctggggtgagcgaatacgagttgcctgaagaccccaagtgggagtttcctagagataagctgacactgggcaagccgctgggggagggttgttttgggcaagtcgttatggccgaagccgtcggtatcgacaaagacaagcccaaagaggcagtgacagtggccgtgaagatgttgaaagatgatgccaccgagaaagacctttcggacctggtttctgagatggaaatgatgaagatgatcggcaaacacaagaacataattaatctgctcggcgcatgcacacaggacgggccactctatgtaattgtcgagtatgccagcaaaggtaatcttcgagaatatctgagggctaggcgccctcctgggatggaatattcttatgatatcaacagggttccagaggagcagatgactttcaaggaccttgttagttgtacataccagctggcccgaggcatggaatatctcgcaagccagaagtgcattcacagagacctcgccgctcgaaacgtgctggtaacagaaaataatgtgatgaagatagcagattttggacttgcgagggacattaataatatagattactataagaagaccacgaacggaaggttacccgtgaaatggatggcccctgaggctctgttcgaccgcgtgtacacacatcagtctgatgtatggagctttggagttctaatgtgggaaattttcacattgggcggatctccatatcctgggattcccgtcgaagagctattcaaactcctgaaagaagggcaccggatggataagcctgccaattgtacaaacgaactctacatgatgatgagggactgctggcatgctgtgccttctcagaggccgacttttaaacagctggtagaagatcttgaccgcatcttaacactcacaacaaatgaagagtaccttgacctctcccagcccttagaacaatattctcccagttacccagatacaagatcctcctgtagcagcggtgatgacagcgtgttttctcctgatcctatgccctatgagccttgcctacctcagtaccctcatataaacggatccgttaagacatag

SEQ ID NO: 223249 - DNA, 2469 bp, Artificial Sequence
  Description of Artificial Sequence: Synthetic coding sequence
atggtcagctgggggcgatttatttgcttagttgtggtcactatggccacactatctttagctcggccttcctttagcctcgttgaagataccacattagaacccgaggagccccctaccaaatatcaaattagtcagcctgaggtctatgtcgcagcccctggtgaatcactagaggtacggtgtctgctgaaggatgcagccgtcatcagctggacaaaggacggagttcacttgggcccaaacaacagaactgtcctgatcggcgaatacctccagattaaaggagcaactcctagggactcggggctgtacgcctgtacagcatctaggaccgttgatagtgagacatggtacttcatggtcaacgttacagacgcaatctcgtctggcgatgatgaagatgatactgacggcgcagaggatttcgtgtccgagaattcaaataacaagcgagcaccatactggaccaataccgagaaaatggagaagcggctgcacgcagttccggcagcaaacactgtcaagttccggtgtccagccggaggcaaccctatgccaacgatgcgctggctgaagaatgggaaagaatttaaacaggagcatcgaattgggggatacaaagtccgtaatcagcactggtcgctcataatggaatccgtggtccccagtgataagggtaactacacatgtgtggtcgagaacgagtacggctccatcaaccatacgtatcatctcgatgtggtcgaaaggagccctcaccgcccaatcctccaggccggattgcctgcgaatgcttcgaccgtggttggtggggatgttgaattcgtctgtaaagtttactcagatgcccagccgcatattcagtggatcaaacacgtcgagaaaaacggcagcaagtacggccctgatgggctcccttatctgaaagtgctgaaggtgactaaggcggctggggtcaacacgacggataaagagatcgaggtgctgtacatccggaatgtgaccttcgaagacgccggtgagtatacatgtttggccggaaattctatagggatctcattccactcagcatggctgactgttctcccggctccaggtagggagaaggaaataactgcatccccagactacttagagatcgctatctactgtattggcgtgttcctaattgcttgtatggtcgtgacagtaattctgtgtaggatgaagaacaccaccaagaaacctgacttcagttcccagcctgccgtccacaagctgactaagagaattcctctcagaagacaggtcagcgctgagagcagtagcagcatgaactccaatacgcccctggtacgtatcaccactagactgtcttccacggcagatacccccatgctcgccggtgtgtccgaatatgagctgccagaggatccgaagtgggaatttccaagagacaaactaacccttggaaagcctctcggtgagggttgcttcggtcaggtggttatggctgaggccgtcgggatagacaaggacaagcctaaggaagctgtgaccgtggccgtgaagatgctgaaggatgacgctacagaaaaggatctctccgatctggttagcgagatggaaatgatgaaaatgatcggtaagcataagaatataattaacctgctgggcgcatgcacacaagacggcccactgtacgtaatcgtcgaatacgcctccaaggggaatcttagagaatacttacgggcacgacggcctccaggcatggagtactcgtatgatattaaccgcgttcctgaagaacagatgaccttcaaagacctcgtgagctgtacctatcagcttgcacgcggtatggaatatttggcgagccagaaatgtatacaccgggatcttgcagcccgaaatgtgctggtgacggaaaacaacgtcatgaaaatcgccgactttgggctggccagagatatcaataacatcgattactataagaagaccactaatggtaggctgccagttaagtggatggcccctgaggcacttttcgatcgggtgtacacccatcagtctgatgtatggtcttttggcgtgttaatgtgggagatctttactctgggaggttctccttaccccggaattccggtagaagagctattcaaactcctcaaggaaggccatcgtatggacaaacctgccaactgtaccaacgaactgtacatgatgatgcgggactgctggcacgccgtgccaagccagcgtccaacgttcaaacagttagtggaagacctagataggattctgacactgaccaccaacgaagaatacttagacctgtcacaacccttagagcagtatagtccatcttacccagataccagatcaagttgctcctccggagatgatagcgtgttctctcctgaccctatgccctacgaaccatgccttccgcaataccctcatatcaacggcagcgtgaagacttag

SEQ ID NO: 223250 - DNA, 2469 bp, Artificial Sequence
  Description of Artificial Sequence: Synthetic coding sequence
atggtctcatggggtcggtttatctgtcttgttgtggtcactatggcaaccctctctctggccaggccctctttttcactcgtggaagacacaacccttgaacctgaggaaccacccactaaataccaaatctcacagcctgaggtctatgtggccgctcccggagagagcctggaggtgagatgtctgctgaaagacgcggcagtgatctcatggacgaaagacggggttcacttgggaccaaataatagaacagtgctgatcggggaatacctgcagatcaaaggcgcaactcctcgcgatagcggcctttatgcctgcaccgcgagtcgtacagtggattcagaaacctggtactttatggtcaacgtaacagacgcgatctctagtggagacgacgaggacgacacagacggcgctgaggacttcgtgagcgaaaacagcaataacaaaagagcgccatactggaccaataccgagaagatggaaaagcggctccatgcagtgccagcagctaacacagtgaaatttaggtgccccgctgggggaaatcctatgcctactatgaggtggctaaagaatggaaaggagtttaaacaggagcaccggatcggcggatacaaagtgcgtaaccagcattggtctcttatcatggaaagcgttgtgccctcggacaaaggtaactatacttgtgtcgttgagaacgagtatgggagcataaaccacacctatcacttagatgtcgttgagaggtcgccccaccgacccattctccaagccggtctgcccgcaaacgcgtctaccgtagttggcggagatgttgaattcgtttgtaaggtgtactcggatgctcagccacacattcagtggattaagcatgtggagaaaaacggaagcaagtacgggccagacggtctcccttatctcaaggttctcaaacattctggaatcaacagttcaaacgctgaggtactcgcactgttcaacgttactgaagctgacgcaggtgagtatatctgtaaagtgtctaattacattggtcaggccaatcagagtgcatggctgaccgtcctgcccaaacagcaggccccaggcagagagaaggaaatcaccgcatcccctgactacttggagatcgctatctactgcatcggagtgtttttgattgcctgcatggtagtgactgtgatcctgtgcagaatgaagaatacaacaaagaagcccgacttttcatctcagcccgcagtgcataaactaaccaagcgaatacccctccgcaggcaggtcaccgtgtccgctgaatcttctagttctatgaactcaaacactcctctggtcaggattacaactcggctctcctccaccgccgacacacccatgctcgccggagtttcggagtacgaacttcccgaggatccaaagtgggaatttcccagggataagttaacgctcgggaagcctctgggagagggctgcttcgggcaagtggtaatggcggaagcggtgggaattgacaaagataagccaaaagaagctgtgacagtggcagtgaaaatgctgaaagacgacgctactgaaaaagatttatctgatctcgtcagcgagatggagatgatgaaaatgatcggcaaacataagaatattatcaatctccttggggcttgtactcaagatgggccactctacgtgattgtggagtacgcaagcaaggggaatctgagggagtaccttcgcgcacggagaccaccgggtatggaatatagctatgacataaatcgcgtaccagaggagcaaatgactttcaaagatctggtatcctgtacttatcagctcgcgcgaggaatggaatacttggcatcccagaagtgcatacacagggacctcgccgcacgcaacgtcctcgtgacggaaaacaacgtaatgaaaattgccgacttcggcctagccagggatatcaacaatattgattattacaagaagaccaccaatgggaggctacccgtgaagtggatggcgcctgaggcgctgttcgatcgcgtgtatacccaccaatcggacgtttggtctttcggcgtgttaatgtgggagattttcacattaggtggctcaccttatccaggtatccctgtggaggagctgtttaagctgctgaaggaagggcatcggatggacaagcccgctaattgtacaaacgagctgtatatgatgatgcgcgattgctggcatgcagtgccatcccagcgccctactttcaaacagttggtcgaggacctcgatcgaattttaacccttacaacaaatgaagaatatcttgatttatctcagcccctggagcagtacagtccatcatatcccgacacccgatcttcctgttcttctggagacgattcagttttttcacctgatcccatgccctacgagccttgcctgccccagtacccccacatcaacggctctgtgaaaacctag

SEQ ID NO: 223251 - DNA, 1515 bp, Artificial Sequence
  Description of Artificial Sequence: Synthetic coding sequence
atgaccccaagtccactgcttctgctgttgctacctcctttgctgcttggagcctttccacccgcagctgccgcaagggggcctcctaagatggccgataaggtggtgccacggcaggtagcaagactcggcaggactgtgcgactgcagtgccccgtggagggtgatccccctccccttactatgtggacaaaagacgggaggacaatccacagtggttggtccagattccgcgtgcttccgcagggccttaaagtgaaacaggttgagagagaagatgccggagtctatgtctgtaaggccacgaacgggttcggatctctgagcgtgaactacactctggttgttttagacgacatttccccaggcaaggagtcacttggcccagacagcagcagtggcggtcaggaagacccagcttcacaacagtgggcacgcccaaggttcacccagccctctaaaatgagaagacgggtgatagctaggccagtgggttcaagtgttcggttaaagtgtgtggcgagcggccatccacgccctgatattacctggatgaaagacgaccaagccctgacccgacccgaagcggctgagcccagaaagaaaaagtggactttgagtttaaagaacctgcgacccgaggattctggaaaatacacatgcagggtgtctaaccgggcaggggcaattaatgctacgtataaagttgacgtgatacagcggacacggtccaaacctgtgctgactggcacacatccagtaaatactacagtggacttcggtggtacgacaagcttccagtgtaaggtccgaagtgacgttaaacccgtcatccaatggctcaagcgcgtggaatatggggctgagggcaggcataatagcactatcgacgtgggcggacagaaattcgtggtcctccccacaggggacgtctggtctagacctgatgggtcctacttgaacaagttattgatcacccgagctagacaagacgatgcaggtatgtacatctgtctgggagctaacacaatgggctacagctttcggagcgctttcctgaccgtgctgcccgatccaaaacctccgggaccacctgtggccagttcttccagtgcgacctcactaccctggcccgtggtcataggtattcctgccggtgccgtgttcatcctcggtactctcctgctttggttgtgccaggcccagaaaaagccatgcactcccgcaccggctcccccactacccggacatcggccacccggaaccgctcgcgatcggtctggcgacaaagacctgccttccctggcggctctgtctgcaggaccaggtgtgggcctgtgcgaggagcacggctctccggctgccccacagcacctgctgggcccaggtccagtcgccggacccaaattgtatcctaagctctataccgacattcacacgcacacacacactcactcccacactcactcacatgtcgagggaaaggtccaccagcacatccactatcagtgctag

SEQ ID NO: 223252 - DNA, 1515 bp, Artificial Sequence
  Description of Artificial Sequence: Synthetic coding sequence
atgacacccagcccactgttgcttctcctgttgcctcctcttttactcggcgcatttccacccgcagctgcagctagaggccctccaaagatggccgacaaggtcgtgccccgtcaggttgccagacttggacggaccgtgagactccagtgtcctgtggaaggtgatccgccaccgctcactatgtggaccaaagatggtaggaccatccattcaggctggagccggttcagggtgctgccccagggactgaaggtcaagcaggtcgagcgggaagacgcaggtgtttatgtctgtaaagcaacaaatgggttcggatccttatccgtgaactatactctggtagtgctcgatgacatctctcccggtaaggaatccctcggtcccgattcaagtagcggcggtcaggaggaccctgcctcacaacaatgggccagacccagattcacacaaccatctaagatgagaaggagagtgatcgcacgccctgtgggcagctcagtacgtctgaaatgcgtcgcctcaggtcatccccgtccggacataacatggatgaaagatgaccaagcgttgaccaggcccgaagccgcagagccccgaaaaaagaaatggacactctccttgaaaaacttgcgccctgaagatagtggaaaatacacctgtcgcgtttccaatcgcgcaggggcaattaatgcaacgtacaaggtggatgtcatccaacggactaggtcaaagcccgtgcttaccgggacgcacccagtgaacaccaccgtcgactttggcggaacaacctcgttccagtgtaaggtgcgctccgatgtgaaacccgtgatccagtggttgaagcgtgtcgagtacggggctgagggcagacacaacagcaccatcgacgtcggtggacagaagttcgtcgtcctccctacaggggacgtgtggagtcggccagatggctcctacctgaacaagctgctgatcaccagggctaggcaagacgatgccggaatgtacatctgtctgggagcaaacactatgggctacagcttcaggtccgcattccttacagttttgccagatcccaaacctccaggccctccggtggcttctagttcttcggctacatcgctcccatggccggtggtcattgggattcccgcaggagcggtcttcatcctgggaaccttactcctgtggctgtgccaggcacagaagaaaccctgcactcctgcgccagctccgccactcccaggccacaggccaccaggcacagcgcgtgatcgctcaggcgataaggaccttccatcgctggctgcactgtccgcaggaccaggcgtggggctgtgcgaagagcatggaagccccgcagctccacagcatctcctgggcccagggccagtagccggacctaagctatatccaaaactgtacaccgatatccacactcatacacacacccactcacatacacactctcacgtcgagggcaaggtacatcagcatattcactaccagtgttag

SEQ ID NO: 223253 - DNA, 1515 bp, Artificial Sequence
  Description of Artificial Sequence: Synthetic coding sequence
atgactccatcccctctgttgctgctgttgcttcctccgctcctgctgggggcttttccacccgctgctgctgccaggggtcctccgaagatggctgacaaggttgttcccagacaggtcgcgagactcggcaggacagtcagactccagtgccccgtagagggggaccccccacctcttacaatgtggactaaggatggtagaaccatccactccggatggtcacgatttagggtgcttcctcaagggctcaaggtgaagcaagtggagagagaagatgcaggggtgtacgtgtgcaaagcaaccaatggcttcggtagcttgagtgtgaactacacattagttgtgttggatgacatctcgcctggcaaagagtcccttggacccgatagctcctctgggggacaggaggatccagcttcccagcagtgggcgagaccgcgatttacccagccaagcaaaatgcggagacgggtaatagctagacccgtcgggtcttccgtccgactcaagtgcgtcgcgtccggacacccacgacccgacatcacttggatgaaagatgaccaagccttaactaggccagaagcagccgagccacgaaaaaagaagtggactctctccctcaagaatttacggccagaggattctggcaagtatacctgcagggtgtccaacagggctggtgcaataaacgctacttacaaggttgatgttattcaacgcaccaggagcaaacccgttctgacaggaacacatcccgtgaatactactgtcgattttgggggtacgaccagcttccaatgtaaggtgagatcagacgtcaagccggtaatccagtggcttaagcgagtggaatacggcgcagaggggagacacaactccaccattgatgtcgggggacagaagttcgttgtactgcccaccggagacgtgtggtcccggcctgacggttcatatttgaataaactgctgatcacacgtgctcggcaggacgatgccggaatgtatatatgccttggcgcaaacacaatgggatactcttttagatcagccttcttgactgttctgcccgaccctaagccacccggacctccagttgcgtctagtagttctgccacttctctcccatggcccgtggtaattgggattcctgcaggggcagtgttcatcctgggtactctgctgctatggctctgtcaagcacagaagaaaccttgcactcccgctccagccccacccctgccaggccacagacctcccggtacggctcgagacaggagcggcgataaagatctgcccagtctggccgcactgtctgctggccctggtgtggggctgtgcgaggagcacggaagtcccgctgccccacagcaccttcttggcccaggaccagttgctgggccaaaactgtaccctaagctgtatacggacatccacacacatacacatacccacagtcatacgcattcgcatgttgaggggaaagtacaccagcacatacactatcagtgttag

SEQ ID NO: 223254 - DNA, 459 bp, Artificial Sequence
  Description of Artificial Sequence: Synthetic coding sequence
atgaccccctctcctctattgctgctgttgctgcccccactcctgctgggggctttcccacccgctgccgcagcaagagggcctccaaaaatggccgacaaggttgtccctcgacaggtcgcccgactggggcgtaccgtgcggctgcaatgtccggtagaaggggacccccctcccctcacaatgtggacaaaagacggacgtaccatccactccggctggtctagatttcgcgtgcttccgcaggggcttaaggtgaagcaggtcgagcgggaggacgcgggtgtctacgtgtgtaaggccacaaatgggttcggaagtctgtcggtaaattacacactggtggttttagacgatatttcacctggaaaggagagtttagggcctgattcctctagcggagggcaggaagacccagcctcacagcagtgggccagaccaaggttcactcagccgtag

SEQ ID NO: 223255 - DNA, 1515 bp, Artificial Sequence
  Description of Artificial Sequence: Synthetic coding sequence
atgaccccaagcccgttgctgctgctgctcctcccacctctgttgctgggggctttcccgccagccgcagcagccagaggcccaccaaagatggccgataaagttgtccctcgccaggtggcacgcttgggtcggaccgtccggcttcagtgtcccgtggaaggtgatcctccgcctctgactatgtggactaaggatggaagaactatccattcagggtggtctaggttccgagttctgccacagggcctgaaggttaagcaggtggagcgcgaggacgccggtgtgtacgtctgtaaagctaccaacggatttggaagcctgagtgtaaactatactctcgtggtgctagacgacattagccccggaaaagaaagcctcggccctgacagctcatccggcggacaggaggatcctgcctctcagcagtgggccaggcctcgattcacacagccaagcaagatgcgaaggagggtaatagccaggcctgtcggctcttcggtgagattaaaatgtgttgccagcggccatcccagacccgatataacatggatgaaggacgaccaggcactcaccaggcctgaagccgctgaaccaagaaaaaagaagtggacactttccctgaagaacctccgtccagaagacagcgggaaatacacgtgcagagtgtctaacagggctggcgcaattaacgctacctacaaagtcgacgtcattcagagaaccagatccaaacctgtcctgaccggcacacaccccgtgaacacgaccgtcgatttcggcggaaccacctccttccagtgtaaggtacgatcagatgtaaagcccgtgatacaatggcttaaacgagttgagtatggagccgagggtcgccataacagtaccatagatgtgggtgggcaaaaattcgtagtgcttcctacaggggatgtttggtccaggcccgacgggtcctacctgaacaagctccttataacacgtgctcgtcaagacgacgctggcatgtatatctgtctgggtgcgaatacaatgggatattccttcaggtcagcatttctgaccgtgctgccagacccaaagccacctggtccacctgtcgccagcagcagctccgccaccagcctcccttggcccgtggtgatagggattccagctggggctgttttcatccttggcaccctgctgttatggttatgtcaggcccaaaagaaaccatgcactccagcacctgcccctcctctccccggacacagacctccaggtactgcacgcgatcgttctggcgacaaggacctgccttctttggcggcattgagtgctgggccaggggtaggcttgtgcgaagaacatggaagccccgctgctcctcagcatttgctgggtcccggaccggtcgcaggtcctaagctgtacccaaagctgtatactgatatccatactcacacacacacacactcccacacacattctcatgtggagggaaaggtccaccagcatatccactatcagtgctag

SEQ ID NO: 223256 - DNA, 243 bp, Artificial Sequence
  Description of Artificial Sequence: Synthetic coding sequence
atgacaccttccccacttttgctattactacttccccctctcctcttaggagcctttcccccagctgccgctgcaagagggccaccaaagatggccgataaagtggtccctcggcaggtagccagacttggacgcacagtacgcctgcagtgtcctgtggagggggacccccctccactcacaatgtggacgaaagacggtaggacaatacactctggctggagccggttcagggtgctttag

SEQ ID NO: 223257 - DNA, 1326 bp, Artificial Sequence
  Description of Artificial Sequence: Synthetic coding sequence
atggctgataaagtcgtgccccgtcaggtggcaaggctcggcagaactgtaaggctgcagtgtccagtggaaggagaccctcccccattgaccatgtggacaaaagatggacgcaccatacattctggatggagccgcttccgtgtgcttccacagggactcaaggtaaagcaggttgaaagagaggacgccggtgtgtatgtgtgcaaggctaccaacggttttgggtctctcagtgtgaattacactctggtggtgctggacgacatctctcccggaaaggagagcttaggccctgattcctcctccggtggccaggaagatccagcctctcagcaatgggccaggccaagattcacccaaccaagtaaaatgcggcgaagggtgattgctaggccagtgggctcctctgttcgcctgaaatgcgtagccagtggacaccctcgaccagacatcacctggatgaaagacgaccaggcactcacacggccagaggccgcagaaccgagaaaaaaaaaatggactctcagcctgaaaaacttgcggccagaagattcggggaaatatacttgtagagtgtccaatcgcgcaggcgctattaatgctacttacaaagtggatgtcatacaaagaacaaggtccaagcccgtgctgaccggaacacacccagtgaataccaccgtggattttgggggaactacaagttttcagtgcaaggtgcgcagtgacgtgaaacccgtaattcagtggctgaagagagtggagtatggggcagagggcagacacaatagtaccatagacgtgggaggccagaaattcgtggtgctgccaacaggcgatgtgtggtctcggcctgacggcagttacttgaataagctgctgatcacacgagcaagacaggatgacgccggtatgtatatctgtctgggtgctaatacgatgggatattcatttagatcagcctttctcactgtattgcccgaccctaaacctccgggacctcctgtggcctcatccagctcagcgaccagtctgccctggcctgtggttattggcattcccgctggcgcagtgtttattctgggtacactactgctgtggttatgtcaggcgcagaagaagccttgcactcccgctcctgctccgccactcccaggccacagacctcctgggacagcccgtgataggtctggggataaggacttgcctagtctggccgctctaagcgcagggccaggagtcggtctctgtgaggagcacggtagccccgcagcccctcagcaccctacagtggtcgttgccccagatctatgcaactttatgtag

SEQ ID NO: 223258 - DNA, 1131 bp, Artificial Sequence
  Description of Artificial Sequence: Synthetic coding sequence
atgcagtggaccagccttctcctgctagccggattattttccctatcacaagcacaatatgaggacgacccacactggtggttccactacttgcgcagtcagcagtctacctattacgacccatatgacccttatccatacgagacatatgagccttatccctatggagtcgacgaaggtcctgcatatacatatggctccccttccccacccgaccccagggactgtcctcaggagtgcgactgtccacctaattttccaacggcaatgtattgtgacaatcggaatctgaagtatctccctttcgtcccaagtaggatgaagtacgtttacttccagaataatcaaatcactagcatccaggaaggggtctttgataatgctaccgggcttctctggattgccctgcacgggaaccagattacttccgataaggtcgggaggaaggtcttttcaaaattgcgacacttggagaggctttacttggaccacaataatttaactcggatgcccggaccactgcctcggagtctcagagagttgcacctagaccacaatcagatatctagagtccccaacaacgcccttgaagggctggaaaacctcactgcactatatcttcagcacaacgaaatccaggaagtgggtagttcaatgcggggactgagatcactgatccttctggacctgagttacaatcatcttcgaaaggtgccagacgggctgcccagtgcgctcgaacagttgtatatggaacacaacaacgtgtacaccgtcccggattcctattttcgcggagccccaaagcttctgtatgttcgactgtcacataacagcctgactaataacggtctcgccagcaacactttcaatagtagcagcctgctggaattggacctgtcttacaaccagctgcagaagatcccacctgtgaataccaacctggagaacttatatctccagggaaaccgtattaacgaattttccataagcagcttctgcacagtagtcgacgtggtcaacttttcaaagttgcaagtgcttaggctggatggcaatgaaatcaaacgctctgcgatgccagcagacgccccactctgcctccgcctggcctcactgatcgagatctag

SEQ ID NO: 223259 - DNA, 1092 bp, Artificial Sequence
  Description of Artificial Sequence: Synthetic coding sequence
atgcagtggacatcattactcctgctcgccggactgttctccttatcacaggctcagtacgaggacgacccccactggtggtttcattacttgcggtctcaacagtctacatactatgacccctatgatccctacccctacgagacatatgaaccctatccatatggcgtcgatgagggcccagcgtacacgtatggttcgccttcccctccggatccacgtgactgcccgcaggaatgtgactgccccccaaacttcccacccttcgtgcccagcaggatgaaatacgtgtacttccagaataaccagataactagtatccaagagggcgtgtttgataatgccaccggcctgctttggatcgcactacacggtaatcaaataacatccgacaaagtcgggagaaaggtgttttctaaactgcggcacttggaacggctgtacctagaccacaataacttaacacgcatgcctgggcctctgcctaggtcccttagggagttacacctagatcataatcaaatcagtcgagtcccaaacaatgcgctcgaggggctcgagaacctgaccgctctctatctgcagcataacgagatccaggaagtgggaagctccatgcgaggcttgaggagccttattctgctggacctctcgtacaatcacctacgcaaagttcctgatggtttgccaagcgccctagagcagttatacatggagcacaacaatgtgtacacagtgcctgatagctactttcgaggagcacccaagcttctatatgtccgccttagccataactctctgaccaataacggcctggcctcgaatacgttcaattcttctagtttgctggaacttgacttgtcttataatcagctgcagaagataccacctgttaatactaatttagagaacctctatctccagggcaaccgcatcaacgaattcagcatttcaagcttctgcaccgtggtagacgtagtgaacttctctaaactgcaggtgctgagacttgacggcaatgagattaaaagatcagcaatgcccgctgacgcaccgttgtgcctgcggctggcatctcttatcgagatctag

SEQ ID NO: 223260 - DNA, 594 bp, Artificial Sequence
  Description of Artificial Sequence: Synthetic coding sequence
atgaagatgaccctaataggcggttcgacgacgtcggccgcttccagtccacccactaccatccccatgacactgactagaatgagaccgaccagtctgactcccatggggtggatgaaggggcagcccaccccgactgctttgcacccccttcaaatccccgctaccgcacccaggtccgccactgcccatccaacatctaccgctatgtactgtgacaataggaatttgaaatatttgccctttgtgccctcgcgaatgaagtatgtgtactttcagaataaccagataacatccatccaagagggtgttttcgataacgctactggcttgctgtggatagcgttacatggaaatcagataactagcgataaggttggcaggaaagtgttctccaaacttagacacttggagaggttatacttggaccacaataacctgacccgcatgccgggacctctgccacgcagtttgcgcgagttacatcttgaccacaaccagatctcacgggtgccaaataacgcgttggaaggcaggacctcacggccatgcacttccaacaccatgagatctcggaagtgggcagtgccctag

SEQ ID NO: 223261 - DNA, 2025 bp, Artificial Sequence
  Description of Artificial Sequence: Synthetic coding sequence
atggtcgtggcccacccgaccgcaactgcaaccacaacgcctactgcaaccgttactgccacggtggtgatgaccacagccactatggacctgcgcgactggctgttcttgtgttacggactcatagcattcttgacagaggtgatcgactccactacctgcccatcagtgtgccggtgcgataatggttttatctactgcaacgatagaggactgacgtctatccctgccgacataccagatgatgccacgaccctctatcttcagaataaccaaattaataacgccggaatcccacaggatctaaaaaccaaggtgaacgtacaggtgatttacctgtacgagaacgacctggatgagtttcccattaatttgccccgttcccttagggagttgcatctgcaggacaataacgtcaggaccatcgcacgcgactcccttgccagaatccctctacttgaaaagctgcatttagatgataattctgtgagtactgtcagtattgaggaagacgcgttcgctgactctaagcagttaaagctgttgttcctatctcggaaccacctgagctctatccccagcggcctgccacacacactcgaagagctgagattggatgataaccgcatctctactatccctttgcatgccttcaaaggactgaactcgctgcgccgtctggttttggatggcaatcttctggccaatcaacgcatcgcggatgacactttctctcggttgcagaatctgacagagctctcactggtgcgcaattccctggccgcaccaccgctgaacctcccgagtgcccaccttcagaagctctacctacaggataatgctatatcccatataccgtataacacacttgctaagatgagagagctggaaagactggacctcagcaataacaatcttacgaccctccctcgagggctgtttgacgacctgggtaatctggcccagctcctgctaagaaacaacccttggttttgcggatgtaatctcatgtggctgagagattgggtcaaggctcgtgcagccgtcgtaaatgtgcggggactgatgtgtcaagggccagagaaggttagaggaatggccatcaaggatatcacctctgaaatggatgagtgtttcgaaaccggccctcagggaggcgtggcaaacgcggctgcgaagacaaccgcttctaaccacgcgagcgccacgactcctcagggcagtctgttcactctaaaagctaagaggcccggtctgaggctccccgactcgaacatcgactaccccatggctacaggagatggcgcaaagacactggccattcacgtaaaggctcttacagcagatagtattcggattacatggaaagccacactgcctgcgtcatccttccgcctgtcttggctgcgtttgggacattccccagcggtcgggtcaataacagagacactggtgcagggcgataaaaccgaatatttattaaccgctttggaaccgaagtcgacgtatattatctgcatggtaactatggaaacctcaaacgcatatgttgccgacgagacacccgtgtgcgcaaaggctgaaactgccgatagttacggccctaccacgactttgaaccaggaacagaacgccggaccaatggcttccctccccttggcaggaatcatcggaggggctgtggcgttagtgttcctgttccttgtcctgggcgcaatctgctggtacgtgcaccaggcaggcgaactgctcacaagagagagagcctacaatagaggatctcgaaaaaaagatgactacatggagagcgggacaaaaaaggacaattctatcttggagatccgtggcccaggactgcagatgcttccaattaatccgtacagagcaaaggaggagtacgtggttcataccatttttccctccaatgggtcttcactgtgtaaggctactcataccattgggtatggaactacccgtgggtatcgggacggcggtataccggatatcgattatagctacacttag

SEQ ID NO: 223262 - DNA, 1983 bp, Artificial Sequence
  Description of Artificial Sequence: Synthetic coding sequence
atgggactacagaccacaaagtggccttctcacggtgcctttttccttaagtcctggcttattatatcactgggtctttactcgcaggtgtcaaaactcctagcttgtccctcggtatgtcgctgtgatcggaatttcgtgtattgcaacgagcggagtctcacctccgtgccactcggaatccccgagggggtcactgttctctaccttcacaataaccaaatcaacaacgccggattcccagccgagctccataacgttcagagcgtgcataccgtttacctgtacggcaatcagctggatgagtttcccatgaatctgccaaaaaatgtgagagtgcttcatctacaggagaacaacattcagaccatcagccgcgcagccttagcacagctcttaaaattagaagagctccacttagatgataattccattagtacagtgggtgtcgaggacggggcatttcgcgaggccattagcctcaagctgctcttcttaagtaaaaatcacctgagctcagttcccgtggggctgcctgtcgatctgcaagagctcagggtcgatgagaatagaatcgccgtcatctctgacatggcattccagaatctcacttcgctggaaaggctaatagtggacggaaatcttctaacaaacaaagggatcgccgaagggactttttctcacctgacaaaacttaaagagttttctatcgttcgcaactcactatcccatcctccacccgacttgccagggacccacttaattcgcctgtacctccaggataatcagattaatcacatccccctcacggcttttagcaatctgcggaaactggagcggcttgacatctctaataatcagctgcggatgcttactcagggggtgtttgacaacctttccaacctcaagcagctgaccgctaggaataatccttggttctgtgactgcagcataaaatgggtcactgagtggttgaagtatattccttcttctttgaacgttcggggattcatgtgtcagggcccagaacaggtgagaggaatggctgtgagagaattgaatatgaatctcctcagttgtccaaccactaccccgggtttgccactgttcactccggcaccctcaacagcttccccaaccactcagcccccaacactgtcgattcctaacccctcccggtcatacacaccacctaccccaaccaccagcaagctgccgaccattcctgactgggacgggagggaacgggtcacgccccctattagcgagcgcattcaactgagcatacactttgtgaatgatacgtcaattcaggtgagttggctgagtctgtttacagttatggcctataagctcacttgggtcaaaatgggtcatagcctcgtggggggaatcgtccaggaaagaatagttagcggcgagaagcagcacctgtctctggttaacctcgaacccaggtctacatatcggatttgtctggtgccccttgatgcttttaattatagggctgtggaggatacaatttgtagtgaggcaaccacacatgcttcatatttgaataacggttctaataccgcctccagccacgagcagacaacaagtcatagcatgggctccccgttcctgttggccggacttatcgggggagcagtgattttcgttcttgtggtcctgctgagcgtattctgttggcacatgcataaaaagggtcgctacacctcccaaaaatggaaatataacagaggcaggagaaaggatgactactgtgaggcaggtactaagaaggataatagcattctcgaaatgactgaaacgagcttccagattgtctcactgaataacgaccagttactgaagggcgacttccgtttgcagcccatttacaccccaaacggcggaattaactataccgattgccatattcccaacaatatgaggtactgtaacagctccgtgcccgatctggagcattgccatacctag

SEQ ID NO: 223263 - DNA, 942 bp, Artificial Sequence
  Description of Artificial Sequence: Synthetic coding sequence
atggccgttcgcgagctgaatatgaacctcctcagctgccccaccacaactccaggactgcctctctttacgccggctcctagtaccgctagccccaccacccagccaccaacattgagtatcccaaatcctagtcggagctacaccccacccactcccactacaagtaagctgccaacaatccccgactgggacggcagggagagagtgaccccacccatctctgagaggatccaattgagtatccattttgtgaatgacacttccatccaggtgagctggctgtcactgtttaccgtgatggcgtacaagctcacttgggtgaaaatgggccacagtttagtggggggaatcgtgcaagaaagaattgtgagtggtgagaaacagcacctgtccctcgtgaacctcgaacccagaagtacctatcggatctgccttgtgccgttggatgcattcaactacagggcagttgaagacaccatttgcagtgaagcaaccacacatgccagttatttgaataatgggagtaacacagcgtcaagccacgaacaaaccactagtcattccatgggctccccattcctgctggccggattgatcggaggagccgttattttcgtcctggtggtacttctctcagtcttctgctggcatatgcacaagaagggcagatatactagtcagaagtggaagtataatagaggccgacggaaagatgattattgcgaagccggaacaaaaaaagataactccatcctggaaatgaccgagacaagctttcaaatcgtcagcctcaataatgaccaactgctgaagggcgacttccgcctccagcctatttatacgcccaacgggggaataaattatacagactgccatataccaaataatatgcggtactgcaacagctctgtccccgatctggagcactgtcatacgtag

SEQ ID NO: 223264 - DNA, 1983 bp, Artificial Sequence
  Description of Artificial Sequence: Synthetic coding sequence
atgggtttgcagacgacgaagtggccaagccatggagcatttttcctgaagtcctggctgatcatctccctcggcctgtattcgcaagtcagtaaactcctagcgtgccccagcgtctgtaggtgtgatcggaactttgtctattgtaacgagagaagtctcaccagtgtgcctttggggatccccgaaggcgttacagtactgtacctgcacaacaaccaaatcaacaatgctggatttccagcagaactgcacaatgttcagtcagtgcataccgtgtatctctacggaaaccagctcgatgaatttcccatgaacttacctaagaacgtccgcgtgttgcacctccaagaaaataacatacagacaattagcagggccgcattagcacagttgttaaaactagaggagctgcacctggacgataattccatatctacagtgggggtagaagatggagccttcagggaagcgatcagcctgaaattgctgttcctctctaagaaccacctgagtagcgttcccgtaggcctgccggtagatctgcaggaactgagagtggacgagaatagaattgccgtaatttccgacatggcgttccagaacttgaccagcctggagagactaattgtcgacgggaatctattaaccaacaaaggcatcgcagaagggaccttcagtcacctgactaagctaaaggagttcagtatcgtcagaaatagcctcagccatccgccaccagacctgccaggtacccacctgattcgtctgtacttacaggacaatcagatcaatcacattcctcttaccgccttttctaatctccgaaagctggagcgactggacatttctaataaccaattgcgtatgctgactcagggggtcttcgataacctgagtaacctcaaacaactgaccgctaggaataacccgtggttctgtgactgctcaattaagtgggtgacggagtggttgaagtacatccccagtagtctgaatgtcagaggctttatgtgccaaggccctgaacaggtaagaggaatggcggtcagagagcttaatatgaatctgctctcttgccccacaactacacctggcctcccactgtttacgccggctccctccactgccagcccaaccacccagcctccgacgctgtctatccctaatccctccaggagctataccccccctacaccaacaaccagtaaactgcccactattcccgattgggacggacgagagcgtgtgacacctcctatatcagaacgaatccagttatctatccacttcgtgaatgataccagcatacaggtaagttggctaagcctgtttaccgtgatggcctacaaactgacttgggtgaagatgggccactctctagtgggcggtatcgtccaagaaaggatagtaagcggcgagaagcagcacttatccctggtcaatttggaacccagatcaacttatcgcatttgcctggttccattggacgcctttaattatcgcgctgtagaagacaccatttgttccgaggcaactactcacgcatcctacctgaacaacgggagcaatactgcctcctcccacgaacagacaacctcccacagcatggggtcgccatttctgctggcgggactgatcggcggtgcagtgatatttgtcttagttgtgctgctatcggttttttgttggcatatgcataagaagggtagatataccagccaaaagtggaagtataatcgaggccgacgcaaggacgattattgcgaggcagggactaagaaagataattccatcttggaaatgacggagacctcgtttcagatcgtctccctcaataacgaccagcttttaaaaggggattttcggttgcagccaatctatacccctaatgggggtatcaactacactgactgccacatacccaataacatgcgctactgcaatagttcagtacccgatctggagcactgtcacacttag

SEQ ID NO: 223265 - DNA, 1950 bp, Artificial Sequence
  Description of Artificial Sequence: Synthetic coding sequence
atgatctcggctgcatggtctatcttcctcatcggaactaaaatagggttgttcttacaagtcgcacctttatccgtgatggcaaagtcatgtccatccgtgtgcaggtgcgatgctgggtttatctattgtaatgatcgctttctgacatcaattcccacaggcatacccgaggatgccactactctttacttgcagaacaatcaaatcaataatgctgggataccaagcgatcttaaaaaccttttaaaagtggagcgaatatatttatatcacaattcactggacgagtttcccacgaatttaccaaagtacgtaaaagagttacatttgcaagagaacaatatcaggacaattacctacgacagcctttccaaaattccttatctggaggaactccacctcgatgacaacagtgtgtccgcggtgagcatagaggagggtgccttccgtgacagcaactatctgagactactgttcctgtctagaaatcatctcagtactatcccctgggggttgccaagaacgatcgaggaattgaggttagacgacaacagaatcagcacaatcagttccccctcgctgcagggactgacttcattaaagagactggtgttggatggcaatcttctcaacaatcacggccttggagataaagttttcttcaacttagtgaacctgacggagctgtcactagtacgcaacagtctcaccgctgctcccgtaaatcttcccggaaccaatttaagaaaactgtacctacaggacaatcacatcaatcgagttccccctaacgccttcagctacttacgtcagctgtatcgtctagatatgtccaacaacaatttaagtaaccttcctcaaggaattttcgatgacttagacaacatcacacaactgatcctaagaaacaacccttggtattgcgggtgcaagatgaagtgggtgcgggattggctacagtcactccccgtgaaagttaatgtccggggactaatgtgccaggccccagaaaaagtgagaggcatggccataaaggacctaaacgcagagctgttcgattgcaaggacagtggaatagtctccaccatccagatcacaacggccatccccaatactgtctaccccgctcagggccagtggccagcacccgtcaccaagcagccagatatcaagaatcccaagttgaccaaagatcatcagactaccgggagtcctagtaggaagacgatcaccattactgttaaatcagtgacttccgatacaatccacatttcgtggaaactggccctgccaatgacggctctaaggctctcttggctgaaactgggtcacagccccgctttcggatccatcactgagacgatcgtaaccggtgagaggtccgaatacctggtgactgctttggaaccagatagtccatacaaagtgtgcatggtgcctatggaaactagcaatctttacctgtttgacgaaacccccgtctgtatcgagacagagactgccccattgaggatgtataacccgaccacaactctgaaccgggagcaggaaaaggaaccctacaagaatccaaacctgcctctggctgccatcatcggaggtgctgttgcactggttactattgctctcctagctctcgtatgttggtatgttcaccgaaacggttctctgttttcaagaaactgcgcatattcgaagggtcggaggcgtaaggacgattatgctgaggccggaaccaaaaaggataactctattctggagatcagagagacgtctttccagatgcttccaatatccaatgaacctattagtaaggaagagtttgtgattcataccatctttccacccaacggcatgaatttatataaaaataatcacagtgagagctctagcaatcggtcgtatagagactccgggatcccagacagtgatcatagccatagctag

SEQ ID NO: 223266 - DNA, 1950 bp, Artificial Sequence
  Description of Artificial Sequence: Synthetic coding sequence
atgatttccgccgcttggtccatctttcttattggaaccaagatcggtctgtttctgcaggtggcccctctgtccgtgatggcgaaaagctgcccctcagtgtgtaggtgtgacgcaggctttatctactgcaacgatagatttctgacttctatccccaccgggatccccgaagatgcgaccacgctttatctgcagaataaccaaataaacaacgcgggtatcccttccgacttgaaaaacctgctgaaagtggagcggatctacttataccataacagcctagacgaattccctaccaatttgcctaaatacgtcaaagagctccaccttcaggaaaataacatccgtacaatcacttatgacagcctctcaaagatcccctatctggaagagctgcacttagatgacaattctgtgtcggctgtctccattgaagaaggagccttcagagactctaattatctccggttgctcttcctgtcacgaaatcacttgtcaacaattccgtgggggttgcccaggacaatagaggaacttagacttgacgataatcgtatctcaaccatctccagcccgtcactacagggactgactagtctcaagagactggttttagacggcaatctcctcaataatcacgggctcggcgacaaagtttttttcaatctggtgaatttaaccgagctctccctggtacggaacagcctgaccgccgctccagtcaatctgcctggaacaaaccttcgtaagctctacctgcaggacaatcatatcaatcgtgttccccctaatgctttttcatatttgagacaactgtacagactcgacatgtcaaataacaatctcagcaacctcccacagggaatctttgacgatctggataatatcacccaactgatcctcagaaataacccctggtactgcggctgtaaaatgaagtgggttcgggattggctgcagtcattgccggtcaaggtgaacgtgcgaggcctgatgtgtcaggccccagaaaaggtacgcggaatggcaataaaagaccttaatgctgaactgttcgattgcaaagactctggaatcgtttccacaattcagataaccaccgcaatcccaaacactgtctacccggcacagggtcagtggcccgctcctgttacgaagcaacccgacatcaagaacccaaagctgactaaagatcaccaaaccaccgggtctccgtctaggaaaacaatcaccatcactgttaaatccgttacttctgataccattcacatcagttggaaactagccttgccaatgacagcattgcggctgagctggttgaagttggggcattcacccgctttcggatcgattactgagaccatcgtgaccggggagcggtctgagtatcttgtcaccgcgctggagcccgactctccttacaaggtatgcatggttccgatggaaacatcaaatctctacctgtttgatgaaactccagtgtgcatcgagacggagaccgcccctctgcggatgtataaccccaccactacgctaaaccgagaacaggagaaggagccctacaagaacccgaatctgcctctcgctgccataattggtggagccgtggctctggtgactatagcactgctggcactcgtgtgctggtacgtccatcgcaatggtagcctcttctctcgaaactgcgcctactctaagggtcgccgacggaaggacgattatgccgaagcaggaactaaaaaagataacagtattcttgagattcgtgagacctcattccagatgttaccaattagcaacgagccaatcagcaaggaagagttcgtaatccatactatcttcccacctaacggcatgaacctgtataaaaataatcatagtgaatcttctagtaaccgtagctaccgtgatagcggcatccctgattctgaccacagtcactcgtag

SEQ ID NO: 223267 - DNA, 1884 bp, Artificial Sequence
  Description of Artificial Sequence: Synthetic coding sequence
atgatctcagccgcttggagcatcttcttgatcgggactaagattggcttgtttttacaagtggcccctctttccgtcatggccaaaagctgcccctctgtatgcagatgcgacgccggttttatatactgtaacgaccggttcctaacctctataccaaccggcatcccggaagacgctaccaccctgtatctccaaaacaaccagataaacaacgctgggattccttctgacctcaagaatctgctgaaggtggagaggatctacctctatcataacagtttagatgagtttcccaccaacctgcctaaatatgtgaaagagctgcacctgcaggagaataacatccgcaccatcacatatgatagcttgtctaagattccttacttagaggagctacaccttgatgataacagtgttagcgctgtgagcatcgaagagggtgcatttagagactctaactacctgagactgctgttcctgagtcggaaccaccttagcacgattccatggggcctgcctaggactatcgaagagttgcgcctggatgacaacaggatttcaactatcagctccccttctttacaaggattgacaagcctgaaacgcctcgtgctcgatggtaacttgctcaacaaccatggactgggggataaagtgtttttcaacctggtgaacttgactgagctctccctagtcaggaacagcctcaccgcagcacctgtcaacctcccgggtacaaacctcagaaaattatacctgcaggacaatcatatcaatagagttccccctaacgccttctcttacctccggcagctctacagactagacatgtccaataataacttgtctaacctcccccagggtatcttcgatgatctcgataacatcactcagctcatcttgcggaacaacccctggtactgtggctgtaagatgaagtgggttagagactggctgcagtctctgccggtcaaggtgaatgtcagaggactgatgtgccaggcaccggaaaaggtgagaggcatggccattaaggatctgaatgccgagctgttcgactgtaaggatagcggcattgtgtccacgatccaaattactaccgctattcctaacacggtataccccgctcaagggcagtggcccgcacctgtgactaagcagccggacatcaaaaaccctaaactgacaaaagatcatcagaccaccggtagcccatcacggaagactattaccatcactgttaagtctgtgacatctgatacaatccacattagctggaagctggcgttgccaatgacggctctgcgcctatcttggctcaagctcggtcacagccctgccttcgggagtatcacagaaactatcgtcactggagaacgctcagagtacctagtcacagcactggagcccgatagtccctataaagtgtgtatggtgcctatggagacttcaaacctgtacctgtttgatgaaacaccagtgtgcatagagactgaaactgcccctctgagaatgtacaatccgacaacaaccctgaaccgagaacaggaaaaagaaccctacaagaaccccaatctacctttggcagcaatcatcggcggagctgtggccctggtgaccatagccctgttggctctggtatgttggtacgtgcacagaaacggttccttgttctcccggaactgtgcttactctaaggggcgtaggaggaaagatgactatgccgaagctgggaccaaaaaggacaacagtatcctcgaaatacgagagacaagcttccaaatgctaccaattagcaatgagcccatttcgaaggaagagtttgtcatccacaccattttcccccctaatgggatgaatttgtacaaacagtcccaatag

SEQ ID NO: 223268 - DNA, 402 bp, Artificial Sequence
  Description of Artificial Sequence: Synthetic coding sequence
atgcctccctctaaaccccaccctcctgttgttggcaaggtcacccatcacagcatagaactctattgggatctggagaagaaggcaaagagacagggtccacaagaacagtggtttcggttctcaatagaggaagaggaccccaagatgcatacctatggaataatctacaccggatacgctacgaaacatgttgtggagggcctcgagccccgtaccttgtatagattccggctgaaggttactagccccagcggcgaatgtgagtactctccgctggtcagtgtttcaaccacttcctccatctggctggggggtgaacccattagttcagagcacctgcacagagctgtctcagtgaacgatgaagacctgcttgtgcgaatcctgcaggggggttag

SEQ ID NO: 223269 - DNA, 849 bp, Artificial Sequence
  Description of Artificial Sequence: Synthetic coding sequence
atgcctccatcaaaaccacacccaccggtcgtggggaaagtcactcaccacagcatcgagctctactgggacctcgagaaaaaagccaagcggcagggcccacaggagcaatggtttcggttctctatcgaagaagaggaccctaagatgcacacatacggcattatttatacagggtacgcaaccaaacatgtcgtggaagggctggaacctcgcacactgtatcgattccgactcaaggtcacctccccgtcgggggagtgcgaatatagtccgctagtcagcgtaagcaccacatcaagcatttggttaggaggcgagccaatatcatctgagcatctgcaccgcgctgtctccgtcaatgatgaggaccttctcgtccgcatcctacaaggtggcagagtaaaagtggatgttccaaacaagtttggcttcactgcacttatggttgctgcgcagaagggatacacctctctgatgctggcctgttatgcgggtcacctcgacgtcgtcaaatacttgaggcgccatggcgcttcatggcaggctagagacttaggcggttgcaccgcactgcactgggctgcggatggaggtcattgtagtgtgattgaatggatgatcaaagacggctgcgaggtcgatgtggtcgatacgggatctggttggaccccacttatgcgggtgtccgccgtctctgggaatcagcgagtggcctcccttttgatagacgcgggagcaaatgtgaacgtcaaagaccggaacggcaaaactcccctcatgtcagtcgtatcactcctggaggaacgaaagaaaaagcaacgacctaaaaagagttgtgtgtgctag

SEQ ID NO: 223270 - DNA, 1116 bp, Artificial Sequence
  Description of Artificial Sequence: Synthetic coding sequence
ctgcagaagcaaaagattatgccaccatccaagccgcacccccctgttgtgggcaaggtgacacatcacagtatcgagctatactgggatctggagaagaaagctaaacgccagggcccacaagaacagtggttccggttttcgatcgaggaggaagatcccaagatgcacacttatggcatcatctacacgggttacgccactaagcatgtggtggaggggctcgagcctcgcacattgtataggtttagactgaaagtcacctcaccatccggagaatgtgagtacagccccttagtatccgtgtctactacacgaccttctctgagtaagtccctggtgaaaatccgaatggttacaagcgtgttacatggccctcccaccgagaacactggggagcctatcagcagcgagcacctccatcgggcagtttcagtgaacgatgaagaccttctggttcggatcctgcaaggaggcagggttaaggtggatgttcctaataaatttggatttactgcactcatggttgccgctcaaaaaggttacacccgattggtaaagatcctggtgtccaacggtacggacgtgaatctgaagaatggaagcggcaaggactcgttaatgctggcctgctacgccggtcacctagacgtcgtgaagtacttgcgccgacatggtgcctcctggcaagctagggacttggggggatgcaccgccctacattgggctgccgacggtgggcactgctccgtgattgagtggatgattaaggatggctgtgaagtggacgtggtcgatactggctcaggctggacccctcttatgcgcgtcagcgctgtgagcgggaatcaacgagttgccagcttactgatcgacgcaggagctaatgtaaatgtgaaggaccgtaacggcaagacacctctcatggtggccgtgctcaataatcatgaagagttggttcagctgctgttagacaagggagccgatgcctcggttaagaacgaatttgggaagggagtgctggaaatggccagagtctttgaccggcagagtgtcgtgagtctccttgaggaacggaagaagaagcagagacctaagaagagctgtgtatgctag

SEQ ID NO: 223271 - DNA, 1038 bp, Artificial Sequence
  Description of Artificial Sequence: Synthetic coding sequence
atggaaccccagaagatcatgccaccaagtaagcctcaccctcccgttgttggaaaggtcacccaccattccatcgaactctactgggatctggagaagaaggccaaacggcagggaccgcaggaacagtggttcagattcagtatagaagaggaggatcccaagatgcatacttacggtattatctacaccggatatgctacgaaacacgttgttgaagggctggagccccgaacattgtatcgattcaggctgaaagtaaccagccctagtggtgaatgcgagtattctcccctggtgtccgtgtccacgacgcgtgagccgatcagcagcgagcatctgcatagagccgtgagtgtgaatgacgaagacctgctggtgcgcatcctccagggcggaagagtgaaggtagatgtccccaacaagttcggatttacagctcttatggtcgcggctcaaaaaggttataccaggctggttaaaattctggtatctaatggtacggacgtgaacctcaaaaatggttctggaaaagattccctgatgctcgcatgttacgcgggacatctcgatgttgtaaaatatctccgacggcacggagcttcatggcaagcccgtgacttagggggttgcaccgccttgcactgggcagctgatggtggtcactgttcggttatcgaatggatgattaaggatggttgtgaagtggacgtggtcgacactggatccggctggacgcccctcatgcgagtaagcgctgtgagtggcaatcaaagggtggcctccctgcttatagatgctggagccaacgtcaacgtcaaagaccggaatggaaaaacaccccttatggtggcagtcctaaataatcacgaggagttggtccaacttctgctggataaaggcgctgacgccagcgtgaagaacgaatttggcaaaggtgtgctagaaatggctagggtgtttgaccgccaatccgtcgtaagtctcctcgaagagcggaaaaagaagcaacgcccaaaaaaaagctgcgtgtgctag

SEQ ID NO: 223272 - DNA, 1020 bp, Artificial Sequence
  Description of Artificial Sequence: Synthetic coding sequence
atgcccccttcaaaaccccacccacctgtggtcggaaaagttacccatcactccattgaactctactgggacctcgagaaaaaagctaagcgccaaggcccacaagagcagtggttccgcttctctatcgaagaggaagaccccaagatgcacacctacggaatcatctacacagggtatgcaactaagcacgtggtggaaggtctggaaccacgaacactgtataggttccggttaaaagtaacttccccatcgggagaatgcgaatactcccctctggtgtctgtaagtaccacacgcgagccgatttcttctgaacatctccaccgggctgtgagtgtgaatgacgaagacctattggtcaggatcctgcaggggggtagggtgaaagtcgacgtacctaataaatttggctttactgccctgatggttgcagcccagaagggttataccagacttgtgaaaatcctcgtgtcaaacggaaccgatgtgaacctcaaaaacggtagcggaaaggactctctgatgcttgcctgctatgccggacatctggatgttgtgaagtacctgagaaggcacggagccagctggcaggccagggatctagggggatgcaccgccctgcactgggctgcagacggaggccattgttccgtgatcgagtggatgattaaagacggatgtgaagttgatgtagtggatacaggttccggctggacccctctgatgcgtgttagcgctgtgagtggcaaccagcgagtagcctccttgctgatcgacgctggagccaacgtgaatgttaaagaccgtaatggaaagacacccctcatggtggccgtattaaacaatcatgaagagttagtgcagctgctgctggataaaggggcagatgccagcgtgaagaacgaatttggcaagggagtcctggagatggccagggtattcgaccggcagagtgtggtgtcccttctagaagaacggaagaaaaagcagcgaccaaagaagagctgcgtttgctag

SEQ ID NO: 223273 - DNA, 375 bp, Artificial Sequence
  Description of Artificial Sequence: Synthetic coding sequence
atgccgccttcaaagccacacccgccagtggtgggcaaggtaacccaccacagcatcgagctttactgggatctcgagaagaaggcaaagcgacaggggcctcaggagcagtggttcagattcagtattgaagaggaggacccaaaaatgcacacgtacggaattatttacaccggctacgctaccaaacacgtggtggagggacttgagcccagaactctttatcgctttagactgaaagttacctccccaagcggcgagtgtgagtattccccactggtttcagtctcaaccacccgagaacccatttcgtccgagcatctccatcgagccgtctccgtgaatgatgaagacctgcttgtgagaatcttgtag

SEQ ID NO: 223274 - DNA, 402 bp, Artificial Sequence
  Description of Artificial Sequence: Synthetic coding sequence
atgcctccctccaaacctcatccccctgtggtcggaaaggttactcatcactccatcgaactatattgggatctggaaaagaaggcaaaaaggcagggccctcaagagcagtggttccgcttctccattgaggaggaagatcccaagatgcatacctatgggattatctacaccggatacgcgaccaaacatgtcgtggaaggactggagcccagaacactgtataggttcagactaaaagtcacgtcaccgtccggcgaatgtgaatattcccctcttgtgtcagtgtccacaacctcttccatctggctgggcggagagccaatcagctccgagcacctccaccgcgcagtgtccgtcaacgacgaggacttgttagtgagaattcttcagggtggttag

SEQ ID NO: 223275 - DNA, 441 bp, Artificial Sequence
  Description of Artificial Sequence: Synthetic coding sequence
atgccaccctccaagccacacccacctgttgtgggcaaggtcacacatcatagtatagaattgtattgggatctcgaaaagaaggccaagcgtcagggccctcaggaacagtggttccggttctctattgaggaagaggaccccaagatgcacacgtatggtatcatctataccggctacgccactaagcatgtcgtggaaggcctggagcccaggaccctgtatcgctttcgtttgaaagttacaagcccgagtggggagtgcgagtactcgccgttggtcagcgtgagtacgacctccgagtattccgaccgaccacatagtcccttatcccgcagcatggaaatgaccagtaatctggagaaaatcttctgcctgtcgtttggtttgactaggtctagaaacgataccatttttaagcattgcaacaatatctgctag

SEQ ID NO: 223276 - DNA, 600 bp, Artificial Sequence
  Description of Artificial Sequence: Synthetic coding sequence
tgagaaccaatcagctccgaacatctacacagagccgtttccgtaaatgatgaagacctcttggtacgaattctgcagggaggaagagtcaaagtggacgtgcccaataagttcggttttacggctctgatggtggctgctcagaagggatacactcggttagtcaagattcttgtcagcaacggaaccgacgtgaaccttaagaatggctccgggaaagacagcctcatgctggcttgttacgcaggccatcttgacgtggtgaaatacttacggagacacggtgcttcttggcaggccagagacctgggtggatgtacagcactgcactgggctgcagatgggggacactgtagtgtgatcgagtggatgattaaagatggctgtgaggtggacgtggtggatactgggagcggctggacccccttaatgcgcgttagcgcggtttctggcaatcagcgggttgcttcactgctcatagacgcgggagctaatgtgaacgtcaaggaccgcaacgggaaaacacctctgatgagcgtggttagccttttggaagagcgcaagaagaagcagcgtccaaaaaagtcatgcgtttgttag

SEQ ID NO: 223277 - DNA, 735 bp, Artificial Sequence
  Description of Artificial Sequence: Synthetic coding sequence
atggaagtcaccggagtaagcgctcccactgtgacagtgtttatctctagttccctcaatacattccgctcagagaagaggtactctagatccctgactatcgcagagtttaagtgtaagctcgaactcttggtagggtctccggcaagttgcatggagctggaactctatggtgtggatgataaattctacagcaagctggatcaggaggatgccctgttgggctcatatccggttgacgacggctgccggatacacgtcatcgatcacagcggcgctcgcttaggcgagtacgaggacgtttcacgagtagagaaatacactatctctcaggaggcatatgatcaacggcaggacacggtgaggtcttttttgaaacgtagtaaactgggtcgctacaacgaggaggagagggcccagcaggaggcagaagccgctcagaggttagccgaggagaaggctcaggccagttcgattcctgtaggcagccgatgtgaagttcgggcagccggacagagccccagacgcggaaccgtgatgtatgtgggcctgactgacttcaagcccggatactggattggagtgcgatatgacgagcctctcggaaagaatgacggcagtgtaaacggcaaacgctactttgagtgccaggccaagtacggtgcgtttgtcaagcccgcagtggtgactgtcggagatttccccgaagaggactacggtttagatgagatatag

SEQ ID NO: 223278 - DNA, 1497 bp, Artificial Sequence
  Description of Artificial Sequence: Synthetic coding sequence
atggacagccaaaaagaggccttgcagaggatcatctccacactcgccaacaagaatgacgagattcaaaacttcatcgataccctgcaccacacgctcaagggcgtccaggaaaacagctccaacattctgagtgagttggatgaagagttcgactccctgtactcaatattggacgaggtgaaagaaagcatgattaattgtatcaagcaggagcaggcccgaaagtcccaagaactgcagagccagatcagtcagtgtaataacgcactcgagaattccgaggagctactggagttcgctactaggagcttggatattaaagaaccagaggagttttccaaggcggcacgccagattaaggaccgcgtgacaatggctagcgccttcaggttgtctctgaagcccaaagtgtcagataacatgacacacttgatggtggacttcagccaggaacgccagatgctgcagacactgaaattcctacctgtacctaaagcccctgaaattgacccagttgagtgcctggtagcagataatagtgtaacagtggcgtggcgcatgcccgaggaggacaataagattgaccactttatcctggaacacagaaaaaccaattttgatggtctccccagagtcaaggatgaaagatgctgggagatcatcgacaatattaagggcacggaatataccttatccgggcttaagttcgattccaagtatatgaactttcgcgtgcgggcttgtaacaaggccgtggcaggcgaatactccgatccagtcaccctggaaacaaaagctttgaactttaatctggataattcaagcagccacctcaatctcaaggtagaggacacttgcgtggagtgggaccccacagggggtaaggggcaggagtcaaaaatcaaaggaaaagagaacaaagggaggtctggcactccctcacctaagcgcaccagcgtgggaagccggccaccggcagtccgtgggtctcgggaccggttcacaggggagagttacactgtacttggagatacagctatcgaaagcgggcagcactactgggaagtgaaagcccagaaagactgtaagagctacagcgtcggggtggcctataaaacactgggcaagttcgaccagctgggaaagaccaatacctcatggtgtattcacgtgaacaactggctacaaaatacctttgccgctaagcacaacaataaggtgaaggccttggatgttacagtcccagaaaagattggcgtgttttgcgactttgacggcggacagctgtcgttctacgacgccaatagcaaacaactcctgtactcatttaagacaaaatttactcaaccagtactgcccggatttatggtttggtgcgggggattgtctctctcaactggcatgcaggttccttccgctgttcgcaccttgcaaaaatccgaaaacggtatgacagggtcagcgtcatctttaaacaatgtagtgacacagtag

SEQ ID NO: 223279 - DNA, 438 bp, Artificial Sequence
  Description of Artificial Sequence: Synthetic coding sequence
atggattcacagaaagaggcattacagcggatcatctccaccctcgccaacaagaatgacgagattcagaattttatcgatacacttcaccatactctgaagggcgtccaagaaaatagttccaacatcttgtcagagttagatgaagagtttgactccctctacagcatactggatgaggtcaaagagtctatgatcaattgtattaaacaggaacaggcccgtaagagccaagagctccagtcacagattagtcagtgcaacaacgccctggagaactccgaggagttgcttgagttcgccacccggtccctggatataaaggaaccagaggaattttctaaagtgcacaaaaattgcataaacacgctcaacaaaggcagctgtatctttaagaaagcatttctctttttttttagctttgggtttctttactag

SEQ ID NO: 223280 - DNA, 1593 bp, Artificial Sequence
  Description of Artificial Sequence: Synthetic coding sequence
atggacagtcagaagtactgtttcaaggaaaatgaaaatgtgaccgtggacaaagcctgcttcctgatcagcaatatcaccataggtcctgaaagcattaacctgcaacaggaggccctgcagaggataatcagtaccctggctaacaaaaatgatgagatccagaatttcatcgacaccctacaccacacgctcaagggggtgcaggagaatagtagcaacatactgtctgaactggatgaggagttcgattccctgtattctatcctagatgaagtaaaagaatccatgataaactgtattaagcaggaacaggctcggaaatcgcaggagctgcaatctcagatcagccagtgtaacaacgcccttgaaaacagcgaagagctgttagagttcgccacaagaagcctggacatcaaagagcccgaagagttcagtaaggctgctcgtcagataaaggaccgagtgacgatggccagtgcctttcggctgtctctaaagccaaaagtgtccgacaacatgacccacctaatggtcgatttcagtcaagaacgacagatgctgcagactctcaagttcttgcctgtgccaaaggcccctgagatcgatcccgtcgaatgcctggtggccgacaactctgtgacagtggcctggagaatgccagaagaggataataaaattgatcactttattctggagcatcgcaagactaatttcgacggattgccaagggtgaaagacgaacgctgctgggagattattgataacataaaaggaactgagtacacattatcaggcctgaagttcgactccaaatatatgaactttagagtgcgtgcatgcaataaagcagtagccggtgaatattccgatcccgtgaccctggaaactaaagctttgaattttaatctagacaactccagttctcacttaaacctcaaggtggaggatacctgtgttgagtgggaccctacaggaggcaaggggcaggagtcgaagatcaagggaaaggagaacaaaggcaggtctggaacaccttcaccaaaacgtacatctgtgggcagtcgcccacccgctgtgaggggctccagggatcgttttactggagagtcttataccgtactgggggatactgcaatcgagtcaggtcagcactactgggaggtgaaggcacagaaagattgcaaaagctatagcgtaggcgtagcctataagacactcgggaagtttgaccagctgggtaagacaaatacatcctggtgcatccacgtgaataattggctacagaatacctttgcagctaagcataacaacaaagttaaggcccttgacgtcacagtgcccgaaaaaattggagtgttttgtgatttcgatggcggtcaattgagcttttatgatgccaactcgaagcaattgctgtactcatttaagaccaagtttacccagcccgttctgcccggtttcatggtgtggtgcggtggcctttcactctccaccggcatgcaggtaccttcggccgttcgaacactgcagaagagcgaaaacgggatgaccggatcagccagttcattaaacaacgtcgtgacccagtag

SEQ ID NO: 223281 - DNA, 1152 bp, Artificial Sequence
  Description of Artificial Sequence: Synthetic coding sequence
atggcatccgccttccgactctcccttaaacctaaggtgtccgataacatgacacacctcatggttgacttcagtcaggaaaggcaaatgttacagactctcaagtttctccccgtaccgaaggctccggagatcgacccggtcgaatgcttagtcgcagataattcagtgactgtggcctggcgcatgccggaggaagataacaagatcgatcactttatcttggagcataggaaaaccaattttgatggactgcctcgtgtgaaggacgaaaggtgctgggaaatcatagacaacatcaaaggaaccgagtacaccctctctggactaaagttcgactcaaagtacatgaatttccgagtacgagcctgcaacaaggctgtagcaggggagtattcagaccctgtgaccttggaaactaaagcactgaactttaatctcgataactcgagcagtcacctcaatctgaaggtcgaggatacctgtgtggagtgggaccctaccggcggtaaaggccaggagtccaaaatcaagggaaaagagaacaagggaagcgtccacgtgacttccttgaagaaacatacctccggcacaccgtccccaaagcgcacaagtgtaggtagcaggccgcctgcagttcgaggatcccgtgaccggttcacaggagagtcttacacagtgctcggcgataccgcaatcgagagcggccaacattattgggaggtgaaggcgcaaaaagactgtaagtcttattcagtcggagtggcctacaaaacactgggaaagtttgatcaattggggaagaccaacacatcgtggtgtattcatgtaaataattggctccaaaatacatttgccgcaaaacacaacaataaagtcaaggctttggacgtgacagtgccagagaaaatcggcgtgttctgcgattttgatgggggacaactgtcattctatgacgcaaactcaaagcagctgctttactctttcaaaactaaattcacccagccagtgctccccggatttatggtctggtgtgggggtttgagcctgagtacaggtatgcaggtccctagtgccgtaagaacacttcaaaaatcagaaaatgggatgacagggtcagcatcctccctgaacaacgttgtaacacagtag

SEQ ID NO: 223282 - DNA, 5685 bp, Artificial Sequence
  Description of Artificial Sequence: Synthetic coding sequence
atggcccctgaagcaggcgcaaccctgagagctcctcggaggcttagttgggcggctctgctgctgctggcagctctgctgcctgtggccagcagcgcagctgcttcggtggaccatcctctgaagcccagacatgtaaagctgctcagcaccaagatgggacttaaagtgacatgggaccctcccaaagatgccacctcaagaccggtggaacactataatattgcctacggtaagtctctgaagtccctgaagtacataaaagtgaatgccgagacatacagtttcttgattgaggacgtggaacctggcgtagtgtacttcgttctgctgacagcggaaaaccactccggcgtctcacgcccagtctaccgcgcagagtccccccctggcggagagtggatcgaaatcgacggctttcctatcaaggggcctggacccttcaacgaaaccgtgacagaaaaggaagtccccaataaaccactgcgagtgcgcgtgcgctccagtgacgaccggttgtcagtggcttggaaagcgccacgccttagcggagccaagagtcccagaaggagcagaggcttcttgctcggttatggtgagtccggcaggaagatgaattacgtgcctctcacgcgcgatgagagaacccatgaaattaaaaagctggcttccgaatccgtctacgttgttagcctacagagtatgaacagccagggcaggagtcagccagtttaccgcgcagctctgaccaagcgaaagatatccgaggaagacgagctggatgtccccgatgatatttctgtgagggtgatgtctagccagtccgtgttggtgagctgggtggaccccgtgctggagaaacagaaaaaagttgtggccagccgtcagtatacagtgcggtatcgtgaaaaaggggaactcgcccgatgggactacaagcagattgcgaacagaagagtacttattgagaatcttatcccagatactgtctacgagttcgcagttaggatctctcaaggggagagagatgggaagtggtctacatctgtgttccagcgtaccccagagagcgcaccaaccactgccccagagaacctgaatgtgtggccggtgaacggaaaaccgaccgtcgtcgctgccagttgggacgcgttacccgaaacagaaggaaaagtgaaggaatacattctgagttatgcccctgccttaaaaccttttggagcgaagagcctgacatatccgggtgatacaacctctgctttagtcgatgggctgcagccaggcgagaggtatctattcaagatccgcgctactaaccgccgaggcctgggtccgcatagtaaggcctttatcgtggccatgccaaccacatccaaggcggatgtagagcagaatacagaggataacggcaaaccagagaagcccgaaccgtcatcaccttcaccacgcgcacctgcttcctcacaacacccatccgtcccggcatctccacagggcagaaatgccaaggacctcctgcttgatcttaaaaataaaatactggctaatggaggagcccctcgaaaaccacagctcagggctaaaaaggcagaggagttggatctgcagagcaccgagatcaccggagaggaagaactgggctctcgtgaggactcccctatgtcaccctccgacacccaggaccaaaagaggacgctccggccaccctcacgccacggccattcagtcgtcgcacccggaagaacagcagtaagagcccgaatgcctgcattgccacggagggagggtgtggataagcccggttttagtctagctactcagcctagaccaggcgcacccccaagtgccagcgcatccccagcccaccatgccagtactcaaggcacaagccatcgccctagcctacctgcttcccttaacgataatgacttggtagatagcgacgaagatgaacgcgcagtgggctcattacatccaaaaggggcattcgcccaacctcgtcctgcccttagtccatcccgccaatctcccagcagcgtgctgcgggataggtcatctgtgcacccaggcgctaaacctgcatcccctgcccgacggacaccgcacagtggcgcagccgaagaggactcatccgcctcagcacccccttccaggctgtctccgccacatggcggtagtagcagattgctcccgacacaaccccacttatctagcccactctctaaaggcggtaaagacggcgaagacgcgccagcaaccaattcaaacgccccaagccgctctaccatgagttcctcagtttcatcacatctgtcctccagaacacaggtcagtgagggggctgaggcgtccgatggagagtcccacggcgatggtgacagggaagacgggggacggcaggccgaggccacagctcagaccctgcgcgctaggcccgcaagcggacatttccacctgttgaggcataagccatttgctgctaacgggaggtcacccagcaggtttagtatcggcaggggacctcgcctgcagccttcgtcatcccctcagagcaccgtgccctcccgggcacacccgagagtgccctctcacagcgactcccaccccaagttgtccagtggcatccacggggacgaggaagacgagaagcccttgccagcaaccgttgtgaatgaccatgtgccatcttcttcccgacagcctatttcccgcggatgggaagacttgagacggtccccgcagcggggtgcctccctgcatagaaaagagcctatccccgagaatcctaagtcaactggggctgatactcatccccagggcaaatacagctccctcgcaagtaaagcccaagacgtgcagcagagtaccgatgccgacacggaaggtcattctccgaaagcccagcccggttctactgataggcacgccagccctgccagaccaccagctgctagaagtcaacagcacccttccgttcctcgtcgcatgacgcccggaagggctccccaacagcaacctcccccacctgtggcgacaagccagcaccatcctggaccccagtctcgcgatgcagggagatccccaagccagccgagactgagcctcacacaagccggacgtcccaggccaacctcacaaggcagatcccatagtagctctgatccctatactgcgagtagcagaggtatgttgcccacggcgcttcagaaccaagatgaggatgctcagggtagttatgatgacgattctacagaggtcgaagcccaggacgttagggctcccgcacatgccgcacgtgcaaaagaagcggcagcgagcctgcccaaacaccagcaggtggaatctcctacaggagcaggtgccggaggcgaccataggagtcagcgcggacacgctgcatcccccgcacgtccatcaaggccagggggtccacaatccagggcgagggtcccatcaagagccgcacccggaaagagtgagccacctagcaagcgccctctgtcatcaaaaagccagcagtccgtgagcgcagaggacgacgaggaggaggacgccggtttcttcaaagggggtaaagaggacctgctctcttcatccgtcccaaaatggccaagttcttctaccccacgtggaggaaaagatgccgatgggtcattagccaaggaggaacgggagcctgctattgctctggctccccgagggggtagcctggcacccgtgaagaggcctctaccacctccaccagggtcaagcccgagagccagccatgtcccgtccaggcttccccctaggtctgcagccactgttagcccagtcgctgggacacatccctggcctcagtatacaactagggctcctcctgggcatttctccaccaccccaatgttgagtctgcggcagcgaatgatgcatgccagatttagaaaccctctaagtcggcagcctgctagaccgagctaccggcaggggtacaacggacgaccaaacgtggaagggaaggtcctaccaggatcaaatggcaaacccaatggccagcggatcataaacgggcctcaaggaacaaagtgggtggttgatctagatcggggactcgtgttgaatgccgagggacggtacctgcaggacagtcatggaaaccctttgaggatcaagttagggggagacggaagaaccatcgtggatctggaaggcactccagtggtgagccctgatgggctcccgctctttggacagggaaggcacggtaccccactcgccaacgctcaggacaagcctatcctgagcctagggggaaaacctctggtagggcttgaggtaatcaaaaaaaccacacacccaccgactactacgatgcaaccaacaacaacaacaacacccctaccaactacaacaactccaagacccaccacagcgactactagaagaactacaactacaagacgcaccaccacccgcagacctacgacaactgtgaggacaactacccgcactacgacaacaactactcctacaccgaccactccgattccaacatgcccccctggaaccttagagcgccacgacgatgacggcaacctgatcatgtctagcaacggcatccctgagtgttacgccgaggaggatgagttctctgggttggagaccgatacagccgtgccaacagaagaggcgtatgttatttatgatgaggactacgagttcgagactagtcgtccaccaacaaccaccgagccctccaccacggccacaactcccagagttatccctgaggaaggagccatcagttcctttcctgaggaggagttcgaccttgccggacggaagaggtttgtggccccttacgtgacttatctgaacaaggatccgtctgctccatgctccttaacagacgccctggaccacttccaggtggatagtttggacgaaatcattcctaacgatcttaagaaaagcgacctgccccctcagcacgcaccacgcaacatcaccgtcgttgctgtggaagggtgccatagcttcgtgattgtggactgggacaaggcaacgcctggtgatgttgtaactggctaccttgtttacagcgcatcatacgaagattttatccgtaacaagtggagtacccaggcatccagcgtcacccacttgcccatagagaacctgaagcccaatacacgctactattttaaggttcaggcgcaaaatccacacggttacggccctatcagccccagcgtgtctttcgtgaccgaatcagacaatccactgctggtcgttagaccccctggtggcgagccaatttggataccgttcgcttttaaacacgatccctcctatacggactgccacggcaggcaatatgttaagcggacatggtatcgaaaatttgtgggggtggtgctttgtaacagcttacgatacaaaatttacttaagcgacaacctcaaagataccttctactctatcggggacagctggggcagaggggaggatcattgccaattcgtcgacagccatcttgacggcaggaccgggcctcagagttacgtggaggctctccccactattcagggctactaccgtcagtacaggcaggaacctgtcagatttggaaatatcggatttggtaccccttattactacgtggggtggtacgaatgcggcgtcagtattcccggtaagtggtat

SEQ ID NO: 223283 - DNA, 5495 bp, Artificial Sequence
  Description of Artificial Sequence: Synthetic coding sequence
atggctcccgaggcaggcgctacattgagggctccccgtagactcagctgggccgctctgctgctacttgccgcactgctgcccgtggcttctagcgctgccgcatcggtcgaccaccctttaaagcctagacatgtgaagctgttgtcgaccaaaatggggctgaaggtgacttgggatccaccaaaggatgcgaccagtcggccagttgagcattacaacatcgcttatgggaagagcctgaagtcactgaagtatatcaaggtaaatgcagagacctatagtttcctgattgaggacgtagaaccaggagtggtctactttgtcctgcttacagctgaaaaccactctggggtgagtcgcccagtgtacagagccgaaagcccccctggcggagagtggattgagatcgatggctttcctattaagggtcctggccctttcaacgagacggtaaccgagaaagaggtccctaataagccactcagagtaagagtccgttcctccgacgaccggctttcggtggcttggaaggcacccagactgagtggagccaaatctccacgcaggtcacgtggcttccttctcggctacggggaatcgggcaggaaaatgaactatgtgccactgacgagagacgaacgaacacatgaaattaagaagttggcctctgaatctgtttacgttgtttccttacagtccatgaattcacagggtaggagtcagcccgtgtatagggccgcactgactaagcgaaagatttccgaggaagacgagctggatgtacccgatgatatctctgtcagggttatgagctcccagtccgtgttagttagttgggttgatccagttctggaaaaacaaaaaaaagtggtggccagtaggcagtacaccgtccgttatcgggagaaaggcgagctggctagatgggactataagcagattgctaatcgtagggtcctgattgaaaacctaataccagacacagtttatgaatttgctgtaagaatctctcagggcgagagagacgggaaatggtccactagcgtgtttcaacggacgcccgaaagtgcccctaccaccgcccctgaaaacctgaacgtgtggcccgtcaatggtaagcccacagtggttgcagcgtcctgggacgcgctgccggagactgaagggaaggtgaaggcttccaaagccgatgtggaacagaacacagaggacaatggcaagcctgaaaagcctgagccctctagtccgtcccccagagctcccgcttctagccagcacccctccgttcccgctagcccccagggcagaaacgccaaggatctgttgctggatctaaagaataagatcttggctaatggcggagcccctcggaagccccagctacgggcaaagaaagccgaggagctggatttgcagtccacggagattacaggcgaggaagaactcggctctagggaagacagtcctatgtcaccctccgatacacaagaccaaaaaagaactttgagaccccctagccggcacggccatagtgtcgtcgcgccaggaaggactgctgttagggcacgaatgccggctctacctaggcgcgagggtgtggataagcctgggttctctctggctacacaacctcgacccggagccccacccagcgcttctgccagccccgcacatcacgcatccacacaggggacttctcaccggccaagcctgcctgcctctttaaatgataacgacctagtcgacagcgacgaagatgaacgcgctgtaggttctctgcacccaaaaggggcttttgcacagcctcgccctgcactgagcccctcccgacaaagcccgtcgagcgtgttgcgggacagatcctcagtgcatccaggtgccaaacctgcttcccccgcaagaaggactccacactcaggggctgccgaggaggattcctctgcatcggctccaccctccaggctttcaccccctcacggaggatcctcgcggcttctcccaactcagccacacctgtcctctccgcttagcaagggcggaaaggacggagaggacgccccagcaaccaattccaatgccccaagcaggagtacgatgtcttcttctgtgtcctcacacctaagctcgcggacacaagttagcgagggggcagaggcctctgatggggaatcccacggggacggcgatagagaggatggaggacgccaggctgaggccaccgcccagacattgagagccaggcccgcttccggacatttccacctgctaaggcataaaccatttgccgcaaacggccgaagtccttcccgctttagtattggacgagggcctcggttgcagccaagctcctcacctcaatccactgtccctagtcgggcacacccccgtgtaccctctcacagcgattcacatccgaagctgagtagcggtatccatggcgatgaagaggatgaaaagcccctgccagcaacagtagtaaatgaccacgtgccctcttccagcaggcagccaatcagcagagggtgggaggatctgaggcgcagtccacagcggggagccagccttcaccgcaaggagcctattccagagaatcccaaatctactggagcagacacccatcctcagggcaagtacagcagtctggccagtaaagcccaggacgtccagcagtctacagacgcggacacggagggtcactcaccgaaggctcagccaggttcaacagatcgccacgcttcaccagctaggcctcccgctgcacggtcccagcaacatccctcagttcccagacggatgaccccaggtagagcccctcaacagcagccacccccacccgttgccacttcccagcaccatcccggtcctcaaagtagggacgctggcagatctccctcgcagcctagacttagccttacgcaggcagggagaccacgtccaacaagtcagggaaggagtcacagcagctcagacccctacacggcctcctcccgaggcatgttgcctacagctctacagaaccaggatgaagatgctcagggatcttatgacgacgacagcacggaagtcgaagctcaagacgtgcgcgctccggctcatgcagctcgcgcaaaggaagctgccgcaagcctgccaaaacaccaacaggttgagtctcccaccggggctggcgctggaggggatcatcggtcccagaggggacatgctgcttccccagccagaccaagtaggccgggaggaccacaatcccgggctcgggtgccctcacgcgctgctcccggtaagagcgaaccaccgagcaagaggccattatcctccaaatctcagcagagcgtgtcagccgaagacgatgaggaggaagatgccggattttttaaaggagggaaggaggatctgctctccagttcagtgcctaagtggcccagcagttctacacccagaggtggaaaagacgccgacggctcccttgcaaaggaggagcgggaacccgcaatagccttggctcctcgtggtggctctctcgctccggtcaaaagacctcttccccctcctcccggttctagccccagagcaagccatgtgccaagccgccttcccccacgcagcgcggcaactgtatctccggtggcaggtacacatccttggccccagtacacgaccagagctccaccaggtcacttctccaccacgcctatgctgtcgctgaggcagagaatgatgcacgcacgatttagaaatccgctcagcagacagccagcaaggcctagctaccggcagggatataacggtaggcccaacgtcgagggcaaggttctccctggctccaacggtaagcctaacggacaaaggatcatcaatggtcctcaaggcactaaatgggtggtggacctggaccgcggtctcgtcctcaacgccgaaggacggtacctccaagactcacacggtaacccgctgcgcattaaattgggcggtgacggacggaccatcgtcgatcttgaggggacccctgttgtttcaccagatggcctgccgctatttggtcagggacggcatggcactccacttgccaacgcacaagataagccaatcttgagcttgggcggtaagcctctcgtgggacttgaggtaatcaaaaagacaacacacccaccaacaaccaccatgcaacccacaactacgaccacccccctcccaaccacaacaaccccaagacctacgacagcaacaacaaggagaaccacaacaacccgccgtacaactacacgaagaccaacaacaaccgtgagaaccactactaggacaacgactactactactcccactcccaccactccaattccaacttgccctcccggtacactcgagcgccacgatgacgacggtaatcttatcatgagcagtaatggaatcccagaatgttatgctgaggaggacgaattcagcggcctggaaaccgatacagcagtgccaactgaggaagcgtacgtgatctacgatgaggactacgagtttgaaacatcccgtcccccaaccactacagaaccttctacaacagccaccactccaagggttataccagaagaaggcgcaatcagctcattccccgaagaggagttcgacttggccggacgcaagcgcttcgtggccccatatgtgacctatcttaataaggacccatctgctccatgcagcttgaccgacgctctggaccactttcaggtcgactccctggacgagattatccccaacgatctgaaaaaaagtgacctcccaccacaacatgcaccaagaaatatcacggtggtagcagtagagggctgccatagctttgtgatcgtggactgggacaaagccacacccggagatgtggtaaccggctacctggtgtactctgcatcttatgaggacttcattagaaacaagtggtctacgcaagctagtagcgtgactcatctcccaatcgaaaacctcaagccaaatacgcgctattactttaaagtacaggcccagaaccctcacggttatggcccaatcagcccatcggttagctttgtcaccgaatctgataatccgctcctcgtcgtgcggccaccagggggagagccaatctggatcccatttgccttcaagcatgacccgtcttacacagactgccatgggcgacagtacgtcaaacggacctggtaccgcaagttcgttggtgtagtgttgtgcaactctctgagatacaagatttacctgtccgataacctcaaagatacattctactcaattggggacagctggggcaggggtgaggaccattgccagttcgttgatagtcacctggacggtaggacaggcccacaatcctatgtggaagccctcccaacaatccagggatattatcgccagtatcgtcaggaacctgtgcggttcggaaacatcggattcggtacaccctattactacgtgggatggtatgaatgcggcgtatcgatccccggtaagtggta

SEQ ID NO: 223284 - DNA, 3615 bp, Artificial Sequence
  Description of Artificial Sequence: Synthetic coding sequence
atgtatgttactatgatgatgactgaccagattccattagaactgccccctctcttgaacggggaagtggctatgatgccacatttagttaacggggacgcagcccagcaggtcatcctggttcaagtcaacccaggggagacatttacaatcagggccgaggacggcactctacagtgcattcagggtccggctgaggtccctatgatgtcaccaaacggttccataccacccattcacgtgccccctggctatataagtcaagtcattgaggacagcacgggtgttagaagggttgttgtaacgccacaaagcccggaatgctatccccctagttatccctcagccatgtcgcctacccatcaccttcctccatacttaacacaccatcctcacttcatccacaactctcacacagcatactacccacccgttaccgggccaggagacatgccacctcagtttttcccacaacatcatctcccacataccatctacggtgagcaggaaattatcccattttatggcatgagtacttatatcactcgggaggaccagtattcaaagcccccacataagaagctcaaggacaggcagatcgaccgccagaatcggttaaattccccaccaagttcgatctataagagcagttgcaccacagtgtataacggatacggaaaggggcacagtgggggtagtggcggtgggggatccggaagtggaccagggattaagaaaacggaacggagagccaggtcgtccccgaagtctaacgactctgacttgcaagaatatgagctggaagtgaagagggttcaagacattctaagtggtatcgaaaagccccaggtcagcaacatccaggccagagcagtggtgctctcctgggcacctcccgttggcttgtcctgcggcccacattccggcctgagttttccctactcttatgaagttgccctgtctgacaagggtagggatggtaagtacaagattatctactccggcgaagagttggagtgtaatctgaaggatctgaggcccgcaactgactatcatgtgcgagtgtacgccatgtataattctgtaaagggctcctgcagcgagcctgtgtcatttacaacccatagctgtgcccctgaatgtccattccctcctaagctcgcccatagatccaagtcaagcctgacactgcaatggaaggctcctatcgataacggatccaagattacaaattacctcctcgaatgggatgaaggcaagcgtaattcaggctttcgccaatgcttttttggtagtcagaagcattgcaaactcacaaagctttgcccggctatgggttatacatttagattggccgcacggaatgacatcggcacatctggatactctcaggaagtggtgtgctacacattgggaaatatcccccagatgcccagtgcaccccgtttagtaagagctggcattacttgggtgactcttcagtggtctaaacccgagggatgcagtcctgaggaggtcattacttatacccttgagatacaggaggatgagaatgacaatctattccatccaaagtacactggggaggacttgacttgcaccgtcaagaaccttaagaggagcacacaatacaagttccgactcacagctagcaatactgagggcaagtcgtgcccttcagaagttctggtttgtacaacctcccctgaccggcctgggccacccaccaggccactcgttaagggccctgtgaccagccacgggttctcagtcaaatgggacccccctaaagataacgggggaagcgagatcctgaagtatctcctggagatcacagacggtaacagcgaggcaaatcaatgggaagtggcgtattcaggatctgcaactgagtatacattcacacacctgaaacccggtaccctatacaagctgcgagcttgctgtatctcaacaggcggacactcacagtgctctgaaagcctgccggtgcggactctctctattgcccctggccaatgtaggccccctcgtgtgctgggcaggcccaaacacaaagaggtccatctcgaatgggatgttccagccagtgagtctggatgcgaagtgagtgagtacagcgtcgagatgaccgaaccagaggacgtagcttctgaagtatatcatggtcccgaactcgagtgtactgtgggtaatcttctgcctggaaccgtgtatcgcttccgtgtgcgtgcacttaacgacggaggatatgggccatatagcgacgtgagcgagattactactgccgcaggtccacccggacagtgcaaggcgccttgcatctcctgtacgcctgacggttgtgtgctggtgggatgggagagtcccgattcctctggtgccgacataagtgagtaccgcctggagtggggagaggatgaggagagtctggaattaatctatcacggcacagatacaagatttgagatacgagacctattgcccgcagctcagtattgttgccgcctgcaggccttcaaccaggcgggtgccggaccctattctgagttggtcctttgccaaacacctgcatctgcgcctgatccggtatccacactttgtgtgctggaggaagagccgctggatgcataccctgactcaccctcagcgtgcctagtcctgaattgggaagaaccctgcaataatggttccgaaattctggcttatacaatcgacctcggagacacgagcattacagttggcaacacaaccatgcatgtgatgaaggaccttctgcccgaaacaacgtacaggatccggatccaggccataaatgaaataggtgcaggccctttctcccagtttattaaggcaaagacccgaccgctgccacccttaccccctcggcttgagtgtgccgctgccggacctcagagcttgaagttgaaatggggagactccaatagcaaaactcacgctgctgaagacatcgtgtatacattgcaactggaagaccggaataagcggttcatatcaatctatcgtggaccttcccatacttacaaagtgcagaggcttaccgaatttacctgttactccttccggatccaggccgcatcagaagccggtgagggcccattttctgagacctacacctttagcacgactaaaagcgttcctccgaccatcaaggctccacgcgtaacgcagctggagggcaactcttgcgagatcctgtgggaaactgtaccttcaatgaaaggcgacccggtgaactacattcttcaggttcttgtgggtcgggaatcagaatataagcaagtctacaagggggaggaagcgaccttccagatttccggcttgcagactaatacggattatcgcttcagggtgtgcgcgtgcaggaggtgcctggatactagccaagagctgtccggagctttctccccatctgccgcatttgttcttcagagatcagaggtgatgttgactggagatatggggtctctggacgatccaaagatgaagagcatgatgcccaccgacgagcagttcgcagcgatcatagtcctgggcttcgcaacattgtctatcctcttcgcatttatcctccaatatttcttgatgaaatag

SEQ ID NO: 223285 - DNA, 216 bp, Artificial Sequence
  Description of Artificial Sequence: Synthetic coding sequence
atgtatgtcacaatgatgatgaccgatcagattccactggagctgcctccattactgaacggggaggtcgcaatgatgcctcaccttgtcaatggagatgcggctcaacaggtgatcctggtgcaggtcaacccaggcgaaacctttactatccgcgctgaggatggaacattacagtgtatccaggaagtcaacgtaaaacggcactgcctgtag

SEQ ID NO: 223286 - DNA, 3615 bp, Artificial Sequence
  Description of Artificial Sequence: Synthetic coding sequence
atgtacgtgacaatgatgatgacagatcaaattcccctagaactccctccactgctgaacggcgaggtggcaatgatgccccacttagtgaatggggatgccgctcagcaggttatcctggtccaggttaacccaggcgagactttcacaatccgcgcagaagacggaacattgcagtgcattcagggacccgctgaagtgcctatgatgagccccaatgggtcaataccacctatccacgtaccacctgggtatatcagtcaggtgatcgaggatagcactggcgtgcggagagtggttgtaacaccacaatctccggaatgttatccccctagctaccccagcgctatgagcccaacacatcatctgcctccctacctgacccaccatccccactttatccataattcccacacagcttactacccgccagtgactggccctggcgatatgccaccccaattcttcccccaacaccaccttccacacactatttatggagaacaggagatcatacctttctatggtatgtcaacttacatcacccgcgaggatcagtactctaaacctcctcataagaaactcaaagatcggcaaatagatcgccagaatcggctcaacagcccgccttccagtatctacaagtccagctgcacaacggtatacaacggttatggaaagggacacagtggcggaagcggagggggtggttccggctccggaccaggaatcaagaagacagaaaggcgggcaaggtcttcccccaaatcaaatgacagcgatctgcaggagtatgagctggaggtcaagagagttcaggacatcctatcagggattgaaaagccacaggtgagcaatattcaagcgagggccgtggtccttagttgggctcctccagttggtctgtcatgcgggccacacagtggactcagctttccttattcttatgaggtagctctctctgacaagggccgagacgggaaatataaaattatctatagcggtgaggaacttgagtgtaacttaaaggatctgcgaccagccaccgattatcacgttcgcgtctatgccatgtataactccgtgaaaggaagctgcagtgaaccagtgtctttcaccacccacagctgcgcaccagaatgcccctttccccctaagttggcccatcgctctaagtcgtctctgaccttacagtggaaagcacccatcgacaacgggtccaagatcacgaactacttactcgaatgggacgaggggaaacgtaactcggggttccggcagtgctttttcggctctcagaaacattgtaagctaactaagctctgcccggctatgggctacactttccgactcgcggcacgaaacgatatcgggacctccggctactcccaagaagtagtatgctatacgttgggcaatataccgcaaatgccatcagcgcctagactggtgcgtgctggcataacatgggttaccctgcagtggtccaaacccgagggatgctcaccagaggaggtgattacctatacactggagattcaggaggacgagaacgataaccttttccatccaaagtacactggggaggaccttacttgtaccgtgaagaatctgaagcgctccacacagtacaagtttcggctgaccgcctctaatactgagggcaaatcgtgcccctctgaagttttggtatgtactacctcccctgaccgtcctgggcctcctacacggccattagtcaaaggccctgtgacttcacacggcttctcggtgaaatgggatcctccaaaagacaacgggggttccgaaatcttaaagtatctgcttgaaattactgacggcaattctgaggccaaccagtgggaggttgcttactccggatctgcgactgagtatacttttacccatctgaagccagggacattgtataaactgagggcctgctgcatcagtacaggtggacattcacagtgttccgaaagtctgccagtcaggaccttgtccatcgcccctggacagtgtcggcctccaagagtccttggcaggcctaaacacaaagaggtgcatcttgaatgggacgtgccagcctcagaaagcgggtgcgaggtcagcgaatattcagtggagatgacagagccagaggatgtggcctccgaggtgtatcacggaccagaattagaatgtaccgttgggaacttgttgcccggaaccgtgtaccggtttcgcgtgcgtgcactgaatgacggtggctatggcccttactccgacgtcagcgagatcacgaccgccgctggacccccaggccagtgtaaggctccatgtattagttgtacccccgatggttgtgtgttagtgggatgggaatcacctgatagcagcggcgctgacatctccgagtacaggctggaatggggagaagacgaggagtccttggagctcatataccacggtacagacacacggttcgagatcagggacctgctgcctgccgctcagtactgttgtagacttcaagccttcaatcaggccggtgccggtccctactccgagctagtcctgtgtcagacacccgcatcagcacccgaccctgtcagcaccctgtgcgttctggaggaggaaccactcgatgcttatcctgacagtccttctgcttgtctcgtcctaaactgggaggagccttgcaacaacgggagtgagatcctggcatacacaattgacctgggagatacaagcatcacagtgggaaatacaactatgcacgtcatgaaggatctgctccctgagacaacgtatcgtatccgcattcaggctatcaatgagatcggagctggcccattcagccagtttatcaaagctaaaacccgccctctgccaccattgcccccacgccttgagtgtgccgctgcaggaccgcagagcttgaaactcaagtggggagactcaaactctaagacccatgctgccgaagacatcgtctacactctccagctagaagatcggaacaagcggttcatctcgatttataggggcccatctcacacttataaggtccagaggttgacagagtttacttgctactcgtttaggattcaagccgcatccgaggccggtgaaggccctttctctgagacatatacgttttcaaccacgaagtcagtccctcccactattaaagcgccacgcgtgactcagctggagggcaatagttgtgaaatcttgtgggaaaccgtgccaagtatgaaaggcgacccggtgaattacattctacaggtcctcgttggacgtgagagtgagtacaagcaggtgtacaagggagaagaggccactttccagatttccggactccagactaatacggactaccgctttcgtgtgtgtgcttgtcgacgctgcttagacacgtcccaggaattgtccggcgcattcagcccctccgctgcttttgtgctgcagcggagtgaagtaatgctaaccggcgatatgggcagtctggacgatcccaagatgaagagtatgatgcccaccgacgagcaatttgccgctataattgtgctgggttttgcaacactttctattctgttcgcatttatactgcagtactttttgatgaaatag

SEQ ID NO: 223287 - DNA, 3615 bp, Artificial Sequence
  Description of Artificial Sequence: Synthetic coding sequence
atgtacgtgaccatgatgatgactgatcagatcccgttggaactgccacctctgttaaatggcgaggttgcaatgatgccccacttagttaacggtgacgctgcccagcaggtgattttagtccaggtgaacccaggcgagactttcacgatccgcgctgaggacggcacgctccaatgcattcaggggccagcggaggtgcccatgatgtctccaaacggtagtattccccctattcatgtgcctcccggttacatcagccaggtgatcgaagatagcacaggtgtaagacgtgtcgtagtgaccccccaaagcccggagtgctaccctcccagctacccctctgctatgagcccaacacaccacctgcctccttacctgacccatcacccccacttcatccataattcccacaccgcttactacccaccggttacgggacctggcgatatgccccctcagtttttcccccagcatcatctgccacacaccatctacggagagcaagaaattatacctttttacgggatgagcacctacattacccgtgaggatcagtattcaaagccgcctcacaaaaagttgaaggaccggcaaatagaccgtcagaaccggcttaacagtcctccgtcctctatatacaaaagctcttgcactacagtctataacggatatggcaaagggcacagcggaggctccggcggaggtggcagcggaagtggcccagggataaaaaagacggagcggagggccaggtcttcaccaaagtccaacgatagcgacctacaagagtacgagctggaagtcaaacgggtgcaggatattctgtccggaatcgaaaagccccaggtgagcaacattcaagcacgagccgttgttctgtcctgggccccacctgttggcctcagctgtgggccacacagcggtctctccttcccctattcatatgaagtggcactcagcgacaagggacgggatggcaagtacaagatcatttactctggggaagagctcgaatgtaacctaaaggatctccgacctgcaaccgactaccatgtgcgcgtatacgccatgtacaacagtgtgaaaggttcttgttccgaacctgtgtcatttaccacacacagttgtgctcccgagtgtccgttcccgcctaaactggcacaccgctcaaagagctccctgactctccaatggaaggccccaatcgacaacgggagcaagatcactaactacttgctcgaatgggacgaagggaagaggaactcaggatttcgtcaatgtttctttgggagccagaaacattgtaaattgaccaagctgtgtcctgccatggggtatactttcagacttgcagctagaaacgatattggtacatcaggctacagtcaagaggtcgtgtgttacacattagggaatatcccacagatgcctagtgcacccaggctcgttcgagccggtatcacgtgggtcactctgcagtggagcaagcccgaaggttgctcgcccgaggaggtgattacttacacgttagagattcaggaggatgaaaacgacaatttatttcacccaaagtatacaggagaagacctgacttgcactgtcaagaacctgaaacgaagcacgcagtacaaatttaggttgacagcgtccaatactgagggcaagagctgcccgagcgaggtgctcgtgtgcactacatcccctgaccggccaggaccccctactagacctctggtcaaagggcctgtaactagccacgggttttctgtcaagtgggacccacccaaagacaatgggggttctgaaattttaaagtatttattggagatcacagacggaaactcagaggctaatcagtgggaagtggcatactcagggtccgccacagagtatacatttacacaccttaaaccaggcactctatataagctgagagcctgttgcatttccaccggcggacactcccagtgctcagagtcgttgccggtccgcacgctgagcatcgccccaggtcagtgtagaccaccacgcgttctcggtcgaccgaagcacaaggaagtgcacctggaatgggacgtccctgcgagtgagtcaggatgtgaagtgtccgagtacagcgtcgagatgactgagcctgaagatgtcgcatccgaagtttatcatgggccagagctggagtgtacggtggggaacctgttacctggaacggtgtacagattcagagtgcgcgctttgaacgacggtggttacgggccttattcagatgtgtctgagataacaactgctgctggcccaccaggccagtgtaaggccccatgtattagttgcacccctgacggttgcgtattagtggggtgggaatctcccgattcaagtggagcggatatctcagaatatcggctcgagtggggagaagacgaagaatctctggaactgatttatcacgggactgacacaagattcgagatcagggatcttctgccggcagcacaatactgctgtcggctccaggccttcaatcaggccggagctggcccttatagcgaactggttctgtgccagacgcccgcatccgcccctgacccagtgagcacattgtgtgtcctcgaggaagagcctcttgacgcctaccctgacagtccgagtgcttgccttgtgttaaactgggaagagccatgtaacaatggatctgagatcttggcgtatacgatcgacctcggcgacacaagcatcactgtggggaatacaaccatgcacgtaatgaaggacttactccccgaaacaacataccgtatcaggatacaggccattaatgaaatcggagccggacccttcagtcagtttattaaggccaagacccgtcccttaccacccctccctcctagattggagtgcgcagccgctggccctcagtccctgaagctgaaatggggcgatagcaactctaaaacgcacgcggctgaagacattgtatatactcttcagctggaagacagaaacaaacggtttatatccatctaccgcggaccttctcacacttataaagttcagaggctgaccgagtttacctgctactcctttaggattcaggctgcgtcggaggccggtgagggcccattctcagagacctacacctttagcaccacaaagtctgtgccgccaaccattaaggcgccacgagtaactcaacttgagggaaattcttgcgagatcctctgggagaccgtgcccagtatgaaaggggacccagtgaactacatcctgcaggtgttagtggggagagaatctgagtataaacaggtgtacaagggtgaggaggctacatttcagatctctggactccagacaaatactgactatcgattccgagtgtgtgcgtgcaggaggtgtttagacaccagccaggaactatctggcgctttttcgccttcagctgcttttgtcctgcagagatctgaggtgatgttaacgggcgatatggggtcacttgacgaccctaagatgaaatcaatgatgcccacagacgagcagtttgccgctattatcgtgttgggtttcgccaccttgtctattttgttcgcgtttattctgcagtatttcctgatgaaatag

SEQ ID NO: 223288 - DNA, 627 bp, Artificial Sequence
  Description of Artificial Sequence: Synthetic coding sequence
atgttcactaaagagaaaatatggtctgaggtcattttagtgcaggtgaatcctggagagacttttactattcgcgctgaagatggcacattgcagtgtatccagggaccggcagaagtgcctatgatgagtccaaatggcagcataccaccaatccacgttccacccggatacatatctcaggtcatagaagactcaacgggcgtacgccgagttgttgtgacacctcagagcccggaatgttatcccccttcttaccctagcgctatgtcgcctactcaccatctaccgccatatttgacacatcacccccactttatccacaactcccacactgcatattatccacctgtcacaggaccaggtgacatgccaccccagttttttccgcagcaccatctgccccataccatctatggggaacaggagatcatccccttttatggaatgtctacatacattacccgggaggatcaatactctaaaccaccacataagaagctgaaggatagacagattgacaggcagaataggctcaattccccacccagttctatatacaagagttcatgcaccaccgtctacaacggctacgggaagggtcacagcggaggcagcggcggatag

SEQ ID NO: 223289 - DNA, 705 bp, Artificial Sequence
  Description of Artificial Sequence: Synthetic coding sequence
atgccgagcgggtgtcacagttctcccccttcagggctccgcggtgacatggcatcactggtgcctctgtcaccatacctttcgccaacagtgttgctgcttgttagttgtgatctgggtttcgtaagagccgatagacccccttccccagtaaatgtcaccgtgacacatttacgcgcaaactctgccactgtgtcctgggacgtgccagaggggaatatcgtaatcgggtattcaatatcccaacagcggcagaatggtccaggccagcgggtcatccgagaggtcaacacaacaacaagggcttgcgctctatgggggctagctgaggactcggattatacggtgcaggttaggtctatcggcctacgcggagaatctcccccaggtcctcgggtccactttcgcacgcttaagggtagcgatagactcccatccaattcttcatccccaggtgatatcacagtcgaagggctggatggtgagcgaccacttcagaccggagaggtcgtgatcatcgtggttgtgttgctgatgtgggcagctgtcattgggttattttgtagacagtatgacattatcaaagataacgatagtaataataaccctaaggaaaagggaaaaggcccagaacagagccctcaaggcaggcctgtcggaactaggcaaaagaagtccccgagcattaacaccattgatgtatag

SEQ ID NO: 223290 - DNA, 2478 bp, Artificial Sequence
  Description of Artificial Sequence: Synthetic coding sequence
atggttggcaaatctcagcagaccgacgttatagaaaaaaaaaagcatatggctatccccaagagctccagcccgaaagcgacccatcggatcggtaacacatcaggttccaagggaagttatagcgcaaaagcatatgagtcaatacgggtctcctccgagctccagcagacttggacaaagcgaaaacacggccaggagatgacaagcaaatccctccagactgacaccattgtcgaggaaaagaaggaggtcaagctcgtcgaggagactgtggtaccagaggaaaagtcagcagacgtaagagaggccgctatcgagctgcctgaaagcgtgcaggacgttgaaataccccctaacatcccctcagttcagcttaagatggaccgttcacagcagacttccagaacagggtactggactatgatgaatatcccaccagttgagaaggtggataaggaacagcagacatatttctctgagtcagaaatagtagtcatcagtagaccggacagctccagtacaaagtctaaggaggacgccctgaagcacaagtctagtggcaaaatttttgcgtctgagcaccccgaattccagccagctacaaatagcaatgaggagatcgggcaaaaaaacatctctcgaacctccttcacccaagagaccaaaaaagggccaccggtgttgctagaggatgaactgagggaggaagttacagttcctgtggtgcaagaagggagcgccgttaagaaggttgcaagcgcagaaattgaaccaccatctaccgagaaatttccagctaaaatccagccgccactcgtggaggaagccacggcgaaagcagaaccacgccctgcagaggagacgcatgtccaggtgcagccaagcacggaagagactcctgacgccgaagcagctaccgccgtcgcggaaaattcggtgaaggtacaacccccaccggcagaagaagcgccactggtggaatttccagcggaaatccaaccgcctagtgccgaagagtctcccagcgtggaattgctggcagagattctacccccttctgcagaggaaagcccatccgaggagccacccgcagaaattcttccacccccagctgagaagtccccatcagttgaactactgggggagataaggagccctagcgcgcaaaaggcaccgattgaggtgcaaccgctccccgcagagggagccctggaagaggctcccgcaaaggtcgagccaccgacagtggaagagacactggcggacgtgcaaccgctccttcctgaagaagctccgagagaagaggctcgggagctccaattaagcacggccatggagacgcctgctgaggaggcacctactgaattccagtcacccttgccgaaagagactacggctgaggaagctagcgccgaaatccagctcctcgccgcaaccgaaccacccgcagacgaaaccccagctgaggccaggtccccgctgtccgaagaaaccagcgccgaagaggcccacgccgaagttcaaagtcccctagcagaagagaccactgccgaggaagcttctgccgaaattcaattgctggcagcaattgaagctcccgctgacgagacaccagccgaggcccagtctccactgagcgaagagacgtctgccgaggaggcgccagctgaggtccagagcccctctgccaagggagtttccatcgaagaagcacccctggagctgcagcccccttctggcgaggagactactgcagaagaagccagtgctgccatccagctgctggcagccaccgaagcctcggccgaagaggcccctgccgaggtgcagccaccgccagccgaagaggctcccgcagaggtgcaacctcctcccgcagaggaagctccagccgaggtgcagcctccccctgcggaggaagccccagcagaggtgcagccaccacctgccgaagaggcccctgcagaggtccagccgccaccggctgaggaggccccagcagaggtgcaaccaccgccagcagaagaagcacctgcggaggtacaatccctccctgctgaagagacgcctatcgaggagacattggccgcagtgcactctccgcctgcggacgacgtgcctgcagaagaagcctcagtggacaaacattccccacccgcagacctgctcctgaccgaagagtttcccataggtgaggcatccgcagaagtgagtccacccccatcagaacagactccagaggatgaagccttggtcgagaatgtgagcactgagttccagagcccccaagtcgctggtatcccagcagtcaagttagggagcgtcgtccttgaaggggaggcaaagttcgaagaagtctcaaagatcaatagtgttctcaaggacctgagtaacaccaatgatggccaggcacctaccttagagatcgagtcagtatttcatatcgagctgaagcagcgccctcccgaattgtag

SEQ ID NO: 223291 - DNA, 2157 bp, Artificial Sequence
  Description of Artificial Sequence: Synthetic coding sequence
atggtggggaagtcacagcagaccgacgtgattgaaaagaagaagcacatggctattcccaaatcttcttcccccaaagctactcaccgtatcggtaacaccagcggatccaagggcagctactcagctaaagcatacgagtccatccgtgtcagcagcgaactgcagcagacttggaccaaaagaaaacacggtcaggagatgacgagtaaatctctgcagacagacactattgttgaggagaaaaaagaggtgaaactggtggaggaaacggtcgttcctgaggagaaaagcgctgatgtgcgcgaggccgcaatcgagttgccggagagcgtgcaggacgttgagatcccccctaacataccatccgtgcaattgaaaatggacaggtcccagcagacttcccgaacggggtactggaccatgatgaacatccccccagtggaaaaggttgataaagagcagcaaacctacttttctgaaagcgagatcgtcgtgataagccgaccggatagttcatccaccaaatcaaaggaagatgcactgaaacacaaatcaagcggcaagatctttgccagtgagcacccagagtttcagccggcaacgaattccaatgaggagattggccagaaaaacatcagcagaacatccttcactcaggaaacaaagaaggggccacctgtgctgctcgaagatgaactccgggaggaggtcacagttcctgtggtgcaagaagggagcgcagtgaagaaagttgcatccgctgaaatcgagcctccaagcacagagaagttcccagcaaagattcaacccccactggtggaagaagctacagccaaggccgagcctcgccctgcagaagaaacccacgttcaggtccaaccttccacggaagagacacctgacgccgaggctgctacagctgtcgccgagaacagcgttaaagtgcaaccccctcccgctgaagaagcacccctggtagaattcccagccgagattcaacctccatcggcggaggagagtcctagtgtggagctcctggctgaaatcctgccgccaagcgccgaggaaagcccatcagaggaacctcccgctgaaattcttcctcctcctgccgaaaaaagcccttcagttgaactgctgggagaaattcgctcacccagtgcccagaaggccccaatcgaagttcagccattaccagccgaaggggcacttgaggaggcaccggctaaagtggagcctccaacagtagaggagacacttgcagacgtgcagccgcttctacctgaggaggcacccagagaggaagccagagagctgcagctctccacggccatggagacccccgcagaggaggcacctaccgagttccaaagcccattaccgaaagagacaaccgccgaagaggcatcagccgaaatccagctcttggccgctaccgaaacctcagcggaagaggcacccgcagaggtccagtctcctagtgctgaagaggccccagctgaggtccagcctcccccagctgaagaggcaccagccgaggtgcaacccccaccagccgaagaggctccagcggaagttcagccccctccagctgaagaagcccctgccgaggtgcagcctcccccagctgaagaagcccctgccgaagtccagcctccccctgcagaagaggccccagccgaggtccagcctccgccagctgaggaagcacctgcagaagtgcagtccctgccagccgaggagacacctatcgaggagactctagccgctgtgcacagcccacctgcagatgacgtgcccgctgaggaggccagtgtggataaacacagcccccctgcagatctgctccttactgaggagtttccgataggcgaggcctcagctgaagtatccccgcctcccagcgagcagacaccggaggatgaggccctggtcgaaaacgtctccactgaatttcaatctccacaggttgctgggatcccagccgtgaagctcgggtccgtcgtgctggagggcgaggccaagttcgaagaagtgtctaagatcaattctgtgttaaaggatctttccaatacaaacgatgggcaagcccctacattggagatcgagtctgtgttccatattgagcttaaacagcggccaccggaactttag

SEQ ID NO: 223292 - DNA, 2052 bp, Artificial Sequence
  Description of Artificial Sequence: Synthetic coding sequence
atggaacgggctgcaccaagtcgaagagtccccctgcctctgctgttactcggcggtttggcccttctagcagctggggttgacgcggatgtgctacttgaggcctgttgcgctgacggccacagaatggcaactcaccagaaggactgttcattaccttacgctaccgaaagcaaggagtgtagaatggtgcaggaacagtgttgtcattctcagttggaggaactgcactgtgccacaggaatttccctggccaatgagcaggaccgctgtgcaactccacacggggataatgcctcactagaggctacattcgtgaaacgctgctgtcactgttgcctgcttggtagggccgcacaggcccagggacagtcgtgcgaatactcactcatggtcgggtaccaatgcggccaagtgttccaagcatgttgtgtgaagtcccaggaaaccggcgatcttgacgtggggggactgcaagagaccgacaaaatcattgaagtggaggaagagcaggaggatccttacctgaacgacaggtgcagaggaggcggtccgtgcaagcagcagtgtagggacactggagacgaagtcgtctgttcttgcttcgtggggtaccagctgctgtctgatggtgtaagctgcgaggacgtcaatgaatgcattacgggtagccattcatgcagattgggagagtcctgcattaataccgtcggctcatttcgatgtcagagggacagctcttgcggcactggttatgaactgacagaggacaacagttgtaaggatattgatgagtgtgaatccggcattcacaattgtctgcctgacttcatttgccagaatacactgggatcattccggtgcaggccgaagctgcagtgtaagtccggtttcatccaagacgcactagggaattgcatagacattaacgaatgcctctcaatcagtgcaccatgccctattggccacacgtgtatcaacacagagggctcctatacgtgtcagaaaaacgtgccaaattgcgggagaggctatcacctgaacgaggaagggaccaggtgtgtggatgttgacgagtgcgctccaccagctgagccctgcggtaagggacaccgatgcgtgaattctcccggaagttttcgctgtgaatgtaaaacaggctactatttcgatggcatttcaaggatgtgcgtagatgtgaacgagtgccagcgctaccccggtcggctctgtggtcataaatgcgaaaatactctaggctcctatctgtgcagctgttccgttggatttagactttctgtcgacgggaggagctgcgaggatattaacgagtgctccagctcaccttgttcgcaggagtgcgccaatgtgtatggctcgtaccaatgttattgtcgtcggggataccagctctctgacgtggatggagtgacatgtgaagacatcgatgagtgtgcccttcctaccggcggacatatatgtagctatcggtgtattaacattccgggatcattccagtgtagctgtcctagctctggataccgactcgctcccaatggcagaaattgccaggacatcgatgaatgtgtgactgggatccacaactgcagcatcaatgaaacctgctttaacatacagggcggatttcggtgtctggcattcgaatgccccgagaactaccggaggtccgccgcaacacgctgcgagagactgccatgccacgagaatagagagtgctctaaactacctctgcgaattacttactaccatctgtcttttccaactaacatccaggcgccagccgtggtctttcggatgggacccagcagcgccgtaccaggtgactctatgcagctggccattactgggggaaacgaagagggattcttcaccacccgtaaggtcagtccgcacagcggcgtggtcgccctgaccaagcccgttcctgagccacgagatttattgctcacagtaaagatggatctttctaggcacgggacagtttcttcctttgtggccaaattatttatcttcgtgtccgctgaactctag

SEQ ID NO: 223293 - DNA, 2112 bp, Artificial Sequence
  Description of Artificial Sequence: Synthetic coding sequence
atggagagggccgctcctagtcggagggtgcccctgcctttactgctcctcggtggcctggcgctcctggccgcaggggttgatgcagatgtgctcctggaggcttgttgcgccgacggtcataggatggccactcaccagaaggattgttccctgccatatgctacagagtccaaggagtgtcgcatggtgcaagaacaatgttgccactcccagctggaggaactccactgtgcaacaggcatctccttagctaatgagcaagacaggtgcgctaccccccatggggacaatgcatccttggaggctacattcgtgaagcgttgctgtcactgctgtctgctgggccgtgccgcacaggcacaaggccagtcctgcgaatattcactgatggtaggttaccaatgcggacaagtgttccaggcctgttgtgtgaagtcccaagaaaccggcgacctggatgttgggggactccaggagaccgacaaaattatcgaagttgaagaggagcaagaagatccatacctgaatgatagatgtcgcggtggtggaccttgcaagcaacagtgccgcgataccggcgacgaagtggtctgctcctgtttcgtgggctatcagctgttgtcagacggtgtgtcttgtgaagacgttaatgagtgtataacgggatctcacagctgcagactcggggaaagctgcatcaacacggtgggctctttcagatgtcaacgggattcctcatgcggtacaggatacgagctgacagaagataactcctgtaaggatattgacgagtgcgagagcggaattcacaattgcctgcccgacttcatttgtcaaaatacattggggagcttcaggtgccggcctaagcttcaatgcaaatccggattcatccaagatgccctgggaaattgtatcgacattaacgagtgtttgtccatctctgctccatgtccaatcggacatacttgcattaacacggagggcagctatacttgtcagaagaacgtgccaaactgtggcagaggataccacctaaacgaagaggggactcggtgcgtagacgtggacgagtgtgcccctcctgctgagccctgcggaaaaggtcaccgctgtgtcaatagccccggatctttcaggtgtgaatgcaagacaggatactactttgacggtatttctaggatgtgtgtcgacgtgaacgaatgtcagaggtatccaggtcggctctgcggccacaagtgcgaaaacacactgggatcttacctgtgctcctgcagtgtcgggttcagactctccgtggatgggaggtcatgcgaagacatcaacgaatgtagttccagtccatgctcacaggaatgcgcgaatgtgtacggaagctatcagtgctattgtcgcagagggtaccagctctcggatgtcgacggcgtgacatgcgaagacattgacgagtgcgcattacccactggcggacatatctgcagttaccggtgtatcaacattcctggtagttttcagtgcagttgcccaagctccggctaccgcctggctccgaatggccgtaactgtcaggatatagatgagtgtgtgactgggattcataactgttctatcaacgagacgtgctttaatatacaggggggtttccggtgcctggcttttgagtgccccgagaactatcggagatccgcagccacgctgcaacaggagaaaaccgacactgtcaggtgtattaagtcctgcaggccaaatgacgtgacatgcgttttcgatccagtgcacaccataagccacacagtcatctccttgccaactttcagagagtttacaaggcccgaggagattatattcctccgagccattactcctccacaccccgcttcacaggccaacatcatattcgacatcacagagggcaacctgcgggatagttttgacatcattaagcgttacatggacggaatgactgtgggagtggtgagacaggttaggcctatagtcggtcctttccacgccgtactgaaattagagatgaactatgtggtgggaggcgtcgtttcccaccggaacgtcgtgaatgtgcatatatttgtgtcagaatactggttttag

SEQ ID NO: 223294 - DNA, 1701 bp, Artificial Sequence
  Description of Artificial Sequence: Synthetic coding sequence
atggagcgcgcagcaccttccaggcgcgtaccattgccattgctgcttctggggggactggcactgctggcagccggtgtcgatgccgacgtgctgctagaggcatgctgtgccgacggccataggatggcaactcatcaaaaagattgcagccttccttatgccactgagtccaaggagtgcaggatggtgcaggagcaatgttgtcacagccagctggaggagctacactgcgccaccggaatcagtttggctaacgagcaggaccggtgtgcaactcctcacggtgacaatgcaagcctggaagctactttcgttaaacggtgctgtcactgctgtttacttggaagagccgctcaagcacagggccagtcttgtgagtattctcttatggttggctaccagtgtgggcaggttttccaagcctgttgtgttaaatcacaggagaccggggatctcgacgtaggcggtttacaggaaactgataagattatcgaggtggaggaggagcaggaagacccgtacctgaatgatcggtgccggggtggcggtccctgcaagcagcagtgtcgggatacaggggacgaggtggtttgttcctgcttcgtaggataccaactgctgtcagatggcgtatcttgcgaagatgttaatgaatgcataactggatcgcactcgtgccgcctaggggagagttgtattaatacagtgggttcctttcgttgccaacgggatagctcttgtgggacaggttatgaattgaccgaggataattcctgcaaagatattgatgaatgcgagtcaggaattcacaattgtctgcctgatttcatttgccaaaataccttgggctcttttcggtgtaggcctaaactccagtgtaaatcaggatttatacaggatgctctggggaattgcatcgacattaacgagtgcctgtctatatccgccccttgtccgataggccacacttgtatcaacactgagggctcatatacttgtcagaagaatgtgcccaattgtggacgaggataccatctgaacgaagagggaacccgttgcgttgacgttgacgaatgcgcccctcccgcagaaccctgtgggaaaggccatcggtgcgtcaatagtcctgggtccttcagatgcgaatgcaaaaccggatattatttcgatggtatatcccgaatgtgtgtggacgtgaacgagtgtcagcgctaccctgggagactttgtggtcataagtgtgagaataccctcggaagttatctgtgcagctgttccgttggctttcgactctccgtcgacggcagaagctgtgaagatattaacgagtgctcctcatctccgtgctcccaggaatgcgctaatgtatatgggtcttatcagtgctattgcagaagaggataccagctgagcgacgtcgacggcgtcacgtgtgaagacatcgacgagtgcgcccttcctaccggaggacacatctgtagttacaggtgcataaatatccctggatccttccagtgtagctgtccctccagtggttaccgcctcgctcccaatggacgaaactgtcaggacatcgacgagtgtgtaacagggatccacaattgttcaattaacgaaacttgcttcaacattcaaggcggattccgatgtttggcattcgagtgccccgaaaattacaggcgcagcgctgccacatag

SEQ ID NO: 223295 - DNA, 2112 bp, Artificial Sequence
  Description of Artificial Sequence: Synthetic coding sequence
atggagcgcgcagcgccatccaggcgggtaccgttgccactcctactactggggggattggccctcctggccgcaggtgtcgatgcggacgtcctattggaagcatgctgcgcggatggccatcgcatggcaactcatcagaaagactgctcactcccttatgctacagaatccaaggaatgccgcatggtgcaggaacagtgttgccattctcagctggaggaactgcactgtgccaccgggatttccttggccaatgagcaggacaggtgtgcaaccccgcacggggataacgcaagcctggaagccaccttcgtcaagagatgctgccactgttgtctgctgggccgtgccgctcaggctcagggtcagtcctgtgaatactccctgatggtcggctaccaatgtggacaggtgttccaggcgtgctgcgtgaagagtcaggagaccggcgatctggacgtcggcggtttgcaagaaaccgacaagattatcgaggtagaagaggagcaggaagacccctacctgaacgacaggtgtagggggggaggaccctgtaaacagcagtgcagggacaccggtgacgaagtagtgtgttcctgcttcgttgggtatcagctactctcagatggggtgtcctgtgaggacgtgaacgagtgcattacggggtcccattcctgtcgtcttggcgaatcatgcatcaacacggtgggctctttcaggtgtcagcgggattcatcctgtggcacggggtacgagctgacagaagacaactcctgcaaagatattgatgaatgtgagagtggcatccacaactgtctgccagactttatctgccagaataccctggggtcattccggtgtcgcccaaagctgcaatgtaagtcaggatttatccaggacgcactaggcaactgcatcgacattaatgagtgcctttctataagcgccccatgccctattgggcatacatgtatcaatacagagggatcatacacctgccagaagaacgtgcctaactgtggtcggggatatcacttgaatgaagagggcaccaggtgtgtcgacgtggatgagtgcgcaccccctgcggaaccttgcgggaagggccatcgctgcgtcaatagccctggatcctttagatgtgagtgtaaaactggctattactttgacggtatcagccgcatgtgtgtcgacgtgaatgagtgtcagcgctatcctggtcgcctctgtggtcacaagtgcgagaacaccctgggaagttacttgtgttcctgctccgttggttttagacttagcgtggacggacgcagctgcgaggacataaacgaatgctccagctctccctgctcccaggagtgcgcaaacgtttatgggtcttaccagtgctattgtcggaggggataccagctttctgacgtcgatggcgtcacctgcgaggacatagatgagtgtgcgctgcctactggtggccacatctgctcctaccgctgcattaacatccctggatcgtttcaatgtagctgcccgagcagcggatatcgcctggcgcctaatggcagaaattgccaggacatagacgagtgtgtgacaggcatccataattgcagtatcaacgaaacttgtttcaacatccagggcggattccggtgtttggcatttgagtgccccgagaattaccgcagatccgcggctacccaaaagtctaagaagggtcgccagaatacacctgcaggttcaagcaaagaggattgtcgtgtcctgccatggaaacaaggcctcgaggacacccaccttgatgcctatctgccgtgctgccggaggttcacacggcctgaggaaatcatttttctaagggcaattacacccccacacccagcgtctcaggctaacataatctttgacattaccgaggggaatctcagagactccttcgacattattaagcgttacatggacggtatgacagtgggcgtcgtacgacaagtgaggcctatcgtggggccatttcatgccgtgcttaaactggaaatgaactatgtggtgggtggagtggtttcccaccgaaacgtggtcaacgtccatatatttgtcagtgagtattggttctag

SEQ ID NO: 223296 - DNA, 2166 bp, Artificial Sequence
  Description of Artificial Sequence: Synthetic coding sequence
atggagcgggctgcccctagtcgccgagtgcctctccccctcctgttgttggggggtctggcattacttgcagccggtgttgacgccgacgtgctgctggaggcttgttgcgcagatgggcaccggatggccacacatcaaaaggattgttctctgccgtacgccacagaaagtaaggaatgtagggctgtggggctggcatctctgtgtcaggacctgaatggagcctgggcagtatggaaagttggcagagcctctcaagctgaaggaaccgcttcagcgagggctcagagaagaggcatggtacaggaacagtgttgccatagccagctcgaagagctgcactgcgcaactggtatctcattggcaaacgagcaagaccggtgtgcaacccctcatggcgacaatgctagcttagaagctacgttcgtgaaacgatgttgtcattgctgtctgttgggcagagcggctcaggcgcaggggcagtcatgcgaatattcactcatggttggctaccagtgtggtcaggtgttccaggcatgttgcgttaaaagtcaggagactggggacctggacgtcggaggactgcaggagaccgacaagatcattgaggtcgaagaagaacaggaggacccctatttaaacgatagatgccgtgggggaggcccatgcaagcagcaatgcagagatactggcgatgaggtggtgtgtagctgcttcgtcggataccagcttctgtcagacggagtgagctgcgaggacgtaaacgaatgcatcactggttcacacagctgtcggctgggggagtcttgtatcaatacagtcgggtcttttcgatgtcagcgtgacagctcatgcggcaccggatacgagcttacagaggataacagctgcaaagacatcgacgagtgtgaatccggcatacacaattgtctccccgacttcatctgtcagaacacactcggaagcttcagatgtaggccgaagttgcagtgtaagagcggctttattcaggacgccctgggcaactgcatcgatatcaatgaatgtctatctatttcagcgccatgtcctatcgggcacacttgtatcaacactgagggaagctacacatgccagaagaatgtgcctaactgcgggagaggctaccatctgaacgaagagggcacacggtgcgtggatgtggacgagtgcgcacctccagcagagccctgtggaaaaggacacaggtgcgtgaacagcccgggaagcttcaggtgcgagtgcaagacaggttactactttgacggaatctcccgtatgtgtgtggatgtaaacgaatgtcagaggtatcctgggaggctgtgcggccataagtgcgaaaatacattggggagctatctgtgctcatgttctgtgggtttcaggctctccgttgatgggcgatcctgtgaagacattaacgagtgttccagcagtccttgctcgcaggaatgcgcgaacgtgtacgggtcctaccagtgctattgcaggagagggtatcagcttagtgacgtggatggtgtcacttgcgaggacatcgatgagtgtgccctacctacaggtggccatatttgttcttacaggtgtatcaatatacctgggtcctttcagtgctcatgtccatctagtggatacagactggcgcctaatgggaggaactgccaagacattgatgagtgcgtgacgggcattcacaactgcagtattaatgagacgtgctttaatattcaagggggatttagatgtctcgcttttgagtgtcccgaaaactaccggagatcggccgctacacggtgcgagcgcctcccttgtcatgaaaaccgggagtgttctaaacttccactgcggattacttattatcaccttagcttccccaccaacatccaggcacctgccgtcgtgtttcggatgggcccatcaagcgctgtccctggcgacagcatgcagctcgctattaccggaggcaacgaggagggattttttaccacccggaaagttagcccccacagtggtgtggtggccctcactaagcctgtgcccgagcccagagatctgctactgacggtcaagatggacctctcgagacatggaacggtgagctcttttgtggctaagctgtttatatttgtttccgctgaactctag

SEQ ID NO: 223297 - DNA, 570 bp, Artificial Sequence
  Description of Artificial Sequence: Synthetic coding sequence
atgaatagctacacaaggggatcccggcgtcccagcgctaaagccgcatctccagcggcatcggtcacatcccgtgtgtccccctcaggaccaggcgtgcctgtcgatgctgatgtgttgttggaggcttgctgtgctgatgggcaccggatggctacccatcagaaagactgttcccttccctacgcgaccgaaagtaaggagtgcaggatggttcaggagcagtgctgccacagtcagctggaggaattgcattgtgccactggtatctccttagccaatgaacaggatcgatgcgctactcctcatggcgataatgcctccctagaggcaactttcgttaaaaggtgctgccattgttgtttgctgggacgagccgctcaggcccaaggccagagttgcgagtactcattaatggtggggtaccagtgtggacaggtcttccaggcctgctgcgtgaaaagtcaggagactggcgacctggacgtgggcggtctgcaagagaccgataagatcatcgaagtggaagaagagcaggaggacccctatctgaacgatcgctgccggtag

SEQ ID NO: 223298 - DNA, 81 bp, Artificial Sequence
  Description of Artificial Sequence: Synthetic coding sequence
atggcgacccaccagaaggattgctctctcccttatgctacagagagtaaggagtgcagaatggtgcaagaacagtgctag

SEQ ID NO: 223299 - DNA, 1806 bp, Artificial Sequence
  Description of Artificial Sequence: Synthetic coding sequence
atggagcgggcagccccttctcgaagggtgccactgccactgctgctgctcggcggtctggccctccttgcggcaggagtggatgccgacgtcctcttggaggcatgctgtgctgacgggcacaggatggccacccaccaaaaagattgctcgcttccctatgcaactgagagcaaagagtgtaggatggttcaagaacagtgctgtcactctcagttggaagaactccattgtgccacaggcattagtctggcaaatgagcaggaccggtgtgccactccccacggggataacgctagcctcgaagctacctttgtgaagaggtgctgtcattgttgcctattgggaagagcggctcaagcccaaggccagtcttgtgaatatagcttaatggtggggtatcaatgcggacaggtttttcaggcctgctgcgtcaagtcacaggagactggggatctggacgtaggcggactgcaggaaacagataagataatcgaggttgaggaggagcaggaagacccctacctaaacgatagatgcagggggggaggaccctgtaaacagcagtgcagggacaccggcgacgaagtcgtttgtagctgctttgtggggtatcagctcctcagcgacggtgtgtcctgcgaggatgttaatgaatgcatcaccggctctcactcttgtcggctcggcgaatcgtgcattaatacagtgggcagttttcgctgtcagcgtgacagttcctgcggtactggttacgaattgaccgaggacaactcatgtaaagatattgatgagtgcgagtcgggtatccacaactgcctcccagattttatctgtcagaatacccttggttctttccgctgtagacctaaactccaatgtaagtctggattcatccaggatgcattagggaattgtatcgacatcaacgagtgtctgtcgatctctgccccatgcccaataggccatacttgcatcaacaccgagggaagctatacctgtcagaaaaacgtacccaattgcggaagggggtatcatctcaatgaggaggggacccgatgcgttgatgtggatgaatgtgcccctcctgctgaaccatgcggcaaaggccaccgctgcgttaatagccccggttcctttcgatgcgaatgtaaaacaggctattactttgacggtataagccgaatgtgcgtagatgtgaatgagtgccagcgctaccctggacgcctttgcggtcacaaatgtgaaaataccctggggtcgtacctatgttcctgttctgtaggctttcggctatccgtggacggccgatcttgtgaggatataaatgagtgcagcagctctccatgctcccaggaatgcgcaaatgtatacggatcctaccagtgctattgccgccgtggataccagctatccgacgtggacggagtgacatgcgaggacatcgatgagtgtgctctacccacaggtgggcatatttgttcctacaggtgtattaatattcccggttcgttccagtgctcctgtccttcttcagggtacaggctagcgcctaacggacgaaactgtcaggatattgatgagtgtgtaacgggcattcacaactgctccataaacgaaacttgcttcaatatccaaggcggtttcaggtgtctggctttcgagtgtcccgagaactacaggagaagtgcagcgacccagaagagcaagaaaggcaggcagaacacgcctgctggtagtagcaaagaagattgcagggtactgccatggaagcaagggctagaagacacacatttagacgcgtag

SEQ ID NO: 223300 - DNA, 198 bp, Artificial Sequence
  Description of Artificial Sequence: Synthetic coding sequence
atggctacccaccagaaagattgcagcctgccctatgccaccgagtcgaaagagtgtcgcatggtgcaagaacagtgttgtcattcacagctggaagagcttcattgcgccacgggtatatctctcgcgaacgagcaagatcgctgtgctacaccccatggcgacaacgcctccctagaagctacattcgtgaaatag

SEQ ID NO: 223301 - DNA, 546 bp, Artificial Sequence
  Description of Artificial Sequence: Synthetic coding sequence
tgccggatggtgcaggaacaatgttgtcactcccagcttgaggagttacactgtgccaccgggattagcctggccaacgaacaagatcggtgcgcaacccctcacggagataacgcctctttggaggctacttttgtcaagagatgctgccactgctgtctgctgggcagagctgcacaagcacagggacagagctgtgaatactccttaatggttggctaccagtgcggccaggtgttccaggcttgctgcgtgaagagtcaggagaccggtgacctcgacgtggggggactccaggagacaggcggaggaccatgcaagcagcagtgtcgtgacacgggggacgaagtggtgtgtagctgctttgttgggtatcagctccttagtgatggcgtgtcttgtgaggacgtaaacgagtgtatcacggggtcccattcctgtaggttgggcgaatcctgtattaacaccgttggctccttccgttgtcagcgtgatagctcttgtggcacagggtacgaactgacagaggataactcgtgtaaatag

SEQ ID NO: 223302 - DNA, 420 bp, Artificial Sequence
  Description of Artificial Sequence: Synthetic coding sequence
atggcaacgcatcagaaagattgctctctgccatatgccacggagagtaaggagtgccgaatggtccaagagcagtgctgccactctcaacttgaggagctgcactgtgctacaggaattagtctcgctaacgaacaggaccgctgcgctaccccccacggagataacgctagtctcgaagcgaccttcgtgaagcgatgttgtcattgttgtcttctcggcagagccgcacaggctcaaggacaatcatgcgagtactctcttatggtaggctaccaatgtgggcaagtctttcaggcgtgttgcgtgaagtcccaggagactggcgatctggacgtgggcggtctgcaggaaacagataagataattgaggtcgaagaggaacaggaagatccatatcttaacgatcgctgccgctag

SEQ ID NO: 223303 - DNA, 519 bp, Artificial Sequence
  Description of Artificial Sequence: Synthetic coding sequence
atggaacgtgccgctcctagccgccgtgtgcctctcccccttcttctcctggggggtcttgccctcctcgccgctggggtggacgccgatgttttactggaagcgtgttgtgctgatggccacaggatggctacacatcaaaaggactgctctctgccctacgccactgagagcaaggagtgcaggatggtccaggagcagtgctgtcattcacaactggaggagctacattgtgcaacaggaatttctctcgccaacgagcaggaccggtgtgcaaccccccacggcgacaacgctagcctcgaagctacatttgttaagcgatgctgtcactgctgcctgcttggacgggctgcgcaggcacaggggcagagctgcgagtatagtctcatggtcggttaccaatgcggacaagtcttccaggcttgttgcgtgaagtctcaagaaacaggagatctggatgtaggaggtcttcaggaaactggcggaggaccctgtaagcaacagtgcagagattag

SEQ ID NO: 223304 - DNA, 3555 bp, Artificial Sequence
  Description of Artificial Sequence: Synthetic coding sequence
atggtgctcctgtgggagcccgcaggcgcttggctggcccttggccttgctctggccttaggcccaagcgtagctgccgctgctcccaggcaggattgtaccggcgtggagtgtccaccgctcgagaactgtatagaggaagccttagaacctggagcatgttgcgctacttgtgtgcagcaaggctgtgcttgcgagggttatcagtactatgattgcttgcagggaggcttcgtgaggggacgggtgcccgctggacagtcctattttgtggacttcggtagcaccgagtgctcatgcccccctggaggcggaaaaattagttgtcagttcatgctttgccctgagctacccccaaactgtatcgaggctgttgtggtggccgatagctgcccccagtgcggtcaagtaggttgcgtccacgccggacacaagtacgccgcaggtcacaccgtgcatctaccaccctgtagggcctgccactgtcccgacgcaggtggagaactgatttgctaccagctccccggatgtcacggcaacttctccgatgccgaggagggtgaccctgaaaggcactacgaggacccatattcttacgatcaggaagttgccgaggttgaggctgcaaccgccctgggcggtgaagtacaggcgggagccgtacaagccggtgccggaggcccacccgcagctctcgggggaggatctcagcccctcagcacaatacaggcaccaccttggcctgccgtcctgcctaggcctaccgctgccgcagcacttggtccgccagcacccgtgcaggcaaaggcgagaagagtgacagaggactcagaggaagaggaggaggaggaagaagagcgggaggaaatggcggtcaccgagcagttggctgctggcggtcaccgagggcttgatggactgcccaccaccgctccagcaggaccaagcctgcctatacaggaagagagggccgaggcaggcgctagggcagaagctggtgccaggccagaggaaaacctcattttggacgcacaggccactagccgatctaccggtcccgaaggggtgacccatgcccctagcttggggaaggccgcactagtgccaactcaagccgttcccggtagcccgagggaccccgtaaagccaagtccccacaacattctgtctacaagccttcccgatgcggcatggattcccccaacacgtgaagtgccccgaaagcctcaagtgctaccacactctcacgtggaggaagataccgatccaaacagtgtgcatagcattccgagaagcagcccagaaggttcaactaaggatcttatcgaaacttgttgcgccgcaggtcaacagtgggccattgacaacgatgaatgtctggagatccccgaaagcggcacagaggacaacgtttgtcgaacggcgcagcggcactgttgtgttagttacctgcaggaaaaaagctgcatggctggcgtgctcggggctaaggaaggagagacatgtggagcagaggacaacgactcctgcggcattagtttatacaaacagtgttgcgattgctgtggccttgggttgcgtgttcgagccgagggccaatcatgcgagtctaatccaaacttgggctacccttgtaaccatgtgatgctatcttgttgtgaaggtgaggagcccctcatcgtcccagaggtgaggcggccaccagagcctgccgctgccccaagaagggtgtctgaagcagaaatggccggtcgcgaggctctttccctggggactgaggcggagctgcctaatagcctgcctggtgatgatcaggatgaatgcctcctgcttcctggcgaattgtgccagcacctgtgtatcaacacagtaggtagctaccattgtgcatgttttcctgggttctccctgcaggacgacgggaggacttgccgacctgagggtcacccccctcagccagaggcaccccaagagcctgcgcttaagtctgagttctcgcaggtagcctctaacactattcctctgcccctcccacagcccaacacatgtaaggataacggaccttgcaaacaggtgtgcagcaccgtggggggatccgcaatttgtagttgttttcccggatatgcaattatggccgacggcgtgtcatgcgaagatattaatgagtgtgttacggacctccatacctgcagtagaggagaacactgtgtcaacaccctgggcagctttcactgctataaagcgctcacttgtgagccaggctatgccctgaaggatggcgaatgtgaggatgttgacgaatgcgcgatgggaacacacacctgtcagcccggatttctgtgtcagaacacgaagggatctttttattgccaagcgcgtcagcggtgtatggatggttttttgcaggacccggaaggcaactgtgtcgatattaacgagtgtacaagcttgtctgaaccctgcagaccgggtttcagctgtattaacacagtgggcagctacacttgtcagcggaacccactgatctgtgctagagggtatcatgctagtgatgatggcactaaatgcgtggacgtgaacgagtgtgagacaggcgtacaccggtgcggcgaggggcaagtgtgccacaatctacccggatcatacagatgtgattgcaaggccggtttccagagagatgcatttggaaggggctgtatcgacgtaaatgaatgttgggcctcaccaggaagactgtgccagcatacctgtgaaaataccctgggcagctacagatgttcctgtgcctcaggtttcctgctggccgctgatggaaaacgctgtgaggatgtaaacgagtgtgaggcccaacgatgctcccaggaatgcgcaaatatttatgggtcctaccagtgctattgcaggcaaggctatcaacttgccgaggacggccatacctgtactgatatcgacgaatgcgcccagggtgccggtatcttatgtactttccggtgcctgaatgtccctgggtcgtaccaatgtgcttgtcccgagcagggctacaccatgactgctaatggacgtagctgtaaggatgtcgatgagtgtgcactgggaactcacaactgtagtgaagcagaaacttgtcacaacatccagggaagtttccgttgtctcaggttcgaatgtcctcccaattatgtccaggttagtaagactaaatgtgagcgcacaacttgtcatgacttccttgagtgtcagaacagccctgctagaattactcactaccaactgaatttccaaaccggtcttctggttcccgctcatatatttcgcattgggcctgctcccgctttcaccggggatacgattgctctgaacataatcaaaggcaatgaagagggctatttcggtacccgcagactgaacgcctacaccggtgtagtgtacctccaaagggcagttttggagcctcgagatttcgcactagacgttgagatgaaattatggcgccagggaagtgtcacaacattcctggcaaaaatgcatatcttcttcactacctttgccttatag

SEQ ID NO: 223305 - DNA, 3696 bp, Artificial Sequence
  Description of Artificial Sequence: Synthetic coding sequence
atggtgcttctgtgggagccagctggtgcctggctggctcttgggctcgctctggccctgggaccaagcgtcgccgctgctgcccctaggcaggattgtacaggcgtcgaatgccctccactagaaaactgtatcgaagaagccctggaaccgggtgcttgttgtgccacatgtgtccaacagggttgcgcttgtgaggggtatcagtactatgattgcctgcagggaggattcgtgcgtggaagggtgcccgctggtcagagctattttgtcgactttgggtctacggaatgttcttgccctccgggaggcggaaaaattagctgccagttcatgttgtgtccggagttacctcccaactgcattgaggcggtggtcgtggctgactcttgtccccagtgtggccaggtgggttgtgtccatgctgggcataagtatgctgctggacatacagtacaccttcctccgtgccgcgcatgtcactgcccagacgcagggggagaactgatctgttatcaactgccaggatgccatggaaatttctctgacgccgaggagggtgaccccgaaaggcactacgaggacccttatagttatgaccaagaggttgctgaggttgaggctgcaaccgctttggggggagaggtacaggcgggtgccgtccaggcaggggctggcggacctcctgctgcgttgggagggggatcccagcccctgtcaaccattcaggcccctccatggccagccgtgctacctcgtcccacagcggcagccgcactgggaccacctgcgccagtgcaagcaaaagccaggagagtgacagaagatagcgaggaggaagaggaagaagaagaagagcgagaggaaatggctgtaacagagcagctagcggctgggggacatagggggctggatggcctgccaactaccgcccctgccggtccttctctgcccattcaggaggagcgcgcagaggctggagcaagggccgaggctggtgcaagaccagaggagaatttgatcctggacgcccaggccacgtcgaggtccacaggacctgagggggtcacccacgccccaagcctgggcaaagcggcactggtgccaacccaagccgtgccgggaagcccacgggacccggtgaagccaagcccccacaatattttgagtacgagtctgccggatgctgcgtggatccctcctactcgggaagttccacggaaaccgcaggtcctgccacacagccacgttgaggaggacacagatccaaactccgttcatagtatccctcggagcagcccagaagggtctaccaaggatctcatcgagacctgttgtgcagcgggtcaacagtgggccattgataacgatgagtgtctcgaaatccctgagagcggcactgaggacaacgtatgccgcactgcacagcgacattgctgcgtttcgtacttgcaggaaaaatcatgtatggctggagtgttgggggctaaggagggggaaacctgtggggctgaggataacgattcttgcggcatctctctttataaacaatgctgtgactgttgtgggctgggattaagggtgagggctgaagggcagtcctgtgaatctaaccctaatctaggctacccctgtaaccacgtgatgctttcttgctgcgagggcgaagaacccctgattgtcccagaggtgcgcagaccacccgaacccgctgccgctcctcgtagggtgtcagaggccgaaatggcgggaagagaagccctgtcacttggcacggaagccgagctgccaaatagtctgcctggggacgatcaggacgaatgcttactcctgcccggtgaattgtgtcaacatttgtgcatcaataccgttgggagctaccattgcgcatgcttcccgggattcagcttacaggatgacggtcggacctgcagaccggaaggtcatcccccacaacccgaggctccccaagagccggcactcaagtccgaattttctcaggtcgcatctaacacgatcccactcccactgccccagccaaacacctgtaaggacaacggaccatgcaagcaggtttgttctactgtggggggttcagctatctgtagctgttttcccggatatgccattatggctgacggcgtgtcctgcgaagatcaggatgagtgtctcatgggcgcacacgactgcagcagaaggcaattctgcgtgaatacgctcggcagtttctattgtgtaaatcatactgtgctctgcgcggacggttacattctgaacgcccataggaagtgtgttgacatcaacgagtgcgttaccgatttacatacctgctctcgaggcgaacactgtgtgaacacactgggttccttccattgctacaaggcactcacctgcgaaccaggatatgctcttaaggatggtgaatgcgaggacgtagatgagtgcgcaatgggcacacatacgtgccaaccaggctttctgtgtcagaacaccaagggaagcttttactgtcaggccaggcagcgttgtatggatggcttcctgcaggatccagaaggcaactgtgtggatattaacgaatgcacatccctctctgagccctgtagacccggattcagctgcattaacacagtcggatcctacacctgtcaacggaaccccttaatatgtgcgaggggctaccacgcttcagacgatggcactaaatgcgtagacgtgaatgaatgtgaaactggggtacacaggtgtggcgaggggcaagtgtgtcataatcttccagggtcttacaggtgcgattgcaaagccggatttcaaagagatgccttcggcagaggctgtatcgacgtgaacgagtgctgggcttcacccggaaggctttgccaacatacatgtgagaacacccttggctcttatagatgcagttgcgcctcgggctttctgctggccgcagatgggaagaggtgtgaagatgttaatgagtgcgaggcgcagaggtgctcccaagagtgcgcaaatatttacggaagttaccagtgttattgccgccaggggtaccagcttgcggaggatgggcacacctgtactgacatcgacgaatgcgcacagggagccggaattttatgcaccttccgctgcttgaatgtaccagggagctaccagtgtgcatgtcctgaacagggatatacgatgactgccaacggacggtcttgtaaagacgtggatgagtgtgcgctcggtacacacaactgctcagaggctgagacatgccacaacatccagggctctttcagatgcctgcggttcgagtgtccccctaattacgtgcaggtgtctaaaacaaagtgtgaacggaccacgtgccatgatttccttgagtgtcagaactctcctgctaggattactcactaccagttgaatttccagacagggttgctagttccagcacacatttttcggatcggcccagcacctgcctttactggggacacaattgccctcaacatcataaaaggtaacgaggagggttacttcggcactaggagactcaacgcatacaccggggtcgtgtatctgcagcgggcagttctggagccacgggacttcgcactggacgttgaaatgaagctgtggaggcagggaagcgtcactacttttctcgccaagatgcatatttttttcactacattcgcgctgtag

SEQ ID NO: 223306 - DNA, 480 bp, Artificial Sequence
  Description of Artificial Sequence: Synthetic coding sequence
atggtgctcctgtgggaacctgctggggcatggttggctttaggactggccctggccttgggaccgagtgtcgcagctgcagctcctagacaggactgcacgggcgttgaatgcccgccacttgagaattgtatagaagaagcactggaaccaggcgcttgctgtgccacttgtgtccagcagggctgcgcgtgtgaaggctatcagtattacgactgtctacaagggggtttcgttcgtggcagagtacctgctggccagagctatttcgtggatttcggttctacagagtgttcctgtcccccagggggtgggaaaatttcctgccagttcatgctctgccctgagctgcctccaaactgtatagaggcagtggtggtcgccgattcatgcccccaatgcggccaggtgggttgcgtacatgccggacacaagtatgctgcagggcatacggtacacctgcctccttgtagggcgtag

SEQ ID NO: 223307 - DNA, 3696 bp, Artificial Sequence
  Description of Artificial Sequence: Synthetic coding sequence
atggtgctgttgtgggaacctgccggagcttggcttgcattgggattggccctggcgctcgggccatccgtggcagccgctgctcctcggcaggactgtactggggtggaatgcccgccacttgagaactgtattgaagaagcgctcgaaccaggcgcttgctgcgccacctgtgttcagcaaggctgcgcatgtgagggataccagtactatgattgtctccagggcggattcgtgcggggacgggtgcctgctgggcagtcgtactttgtcgactttggcagcactgaatgttcttgcccacctggcggtgggaaaatcagctgccagtttatgctgtgccccgagctgcccccaaattgcatcgaagcggttgttgtggcggatagctgtccacaatgtggacaggtgggatgcgtccacgccggacacaagtacgccgctggacacacagtccacctgcctccctgccgagcatgccactgtcctgacgcaggcggtgagcttatttgctaccaacttcctggctgccatggtaacttttctgacgcggaggagggcgatcccgagaggcactatgaagatccctattcttacgatcaggaggtggctgaagtcgaggctgctacagctctggggggtgaggtccaggctggggcagtgcaggccggagccggaggcccaccagcggctctgggcggtggatctcagcccctttctactatccaagcccctccctggcctgccgttctgcctaggcctactgctgcagccgcactgggacctccggctccggtgcaggctaaggccaggagagtgacggaggactcagaagaggaggaggaagaggaagaagagagggaggaaatggccgtgacagagcaactcgctgccggtggacatcgcggactcgatgggctcccaactacagcacccgcaggaccctctttgcctattcaggaagagcgggctgaagctggcgctagagccgaggcaggcgctaggccagaggaaaacctcatactggacgctcaggcaacaagccgcagtacaggaccggaaggagtgacgcatgcgccatcactcggtaaggctgccctggtgcccacccaggccgtacccggatccccacgagaccccgttaaaccatccccacataatatcctgagcacgtcccttccagacgccgcttggatcccacccacacgagaagtgccgagaaaaccacaagtgttaccacacagtcatgtggaggaggatacagatcccaacagtgtacactcaattcctcggtcttcacccgaaggtagcaccaaggatcttatagaaacatgttgtgctgccggtcaacagtgggccatcgacaatgacgagtgtctcgagattcccgagtcgggcacagaagataatgtatgtagaactgctcagcggcattgctgcgtgagctatttgcaggagaagagttgcatggctggcgtgctgggcgctaaggagggagaaacctgcggcgcagaagataatgactcctgcggaatcagtttatacaaacagtgctgtgactgctgcggactcggcctgagagtaagggccgaaggacagtcctgtgagtccaaccctaatcttggttacccctgtaaccacgtgatgttaagctgttgcgaaggggaggagccactcatcgtgccagaagttaggcggccaccggagcccgctgctgcccctaggagagtttccgaggccgagatggctgggcgtgaagctttaagtttgggtaccgaggctgagctgcccaactccctccctggggacgatcaggatgagtgcctgctgctacctggagagctctgccagcatctgtgtataaataccgtgggctcgtaccattgtgcttgcttcccaggtttctcactacaagacgatggaagaacctgcagaccagagggtcatcctcctcagcccgaagcgcctcaggaaccagccctaaagtccgaattctcccaagttgcctccaatactattcccctgccattgccacagccaaacacctgcaaagacaacgggccatgtaaacaggtgtgttctaccgtaggcggttctgccatctgttcttgcttccccggatacgctataatggctgacggggtttcttgcgaagaccaggacgaatgtctgatgggggctcatgattgctcccgtaggcagttctgtgtcaatactctggggagcttttattgtgtaaatcataccgtactgtgcgcagatggatatattttgaatgcccaccgcaagtgcgttgacatcaacgagtgtgtcacagatcttcatacctgctcacgcggagagcactgcgtcaatactctgggttccttccactgttataaggccctgacatgcgaaccgggatatgcgctgaaagatggcgagtgtgaagatgtcgacgagtgtgcgatgggaactcacacctgccaacctggatttctgtgccagaacacaaagggttctttctattgtcaggcccgacagcgctgcatggatggcttcttgcaggatcctgagggtaattgtgtggatataaacgagtgcactagcctgagcgagccttgcaggcctggcttttcatgtattaacaccgtgggatcatacacttgccaaaggaacccactgatatgcgcaagaggctaccacgcaagcgatgacggtaccaagtgtgtagacgtcaatgaatgcgagacaggcgttcaccggtgcggagagggacaggtctgtcacaatctcccaggtagttacagatgcgattgtaaggctggattccagcgcgatgctttcgggagaggatgtatcgacgttaatgagtgctgggctagcccaggccgactgtgccagcatacctgtgagaacacacttggcagttaccgatgttcctgcgctagcggattcttgcttgcagcagatggcaagcgctgtgaagatgtaaatgaatgcgaggctcagcggtgctcacaggagtgtgctaacatatatgggagctaccagtgttactgtcgccaagggtatcaactggctgaagatggtcacacttgcacagacatcgatgaatgtgcccagggtgcagggattctctgcacattccgatgtctgaacgtgcctggctcttaccaatgcgcctgtcccgagcagggctacaccatgacggctaatggacgatcctgtaaggatgtggatgagtgtgccctgggaactcataactgtagcgaggccgaaacctgtcacaacatccaaggctcttttcggtgtctccggttcgaatgtccacccaattatgtgcaggtgtctaagacaaaatgtgagcgcactacctgccatgatttcctagaatgtcagaattcgccggcaaggatcacccactatcagctcaactttcagacggggcttctggtgccggcacatattttccggatcggcccagccccagccttcacaggagatacgatcgctttgaatatcataaagggaaacgaagagggatatttcggcactagaagactcaatgcgtacaccggcgttgtgtatttacagcgcgctgtgctcgaacctcgagactttgccctcgacgtcgaaatgaaattgtggcgacagggttccgtgacaacgttcctcgccaaaatgcatatcttttttacaacatttgcactctag

SEQ ID NO: 223308 - DNA, 3633 bp, Artificial Sequence
  Description of Artificial Sequence: Synthetic coding sequence
atggagacctctctctccttggagagtggccatcacgggtcctaccggagaggcgaccgaccgggtctggcatggaccatggtgctgctgtgggaacctgcaggtgcatggttggcactggggctggctctggccctgggccctagtgttgctgccgctgcacctaggcaggactgtacaggcgtggagtgtcccccattagaaaactgtattgaagaggcactggagcccggagcttgttgcgccacctgcgtccagcaaggttgcgcctgtgaagggtaccaatactacgactgcctgcagggcggattcgtcaggggtcgagtgcctgccggtcagagctatttcgtcgatttcgggagcaccgagtgctcatgccctcccggtggaggtaaaattagttgccagtttatgctctgcccagaattgccacccaactgcattgaggccgtagtggtggcagactcttgccctcagtgtgggcaagtcggttgtgtgcacgccggtcataaatatgctgcaggacataccgtgcatcttccgccatgtcgtgcttgtcactgtccggacgcaggcggagagctcatatgctaccaactccccggttgccacggaaatttctctgacgccgaggaaggcgatccagaacgccactacgaggacccatattcttacgaccaggaagtggctgaggttgaggccgcaaccgccctgggtggtgaggtgcaggccggagcagtgcaggccggtgccggtggtcccccagccgcacttggcggaggctctcagccactgtccacgatacaggcgcctccctggcccgctgtgcttccacgtcctactgctgctgctgcactgggtccccctgccccagttcaagccaaagcaaggagggtgactgaagattctgaggaggaggaagaggaagaagaagaacgtgaggagatggccgttacagaacaactagccgcaggcggacaccgcggtctggacgggctgcctacaacagctcccgcaggcccttccctgcctattcaggaggaacgcgcagaagcaggcgcaagagccgaggccggtgctcgccctgaggagaatcttatacttgatgcccaagcaacctccagatctacaggtccagaaggagttactcatgcaccatcactcggtaaggcagcgttggtcccaacccaggccgtccctgggtccccgagggacccggtcaaaccctccccacataatattctcagcacgagcctccctgacgcggcttggatcccaccaacccgggaagtgcccagaaaaccccaagtgttgccgcactctcacgtggaggaagatacggatcccaactcggtgcactccatccccagaagttctcccgaagggtccacaaaggatttgatcgaaacttgttgtgcggctgggcaacagtgggctatagataatgacgaatgtcttgagattcccgagagcgggaccgaggacaatgtgtgccgcactgcccagcgccattgctgtgtctcatacctgcaggaaaagtcgtgtatggccggagttttgggcgcaaaagaaggggaaacgtgcggtgctgaagacaacgacagttgtggcatatcgctgtataaacaatgctgcgactgttgtggtcttgggctgcgagtaagggccgaggggcagagctgtgaatctaaccccaatttgggatatccttgcaatcacgtgatgctctcatgttgcgagggggaagagcccttaatcgtccccgaggtccgccgacctcctgagcccgctgccgctcctaggagggtatcggaggcagagatggccggacgcgaggcgctctccctggggaccgaagccgaacttccaaattctctccctggggacgaccaggatgagtgtctgttgttacccggagagctttgccagcatctgtgtatcaatacagtgggatcctatcattgtgcctgcttccctgggttctcccttcaggacgatggcaggacatgccggccagaaggacatccgcctcagccggaagctccacaagaacctgctctgaagtctgaatttagtcaggtggccagtaatacaatccccctgcccctgccacaaccaaacacttgcaaagataatggaccatgcaaacaagtgtgcagtaccgttggcggaagcgccatatgctcatgctttcccggatatgctataatggccgacggcgtgtcttgtgaggacataaacgagtgtgtgaccgatctgcatacatgctcccgcggagaacattgcgtgaatacattagggagcttccattgttacaaggctcttacatgcgaacccggttacgccctcaaggacggagaatgcgaagatgtggacgagtgtgctatgggtacgcatacgtgccaacccggatttctgtgtcaaaataccaaaggaagtttttactgtcaggcccgacagcgctgcatggatggatttctccaggacccagagggcaactgtgtcgacatcaatgagtgcacttccttatccgagccctgcagaccaggcttctcgtgcatcaacacagtcggcagctacacctgccaaaggaatccactgatatgtgcccgagggtaccatgcgagtgatgatggcacaaaatgtgtcgacgttaatgagtgcgagactggagtgcaccgctgtggtgagggccaggtttgccacaaccttcccggtagctacagatgcgactgcaaggctggattccagagggatgctttcggtagaggatgtatcgatgtgaatgaatgctgggcttcacccggtcgactgtgccagcacacatgcgagaatacattaggaagttaccgctgcagttgcgcatcagggttcctgctggccgcagatgggaagaggtgcgaagatgtgaacgagtgcgaagcacagaggtgttctcaggagtgtgctaacatctacggaagttaccaatgctactgtagacagggttatcagctcgctgaagatggacatacatgcacagatatcgatgagtgtgcccaaggagccggaattctatgcacattcagatgcctgaacgtgcccggatcctaccagtgcgcttgcccggaacagggatacaccatgaccgcaaacggacggtcttgtaaagatgtggatgaatgtgcactgggaacacataactgcagtgaggctgagacctgccacaacatacagggatcctttagatgcctgagatttgaatgcccccctaactatgtgcaagtgtctaagactaaatgtgaaagaacaacctgtcatgatttcttagagtgtcagaacagccccgcaagaattacacattatcaattgaattttcaaaccggattgttagttcctgcccacatcttccgaattgggcctgctccagcatttacaggtgacacaattgcgctgaatatcatcaagggcaatgaagagggatactttggaacccgacgcctaaacgcctacaccggcgtggtttacctccagcgggctgtcttggaaccaagggactttgccttggatgtggagatgaagctctggaggcagggatcagtgacaacatttctggccaaaatgcatatcttctttaccaccttcgctctatag

SEQ ID NO: 223309 - DNA, 1347 bp, Artificial Sequence
  Description of Artificial Sequence: Synthetic coding sequence
atgcctggcatcaaacgtatactgaccgttaccatcctggccctctgtctgccaagccccggaaatgcacaagcccaatgcactaacggctttgatcttgaccggcagtctgggcaatgtctggacattgatgagtgcagaaccattccagaggcatgtcggggtgatatgatgtgcgtgaatcagaacgggggatacctgtgtattccccgtactaatcccgtttaccggggtccctattccaatccatatagcactccttactctgggccttatccagccgctgcgccacccctctccgcgccaaactaccccacaatttctcgcccactcatttgccggtttgggtaccaaatggacgaaagcaaccagtgcgttgatgtggatgagtgtgcaaccgattctcaccagtgtaatccaactcagatttgcatcaatactgagggaggatacacgtgttcctgcacagatggctactggctgctggagggccagtgccttgatattgatgagtgtagatatgggtactgccagcagctctgtgcaaatgttccagggagttacagctgcacatgcaatccaggctttaccctgaacgaagatggcagatcgtgccaggatgtcaatgaatgtgccacggaaaatccttgcgtgcagacctgcgttaacacatatggcagcttcatatgcaggtgcgatcctggatacgaactcgaggaggacggagtgcattgttctgacatggacgagtgttcctttagtgaattcctgtgtcagcatgagtgcgtaaaccaacctggcacgtatttctgcagctgccccccaggctacattctgttagacgacaaccgcagctgtcaagacattaatgaatgtgaacatcgtaatcatacatgcaacttacaacaaacttgctacaatctgcaaggcggatttaaatgcatagacccaatccgttgtgaagagccttacctcaggatttctgacaacagatgcatgtgcccagctgaaaacccaggttgcagggaccaaccctttaccattctgtaccgcgacatggacgtggtctcaggcaggagtgttcccgcagatattttccagatgcaggctactacacgctaccctggcgcttattacatctttcagattaagtccggtaacgaaggcagagaattttacatgagacagaccgggccaatctctgccaccctggtgatgacccgacctattaaggggccaagagaaatacagttggacctggagatgatcacagtcaacacggtgattaattttagggggagttcagtcatccgcctccggatttacgtgtcacaatatcctttctag

SEQ ID NO: 223310 - DNA, 276 bp, Artificial Sequence
  Description of Artificial Sequence: Synthetic coding sequence
atgcccggaatcaagcgaatcttaacggttactattctagccctctgtctgccgagtccaggcaacgctcaggcccaatgtaccaacggcttcgacctcgacagacaaagcggacagtgcctagacatcgacgaatgccggactattccagaggcatgccgaggtgacatgatgtgcgtcaaccagaatggaggctacttgtgtataccgaggactaatcctgtttacagaggcccatactccaatccttactcaactccatatagtggcccatag

SEQ ID NO: 223311 - DNA, 1320 bp, Artificial Sequence
  Description of Artificial Sequence: Synthetic coding sequence
atggtgccgtcaagccctcgggcactctttttgctgctgttgatcctcgcttgccccgaacctagggctagccagaactgcttgtctaagcaacaactgctgagtgctatcaggcagctgcagcagctcctcaaggggcaggaaactcgctttgctgaagggattaggcatatgaagtcccgtttggcggctctccagaatagcgtcggacgggttgggcctgacgctcttcccgtgagctgccccgcactcaatacaccagcagacggtcggaaattcggtagtaaatatcttgtcgatcatgaggtccactttacctgtaatccaggtttccgcctggtgggccctagctccgttgtgtgcctccctaacggaacgtggaccggtgaacagccgcactgtcgtggaatctccgaatgctcatcccagccttgtcagaacgggggtacctgcgttgaaggggtgaatcaatacagatgtatttgcccgccagggcgaacgggcaataggtgccaacaccaggctcagaccgcagctcctgaagggtcagttgccggagattctgccttcagccgagcaccacggtgtgctcaggtagagagagcgcagcactgctcttgtgaggcagggttccatctctcaggggctgcgggagacagtgtgtgccaggatgttaacgagtgtgagctatatggacaagaaggccgaccacggctctgcatgcacgcatgtgtgaacacgcctggctcgtacagatgcacatgccccggaggataccggacattagcagatggcaaatcatgcgaagacgtggacgagtgcgtgggcctccagccagtatgtccacaaggcactacatgcataaacactggcggatccttccagtgcgtatcacccgagtgtccagaaggaagtggcaacgtgagctacgttaagacgagcccttttcagtgcgagaggaacccttgccctatggacagtcgcccttgcaggcacctgcccaaaaccatttccttccactacctttcactgccgtcaaatctgaaaaccccaatcacgcttttcaggatggcaacagcttccgcacctgggagggcaggtcccaactcccttaggtttgggatcgtgggaggcaacagccggggtcattttgtcatgcagcggtcagatagacagacgggtgatctaattctggttcagaatttagaagggccacagactctcgaagtggatgtggacatgtcagaatatcttgatcgcagctttcaagctaaccacgtatcaaaagtgaccatattcgtgagtccttacgacttttag

SEQ ID NO: 223312 - DNA, 1182 bp, Artificial Sequence
  Description of Artificial Sequence: Synthetic coding sequence
atggtgccctcctcccctagggccttgtttctgctgttgttgattttggcatgtccagaacccagagctagtcagaattgcctctccaagcaacagttgctgagtgccataaggcagttgcagcaattgctgaaggggcaggagactcggtttgctgaggggattcgccacatgaaatcccgcctcgctgcgctgcagaattctgtgggaagggtcggccctgacgccctgcccgtgtcatgcccagccctgaacacaccagctgatggcaggaagtttggctcaaagtacttagtagaccatgaggtgcacttcacttgtaaccccggattcaggctggttgggcctagtagcgtggtgtgtcttcctaacggcacctggacaggagaacaaccacactgtaggggtatttccgagtgttcttctcagccttgtcagaacggcggaacgtgtgtcgagggagtaaaccagtaccggtgtatctgcccacccggaaggacaggtaatcggtgccagcaccaggcccaaacggacgtgaatgaatgtgagctgtacgggcaagaaggacgtccacggttatgtatgcatgcttgtgtcaatactcctgggtcctaccgctgtacctgccctggaggttacagaacactcgctgacgggaaaagctgcgaggacgtggacgaatgcgtcgggctacagcccgtatgcccacagggcactacatgcatcaatactgggggaagcttccaatgtgtgtctcctgagtgccccgaagggtctggtaacgtctcctacgtgaaaacgtccccatttcagtgtgagcgcaatccatgcccaatggattcccgaccatgtaggcatttaccaaagaccatatcgttccactacctgtctcttccctccaatctaaaaaccccaatcacccttttccgcatggctaccgcctccgcgccaggcagagccggtccgaattctcttagatttgggatcgtgggagggaatagccggggacactttgtgatgcaacgatcagaccgacagaccggcgatcttatcctggttcagaacttggagggcccacaaacactggaagtcgacgtggatatgagcgagtacctagatcgcagtttccaggcaaatcacgtgtctaaagttaccattttcgtgtcgccttacgatttctag

SEQ ID NO: 223313 - DNA, 942 bp, Artificial Sequence
  Description of Artificial Sequence: Synthetic coding sequence
atggagttggatcgcgcagtgggtgtgttgggagccgctacactcctgctgtccttcttaggcatggcctgggccctgcaagccgctgacacctgtcctgaggtgaaaatggttgggcttgaaggcagcgacaagcttactattttgagaggttgtcctgggctgccaggagccccaggacccaagggtgaagcaggcaccaacggtaaacgcggagagaggggaccacctggaccccctggtaaggctgggcctcccggaccaaacggagcaccaggggaacctcagccctgcctcaccggcccaaggacgtgtaaggatctcttggaccggggacatttcctcagcgggtggcacaccatctatttgccagattgtaggcctctgactgtgctttgtgacatggacaccgacggcggagggtggacagtattccagaggcgcgttgatggaagcgttgatttttatcgagattgggcgacatacaaacaagggttcggctcaaggttgggcgagttctggttgggaaacgacaacatccatgccctgacagcgcagggcaccagcgagttaagagttgatttggtggatttcgaggacaactaccagttcgccaagtataggtctttcaaggtagccgatgaggcggaaaagtataacctggtgcttggcgcatttgttgagggcagtgctggggactctctcaccttccataataaccagtccttcagcacaaaagaccaggacaacgacctgaacacaggcaactgtgctgttatgtttcagggcgcatggtggtacaagaattgccacgtcagcaacctcaatggcagatacctgagggggacccatggctccttcgccaacgggataaattggaaaagcgggaaggggtataactacagttacaaggtttccgagatgaaggtgcggccagcttag

SEQ ID NO: 223314 - DNA, 828 bp, Artificial Sequence
  Description of Artificial Sequence: Synthetic coding sequence
atggagttggatcgcgctgttggcgtgcttggagctgccaccttactgctcagctttctgggcatggcatgggctctgcaggctgcagatacatgccctggagaaaggggccctccgggaccccctggaaaagccggaccccctgggccaaacggggctcctggcgaaccccagccgtgcctgacaggaccacggacatgcaaggatctgttggatcggggacatttcttgtccggctggcacaccatctatttacccgattgtcgcccactgactgtgctctgcgacatggacactgatggaggagggtggaccgtattccagcggagagtggacggatcagtggatttctatagggattgggccacttataagcagggttttgggtccagactcggagaattttggttgggtaacgataacattcacgcactcacagcccagggcacttccgaactccgcgtcgacctggtcgacttcgaggacaactaccagttcgcgaagtacagatcttttaaggtggcagacgaagctgagaagtataaccttgtgctaggagccttcgtagaaggcagcgccggtgacagcttgacgttccataataaccagtcattctctacaaaagaccaggataatgatctaaatacgggaaactgtgcagtgatgtttcagggggcatggtggtacaaaaactgtcacgtatctaatctgaatggacggtacctccgcggaacgcatggctcatttgccaacggcataaattggaaatctgggaaaggctacaattactcatataaagtaagcgagatgaaagtacggccagcttag

SEQ ID NO: 223315 - DNA, 564 bp, Artificial Sequence
  Description of Artificial Sequence: Synthetic coding sequence
atggaactgagcggcgcaactatggcgagggggctcgccgtattactggttctgtttctccatatcaaaaatctcccagcgcaggccgctgatacgtgtccagaagtaaaggtggtagggctggaaggcagcgacaaattgacaatccttaggggctgtccgggtctgccaggggctccaggccctaagggcgaggccggagtgattggggaacgaggcgagagaggtctgccaggtgcgccaggcaaggctgggcctgttggaccaaaaggcgacgcgggacagagccagtcttgtgccacagggccaaggaactgtaaagacctcttggaccgcggatacttcctcagtggctggcacaccatttatcttcccgactgtcggcctcttaccgttctatgcgatatggatactgatggtggtggctggactgtgttccagaggaggatggacgggtcagtggatttctacagggactgggcggcttataaacaaggatttggaagccagttaggtgaattctggttaggcaatgataatatccacgcccttacggcacagtag

SEQ ID NO: 223316 - DNA, 981 bp, Artificial Sequence
  Description of Artificial Sequence: Synthetic coding sequence
atggaacttagcggtgccacaatggcccgtggacttgccgtgctgctggtgctgttcctccacatcaaaaaccttccagcccaagccgctgatacatgccccgaggttaaggtggtggggcttgaagggtctgacaaacttacaatccttagggggtgccccggtctgcccggtgccccaggacctaagggagaggccggtgtcattggggagcgcggtgaacgaggcctgccaggagcccctggaaaggcaggcccagtcggacctaagggagatcgtggagagaaaggtatgcgcggagagaagggcgatgcaggacagtctcagagctgtgccactggcccacgaaattgcaaagatttgctggatcgtggctacttcctgagtggctggcacacaatctatctgccagattgccgcccactgactgtgctgtgtgatatggacactgacggaggcggttggaccgtatttcagcgcaggatggacggttcagtggatttttacagagattgggcagcatacaagcaagggttcggatctcaattgggagaattttggctgggcaacgacaatatacatgccttaacagcccagggtagttccgagctgagggtggatctagtcgatttcgaagggaaccatcaattcgccaagtacaaatcttttaaagtggcagacgaggctgaaaagtataaattggtactcggggcttttgttgggggttcggcgggtaactcccttacaggtcataataataattttttcagtacaaaagaccaggacaatgacgtgtcgtcttccaactgcgccgaaaagttccagggcgcttggtggtatgctgattgtcacgcctctaacttgaacggcctatatttgatggggccacacgaatcctacgctaatggcattaattggagtgcagccaaggggtataagtattcttacaaggtgagcgagatgaaagtacggcctgcctag

SEQ ID NO: 223317 - DNA, 1083 bp, Artificial Sequence
  Description of Artificial Sequence: Synthetic coding sequence
atggagctgtctggggctacaatggcccgtggactcgcagtactcctggtgctctttctccacataaagaacctgcccgcacaggccgcagatacttgccccgaggtaaaagtggtgggtctggagggttccgacaagttaacaatcctcagaggctgccccggtttgcccggagcacccggacccaagggggaagccggtgtgatcggcgagaggggggagcggggtctccctggtgctccaggcaaagccggtccagttgggcctaagggcgacaggggtgaaaagggtatgaggggagagaagggagatgctggacaaagtcagagttgcgctaccgggccacggaattgtaaagatttgctcgacagaggttactttttgagtggatggcataccatatacctcccagattgccgaccacttaccgtcctatgtgacatggataccgacgggggagggtggaccgtgtttcagcgtcgcatggacggttcagtcgacttttacagggactgggctgcctacaagcaagggttcggaagccagacccactcacacgacgctcacagctgtcctttcgccccatccagcgtcaagccccctcacgcccacaacctgacacgaggcagaatcatgtttctgaacatgtttacactggggcagaagagtttcacttcatttaatgtgtgttttctcaataccagcggttttgaccattttccagtatccgtggcacggcaggtttttccgtggaatctggtgagcagggaggaaagtggaccactgttctcgagatggcattaccgctgcagtggtcggctgtccgacttctgcgaggactttcctccccctgtgatcgacacagggcgatctagtccgcctccaccatcattaccacacccacccatgccccattcccagcattttacactgctggagaagggacatttcggtgtacaaaaaactctgacaaagaaaggggaatcccttgtcgggacttttctgctgcctaccacggctgaattcatgttgtgggctggatggctcctgggccgagacaaacacttggccctgactaaatag

SEQ ID NO: 223318 - DNA, 900 bp, Artificial Sequence
  Description of Artificial Sequence: Synthetic coding sequence
atggatctcttatggattttaccaagcctgtggctcttgcttttgggcggtccggcatgtctcaaaacacaagagcatcctagttgtcccggacccagagaattggaggctagtaaagtggtgcttttaccaagttgccctggtgccccaggttcccctggagagaagggggcaccagggccacagggaccgccaggccctcctggaaagatggggccaaagggtgaacccggagatccagtgaaccttctcaggtgccaagagggtcccaggaactgtcgcgagttgctctcacaaggagccactctgtcaggctggtatcacctctgtctgcctgagggccgagcgctgcccgtgttttgcgacatggacacggaagggggtgggtggctggttttccagaggcgtcaggacggatcggtggatttcttcaggagctggtcttcttatcgggcaggcttcggcaatcaggagtcagagttttggctagggaacgagaacctgcaccagctgaccctccaaggcaattgggaattaagggtggagttagaggatttcaacggcaaccgcacattcgcccactatgctaccttccggctacttggtgaagtcgatcattaccagctcgctctgggcaaattcagcgaaggtaccgccggtgattccctgagcttgcattctggcaggcccttcacgacctacgacgccgaccacgactccagcaatagcaactgcgctgtcattgtgcatggtgcatggtggtacgcatcttgttacagatcaaacttgaatggaagatatgccgtgtccgaggctgccgcacacaagtacggaatcgattgggcaagtggaaggggagtgggccatccgtataggagggtgcggatgatgctacgatag

SEQ ID NO: 223319 - DNA, 867 bp, Artificial Sequence
  Description of Artificial Sequence: Synthetic coding sequence
atggatcttttgtggatcctgcctagtttgtggctcctgctactgggagggcctgcctgtctcaaaacacaggagcatccctcatgtccagggcctagggaacttgaagctagtaaagtggtgctcttgccttcctgtcctggggctcctgggtccccgggagagaaaggcgcaccaggaccacagggacccccaggaccgccagggaagatgggacctaagggcgagcccggacctcggaactgtcgggagttactgagccaaggagcgaccctcagcggctggtaccacctgtgtttaccggaggggagagccctgcccgtcttctgcgacatggataccgaaggcggtggctggttggtatttcaacgcaggcaagacgggtctgttgacttcttccgatcttggtcttcataccgcgcaggatttggcaaccaggagagtgagttctggcttggcaatgagaatctccatcagctcaccctgcaggggaattgggaactgagagtagagctagaagactttaacggcaaccggacattcgcacattacgcgaccttccgtctcctgggggaggtagatcactaccagcttgccctcgggaaattttctgaaggcactgcaggagactcactgtccttacactcaggtcgacctttcacaacctacgatgcagaccatgactcttctaacagcaactgtgcggttatcgtacacggtgcgtggtggtatgctagctgttataggtcgaacttaaatggcagatacgctgtctccgaggctgccgctcacaaatacgggatcgactgggcctcggggagaggtgtgggccatccataccgaagagtgcgaatgatgctgcgctag

SEQ ID NO: 223320 - DNA, 300 bp, Artificial Sequence
  Description of Artificial Sequence: Synthetic coding sequence
atggacacagagggaggaggatggctcgtgtttcagcgaagacaggacggctccgtggacttctttcggagctggagctcttacagggctggcttcggcaaccaggagtcagaattttggctcggcaacgagaacctacaccagctgactctgcagggaaattgggagctgagagtagaattggaggatttcaatgggaatcggactttcgctcactatgcgacctttcggctgcttggggaggtggatcactaccagcttgcattagggaaattctctgaggggaccgccggtgagtag

SEQ ID NO: 223321 - DNA, 2094 bp, Artificial Sequence
  Description of Artificial Sequence: Synthetic coding sequence
atggccgagactagtcctgagcctagtggtcagcttgtcgttcacagtgacgcacattccgacacagtactggccagttttgaggaccagaggaaaaagggcttcctgtgcgacataaccttgattgtggagaacgttcattttagggctcacaaggcgctgttagcggcttccagcgaatacttcagtatgatgtttgcagaggagggggaaattggacaatcaatttatatgctggaagggatggtagcagacacattcggcatcctattagagtttatctatactggctacttacatgcctctgagaaatccacagagcagatacttgccaccgctcaattcctgaaggtgtatgatctcgtgaaggcgtataccgactttcagaacaatcattccagtcctaaaccaaccacactgaacacagcaggggctccagtggtggtcatttctaataaaaagaatgatccacccaaaagaaaacggggacggccaaaaaaggtgaatacactgcaggaggagaagtcagaattggctgcagaagaggagatccagctgagagtgaacaactctgtccagaatagacagaacttcgtggtgaaaggtgattcaggagttctgaacgagcagattgcagccaaagaaaaggaggagtccgagcctacatgcgagccctctcgcgaggaggaaatgcccgtggaaaaggatgaaaactacgatcctaagaccgaggacggccaggccagtcagtccaggtactcaaaacgccgtatctggcggagcgttaagttaaaggattacaagctcgtcggcgatcaggaggaccacggcagcgctaaacggatctgtggtcggcgtaagcgaccagggggaccagaggcaagatgcaaggactgtggaaaggtttttaaatacaaccactttctggccatccaccagcgctcccatacgggagagcgcccatttaaatgcaatgaatgcggcaagggcttcgcacagaagcactcgctccaggtgcacacccgcatgcacaccggagagagaccgtatacatgtacagtgtgctccaaagcactcacgacaaaacactccctcctggaacatatgtctttacactcgggccagaagagctttacctgtgaccaatgtgggaagtatttctcccagaatcgccagctgaaaagccactacagggtccacaccggacactccttgcctgagtgcaaggactgtcacagaaagttcatggacgttagccagctgaaaaagcatctacgtactcacaccggggaaaaaccctttacatgcgaaatctgtggcaaatcgtttacagccaaatcatccctccagacgcatattcgaatccaccggggtgagaagccgtatagctgcggtatctgtggtaagtccttttctgactcgagtgcaaagcggcgtcactgcattctgcataccggaaagaagccgttttcctgccctgagtgtaacctccagttcgccaggctcgataaccttaaggctcatctcaaaattcattccaaggaaaagcacgcctcggacgcttcttcgatctccggttcaagcaatactgaagaagttcggaatatcctgcagctgcaaccataccagctgtccacatcaggtgaacaggagattcagttgttggtaacagattctgtccacaacatcaatttcatgcccggtccctctcaagggatctctatcgtcactgcggagtcctctcagaacatgactgctgatcaggcggcaaacttgaccctgttaacccagcagcctgaacagctgcaaaatttgattctgagtgcccagcaggaacaaaccgagcacatccaatctttaaatatgattgaaagccagatgggacctagtcaaactgagcctgtccatgtcattacgctgtccaaggaaaccttggagcacctccatgcccatcaagagcagactgaggaactgcacctcgctaccagtacttccgacccagcccagcacctgcagttgacacaagaacctgggcctcccccacccacccatcacgtgccccagcctacccccctgggtcaggaacaatcttag

SEQ ID NO: 223322 - DNA, 420 bp, Artificial Sequence
  Description of Artificial Sequence: Synthetic coding sequence
atggggcaaaagggctccagcggcctgtttagagcagtgtcagctttcggagtggtgggcttcgtgagattcttagaagggtactatatcgtgctgatcacgaaacgtcgtaaaatggccgatattggaggtcacgccatctataaagtcgaagacactaatatgatctacatcccaaacgatagcgtgcgagtgacccaccctgacgaggctcgctatttgcgcatttttcaaaacgtggacttgtccagtaatttttatttcagttactcctatgatctgtcgcactcccttcagtataaccttactgttctgagaatgcccctggagatgctgaagagcgaaatgactcagaaccggcaagagtcatttgatatcttcgaagacgagggcctgatcactcaggggggatccgggtag

SEQ ID NO: 223323 - DNA, 411 bp, Artificial Sequence
  Description of Artificial Sequence: Synthetic coding sequence
tgactttttgaagaactgtatgaagaccatggtgatacgctgtctctgcagtatggcggatcacaactggtccatcgtgtaaagacttacaggaagatagctccatggacacaacattctaaagacataatgcaaactttgagccggtactatagcaatgccttttcggacgccgaccgccaggactcaataaatctgttccttggggtgtttcacccgactgaagggaagccacatttgtgggagcttcctacagatttttacctgcaccacaagaacactatgcgtctgctcccgactcgcaggagttacacctactggtggacccccgaggtcattaaacacctgcccctaccatacgatgaggggtttctggccagatcgcctgccaacttagagtgttcaaattag

SEQ ID NO: 223324 - DNA, 300 bp, Artificial Sequence
  Description of Artificial Sequence: Synthetic coding sequence
atgaccagcagcgccagagatttcatgcctaaaacggtggggatcgatccctctccgttcactgtcaggaaacccgacgagacgggcaagagtgtactgggcaacaagtcaaatcgcgaggaggccgtcttgcagcgcaagactgccgcaagcgctcccccacctccttctgaagaggccgtgagctcttccagcgaagacgattccggaaccgaccgtgaagaggaggggagtgtgagccagcgcagtacccctgtgaagatgacagacgccggagacagcgctaaagtgactgaatag

SEQ ID NO: 223325 - DNA, 1806 bp, Artificial Sequence
  Description of Artificial Sequence: Synthetic coding sequence
atgactggctatctgagaatttttcagaacgtggacctgtcgtccaacttctacttctcttattcatatgatctgtcacattccctccagtacaatctgacagtgttgcgtatgcctcttgaaatgctgaaatccgagatgacccagaacaggcaggagagcttcgacattttcgaggatgaaggcctgatcactcaaggtggctctgtcgaccaagcagaccccttcgcgcacgtcgcggcactgcacttcgatcaaatgttccagagattcgggtccccaatcattatcctcaacttggtgaaggaaagagaaaagagaaagcatgaaaggatcctgtcagaggaactcgtggccgcagtgacttatttgaatcaatttcttcctccggaacacacgattgtgtacatcccctgggacatggcaaaatacaccaaaagtaaactatgcaatgtgctggacagactgaacgtcatcgcagaatcggttgtcaaaaaaacgggtttttttgtcaatcggccagattcctactgcagcattctcagacctgacgagaaatggaatgagctgggtggttgtgtcatccctaccggaagactacagactgggatcctgagaacaaactgcgtggattgtctagatagaaccaacaccgcccagtttatggtcggcaaatgtgccctggcctatcagctgtacagcctgggcctcatcgacaagcctaacctgcagtttgatacagacgcagtgagactgtttgaagagctttacgaggaccatggcgacacactatcgctgcagtacgggggatctcaattggtgcacagagttaagacctaccgaaaaatagcaccttggactcaacattccaaggacatcatgcagaccctttccaggtattatagtaacgcctttagtgacgccgaccggcaggattcaattaacctgtttctgggggtgtttcatcctacagaagggaagccccacctttgggaactcccaacagatttttacctgcaccacaaaaacactatgcgactgttacccacaaggcgctcctacacgtactggtggacccctgaggtgattaagcatctgcctctgccctacgacgaagttatatgtgctgttaatcttaaaaagctgatcgttaagaagttccacaagtacgaggaagagatagacatccacaacgagttcttccgtccatatgagcttagtagcttcgatgacacattttgtcttgccatgacctcctcggccagagactttatgcccaagacggtcggcattgatccttccccttttaccgttcgcaaaccagatgaaactggcaaatctgttctgggtaataagtcaaatcgggaggaagccgtcctgcagaggaagaccgctgcctcagcgccaccacctccttccgaagaagccgtgtcctccagttctgaggatgattcaggtactgaccgggaagaggaaggctcagtctcccagcggagtacccctgttaagatgactgacgcaggcgatagtgcaaaagtgacagaaaacgtggtacaacctatgaaagagctgtacgggattaacctgtccgatgggttatctgaggaggacttctccatctattctcggacccccattagcgcatttagccaggataatatctatgaggtccaacctccccgagttgacagaaagtctacagagatattccaagcccacattcaggccagtcagggaatcatgcagccactaggtaaagaggattctagcatgtaccgggagtatattaggaaccgctatctatag

SEQ ID NO: 223326 - DNA, 714 bp, Artificial Sequence
  Description of Artificial Sequence: Synthetic coding sequence
atgcggtactttctggtggggagtaataatgccgaaactaagtacagggtgctgaagatcgacagaacggagcccaaagacctcgtcattatcgacgatcgtcacgtgtatacgcaacaggaggtaagggagctccttggtcgtctagatctgggcaatcgtacaaagatgggccaaaagggatcatctggactctttcgcgctgtgtccgcttttggggtggtggggtttgtccggttcttagaaggctactacatcgttctgatcaccaagcgaagaaagatggccgacatcggaggacacgcgatatacaaggtggaagacacgaatatgatctacatacccaacgacagtgtgagagtcacccacccggacgaggccagatacctacggattttccaaaatgtagatctctcatccaacttctattttagttatagttatgacctgagtcacagtttgcagtacaacctgaccgttctcagaatgcctctggagatgcttaagagcgaaatgacccagaaccgccaggaatccttcgatattttcgaagacgaagggctgatcactcagggcggttcgggagtgtttggcatctgcagcgaaccatacatgaagtatgtctggaacggagagcttttagacataatcaagtcaactgtgcacagggactggttgttgtacatcatacatggattctgtggacagtcatag

SEQ ID NO: 223327 - DNA, 969 bp, Artificial Sequence
  Description of Artificial Sequence: Synthetic coding sequence
ctgtaccaggtgagcacacacgaacagtcagagtccgcccatggtcgcacgggcccatctacgggtggcagacagcggagccggcatgaacaggcccgtgatagctccaggcacagtgccagccaagaaggccaggacaccattaggggtcaccctgggagctctagaggcggaagacagggctctcattatgagcagtccgttgacagctccgggcatagtgggtcacaccactcccatacgactagccaggagcggtcggacgtcagcagaggacaaagcggctcccgatccgtcagcagacaaactcggaatgaaaaacagtctggcgatgggtcacggcattccggcagccgacaccacgaagccagttcccgggctgactcatctcggcattcccaggtaggccagggccagtccagcggtcccagaacctcacgcaatcaggggagctccgtgtcccaggatagtgactcgcagggtcattcagaggattcggagagacggtctggctccgcctcgcggaaccaccatggctccgctcaggaacagtcccgggatgggtcacgccaccctagaagtcaccatgaagacagagcaggacatggccactccgccgagagtagccggcagtctggcactcatcacgccgagaactcatcgggcggacaagcagcttccagccacgaacaggcacgatctagcgctggcgagcgccacgggtcacatcaccagcagtccgctgactctagcaggcacagcgggattggccacggccaggcctcctccgcagtacgcgattccggccacaggggatcatccggatcccaggcgtctgatagcgagggacattctgaggatagcgatactcaatccgtgtctgcccacggtcaggctggcccacaccagcagtctcaccaggagagtacccggggtagatctgcgggaagatccggtagatctggatag

SEQ ID NO: 223328 - DNA, 969 bp, Artificial Sequence
  Description of Artificial Sequence: Synthetic coding sequence
ctgtatcaggtgtctacccacgaacagtctgaatcaagccacggttggaccggcccatccaccaggggtcgccagggatctagacacgaacaggcacaggattcctcacggcacagtgcctcgcaggatggccaagatacaatcagaggacacccaggaagcagtagagggggaagacagggttaccaccatgagcacagcgtggattcatcaggacatagcggctcccatcatagtcatacaacatctcaggggcgttccgacgcatctcgaggtcagtctggctcccggtccgcctcccgaacaactagaaacgaggagcagtccggcgatggttcgaggcacagtggaagtaggcaccacgaagcatccactcatgctgatatctctagacattcgcaggctgttcaggggcagagcgagggctctcgcaggtcccgaagacaaggctcttccgtctctcaggattcggactcggagggccattctgaggacagtgaacggtggtctgggtctgcatctagaaatcaccgcggatccgtgcaggaacagtccagacacggctcacggcatcccaggagccaccacgaagaccgagcaggacacggccactctgctgaccgcagccgtcagtccggcacaaggcacgccgaaacatcaagtggaggccaggcagcatcaagccacgagcaggcccgatccagtcccggagagaggcacggaagccgtcatcagcagagcgcagattcctcaaggcactctgggattccgaggggtcaggcaagctccgctgtaagggattctcgccactgggggagctccggctcacaggcttctgacagtgaaggccatagcgaggaatccgacacccaaagcgtgagcggccatgggcaggctggacctcaccagcagtctcatcaagagtctgctagagacaggtccgggggaagaagtgggcgtagtgggtag

SEQ ID NO: 223329 - DNA, 12186 bp, Artificial Sequence
  Description of Artificial Sequence: Synthetic coding sequence
atgagcacgctactcgagaacatcttcgcaatcattaatttatttaaacagtacagcaagaaagacaagaacaccgataccctgtcaaaaaaagagctgaaagagcttctggaaaaggagtttcggcagatactcaaaaaccctgatgacccggacatggtggacgtgtttatggaccatctggatatcgatcataacaagaagatcgacttcaccgagtttttactcatggtctttaagttagcacaagcgtattacgaatccacacgtaaggaaaatctccccatctctgggcataagcaccggaagcactcacatcacgacaaacacgaggacaacaagcaggaggagaacaaggaaaacaggaagagaccttcttcgcttgaacggaggaataatagaaaaggaaataaaggacgtagtaagtctccaagggaaactggtggtaaaaggcatgagtcctcctccgaaaagaaggagagaaagggttactctccaactcacagggaggaggaatatggtaaaaaccaccataactccagcaaaaaggagaagaacaagactgaaaacactcgcttgggggataatcgcaagagactgagcgagagactggaagagaaagaggataacgaggaaggtgtttacgactacgaaaacacagggaggatgacacagaaatggatccagagtggccacattgctacctactacacgatccaggatgaggcttatgacaccaccgattctctgctcgaagaaaacaaaatctatgagcgatccagatcctccgacgggaagtctagctcacaggttaacaggagtcgccatgagaacacaagccaagtcccgttacaggagagtaggaccagaaaacggagagggtcccgcgtatcacaggaccgcgatagtgaagggcacagcgaggattccgagcgacatagcggaagcgcctccagaaatcaccacggcagcgcatgggagcagagtagagatggctctagacacccccgtagtcacgatgaggaccgagctagtcacgggcattctgctgacagttcaaggcagtctggcacccgccatgcggaaacaagctcacggggacaaaccgcttctagccacgagcaggctcggagttcccctggggagcgccacggctcgggtcaccagcagtccgctgatagtagtaggcacagcgccactgggaggggccaagcaagtagtgctgttagcgaccggggacatcgcggatcttcaggcagtcaagctagcgacagcgaaggccatagtgagaacagtgatacccagtctgttagcgggcatggtaaagccggtttgcggcagcaaagccaccaggagtcaacacggggtcgttcaggggaacgctctgggcgatctggtagctctctttaccaggtgtcaacccacgagcagcccgatagcgcccatggaaggactggcacgtccacagggggtcggcagggatctcatcacgagcaggccagagactcatcccgccattcagcgtcacaggaaggtcaagatactatccgaggacatcctggctctagccgagggggtcggcagggctcacaccacgaacagagtgtgaaccggagtggacatagtggcagtcaccacagtcatacaacctcccagggacgtagtgatgcttcccatggtcaatccggttccagatcagcatcccggcagacacgaaacgaggaacagtctggggatgggactcggcatagcggttcccggcatcatgaagcaagcagtcaggctgattcatccaggcactcgcaagtaggccaaggacagagtagtggcccacgaacctctagaaaccaggggagttccgtcagccaggactccgacagccagggccacagcgaggactcagaaagatggagcggaagtgcgtctcgaaaccaccacggttctgcacaggagcaaagcagagacgggagcagacacccgagatcccaccacgaagacagggccggacatggacactcagccgatagctcgagaaagagtggaactcgtcatacgcagaattcatctagtggtcaagcagcctcatctcatgagcaggccagaagctccgcgggagaacgccacggttcaaggcaccagttgcagtccgctgattcgtctaggcattccggcaccgggcatggccaggcctcatcggcggttcgtgactccggccaccgtggctctagcgggagtcaggccaccgacagcgaaggccactctgaggactcagacacccagtccgtatccggccacggccaggctgggcatcaccagcagtcacaccaagaaagcgcccgtgaccgctctggggaacgctcgcgcaggtcaggttcattcctgtaccaagtatccacccacaagcagtcagaaagtagccacggctggacaggtcccagtacaggcgtgaggcagggatcccatcatgagcaggctagagataattcccgccacagcgcttcgcaggatggacaggacaccatccgaggccaccccggtagctcccgacgcggtcgtcagggctctcatcatgaacagtctgtcgatcgaagcggccacagcggaagccaccattctcatactacctcccagggacgatccgacgcatcaagaggccagtccgggtcaaggtccgcttcgagaaccactcgaaatgaggagcagtcccgcgacgggtcaagacacagcgggtctcgccatcatgaggctagctctcacgcggacatatcacggcactcccaggcgggacaaggccagtctgagggcagtcgcacgtcaagacggcaaggatcaagtgtctcccaggatagcgattctgaaggccactctgaggattctgagcgctggagcggatcggcttctcgaaatcacagagggtccgctcaggagcaatccagacatggcagcagacacccaaggagtcaccacgaggacagggccggacatggacacagtgccgactcttctcgacagtctggtacccctcatgccgaaacttccagcggcggtcaggcagctagttcccatgagcaagccaggtcctccccgggtgaaaggcatggttcacgacaccaacagtccgccgacagctccagacattccggcatccctcgacggcaagcgagctcagcagtacgcgactctggtcattgggggtccagcggaagccaggccagcgattcagaaggacattctgaggagtcggacacgcagagtgtctctgggcacgggcaggacggccctcaccagcagtctcatcaggagtctgcccgtgattggtccggcggtcggagcgggaggtccggaagctttatctaccaagtctcaacacacgaacaatcggaatccgctcacggcaggactaggacatccaccggacgacgccagggcagccatcatgaacaggctcgggactcgagtaggcacagcgcctcccaagaggggcaagataccatccgagcccatcctggctcccgaaggggcggaaggcaaggatctcaccacgagcaatcagtggacagatcaggtcacagtgggagccaccactcccatactacatcccagggaaggtctgatgccagccacgggcagtctggatccagatcagcctcacggcagacccgaaaagacaaacagtccggagacggatcaaggcactcgggaagcagacaccacgaggcagcgtcctgggcggattcctcacggcattcacaggtgggccaggagcaatcgtcagggtcaagaacttctcggcaccaggggtcgtccgtaagccaggactccgatagtgaaagacactctgatgacagtgaacggttaagcgggtctgcaagcaggaaccaccatggatcctcccgcgaacaatccagagacggttctcggcaccctggtttccatcaagaggatagggcatcacacggccacagcgctgattcttctcgacagtccggtacacaccacactgagagctctagtcatggccaggccgtttcctcgcacgagcaggccaggagcagtcccggtgagcgccacggaagccgacaccaacagagtgctgacagttccaggcactctggtatcggccaccgccaggccagtagcgcagttagagatagcggccacagaggttcttccggatctcaggtcactaattctgagggacactctgaggattctgacactcagtcggtgagcgcgcacggtcaagccggaccccatcagcagagccacaaagagtccgccagaggccaaagtggagagtcatctggccgttcccgtagttttctgtatcaagtgtccagccatgagcagtccgagtctactcacggtcagactgctccaagcaccggcggtcgtcaagggtctcggcacgagcaggccagaaactcttccaggcattccgcctctcaggatgggcaggacaccatcaggggtcacccgggtagctcacgtgggggacgtcaggggtcctatcacgagcaaagtgtggacagaagcggccatagcggttaccaccattcacacaccaccccccaggggagatccgatgcctcccacggccagagtgggcctcggagcgcatcccggcagacccgcaatgaagagcagagtggggacggatccaggcactctggatccaggcaccatgagccatccacaagggccggaagttcccgtcactcccaggtggggcagggcgagtctgcgggaagcaaaacctcaaggcgccagggttcgtccgtgagtcaggatcgggactctgagggacactctgaggacagcgagcgcaggtcagaatcagcttccagaaaccattacggctctgcaagagaacaaagccgccacgggagcagaaatcccagatctcatcaagaagatagggccagccatgggcattctgcagagtcctccaggcagtccggcacaaggcacgctgaaactagtagcggtggtcaggccgcaagtagccaggagcaggcgcgttctagcccaggagaacgccatggaagcagacatcagcagtcggcagactcttccactgactcgggaaccggccgtaggcaggactcctccgttgtcggggatagtggtaatcgaggatcatcagggtctcaagcctcagatagcgagggccactccgaggaaagcgacactcaatctgtcagcgcacacgggcaggcgggtccccaccagcaaagtcaccaggagtcaacacggggacagagcggtgaacgaagcgggagaagcgggtcattcctttaccaagtcagtacacacgagcagtccgagtccgcccacggcaggactgggcctagcaccggcggacgacagcgcagccggcacgagcaggccagggatagtagccgtcattctgcatctcaggagggccaggataccataaggggtcatcccggttctagccggggtgggagacaaggttcgcactacgagcaaagcgtcgattctagtggtcatagcggatcccaccactcccacactacatctcaggagcgctccgatgttagcagaggccagtcagggtctcgctccgtttccaggcagacccgcaatgagaagcaatcaggggatggatccagacacagcggttcacgccatcacgaggcatcatctagagcagacagcagcagacattctcaggtgggacaaggccaaagtagcggcccacgaacttccagaaaccaaggttcaagcgtcagtcaggattcagattctcaaggacacagtgaggatagtgagaggtggagcggcagtgcaagcagaaaccatctggggtccgcctgggagcaaagtagggacggctcccgccatcctggtagccaccatgaggatagagccggacacggccattcagcagactcttccaggcagagtgggactaggcacaccgaaagcagttcccgcggtcaagcagcctcttcacatgagcaggcgagaagcagcgctggagaacggcacggctcccaccaccagctccaaagtgccgacagcagtcgacattcagggatcggacacggtcaggcctcaagcgctgtcagggattcgggccacaggggatactcaggctcacaggctagcgattccgaaggccactccgaagatagcgatactcagtcagtgtcagcccaaggaaaggccggtccccatcagcaatcccataaggaaagcgccagggggcagtctggcgaatcgtccggcaggtcgggaagctttctctatcaggtgtctacacatgagcaatccgagagtacacacgggcaaagtgcccctagtactggcggaagacagggctcccactatgaccaggcccaggactcttctaggcactcagcttcccaagaaggccaagatacgattcgtgggcaccccggaccttctaggggcggaaggcagggctcccaccaagaacagagcgtggatagatcaggtcactcagggtctcatcattcgcatacaaccagtcaaggtaggagcgatgcctcacggggtcagtcaggttcccgatcagcatctaggaagacctatgataaggagcagagcggtgacggaagccgccattctgggtctcatcaccatgaagcaagttcctgggccgacagctcaagacacagcctcgttgggcagggtcagagtagtggaccaaggactagccggcctcggggttcttccgtgtctcaggactcagacagtgagggccattccgaggattccgaacgcaggtctgggagtgccagtagaaaccaccacggtagtgcgcaggaacagagcagagatggctccagacatccacgtagccaccatgaagacagagctggccacggacactccgccgagtcttccaggcagtccgggactcatcatgctgagaactccagcgggggtcaggccgcaagcagtcacgaacaggcaaggtcctccgccggagaaagacatggctcacaccaccaacaaagcgcagactctagccgccactctggaatcgggcatggacaggccagctcagctgtccgtgacagcggacacagagggtcctccggcagtcaggcctctgattctgagggccacagcgaggactccgacacacagtcagttagcgcacatggccaagcagggccacatcagcaatcacatcaggaatccacaagaggcagatccgcgggaagatcaggacgatctgggagtttcttgtatcaggtgagcacacacgaacagagcgagtccgcacatggaaggacaggtactagtactggtgggagacagggatctcatcacaagcaagctagggactcctccaggcatagtacttcacaggaaggacaggacaccatccatggccatcctgggagcagcagtggaggccgtcaaggctctcattatgagcagctggtggatcgttctggacactcaggatcgcatcatagccacacaacaagccagggccgttccgacgcgtcacacggacacagcggatctcgttccgccagccggcagacacggaacgacgagcaaagtggcgacggctccagacactctggatcacgtcatcatgaggcctcatcccgtgctgatagttccggacattcccaagttggccagggtcagtccgaagggcctcgaacatcacgaaactggggcagctcattttctcaagattctgactcccaaggacactctgaagacagcgagaggtggtcaggtagtgcaagtcggaaccaccatggaagcgcccaggagcagctacgtgacggatcaaggcatcccagatcccatcaggaagatcgggcaggccacggacactcagctgactctagccggcagagcggaactaggcacactcagactagctcaggtgggcaggccgcttctagccacgaacaggcacgttcctcagcaggagaaaggcacggctcccaccaccagcaatccgccgacagcagccgacactccgggatcggacacggtcaggcgtcgtcggccgtacgcgattcagggcacaggggttactcagggagccaggcatcggacaacgaaggccacagtgaagacagtgacactcaatccgtttccgcccacggccaagccggttcacatcagcagagtcatcaggagagcgcgaggggacgatctggagagacgtctgggcactctggctcttttctgtatcaagtatccacccacgagcagtcagaatcctcccatggttggaccggcccaagcacgaggggccgtcaaggaagtcgacacgagcaggcccaggactccagccgtcactccgcaagccaggatgggcaggatacaatccggggacatcctggatcaagccgtggaggacgtcaaggttaccaccatgagcacagcgtggattcctcaggacattctggctcccaccactctcatacgacaagtcagggacgcagtgacgcctcaagaggacagtccggatccagatcagcaagccgcacaacaagaaacgaagagcagtctggcgatggctccagacactccggctcccggcaccacgaagcttccacccatgccgacatctcccgtcactcgcaagccgtgcagggccagagtgagggttctcgcagatcaaggcgccaggggtcctccgtgtcccaggacagcgatagcgaaggccattccgaagactcggaacgctggtctggctcagcctcacggaatcaccatggatcagcacaagaacagctgcgagatggctccaggcacccccgtagccatcaagaggatagggccggacacggtcactcggcagattcttctaggcagagtggcactaggcatacgcagacaagctcgggtggacaggccgcaagcagtcacgaacaggctagatcctctgctggggagcgccatggctcgcaccatcagcaatccgcagactcaagcagacattcggggatcgggcatggccaggcgtcctcagccgtccgcgacagtggccacagagggtactccggatcccaagcctcagacaacgagggccattctgaagatagtgacacccagtccgtttccgctcatggccaggctggctcgcaccagcagagtcatcaagagtccgccagagggcgaagcggtgagacaagcggccacagcggatccttcctataccaagtgagcacgcacgagcaaagtgagagctcacacgggtggacaggtcctagcacacggggaaggcaaggatcgcgtcatgagcaggcccaagatagcagtagacattcagctagtcagtacgggcaggacacaatcaggggccatcctggaagctcacgcggtgggaggcaggggtatcaccatgaacactctgtcgactcttcgggccattccggctctcaccacagtcacacaaccagccaaggacgtagtgacgccagccgaggtcagtcggggtccagaagcgctagccgtactacccgcaatgaggagcaatccggcgactcttccaggcatagcgtttcgaggcatcatgaggccagcacacacgccgacatttccaggcactcacaagcggtacaggggcagagcgagggatcccgacggtctaggagacaggggagctccgtaagccaagattcagactccgaggggcattccgaggattctgagcgctggtcaggaagtgcctcacggaaccacaggggtagtgtccaggaacagtctagacacggttcacgccatcctcgctctcaccatgaggacagagctggccatgggcattctgccgatcggtctcgacaatccggcacccgacacgccgagaccagcagcggtggccaggctgcctcaagccacgaacaagcaaggtcttcgcccggagagagacacggctcccgacaccaacagtctgccgactcctctcgtcacagcggtatacccagaggacaggcgtccagcgctgtaagagacagcagacattgggggtcctctgggtctcaagcctcagattcagagggccactccgaggagtccgacacccagagtgtatccggccacggacaggccggtcctcaccagcagtcccatcaggagagcgccagggaccgttccgggggaagatccggcaggtccgggtcattcctgtatcaagttagtacccacgaacagagtgagtccgcccatggaagaacaaggacgagcaccgggcgtcggcaggggtctcaccatgagcaggctagggactcttctcgccatagcgcaagccaggaaggccaagatacaattaggggccatccagggtcatcaagacggggaagacagggctcacactacgagcagtctgtggacaggtccgggcactcaggctctcaccactcacacaccacgagccagggcaggtctgacgcatcacggggtcaaagtggaagtcggtctgcatctagacagactagaaacgacgagcaatccggcgacggatccagacattcctggtcccaccaccacgaagcaagcacgcaggcagactcttcccgacactcccagtctggacagggccagagcgcgggacctaggacgagccggaaccagggctccagcgtatcacaagactcagacagtcagggtcattccgaagactctgaacgctggtcaggctctgcctctagaaatcaccgtgggagcgcacaggagcagtccagagatggctccagacatccaacctcacatcatgaggatcgagctggccacggacacagcgcagaaagtagtaggcagagcgggacccaccacgctgaaaatagttctgggggacaggctgccagtagccacgaacaagcccgaagttcggccggagagcgacatggcagccatcaccagcaatcagctgactccagtcgccattccggaatcgggcacgggcaggcaagctctgccgtgcgtgactccggccaccgcggaagctccggttcgcaggcttctgacagtgaaggtcactccgaagattctgacacacaaagtgtttcagctcacgggcaggccggacctcatcagcagtcccaccaggagagcaccaggggaagatccgcaggccgttccggccgtagtggttctttcctgtatcaggtgtccactcatgaacagagcgagtcagcgcacggcagagcaggccctagtaccggcggtcggcagggctcccgccatgagcaggccagagactcaagccgccatagtgcctcccaggaaggacaagacacaatcaggggacaccccggttctagacgcggtggccgtcagggcagctaccacgaacagtcggtcgaccgctccgggcactcaggtagccaccactcacatactacctcacaaggacgctccgacgcatctcatggccagagcgggtcccgaagcgccagccgcgagacacggaatgaggagcaaagcggagatgggtcccgacactctggcagtagacatcatgaagctagcacacaggcggattctagtaggcatagccaatcagggcagggtgagagcgcagggtcccggcgaagtcgacgccaggggtcatccgtatctcaggacagcgattcagaggcatatcccgaagatagcgaaaggagatcggaatcggcatcccggaatcaccacggttcaagtcgggagcagtcccgggacggaagccggcaccccggatcctcccacagagacacggcgagtcatgtgcagtccagcccagtacagagcgacagtagcacggcaaaagagcatggccatttcagctctctgtcgcaggactctgcataccactccgggatccaaagtagggggagtccccacagctcctccagttaccattaccaaagcgaaggaactgagcgccaaaagggtcaatccggactggtgtggaggcatggaagttatggaagtgccgactatgattacggggagtcggggttccggcattcacagcatgggtcagtgagttacaattcaaatccagtggtgttcaaagaaaggagtgatatttgtaaagccagtgcgttcggtaaagaccaccctcgctactatgccacctatattaacaaagatcctggcctttgtggtcattcaagtgacatcagcaagcagttggggttttcacagtcacaacgctattattattatgagtat

SEQ ID NO: 223330 - DNA, 969 bp, Artificial Sequence
  Description of Artificial Sequence: Synthetic coding sequence
ctgtatcaagttagcacacacgaacagccagattccgctcacggcaggactggaacttcaacagggggacgtcagggatcccatcacgaacaggccagagacagtagcaggcactccgcttcacaggaaggacaggatacaattcgaggtcaccctggctctagtagaggcggtaggcaggggagccatcacgaacagtctgtgaaccgttcggggcattctggcagtcatcactcgcatacaacgtctcagggccgatcagacgcttcacatgggcagtctggaagtcgttccgctagcagacagacacgaaatgaggaacaatcaggggacgggaccagacactcaggttctcgacatcatgaagcctcctcccaagctgactcctccaggcattcgcaggccggtcaaggccagtctgaggggtcgcggacaagccgcaggcaagggtcgtcagttagtcaagacagcgatagcgagggacatagcgaagacagtgagaggtggtccgggtctgcaagccgtaaccataggggaagcgcccaggaacagagtcgccacggtagccgtcacccacggagtcaccatgaggacagggcaggccacgggcactccgctgattcttctcgacagtccggcacacctcacgccgagactagctctggaggccaagctgccagcagtcacgaacaggctcgttcgtcccccggtgaacggcacgggtctcgtcatcagcagtctgctgatagttcacgtcacagcggtattccaagacgacaggcctcctccgctgtccgcgactcaggtcactggggctcgtccggtagccaggctagcgactcggagggtcactcagaggaaagtgatacccaatccgtcagtggccacggccaagacggccctcatcaacagagtcaccaggagtccgctagggactggtcaggcggacgtagtgggaggagcggatag

SEQ ID NO: 223331 - DNA, 3402 bp, Artificial Sequence
  Description of Artificial Sequence: Synthetic coding sequence
atgagaagcagaggaagcgacacggagggatctgcacaaaaaaagttccccaggcataccaaaggccacagcttccagggcccaaagaacatgaaacatagacaacaggataaggactcaccttctgagtctgacgtgatactgccttgtcctaaagccgagaaaccccactctggcaatggccaccaggccgaggacctgtcccgggacgatctgctgtttcttctgtcaatcctcgaaggggagctgcaagccagagacgaagttatcgggatcctgaaagcggagaagatggacttagcgttgctggaggcccaatacggatttgtcactcctaagaaagtgctggaggcgctgcagagagacgcctttcaagcaaaatcaactccctggcaagaagatatctatgaaaagcctatgaatgagttggacaaggtagtggaaaagcacaaagaatcgtaccgccgtatcctcggccaactgctggtggccgaaaagtcccgtcgccagaccatccttgaactcgaagaggaaaagaggaaacacaaggagtacatggagaagtctgacgagtttatctgtttactcgagcaggagtgcgaacgcctgaagaaactgattgatcaggaaattaaatcacaggaggagaaggagcaggagaaagagaaacgcgttacaaccttgaaagaggagttgacgaagctcaagtcattcgccctaatggtagtggacgaacagcagcgactcactgcccaactgaccctgcagagacagaagatccaggaactgaccactaacgctaaagagacacacacaaaactggctctagcagaggccagggtccaggaggaggagcagaaggccacccgcctagagaaggaactgcagacccagaccacaaaattccaccaggaccaggataccatcatggctaagctgaccaatgaggattctcagaatagacagcttcagcagaagctggctgctctctctcgtcagatcgacgagctggaggagactaatcgcagtctgagaaaagctgaggaagaactccaggacattaaagagaagataagtaaaggagaatacggcaacgctggaatcatggctgaggtcgaggaactgcgaaaacgggtcctcgacatggagggcaaggatgaggagcttatcaagatggaggagcaatgccgggatctcaacaaacggctggaaagggagacccttcagagcaaggattttaaacttgaagttgaaaaactgagcaagcgtattatggctctggagaaacttgaggatgctttcaataagagtaagcaggagtgctactcattaaaatgcaacctggaaaaggaacgcatgacaacgaagcagctttctcaggaacttgaatctctgaaggttagaataaaggagctcgaagctattgagtcaaggctcgagaaaaccgagtttactctaaaggaggacttgaccaagctcaagaccctgactgtgatgttcgtcgatgagcggaaaacaatgagcgagaaattgaaaaaaaccgaggataaactacaggccgcatcgtcccagttgcaggtagagcagaacaaggtaaccaccgtcaccgaaaaactaattgaggagacgaaacgcgcactaaaaagcaagaccgacgtcgaagaaaagatgtacagcgtgaccaaagagcgcgacgacttgaagaataagcttaaggctgaagaagagaagggcaacgatctactgtctagggtgaatatgctcaaaaatcgcttgcagtcgctggaagcaatcgaaaaagactttctcaaaaacaagttaaaccaggacagcggtaaatctacaaccgccttacaccaggaaaacaataaaataaaggagttgagccaagaggttgaaagactgaaactgaagttgaaggatatgaaagcaatagaggacgacttgatgaagactgaggatgagtatgagaccttggagcggaggtacgccaacgaacgcgacaaggcacagttcctctctaaagaattagagcacgtgaaaatggagctggccaaatacaagttggctgagaaaaccgagaccagccacgaacagtggctgtttaaaaggcttcaggaggaagaggctaagtccgggcacttatcaagggaggtcgacgccttgaaggaaaaaatccatgagtacatggccaccgaggatttaatctgtcatctacaaggggatcactcggtgttacagaaaaagctgaatcaacaggagaaccgcaatagagacttgggacgcgaaattgaaaatctgacgaaagaactggagcgctatagacacttttctaagtcgcttcggccatctctaaatgggagaaggatatcggatccccaggtgttctcaaaggaagtccagacggaggctgttgataacgagccccctgattacaaatctcttatccctcttgagagagcagttatcaacggtcaactgtatgaagagtccgaaaatcaggatgaggatcctaatgacgagggctccgtcctctcgttcaaatgtagccaatctacgccatgccccgtaaacagaaagttgtggattccatggatgaagtccaaggaaggtcatttacaaaacggtaaaatgcagaccaagccgaatgcgaactttgtacaacccggtgacttggtactttcccacacgccaggacagcctctacacattaaggtcacccctgaccatgtgcaaaatactgcaactctcgagataacatcacctaccacagaaagcccgcattcctacacgagtactgcggttattcctaactgtggcacaccaaaacagcgtattacaatcctgcaaaacgctagtataactcccgtgaagtctaagacctcaaccgaggatcttatgaacctcgaacagggtatgtcgccaatcaccatggccactttcgcccgagcgcaaacacccgaaagctgcggtagtctcacacctgagcggacgatgtcgcccattcaggtgctggcggtcaccggttctgctagctctcccgagcagggcagatctcccgaaccaacagagatcagtgccaaacacgctatctttcgggtgtcgccggatcgacagtcatcttggcagtttcagagatccaacagcaatagcagcagcgtgataactaccgaggacaacaagattcatatacacctgggttctccctatatgcaggccgtcgcttccccagtgcgtccagcttcgccttccgctccactgcaagataacagaacgcaagggctcataaacggcgctctgaataaaacaaccaacaaggtgacttccagcattacaataactcccactgcgactccactcccccgacagagtcagatcaccgtgtcaaatatctataactag

SEQ ID NO: 223332 - DNA, 3408 bp, Artificial Sequence
  Description of Artificial Sequence: Synthetic coding sequence
atgagaagtcggggaagcgacaccgagggaagcgcccagaagaaattccccagacacaccaaggggcactccttccagggtccgaagaatatgaaacaccgccagcaagacaaagactcaccaagcgagtccgacgtaatactaccttgccccaaggcggagaaacctcactccggtaacgggcaccaggctgaggacctgagtagagatgatcttctgttcctgctcagcattctagaaggagagctccaagccagggacgaagtaatcggaattctcaaagctgagaaaatggatttggctctgcttgaagcccagtatggatttgtaactccgaagaaggtcttagaagcacttcagagggacgcatttcaggccaagtcaacaccatggcaagaagacatttacgagaagcctatgaacgaacttgacaaagtcgtggagaagcacaaggagtcctatcgaagaatcctgggccagttgctggtcgctgaaaagagtaggcgccagacaattctcgaactggaggaagagaagaggaaacataaggaatatatggagaagtctgacgagttcatctgcctgctcgagcaggaatgtgagcgcctgaagaagctgatcgaccaagagatcaaatctcaagaggagaaagaacaggaaaaggaaaagcgcgtgacgactttgaaagaggaactgacgaaattaaaaagttttgcactgatggtcgttgacgaacagcagagactaaccgcccagctgaccctccagcggcagaagattcaagagctaacgactaatgcgaaagagactcacactaagcttgccttggccgaagctagagtccaggaggaggaacagaaggccacccgtcttgaaaaggaactgcagactcagacaaccaagttccaccaggaccaagacacaattatggccaagctcaccaatgaggacagccaaaatcggcagctccaacagaagctagccgctctctcccgtcagatcgatgaactggaggagacaaatagatccctgagaaaggcagaggaggaactccaggatatcaaggaaaagatctctaaaggcgagtacggtaacgctggcattatggccgaggtagaggagttgagaaaacgggtcctcgatatggagggcaaagatgaggaactgatcaaaatggaagagcagtgccgtgatttgaacaagagactggaaagggagacccttcagagcaaggacttcaagctcgaagtcgaaaaattgtccaagcgcatcatggcattggagaagctggaggacgcgtttaacaagagtaaacaggagtgctacagtctgaagtgcaacctggagaaggagcgcatgacaactaagcagctgagtcaggaactggagtccctgaaagtccgcatcaaagagctggaggctatcgagtctcgacttgagaagacagaatttacactcaaagaggatcttactaaactgaaaaccctgacggttatgtttgtggatgaacgtaagacaatgtcagaaaaattaaagaaaactgaggacaagctgcaagcagcaagttcccaactgcaagtggaacagaacaaggtgacaacagttaccgaaaagcttatagaagagacaaaacgggcactgaagtcgaaaactgacgtggaagaaaaaatgtacagcgtcaccaaagaacgtgatgatttaaaaaacaagttaaaggcagaggaggagaaaggaaacgatctgttgtctcgcgttaacatgctaaagaacaggctccaatcccttgaggcgatcgagaaagattttctgaagaacaagctgaatcaggatagtggaaagagcacaactgctctccatcaggagaacaataagattaaagagctgtcccaggaggtagagcgtctgaagctgaagctcaaagacatgaaggccattgaggatgatttgatgaaaaccgaggatgagtatgagaccctggaaagacgctacgctaatgaacgtgataaagcccagtttctgtcaaaggaacttgagcatgtaaagatggagctggcaaagtataagcttgcagagaagaccgaaactagccatgagcagtggctgttcaagcggctgcaggaggaggaagcaaagtcaggtcacctctcacgggaagtggatgctctcaaagaaaaaatccacgagtatatggctactgaagatctgatttgccatcttcaaggagaccatagtgtgcttcagaagaagctgaaccagcaggaaaaccgtaaccgcgatctcggcagggagattgagaacctcacaaaagagttagagcgatatcggcatttttctaagagccttaggccatctctgaatggtcgcagaatctctgacccccaagtgttttccaaagaggtccagaccgaagctgtagataatgagccgccagactacaaaagcctgattccactggaaagagcagtgatcaacggccagctctacgaggagtccgagaatcaggacgaggatcccaacgacgaagggtcggtcttgtcttttaagtgttcccagtctactccttgcccagtcaatagaaaactctggattccttggatgaagagcaaggagggccatctgcaaaatggaaaaatgcagactaagccaaacgcaaacttcgttcagcctggggacctggttctcagccacactccagggcagccactgcatatcaaagtgactcctgatcatgtccagaataccgccacattggagatcacttccccgactaccgagtcaccgcatagctacacctccaccgctgttattcccaattgcggtacgcccaagcagagaatcaccatcctgcagaacgccagcataaccccagtaaagtcaaaaactagcaccgaagatctcatgaaccttgaacagggaatgagccccataacgatggccacgtttgcgcgagctcaaaccccagagtcctgcggaagtctcacccctgaaagaacgatgagtcctatccaggtactggcagtaaccggcagcgccagtagccctgagcaaggcagatctccagaacctacagaaatcagcgcgaaacatgcgatatttagggtttcgcctgacaggcagagcagctggcagtttcaacgcagcaattctaattcgtcctcagtaataactactgaggacaataagatccacatacatttgggtagtccgtatatgcaggccgttgctagccctgttcggccagcatccccttccgccccactccaggacaatagaacacagggacttataaatggggcactgaataagactaccaacaaagtcacatcatccattactattaccccaaccgcgactcctctgcccaggcagagtcagatcaccgtcgagcctcttctcctacctcactag

SEQ ID NO: 223333 - DNA, 2682 bp, Artificial Sequence
  Description of Artificial Sequence: Synthetic coding sequence
atggtggtagatgaacaacagcggctcaccgcacagcttacccttcaacggcagaagatccaggagctgactaccaacgcaaaggagacccacaccaaacttgctctggcagaggcccgagtccaggaagaggagcagaaggccactagattggaaaaagagcttcagacacaaacgaccaaatttcatcaggaccaggacaccattatggctaaattaacgaacgaagattctcagaacagacagctgcagcaaaaattggccgctctctctagacagatcgatgagcttgaagagaccaaccgatccttacgtaaagcagaggaagagcttcaagatatcaaggagaaaattagtaagggcgagtatggtaacgccggaatcatggcggaggtggaggaactgcggaagagagtgcttgacatggagggaaaggacgaggagctcatcaagatggaagagcagtgccgtgacctcaataagaggctcgagcgtgagacccttcagagcaaagacttcaaattggaagttgagaagctcagtaaacgcatcatggctttggagaagctggaggacgcctttaacaagagtaaacaggagtgctactcacttaagtgtaacttggagaaggaaagaatgaccacaaagcagctgtctcaggaactggaaagcctgaaggtccggatcaaagaactggaggccatcgagtcaagattggagaagactgagttcaccttgaaagaggatttgaccaagttaaaaactctgactgtgatgttcgttgatgagaggaaaacgatgagcgagaagctgaaaaagacggaggacaaactgcaggcagcctcgtcccagctgcaggttgagcagaataaagttactaccgtcaccgagaagctgatcgaggagacaaaaagggcactgaaatccaagactgatgtagaagagaaaatgtacagcgtgactaaagagcgcgatgacctgaagaacaaactcaaggccgaggaggagaaaggaaatgacctcctctcgagggtgaatatgttaaagaatcgcttacagtcactggaagccatagagaaggactttttgaaaaacaagctaaatcaggattccgggaaaagcactacagctttacaccaggagaataacaaaataaaggagctgtctcaagaggtggaacgcttaaagcttaagctgaaggatatgaaagccatcgaagatgacctcatgaagaccgaagacgaatacgaaacactcgaacggcgttacgcgaatgaacgcgacaaggcccagttcctctccaaagaacttgaacacgtgaagatggagctcgccaaatataaactggccgaaaagaccgaaacttcacacgagcagtggttgttcaaacgccttcaggaagaagaggccaagtctggtcatttaagtcgtgaagtggatgccttgaaagaaaagatccacgaatatatggcaacagaagatctaatttgccacctccagggcgatcacagcgtgctgcagaagaaactaaatcaacaggagaaccggaatcgtgacctgggtcgggaaattgaaaacttgactaaggaacttgaacggtaccggcacttttcaaagtctctgcgacctagccttaatggacggagaatttctgacccccaggtcttctcgaaagaagtgcagaccgaggccgtagacaatgagccaccggactacaagtctcttataccgctcgaaagagcagttattaacggacaactgtacgaggaaagcgagaaccaggatgaagacccaaacgatgaaggcagtgtgctcagcttcaaatgctctcagtcgaccccttgccccgtgaatcgcaagctgtggatcccttggatgaagagcaaggaaggtcaccttcaaaacggaaagatgcagaccaagccaaacgcaaatttcgttcagccaggcgacctggttcttagccatactcctggccagccactgcacatcaaggtcacccccgatcatgtgcagaacacagccaccctggaaatcacaagcccaaccaccgagtctccacattcctatacctctacagcagtgataccgaattgcggcacaccaaagcaaagaatcacaatccttcaaaatgcgagcatcactcccgtgaagagcaagacttccaccgaggaccttatgaatctcgaacaggggatgtctccaatcacgatggctacatttgctcgggcacagaccccagagagctgtggaagcttgaccccagaaagaacaatgtctcccatccaggtactcgccgttaccgggtccgcgtcctcacctgaacagggcagaagtcctgaacctacggagatcagcgcaaagcatgccatctttagggtgtccccagatcggcagtcctcttggcaattccagagatccaattcgaacagctcttccgtgattacaactgaggataacaagatccacattcatcttgggagtccatacatgcaagccgttgctagccccgtgcgaccagccagccccagcgcccctctgcaggacaacagaacacagggtcttataaatggcgcactgaataaaacgaccaacaaggtcactagctccattacgatcacaccaacagctacacccctgcctcggcagtctcaaatcacggtatcaaatatttataattag

SEQ ID NO: 223334 - DNA, 768 bp, Artificial Sequence
  Description of Artificial Sequence: Synthetic coding sequence
atgaggtcccgcggttcggacacagaagggtctgcccagaagaaatttcctagacacacaaaaggccatagctttcagggccctaagaacatgaagcatcgtcagcaagacaaggactccccttccgaatccgatgtcattctgccctgcccaaaggcagagaagccacattccggcaatggacaccaagcggaggatctgtcaagggacgatctgctctttttactgtccatcctggagggcgaattgcaggctagggatgaggtgattggaatcctgaaagccgaaaaaatggacctggcactgctcgaagcccagtatgggttcgtaacccccaagaaagtgctcgaggctctgcagcgcgacgcttttcaagcaaagtcgaccccttggcaggaggacatctatgagaagcccatgaatgagctggacaaagtggtcgagaagcataaggagtcttaccgtcgaatcctggggcagctccttgtggcagagaaaagcaggcggcaaacaatcctagagctggaggaggagaagcgtaagcacaaggaatacatggagaagtctgacgaattcatctgtcttctcgagcaagagtgtgagaggtggagtctggctcttctgcccagactggagtgtaacgggatgatattggcccattgtaacctctgccttctcggttcaagtgattcccctgcttccgcgtttcaggtggccggtatcactggtactaggcaccatgcccagctggtttttgtgttcctgtag

SEQ ID NO: 223335 - DNA, 2640 bp, Artificial Sequence
  Description of Artificial Sequence: Synthetic coding sequence
atggtagtcgacgagcagcagagattaacagcgcaattgaccctgcagcgccagaaaatccaggagctgacaacaaatgcaaaggaaacacacaccaaactggcgcttgccgaggccagagtgcaggaagaagagcaaaaggctaccagactggagaaagagcttcagactcagaccaccaagtttcaccaggaccaggatacgatcatggccaagttaacaaatgaggattcgcaaaatcgccaactgcagcaaaaattggctgctctgtcccggcaaattgatgagctggaagaaactaacaggtccctgcggaaagccgaagaggagctgcaggacattaaggaaaaaatcagcaagggagaatacggcaacgcaggcatcatggccgaggtggaggagttgatcaagatggaggagcagtgtagggacctcaataagcgtctcgaacgcgagactctgcaaagcaaagacttcaaactagaagtggagaaacttagtaagagaatcatggccctggagaagttagaggatgctttcaacaagtccaagcaggagtgctactctctgaaatgcaatctcgaaaaggagaggatgacaacaaagcagttaagccaggagctggaatcccttaaagtacgcatcaaggaactggaagccatcgagtcacggctagaaaagacggaatttactctgaaggaagacctcacaaagcttaagactttgactgtgatgtttgtcgacgaacgcaagactatgtcagagaagctgaaaaaaacagaggacaagctgcaggccgcttcatcacagctgcaggtggaacagaataaagttaccaccgtaacagaaaaacttatagaggagacgaaacgagcgctgaagagcaaaaccgatgtcgaagagaagatgtactccgttacaaaagagcgagacgatctgaaaaataagctgaaagccgaggaggaaaaaggaaatgatctcctgagtcgtgttaatatgctcaagaatcggctacagtcactagaagccattgagaaagactttcttaagaacaaactgaaccaggatagcgggaaatcgactactgcacttcatcaagaaaacaacaagattaaagaactgagccaagaagttgagagactcaagctgaaactgaaagacatgaaagcaatcgaggatgacttaatgaaaactgaggacgaatacgagactctggaacggcgttacgctaacgaacgggacaaggcccagttcctttcaaaagaactggaacatgtcaaaatggaacttgccaagtataagcttgcggaaaaaacagaaacaagccacgagcagtggttgttcaaacgtctgcaggaagaggaagctaagtctgggcatctgagtcgggaagtcgacgccctcaaagaaaaaatccatgagtatatggctaccgaagacctgatttgccacctgcagggcgaccattcggtgctgcagaaaaagctcaaccagcaggaaaatagaaatagggatctgggaagggaaatagagaacctgacgaaggagctggagcgctataggcacttctccaaatctctgcgcccttccctgaacggtaggcggatcagtgaccctcaagtattctcaaaagaagtacagacagaagccgtggataacgaacctcccgactataaatcacttatcccacttgagagagctgttatcaatgggcagctgtacgaggaatctgaaaaccaggatgaggaccccaacgatgaaggctctgtcttgtcttttaagtgctcccagagcacaccttgcccagtcaatcgcaaactgtggattccatggatgaagagcaaggaaggccacctgcagaatggcaagatgcagacaaagccaaacgccaacttcgttcaaccaggtgacctggtgctgtctcatacacccggtcaaccgctccacattaaggtgactcctgaccatgtgcagaacaccgccaccctagaaatcacaagcccaaccacagaatcccctcacagctacaccagtactgcagtcattcctaattgtggcaccccaaagcagagaattacaattctccagaatgcttcaatcactcctgtgaagagcaagacatccacagaagatctgatgaaccttgagcagggcatgagcccaatcaccatggccactttcgcaagagcccagacaccagagagctgcggaagcctaacccccgagcgcactatgtccccgattcaagtcttagccgttacgggttccgcaagctccccagaacagggaaggtctcctgaaccaaccgagatttcggcaaaacacgctatcttcagagtctcgcccgatcggcagtcatcctggcagttccaacggtcaaacagtaacagtagtagtgtcattacaaccgaggataacaagatccacatacacctaggatctccttatatgcaagccgtggcatctcccgtgcgacccgctagtccctctgcccctttgcaggacaacaggacccagggactgatcaacggtgccttgaacaagaccacaaacaaggtcaccagctcaataaccattaccccgaccgcaactcccttacctcgccagtcccaaatcaccgtgtcaaacatctacaactag

SEQ ID NO: 223336 - DNA, 2688 bp, Artificial Sequence
  Description of Artificial Sequence: Synthetic coding sequence
atggtggtcgatgagcagcagcgcctgaccgcacagctaactctgcagaggcagaaaattcaagagcttactaccaatgccaaagagactcataccaaactcgcactcgctgaagcccgagtccaggaagaggagcagaaggctactcggttggaaaaggagctgcaaacccagaccaccaagttccatcaagatcaggacactatcatggccaagctgactaatgaagactcccaaaacagacaattgcagcagaaactggccgcattgagcagacagattgatgaactcgaagaaacaaacaggagcctcagaaaggcggaagaggaactgcaggatataaaagaaaaaatctccaaaggcgagtacggaaacgccggaattatggctgaagtggaagaactgcgtaagcgggtgttggatatggagggcaaggatgaggagctcatcaagatggaagaacagtgcagagatcttaacaagaggctcgaaagagagacactccagagcaaggactttaaactagaagtcgaaaaactctctaagcggatcatggccctggaaaagctcgaggatgcatttaacaagtcgaaacaggagtgttatagcctgaaatgcaacctggagaaagaacggatgaccacaaaacaactgagtcaggaattggagtctctaaaagtgcggatcaaggagctggaagccatcgaaagccgcctggagaaaaccgaattcacgttaaaggaagatttaacaaagctgaaaacactgaccgtgatgttcgtggacgagcgaaagaccatgtccgaaaaacttaagaagacagaagacaaactccaagctgcatcctcccagttacaagtcgagcagaacaaggtaacaacagtcactgaaaagttgattgaagagacgaagagggccctaaaaagcaagactgatgtggaggaaaagatgtactctgttaccaaggagcgggatgacttgaagaataagctgaaggctgaagaagaaaagggcaatgatctactgagcagagtgaacatgctgaagaatcgcttgcagtccttagaggctatagagaaggacttcctcaaaaataaattgaaccaggacagtggcaagagtactacagctctccaccaggagaacaataagatcaaagaactttctcaggaagtcgaacgcttgaagctgaagctaaaggatatgaaagcaatagaggacgatctgatgaagaccgaagatgagtatgagacactggaacgacggtatgccaatgagcgggataaagcccagttccttagtaaagagctcgagcatgtgaagatggaactggcaaagtataaactagctgagaaaacagagacctcccatgagcagtggctgtttaaaaggttacaggaagaggaggccaagagtggccacctgtctagagaggttgatgcacttaaggaaaagatacacgaatatatggctacggaagacctgatctgtcacctgcaaggcgaccatagtgtgctgcagaagaagttgaaccagcaagagaaccggaatagggatctcgggagggaaatcgaaaatcttacaaaggagctggaacgttatcgacatttctctaagtccctgcgtccgtcacttaatggtcgaaggatatctgatccccaggttttttcgaaggaggtccaaactgaggccgtcgataatgagccacctgactacaagtcacttatccctctggagcgggctgtcataaatggacagctgtatgaggaaagtgaaaatcaggatgaggacccgaacgatgaaggctccgtcctctcattcaagtgcagccaaagcactccgtgccccgtcaatcgtaagctgtggatcccctggatgaaaagcaaggaagggcacctgcagaacggcaagatgcaaaccaagccaaatgctaactttgtacagccaggagatctggtgctgtctcacacccccggtcagcctcttcacattaaggtgacacccgatcacgtacagaatactgcaacgctcgagatcacttctcccactacagaatccccacactcctatacatccactgctgtaatccctaattgcggcacgcccaagcagcggattaccattttgcagaatgctagcattacccctgtgaagagcaagacgagcactgaggaccttatgaatctcgagcagggaatgagcccgattacaatggctactttcgcgagagcccagacccctgagagctgcggcagcctgacccctgagcgaacaatgagccctatccaggttctggctgtcactggatctgcctcttcacctgaacaggggagaagtccggagcctacagaaatatcagccaagcacgccatcttccgcgtgtctcctgaccgacaaagtagttggcagttccagcgctctaattctaatagctcaagcgttatcacaaccgaagataacaagatacacattcacctcggctccccatacatgcaggctgtcgcaagccccgtgcgccctgcctctccttcggctccacttcaggacaatcgtacacaaggtctcatcaacggcgctctaaacaaaaccaccaataaagtaacatctagcatcaccatcacccctacagccactcctttgcctagacagtctcagataacagtagagcctctccttttaccacattag

SEQ ID NO: 223337 - DNA, 2136 bp, Artificial Sequence
  Description of Artificial Sequence: Synthetic coding sequence
atggccctagaaaagctggaagacgcctttaataagtccaagcaggagtgctactcactcaagtgtaatctcgagaaggagcgaatgacaacaaagcagctctctcaggagttggaaagtctgaaggtccggataaaggaactcgaagccatcgagtccaggctggagaaaacggagttcacccttaaggaggatctgacgaagctcaagacactcaccgtcatgttcgtggacgaaagaaagactatgtcggaaaagctgaagaaaaccgaagataagctccaggcagcttccagccaactccaagtggaacaaaacaaggtcaccaccgtcacggaaaagcttattgaggagaccaaacgcgcactaaagagcaagacagatgtggaggagaagatgtactctgtgactaaagagagggatgatctgaaaaacaagctgaaggccgaggaggagaaagggaacgacctgctgagccgcgtgaatatgctgaagaatcgactccaatctctggaggctattgagaaagattttctgaaaaacaaactgaatcaggattctggaaagagcacaactgcgctgcaccaagagaacaacaaaattaaggagcttagccaggaggtggagaggctgaagctgaagctgaaggacatgaaagctatcgaggacgacctgatgaagaccgaggatgaatatgaaaccttggaaaggaggtacgctaatgaacgagacaaggcccagttccttagcaaagaactcgagcacgtgaaaatggagctcgctaagtataagctcgccgagaaaacagagaccagtcatgaacaatggcttttcaagcgtcttcaggaggaagaggcaaagtcggggcacctgagccgggaggtggacgctctgaaggagaaaattcacgaatacatggcaaccgaagacctgatttgccaccttcaaggtgaccattctgtccttcaaaagaaactaaaccagcaggaaaatcgaaatcgggatctcggaagagagatcgagaacctgaccaaggaactcgaaagataccggcacttcagcaagtcccttaggcctagcctgaacggtcggaggatttccgacccacaagtgttcagtaaagaagtgcaaactgaggccgtggataacgagcctcccgactataagagtctgattccactcgagcgggcagtgataaacgggcagctgtacgaagagtcagaaaaccaggacgaagaccctaatgacgagggatccgtgctctccttcaagtgcagccaatcaaccccatgcccagtgaatcgaaaattgtggattccgtggatgaaatcgaaggaagggcatctgcagaatggaaagatgcagaccaaaccaaacgctaattttgtgcagcccggagatctggtattatcgcatacgcccggtcaaccactacacataaaggtgacccccgaccatgtacagaacacggctaccctagagataactagtccgactaccgagagcccccactcgtataccagtacggctgtcatccccaactgcggcaccccaaagcagcgcattacaatcttacaaaatgcctcaattactcccgtgaaaagcaagaccagcaccgaggacctgatgaacctggagcagggaatgagtccaatcactatggccacctttgctagggcccaaactcccgagtcttgtggtagccttactcctgaacggacaatgtcgcccatccaggtcctcgcagtgactggtagtgcttcgtcccctgagcagggcaggtcccctgagcccaccgagatctcagccaagcacgctatattccgggtgtctcccgacaggcaatcttcttggcagtttcagcggtcgaactctaactctagcagcgtgatcacaaccgaagacaacaaaattcatattcacctgggttcaccttatatgcaggctgtggctagccccgtccgcccagcatccccgtctgcgcctttgcaggacaatcgcacacaggggctgatcaacggggctttgaacaagaccaccaacaaggtgaccagctccatcactatcaccccaacagccactcctctgcccagacagtctcagattaccgtggagccattactgctgccacactag

SEQ ID NO: 223338 - DNA, 2514 bp, Artificial Sequence
  Description of Artificial Sequence: Synthetic coding sequence
atggtcgtagacgagcagcaaagactaaccgcacagctcactctgcagcggcaaaagattcaagaactgacaactaatgccaaggagactcacacaaagctggctctcgctgaggcaagagtacaggaagaggaacagaaagctacccgtttagagaaagagctgcagacccagaccaccaaattccatcaggaccaggataccattatggcaaaacttacaaatgaagacagccagaacagacagttacagcagaaactcgctgcattgtccagacagatagacgagcttgaagaaactaataggtcactgcggaaagcagaagaggagttgcaggatattaaggaaaaaatttccaagggagagtatggcaacgcaggtatcatggccgaggttgaggagctgaggaagcgtgtcctggacatggagggcaaggatgaggagctcatcaagatggaggaacagtgccgcgacctcaataaacggctggagcgcgagactctgcagagcaaagacttcaagttagaagtggagaaactgtccaagagaatcatggccctggagaagctggaggatgcatttaataaatctaagcaagaatgttattcgcttaaatgcaacctcgaaaaggagagaatgacaacaaaacagctgtcacaagaactagaatctttaaaggtaagaattaaagaactcgaggccatcgagtcaaggcttgagaagactgagttcacactgaaggaagaccttactaagctaaaaacactgacagtgatgttcgtcgacgagcggaaaacaatgtccgagaaattgaagaaaaccgaggataaactgcaagcggcaagctcacagttacaagtggagcagaataaagtgaccacagtgacggaaaagcttattgaggaaactaagcgtgctctgaagtctaaaaccgacgtcgaagaaaaaatgtactcagtgacaaaagaaagggacgacctaaaaaacaagcttaaggccgaagaggagaagggcaacgatctgctatccagagtgaatatgctgaagaaccgactgcagtcactggaggccattgaaaaggatttcttgaaaaataagcttaatcaggacagtggcaaatccaccactgctcttcatcaagaaaacaataagataaaggagctaagtcaagaagtggagagactcaagctgaagttaaaagacatgaaggctatcgaggacgacctgatgaagactgaagatgaatacgagacactagagcgcagatatgcaaacgaacgcgacaaggcgcagttcctgagcaaggagttggaacacgtgaagatggaactggctaaatacaaattagcagagaaaactgagacaagccatgagcagtggctcttcaagcgtctccaggaagaggaagccaagagcggccacctatctcgcgaagtggacgcccttaaagaaaagatacacgagtacatggcaacggaagatctgatctgccatctacagggtgaccactctgttctccaaaaaaagctgaaccagcaggaaaacagaaatagggacctgggacgagagattgagaatctaactaaggaactcgaacgctaccggcatttttcaaagagtctcagaccaagcctgaacggacgcagaatctcagatccacaggtgtttagcaaggaggttcaaacagaggctgtggataatgagccccctgactacaagagtttgatccctcttgagcgcgctgtgatcaatggacaattgtatgaagagtccgaaaatcaggacgaagatcccaacgatgaaggcagcgtgctgtctttcaagtgttctcagtctacaccctgccctgtcaaccgcaaactttggatcccttggatgaaatccaaggagggtcatctacaaaatggaaagatgcaaaccaaacccaatgcaaacttcgttcagccaggtgatttagttttgtctcacaccccaggccaacctctgcatatcaaggtgacccctgatcacgtgcagaataccgcaaccctcgaaatcacaagtccaaccacagaatccccccattcatatacttctactgccgtgatccccaactgcggtactccaaaacagagaattacaatcctgcagaacgcgtctatcactccagtcaagagcaagacctccaccgaggacctaatgaatttagagcaaggcatgtcacctattaccatggccaccttcgctagggctcaaacaccagaaagctgtggctcactgacacccgagcggacaatgtccccgatccaagtgctggctgtcaccggctctgcctcatcacccgagcagggacgttctcctgaaccaactgagatctcagccaagcacgcaatttttcgcgtgtcccccgaccgacagagttcatggcagtttcagcgatcgaattcaaatagctcttcggtgatcactacagaagataacaagattcatatccacttaggaagcccctacatgcaggccgtggctagcccatag

SEQ ID NO: 223339 - DNA, 7943 bp, Artificial Sequence
  Description of Artificial Sequence: Synthetic coding sequence
atgagttcctcacactcccgcgcaggccagagcgcagcaggcgcagcgcctggaggaggagttgatactcgggatgctgaaatgcccgctaccgagaaagacctggccgaagacgcgccatggaagaagatccagcagaacaccttcactagatggtgtaacgaacatctgaagtgcgtaagcaaacggatcgccaacctccaaaccgacctgagcgatgggctccgactgatcgcactcctggaagtgttatctcaaaaaaagatgcacagaaaacacaatcaaagacctacgttcaggcagatgcagctggagaatgtcagtgtagcgctggaattcctggaccgcgaatctatcaagctcgtatccatcgattccaaggctattgtggacgggaatctgaagctgatcctggggctgatctggaccctgattcttcactacagcatttctatgccaatgtgggacgaagaggaagacgaagaagctaaaaagcaaacccccaagcagaggctgttagggtggattcaaaataagctgccgcagctgcctatcaccaacttcagtagggactggcagtctggcagggctttaggagcactcgtggatagttgcgctcccggactgtgcccagactgggatagctgggacgccagcaagccagtcacaaacgccagagaggcaatgcaacaggcagatgactggctcgggatcccgcaagtcataaccccagaggagatcgtggatcccaatgttgatgaacactctgtcatgacctacctaagtcagtttcctaaggccaaacttaagcctggggcacctctgcggccaaagctgaatcctaaaaaggccagagcttatggacctggaatcgagcccacaggtaacatggttaagaaacgggctgagttcaccgtggagacgcgcagcgcaggtcaaggcgaagttctcgtgtatgtcgaggatcctgcaggccatcaggaagaggcaaaagttacagctaacaacgacaagaatcgtacattttcagtctggtatgtaccagaggtgaccggcacccacaaagtcacagtcctgttcgctggccaacacattgccaaaagcccattcgaagtttacgtggataaatctcagggggacgcttcaaaagtcaccgcacagggtcccggactcgagcctagcggcaatatcgcgaataagacaacctatttcgagatatttacagcaggagcaggcaccggtgaggtcgaggtagtgatccaggacccgatgggccagaagggcacagtagagccgcaactcgaagccagaggtgattcgacctacagatgctcctaccagcctaccatggaaggcgtgcacactgtgcacgtaaccttcgctggtgtgcctatcccaaggagcccctatacagtgacggtcggtcaggcctgtaacccttctgcttgccgcgcagtgggcaggggtctgcagccgaaaggcgttagggtgaaggagacggctgattttaaagtatatacaaagggagccggaagcggagagttgaaagtgactgtcaagggccctaagggcgaggagcgggtgaaacagaaggacttgggtgacggtgtgtatggcttcgaatattacccaatggtaccaggaacctatatcgtgactattacatggggcggacagaatataggaagaagcccgttcgaggtcaaagttgggaccgaatgcggaaatcagaaggtgagagcatggggcccagggttagagggcggagtggtgggcaagtccgctgactttgtggttgaagccattggcgatgacgtgggtaccctgggcttctcagtcgaagggcctagtcaggctaagattgaatgtgacgacaaaggcgatggatcctgcgacgttagatactggccacaggaagccggagagtatgctgtccatgtgctgtgcaattccgaggatattagactctcaccttttatggctgatatccgcgatgctcctcaggactttcacccagatagggtgaaggctagaggccctggtttggagaagactggtgtggcggtaaataagccggcagagtttaccgttgatgccaaacacggtgggaaagcaccccttcgcgtacaggttcaggataatgaggggtgtcctgtggaggctttggtgaaagataacggtaatggaacatactcatgttcctatgttcccagaaaacccgtgaagcacaccgcgatggtgagttggggcggtgtatctatccctaatagtccgttcagagtgaacgtgggcgcaggctcccatcccaacaaggtcaaggtctatggcccaggtgtcgctaagaccggtctgaaagcacatgaacctacttatttcaccgtggattgtgccgaagcagggcagggagacgtgtcaatcgggatcaagtgtgcaccaggagtcgtaggcccagctgaggctgacattgacttcgacataatcaggaatgataacgatacattcacagttaaatacacaccaaggggcgctgggtcctacaccattatggtcttattcgccgatcaggccacacccaccagccctatcagggtcaaggttgagccgtcccatgacgcctctaaagtgaaagcagaaggaccgggtctttctcgaacaggcgtggaactggggaagcccacccacttcacagtcaatgccaaagccgctggcaaaggtaaactcgatgtgcaattttctggacttaccaagggtgacgctgtccgggacgttgacatcattgaccaccatgataatacctatactgttaaatataccccagtgcagcagggcccagtgggggttaacgtaacctacggcggagaccccataccaaagtcgcccttctccgtcgccgtatcgccaagccttgacttaagtaaaatcaaggtcagtgggttaggcgagaaggtcgatgtcgggaaggaccaagaattcacagtgaagagcaaaggcgcaggcggacagggcaaagtggccagcaagatcgtgggccctagtggcgctgccgtgccatgcaaagtggagccaggactaggcgctgataacagcgtggtccgctttcttccccgagaggaggggccatacgaagtggaggtgacttacgatggggtccctgtgcctggctcaccatttccccttgaggcagtggctccaaccaagccatccaaagtgaaggcctttggtccaggtctacaaggcggttcggccggtagccccgcacgctttaccatagacactaagggtgctgggactggagggctcggcctaaccgtcgagggcccatgcgaggcccagctggaatgcctagacaacggagatggcacttgttcggtgagctatgttcccacagaacccggtgattataacatcaacatattgttcgccgatacccacatccctggctcgccgtttaaagcccacgtggtcccctgtttcgacgccagcaaggtaaagtgctcaggtccaggtttggagagggcgactgctggagaagtgggccagtttcaggtcgattgctcaagcgcgggatccgctgaactcaccatcgaaatatgttcagaagccggactgccagctgaggtatatatccaagatcacggtgacggcactcataccattacttatatccccctgtgtcccggagcatatacggtaacaatcaagtacggaggtcaacccgtgcctaacttcccaagcaagctgcaagtcgaacctgctgttgacacgagcggagtacagtgctacggacccggaattgagggccagggtgttttccgggaggcaacaaccgagttctcagtagatgccagggcactgacccagacagggggtcctcacgtaaaggcgagagtggcgaacccgtctggaaacttaactgagacgtatgttcaggataggggcgacggaatgtacaaggtggagtataccccatatgaggagggcttgcacagtgtcgacgtgacatacgatggcagtccggtgcctagctctccattccaggtcccggtgaccgaaggttgcgacccttcacgcgttagagtccatggccctgggattcagagtgggacaaccaataagcctaataagttcaccgtggagaccagaggtgccggaacaggtggcctgggacttgccgttgagggtccctccgaggctaaaatgtcctgtatggacaataaggatgggtcctgttccgtcgagtatattccctacgaggcagggacatactccctgaatgttacctacgggggacaccaagtgcccggttctccgtttaaagtccctgtccacgacgtgaccgatgcaagcaaggtcaagtgttctggccctggcttgtctcctggcatggtgagggctaatctcccacagtctttccaggtggatacatcaaaagccggagtggctcctctacaggttaaagtgcagggacccaaagggctcgtagagcccgtggatgtggttgataatgctgacgggacccagaccgtgaactatgtgccctctcgcgagggtccctattctatctccgtcctctacggcgacgaggaggttcctaggagtccttttaaggtgaaagtgcttcccacgcatgacgccagtaaagtgaaagcctccggccctggcttaaatacgaccggagtaccggcatcacttccagttgagtttacaattgacgccaaggatgctggggagggtctgcttgctgttcagatcaccgacccagaaggaaagcctaagaagacgcatatccaggacaaccatgatgggacgtataccgtggcctacgtcccagacgtcacaggccgatataccatattgatcaagtatggcggagacgagattccctttagcccataccgtgtacgggctgtgcctaccggggatgcttcaaagtgtacagtgaccgtgtcaattggaggccatggcctgggcgcaggcataggaccaactattcagatcggcgaagaaactgtcataactgtcgacacaaaggccgctgggaaagggaaagtgacctgcactgtgtgcaccccagatggctccgaagtggacgttgatgtggtggaaaacgaggatggaacttttgacatcttctacacagctccccagcctggcaaatatgtgatttgtgtgagattcgggggagagcacgtgcctaatagcccttttcaggtgacagccctggccggtgaccagccgtccgtccaacccccactcagatcccagcagttggccccacagtacacctatgcccagggtggacagcagacttgggcaccggagagacctctggtcggcgttaacggccttgacgttacgagtcttaggcctttcgatctggtcattcctttcactataaagaagggggagatcaccggagaggtgagaatgccctccggaaaggtcgcccagcctaccatcacagacaataaagatggaactgttacagtgcgttatgccccatccgaagcgggactgcacgaaatggatattcggtacgacaatatgcatattccagggtccccacttcagttctatgtcgattacgtcaattgcggccacgtgacggcttatgggcctgggctgacacacggggtggtgaacaaacccgcaacttttaccgtgaacaccaaggatgcaggggagggcggactgtccctcgcaatcgagggccctagtaaagctgaaatatcatgtaccgataatcaggacggcacctgctctgtatcttacctccccgtgctgccaggagattattctatcctggtgaaatacaatgagcagcacgtgccagggtcgccatttactgcacgggttaccggcgacgattcgatgagaatgtcccatctcaaggtggggtctgccgcagacatccctatcaatatctccgagactgacctttccctgctcaccgccaccgtcgtgccacctagtggcagagaggaaccgtgcctgttgaaacgcctgaggaacggacatgtgggaatatcctttgtcccaaaagagacgggtgagcacttagttcacgttaagaagaatggacaacacgtggccagttcacccatccccgtggttatcagtcagagcgagataggagatgcttcgagagtccgagtctccggacagggtttacacgaaggccacacgtttgagccagcggagtttatcattgacactcgggatgccggatatggcggtctgagcctgtcaattgaaggcccaagcaaggtggacattaacaccgaggatctagaagatggcacatgccgcgtaacctattgccctaccgagcccggtaactacattattaatattaaatttgccgatcagcacgttccaggaagccctttcagcgtgaaagtgacaggagaaggaagggtgaaggaatctatcacacggaggcgtagagcaccaagcgtggccaacgtaggcagtcattgtgatctcagcctgaagatccctgagatctctatacaggacatgaccgcccaggtaacctcacccagcggaaaaacacacgaagcagagattgttgagggtgaaaaccacacttattgtatccgatttgtgcctgcagaaatgggaacacacaccgtgtccgttaaatacaaaggccagcatgtccccggaagcccattccagtttaccgtgggccctctgggtgagggaggtgcccacaaagtgcgcgctggcggacccggactcgagagagccgaagccggagtacccgctgagttttccatctggacccgggaggccggtgcagggggactggctatagctgtggagggcccatcaaaggccgagatttcattcgaggacaggaaagatggatcttgtggcgtggcctatgttgtgcaggaaccaggggattatgaggtgtccgtaaaatttaacgaggagcacatccccgattcacctttcgtggttcccgtagcctctccttcaggcgatgccaggcggctgactgttagctccttgcaggagagtggcttgaaggttaatcagccagccagctttgctgtgagcctgaatggtgccaagggagctatagatgctaaagttcactcaccaagcggtgccttagaggaatgctacgtgaccgagatagaccaggataaatatgcggtgagatttatccccagggaaaacggagtgtacctgattgatgtaaagttcaacggaacccacatcccgggatcgccttttaagattcgggtgggggaaccaggacacggaggcgacccaggcctggtctctgcctacggggcagggctggaaggcggtgtgacaggcaatccggcagaattcgtagtgaatacttccaacgccggtgccggagccctgagcgtaaccattgatggtccttctaaagtgaaaatggactgtcaggaatgccctgagggttatagagtcacatatactcccatggccccaggttcctacctgatctcgatcaagtatggcggtccttaccacataggagggagccctttcaaggcgaaggtgactggcccacgcctggtgtcaaaccattctctgcacgaaaccagtagcgttttcgtcgactccttgactaaagccacatgcgccccacagcacggcgcacccggacctggaccagctgacgcctccaaggtcgtcgctaagggccttggcctgagcaaagcgtatgtgggccagaagagctcgttcaccgtggattgtagcaaggccggaaataatatgctgttagtgggggtgcacggacccagaacaccatgcgaagagattctggtcaagcatgtggggagccgtctatacagtgtctcgtacctgttgaaagataagggtgagtacactctcgtcgtaaagtggggggacgaacatattcccggttcgccttaccgcgtcgtggtgcctta

SEQ ID NO: 223340 - DNA, 6947 bp, Artificial Sequence
  Description of Artificial Sequence: Synthetic coding sequence
atgccagccacagagaaggatctggccgaggatgcgccttggaaaaaaatccagcagaatacattcacccgatggtgtaacgagcatctcaaatgtgtgtccaaaagaattgctaatctccagacagacctctccgatggactaagactgatcgctctcctggaagtgctgtctcagaaaaagatgcacagaaagcacaatcagcgtcctaccttccgccagatgcagcttgagaatgtcagtgtggcactggagtttctggaccgcgagtccatcaagttggtatcaattgactctaaagccatcgtggatgggaacctcaaactcatccttggcctgatatggacgctaatcctgcattattctattagcatgcctatgtgggacgaggaggaggacgaagaggccaaaaaacaaacaccaaaacaaaggctcctgggctggattcaaaacaagctacctcagctgcctattacaaatttttcaagggactggcaatccgggagagcgctcggcgcactggtggacagctgtgcccctggactctgccccgactgggattcatgggatgcttctaagccggtgacaaatgctagggaagctatgcagcaggccgatgactggctcggcattccccaggtgatcacccctgaagagattgtcgacccgaatgtggatgagcactccgtcatgacgtatttatcccaattccccaaggccaaactgaagccgggagctcccctgcgccctaagctgaaccctaaaaaagccagggcctatggaccgggaattgagcccaccggaaacatggttaagaagcgggcagagttcactgtagaaacgcgctccgccggtcagggggaagtccttgtgtatgtcgaagacccggctggccatcaggaagaagccaaggttacagcgaacaacgacaagaatcgaacatttagcgtgtggtacgtgcctgaagtgactgggacacacaaggtcactgtgctgtttgccggtcagcatatagcgaagtccccttttgaggtttacgtggacaaaagtcagggtgatgcttcaaaggtgacggcgcagggtcctggtctcgagccatcaggaaatattgccaataaaaccacttactttgaaatcttcacggccggagccggtactggcgaagtcgaagtggttatccaggatcccatgggacagaagggaactgtggaaccccagttagaggcgagaggcgattctacttacaggtgctcctaccaacccaccatggaaggagtgcacacggtgcacgtgacattcgccggagtacccatcccaagaagcccctacaccgtcaccgttggccaagcctgcaatccttccgcctgtagggcagttggcagggggctccagcctaaaggcgtgcgcgtaaaagaaacagccgatttcaaggtgtacactaaaggggctggcagtggcgagcttaaggtcacagtaaaagggcctaagggcgaagagcgcgtaaaacaaaaggatctcggggacggcgtttacgggttcgaatactatcctatggtccccggtacctacatcgttacgatcacatggggcggtcagaacatcggcaggtcccccttcgaggtgaaagtgggaacagagtgcgggaaccaaaaggttcgcgcttggggtccgggtctggaaggcggagtggtcgggaaaagtgcagacttcgtcgtagaggccatcggcgacgatgtggggactctgggcttctctgtggaaggtccaagccaggcaaaaattgagtgcgatgataagggagatggcagttgtgatgttcgctactggccccaggaggccggagaatatgctgtgcacgtcctctgcaattccgaggatattcgcctgtccccattcatggccgatatccgagacgccccacaggatttccacccagaccgtgtgaaggccagaggcccaggactggaaaaaaccggcgttgccgtgaacaaaccggctgagttcacagtggacgcgaagcatggagggaaagcacccttgcgtgtacaggtgcaggataacgaggggtgccctgtcgaggccttagtcaaagacaacggtaatggcacatactcctgctcatacgtccctagaaaacctgtgaaacacactgctatggtctcttggggcggagtgagtatacctaacagcccattcagggtgaatgtgggggcaggatcccatcccaataaagttaaggtgtacggtcctggggtggcaaaaaccggcctcaaggcacacgaaccgacatactttacagtggactgcgccgaggctggccagggcgacgtgagcataggcatcaaatgtgcaccaggcgtcgtcggtccggctgaggctgacatagatttcgacattattaggaacgacaacgacacatttaccgtgaagtacacaccccgaggcgctggatcatacacaattatggttttattcgccgatcaagcaaccccaacctcacctattagagtgaaagtggaaccctcgcacgacgcatcaaaggtgaaggccgaaggacccggactttcaaggactggggtggagctgggcaaacccacgcacttcacggttaatgccaaagctgccggaaagggcaaattagatgtacaatttagtggtttgaccaaaggagacgccgttcgtgatgtggacatcatagatcatcatgacaacacttacaccgtcaaatacacccctgtacagcagggccctgtaggagtgaatgtgacatacggtggtgacccaatccccaaaagcccattttcggtggccgtgagccctagtctcgacttaagcaagattaaggtttccggccttggtgagaaggtggacgtgggaaaggatcaagagtttaccgttaagagtaagggtgctgggggacagggtaaggtcgcgagcaaaattgtgggcccatctggagctgctgtcccatgcaaagtggaaccagggttaggcgctgataatagcgtcgtgcgctttctgcctagggaggagggaccctatgaagtggaagttacatatgacggcgtgcccgtcccgggaagtccctttccacttgaagcggtggctcctaccaagccaagtaaggttaaagcctttggtccaggtctgcagggtggctctgctggcagtcctgcgaggttcactattgacactaagggcgctggcaccggcggtctgggcctgacagtcgaggggccatgtgaggctcagctggagtgtctggataatggtgacggtacctgcagcgtcagctatgtgcctacggaaccgggtgattataacatcaacattctgttcgcagacacccatatcccgggttccccctttaaggcgcatgtggtaccatgtttcgatgcctctaaagtgaaatgttcaggaccagggctagaacgcgcaacagccggagaggtgggccaattccaagtggattgctcttccgcaggatcagctgagttgaccattgagatatgctcagaggcaggcctgcccgcagaagtgtacattcaagatcatggcgacggcacccacaccatcacctatattcctctctgtccaggcgcttacaccgttaccattaaatacggcggtcagcctgtcccgaattttccatcaaagctacaggtggagcccgctgtggacacttccggagtccagtgttacggcccaggtatcgaaggacagggcgtgttcagggaagctacaacggaattctcggtggacgcccgtgcgctgacacagaccggcggtccacatgtcaaagccagagtcgccaatccatctgggaacctgactgagacttatgtgcaggaccgtggcgacggaatgtataaagtcgaatacacaccttatgaggagggcctgcacagtgttgacgtgacttatgatggcagcccggtcccatcttccccctttcaggtgcccgtgaccgagggttgcgatccaagccgcgtaagagtacacggacccggaatacagtctgggacaacgaataagcccaataagttcaccgtcgagacgcgtggggcaggtactgggggactgggattagccgtggagggtccctccgaggccaagatgtcctgcatggataataaggacggatcgtgcagtgttgagtacataccctacgaggctggcacatacagccttaacgtgacatacggcggacaccaggtccccggttccccctttaaggtaccagtccacgatgtcacggatgcctcaaaagtcaaatgttctggacccggactgtcaccaggcatggtgagagctaaccttccccagtcttttcaggtcgacaccagcaaggcaggcgttgccccactgcaggtgaaggtgcagggaccaaagggcctggtggagcccgtcgatgtggtcgataatgccgacggaacacagactgttaactatgtacctagtagggaaggaccgtacagtatctcagtcctttatggcgacgaagaggtcccacggtctccgttcaaggtaaaagtgcttcctacacacgacgcgtcaaaggttaaggcctccggccctgggctgaacacaaccggcgttccggcttcactacccgtcgagtttaccatcgacgctaaagacgctggcgagggcctcttggctgtgcagatcaccgatcccgagggaaagcccaaaaaaactcacattcaggacaaccacgacggtacatacaccgtggcttatgtgcccgacgtgaccgggagatacaccatccttattaagtatggtggcgacgaaatccccttttccccttatcgggtcagagcagtgcccacaggagatgcctcaaaatgcacagtgacagtttccatcggtggacacggactgggggcagggattggcccaactatccagattggagaggaaactgtgattactgtggacaccaaagccgcaggaaaagggaaagtgacatgcacagtgtgtacccctgacggctctgaggtggatgtagatgtggtggagaacgaagatggcaccttcgacattttttacacagctcctcaacccggaaagtacgtgatatgtgtacgttttggcggtgagcacgttcccaatagtcccttccaggtgacagctcttgcaggcgatcagccctccgtgcaacctccactccgctcccaacagctcgcaccccagtatacctatgcccagggcggtcagcagacctgggcccctgaacggccactggttggcgtgaacggtcttgacgtgacctcactgcggccatttgaccttgtgatcccattcacaattaagaagggtgaaatcacaggtgaggtccggatgccatccggtaaagttgcccagcccacaataacagataacaaggatggtaccgtgactgttcgctacgcgccatccgaagctggccttcacgaaatggacatccgatatgacaatatgcacattcctggctcaccactccagttctacgtcgactacgtgaattgtggacacgtgaccgcctacggcccagggcttacgcacggcgttgtaaataagcccgcaacatttactgtgaacactaaggacgcaggggaaggaggattgagcctggccatcgaaggacctagcaaagcagagataagttgtactgataaccaggacggcacctgctctgtgtcttacctgccagtgttaccaggggactactctattctggtcaaatacaacgagcaacacgtacctggttcccctttcacagcacgcgtgacgggggacgattccatgagaatgagccatctcaaagtcggtagtgccgctgatatccctataaacataagcgaaatatctttcgaggaccggaaagacggtagctgcggagtggcatacgtggtccaggaacctggagactatgaagtgagcgtaaagttcaatgaggaacacatccccgatagccctttcgttgtaccggttgcatcacccagtggagatgccagacgcctcactgtgagctccctgcaggagtcgggattgaaagtgaaccagccagccagcttcgctgtgagtctcaacggcgctaagggcgctattgacgccaaagtacattctccgtctggggctctcgaagaatgctacgttactgaaatcgatcaggacaagtatgccgtgagattcatcccaagagaaaatggtgtgtacctgatcgacgtgaaattcaacgggacccacatccccggatcaccttttaaaattcgggtgggagagccaggccacggaggagaccctggcctggtctctgcatacggagcaggcctcgaagggggtgtgaccgggaaccctgccgagtttgtggtgaatactagtaacgcaggagctggtgcactcagtgtgaccatcgatggtccctcaaaagttaaaatggattgtcaggagtgcccggaggggtaccgggtgacgtacacacccatggcccctggcagctatctcatctctattaaatatggcggaccctaccacattgggggaagccctttcaaggcaaaagtcacaggtccgcgtctcgtatctaaccacagcctccacgagaccagctccgtgttcgtggactctctgactaaagcaacctgtgcaccccaacatggggctccaggaccaggcccagctgatgccagtaaagtggttgcgaaggggcttggcctgagtaaggcgtacgtgggacagaagtcttccttcactgttgattgttcaaaggctggaaataatatgctcttggtaggcgtgcatggtccaaggaccccctgcgaggaaatcctggtgaagcacgtggggtctagactttatagtgtctcttacctcttaaaggataaaggcgaatacacattagtggtgaaatggggcgatgagcatattccagggtctccttatagagtggtggtgcccta

SEQ ID NO: 223341 - DNA, 2343 bp, Artificial Sequence
  Description of Artificial Sequence: Synthetic coding sequence
atgccttctggtaaggtggcccagcccactattacagacaataaggacggtacggtaactgtgagatatgcgccttctgaagcaggcctacacgagatggacatccggtatgacaacatgcatatcccaggaagccctcttcagttctatgtagactatgttaactgtggacacgtgacagcttacggtcccggactgactcatggagtcgtgaataagcccgcaacatttaccgtgaacacgaaggacgcaggcgagggcgacgattcaatgaggatgagccacctgaaggtggggtcagccgctgacatcccgatcaacatcagtgagactgacctatccctgctgactgcaacagtggtgccacctagtggtagagaggagccttgtctgctcaagcggctacgcaacggccatgtcggaattagttttgtgcccaaagagacgggggaacacctggtgcatgtcaagaaaaacgggcagcatgtcgcctccagccctatccctgtggtgatatctcagagcgagatcggggacgcctccagggtgcgagtatccggtcagggactgcatgaggggcacaccttcgagcccgctgagtttattatcgacaccagagatgcgggttacggcggtcttagcctctccatcgaagggccatcaaaggtagacatcaatactgaggatctggaggatggtacatgtagagttacttactgccccaccgaacctgggaattatataattaacattaagtttgccgatcaacatgtgcccggttctcccttttccgtgaaagtcaccggtgagggcagggtgaaggaatctatcacgcgacgcagaagagctcctagtgtggcgaacgtgggctcacattgcgatttgtccttaaagataccagagatcagtatacaggatatgactgcgcaggtgacctctcccagcggtaaaactcatgaagcagagatcgtggagggcgagaaccatacctactgcataagatttgtccccgcagagatgggtacacacacagtctcagtgaagtacaagggtcaacatgtcccaggctcccccttccagttcaccgttggccctctgggcgaaggaggcgcacacaaggtgcgggctggcggtccaggacttgagagagccgaagctggggtcccagcagagttctccatctggacccgcgaggcaggagcaggcggactggcaatagccgtggaggggccatccaaggctgaaattagcttcgaggaccggaaagacggctcatgcggcgttgcatacgtggttcaggagcctggagactacgaggtgagcgtaaaattcaacgaagaacatatcccagacagtccgtttgtagtgccagtggccagtccttctggcgacgccagacggctgactgtgtcatctctgcaggagtccgggctgaaggtcaatcagccagcatccttcgcggtctcactgaacggcgctaagggtgccattgacgccaaggtgcacagcccttcaggagcactcgaagaatgctacgtcacagagattgatcaagacaaatatgccgtcaggtttattccgcgagagaatggagtgtatctcattgacgttaagttcaacggtacacacattccagggagtccttttaagatcagggtcggcgagcccggtcacggcggtgatccagggttggtgtccgcctacggggctggactggaggggggagtgaccgggaatcctgctgaattcgttgtaaacacatcaaacgcaggggcaggagctctcagcgtgacaatcgatggaccctccaaagtgaagatggattgtcaggaatgccctgaaggatatcgagtgacctacacccccatggcaccgggtagctatctaattagtatcaagtatgggggtccctatcacattggcggttcaccattcaaggccaaagtgactggccctcggctcgtctccaaccactccctccatgagacttcctcggtgtttgtggactccctgaccaaagcgacgtgcgcgccacagcacggtgcaccagggcctgggcctgccgacgccagtaaagttgtcgcaaagggtctgggactatctaaggcatacgtaggccagaagagctccttcaccgtggattgcagcaaggcaggaaataacatgttactcgtaggcgtgcacggccctcgcacgccttgtgaggagatcctagtaaagcacgttgggagcaggctgtacagcgtgtcctatctgctcaaagataaaggcgagtacacactcgtagtcaaatggggcgacgagcacatcccaggatctccatatcgtgtggtagtgccctag

SEQ ID NO: 223342 - DNA, 7919 bp, Artificial Sequence
  Description of Artificial Sequence: Synthetic coding sequence
atgagttccagccattccagggcgggtcagtcagctgccggagctgctccaggcggtggagtggacactagagacgcagagatgcctgcgacagagaaggacctcgccgaggacgcaccttggaagaagattcagcagaacacattcacacgctggtgtaatgagcacttaaaatgtgtctcaaaaagaattgccaatctccagactgacttgtctgacggcctaaggttaattgcgctgctggaagtgctcagccagaaaaagatgcaccggaaacataatcagcggcctacttttcgccagatgcagctggagaatgtgagcgtggcactcgaatttctcgatcgggagagcattaaacttgtgagtatcgacagcaaggccatcgtagacggcaacttgaaattaatcctcggtctcatctggactctgattctccattactcaatcagtatgccaatgtgggacgaagaggaggatgaggaggccaagaagcagaccccaaaacagcggctgctggggtggattcagaacaagctgccccaacttcctattactaactttagccgcgactggcaaagcggtagagcgttgggcgctctggtcgactcctgcgcacccggactctgccctgactgggacagctgggatgcatccaagcccgtgactaacgctcgggaagccatgcagcaggctgatgactggttaggcatcccacaggttatcacccctgaggaaatcgtcgaccctaacgtggacgagcattcagttatgacttatttgtctcagtttcccaaagcaaaattgaaaccaggtgctccattgagaccaaagctcaatcctaagaaggccagggcatacggtccaggcatcgaacccaccgggaacatggtgaaaaaaagggcagaatttaccgtcgagacaagaagcgcgggacagggggaggtactcgtgtatgtggaagaccccgctggacatcaggaggaggcaaaggtgacagcaaataatgataagaaccgaacattctcagtgtggtacgtgccagaggtcaccggcacgcacaaagtgactgtactttttgctggacaacatatcgccaagagccccttcgaggtttacgtggacaagtcccagggggatgcatcaaaggttaccgcccaaggccctggcttggagccttcgggcaacatagctaataagaccacttacttcgagattttcacggccggagctggaacaggggaagtggaagtggtgatacaggacccaatgggccagaagggaacagtggagccccagttagaggctagaggagactctacgtacagatgttcttatcagcccaccatggaaggcgtgcacacagttcatgttactttcgctggagtgcctatcccccgatccccttacacagtcactgttgggcaggcttgtaatccctccgcctgtagagcagtgggtagaggtctgcaacccaagggggtccgcgtgaaagagactgcagactttaaagtgtatactaagggggcagggagtggtgaactcaaggtgaccgtgaaaggtccaaagggcgaggaacgtgtcaagcaaaaggatctgggggacggcgtttatggtttcgagtattatcctatggtgccaggcacctacatagtgaccatcacttggggcggtcagaacatcggacgaagcccattcgaagtgaaggtgggcactgagtgcgggaaccaaaaggtgcgggcatggggccctggtctggaagggggtgtagttggtaaaagcgctgatttcgttgtggaggccattggcgacgatgtggggacccttgggttctcagtggagggtccctcccaggccaaaatcgagtgtgacgacaagggagacggttcctgcgacgtgaggtattggccccaagaggccggagaatacgccgttcacgttttatgtaacagcgaggatattaggttatcacccttcatggcagatattcgtgacgcaccccaggacttccacccagacagggtgaaagcacggggaccagggctggagaagacaggtgttgcagtcaacaagccggctgaattcaccgttgatgccaaacatggcggaaaagctccgctgcgagttcaggttcaagataacgaggggtgtccggtcgaagccttagtcaaggataacgggaatggcacctattcatgctcatacgtaccacgaaaaccggtgaagcacaccgccatggtcagctggggcggagtgagcatacctaactcaccatttcgagtgaatgtaggggctggatcccacccaaacaaagttaaggtgtacggccctggagtggcgaaaaccggattaaaggcccatgaaccaacttattttaccgtggactgcgctgaagctgggcaaggagatgtctccataggtattaagtgtgcgccaggcgtggtgggacctgccgaggccgacatcgactttgatatcattagaaacgataatgatacctttaccgtaaagtatactcccaggggcgctggcagctacactatcatggtcctgttcgccgatcaggccacaccgacatcccctatcagagtgaaagtagagccctcccacgatgcttccaaggtgaaagccgagggccctgggctctccaggaccggcgttgagctgggcaaacccacccactttactgttaatgcgaaggccgcagggaagggcaagctggatgtgcagttttccggcctcactaagggcgacgccgtgagagacgtggacatcattgaccaccacgacaacacctataccgttaaatatactcccgtgcagcagggtccagttggtgtgaacgtgacctacggcggagacccgatacctaagtctcctttcagtgttgcagtctccccgtctctagacttatcgaaaattaaggtcagcggcctcggagaaaaagtcgacgtgggcaaggaccaggagtttaccgtgaagtcaaaaggggctggaggccaggggaaagtggcatcaaagatcgtcgggccttctggagccgcagtcccttgtaaggtagagccaggtttgggcgctgacaactctgtcgtgcggtttctgccgcgagaggaagggccatacgaggtggaggtgacatacgatggtgtcccagtgccaggctcacctttcccgcttgaggccgttgcgcctacaaaaccgagtaaagtcaaggcctttggtcctggcctgcagggtggctctgctggttccccagctaggttcacaatcgatactaaaggtgcgggaacagggggactggggttgacagtggaggggccatgtgaggcacagttagaatgtctggataacggtgatggaacatgctccgtaagttacgtacccacggaacctggggactacaacatcaacattcttttcgccgacacacacattcctggctcccctttcaaagcccatgtagtgccttgtttcgacgcttcaaaggtgaaatgttctggcccagggctggagagagcgactgcaggggaggttggacaattccaggtcgactgctcctctgctggttcagcagagctcaccattgagatttgttcggaggctggcttaccagcggaggtgtacatccaggaccacggcgacggtacccacaccattacgtatatccctctttgtcctggggcttacactgtgacaattaaatatggaggacagcctgtccctaacttcccgagtaagctgcaagtagaacccgctgtcgacaccagcggcgttcagtgctatggtcctggtatcgaagggcagggagtgtttcgggaagccactacggaattctcggtagacgcacgggctctgacccagacggggggaccccacgttaaagctcgcgttgccaacccatctggcaacctgaccgaaacttacgtgcaggaccgtggagacggtatgtataaagtggaatacaccccatacgaggaaggcctccattccgtcgacgtaacctatgacgggtctccggtccccagcagcccttttcaagtaccggtgacggaaggttgcgatcccagtagagtgagagtccatggacctgggatccagtccggcaccaccaacaagcccaataaattcaccgtggagactcggggtgctggcactggtggcctgggcctggccgtggaaggcccttctgaagccaaaatgtcatgcatggataataaggacggttcatgtagcgtggagtatattccttatgaggcaggcacatattcccttaacgtcacttatggaggacaccaggtccctgggtcaccttttaaggtcccagtgcacgatgtcaccgacgccagcaaggtgaaatgttcagggcctggactgtctcccggaatggtccgggcaaacttaccacagtcctttcaggtggacacatcaaaggcaggcgtggcccctcttcaagtgaaggtgcaaggccctaaaggactggtcgagcctgtggacgttgtggataacgcagacggaacccagaccgtcaattacgtgccaagccgagaaggaccttactctatatctgtgttatacggggacgaggaggtcccaaggagccctttcaaagtgaaagtcctcccgacccatgacgcatccaaggtcaaggcttctgggcctgggctgaatactaccggagtcccggctagcctacctgtggagtttaccatcgatgcgaaagatgcgggtgagggccttttggcagttcagattaccgacccggagggcaaacccaaaaaaacacacatccaggacaaccatgacggcacctatacagtcgcctatgtccctgatgtcacaggcagatatacaatcctcatcaaatacggcggagacgaaattccattttcgccatacagagtgcgggctgtgccaaccggggatgccagcaagtgtaccgtaacaggggctgggatcggccctactatccagatcggagaagagactgtaatcacagttgacaccaaagcagccggaaaggggaaggtgacatgtacagtgtgcacacccgacgggagcgaagtggatgtcgacgtggtggagaacgaggacggaactttcgacatattttacaccgcccctcagcccggaaaatatgtcatatgcgtgagattcggcggagagcacgtgccaaattctcccttccaggtcacggccctcgctggggaccaaccctctgttcagccccctctgcgctcccagcagctcgcaccacagtatacttacgcccagggcggacagcagacatgggctcccgaaagacctctggttggagtgaacgggctggatgtgacctccctgagaccttttgacctggtcattccctttaccatcaaaaaaggcgagatcacaggcgaggtccgcatgccatctggcaaggtcgcccagccaactatcaccgacaataaagacggcacggttacagtcaggtatgcacctagcgaagcaggtctgcacgagatggatatccgctacgataacatgcatattcccggtagccccttgcagttctacgtagactatgtaaattgtggccacgtgaccgcgtacggtcccggtcttacacatggtgtggtcaataaacctgccaccttcaccgtcaataccaaagacgcgggtgagggaggactttcactggccattgagggcccatctaaagccgagatatcctgcaccgataatcaggatggaacgtgttcagtctcctacctgccagtcctccccggagactatagtatcttggttaagtacaacgaacagcatgtgcccggaagtccatttactgccagagtgactggcgacgacagcatgcgaatgagccacctcaaggtaggctcagcggcagatatcccaataaacatcagcgagacagacctcagcctcctgacagcaacagtcgtgcctccctccggaagagaggaaccctgcctgctcaagagacttagaaatggccacgtcggaatctctttcgttccaaaggagacaggcgagcatttagtccacgtcaagaagaatggtcagcacgttgctagcagccccattcctgtggtaattagtcaaagtgagattggggatgcatcccgcgttcgagtgtccggacagggtctgcacgaaggccatacctttgagcccgcagagttcatcattgatactcgggatgctggatacgggggactttcactgtccattgaaggcccttcaaaggtggacattaacactgaagacctggaagacggcacttgtagggttacatactgtcccacagaaccgggaaattatataattaatatcaaattcgccgaccagcacgtgccaggcagtcccttttccgtgaaggtgaccggtgaggggagggtcaaagaatccattactcggagaagacgagccccatctgtcgccaacgtggggagccattgtgatcttagtctgaaaattcccgaaatctctatccaagacatgactgcccaggttacttccccctcgggaaagacgcacgaagccgaaattgtggagggggagaatcacacatattgtatccggtttgtcccagctgaaatgggtacgcatacagtctcggtgaagtataagggtcagcatgtgccaggttcacctttccagttcacagtgggccctttaggggaaggcggagctcacaaagtgagggctggaggacccggactggaacgggcagaggctggagtacctgcggagttctcaatctggacaagggaagcaggtgcgggagggctcgcaatcgcagtcgagggcccttccaaggctgaaatcagctttgaggacagaaaggacggaagttgtggggtggcatacgtggtgcaggaacctggggactatgaggtgtctgtcaaatttaatgaggaacacatccccgattcccccttcgttgtccccgtggcctctccaagcggtgacgccagaagactgactgtatcatcccttcaggagagcgggctcaaagtgaaccagcccgcatcgtttgccgtgagcctaaacggtgccaagggggctatcgatgctaaagtgcactccccctcgggggctctcgaggagtgctacgtgaccgagatagaccaggacaagtatgctgttcggtttattcctagggaaaacggggtatacctgatcgacgtgaagttcaacgggactcacatcccgggaagcccatttaaaatcagagtgggcgagcccggtcacggcggtgacccaggtttagtcagtgcttatggggcagggctggagggcggtgtgaccggcaacccagccgagttcgtcgtaaatacgagcaatgcgggagccggtgccctgagcgtcaccattgatgggccttccaaggtaaagatggattgccaggaatgcccagagggataccgcgtaacctatacccctatggcgcctggaagctacttgatttccattaagtacggagggccatatcacattggcggaagtccctttaaggcaaaggtgacaggccctaggttagtgagcaaccatagcctccatgaaacctcatctgtgttcgtcgactccctgaccaaggccacttgcgccccacagcacggagctccgggacctggcccagctgacgcctccaaggtggtagcgaagggcttgggccttagtaaagcttacgtgggacagaagtcttccttcactgttgactgctccaaggccggaaacaacatgctgttggtcggagtgcatggaccacgcaccccttgtgaggaaatcctggtcaagcatgtaggcagccgcctctattcagtcagctatctgctcaaagataaaggagaatacactctcgttgtgaaatggggagacgagcacattcccggatccccctacagggtcgttgtgccata

SEQ ID NO: 223343 - DNA, 7808 bp, Artificial Sequence
  Description of Artificial Sequence: Synthetic coding sequence
atgccggtgacagaaaaagacctcgccgaggacgccccatggaagaagatacagcagaacacctttacccgatggtgtaacgaacacttaaaatgcgtcaacaagagaatcggcaacctacagacggatctgagcgacggccttaggctgatagccctgctggaggtgctgtcccagaagagaatgtataggaagtaccaccagcgccctacctttcgccagatgcagctggagaatgtgagtgtagccctggaattcttggatcgcgagtcaattaagttagtctctatcgacagcaaggcgatcgtggacggcaatctcaagctgattcttggattggtgtggaccctgattctgcattactccatcagtatgcccgtttgggaagacgagggtgacgacgacgccaaaaaacagacacccaagcagaggctgctaggttggatccaaaataagattccgtacttaccaatcacaaacttcaatcagaattggcaggatggtaaagccctcggcgcacttgtggactcctgcgctcctggactttgccccgattgggaaagttgggacccccagaaaccggtcgacaacgccagagaggccatgcagcaggccgacgattggctgggggtaccccaagtcattacacccgaagagataatccatcccgatgttgatgagcacagtgtgatgacgtacctttcccagtttccgaaagcaaaactgaagccaggggctccgctgaagcccaaactgaatcctaaaaaggctagggcctatgggagggggatagagccaacgggcaatatggtgaaacagcccgctaaattcactgtggataccatcagcgctggacaaggagatgtcatggtattcgtggaggacccagaaggcaataaggaagaagcgcaagtaacgcccgattcggacaaaaacaagacttattcggtagagtatctgcctaaggtcacaggattacacaaagtaacagttctgtttgccggtcagcacatctccaagtctcctttcgaagtgtcagtggacaaagcacaaggggatgccagcaaagtgactgctaagggaccagggcttgaggcagtgggcaacattgcgaataagccaacttatttcgacatttacacagccggagccggtgtgggggacattggagtggaggtggaagatccccagggaaagaatacagtggaactcttggtggaagataagggcaatcaagtctatcgttgcgtatataaacctatgcagcctggtccgcatgttgttaagattttttttgcaggcgacacaataccaaagtctccatttgttgtgcaggtgggagaagcctgcaacccaaacgcttgccgtgcatcaggcaggggtctccaaccgaagggcgtcaggattcgagaaaccactgacttcaaggtagatactaaagctgcgggatccggcgagctgggtgtgaccatgaaagggcctaagggactcgaggagctggtcaaacagaaggacttcctagatggcgtgtatgcctttgagtactacccatcaactcccggtcgatactctattgctatcacctgggggggtcaccacatacccaaaagtcctttcgaggttcaggtcggtccagaggccggaatgcagaaggtgcgcgcttggggccctgggcttcacggcggaatcgtggggaggtccgcggatttcgtggtggagtccataggcagtgaggtgggatctcttggttttgcaattgagggtcccagtcaggccaaaatagaatataacgaccaaaacgacggtagctgtgatgtgaaatattggcccaaggagcccggagagtacgctgtacacattatgtgtgatgacgaagacataaaggactccccatacatggccttcatacaccctgcaacagggggatataacccagatctggtccgggcttacggacccggactggagaaaagcgggtgcatcgtcaataacttggcggaattcactgtagaccccaaagacgccggaaaagcaccgctcaagatcttcgcacaggacggtgagggccaaaggatcgacattcagatgaaaaacagaatggacggaacatacgcctgcagctacaccccagtgaaagccatcaaacacacgatagccgtcgtgtgggggggtgtcaacattccacattccccttaccgagtgaatatcgggcagggaagtcatccccagaaagtcaaagtttttggaccaggagtggaaaggtccggattgaaggcaaatgaacccacccacttcacagtggactgtactgaagccggagaaggcgatgtgtctgtcggcatcaaatgtgatgcaagagttctgagcgaggatgaggaagacgttgatttcgacataatccacaatgccaatgatactttcaccgttaagtacgtccctccggctgctggacgatacacaatcaaagtcctgtttgcttcacaggagattcccgctagtccattccgtgttaaggtagatccaagccacgatgcgtccaaggtcaaggcagagggacctggactctccaaggccggagtcgaaaatgggaagccaacccatttcacagtgtatactaaaggagccggaaaggctcccctcaacgtgcaatttaactctcccctgcctggcgacgctgtcaaggatctggatattattgacaactacgattatagccataccgtgaagtatacccccacgcagcaaggcaatatgcaagtgctggtgacttacggcggagatcctatccctaagtctccgttcactgtaggagtggcagccccactagatttgtctaaaattaagctgaatggactagaaaacagagtggaagtaggtaaggatcaggagtttactgtggacactagaggtgccggtgggcaaggcaagctagacgtcacaatattgagcccatcacgaaaggtggtgccatgccttgtgactcccgtcacgggacgcgaaaattcgacagcaaagtttattccgagagaggaagggctgtacgccgtggatgtcacatatgacggccaccccgtccccggatcgccctatactgtggaggctagcttgccccctgatccgtcaaaagtcaaggctcatgggcctgggctggagggaggactggtgggaaaaccggctgagttcacgattgatactaagggggctggaacgggcggactcggtctcactgtggaaggtccttgcgaggctaaaatagagtgtagtgacaatggcgacggcacgtgttctgtttcataccttcctaccaaaccaggggagtactttgtgaatatcctgtttgaggaagtgcacattcctggctcaccattcaaggccgatattgagatgccatttgacccctctaaagtagtcgccagcggaccagggttagagcatggtaaggtcggtgaggccggtttactgagcgtcgactgctcagaagcaggcccaggggctctgggcttggaggcggtctctgattctggtaccaaggcggaggtgtcgatacaaaataacaaagacgggacgtacgcagtaacttatgtgccactgacagccggtatgtataccctgaccatgaaatacgggggtgagctggttccccacttccccgctcgggtaaaagtggaacccgcagttgatactagtcggatcaaagtgtttggcccaggaattgaaggcaaagatgtgtttcgagaagcaacaacagactttacagtggatagccgccctctcacacaggtcggcggtgaccatattaaggcccacattgccaacccttctggtgcgagtacagagtgtttcgtgaccgacaatgctgatgggacctatcaggtcgaatacactccattcgagaaggggcttcatgtagtggaagttacctatgacgacgtgcctattcctaattccccatttaaagtggccgtgacagagggctgccagccttcccgggtccaggctcagggacctgggctaaaggaagcctttacgaataagcccaatgtgttcacggtggtaacccgaggtgcagggatcggcggtcttggcataacagttgaaggcccatctgaaagtaagatcaattgtagggataataaagacggctcttgttcagcagagtatattccatttgcacccggtgattacgacgtgaacatcacatacggtggagcgcacataccagggagccctttcagggtgcccgttaaggacgtggtcgatcccagcaaggtcaagatcgctggcccaggacttgggagtggggtgcgagcaagagtgctgcagtcctttaccgtagacagtagcaaagcaggccttgcaccgctcgaggtacgtgttttgggcccacgcggtttagtagagcccgtaaacgtagtcgacaacggcgatgggacgcataccgttacttacaccccatcacaagagggcccttacatggtgtcggttaaatacgccgacgaggagattcctcgcagtcccttcaaggtgaaggtgctgccgacttatgacgccagtaaagtcaccgcttcagggcctggtttatcaagctatggagtaccagcctcccttcccgtggatttcgccatcgatgcaagggatgctggcgaggggctgctggctgtccagattaccgatcaagaggggaagcccaaacgcgcaattgtccacgacaacaaggacggaacctatgcagttacatacatcccagataagacaggccgatacatgataggtgtcacttacgggggagatgatatcccactctccccttacagaatcagagctacccagactggcgacgcctctaagtgtctggctacaggcccagggatcgcgagcacagtgaagaccggggaggaggtaggctttgtcgtcgacgcgaaaaccgccggaaaagggaaggtgacatgcaccgtgctcacaccagatggcactgaagctgaggcagatgtaattgagaatgaggatgggacctatgacatattctacaccgccgctaaacccggaacctatgtgatctacgtgcggtttgggggagttgatattccgaacagcccgttcacggtaatggccaccgacggtgaggtgacggcagtggaggaagctccagttaatgcctgcccacctgggtttcggccttgggtaaccgaggaggcctacgtgcctgtgtctgacatgaacggtctgggtttcaagccctttgacctcgttattccatttgccgtcaggaagggcgagattaccggggaggttcatatgcccagtggtaagaccgccacccctgagattgtcgataacaaggacgggaccgtaaccgtcaggtacgcccctactgaggtaggccttcatgagatgcatataaagtatatgggctcacacatccctgaaagcccccttcagttctacgtgaactacccaaactccggtagcgtctctgcatatggacccggattggtctatggtgtcgccaataaaaccgccacattcaccatcgtgactgaggacgcaggggagggcggactggacctggcgattgaagggccttccaaggccgaaatcagttgtatcgacaataaggacgggacctgcaccgtgacatatctccctacattgcctggagactattccatcttggtgaagtacaacgacaagcacatcccagggtcaccgtttaccgctaagatcaccgacgattctagaaggtgtagtcaggttaaactcggaagcgcagcggatttcctcctggacattagcgaaaccgatctgagcagtttgaccgccagcataaaagcgccttcgggaagggacgaaccttgtctgctcaaacgcctccccaataaccacataggaatcagctttataccacgggaggtgggggaacacctggtctcgattaaaaaaaatggtaatcacgtggcgaacagcccagtgtctattatggtggtgcagagcgaaattggtgatgcgaggcgagctaaagtctacgggagaggcctgagcgaaggcagaacattcgaaatgagcgactttatcgtagatactcgcgacgcaggctacgggggtatcagtttagcagtcgagggtcctagtaaagtcgatatacagactgaagatttagaagatggaacttgtaaggtgtcctatttccccaccgtgcctggagtatacatagtgagcacaaagtttgccgacgagcacgtacccggaagcccgttcaccgtgaagatatctggagagggtagggttaaagagagcattacacgaactagtcgagccccatcagtcgcgacggtgggttccatttgtgatcttaatctgaaaatccctgaaattaacagttccgacatgagcgcacacgtgacaagcccttctggaagagtgaccgaggccgaaattgtccccatgggcaagaattcacattgcgtgcggtttgtcccccaggagatgggtgttcatacagtgtccgtgaagtaccggggacagcatgtgaccggatcccctttccaattcactgtcgggcctctaggagagggcggagctcataaggttcgcgctggcggacctggcctggaacggggagaggccggagttcctgccgagttttcaatctggacacgtgaagccggagcaggcggtctgagtatcgccgtggagggaccatcaaaagccgagataacgttcgacgatcacaagaacgggtcttgtggggtatcatatatcgctcaggagccaggtaactatgaagtttctatcaagtttaatgatgaacatattcctgaaagcccctacctggtccccgtcattgccccatctgatgacgctaggcgacttactgtaatgagtttgcaggagtcgggcctgaaagtaaaccagccagcatctttcgcaattcggctgaatggcgctaaggggaaaatagatgctaaagtgcactcaccctctggcgctgtggaggaatgccacgtgtccgagttggaacccgataaatatgccgtccgcttcataccccacgaaaatggcgttcacaccatagacgtgaaatttaatgggtcccatgtagtcggctccccttttaaggtgcgcgtaggggagcccggacaggcgggaaaccctgcgctcgtctccgcctatgggactgggcttgaggggggtacaaccggtattcagagcgaatttttcattaacactaccagagctggacctggcaccctgagcgtgaccattgagggcccttctaaagttaaaatggattgccaggagacacctgaaggatacaaggtgatgtacactccaatggcccctggcaattatcttattagcgtcaagtatggaggccctaaccacatcgtgggcagccccttcaaggccaaggtcactggacaaaggctggtgtctccaggatccgcgaacgagacttccagcattttggtggagagcgtgactcggtcatccactgagacttgctactctgccatccctaaggcctcttccgatgcctccaaagtaacctccaagggtgctggcctctcaaaagcgtttgttgggcagaagtcatcttttcttgtggattgttccaaggcaggaagtaacatgctgttgattggggtgcacggacccactactccctgtgaggaagtaagtatgaagcatgtggggaatcagcagtacaacgtgacatatgtcgtaaaggagcgtggagactatgtcttggctgtcaagtggggggaggaacacattccgggatcccctttccacgttaccgtgccgta

SEQ ID NO: 223344 - DNA, 7685 bp, Artificial Sequence
  Description of Artificial Sequence: Synthetic coding sequence
atgcccgttacagaaaaggatctggcggaagacgcaccgtggaaaaaaatccagcaaaacaccttcacccgatggtgcaacgaacacctgaaatgcgttaacaaacgaattggaaacctgcaaacagacctgtctgatggcctcaggctgatcgccctcctcgaagttctctctcaaaaaagaatgtacaggaagtatcaccaacggccaacgttcaggcagatgcagctcgaaaatgtctctgtcgcccttgagttcctggatcgggagagtattaagctcgttagtattgactccaaagcaattgtcgatgggaatttaaagttaatccttggcctggtgtggaccctgatcctgcactactcaatctcgatgccggtttgggaggacgaaggcgacgacgatgccaagaaacagacaccaaagcagcgcctgctgggatggatacagaacaagatcccgtacctcccaatcacaaatttcaatcagaactggcaggatgggaaggcacttggtgccctggtggattcctgtgcccctggcctgtgccctgattgggaaagctgggacccacaaaagcctgtcgataacgccagggaggcgatgcagcaggcggacgactggctaggggtgccgcaggttatcacacccgaagaaatcatccatccggacgtggatgagcactcggtcatgacatacttaagccagtttccgaaagccaagctaaaacctggagccccattaaaacccaaactcaaccccaagaaagcaagggcatatgggcgagggatcgagcctacaggtaacatggtcaaacagccagctaaattcactgtcgatacaatcagcgccggacaaggagacgtgatggtcttcgttgaagatccagaaggcaacaaggaggaagcacaggttacccctgactcagacaaaaataagacctattctgtggagtacctccccaaagtgaccggactccacaaggtcaccgtgttgtttgctggccaacatatcagcaaaagcccatttgaggtttcagtcgacaaggctcagggcgatgcttcaaaagtgaccgcaaaaggtcctggattagaggcagtcggaaacatcgcaaataagcccacttactttgacatctacaccgctggcgctggcgtcggagatattggagtggaggtggaagatccccaaggcaagaataccgtcgagttgctggtggaagataaagggaatcaggtgtacagatgcgtgtacaaaccaatgcagcccggaccccacgtggtgaaaatcttttttgctggcgacactatccccaagtccccattcgtcgtccaggtgggagaggcttgtaatcccaatgcctgcagagcttccggtcgaggactgcagccaaagggcgttcgcattcgggagaccactgatttcaaagtcgacactaaggccgcaggatcaggcgagctgggcgtgaccatgaaagggccaaagggcctcgaagagcttgtcaagcaaaaagactttctggacggggtgtacgcttttgaatactatccctcaacaccaggacgctacagcatcgccatcacttggggaggacatcatatcccaaagtcgcctttcgaagttcaggtgggtcctgaggccggtatgcagaaagtacgagcctggggaccaggcctccacggcggaatcgtaggaagatcagctgacttcgtagtggaatcaatcggttcagaggtgggcagcctgggcttcgccatagagggcccttcccaggctaagattgaatataatgaccagaatgacggctcctgcgatgtgaagtattggccaaaggagcccggagagtacgcagtccacataatgtgcgatgacgaagatataaaggattccccatacatggctttcattcaccctgcaaccggcggttataatccagatctcgtgagagcctatggaccaggcttagagaagagcggctgcatcgtgaataacctcgcagaatttaccgtcgaccctaaagacgccggtaaagcccctctgaagattttcgcccaggatggcgaaggtcagcggatcgatatacaaatgaagaatagaatggacggcacatacgcttgttcatatacaccagtgaaggccatcaagcacaccattgcagtcgtgtgggggggtgttaatatcccccactctccctacagggtgaatattggacaggggtcacaccctcagaaggtcaaggtattcggcccaggggttgaacgttctggactcaaagccaacgaacccacccactttacagtggattgcacagaagctggggagggggatgtgtccgtcggcatcaagtgcgacgccagagtattgtctgaggacgaggaagatgtggactttgacatcattcacaatgccaacgacaccttcacagtgaagtatgttcccccagcagcaggacggtacacgattaaagtcctcttcgcgtctcaggagatcccggcatcacctttccgcgttaaggtcgacccatcacatgatgcctccaaagtcaaggccgaaggacctggactgagtaaggcaggcgttgagaacggaaaaccgacacattttacagtgtacacaaagggagcagggaaggcacctcttaacgtgcaatttaactcccctttaccgggagacgcagttaaggacctcgatattatcgataattacgactactcccacacagtgaagtacacccctactcaacaaggaaatatgcaggtgctggttacatatggcggtgaccccattccgaaaagtccttttacagtgggagtggccgctcctttggatctgtctaaaatcaagttaaacggcctggagaaccgggtggaagtaggaaaggatcaggagttcacggtggacacccgtggagccggaggtcagggcaagctggatgtaaccatattgtccccaagccggaaagtcgtaccctgtctagtcactcccgtaactggaagggaaaattctactgccaaattcattccccgtgaagaaggactctacgcagttgacgtaacgtacgacggacacccagtacccggttccccctacaccgtggaagctagtctgcccccagatccctcaaaggtcaaggcgcatggacccggtctggaggggggactggtcggtaaaccggctgagttcaccatcgacaccaagggcgctggaacaggcggtctaggcttaaccgtggagggcccatgtgaggcgaagatcgaatgcagcgacaatggcgacggtacctgttctgtctcataccttcccacaaagcctggggaatactttgttaatatcctcttcgaagaagtgcacattcctggaagtccctttaaagcggacatcgaaatgccttttgacccaagtaaggtcgtcgcatctggcccagggttggagcacggaaaagtcggagaggctggcctgttatccgtcgactgtagtgaagctggacctggtgctttaggcctggaggccgtgtcagacagtggcacgaaggctgaagtgtcaattcagaataacaaggatggcacctacgcagtgacttatgtgcctcttactgctggaatgtacactttgacaatgaagtatgggggtgagcttgttccgcactttccggcaagggtgaaggtggaacccgctgtggacacatcccggattaaggtgttcggacctggtatcgagggcaaagacgttttcagggaggcgacaacggatttcaccgtcgatagccgccctctgacccaggtgggtggcgaccacataaaggcacacattgctaacccttccggagcatcaaccgagtgctttgtgaccgacaatgccgacggcacataccaggtagaatacactccattcgagaaagggctccacgtcgtggaggttacctacgatgacgtgcctattcccaattccccatttaaagtagccgtcactgagggatgtcagcctagcagggtgcaggcacaaggacccggtttaaaagaggcctttaccaataaaccgaatgtgtttacggtcgtgacacgaggcgctggaattgggggactgggaataacagtcgaaggacccagcgagtcaaaaatcaattgccgggacaataaggacggttcttgctccgccgagtacatcccctttgcccctggagattacgatgttaatattacctatggcggtgctcatatccccggatctccttttcgggtacccgttaaggacgtggtggacccaagcaaggtgaaaatcgccggaccgggactgggatccggagtgcgtgcgagagttctacagtcctttacagtggatagcagtaaagccggtctagcgcctctcgaggtacgcgtgctgggtcccagggggctggttgagccagtgaatgtggtcgacaatggggacgggacacacacggtgacctatactcccagtcaggaaggcccttatatggtgtctgtgaagtacgccgatgaggagattccaagaagtccattcaaagtgaaagtgctacccacgtatgatgctagcaaggtcaccgcttcgggacccggtctaagttcatacggtgttcccgcttccctgcccgtcgactttgctatagatgcacgcgatgccggagaggggttgctggctgtccaaatcacagatcaggaagggaagcctaagagagccatcgtgcacgacaacaaggacggaacatacgcagttacatatattccagataaaacaggacggtacatgataggagtgacgtacggtggcgacgatattccactaagcccttaccgaattagagctactcagaccggcgatgcatccaagtgcctggccaccggacctggaatagcatctactgtgaagactggggaagaggtcgggtttgtggttgatgccaagacagctggtaagggaaaggtgacgtgcaccgtcctgacgccagacggaacagaagctgaagctgacgtgatcgaaaacgaggacgggacatatgatatcttctataccgccgctaaacccggaacttacgtgatctacgttaggtttggcggagtggatatccccaacagtccttttacagttatggccacagacggcgaggtgacagcagtggaggaagcaccagtcaacgcctgtcctccaggctttagaccctgggtaacagaagaggcatatgttccagtgtcagatatgaacggcctgggcttcaagccgtttgatcttgtgattccatttgctgtgaggaaaggcgagatcaccggtgaagtgcatatgccgagcgggaagactgctacaccagaaattgtagacaataaagacggtactgtgaccgtaagatatgcccctacggaggtgggattgcacgagatgcacatcaagtacatgggtagtcacatcccagagtctccgttgcagttctacgttaattaccccaacagcggctcggtctcagcctatggtcctggcctggtatatggcgtagccaataaaacggccacttttacgatagtcactgaagacgctggcgaaggtggactggacctggctatagagggtccttcaaaggcagagatctcatgtatcgataacaaagacggcacttgcacagtgacttatctccccactttgcccggtgactacagcatccttgtgaagtacaacgataaacatatacccggttcaccctttaccgcgaagataactgatgacagcagaagatgttcacaagtgaagcttggaagtgccgctgacttcctgcttgacatttcagagacagatctatcgagtctgacagcgagtattaaggcccctagcgggcgagacgagccttgcctgcttaagcgactcccaaacaaccatattggtatttcttttatcccgagagaggtcggggaacatctggtgagtatcaagaagaacggcaaccacgtagcaaatagcccggtgtcgatcatggtcgtgcaaagcgagattggagacgcaaggagagccaaggtctacggcaggggcttgagcgaaggcagaacattcgagatgtcagactttattgtggacacacgggacgcgggatacggcggaatctctctggccgttgagggcccatcaaaagtggatatccagacagaagatctcgaagacggtacttgtaaagtctcttattttcctacagtgcccggagtgtatattgtgtctaccaagtttgctgacgagcacgtacccgaaattaatagttcggacatgagtgcccacgttacctctccttcaggacgggtaaccgaggcagaaatcgtgcccatgggcaaaaattcccattgtgtgcggttcgtaccacaggaaatgggggtgcacacagttagcgtcaaataccggggtcaacatgtaaccggtagtcctttccagtttacagtcgggccactgggcgagggcggagcacacaaagttcgcgcaggaggcccaggactggaacggggagaagctggtgtgcctgcagagttttccatctggacgcgggaggctggggctgggggactctctattgcagtggaaggccctagtaaggctgagatcacctttgatgatcataagaatgggagctgtggtgtcagctatatagcacaggagcctgggaattacgaggtttcaattaagtttaatgatgaacacatacccgaaagtccgtatctagtcccggtgatcgccccttctgatgacgcccgacgcctcactgtgatgagtctccaggagtcagggctcaaggtgaatcaacctgccagcttcgctataaggcttaacggtgcaaagggcaagatcgacgctaaggtgcatagccccagcggagccgttgaagagtgccacgtttctgaactagagcccgacaagtatgctgtacgtttcatcccccatgagaatggcgtccacacgattgacgtgaagttcaatggctcacatgtagtggggtcacctttcaaggtgcgagtgggcgagcctggacaggccggaaatccagccctggtgagcgcatatggtactgggctggaaggcggaaccacaggcatccagtccgaatttttcatcaataccaccagggctggaccgggtaccctatctgttactattgaaggtccttcgaaagttaaaatggactgccaagagacccctgaagggtataaggtcatgtacaccccaatggcccctggtaactatctgatttctgtgaaatacggcggacccaatcacatcgtgggttccccgtttaaagccaaagtaactggtcagaggcttgttagtcccggttccgccaacgaaactagttccatcctggtggagagtgttacccgctcttcaaccgagacttgttacagcgctattcccaaggcttcttccgatgcgtccaaggtgacatccaagggagctggactcagcaaagcctttgtgggccagaaatcctcattcctggttgactgttctaaggccggtagtaacatgttgcttattggagtccacggccctactaccccctgtgaggaggtgtcgatgaaacacgtgggcaaccaacagtataatgtcacttacgttgtaaaggagcgtggggactatgtgcttgcagttaagtggggagaggaacacattccagggtcaccatttcatgtgaccgtgccata

SEQ ID NO: 223345 - DNA, 6452 bp, Artificial Sequence
  Description of Artificial Sequence: Synthetic coding sequence
atgcccgttacggagaaggacctggccgaggatgccccatggaagaagattcagcagaacacatttaccaggtggtgcaatgaacacttaaagtgtgtgaataagcgaattggcaatctacagactgacctgtccgatgggctgcgcttaatagccctgttagaggttctgtcccagaagcggatgtatcgcaagtaccaccagcggcctactttcagacaaatgcagctcgagaacgtgtctgtcgccctagaatttctggatcgtgagtccataaaactggtgtccatcgacagcaaagcgatagtagacggaaatttgaaactgattttgggcttggtatggacgttgatcttacactactccatcagcatgcctgtgtgggaagacgaaggcgacgatgatgcgaagaaacagactccgaagcaacgtctcctggggtggattcagaacaagatcccgtacctccctatcacaaattttaatcaaaactggcaagatgggaaagcgctcggggcactagtcgattcctgcgctcccggtttatgtcctgactgggaaagctgggatccccaaaagcctgttgacaacgccagggaagctatgcaacaggctgatgattggctcggcgtgccacaagtcataacaccggaggagattatccaccctgatgtggacgagcattcagtgatgacctacctttctcagttccccaaggccaagctcaagcccggagctcccctgaagccaaagctaaatccgaaaaaggcaagggcttacgggcgaggtattgagcccaccggcaatatggtcaagcagccggcaaaattcacagttgacactatcagtgcagggcagggagacgtcatggtgtttgtcgaagaccctgagggtaacaaagaggaggcccaggtgacacctgacagcgacaaaaacaaaacctactccgtagagtacctgccgaaggtgacgggattgcataaagtgactgtgctattcgcgggacagcatatcagcaagtctcccttcgaagtgtccgtggacaaagcccaaggcgacgccagtaaggttacagcgaaggggcctgggctcgaggccgtgggtaatattgcaaataagcccacatactttgatatctacactgccggagctggcgtgggggacatcggcgtggaagttgaagatccccagggtaagaacaccgtcgaactgctcgtcgaggacaagggaaaccaggtgtaccgctgtgtctataaaccgatgcagcccggacctcacgtagtgaaaatatttttcgccggagacacgattcccaaaagcccattcgtggtgcaggtgggcgaagcatgcaaccctaatgcctgtcgagccagcgggcgaggtctgcagccaaaaggtgttcggatacgtgaaaccaccgactttaaagtggataccaaggccgctgggagcggagagctaggagttaccatgaagggaccaaagggattggaagaactggtcaagcagaaagatttcttggacggggtctacgccttcgagtattacccttccacacccggacgatattccatcgccataacatggggtggacatcatatccccaaaagtccgttcgaagtgcaggtgggacccgaagcaggcatgcagaaggtgagagcttggggtccagggcttcatggaggtatcgtgggacgatcagccgacttcgttgtggagtccatcgggtccgaagtagggtctctgggattcgctattgagggaccctcacaggcgaaaatcgagtacaacgatcagaacgatgggtcctgcgacgtgaagtattggcccaaggaaccaggagagtacgccgtccacattatgtgtgatgacgaagacatcaaggacagcccttatatggcgtttatccaccccgctacagggggttataaccctgacctggtccgagcatatggtcctggcctcgagaaatcagggtgcatcgtgaataatttggccgaattcactgtagatcccaaagatgccggaaaggccccacttaaaatatttgcgcaggatggtgaagggcagaggatcgatatacagatgaagaacaggatggatggcacctacgcttgcagctatacccccgtgaaggctatcaaacatactatcgccgtggtttggggtggcgtgaacattccccactctccttaccgcgtcaatattggtcagggctcacatcctcagaaggtgaaagtttttggcccaggcgtggagcgtagtggcctgaaggccaatgaacccacgcacttcacggtggactgcacggaggccggagagggggatgtgagtgttggcattaagtgcgatgcacgggtgttgagcgaagacgaggaggacgtggattttgatattatccacaatgcaaatgacacttttacagtgaagtatgtgccccctgctgcaggccgatatactataaaagtcctgttcgccagccaggaaatccccgcaagcccgtttagagtgaaagtggacccctcgcatgacgcctccaaagtgaaggctgaaggcccagggctcagcaaagccggagtggaaaatgggaaaccaactcatttcaccgtgtatacaaagggagcgggaaaggcaccgctgaacgtgcagttcaatagcccccttccgggtgatgccgtgaaagatcttgacattatcgataattacgattattcccacacggtgaagtatacccctacacaacaggggaacatgcaggttttggtgacatatggcggagatcccatcccaaagtcccccttcacagtgggagtggccgctcctctagacctttccaaaataaaacttaacgggcttgagaatcgggtagaggtgggaaaagatcaggagttcactgtggatactcgtggcgcaggcggacagggaaagctcgacgtgacaattctctctccatcaagaaaagttgtgccatgtctcgtaacacctgtgaccgggcgtgaaaattccactgcaaagtttatccctcgagaggaggggctttacgccgtcgatgtgacttatgacggccatcccgttcccggttcaccgtatacagttgaagccagtctgccccctgaccctagcaaagttaaagcccacggcccaggtctggagggcggactggtcggtaaacctgctgaattcacaattgacacaaagggtgctggtacagggggactggggttaacagtcgaagggccttgtgaggctaaaatagaatgctccgataacggcgatggtacttgcagcgtgtcatacctgcccaccaaaccaggcgaatacttcgtcaacattctctttgaggaggtgcacatccccggaagtcctttcaaagcagacatagaaatgccattcgatccttctaaggtcgtcgcctcgggacctgggctggaacacggcaaggtgggcgaagccggattactgagcgtcgactgctctgaggctggccctggtgccctgggcctcgaggccgtatccgattcaggcacaaaggctgaagtatcaatccagaataacaaggatggaacatacgcagtgacttacgttccattaaccgctggtatgtatactctgaccatgaagtatggtggggagctggttcctcattttcctgctcgagtaaaagtggagccagctgttgatacctcacgcattaaggtgttcggacccggaattgagggcaaggacgtctttagggaagccaccacggatttcactgttgatagcagacctctgacccaggtgggaggagaccacatcaaagcgcacatcgcgaacccatccggcgcttccaccgagtgcttcgtcactgacaatgctgacggaacctaccaggttgagtacacgccctttgagaagggactacacgtcgtggaggtgacatacgacgacgtgcccatccctaactctcctttcaaagttgctgtgactgaaggctgtcagccctcaagggtgcaggctcagggaccgggtttgaaggaagctttcacaaacaagccgaatgtttttactgtggtcaccaggggtgctggcatcgggggtcttggtattaccgtagagggaccttcagagagcaagattaactgcagagataacaaggacgggagttgctccgccgagtacatcccttttgcccctggggattacgacgtgaacattacttacggaggagctcatataccgggttcccctttccgtgtgccagtaaaagatgttgtagatccgagtaaggttaaaatagctggaccaggcttagggtccggcgtccgagccagagtactgcagagcttcacggtggactcgtccaaggcaggcctggcccctctcgaagtgagggttcttgggcctcggggtctcgtcgagcctgttaacgtcgtggataatggggacggaacgcatacggtaacctacactccttctcaggaagggccatacatggtgtcagtgaagtacgcagatgaagaaatcccgaggtctcccttcaaagtcaaagtgttgcccacctatgatgcatcaaaggtgaccgcctcggggccaggcctgagctcttacggagtgcctgcctcactccccgtggacttcgcaatcgacgcaagagacgcgggtgaagggctccttgcggtgcagatcactgaccaagagggcaagcctaaacgcgcaatcgtgcacgataataaagacggaacatacgccgtaacctacattcctgacaaaaccggacgctatatgattggcgtgacctacggtggggatgacatcccactgagtccgtataggataagagcgacacagaccggggacgcctctaagtgcctggccactggtcctggcattgcatccacagtcaagacaggggaagaagtgggcttcgtcgtggatgcaaaaacagcgggaaaaggtaaggtaacatgcactgtgctgacaccggatgggacagaagcagaggctgatgtgatcgaaaatgaggacggtacctacgatatcttctacacagccgctaaacccggtacctacgtgatttacgtccgattcggaggcgttgatatcccaaacagtccctttactgtaatggctaccgatggcgaggtcacagctgttgaagaagcgccagtgaatgcgtgcccacccggttttagaccctgggttaccgaggaagcctacgtgcccgtgtccgatatgaatggcttaggctttaaaccattcgaccttgtgatcccgtttgccgtccgcaaaggtgaaattacaggcgaggtgcatatgccgtccgggaagacggctactccggagattgtagataacaaggatggaacggtcactgtgcggtacgcccctactgaggtcgggttacacgagatgcatattaagtatatgggctcccacatccccgaaagccctcttcagttttacgtgaactatccaaattcaggctctgtctctgcttacgggccaggcctggtatatggggtagccaataaaaccgccacctttacaattgttacagaggacgcgggtgaaggcggactggacctggcaatcgaaggcccatctaaagccgaaattagctgcattgacaataaagatggcacctgtactgtcacttatctccctactctgccaggagattacagcattctggtgaaatacaacgataaacatattcctgggtccccatttacagctaaaataacagatgacagccgaagatgctcgcaggtaaagttaggatccgccgcagattttctactggatatcagcgagaccgatctaagctctctaacagccagcatcaaagccccttccggcagggacgagccctgccttctcaaaaggctgccaaacaaccacatagggatatcttttattcctcgggaggtgggggaacatctcgtcagcattaaaaagaacgggaatcacgtggccaattcccctgtaagtataatggtggttcagtccgaaatcggcgatgcccgtagagctaaagtctacgggaggggactgtcagagggcagaaccttcgagatgagcgatttcattgtagatacccgcgatgcgggatacggaggcatcagtctagcggtagaggggccatcaaaagtggacatacagacggaggacttagaggacggtacatgcaaagtcagctacttccctaccgtacccggtgtctatatagtgtccaccaagtttgcagacgagcacgtccccggttccccttttaccgtgaagatcagtggcgagggcagagttaaggaaagtataacaaggacatcaagagcccctagcgtcgcaacagtagggtcgatttgcgacctgaatctgaagattcctggtgtgagagtgatgaactgtagcgcgcagatcctgtggggatggcgtgtgcagtttcatactggctctagaaaccaacagcaata

SEQ ID NO: 223346 - DNA, 7736 bp, Artificial Sequence
  Description of Artificial Sequence: Synthetic coding sequence
atgcctgtcacagaaaaggacttagccgaggatgcgccttggaagaaaatccaacagaataccttcacacgctggtgtaatgagcatctcaagtgtgtaaataagaggattggaaacctgcagactgacctctccgacgggctccggttaatcgccctgctggaagttctatcccagaagaggatgtatcgtaagtaccatcagcgcccaacctttcgccagatgcagctggaaaatgtgtcagtcgctcttgagttcctcgacagagaatctatcaaactggtcagtattgactccaaagcaattgtggacggtaatctgaagctcatcttgggtttggtgtggaccctgatcttacactatagtatcagcatgcctgtctgggaagatgagggtgatgatgatgccaaaaagcagacgccaaagcagcggctgctgggatggatccagaataaaattccttacctcccaatcaccaatttcaaccaaaactggcaggacggcaaggctctgggggctcttgtggatagctgcgcccctggcttgtgcccagattgggagagttgggacccgcagaagcctgtggacaacgcccgagaggctatgcaacaggcagacgattggttaggagtaccacaggttatcactcccgaggaaattatacaccctgatgtagatgaacactctgtgatgacctacctgtctcaatttcctaaagcgaagctcaaacccggtgcacctctgaaacctaagttaaaccccaaaaaggcgagggcttacgggagggggatagagccaactggcaacatggtcaaacaaccagcgaaattcactgtggacacaatttctgctggacagggtgatgtcatggtcttcgtggaggaccccgagggaaataaagaggaggcccaggtgacccccgactcagataaaaataagacttactcagtggagtatctgcccaaagtgacgggacttcacaaggtgactgtgctgtttgctgggcagcacataagtaaatctccctttgaggtatctgtggacaaggctcagggggacgcctccaaggtgacagctaagggaccagggctagaggccgtgggaaacattgccaacaaaccaacctacttcgacatttataccgccggtgctggcgtcggcgacatcggtgtcgaggtggaagatccccagggcaagaacacagtagagctgctggtggaggacaaaggcaatcaagtgtatagatgtgtctataagcctatgcagcccggtccacacgtggtgaaaattttttttgccggtgatacaattcctaagtctccttttgtcgttcaagtcggggaggcctgtaacccaaacgcctgccgggctagcgggagaggattgcagcctaaaggcgtccgaattagggagaccaccgactttaaggtcgatacaaaggctgccggaagcggagagctaggcgttaccatgaaaggccctaaaggcctggaagaactggtgaagcagaaggatttcctggatggcgtgtacgccttcgagtactacccctcaacacccggtcggtattcaatagcgattacatggggcggacaccacatcccgaaatctccgttcgaggtgcaggtagggccagaagcgggtatgcaaaaggtgagggcctgggggccagggctccatggtggaatcgttggaagatcagctgattttgtggtggagagtatcggaagtgaagttggctccctcggtttcgcaatcgaaggaccttcacaggcgaagatcgaatataacgatcagaacgacgggagttgtgacgtgaagtactggcctaaggaacccggagagtacgccgttcacataatgtgcgatgatgaggacatcaaggacagtccatacatggcatttatccatcccgctaccggaggatataatcctgacctcgtgagagcttatggtccgggtttggagaagagcggctgcattgttaacaatttggcggaattcacagttgaccctaaggatgcaggtaaggccccactgaagatttttgcccaggatggggaggggcaacgtatagacatccaaatgaaaaaccgaatggacggcacatacgcctgttcgtacacccctgtgaaggccatcaaacacacgattgcagtggtgtggggcggagtgaacatcccacattccccctaccgggtaaacatcggacagggaagccatcctcagaaggttaaggtgttcgggccaggggtcgagaggagtgggttgaaagcaaatgaacccacacactttacggtggactgcactgaggctggggagggcgacgtttccgtcgggattaagtgcgacgccagggtcctgtccgaagatgaggaggatgttgatttcgacataattcataatgcaaacgacacattcaccgttaagtacgtgccccctgccgctggcaggtatacaataaaagttctctttgcgtcccaagaaatcccagcaagccccttccgcgtaaaggtagaccctagccatgatgcgtctaaggtgaaggccgagggtcccggactgtctaaggcgggtgtggagaacgggaagcccactcactttacagtctatacaaaaggggctggaaaagcgccactcaacgtacagttcaattcacccttgcctggtgacgccgtgaaagaccttgacataatcgacaattacgattactctcacaccgtgaagtatacgcccacacagcaggggaatatgcaggtgctggtaacatatggaggcgaccctattcctaaatcaccctttactgtcggtgtggctgccccactggacctctccaaaatcaaactgaacgggctcgaaaatagagtggaagtcggaaaggatcaggaattcacagttgacaccaggggggctggagggcagggcaagctggacgttacaattttatcacccagccggaaggtggtaccatgcctggtgactcctgtgaccggcagggaaaactcaacagccaaatttatcccaagagaagaaggcttatacgccgtggacgtcacttacgacggccaccctgtgcctggatctccatatactgtggaggcgagcctgcctccagatccctcaaaagtgaaagcccacgggcctggccttgaagggggattagtcggcaagcccgctgagttcactattgacaccaaaggagcaggtacaggtggattagggctcaccgtggaagggccttgcgaagccaagattgagtgctctgataacggcgatggaacatgtagcgtctcctatctgcctaccaagcctggcgaatacttcgtgaatattttattcgaggaggtccacataccaggcagccccttcaaggcagatattgagatgccatttgatccttccaaagtggtcgccagcggtccagggctcgaacatggcaaagtcggggaggccggactcctctctgtcgactgtagcgaggccggacccggagccctggggttagaggccgtcagcgacagcggaaccaaagcggaggtcagcatccagaacaacaaagacggtacttatgctgttacctatgtcccgctcaccgctggaatgtacacacttacaatgaagtacggtggtgagctggtgccccatttccctgcccgtgttaaagtagaacctgctgttgacacctcaagaataaaagtgttcgggcctgggatcgaaggcaaggatgtgtttagagaggccacgacggattttaccgtcgatagcaggcctttgacccaagtcggtggagatcatatcaaagctcacatcgccaatccgtccggcgcatctacagagtgtttcgtgaccgataacgctgatggcacttatcaggtggagtatacaccattcgaaaaaggcctacatgtggtagaagtcacttacgacgacgtgccaatccccaactcaccttttaaagtggcggtgacagagggttgccaaccttcccgcgttcaggcccagggccctggcctgaaggaggcctttaccaacaaaccaaacgtcttcaccgttgtgactagaggtgctggcattgggggtctggggatcacagtcgagggcccttccgagtccaaaattaactgtcgagataacaaagatggcagttgctctgcggaatacatcccgttcgcccctggcgactacgacgtgaacattacctacggtggagcacacatacctggctcccctttccgcgtgcctgttaaagatgtggttgatcccagcaaagtcaagatcgccggtccgggtctgggatctggtgttcgtgccagagtcttgcagtcgttcaccgtggatagttccaaagccggactcgcccctctggaagtgagggtgttgggaccccgaggcttagtcgagccagtgaatgtcgttgataatggggacggaacccacacagtaacttacacgcctagccaagaaggcccttacatggtaagcgtgaagtacgctgacgaggaaatccccagatcacctttcaaagtgaaagttttaccgacttatgatgcaagtaaggtgacagcgagcggtcctggtttatcttcctacggggtaccagcctccctgccggttgacttcgccatcgacgcacgggatgctggcgaaggcctactggccgtgcagattaccgaccaagaaggtaaacctaaacgagcaatagtacatgataataaagatgggacttacgccgtgacctacatacccgataagactggtcggtatatgatcggcgtgacttatggaggggacgatatcccactcagcccttatcgtatcagagcaacacagacaggcgatgcctcaaagtgcctggccacaggacccggtatcgccagcactgtcaaaacaggtgaagaggtgggtttcgtcgtggacgcaaaaacggctggtaaggggaaagtgacctgcaccgttcttacacccgacggaaccgaggccgaagccgatgtgattgagaatgaagatggaacatacgatattttctacactgctgcgaagccgggaacctatgtcatctatgttagatttggaggtgtcgatatccctaactctccttttactgtgatggtaacagaggaggcatacgttcccgtctccgatatgaacggccttggcttcaagccattcgatctggttatccctttcgccgtgagaaagggtgagattaccggcgaggttcatatgccatcagggaagacagctacccctgagatcgtcgacaacaaagacggtaccgtgacagtccggtatgcccctacggaagtgggcctccacgaaatgcacataaagtatatgggctcccacattcctgaatccccactccagttctatgtgaactaccctaactccggctcagtttcagcttacggacccggactggtgtatggcgttgcgaacaaaactgctacttttactatcgtcaccgaggatgctggggagggtggcctggatctggcaattgaaggaccaagtaaggctgaaattagttgtatcgacaacaaagatgggacctgtacggtcacctacctgccgacactgcctggagactacagcatcctggtgaaatataatgataagcacattccaggaagcccattcaccgctaagattaccgatgacagccgcagatgctcccaagtcaaactgggctccgccgctgacttcctgctggatatctcagagacagatctatcatcgctcacggcttccatcaaagcacctagcgggagggatgagccgtgcctacttaagaggcttcccaacaatcatatcggtatttcttttatcccgagggaagtgggcgagcatctggtatcaattaagaaaaacggtaaccacgtggccaattccccggtctctatcatggtggttcagagcgagatcggggatgcccgacgggctaaggtctatgggcgagggctgagtgaggggagaaccttcgagatgagcgatttcatagtggatacaagggatgcaggctatgggggaatttccttggccgtggagggcccttccaaagtagatattcagacagaggacttggaggatggaacatgcaaggtgtcgtacttcccaaccgtgcccggagtgtacatagtttcaactaaattcgctgatgaacacgtcccgggtagtcctttcacagtgaaaatatccggggagggacgggttaaggaaagcataacacgcaccagcagggctcctagtgtggcaaccgtcggaagcatatgtgacttaaatctgaagattccagagatcaattcctctgacatgtctgcacatgtgacctcacccagcggacgcgttactgaagccgagattgttccgatgggaaaaaacagccactgcgttagatttgtgccccaggagatgggggtgcacaccgtttcggttaaataccggggtcagcatgtgactggttccccttttcaattcactgtcgggcctctgggggagggaggcgcacataaggtgcgagcaggtggccctggtttagaaagaggagaggccggagttcctgccgagttctctatctggacgagggaggccggtgcgggaggactgtccatagccgtggaaggcccatctaaagctgaaatcacctttgacgatcataagaatggcagctgcggggtctcttatatcgctcaggaacctgggaattacgaggtatcaatcaagttcaacgacgaacatatccctgagtccccttacctggtaccagtgatagccccttccgatgacgcaaggcggcttacggtcatgagtctgcaggagagcggactcaaggttaaccagccggctagtttcgctatacgcctcaacggcgcaaaggggaagattgacgctaaggtccactctccatctggagctgtcgaggagtgtcatgtttctgaattagagccggataagtacgcagtccgcttcatcccccatgaaaacggcgttcatacaatagacgtcaagttcaatggtagccacgtcgtgggaagtcccttcaaagttagagtcggcgaacccggtcaggccggaaaccccgcactggtgtcagcttatgggactggtctggaaggagggacaacaggtatccagagtgagttttttataaatactacaagagccggaccgggtaccctcagcgttacaattgaaggaccatctaaggtaaagatggactgccaagaaactccggagggctacaaggtcatgtatactcccatggccccaggcaattacctaatttccgtgaaatatggcggtccaaatcacatagtcggaagcccgttcaaagctaaggttacgggtcaacgccttgtgtctccaggaagcgctaatgagactagcagcatattggtggaatcagttactagatcctctacagagacttgttattctgccatcccaaaggcttcaagcgatgcttctaaagtgacctctaagggtgccggtctctctaaagcctttgtaggccagaagtctagtttcctggtcgattgcagcaaggccggaagcaacatgttgctcatcggggtgcacgggccaactacaccctgtgaggaggtgagcatgaagcacgtggggaaccagcagtacaacgttacctacgtggtgaaagagcgtggagactacgtcttagccgtgaaatggggagaagaacatatcccaggtagtccatttcatgtgacagtcccata

SEQ ID NO: 223347 - DNA, 7268 bp, Artificial Sequence
  Description of Artificial Sequence: Synthetic coding sequence
atgcaggaacattccaccagaagaagatctctgtccctgtgtccagattgggaatcctgggacccacagaaaccggtagacaacgccagagaggccatgcaacaggctgatgattggctgggagttcctcaggtcatcacccccgaggagatcatccatcccgacgtcgacgagcacagtgtgatgacttatttatcacagtttcccaaagctaagctcaagcccggagctcctctgaagccaaaactgaatcccaaaaaggcacgagcatacggtcggggtattgagccgacggggaacatggtgaagcagcctgcgaaattcacagtagacactatatctgccggtcagggggacgttatggtatttgtggaagatcctgaaggcaacaaggaggaggcccaggtgacacccgactctgataagaataaaacatattcggttgagtatcttcccaaagtaactggtctccacaaagtcaccgtgctcttcgccggtcagcatatttcaaagtctcccttcgaagtcagtgtcgacaaagcgcagggcgatgcaagcaaagtgacagccaaaggcccaggactggaggccgtgggtaatatcgcaaacaagcctacatacttcgatatctataccgccggtgctggggtgggtgacatcggcgttgaagtggaggacccgcaggggaaaaacacagttgaactcttggtcgaggataaaggtaaccaggtctaccgttgtgtctacaagccgatgcagccgggtcctcacgtggtgaaaatcttttttgccggtgacacgattcctaaaagtccatttgtggtccaagttggagaggcttgcaaccctaacgcctgccgcgctagcgggcgtggcctgcagcctaaaggcgtaagaatcagggaaaccactgactttaaggtagatacgaaggccgcaggatccggagagctaggcgtcactatgaagggacctaagggccttgaagaacttgtcaaacagaaggattttctagacggagtgtatgcttttgagtattatccgagtacacccggacgctactccattgccatcacctggggcggacatcatatccccaaaagccccttcgaagtacaagttggtcctgaagccggaatgcagaaggttcgggcttggggacctgggctgcatggcggtattgtcgggcgaagtgctgatttcgtcgtggagagtatcggatccgaagtcgggtccttaggcttcgccatcgagggtccgtcccaggccaaaatcgaatacaatgatcaaaatgacggcagctgcgatgtcaagtattggcccaaagagcctggggagtacgctgtgcacatcatgtgcgatgacgaagatatcaaggactccccatacatggccttcatccatcctgccactgggggttacaatccagacttggtgcgcgcttacggccctggattagagaaaagcggttgcattgtgaacaatctggccgaatttaccgtggatccaaaggacgctggcaaagctccgctcaagatttttgcgcaggacggggagggccagcggatagacatacagatgaaaaaccgaatggacggaacgtatgcctgttcgtacacacccgttaaggcaattaagcacaccatcgctgtggtctggggtggcgtgaatatcccgcattctccctacagggttaacatcgggcaggggtcccacccacagaaggtcaaggtatttggaccaggcgtcgagaggagcggacttaaagcaaatgaacctacacactttaccgtggattgcacggaggccggtgagggtgatgtctctgttggcattaaatgtgatgcaagagtactgtcagaagacgaggaagatgtggatttcgatatcattcataatgctaatgataccttcaccgttaaatatgtgcccccagctgctggaagatatacaatcaaggttctctttgcatctcaggaaattcccgcttcgcccttccgggttaaggtggacccatcccacgacgcatcaaaagtgaaagcagaggggcctggtctgagtaaagccggtgtggaaaatggcaaacccacacactttactgtgtatacaaagggagctgggaaggctcctctgaatgtccagttcaattctcccctacctggcgacgcagtcaaagatctcgacataatagataactatgattactctcacaccgtgaagtatacacccacccagcaggggaacatgcaggtcttagtaacctacgggggagacccaattccgaaaagcccattcaccgtgggggttgctgcaccactggacctgtctaagattaaactaaatggcctcgagaatagagtcgaggttgggaaggaccaggagttcacagtggacacccgcggagctggcggacagggtaaactggacgtcaccatcttgtctccatccagaaaagtcgtaccctgcctggttactcccgtgactggcagggagaacagtaccgccaagttcattcctcgggaagaaggactgtacgcagtggatgtgacttatgatggtcacccagtgccgggatccccttatacagtcgaggcaagcctgccaccagacccttctaaagtgaaggcacacggcccaggactggagggagggttagttggcaagcccgctgagtttactatcgacacgaagggggcagggacgggcggtctaggattgacggttgaggggccatgcgaagccaagatcgaatgttccgataatggagatggcacgtgtagtgtttcttacctcccaacgaagcccggagaatactttgtcaatatcctgttcgaggaggtgcatataccagggtccccctttaaagccgatatcgagatgccctttgatcccagcaaggtggttgcatcgggcccaggtctcgaacatggcaaggtcggggaggccggactgctgtcagtcgattgtagtgaagccggaccaggcgctctcggcttagaggctgtgtctgatagcggtacaaaggcagaggttagtattcagaacaacaaggatgggacctacgcagtcacctacgttcccctgactgctggcatgtacacactgacgatgaagtacggcggtgaactcgtcccacattttccggctcgcgttaaggtggaaccagccgtcgataccagtaggattaaagttttcggccctggcatcgagggaaaggacgtattccgggaagcaactaccgacttcaccgtggattccaggccactgacgcaggtcggtggggatcatatcaaggctcacatcgctaacccatctggtgctagtacagagtgcttcgtcacagacaacgccgacggaacatatcaggtcgaatataccccattcgaaaaaggccttcatgtggtggaggtcacttacgatgacgtgcccatccctaattccccctttaaagtggcagtcacagaagggtgtcagccatccagggtgcaggcccagggacctggtctcaaagaggcctttaccaataagcccaatgtgtttaccgtagttacccggggagccggaattgggggactgggtatcacagtggaaggcccaagcgaatcaaagattaattgccgcgacaacaaagacgggtcatgttccgccgagtacataccttttgccccaggggattatgatgttaatatcacctatggcggagcccatatccccggttccccttttcgggtacccgttaaggacgtggtggatccttctaaagtgaagatcgctggacccggattaggtagcggcgtccgggcaagagtactccagtcattcacagtcgacagtagcaaggccggactggcccctctggaagtccgcgtgctgggaccccgtggactggttgagcccgttaatgtggtggataatggcgacgggacacacaccgttacatatacgccatcacaggagggaccctatatggtttctgtgaaatacgccgacgaagaaataccaagatcccccttcaaggttaaggtcctccccacgtatgacgcatctaaggtcactgccagcggacctggcttgtcttcatatggagtcccagcctccctgccagtggacttcgcgattgacgcccgagacgctggggagggactcctggccgtgcagatcaccgatcaggagggcaagccaaaaagggcaatagttcatgataataaagatggaacgtacgctgttacatacatcccggataaaaccggcaggtatatgatcggagttacttacggcggagatgatataccactatccccctatagaattcgggctactcagactggcgacgcctctaaatgcctggctaccggaccagggattgcctcaacagtgaagacaggagaagaagtggggtttgtagtggacgctaaaactgccggaaaagggaaagtgacgtgcaccgtactaactcctgacggcacagaggccgaagccgatgtgattgaaaacgaagatggcacatatgatatcttttatacagccgctaaaccaggaacatacgtgatatatgtgcgatttgggggagtggacattccaaatagtcctttcactgtgatggcaacagatggggaggtgacggccgtcgaagaggcacccgtgactgaggaagcctacgtccccgtgagtgatatgaatggcttgggcttcaagccctttgaccttgtcatcccatttgccgtacggaagggggaaatcacgggcgaggtgcatatgccatctggtaagacagcaacacctgaaatcgtcgacaacaaagatggtacagtaacagttcgatacgcccctaccgaggttggtcttcacgaaatgcacataaagtatatgggctcacacatccccgagtctccactgcagttttacgttaattacccaaactctgggagcgtatccgcgtatggacccggactggtgtacggggtggccaataaaacagccacgtttactatagtcactgaggatgccggtgaagggggacttgacctggccatcgaaggacctagcaaagccgaaattagttgcatcgataacaaggatggtacttgcaccgtgacttacctccccacgttgcctggagactactctattttggtgaaatacaatgacaagcacatccccggatctccatttaccgccaagatcactgatgatagcagacgttgttctcaggttaagctgggaagcgccgcagattttctgttggacattagtgaaactgatctgtctagtctcacggcctcaattaaagcccctagtggcagggatgagccttgtctgttaaaaagactccccaacaatcacattggcatatcatttattcccagagaggtgggcgagcatctcgtttccatcaaaaaaaatggaaatcacgttgccaacagccccgtctccataatggtcgtccaaagcgaaataggagacgcacgcagggccaaggtatacgggcgtggattatctgaggggagaacctttgaaatgtcggacttcatcgtagatactcgcgatgccggttacggaggaattagcctggcggtcgaagggccatccaaggtggacatccagacagaagatctcgaagatggtacgtgtaaggtaagctattttcctacggtgccaggtgtttacattgtgagcactaagttcgccgacgagcacgttcctgggtcaccatttacagtcaaaattagcggagaaggcagagtgaaagaatccatcacgaggacaagccgagctccgtcggtggccactgtgggctctatttgtgacctcaatctcaagatccccgagattaactcaagtgacatgtcagctcacgtgacaagccccagtggtcgcgttacagaagcagagattgttcctatggggaaaaactcccattgcgtgcggtttgtgcctcaggaaatgggggtccatacagtgagtgtcaagtatcgaggacagcatgtcacgggcagcccctttcagttcacagtggggcctctgggggaaggcggtgcccacaaagtcagggccggaggaccgggtcttgagaggggagaggccggagtcccagctgagttttccatctggacgcgcgaggccggtgcaggaggattgagcatcgcagtagaaggtccaagcaaagcagagatcacgttcgacgaccacaaaaatggatcatgcggagtctcatacatcgcgcaggagcccggaaactacgaagtgtccataaaattcaacgacgaacacatccccgagtcaccttacctcgtccccgtgatcgctccctcagacgatgctaggcgactgaccgtgatgtccctgcaggaaagcggactgaaagtgaaccagccagcctcttttgcaattcgcctgaacggggcaaaaggtaaaatagacgcgaaggtccattcaccaagcggcgctgtggaggagtgtcacgtatcagaactcgagcctgacaaatatgctgtccgtttcatcccccatgagaacggagtgcacaccatcgatgtcaagttcaatggcagccacgtagtgggttcacccttcaaagtaagagtgggggagcccggtcaggccggaaaccctgcattggtgtctgcttacggaacgggcctagaagggggaacaactggaatacaaagcgaatttttcataaacaccaccagggctggacccggtacactaagtgtcacgatcgaaggaccatcgaaagtcaagatggattgccaggaaacacctgaaggctataaggtgatgtatacccccatggcccctgggaattacctcatctctgtcaaatacggcggacctaatcacatcgttggaagcccctttaaggcgaaggttacaggccagaggttggtctcgcccggtagcgccaatgagacatccagcattctcgtggagagtgttacacggtccagtaccgaaacttgctattctgccatacctaaagcctccagtgatgcaagcaaggtgacaagcaagggtgctggattgtccaaagcgtttgtaggacaaaagtcttcctttttagtggactgtagcaaggccggtagcaatatgttgttgataggcgtgcacggacctacgaccccttgcgaggaggtgagcatgaagcacgtcgggaaccagcagtacaatgttacatacgtcgtcaaagagcgaggggactacgttcttgccgtaaagtggggagaggagcatatccccggaagtccatttcatgtcaccgttcctta

SEQ ID NO: 223348 - DNA, 7775 bp, Artificial Sequence
  Description of Artificial Sequence: Synthetic coding sequence
atgcctgtaacagagaaagacttggcggaggacgccccttggaagaaaatccaacaaaatacattcaccagatggtgtaatgaacatttaaagtgcgtgaacaaaagaatcggaaacttgcagacggacctgtctgacggcttgcggctcatcgcactcctggaggtgctcagccagaagaggatgtacagaaagtaccatcagcgtcctacatttcggcagatgcagctcgaaaatgtgtctgtagcgctggagtttctcgacagggaatccataaaactggtgtccatcgatagcaaggcaatagtggatggcaacctgaagctgattctggggttagtttggacgttgatacttcactattccatcagcatgcctgtatgggaggatgaaggtgatgatgacgcaaagaagcagacgcctaagcagcggctgctcggatggatacagaataagattccctatctgcctataacaaacttcaaccaaaactggcaagatggcaaagcccttggtgcactggttgattcatgcgcacccggtctctgccctgattgggagtcttgggaccctcagaagcccgtggataacgccagagaggcaatgcagcaagcagacgattggctcggcgtgcctcaggttatcacacctgaagagatcatacacccagatgtggacgagcattctgtgatgacttatttaagccagtttccaaaagccaaactgaagcccggagcgccactgaagcccaaactgaatccgaaaaaagcaagagcctacggcagaggcatagagcccaccggcaatatggtgaagcaacccgcaaaatttactgtggatacaatcagcgcaggtcaaggcgacgtcatggttttcgtcgaagaccctgagggcaacaaggaagaagcgcaggtcacccctgactctgataagaacaagacttactcggtagagtatttgcctaaagtgacagggctgcacaaggtcaccgtgctctttgccggacagcacatttcaaaatcaccattcgaggtatcagtcgataaggctcagggtgacgcctccaaggtcaccgccaagggacccggtctggaggcagtggggaacattgccaacaaacctacgtatttcgacatatatacagcgggagccggtgtgggggatataggggtggaggtggaggacccacaggggaaaaataccgtcgaactgctggtggaagataaggggaatcaagtgtatcgctgcgtttacaagcctatgcagccagggccacacgtagttaagattttctttgcgggagatactataccaaagtctccattcgtggtccaggtcggtgaggcctgtaatccaaacgcatgccgtgcctctggccgtggactgcagcctaagggggtgcggatccgcgaaactactgatttcaaagtagacacaaaagcagctggatctggcgaattgggggtgaccatgaaggggccaaagggcctcgaagagttggtgaaacagaaggacttcctggatggagtgtatgcgtttgagtattacccaagcactccgggtagatactctattgccattacttggggcggacaccacatccccaagtctccctttgaggtccaagtcggccctgaggccggtatgcagaaagtgcgagcttggggcccaggtttgcacggtgggatagttggtcggtcagcggactttgttgtggaatcgattggctccgaggtgggtagcctgggattcgctatcgaaggtccatcccaggccaagatcgagtacaatgaccaaaatgacggatcctgcgatgtaaagtactggccaaaggaacccggtgagtatgctgtccacatcatgtgcgacgatgaggacattaaagattccccttacatggcttttatacatcctgctacaggcggatataaccccgacctggtccgcgcttacggaccaggcctggaaaaatctggatgtatcgtgaataacttggccgagttcactgtagacccgaaggatgcaggcaaagctccattgaagatcttcgcccaggacggcgaaggtcaacggatcgacattcagatgaagaatcggatggacggtacgtacgcttgtagttataccccggtgaaggccatcaaacacactattgctgtggtctggggaggtgtcaacatcccgcatagcccttatagagtaaacatcggccagggctctcatccacagaaagtgaaggtgtttggtccaggtgtagaaaggagtggactcaaggccaatgagcctacacacttcaccgttgattgcacagaggctggagagggagacgtcagcgttggaattaagtgcgacgcacgggtgttgagcgaggacgaggaagatgtggactttgacattatccataacgcaaatgacacctttaccgtcaagtacgtcccccctgcagccggaagatatactataaaggtgttatttgcatcccaggaaatcccagcctcacctttccgggtgaaggtcgacccatcccatgacgctagcaaggttaaggctgaaggccctggcttgagcaaagctggagtcgagaatgggaaacctacccactttacagtctataccaagggagccggtaaagccccactcaacgtgcagtttaacagcccgctgccaggcgatgcagtaaaggacttagacataatagacaattatgactactctcacaccgtgaaatatacacccacacagcagggcaacatgcaggttttagttacatacgggggagatcctatacctaagtcacccttcaccgtcggggtcgccgcaccgcttgatttgagcaaaatcaaactgaatggcctggaaaatagggtggaagtcgggaaggaccaggaatttactgtcgataccagaggggcaggcggtcaggggaaacttgatgtgaccattctgtcaccaagcagaaaagtcgtgccatgtttagtaacacctgtgactgggagagaaaatagcacagccaagttcattcccagggaggagggcctctacgccgtggacgtgacatatgacggccacccggtgccgggtagcccttatacagttgaggcctcgctgcccccagacccaagtaaggttaaggcccacggtcccggactggaaggaggcctcgtcggtaagcccgcagagttcactattgataccaagggcgcaggtacaggcggtcttgggctcacggtagaaggcccttgcgaagccaagatcgaatgttctgataatggtgacggcacatgttccgtgagctatctgcccaccaaacccggtgagtattttgtgaacatcctatttgaggaagtgcacatacccggaagcccgttcaaggccgatattgagatgccctttgatccttcaaaggtagtggcctctggacccggtctggagcacggaaaagtgggagaagcgggattgctgagtgtagattgtagtgaggccggacccggtgctctcgggctcgaggctgtgtctgattcaggaacaaaagcggaggtgtcgatacagaataataaggatggaacatacgccgttacctacgtaccccttacggcaggcatgtacactttgacgatgaaatatgggggtgaacttgtgcctcacttcccggcacgagttaaggtggagccagccgttgacacatcacggatcaaggtctttggtcctggaatcgagggaaaagacgtgtttagagaagccacaacagactttacagtggacagccggcctctgactcaggtcgggggtgaccatatcaaggcccacattgccaacccttccggggcttcaacagaatgctttgtaacggacaatgccgacggaacttatcaagtagagtataccccgttcgagaaggggttgcacgtggttgaagtcacttatgatgacgtaccaatacccaattcgccctttaaggtcgccgtgaccgaagggtgtcaaccctccagagtacaagcacagggtcctgggctgaaggaggcattcactaacaagcctaacgtgttcactgtcgtgacaagaggcgcaggaataggaggcttagggatcacagtggagggaccttccgagagcaaaataaattgtcgggataataaggatggcagttgctcagcagagtacatcccgtttgcccctggcgattacgatgttaacataacttacggtggcgctcacataccgggaagtccatttcgggtgcctgtgaaggacgtagtggatccgtccaaagttaagatagcgggacctggcctcggttccggggttcgggctcgggtccttcagtcttttaccgtggatagcagcaaggcaggactagcccctcttgaggtgcgcgtgctagggcctcgaggtttagtcgagccagtgaatgtcgtggataatggggatggcacacatacggtgacttatacaccaagccaggaaggaccctatatggtttcagtaaagtacgccgatgaagagataccacgatcccccttcaaagttaaagtgttgccaacatatgacgccagcaaagtcacagcctcaggaccaggactgagttcctacggcgtgcccgcatcactcccagtggactttgctatagacgccagagatgcaggcgaggggctgctggccgttcagattactgatcaagagggcaaacccaaacgcgcaatcgtacacgacaacaaggacggaacctatgccgtgacctacatccctgacaaaaccggacgttacatgattggcgtaacatacggcggagatgacattcccctgtctccctacagaatccgtgctactcagaccggggacgcctccaagtgtcttgcaacaggacctggaattgccagtaccgtcaaaaccggtgaggaagtgggcttcgtggtagacgccaagactgcaggcaagggtaaggtcacctgtactgtccttacacccgacggaaccgaggcagaggccgacgtcattgagaatgaggatggtacctatgacattttctacactgccgctaagcccggtacttatgtgatttacgtgcggttcggtggagtggacatccctaatagcccttttaccgtgatggcgacagatggggaagtcacagctgtagaagaggcccctgtgaccgaagaagcatacgtgcccgtgagcgatatgaatgggctagggtttaaacctttcgacctggttattccttttgcagtgaggaagggtgaaatcaccggggaagttcatatgccgtcaggcaagacagcaacccctgaaatcgtcgacaacaaggacgggaccgtcactgtccgctatgcacctacagaagtaggcctccacgagatgcacattaagtatatgggcagccatattcccgagtcacccctgcagttctatgtcaactatcccaactcaggctccgtgagcgcctacggtcctggactggtctacggcgttgctaacaagactgcaacattcacaatcgtgactgaggacgcaggtgagggcggtttggatctcgccatcgaagggccttcaaaggccgagatctcttgtattgataataaggacggaacgtgtacagtaacctatctacccacactgcctggtgactatagcatcttagtgaagtacaatgacaagcatatcccaggatccccctttactgcgaagatcacagatgatagccgtcgctgctcccaggtgaagttgggtagtgccgctgattttcttttggatatatcagaaactgacctgtcttcgctgacagcctctattaaagctccatccggacgcgatgaaccatgtttactaaaacgtctcccaaacaaccatattggaatctcatttatacccagagaggtaggtgagcacctggtgtctatcaaaaagaatggaaaccatgtggccaactccccagtgagtatcatggtcgtgcaatcggagatcggcgacgccagaagggctaaagtctacggtaggggcctatctgagggtcggacatttgaaatgagtgatttcattgtggacacgcgagatgcgggatacggaggaatttcactagcggtagaggggccttctaaagtggatatacagactgaggacctggaggatggtacatgtaaggtgtcctattttcccacggtccccggtgtgtatatagtgagtaccaagttcgcagacgagcatgttccgggatccccgtttacagtcaaaatctctggggaaggacgtgttaaggaaagcataactcgcaccagtcgtgcccctagtgtggcgaccgtcggctccatttgtgatctgaacttgaagataccagaaataaattcaagtgacatgagtgctcacgtcactagcccatccgggagagtgacagaggctgagattgtgccaatggggaagaactcccactgcgtccggtttgtcccccaagaaatgggcgtgcacacggtgagcgtcaaataccggggtcagcatgtgaccgggagtccattccagttcactgttggaccactgggtgaaggtggcgcacacaaagtcagggccggtggtcctggtcttgaacgcggagaagccggagtgccagccgagttctccatctggaccagagaggccggagcagggggactgtccatcgctgttgaaggcccatccaaagccgagataactttcgacgatcacaaaaacggaagctgcggggtgagctacattgctcaggaacctggcaattatgaagtttctataaagtttaacgatgagcacattccagagtcaccctacctggtgcccgtaatagccccatccgacgacgcacgaaggctcactgtgatgagcctccaggagagcgggctcaaagttaaccagccggcttcattcgctattcgcctaaacggcgcaaaaggtaaaatagacgccaaagtacattcacccagcggagccgtcgaggagtgccatgtcagtgaactggagcccgacaaatacgccgtgagatttataccccatgagaatggagttcataccatagacgtcaagtttaacggctcacatgttgtggggtcaccgttcaaagttagggtgggggagcccggacaggctgggaatcccgctttagttagtgcctacggaacaggtttagaggggggtactacaggtattcagagtgagttttttattaatacaacacgcgctggaccgggaaccctgagcgttactattgagggtccttcaaaagtgaaaatggattgccaagagaccccagaagggtacaaggtgatgtacactcccatggccccaggaaactatctcatatctgttaaatacggcggtcccaatcatattgtggggtcgcctttcaaggcgaaggttacagggcagcgtttggtgtcaccagggtcggctaatgaaacgtctagcatcttagtggagtccgtgactagatcaagcaccgagacatgctatagcgctataccaaaagcttcatccgacgcttcaaaggtgacaagtaaaggagccggactaagcaaggccttcgtgggccagaaatccagcttcctggtggattgctccaaggcgggatcaaatatgctgttaattggcgtacacggtccaacaaccccctgcgaagaggtgtccatgaaacatgtaggcaaccaacagtacaatgtgacatacgtggtcaaagagcgtggagactacgttctcgcagtgaagtggggggaagaacatattcccggtagtccgtttcacgtgacagtacccta

SEQ ID NO: 223349 - DNA, 408 bp, Artificial Sequence
  Description of Artificial Sequence: Synthetic coding sequence
taactggctgtagaaggtcccagcaaagtggacatccagactgaagacttggaggatggaacctgtaaggtgtcgtacttccccacggttcctggagtctatattgttagcaccaagtttgccgatgagcacgtgcctgagatcaatagttctgatatgagcgcgcacgtaacatcacctagtggacgggtgacagaggcagaaatcgtcccaatgggcaaaaactcccattgtgtgcggttcgtgccacaggagatgggggtgcacaccgtgagtgtgaaatatcggggtcagcacgtcactggaagcccatttcagttcaccgtaggcccactgggggaaggaggcgctcacaaggtacgagcagggggtcctggcctggagcggggagaagccggagtgccatag

SEQ ID NO: 223350 - DNA, 7901 bp, Artificial Sequence
  Description of Artificial Sequence: Synthetic coding sequence
atgcccgtgactgagaaagatctcgcagaggatgcgccatggaagaagattcagcagaacacatttacacggtggtgtaatgagcacctaaaatgcgttaacaaacgcattggaaatctgcagactgatctgagtgatgggctgaggctcatcgcgcttctggaagtgttgtctcagaagcgcatgtaccggaagtatcatcaaagaccaacttttaggcaaatgcagctagaaaatgtcagcgtggcccttgaatttcttgatcgggaatcaattaagctcgtgtccatcgacagtaaggctattgtggacggcaacttgaaactcatcttgggactggtttggacactgatcctccactattctatctcaatgccagtgtgggaggatgagggcgacgatgacgccaaaaagcagacacctaagcagcgacttttaggctggatccagaacaagatcccatacctccctatcactaacttcaaccagaactggcaggacggtaaggcacttggagccctcgtggatagctgcgcgcctggattgtgccccgactgggaatcctgggacccccagaagccagtggataatgctcgggaagccatgcaacaggcggatgattggctcggggtgcctcaggtgataactcccgaggagattatccatccggacgtagacgagcactcagttatgacgtacctcagccaattccctaaagccaagcttaaaccgggtgcaccactgaaacccaagctaaatcccaagaaggcaagggcctatggtcgcggaatcgagcctactggtaatatggttaaacagcccgcaaaatttacagtggacactatttctgctggtcaaggcgatgtcatggtgtttgtggaggaccctgagggaaataaagaagaggcccaggtcacaccggatagtgataagaataaaacctacagcgtggagtacttacccaaggtgacaggcttgcacaaggtcactgtgctcttcgccggacaacatatctcaaagtctccttttgaggtgtcagtggataaggctcagggggatgcgagtaaggttactgctaagggcccagggctcgaagccgtgggcaacatcgccaacaagcccacctactttgatatctataccgccggtgcgggtgtaggtgacatcggcgtggaagtcgaagatccacaggggaagaataccgtcgagcttttggtagaagacaaaggcaaccaggtgtaccgatgcgtatacaagcctatgcagcctgggccacacgttgtaaagatatttttcgccggagataccattcccaagtccccctttgtggtccaggtgggcgaggcttgcaatcccaatgcttgccgggctagcgggaggggactccaacctaagggagtacggatacgagagactacagacttcaaggtcgacaccaaagcagctggctccggcgagctcggtgttacaatgaagggacctaagggtttggaagagttggtcaagcagaaagatttccttgacggggtatacgctttcgagtactaccctagtaccccagggaggtacagcatcgccattacatggggcggacaccacatccccaagtcaccattcgaagtccaggtcgggccagaggccggaatgcagaaggtgagagcttggggtccagggctgcacggagggatcgtgggacgaagcgcggacttcgttgttgagagcattggtagcgaagtgggctcccttggatttgctatagaaggccctagtcaggctaagatcgagtataatgaccagaacgatggctcttgtgatgtgaaatactggccaaaagaaccaggcgagtacgctgttcacattatgtgtgatgacgaagacatcaaggactccccttatatggcatttatccatcccgctactggcggttacaaccctgacctggtacgcgcatacggtcctggactagaaaaaagtggatgtatcgtgaacaacttagcagagttcaccgtcgacccgaaggatgccggtaaggcccctctcaagattttcgcccaggacggtgaagggcaaaggatagatattcagatgaagaaccgcatggacggtacctacgcctgttcgtatacaccagtgaaggccatcaagcatacgatcgctgtggtatgggggggagtaaatatccctcacagcccttaccgcgtgaatatcgggcagggctctcacccacagaaagtcaaggtgttcggtccaggcgttgagagaagtggtctgaaggcaaatgagccaactcacttcaccgttgactgtaccgaggcaggcgagggtgacgtctccgtcggtatcaagtgcgatgcgagggtgttatccgaggatgaggaagacgtggacttcgatatcatccacaatgccaacgacacattcaccgtcaagtatgtccctcctgccgcaggccgatacaccatcaaggttctctttgcttcccaggaaattcctgcttctcctttccgcgtgaaagtggatccttctcacgatgccagcaaggtgaaagcagaggggcctggtctgagtaaggcaggagtcgaaaacggcaaacccacccacttcaccgtctacacaaagggggctggcaaagcccctctcaatgtccagtttaattctccattgcctggagatgctgtgaaggacctcgatattattgacaactacgactacagtcacaccgtaaagtacacgcccacacaacagggaaatatgcaggtcttagtaacttacggaggagacccgatccctaaaagccccttcaccgtgggagttgccgcacctctggacctctccaagattaagctgaacgggctggagaatcgtgtagaagtgggcaaagatcaggagttcacggtggacacaagaggggctggtggccagggaaagctggacgtaactatcctttcaccctcccgtaaagttgtcccgtgcttggtgacccctgttaccggcagggagaacagcacagccaagttcatccccagggaagaaggcctctacgccgtggatgtcacatacgacggacatccggtgcccggatctccttacaccgtggaagcaagcttgccacccgaccctagcaaagtgaaggcccacggaccagggctggaaggtggcctggtaggaaaacctgctgaattcacaatagacaccaagggggctggcacaggaggacttggactgactgtggagggcccatgcgaggccaaaattgaatgttccgacaatggggatggcacctgttctgtttcttatctacctactaagcccggagaatactttgtcaatatcctgttcgaggaggtgcacatccctggctccccttttaaggcagacatcgagatgccctttgacccttctaaggtcgtggcaagcggcccaggtctggagcacggcaaggtgggagaagcaggactgctgtctgtcgactgctccgaggccggtcctggcgctctggggttggaagcagtttccgattccggcactaaggcagaggtgagcattcagaataacaaggatggcacatacgctgtgacctacgtccctctgactgccggaatgtatacgctgacaatgaagtacgggggagaactggtgccgcacttccccgcacgggtcaaggtcgaaccagccgtggatactagtaggatcaaggtgtttggtccgggaattgagggcaaggatgtcttcagggaagcgaccacagattttaccgtcgattctaggccactgacccaggtgggaggggatcatatcaaggcccacattgccaatccatcaggcgcaagtaccgaatgttttgtgacagacaatgcggacggcacttatcaagtggagtacacaccgttcgagaaaggcttgcacgtcgtggaggtgacatacgacgatgtgcccattcctaacagcccgtttaaagtggccgtcacggaaggatgccaacccagccgcgtgcaggctcagggccctggcctgaaggaagccttcactaataaacccaatgtcttcacggtggtgactcgtggggctggcatcggtggcctcggaattacggtggaaggtccatctgagtccaagattaactgccgggataacaaggacggaagttgttcagcagaatatattcctttcgctcctggagactatgacgtcaatatcacttacggcggagcccatatcccaggctccccttttagggtgccagtcaaagacgtggtggaccccagtaaagttaagatcgctgggcctggcctgggctccggagtacgcgcaagagtcctgcagtctttcacggtggacagctcaaaagccggactcgcgcctctggaagttagagttctggggcctcgtgcagacgatacagacagccagtcatggcggtcccccctgaaagcactgtccgagttttttaaaggggacccaaagggagatttcaataagacagggctggtggagccagtcaatgtggtcgacaatggggatgggacccacacagtgacctatacaccatcccaggagggtccttacatggtctccgtcaaatatgctgatgaggagatcccgaggtctcctttcaaagtgaaagtgctccctacgtacgacgccagcaaagtcacggctagtggaccaggactgagcagttacggggtccccgcttccctgccagtagacttcgcgattgacgctagggacgcgggagaaggtctgctcgcagttcagattacagatcaggaagggaaacccaaacgggcaatcgtgcatgataataaggacggtacatacgcagtcacatacatccctgacaaaactgggagatatatgatcggcgtgacatacgggggagatgacatcccactctccccttataggatacgcgcaacccagaccggtgatgcttctaagtgcctagctaccgggccagggatcgcgtctacagtcaagacaggcgaggaggtcgggtttgtcgtcgacgccaaaacagcgggaaaaggaaaagttacctgcacagttctcacccccgacgggaccgaggcagaggccgacgtgatcgagaatgaggacggtacctatgacatcttttacaccgcggcaaaacctgggacttacgtgatctacgtacgcttcgggggagtagacatccccaacagccccttcactgttatggccaccgatggggaagttacggccgtcgaagaggcccctgtcaacgcctgccctcccggattcaggccatgggtgaccgaggaggcctacgtgcccgtgtctgatatgaatggtttagggtttaagccattcgatctggtcatcccattcgctgtccggaagggcgagataactggcgaagtccacatgccctctggcaaaacagctactccagagattgtagataacaaagatggtaccgtgaccgtgcgttatgccccaactgaagtaggcctccacgaaatgcacatcaagtatatgggcagccatatacccgaatccccattgcagttctatgtgaactacccaaattctggaagcgtcagtgcatacgggccaggactcgtgtatggtgtcgcgaacaaaactgctaccttcaccatcgtgactgaagatgctggggaaggcggactcgacttagccatcgaaggtccctccaaggccgagatctcttgcatagacaacaaggacggtacttgcacagtgacatatttaccaaccctgcctggagattactccatcctggtgaaatataatgataagcacatcccaggttctcccttcaccgctaagattactgacgattcccgcagatgttcccaggtcaaactcggttccgctgctgactttttactggatatctcagagaccgacctgtcgagcctgactgcatccattaaagcaccctctggtagagacgagccctgtctgcttaaacgtttgcccaataatcatattgggattagctttattcctcgcgaggtcggagagcatctagtatcgatcaaaaaaaacggcaaccacgttgcaaactccccggtttcaataatggtcgtccagtccgaaatcggtgatgccagaagagccaaagtgtatggtcgcggactgagcgagggtaggacgttcgagatgagtgactttatcgtagatacccgagatgccggatatggtggcatcagcctggccgtcgaaggcccaagtaaagttgatattcagaccgaagacttggaagacggcacatgcaaggtctcttacttccctactgttccgggtgtgtacatcgtctcgacaaaatttgcagatgagcatgtgcccggatcaccattcacagtcaagatttcaggtgaaggtcgagtaaaggaaagcataacacggacgagtcgggctccatcagtggctaccgtcggcagtatttgtgatctgaacctgaaaatacctgaaatcaattcgagcgacatgtccgcacacgtgaccagtccgagcggccgtgttaccgaggcagagatagttccgatgggcaagaactcccactgtgttcgattcgtaccgcaggaaatgggagtccacacagtttccgtcaagtaccgcggacagcacgttaccgggagccccttccagtttactgtgggacctctgggtgaaggaggcgctcacaaagtcagggccggaggacctggcctggagcgaggggaagccggtgtgcctgctgagttcagtatttggactagagaagctggagcaggcggactgtcaatcgctgtcgaaggccctagcaaagccgaaattacatttgatgaccataagaatggatcttgcggagtatcctacatagctcaagagcctggaaactacgaagtgtctattaagtttaatgatgagcacatccctgaatccccgtacctggtaccggtgatagcaccctcggatgatgctagaaggctcacagttatgtctcttcaggaaagtgggctgaaagttaaccagccagcatcgtttgctattagactaaacggtgctaaggggaaaatagatgccaaggtgcactccccttccggcgctgtggaggagtgccatgtgtccgagcttgaacccgacaagtacgcagtcagattcattccccatgagaatggtgtacacacgatcgacgtgaaatttaatggcagccatgtcgtgggctcccccttcaaggtgagggttggagaacccggtcaggctggcaaccccgcactggtgtctgcctatggaactggcctggagggcggaaccactgggatccagagcgaattcttcattaatactaccagggccggacctggtaccctctcagtgacgattgagggcccatcaaaggtgaaaatggactgccaggagacaccagagggatataaggtgatgtacactcctatggctcctggaaactacctcatatctgttaaatacggtggcccaaaccacatcgtggggagcccgttcaaggcgaaagttaccggccaacgtcttgtatcgccagggagtgctaacgagacctcctccatcctggtcgaaagtgttaccagatcaagtaccgaaacatgttactccgctattcctaaagcttcttctgacgcgtcaaaggtgacatcaaaaggtgccggactctctaaggccttcgttggacagaagtcctcattcctggtcgactgtagtaaagcaggctccaacatgcttctgattggcgtccacgggcctaccactccgtgcgaggaggtcagcatgaaacatgttgggaatcagcagtacaacgtgacatatgtagtaaaggagaggggcgattatgtgctggcggttaaatggggagaggagcatattccgggaagcccatttcacgtcaccgttcccta

SEQ ID NO: 223351 - DNA, 8177 bp, Artificial Sequence
  Description of Artificial Sequence: Synthetic coding sequence
atgatgaataattctggatatagcgatgccggattggggttgggcgacgaaaccgacgagatgccatctactgagaaggacttggccgaggatgcgccttggaaaaagatccaacagaacacatttactagatggtgcaacgaacacctcaagtgtgtaggaaaaaggcttaccgatcttcaaagagacctatcagatgggcttcggctgattgcgttgctcgaggtcctgtcccagaaaagaatgtatagaaaatttcaccccaggcctaattttcgccagatgaaactcgaaaacgtgtccgtcgctctggaattccttgagagggagcatattaaactggtaagtatcgattccaaggcaatagttgatggtaacctgaaacttatcctgggactaatatggaccctgatcctccattactctatctctatgcctatgtgggaggatgaagatgatgaagacgcgagaaagcagacgcccaagcagcggttacttggctggatccaaaacaaagtcccacagctccctattaccaatttcaatcgggattggcaagacgggaaggcgctaggggcactggttgacaattgcgctcccggattgtgccccgattgggaagcatgggacccgaaccagcctgtagaaaacgcacgtgaggctatgcagcaggctgatgactggttaggtgttccccaagtgattgcacctgaagaaattgtcgacccgaacgtggatgaacacagcgtcatgacgtacctaagtcagtttcctaaagccaagctgaagcccggagcaccggtacgatcgaagcagttgaatcccaaaaaagccatcgcttatggtcccggtatcgagccccaaggaaacactgtcttgcagcccgctcatttcactgtgcagacagtcgatgccggagttggggaagttctggtgtacatcgaggacccagaaggacatacggaggaggctaaggtggtgcctaataatgacaaagaccgcacctatgccgtcagttacgtgccaaaggtagctggactgcataaagtaaccgtactgttcgccggacagaatatcgagcgatcgccattcgaggttaacgtgggcatggcgctgggagatgcaaacaaggtttccgctcggggtcctggcctagagccggtcggcaacgtagcaaataaacccacatacttcgatatctatacagccggagccggaactggagatgttgcggttgtcattgtggatccccagggacgcagagacaccgtcgaagtcgcgctcgaagataaaggtgactctacgttccggtgcacctatcgtccagccatggagggtccccacactgtgcatgttgcctttgcgggagctcctatcacccgcagcccatttccggtgcacgtctcagaagcttgcaaccctaatgcttgccgcgcaagtggacggggtcttcagcccaagggcgtgcgcgtgaaggaggtagccgactttaaagttttcacgaaaggtgccggaagcggggagttgaaggtgactgtgaaggggccaaaggggaccgaagagccagtaaaggttagagaggccggagacggggtattcgagtgtgaatactaccctgtggtgccagggaagtatgtagtgacaataacttggggtggctatgccatcccaaggtcaccttttgaggttcaggtgtcacccgaagccggagtacagaaggtgcgcgcatggggcccaggtctcgagaccggccaggtgggcaagtcagccgactttgtagttgaagccattggaacagaggtaggcaccctcggattttcaattgaaggcccatcgcaggctaaaatcgaatgtgatgataagggcgacggatcctgcgatgtgaggtactggcctacagaacctggggagtacgccgtgcatgtgatctgcgacgacgaggatatccgggactctcctttcattgcccacattttaccagctccgccagattgtttccctgataaggtgaaggcgttcggcccagggctggagcccacaggctgcattgtggacaaacccgctgaatttacgattgatgcacgagctgctggcaaaggtgacctgaagttatacgcccaggatgctgacggatgccctatcgatatcaaagtcataccaaatggggacgggacattccgctgctcctatgtgcccaccaaaccgatcaagcatactattatcatctcatggggaggagtgaatgtgcctaagtccccgttccgggtgaatgtaggtgaaggctctcaccctgaacgtgtgaaggtctatggcccaggagttgagaaaaccggactgaaagctaacgagcctacttacttcacagttgattgctcagaggccggacagggcgacgtatccataggaattaagtgtgcacctggagtcgtgggaccggcagaggctgacatcgatttcgatataatcaagaatgacaacgacacattcactgtgaagtacacacctcctggtgccggaagatacacaatcatggtgctgtttgcaaatcaggagattcctgccagtcctttccacattaaggtcgatccgtcccatgatgcgagcaaagtcaaggctgaaggaccaggcttgaatcgaaccggggttgaagtcggaaaacctacacactttaccgtactgactaaaggagcaggaaaggccaaattagacgtgcagtttgcgggtaccgctaagggggaagtcgttagggatttcgaaatcatagacaaccatgactactcttacaccgttaaatataccgccgtgcagcaggggaacatggccgtgactgtaacatacggcggagatcccgtgccaaagagtccgttcgtggtcaatgttgccccacccctagatctctcaaagatcaaggttcagggactaaatagtaaagtggccgtgggacaagagcaggccttcagcgtgaatactaggggagctgggggtcagggacaattggacgttagaatgacaagtccctcaagacgcccaatcccgtgtaaactggagcctggcggaggggctgaagctcaggccgttagatacatgccacctgaggaaggaccctacaaggtggatataacgtacgacggacaccccgtcccgggtagccctttcgcggtggagggggttctccccccagatccgagcaaagtttgcgcctatgggccagggctgaaaggtggcttagtgggaacgcccgcaccgttctccatcgacacaaaaggggctggaacagggggtttgggactgacagtcgagggaccgtgtgaagctaagattgaatgccaggataacggagacggcagttgcgctgtatcttatcttccaacagaacctggagagtatacaattaatattcttttcgctgaggcccatatacccggaagtccttttaaggctacaattcgacctgtgtttgaccccagcaaagtgagggcttctggccctggcctggagagaggaaaggtgggggaggccgcaacgtttactgttgattgcagcgaagctggcgaagcagagctgaccatcgagatcctttctgacgcaggagtgaaggctgaagtcctcattcataacaatgctgacggcacataccacataacctattcacctgcttttcccggaacatatacgattaccatcaagtatgggggtcaccccgtgccaaagttcccaacaagagtccacgtccagcctgccgttgacacctccggtgtcaaagttagcggaccgggagttgaaccgcatggtgtcttgcgggaagtcaccaccgagttcacggtggatgccagaagtctgactgccaccggaggcaatcatgtgactgccagggtactgaacccctccggggctaagactgacacttacgtgacagataacggagacgggacttaccgtgtgcagtacaccgcctatgaagagggagtgcacttggtggaggtcctgtacgacgaggtggccgtccccaagagtccattcagggtcggggtgaccgaggggtgcgaccctactcgggtgcgagcgttcggtcctggcctggagggtggcctagttaataaggctaacaggtttactgtggaaactcggggagccggaacagggggtctaggactggccattgaaggcccttccgaggccaagatgagctgcaaagacaataaggatggcagctgtactgtggaatacattcccttcaccccaggggattacgatgtcaatattacttttggtggtaggccaatcccagggagcccctttcgagtccctgtaaaggacgtagtagatccgggaaaggttaaatgcagcgggcctgggcttggcgcaggcgttcgagcaagggtccctcaaacatttaccgtggactgctctcaggctgggagggccccacttcaggtggccgtgctcggcccaaccggggtagccgaacccgtggaagtccgtgataatggcgacggaacacacactgtacattatacacccgcaaccgatggaccttacactgtggccgtgaagtacgcagatcaggaggtgcctcgttccccgtttaagattaaagtgctgcccgctcacgacgcgagcaaggttagagcaagtgggccaggactgaacgcctcggggattccagccagcctgccagtagagtttactattgatgctagggacgcaggggaaggcttgctcacagttcagatcttagacccggagggcaagcctaaaaaagcaaatatccgtgataacggggacggcacctacaccgtctcttacctgcctgacatgagtggaaggtatactattactattaagtacggaggagacgagattccatactcaccatttcgaatccatgccctgccaacgggtgacgcctcaaagtgcctggtaaccgtgagcatcggcggacatgggcttggggcatgcctcggcccacgaattcagattggccaggagaccgtcattactgtggacgccaaagctgccggagaaggtaaagtgacctgtaccgtctcaacacctgatggagccgaattagacgttgacgttgtggagaatcacgacggaacatttgacatatactacacggctccagaacccggaaaatatgtaattacaattcggttcggcggagaacatatcccgaattccccatttcacgtcctagcttgcgacccactgccgcatgaagaggagccttccgaggtgcctcagcttaggcagccttacgctccaccacggccaggtgccaggccaacccactgggcaaccgaggagcctgtggtgcccgtcgagcccatggaaagcatgctgcgcccattcaatctcgtgatcccatttgccgtccagaagggagaattaacaggcgaagtcagaatgccaagcggcaagacagcaaggcctaatatcaccgacaacaaagatggcactatcaccgtgaggtacgccccaacagagaagggactgcatcagatgggcataaagtacgatggaaatcatatcccgggatcccctctacagttttatgttgatgcgattaatagccgacacgtcagtgcctatgggcctgggttgagccacgggatggtgaacaaaccggctaccttcactatcgtgaccaaagacgctggggaaggcggactgagtcttgccgtggagggcccatccaaggccgagatcacatgcaaggataataaggacggcacttgcacagtgtcttacttaccaaccgccccaggcgactactctattatcgtgaggtttgacgataagcacatcccaggtagtccattcaccgcgaagatcaccggagacgattccatgcggacgagtcagcttaacgtggggaccagcaccgacgttagcctgaagattaccgaaagcgatctgagccaactgacagcttctatccgagcaccctcagggaacgaagaaccatgtctgctgaaaagattgcctaacaggcatatcggaatctccttcacgcccaaagaggttggcgagcacgtagtatccgtcaggaaatcaggtaagcacgtcacgaactccccgtttaaaatcctggtgggaccatcggagatcggggacgcctctaaggtgagagtttggggcaaaggcctgtccgagggtcatacattccaagtagctgagttcatcgtggacacacggaacgcgggatacggaggactagggttgtccattgaaggtccctcgaaggtcgacatcaactgcgaagatatggaagacggaacatgcaaggtaacttactgtcccactgaaccaggcacctatatcatcaatatcaaatttgccgacaaacacgtgccaggcagccctttcactgtgaaggtgaccggagaaggacggatgaaggagagtattactaggaggagacaggccccatccatcgctacaattggcagcacatgtgacctcaacctgaaaattcctgggaattggttccagatggtgtctgcccaggagcggctcacacgaaccttcactagatccagccacacctatacaagaaccgaaagaacggaaatttcaaagacgcggggtggtgaaacgaagcgtgaagtgagggtggaggagagtacccaggttggaggtgatccatttcctgcagttttcggcgacttcctggggagagaacggttagggtctttcggaagcattactagacagcaggaaggggaggctagctctcaggacatgactgcacaggtaacctccccttccggaaaggttgaagctgctgagattgtggaaggcgaagacagtgcctattcggtgagattcgtgccccaggaaatgggcccacatacagtcgctgtcaaatacagaggtcagcacgtacccggttccccatttcaatttacagtaggtcctctcggtgagggtggcgcacacaaagttagagcaggagggactggacttgagagaggcgtagccggtgtccctgctgaattcagtatttggactagagaggcgggagcagggggtctcagtattgctgtagaagggccatccaaagccgaaatagcttttgaagacaggaaggacggtagctgtggggtatcttacgttgtacaggaaccaggcgattatgaagtctcgataaagttcaacgacgaacatattccagatagtccatttgttgtgcccgtggcctctctctctgacgacgcccgacggttgactgtcacatcgctgcaggagacaggcttaaaggtgaaccaacccgcttcatttgcagtgcaattgaatggagctcgcggtgtgattgacgcccgtgtgcatacgccgtccggagccgtggaggaatgctatgtgagcgagctggacagtgacaagcacacgattcgctttatcccacacgaaaacggcgttcactccattgatgtaaagttcaatggagcacacatacccggttcaccgtttaaaataagggttggggagcagtcccaggcgggtgaccctggcctggtgtctgcttacggccctggcttggaagggggaaccactggcgtctcctcagagttcatcgtcaataccctgaatgcgggaagtggagcccttagcgttaccatagacgggccttcaaaggtgcaattagactgccgcgagtgtccagaaggtcatgtggtcacatacacgcctatggcaccgggaaactacttgattgcaattaagtatggaggacctcagcacattgtcgggagcccttttaaagccaaggtgactggtccccgtctgtctggcggacattccttgcacgagacaagtaccgtgctggtggagacagtgacgaaatcctcaagctcccgtggaagcagttattcttcaattcccaaatttagctctgatgccagcaaagtggtgacccgaggcccaggcttgagccaggcgttcgtaggacaaaagaattcctttaccgtggactgttccaaagccggaactaacatgatgatggtgggtgtacacggacctaagacaccttgtgaggaagtgtatgtgaagcacatgggaaatagagtgtataatgtaacatatactgtcaaggagaagggcgattatattttgattgtgaagtggggcgacgaatcagtcccgggttcaccctttaaagtgaaggttcctta

SEQ ID NO: 223352 - DNA, 8078 bp, Artificial Sequence
  Description of Artificial Sequence: Synthetic coding sequence
atgatgaataattcaggctattctgacgcagggcttggattgggtgacgaaactgacgagatgcccagcaccgagaaggatttggccgaagacgccccttggaagaagatccagcagaacactttcactagatggtgcaacgagcacttgaaatgtgtgggcaagcggctgacagatctgcagagagacctcagcgatgggctgagactaatcgcccttcttgaagtgctgagtcagaagcgtatgtaccgcaaattccatcctaggcccaatttccgccaaatgaagctggagaacgtgtccgtggccctggaatttctggagagggaacatatcaagctcgtcagtatcgacagcaaagcaattgttgatggcaacttaaagctgatccttggcctgatatggactctgatcctgcactactctatttctatgcctatgtgggaggatgaggatgacgaggacgcccgtaagcagacccccaaacagagattactggggtggattcagaacaaggtccctcaactgcccattactaatttcaatcgggattggcaggacggcaaggctctgggcgctctagtagacaactgcgcacccggtctttgccctgactgggaggcctgggatcctaatcagccagtcgagaacgccagggaagctatgcaacaggctgatgactggcttggagttccccaggtgatagctcctgaggagatcgtggacccaaacgtcgacgagcactcagtgatgacatatttatctcagtttccaaaggccaaactgaagccgggagcccctgtgcggagcaagcagttgaatccaaagaaagccatagcttatgggcctggcattgagccccaaggcaacaccgtactgcagccagctcacttcaccgtacagaccgtcgacgccggagtaggtgaagttttggtctacatcgaggatcctgaggggcacaccgaagaggccaaggtggtgcctaacaacgataaagaccgcacgtacgctgtgtcttatgtgccaaaggtagccggtcttcataaagttactgtgctgtttgctgggcagaacatcgaacgcagtccattcgaagtgaacgtaggcatggccctgggagatgccaataaagtatcagccagagggccagggctagagcctgtgggtaatgtggccaataaacccacgtacttcgatatttacacagcaggtgccggaaccggggatgtcgctgttgtgatcgttgatcctcagggcagaagggacaccgtcgaggttgccctggaggacaaaggggactccacgttccggtgcacttacagaccagctatggaagggcctcacacagtgcacgtggcatttgccggagcacctattactcgctcaccgttccctgttcacgtgtcggaagcctgtaaccctaatgcttgccgcgctagtgggcgtggtctccagcccaagggcgtcagggtgaaagaggtggccgactttaaggtcttcaccaagggtgctggctctggcgaactgaaggtaaccgtaaaaggccctaaagggactgaggaacctgtgaaagttagagaggccggtgatggggtgtttgagtgcgaatattaccctgtggtgcctggcaagtacgtggtgacaatcacttgggggggttatgccattcccagatccccatttgaagtccaggtgtctcctgaggccggagttcaaaaggtaagggcttgggggcctggactagagacaggtcaggttggaaagtctgccgactttgttgtggaagcgatcgggacggaagtgggcacgttgggtttttccatcgagggcccaagccaggctaaaatcgaatgtgatgataagggagatgggagttgcgatgtgagatactggcccacggagcctggggaatatgccgtacatgtgatctgcgatgacgaggacatccgcgatagtccttttattgcacacatcctgccagctcccccagactgcttccctgataaagtgaaagcctttgggcctggtctagagcctactggctgcatagtagataagccggctgagtttacaatcgacgcgagagccgctggaaagggcgatctgaagctgtacgctcaggacgctgatggctgtcctattgatatcaaagtgattccaaacggcgatggcacgtttaggtgcagttatgtgcctaccaaacccataaagcatacaatcattataagctggggcggtgtgaatgtcccgaagagtccttttagagtgaacgtcggcgagggatcgcatcctgagcgggtgaaggtgtatggacctggcgtggagaagaccggcctcaaagcaaatgagcccacgtactttacagtcgattgctcagaggctggtcagggcgacgtctccatcggcataaagtgtgcacctggtgttgtggggcctgcagaagccgacatcgactttgatataattaaaaacgacaacgacactttcacagtgaaatacaccccaccgggtgccggacgctacacaataatggtgttattcgcgaaccaggagatcccagcttctcctttccacatcaaagtggacccctctcacgatgcttccaaggtcaaggccgagggtcctggactgaaccgcacaggggtggaggtcgggaaacccacacatttcacggtgttgaccaaaggggcaggcaaagccaagttggacgtgcagtttgcaggcactgccaaaggcgaggtagtgcgtgacttcgagatcattgacaaccatgactactcttacactgtgaaatacacagctgtacagcagggcaacatggccgtcacagtcacatacggcggtgaccctgtacctaaatctcctttcgtggtaaatgtggcccctccactggacctaagtaaaatcaaggttcagggccttaattccaaagtcgctgtcgggcaggagcaagcatttagtgtcaatactagaggcgcaggcggtcaggggcagctcgacgtgcggatgacgtctccctctcggcgtcccataccgtgcaagctcgagcctggcggtggggctgaagcccaggccgtccgctacatgccacccgaagaaggcccatataaggtcgacatcacttatgacgggcatcctgtgcctggaagtccgtttgcagtggagggcgtgctgcctcccgatccatcaaaggtgtgtgcatatggccctggcttaaagggcggtctcgtgggaacacccgctcccttctcaatcgatacgaaaggtgccggaaccgggggtttgggacttaccgtggaagggccttgcgaagcgaagatagagtgccaggataatggggatgggagctgtgccgttagctatctgcccaccgagcccggagaatacaccatcaacattctgtttgccgaagctcatattcctggcagtcccttcaaagcaacgatccggcctgtgtttgacccaagtaaggtcagggctagcggacctgggttggaaagaggtaaggtgggtgaggcagcaacctttacagtcgattgctccgaggcgggagaggctgagctgacaattgaaattctgtctgacgcaggcgttaaagccgaagtcttaattcacaacaatgccgatgggacctatcatatcacctactcccctgccttcccaggtacctatacaattacgatcaagtacggaggtcatcctgtgccgaaatttcccaccagggtacatgtacaaccagccgttgacacttcaggggttaaggtgagcggacccggagtagagccccacggcgttctgagagaggtcactaccgaattcacggtggatgccaggtcactgaccgcaaccggcggtaaccacgtaactgcccgtgtgctcaacccatccggcgcaaaaaccgacacctacgttaccgacaacggcgatggcacatacagggtgcagtatacagcctatgaagaaggcgtgcacttagttgaggtgttatacgacgaggtggcagttcccaagtcaccgtttcgggtgggggtaaccgaaggatgtgaccccacacgcgttcgggctttcgggccaggactcgaggggggtctggttaacaaggccaaccgctttacggttgaaactagaggagcaggaactggtggcctggggctcgcgatcgaggggccaagcgaggccaagatgagctgtaaagacaataaggatggttcttgcactgtcgagtatatcccctttacaccgggtgattacgacgttaatatcacatttggagggagacctatccccggatctcctttccgggttccagtgaaagacgtagtagatcctggcaaagtcaaatgttctgggccaggactgggcgctggagtgcgggctcgagtgccccagacctttacagttgattgctcccaggctggcagggccccacttcaggtcgctgtactcgggcctacgggggtggctgagccggtggaggtgagggacaatggggacgggacacataccgtgcactacacccccgcaacagatggcccttatactgtggctgtcaagtacgcggaccaggaagtgccccgatcaccctttaagattaaagtgctgcctgcgcatgacgcaagcaaagttcgggctagtggtcctgggctgaatgccagtggcattccagctagtctgccggtggaattcaccattgacgcccgagatgccggagagggtctactgacagttcagatccttgaccccgaaggaaagcccaaaaaggcaaacattcgggataatggagacggcacctatactgtcagctacctacctgacatgtccggcagatacaccataacgatcaagtacggtggtgacgaaattccctactcgcccttccgcattcatgctctgccaaccggcgatgccagcaagtgcttggtcactgtgagtataggaggccacggattgggggcatgcctgggccctagaatacagatcggccaggagaccgtgattaccgtagacgctaaggccgcaggagagggaaaagtgacttgtactgtctcaaccccagacggcgctgagttggatgtcgatgttgtcgaaaatcacgacggtactttcgacatatactataccgccccagaaccaggaaagtatgtgattaccatccgatttggcggagaacacatcccgaactcaccctttcacgtacttgcgactgaagaaccagtggtgcctgtcgaacctatggagagcatgctgcgcccatttaatttagttatcccttttgccgtgcagaagggagagttgaccggggaagtaagaatgccaagtgggaagacagcccgacccaacatcaccgacaacaaagacggtaccatcacagtgagatacgcaccgacagagaaaggcctgcaccagatgggcatcaagtatgacggcaaccatatcccaggcagccccctgcaattctatgttgatgctattaacagcagacatgtgagtgcttatggtcccggtttgtctcacgggatggtaaataagccagccaccttcacgatcgttacaaaggacgcaggtgaggggggactaagtcttgctgtagaggggcctagcaaggccgaaattacctgcaaggacaacaaggacggtacgtgtaccgtctcatatctgccaaccgctccaggcgactattctattatagtccggttcgacgataaacacatcccgggtagtccgtttacagccaaaatcactggggatgactctatgcggacctctcagctcaatgtgggtacctcaacagatgtgtccctaaagataacagaatcagacctcagccagcttaccgcgtcaattagagcgccttcgggcaatgaagaaccgtgcctgttaaaacgtctccctaacagacatattgggatcagcttcacccctaaagaagtgggggaacatgtggtttctgttcggaagtccggaaagcatgtcacaaactcccccttcaagatattagtggggccatctgaaatcggcgatgcaagcaaagtccgcgtatgggggaaagggctgagcgaaggtcacacatttcaggtggcagaattcatcgtggatacaagaaacgccggatatgggggactgggactcagcattgagggcccatctaaggttgatataaattgtgaggatatggaagatggaacctgtaaggtcacctactgtcccaccgaaccaggcacttatatcattaacatcaagtttgcggataaacatgtgcctggctctccgttcacagtgaaggttaccggagaaggccgtatgaaggaatcaattacccgcagaagacaggccccatccattgcgacaatcggctccacctgcgacttaaacctaaagatacctgggaactggttccaaatggtaagcgctcaggagcgcctcactcggacgtttacgcggagctcccacacctacacaagaacggagcgtacagaaatcagcaagactcggggaggcgagacaaagcgggaggtccgcgttgaagagtccactcaggtgggtggggatccctttccagcagtgtttggggattttttggggagagaaagactgggtagttttgggtcgataacaaggcaacaggaaggggaggctagctcacaggatatgactgcccaggtaacctcaccttccgggaaggtggaagcagccgaaattgtggaaggggaagattctgcctacagtgtccggtttgtgccacaagagatgggtccacataccgtggccgtcaagtacagaggccaacacgtgccgggatcgccatttcagtttacggtcggccctctgggcgaaggcggtgcccataaagtcagagcaggtggtactggcctcgaacgcggagtcgctggcgtcccagccgaattctccatttggacacgcgaggctggggcaggtggcctgtctattgcagtggaggggccatccaaggccgaaatagcttttgaagaccggaaggatggatcctgcggcgtgagctacgtggtgcaggagcccggtgattacgaggtttcaattaaattcaatgatgagcacattcctgactccccatttgtagtccccgtggcctccttgtccgatgacgcccgaagactgacagtcacaagtttgcaagagactgggctgaaagttaatcagcccgcaagctttgccgtacaattgaacggtgcacgcggagttatagatgccagagtgcacacaccatctggcgcagtcgaagaatgttatgtatccgagcttgactccgacaagcataccattcggttcattccgcatgagaacggtgttcactctatcgatgtgaagttcaacggagcccatatccctggctccccttttaaaatacgggtgggggaacaaagtcaagccggagaccctgggctggttagtgcatacggacccggacttgagggaggaacgactggcgttagcagcgaatttatagtcaacacactgaatgcaggatcaggagccctgtccgtgactatcgacggacccagtaaggtgcaactggattgccgggaatgcccagaaggacatgtcgtgacatataccccaatggcaccaggcaactatttaatcgccatcaagtacggcggtccacagcatatagtgggctccccttttaaggcgaaggtcacagggccacggctttccgggggacattcattgcacgaaacctccaccgtgctagttgaaaccgtcactaaatccagcagcagcaggggatcgagttatagcagcattcccaaattcagttcggacgcctccaaggtcgtcactcgaggcccagggctgtcacaagccttcgtgggacagaagaattcatttaccgtcgattgcagcaaggcaggaaccaacatgatgatggtaggtgttcacggccctaagactccctgcgaggaggtttacgtgaaacacatgggtaaccgagtctataacgtcacctacaccgttaaagaaaaaggggactatatactgatagttaaatggggcgacgagtctgtgccgggatccccatttaaggtcaaggtcccata

SEQ ID NO: 223353 - DNA, 264 bp, Artificial Sequence
  Description of Artificial Sequence: Synthetic coding sequence
atgcagctctttgtacgggcacaagaattgcatacattcgaggttacaggccaggagactgtggcgcagatcaaagcacacgtggcctctttggagggcattgctccagaagatcaggtcgtgctacttgctggcgctccgttagaggacgaagccaccttgggtcagtgtggcgtcgaagctcttactactctagaagtggctggaaggatgctgggagggggacagaccggggaggaagaggaagaagataggtcaggttag

SEQ ID NO: 223354 - DNA, 228 bp, Artificial Sequence
  Description of Artificial Sequence: Synthetic coding sequence
atgcagttgtttgtgcgagctcaggagttgcacacatttgaggttactgggcaggaaacggttgcacagataaaggctcacgtggcatctctcgaaggtatcgctcctgaggaccaggtcgtcctcctggccggtgctcctttggaggatgaggcaaccctcgggcagtgcggtgtagaagcgcttaccaccctggaggtggcagggagaatgctcggaggggaatag

SEQ ID NO: 223355 - DNA, 297 bp, Artificial Sequence
  Description of Artificial Sequence: Synthetic coding sequence
atgcaactgtttgttagggcccaggagttgcacacctttgaggtgacaggccaggagacggtggcacagatcaaggccctgactacactcgaggtcgcaggcaggatgttgggcggaaaagtgcatggcagtctcgcacgtgccggaaaggtgagaggacagacaccgaaggtggcaaagcaagaaaaaaagaagaaaaagactgggagggctaaacggcgaatgcagtacaaccggaggttcgttaacgtggtgccaaccttcgggaagaaaaagggcccaaatgctaattcatag

SEQ ID NO: 223356 - DNA, 330 bp, Artificial Sequence
  Description of Artificial Sequence: Synthetic coding sequence
atgcagctgtttgtgcgcgctcaggagctgcacacattcgaagtgactggccaggagaccgtcgctcagattaaagcgcatgtggcgagcctggaaggaattgctcccgaggaccaggtcgtcctgctcgccggagctccactggaggatgaggccactctgggacagtgcggggtggaggctcttaccactctggaggtggcagggcgtatgcttgggggtaaggtgcacggcagtctcgcccgtgcagggaaggtgagagggcagacgccaaaagttgcaaaacaggaaaagaagaagaaaaagacgggacgagcaaaacggaggtag

SEQ ID NO: 223357 - DNA, 402 bp, Artificial Sequence
  Description of Artificial Sequence: Synthetic coding sequence
atgcagctgttcgttcgcgcacaagagctccacaccttcgaagtgactgggcaggaaaccgtggcccaaataaaagcacacgtcgcgagtctggaaggcatcgcgcctgaagaccaggtggtcctactcgctggtgccccactcgaagacgaagcaactctcggacaatgtggggtggaggccctcacgactctagaggtcgccggaaggatgctgggcggaaaagtgcacgggtctctggctcgcgcaggcaaggtgcggggtcagacgcctaaagttgccaagcaggagaaaaaaaagaagaagaccgggagggccaaaagaaggatgcaatacaaccgacggtttgttaacgtggtccctacattcggcaaaaagaaaggcccaaatgcgaactcttag

SEQ ID NO: 223358 - DNA, 228 bp, Artificial Sequence
  Description of Artificial Sequence: Synthetic coding sequence
atgcagctgttcgttcgagcgcaggagctccacaccttcgaagtgaccggacaagaaaccgtggcacagatcaaggcacatgttgcgtctctggaaggcatagccccagaagaccaggtggtgctgctggccggagctcccttggaagatgaggcaaccctcggccagtgcggagttgaagccctcacaaccctggaggttgccggacgcatgctgggaggggagtag

SEQ ID NO: 223359 - DNA, 402 bp, Artificial Sequence
  Description of Artificial Sequence: Synthetic coding sequence
atgcagctctttgtcagagcccaggaactgcacacttttgaagttacaggacaagagaccgtggcccagataaaagcacacgtggcctcactagaaggcatagcaccggaggatcaggttgtcctgctggcaggagcacctctggaggacgaggcaacattgggccaatgcggggtcgaggccttgaccacacttgaggtggctggccgaatgctcggaggtaaggtgcatggcagtcttgcacgcgctggcaaggtgaggggccagacccccaaggtggcgaagcaggagaaaaaaaaaaagaaaactgggagggcaaagcgtagaatgcagtacaaccgaaggtttgtgaacgttgtgccaacctttggaaagaagaagggacctaatgctaattcatag

SEQ ID NO: 223360 - DNA, 402 bp, Artificial Sequence
  Description of Artificial Sequence: Synthetic coding sequence
atgcaactgttcgtccgggctcaggagcttcacaccttcgaagtgaccggccaggagacggttgcccagattaaggcacacgtggcttccttggaagggattgcccctgaagaccaggtcgtgttgctagccggagcccctctcgaggatgaggcgactctcgggcaatgcggcgtggaagcacttactaccctggaggtggctggaagaatgctgggcggtaaggtgcacgggtcactggccagggctggcaaggttagagggcagacacccaaagtggcaaaacaggagaagaaaaagaagaagactggacgcgctaagagaagaatgcagtataatagaagatttgtaaacgtggtccccactttcggaaaaaagaagggacccaatgcaaactcttag

SEQ ID NO: 223361 - DNA, 1563 bp, Artificial Sequence
  Description of Artificial Sequence: Synthetic coding sequence
atgtctgctggggaggtggagcggctcgtatctgagctgtccgggggaactgggggtgacgaggaggaggagtggctctacggcgatgaaaacgaagtggaacgacccgaagaagagaacgcatcagcaaacccacccagtggcatagaagatgaaacagctgagaacggtgtaccaaaacccaaagtgactgagacagaggacgattctgattctgattctgacgacgacgaagatgatgtacatgtgaccatcggggacataaagaccggcgcaccgcagtacgggagctatggaaccgccccagtcaatctaaatatcaagacgggcggaagagtttacggaaccacagggactaaagtcaagggggtggaccttgacgcccctggctccataaatggcgtgccactccttgaggtggatcttgacagttttgaagataaaccatggcgcaaaccaggcgctgatctgtcagattacttcaactatggctttaacgaagatacctggaaggcttattgtgagaagcagaaacgcatccgcatggggcttgaagtaattcctgtcacctccactacaaacaaaattactgtgcagcaggggaggacaggcaatagcgaaaaagagactgcattacctagcactaaagccgagtttacgtcacccccatccttattcaagactggactccccccatcaagaaggctgccgggagcaatcgatgtgatagggcagactatcacgatcagccgagtcgagggacggaggcgcgcaaacgagaacagtaacattcaggtgctctccgagcgcagcgcaacagaggttgataataacttctccaagccccctcccttttttccaccaggagccccacccacgcatctgcctccacctccatttctgccccctcccccaactgtctctactgctccaccgctgattccgcctccaggctttccacccccacctggcgcacctccaccctcgctgatacctactatcgaatccggccactcctccggatacgactcgagatccgctcgagcttttccatacgggaacgtggcgtttccccatctgcccggtagcgcaccctcttggccctctctggtagacacttccaagcagtgggattattacgctcgtcgagaaaaagatcgtgacagggaaagagaccgggatcgggagagggacagagatagagatcgcgagcgagagcgcacccgagaaagagagagggaaagagaccactcgcccacacccagtgtgttcaactctgacgaagagcggtacaggtacagggagtacgcggaaagaggatacgaacggcaccgggcatcccgtgagaaggaggaacgccaccgcgagcggagacaccgcgagaaagaggagacgcggcacaagagcagtagaagcaacagcagacgaagacacgaatccgaggagggggactcccatcggagacacaagcataaaaaaagcaagagatcaaaggaggggaaagaggcaggctcagaacccgcacccgaacaggagtccacagaggccacgcctgccgaatag

SEQ ID NO: 223362 - DNA, 1785 bp, Artificial Sequence
  Description of Artificial Sequence: Synthetic coding sequence
atgtctgcaggggaggtcgagaggctggtgagtgaattgtctggcggaactggaggtgacgaagaagaggagtggttgtatggaggcccttgggatgtacacgtgcatagtgacctcgcgaaagatctcgatgaaaacgaggttgaaagacccgaagaggagaacgcgtcggccaaccctccgtcgggcatcgaggacgaaacggccgaaaatggtgtaccgaagccgaaagtgaccgagacggaggacgactcagactcagactccgatgacgatgaagacgatgtgcatgtgaccataggagacattaagactggcgcaccacagtatgggtcctacggtaccgccccagttaatctcaatataaagacaggtggcagagtctatgggacaaccggcaccaaagtgaaaggagtggacttggacgcaccaggaagtatcaacggagtaccactgctcgaggtcgatctagactcgtttgaagacaaaccttggagaaaacctggggcagacctcagtgattacttcaattacgggtttaatgaggacacctggaaggcatactgcgaaaagcagaaacggatccgcatgggtctggaggtgatacctgttacctctacaaccaataaaattacagcagaagactgtactatggaggtaacccctggcgcagagattcaggacggtcggttcaacctgtttaaggtgcagcaggggcgtaccgggaatagcgaaaaggaaaccgcactcccaagtactaaggccgagtttaccagtcctccgtcactcttcaagactggactcccaccatcccgcaatagtacaagcagccagtcccagacgtcaacggcttcgagaaaagcgaacagcagtgtgggaaaatggcaggatcggtacgggagggccgagtccccggatcttcgtagactgccaggagctatcgacgtcatcgggcagaccataaccatcagccgggtagaggggagaagaagagcgaatgaaaacagcaatatacaagttctttcagagcggtcagctacagaggtggacaataacttttcaaagcccccacctttcttcccacccggagccccaccgacacacctaccgcctcctcctttcctgcctccaccaccaaccgtgagtacggcgccacctctgatccccccaccagggttccctcctccacctggagccccaccccctagcctgatacccaccatagagtctggacattcctccggatacgacagccgttctgcgagggctttcccctatgggaacgtagcttttcctcacctaccaggcagtgcaccctcttggccctcgctcgttgacacaagtaaacagtgggactattatgccaggagggagaaagacagagaccgcgaaagagatagggaccgggagcgagacagggatagagatagggagagagaacgcacaagggagagggagcgagaacgggatcacagccccacgcccagtgtgttcaattctgacgaagagaggtatagataccgcgagtacgcagagcggggatatgagcgccacagagcctcccgggaaaaggaagagcggcaccgagaacggaggcaccgagaaaaagaggagacccgtcacaaatccagcaggtctaactcaaggaggagacatgagagcgaagagggcgactctcatcgtcgacacaagcataagaaaagcaagagatctaaggaggggaaggaggctgggagtgaaccggcaccagagcaggaatccactgaagccacccccgctgaatag

SEQ ID NO: 223363 - DNA, 1767 bp, Artificial Sequence
  Description of Artificial Sequence: Synthetic coding sequence
atgtcagctggcgaagtggaacgactggtatcagagctctccgggggaaccgggggagacgaagaagaagaatggttatacggagacgaaaatgaggtggaacgccctgaggaggagaacgccagcgcaaatccgccatccggaatcgaggacgagaccgcagaaaatggtgtgcctaaaccaaaggtcaccgaaacagaggacgattctgatagtgatagcgatgacgacgaagacgacgttcacgtaaccattggtgacatcaaaactggagcaccacagtatggttcgtacggaacagcgcctgttaacctgaatatcaagaccggcggtagggtttatggtaccacggggacaaaggtgaagggtgtagatttggatgcacctggcagtatcaacggcgttccactgctggaggtcgatctcgacagttttgaagacaagccttggcgaaagccaggggcagatctgtccgattatttcaattatggctttaacgaagacacctggaaagcctattgtgagaagcagaagcgtatcagaatggggttggaagttatacccgtcacatctaccacaaacaagataaccgcagaggactgcactatggaggtgacccctggggcagagatccaggacggcaggtttaatctcttcaaggtgcagcagggacgcaccgggaattccgagaaggagacagccctgccctccactaaggccgaattcacgtccccgccatccttatttaaaacaggactgcctccatctcgcaattctacgtcctcccagtcacagacgagcactgcgagtcggaaggcgaattcctccgtgggcaagtggcaggaccgctacgggagagctgagtccccagatctcaggaggctacctggagccattgatgtcataggacaaacaatcacaataagtagagtagaaggaaggcgacgtgctaacgagaactcgaatattcaagtcctgagcgaaaggagcgctaccgaggtggataataatttttctaagccgccacccttcttcccccctggtgcccctcccacccacctcccgccaccacctttcctccccccacccccaaccgtaagcacagctccgccactgattccaccgcctggaatccccatcaccgtacctcccccaggtttccctccccctccgggtgctccccctccatccctcattcccaccatcgagtctggccattcttctgggtacgattctaggagtgccagggcatttccctacgggaatgtcgcttttccacacctacccggttcagctccttcttggccgagcctggtggacacatccaagcagtgggattactacgcccgtcgagagaaggatcgcgaccgagagagagatagagatcgcgaacgcgacagagatcgggaccgggagcgcgagcgaactcgtgagcgagaaagagaaagagatcactcccctacaccaagtgtttttaatagtgacgaagaacgatatcgctatcgggaatacgctgaacgaggatacgaaagacaccgcgcaagccgcgagaaggaagagcgccaccgggaaaggagacatcgcgagaaggaagagactaggcacaagagtagtcgctcgaattctaggaggcggcacgaatccgaagaaggtgacagccatagacgccataagcacaaaaagtcaaaacgctccaaggagggcaaagaagctggctccgagccggctccagaacaggagagtactgaggccacccccgcagagtag

SEQ ID NO: 223364 - DNA, 366 bp, Artificial Sequence
  Description of Artificial Sequence: Synthetic coding sequence
atggtagacatgatggacctacctcggtctagaatcaatgccggaatgcttgcgcagtttatcgataagcctgtgtgctttgtcgggcgtttagaaaagattcatcccaccggcaaaatgtttatactgtccgatggagaaggtaaaaacggaactattgagctgatggaacctcttgacgaagagatcagcggtatcgttgaggtggtcggccgagtgaccgccaaggcgacgatcctctgtacgagttacgtccaattcaaagaggactcacacccattcgacctggggctttacaacgaagcagtgaaaatcattcacgactttccccagttttatccactgggcattgtgcagcacgactag

SEQ ID NO: 223365 - DNA, 1413 bp, Artificial Sequence
  Description of Artificial Sequence: Synthetic coding sequence
atgtttccggctggtccacctagccattcactgttaagactgcccctcctgcagctgctgctgctggtggtgcaggctgtggggagaggcctgggacgggcaagccctgcagggggacctcttgaggatgtagtaatagaacgatatcacatccccagagcttgcccacgtgaagtgcagatgggcgacttcgtacggtaccattacaatggaactttcgaggatggcaagaagttcgatagctcttatgacaggaataccctcgttgccatagtggttggggtgggacgcctcatcacaggcatggatagaggcctaatgggtatgtgcgttaacgaacggaggcgcttaattgtccctccacacttgggatatggttccatcggacttgctggcttgatcccgcctgacgccactctgtacttcgacgttgtgctgcttgacgtttggaacaaggaagacactgtccaggtatccacgctacttcgccctccccattgcccacgtatggtgcaggatggcgattttgtgcggtaccactacaacggcaccctactggatggtacttcctttgacactagctactcaaggaaccacacctacaacacctatatagggcaagggtacatcatacctggcatggaccaaggcctccagggagcatgcatgggagagcgcagaaggatcaccatccctccacacttggcttatggagagaacggaaccggcgacaagataccagggagtgccgttttgatcttcaacgtccatgtgattgactttcataaccctgccgacgtggtggagatacgcactcttagcaggccatctgagacctgcaacgagacaactaagcttggcgattttgtgcgctaccattataactgttccctgctggatgggacccagctgtttaccagccacgattacggagcaccacaggaggccaccctgggggcaaataaagtcattgagggactggacacagggctacagggtatgtgtgtcggcgaacgtagacaactcattgtgccaccccatctggcacacggagagagcggtgccagaggcgttcccggatccgcagtgttgctattcgaagtcgagttggtctcgcgcgaagatggcctgcccaccggctacctgtttgtgtggcataaggacccgccagcaaacctgttcgaggacatggacttgaacaaggatggagaagttccgcctgaggagttcagtaccttcatcaaggctcaggtctcagagggaaaaggccgacttatgcccggacaagatcccgaaaaaaccatcggggatatgttccagaatcaagacaggaatcaggatggtaagattaccgtcgacgaactgaaactcaaaagtgacgaagatgaagaacgggttcatgaagagttgtag

SEQ ID NO: 223366 - DNA, 1749 bp, Artificial Sequence
  Description of Artificial Sequence: Synthetic coding sequence
atgtttccagccggacccccaagccacagtctgctgaggctgcctctcctgcagctgctgctgctggtggtacaggccgttgggaggggtctgggtagagcatctcctgcaggaggcccactggaggatgtggtgatagaacgataccacattccacgggcttgtccaagggaggtgcagatgggggacttcgtcaggtaccactataatgggacttttgaggatggcaaaaaattcgactcatcgtacgatcgtaacaccctggtggcgatagtcgtgggtgtgggccgactcatcactggaatggaccgcggactgatgggtatgtgcgtgaacgagcgacgcagactcatcgttccgccacatctgggctacggctccatcggtctggccggtctaatcccccctgatgccaccttgtatttcgatgtggtattgttggatgtgtggaacaaagaggacacagtgcaagttagcaccttactgcgtccacctcattgcccaaggatggttcaggacggtgactttgtgaggtaccattataatggcaccctcctggatggcacatccttcgacaccagctacagcaagggcggtacatacgatacttacgtcggatccggatggctgattaaaggcatggatcaagggttgcttggtatgtgcccaggcgaacgcaggaaaattattatcccccctttcctcgcctacggcgagaagggctatgggactgttattcctcctcaggccagtttagtgttccatgttctcctcatcgacgtccacaacccaaaagatgccgttcaactcgagacgctcgagctgccacctggatgcgttagaagagcaggcgcaggtgacttcatgcgataccattacaatggttctttgatggatggaaccctcttcgacagttcgtattctcgtaatcacacttataatacttatatcggacagggatacatcatccccggaatggaccagggactgcagggcgcatgtatgggcgagaggcgcaggataactataccgccacacctcgcctacggtgagaatggaactggagacaagatcccaggttctgcggtcctgattttcaacgttcacgtgatcgatttccacaaccctgccgatgttgtcgagattcgaactctgtctcggccatccgagacatgtaacgagacaaccaagctgggagactttgtcaggtaccattataattgttcactgctggatgggactcagctgtttacatcccatgactacggagcaccccaggaagcaaccctgggcgctaacaaggtgattgagggtctggatacaggactgcaaggtatgtgcgtgggagaacgccgtcagctgattgtccctcctcatctcgcccacggggaaagcggagcgcgaggcgtccccggatccgccgtcctcttgtttgaagtggagctggtctctcgagaggacggactacctaccggttatctatttgtgtggcataaggatcctcccgcaaatctctttgaggacatggacctgaacaaggatggtgaagtgcccccagaagagttctccacgtttatcaaggctcaggtgtcagaagggaaaggcagattaatgcccggtcaggaccccgaaaagactattggggacatgtttcagaatcaggatcgtaaccaggacgggaagatcaccgtggacgagttaaagctgaaaagcgatgaggatgaggagcgagtccatgaagaattgtag

SEQ ID NO: 223367 - DNA, 1629 bp, Artificial Sequence
  Description of Artificial Sequence: Synthetic coding sequence
atgttccctgccggacccccatcacactctctcctgaggctcccactcttgcagcttctgctgctcgtcgtgcaggccgtaggccgtggccttggtagggcctccccagcaggcggacccctagaggacgtggtgatcgaaaggtatcacattccacgggcttgccccagagaagtgcagatgggagactttgtgagataccattataatggaaccttcgaggatggcaagaagtttgactcaagctacgaccggaacacactggtggccatcgtggtgggcgtaggcaggttgattaccggcatggataggggcctcatggggatgtgtgtcaacgagcgccgtcgtctgatcgttcctccacaccttggttatggctccattgggctcgcaggcctgattccccctgacgccacgctgtattttgacgtcgtgctgctagatgtgtggaacaaggaggacacagtgcaggtctccacgctgctacgaccccctcactgcccacggatggtccaagatggagattttgtgcggtatcattataatgggacattacttgatggaaccagttttgacacatcctattctaaaggtggtacctacgacacctatgtgggttccggatggttgatcaaggggatggaccagggcttgctgggtatgtgccccggtgagcgcaggaaaattatcatcccgccatttttggcctacggggaaaaaggctatggtactgtaatccctccccaggcttccctggtgttccacgtattgctgatagatgtccataaccccaaggacgcagtgcagctcgaaaccctagaattacctccgggttgcgtcagaagagctggggctggggacttcatgcggtatcactacaacggatcattgatggacggcactctgtttgatagctcctactctcgaaatcacacctataacacatatatcggacagggatatattatcccagggatggatcagggactgcagggtgcttgcatgggcgagagacggaggataacaattcctcctcatcttgcatacggcgaaaacggaacaggggacaagatccccggttccgccgtgctcattttcaatgtccatgtgatcgatttccacaatcctgctgacgtggtggagatcagaactctcagtaggccgagcgagacttgtaacgagaccacgaaattgggcgacttcgttcggtaccattacaactgtagccttcttgacggaacccagctttttacgtcgcacgactatggagcgcctcaagaggccacactgggggctaacaaggtaatcgaagggttggacacggggctgcaggggatgtgtgtcggcgagcggcgtcagctcattgttccaccacatttggcccacggagagtctggcgctcgaggtgtccccggtagcgctgttttgctctttgaggttgagctcgtgtcccgggaagacggtctgcccacagggtacctgtttgtgtggcataaagacccacctgcgaacctgttcgaggacatggatcttaataaagacggagaagtgccgcctgaggagttctccacctttattaaggcccaagtgtctgagggaaaaggcccacacgcatgggccggtccgtag

SEQ ID NO: 223368 - DNA, 246 bp, Artificial Sequence
  Description of Artificial Sequence: Synthetic coding sequence
atgggggacttcgtccgttatcattataacggaacctttgaagatggtaagaagttcgattccagctatgaccgcaacacactggtcgctattgtggttggagtaggccgactcatcactggtatggaccgtggactgatgggaatgtgcgttaatgaacgacggagactaatcgtgccccctcatcttgggtatggctccattggcctcgccggtctgatcccacccgacgcaacactatattag

SEQ ID NO: 223369 - DNA, 1161 bp, Artificial Sequence
  Description of Artificial Sequence: Synthetic coding sequence
tagatcgatgtgcataatccgaaggatgcggtccagctcgagaccctggaactgcctccgggatgtgtgcggagagccggagctggagattttatgaggtaccactacaatggatcattaatggacggcacgttgtttgactcctcttatagccgtaatcatacctataacacatacatcggccagggctatattatccccggaatggatcaggggctccagggggcttgtatgggagagcgcaggagaatcacaatccctccccacctggcttatggggagaacgggactgactcaatcggctttcttcaagggtccgctcctttacgaccattccggagtggggagggtcagcccagcctggggagggaaggcggttacgggaagaccgaaccagcataccctcaggacccagccgtgttaggagcgtctgtctcaagccccgtcaagtgggcctcacatgcggacccccagggcgacaagattcctggatcagccgtgctgatctttaacgtccacgtcatagacttccataacccagctgatgtggttgaaattcgcaccttatcccgcccaagcgagacgtgcaacgaaaccactaaactgggggacttcgtgaggtaccactataactgttctttgttggacggcacgcagctcttcacgtcacatgactacggggctcctcaggaggcgactctgggggctaacaaagtgattgaaggactggacacgggcctgcagggcatgtgcgtgggagaaaggcggcaattgatcgtgccgcctcacctcgcacacggggagagtggagccaggggagtcccaggaagcgcggtcctgctatttgaagtggagctggtgtcccgtgaggacggcctcccaactgggtacctgttcgtatggcataaagacccccctgccaatctcttcgaggatatggatctcaataaggatggggaggtccctccagaagaatttagcacattcatcaaagcccaggtgtcagaggggaaagggaggcttatgcctgggcaggatcctgagaaaaccattggtgacatgttccaaaatcaagacaggaaccaagacggaaaaattacagttgatgagcttaagctgaagtcagatgaggatgaagaaagagtccacgaagagttatag

SEQ ID NO: 223370 - DNA, 1068 bp, Artificial Sequence
  Description of Artificial Sequence: Synthetic coding sequence
atgcgataccactacaatggaagtcttatggacggcaccctattcgactccagctatagtaggaatcatacttacaatacttacatcggccaggggtatattatacctgggatggatcagggcctccagggcgcttgcatgggggagaggcgtcgaataactattccaccccatttagcctatggtgagaacgggacagatagcatcggctttcttcaaggaagtgcccctctaagacccttcaggtctggcgaaggacagccaagccttggcagggaagggggatatggcaaaaccgagcctgcctatcctcaagatcctgcagttctaggagcctccgtgtccagccccgtgaagtgggcgagtcatgctgatccccagggcgacaaaattcctgggtccgcggtactgattttcaacgtgcatgtgattgattttcataatcccgctgacgtagtcgagatcagaaccctgagccgcccaagcgaaacatgcaacgagacaacaaagctgggggacttcgtgagataccactacaattgctcccttcttgacggcacccaactttttacgtcacacgattacggagccccacaggaagcaacactgggggcaaataaagtgattgaggggctggatacaggactccagggcatgtgcgtcggggaaaggagacaattgattgtacccccacacctggcgcacggggaaagcggagcacggggagtaccgggttcggcagtgctcttgttcgaggtagagctggtatcacgtgaggatgggctgcccactggttatctcttcgtatggcacaaagatcctcccgctaacctttttgaggatatggatctaaacaaggacggcgaagttccccctgaggagttcagcacgttcatcaaggcacaagtgagtgaagggaagggcaggcttatgcctgggcaggatccggagaagaccatcggggacatgtttcaaaatcaggaccgcaaccaagacggcaaaatcactgtcgatgaattaaagctgaagtccgatgaggatgaagaaagggttcatgaggaactgtag

SEQ ID NO: 223371 - DNA, 327 bp, Artificial Sequence
  Description of Artificial Sequence: Synthetic coding sequence
atgggagtggagatcgagaccatttcgccaggtgatggcaggacattccccaagaaaggacaaacgtgcgtcgtgcactataccggtatgctgcagaacggcaaaaaattcgactcctcacgcgaccggaacaagcccttcaaattccggatcggcaagcaggaggtgatcaagggttttgaggagggcgctgctcaaatgtcactgggccaacgagcaaaattaacatgtacccccgatgttgcctatggcgctacggggcatcccggagtgataccaccgaacgcaacactgatctttgatgtggaactgttaaatctggagtag

SEQ ID NO: 223372 - DNA, 243 bp, Artificial Sequence
  Description of Artificial Sequence: Synthetic coding sequence
atgggagtagagatagaaacaatatctccaggcgatggcaggacattccctaaaaagggacagacctgtgtggtgcactatactggcatgctgcagaatgggaagaagtttgattcttccagggaccgcaataagcctttcaagtttaggatcggtaagcaagaggttattaaagggttcgaagagggagcagctcaacttggaccactgtctccccttcccatctgcccacacccctgttag

SEQ ID NO: 223373 - DNA, 429 bp, Artificial Sequence
  Description of Artificial Sequence: Synthetic coding sequence
atgagactctcatggtttcgggtgttgacagtcttaagcatctgtctcagtgcggttgcgacagcaacaggagccgagggaaagcgaaaattgcagataggagtaaagaaaagagtcgaccattgcccaattaaatcccgtaaaggagatgtgcttcatatgcactatacagggaagctggaggacggcacagaatttgactcctcactgcctcaaaaccagccctttgtatttagtctgggtactggccaagttatcaaaggatgggaccaaggcttgctgggcatgtgcgaaggtgaaaaacgcaagcttgtgataccaagcgagctggggtacggagaacgtggtgccccacctaaaatcccaggtggcgctaccctcgtctttgaggttgagctgctcaagatcgaacggagaacagagctctag

SEQ ID NO: 223374 - DNA, 429 bp, Artificial Sequence
  Description of Artificial Sequence: Synthetic coding sequence
atgagattgtcctggtttagagtgcttaccgtactctccatttgcctgagcgcagtagcaacagcgacaggtgctgagggaaaacggaagttacaaatcggtgtaaaaaagagggtcgatcactgcccaatcaagtctcggaaaggcgacgtgcttcacatgcactataccggaaaattggaagatggcacagagttcgactcctcactcccacaaaaccaaccttttgtgttcagtctgggaaccgggcaggtaattaagggctgggatcagggattgcttgggatgtgcgaaggagagaagaggaagctggtaatcccgagtgaactggggtacggcgaaaggggcgctccaccaaagatccccggaggcgctactctcgtctttgaagttgagctgttaaaaattgagcggagaactgagttatag

SEQ ID NO: 223375 - DNA, 429 bp, Artificial Sequence
  Description of Artificial Sequence: Synthetic coding sequence
atgaggcttagttggttcagggtgctgacagtgctgtctatttgtttatccgccgtggccacggcgacaggcgctgagggtaagcggaagctgcagatcggagtcaaaaagagagtggaccactgtcccatcaagtcgagaaagggagacgtgctccatatgcattacaccggcaagctggaggatggtaccgagttcgactcctccctaccacagaaccagcctttcgtcttctcactggggacagggcaggtgattaaaggctgggatcaggggttactggggatgtgtgaaggagaaaaacggaagctggttatcccttccgaactaggatatggagagcgcggagcccctcctaaaattcccggtggtgccaccctcgtatttgaggtggaactgttaaaaatcgagcgacgcaccgagctttag

SEQ ID NO: 223376 - DNA, 309 bp, Artificial Sequence
  Description of Artificial Sequence: Synthetic coding sequence
atgcgtctgtcttggttccgcgtgctcacggttctgagtatctgcctttccgccgtagcgacagctaccggggctgaaggaaaaaggaagttacagatcggtgtcaaaaagcgagtagaccattgtccaatcaaaagcaggaaaggcgacgtccttcacatgcattataccggaaaactcgaggatggtacagaattcgacagttccctgcctcagaatcaacctttcgtgttttctctcggcactggccaggtgatcaaaggatgggatcagggactcctggggatgtgcgagggcgaaaagcggtag

SEQ ID NO: 223377 - DNA, 3144 bp, Artificial Sequence
  Description of Artificial Sequence: Synthetic coding sequence
atggcagtgacactcgacaaggacgcctactaccgaagagtcaagcggctctacagcaactggcggaagggggaagatgagtatgcgaatgttgacgcaatcgtcgtgagcgtgggcgtggacgaggagatcgtctatgcaaagtctactgcactgcaaacgtggctctttggctacgagctcactgacaccatcatggtattctgtgacgataagattatttttatggccagcaagaagaaggtggaatttctgaaacagatagccaacaccaaagggaacgaaaacgcaaacggggcacctgccatcaccctcctgataagggaaaagaatgaatctaataagtcttccttcgataagatgatagaggccatcaaggagtccaagaacggcaagaagattggcgtgtttagcaaggacaagtttcccggagagtttatgaagtcctggaatgattgcttgaacaaagaaggtttcgataagatcgatatatcagccgtagtagcctacaccattgcagtgaaggaagatggggagctgaacctgatgaaaaaggccgctagcattacgagtgaggtattcaacaagtttttcaaagagcgagtgatggagatagtggacgctgatgaaaaggtgaggcacagtaagctcgccgagtctgtggagaaggccattgaagaaaagaagtacttggcaggcgctgaccctagtaccgtggagatgtgctacccccctattatacagtccggtggaaattataatcttaagttttcagtggtgagtgacaaaaaccatatgcactttggcgctattacctgtgcaatggggatccgttttaagtcttactgcagtaacttggtgaggacactgatggttgatccatcacaggaagtgcaagaaaattataacttcctgctgcaactccaggaagaactgctcaaagaactcaggcacggtgtaaagatttgcgatgtttacaatgcggtgatggacgtggtaaaaaaacagaaacccgagttattgaataaaatcacaaagaatctgggattcggaatgggcatcgagttcagggagggaagtctggtaattaactctaagaaccagtataagttgaagaaaggtatggtcttttcaatcaatctcggattctctgacctaaccaacaaggagggaaagaaaccagaagagaaaacttacgcactgtttataggtgacactgtcctggtcgacgaagacgggccagccacagtcctgacgtcagtcaaaaagaaggtgaagaacgtgggtattttccttaagaacgaagacgaggaagaggaggaagaagagaaggatgaagcagaagacttacttggacgcggttcaagggctgctctgctgactgagcgtaccaggaacgagatgaccgctgaagagaaacggcgagctcaccaaaaggagcttgctgcccagctgaacgaagaagcaaaaaggcgactcaccgaacagaagggtgaacaacagatccaaaaagctaggaagtcaaacgtgtcgtataagaaccccagtctgatgcccaaggaacctcatatccgagagatgaagatctatatcgacaagaaatatgaaaccgtcatcatgcctgtcttcgggatcgctacaccatttcacattgcaactatcaaaaacatctccatgtctgtagaaggggactacacttatctgcgtattaacttttactgtcccggaagcgctcttggcaggaatgaaggaaacatctttcccaaccccgaggctactttcgtgaaggagatcacctatagagcttccaatatcaaagcccctggcgagcagactgtccctgccctgaacctccaaaacgcctttagaatcataaaggaagtgcaaaagcgatataagacaagagaggccgaagaaaaggagaaggaaggtattgtcaagcaggattctttggttatcaatctgaatagaagtaatccaaagttaaaggatctctacattaggccgaatatagcacagaaacgaatgcaggggagtcttgaagcgcacgttaacggattccggttcaccagtgtgaggggcgacaaagtggacatcctgtataataacattaagcatgcactttttcagccatgtgatggtgaaatgattattgtgctgcattttcacctgaagaacgccatcatgttcggtaaaaaacgtcataccgatgttcagttttacactgaggtgggggagataaccacagacctgggtaagcatcaacatatgcacgaccgagatgacttgtacgccgaacaaatggagcgggaaatgcgccacaagctgaagaccgcctttaagaactttatcgagaaggtcgaggcactcacaaaggaagagctggaatttgaggtgcctttccgagacctcggctttaatggggctccttaccgcagtacctgcctgctgcagcctacaagcagcgccctcgtcaacgctactgaatggcccccttttgtggtaacacttgacgaggtggaactaatccattttgaaagggtccagttccacctcaagaatttcgatatggtgattgtctataaggattactcaaaaaaggtgacgatgataaatgccatcccggtcgcaagcctggaccctatcaaagagtggctgaattcctgcgatctgaaatacactgaaggcgttcaaagtttgaactggacgaagatcatgaagacaattgttgatgatcccgagggcttttttgagcagggcggatggtcctttctggagcctgaaggtgaaggttcggatgccgaggagggtgacagcgagtcagagattgaggacgagacgtttaacccatcagaggacgattacgaagaggaagaagaggattccgatgaggattattcttccgaagccgaagagagcgattactccaaagagtctctcggaagcgaagaggaatccggaaaagactgggatgagctggaagaggaggccaggaaagctgacagagagagccgttatgaagaagaggaggaacagagcaggagcatgagccgcaaaagaaaggcctcagtacactcctcaggacgaggctccaatagggggtctcgtcattcttccgccccacccaagaaaaaaagaaagtag

SEQ ID NO: 223378 - DNA, 675 bp, Artificial Sequence
  Description of Artificial Sequence: Synthetic coding sequence
atggccgctgcagtgccgcaacgcgcttggacagtcgagcagctccgatccgaacagctccccaagaaagatattattaagtttctgcaggagcacggctcagacagcttcctagctgagcataagctgctggggaatatcaagaacgtcgcgaaaacagctaataaggatcacctagtcaccgcatacaatcacctcttcgaaactaaaaggtttaaaggcactgaatcaatctcaaaggtctcagagcaggtaaaaaacgtgaagcttaatgaggacaagcccaaggaaaccaagagtgaggagactctcgacgagggacctcccaagtacaccaagtcagttctcaaaaagggagataagacaaactttcctaagaagggagatgttgtgcactgctggtatactggaacactgcaggacgggacagtgtttgacacaaacatacagacaagtgccaagaagaagaaaaacgccaaacctctttcttttaaggtcggtgtagggaaggtgatccgcggatgggacgaggccttgttgaccatgtccaagggtgaaaaggcaaggctcgagatcgagcccgaatgggcatacggcaagaaagggcagcctgacgctaaaatcccaccaaacgccaaactgacgtttgaggtggagctggtcgatattgattag

SEQ ID NO: 223379 - DNA, 1374 bp, Artificial Sequence
  Description of Artificial Sequence: Synthetic coding sequence
atgaccaccgatgaaggcgcaaaaaataatgaagagtccccgaccgccaccgtagctgaacagggtgaggacataacgtctaagaaagacagaggtgtcctaaaaatcgttaaacgggttgggaacggagaagaaacgcccatgattggggacaaagtatatgttcactacaaggggaagctgagcaatggcaagaagtttgacagctcccacgaccggaacgagccctttgtgttttccttaggtaagggccaggtgattaaggcctgggacatcggcgtggccactatgaagaagggagaaatctgtcatcttttatgtaagccggaatacgcttacgggtcagcaggcagcttgcccaaaatcccttccaacgccaccctgttttttgaaatcgaactgctggactttaagggtgaagatctgtttgaagacgggggaattattaggaggacgaagcgaaagggtgaaggctacagcaatccaaatgagggcgcaactgtggaaatccatttggaggggcgatgtggcggaagaatgttcgactgccgcgatgtggcgttcaccgtgggcgagggggaagatcacgacatccccataggaatcgataaggctttggaaaaaatgcaacgtgaggagcagtgtatcctctatctggggcctcgatacggttttggcgaagcgggtaagcccaaattcggcattgaacctaacgccgaactgatctatgaagtgacactgaaaagcttcgaaaaggccaaagaaagctgggaaatggacactaaagaaaagttggaacaggccgctatcgtcaaagaaaagggtacagtgtatttcaaggggggaaagtacatgcaggcagttattcagtatggaaagattgtatcctggctggagatggagtacggcctgtccgagaaggagagtaaggcctccgaatccttcttgctcgctgccttcctgaatctcgccatgtgttatttgaagctcagggaatacaccaaggctgtggaatgctgtgacaaggcactcgggctcgattccgcgaacgaaaagggtctatacaggcgcggagaggctcagttgctgatgaatgagttcgaatcagcaaaaggcgattttgagaaagtgctcgaggttaatcctcaaaataaggccgctcggcttcagatctcaatgtgccaaaagaaagctaaggaacacaacgagcgagataggagaatttacgctaacatgttcaagaagtttgctgaacaggacgcgaaagaggaggccaataaggcaatggggaaaaaaacgtcagagggggtgaccaatgaaaaaggcacggactctcaggctatggaggaggagaagcctgaaggacacgtctag

SEQ ID NO: 223380 - DNA, 1374 bp, Artificial Sequence
  Description of Artificial Sequence: Synthetic coding sequence
atgacaacagatgagggggcaaaaaataatgaagaaagccccacagccaccgtagcagagcagggtgaagacattaccagtaagaaggaccggggtgtgcttaagatcgtcaagcgcgtggggaacggagaggagaccccgatgatcggcgataaagtgtacgttcactacaagggcaagctttccaacggcaagaagtttgacagcagccatgaccggaatgagccctttgtgttctctctcgggaaaggccaggtcatcaaagcatgggacatcggggttgccacaatgaagaagggtgaaatctgtcatctgctgtgcaaaccagagtacgcttatgggagtgcaggctccctgccaaagatacctagcaatgcgactctctttttcgaaatagagcttttggactttaagggagaagacctattcgaggacggtgggatcatccggcgtactaaaaggaagggcgagggttacagcaacccaaatgaaggcgctacggtcgaaattcatctggagggtcgatgcggcggacgcatgtttgactgccgcgatgtggcatttacagttggtgaaggggaggaccacgatatccctatcgggattgataaggcactagaaaagatgcagagggaggaacagtgcatactatatttgggcccacggtatggattcggggaggcagggaaacccaagtttggtattgagccaaacgctgagttaatctacgaagtcaccctgaaatcttttgagaaagctaaagagagttgggaaatggacaccaaggagaaattggagcaggcagctatagtgaaggagaagggaactgtctatttcaaaggcggaaaatatatgcaggccgtcatccagtacggcaaaatcgtctcctggctcgaaatggagtacggcctgtctgagaaggaatctaaggcctcagaatctttcctccttgccgcttttctgaacctggccatgtgttacctgaaactccgagagtatactaaagctgttgagtgctgtgataaagctctggggctggattccgcaaacgaaaaaggcctataccggagaggggaggcccagctgctcatgaacgaatttgaatccgctaagggggatttcgagaaagtgcttgaggttaaccctcaaaataaggcggctaggctccaaattagcatgtgtcagaagaaggcgaaggaacacaacgaacgcgacaggagaatatatgcaaatatgttcaaaaagtttgcagaacaggacgctaaggaagaggctaacaaagctatgggtaaaaagacttctgagggcgtaacaaacgagaagggtaccgacagtcaggccatggaggaagagaaaccagaaggacatgtttag

SEQ ID NO: 223381 - DNA, 801 bp, Artificial Sequence
  Description of Artificial Sequence: Synthetic coding sequence
ttgcttatgaaggtaccacgcacaatgaagaaggcaccgcagccactcctgctgagtagggagcgcatcctgcccccaaaagataggggggtactgaaaatcgttaagcgagttggtaacggtgaagaaacccccatgataggcgataaggtttatgtccattacaaaggcaaactttctaatgggaagaaattcgatagtagccacgaccgcaatgaaccctttgtattcagcctaggcaaaggtcaggtaattaaggcatgggatatcggagtagccactatgaagaagggggaaatctgtcatctgctctgcaagcccgagtacgcatatgggtctgccggtagtcttcccaagatcccaagtaatgccacgctgttcttcgagatcgagctgctggactttaaaggcgaggatctgttcgaagacggtggcatcatccggaggaccaagaggaagggagagggctacagcaaccctaatgaaggcgctacagtagagattcacttggaaggacgttgcgggggacggatgttcgactgtagggatgtcgccttcacggttggagaaggtgaagaccacgatattccaatagggattgacaaagcccttgaaaaaatgcagcgcgaagaacagtgcatcctatacctgggacccagacctaagaatcccggaaggtggatcccaaagaaaaactggtctcggctacccctgtctaagaggagagagccctacaccagcagatgcgtgtccccctacgccattttgagtatatccaaaaatctcttcaaatgctggtag

SEQ ID NO: 223382 - DNA, 1374 bp, Artificial Sequence
  Description of Artificial Sequence: Synthetic coding sequence
atgactaccgacgaaggagcaaaaaacaacgaagagtcccctacagcaaccgttgcagagcagggggaagatattactagtaagaaagatcgaggggtcttgaagatcgtaaaacgtgtgggcaacggggaggaaacaccaatgatcggggataaggtctatgtgcactacaagggaaagcttagtaatggcaaaaagttcgacagtagccatgaccgcaatgaaccctttgtgttttctctcgggaaggggcaggttattaaggcttgggacattggtgtcgctacaatgaagaaaggcgaaatttgtcacctcttgtgcaaacccgaatatgcttatgggtctgccggatcgctgcctaagatcccatctaatgccaccttgttcttcgagatcgaattactcgatttcaaaggagaggacctctttgaagacggcggaatcataagacgaaccaaacggaagggagaggggtattctaatccaaacgaaggagctaccgtcgaaatacacctggaaggccgttgtggcggtcgtatgtttgattgtagagacgttgctttcacagtcggcgagggcgaggaccatgacatccccattggtatagataaagctctagagaaaatgcagagggaggaacaatgcatcctctatttggggcctaggtacggcttcggagaagccggaaaaccaaagttcgggatcgagcccaacgctgagctcatctatgaggtgacgttaaaaagcttcgagaaggccaaggagtcctgggagatggacactaaggaaaagttagagcaagctgctatcgtgaaggagaagggcaccgtatactttaaagggggaaagtacatgcaggccgtaatccaatacggtaagatcgtgtcttggctcgagatggaatacggtctgagtgaaaaggaatccaaggcatctgagtcctttcttcttgctgcttttttgaacttagctatgtgttatctgaagctgcgggagtacactaaggcagtagaatgctgtgacaaagcacttggcctcgattccgccaacgagaaaggcctataccgaagaggggaggctcagttactcatgaatgaattcgagagcgccaaaggggatttcgaaaaggtgctggaagttaatccccagaataaagccgctcggctgcagatttcaatgtgtcagaaaaaggcaaaggagcacaacgagcgggatcggagaatttatgccaatatgtttaagaagtttgcagagcaagacgcaaaagaggaagccaataaggccatggggaaaaagacttccgagggagtgactaatgaaaagggcacagactcccaggctatggaagaagaaaagcccgagggccatgtttag

SEQ ID NO: 223383 - DNA, 1374 bp, Artificial Sequence
  Description of Artificial Sequence: Synthetic coding sequence
atgacaactgatgaaggggctaagaataacgaggagagcccaacagcaactgtggcagaacaaggggaagacatcacctccaaaaaagacaggggagtgctgaagatcgtgaagcgcgtgggcaacggtgaggagacgcctatgatcggcgacaaagtctacgtgcactacaaaggcaagctgagtaatggcaagaaattcgatagctcacatgacaggaatgaaccattcgtgttttccctggggaaggggcaagtaataaaggcctgggacataggggtggcaaccatgaagaaaggcgagatttgccacctgctgtgtaagccagaatatgcatatggctccgctggttccctgcccaagatcccgagtaatgcaactctattcttcgaaattgagctcctagacttcaaaggcgaggacctgttcgaggacgggggaatcatacgcagaaccaagagaaagggggagggctacagtaaccctaacgagggcgcaacggtagaaattcacttagagggcagatgcgggggtcgtatgtttgactgcagggacgtggccttcacagtgggcgagggagaggaccacgatatccctatcgggatcgacaaagcgctcgagaaaatgcagcgggaggagcagtgcattctgtatctgggtcctcgatatgggttcggggaggctggaaaacccaagtttggaatcgagcctaacgcagaactgatttacgaagtcactctcaagagcttcgaaaaggccaaagagagctgggagatggatacaaaagaaaaattggaacaagccgcaatcgtcaaagaaaaggggactgtatatttcaaaggcggaaaatacatgcaagcagtaattcaatatggcaaaattgttagttggttagaaatggagtacggtctgtctgagaaagagtctaaagccagtgagtctttcctgctggcggcatttttgaaccttgcaatgtgttatctgaaactccgggaatatactaaagcagtcgagtgctgcgacaaagcgttaggcctagacagtgctaacgagaaagggctttatcgcaggggggaggctcagctgttaatgaacgaattcgagtccgccaagggggactttgagaaagtgctcgaagtgaacccacagaacaaggcagccagattgcagatctcaatgtgtcagaaaaaagcgaaggagcataacgaaagagatcgtagaatatatgccaatatgttcaaaaaattcgccgaacaagacgcaaaggaggaagcgaataaggcaatggggaaaaagacaagcgagggcgttactaacgaaaagggcacagattctcaggccatggaggaggagaagcccgagggacacgtgtag

SEQ ID NO: 223384 - DNA, 837 bp, Artificial Sequence
  Description of Artificial Sequence: Synthetic coding sequence
atgtttgactgcagagatgtggcctttactgtgggggagggcgaagaccatgacataccgataggcattgataaagcgctggaaaaaatgcaaagagaggaacaatgtatcttatacctcggacctcgatatggttttggggaggcaggcaagccaaaatttggaattgagccgaacgccgaactgatctacgaggtgactctgaagtccttcgaaaaagctaaagagtcatgggagatggataccaaggagaagttagagcaggcagccattgtgaaagagaagggaaccgtctatttcaaaggagggaagtatatgcaggctgttattcaatacgggaagatcgtgagctggctggagatggaatacggcctgagtgagaaggaatcaaaggcaagtgagagcttcctcctggcggctttcctgaacctggcaatgtgttacctgaagcttcgtgagtatacaaaagctgttgagtgctgtgataaggcactaggactcgactctgccaacgaaaaagggctctatcgcagaggcgaggcacagcttctgatgaacgagttcgagagtgccaagggtgacttcgaaaaggtgcttgaagtgaatccccagaacaaagcagcacgtctgcagataagcatgtgtcaaaagaaagcaaaggagcacaatgagagggaccgcaggatctatgcgaacatgtttaaaaaattcgccgaacaggatgcaaaggaagaggcaaacaaagcgatgggaaagaagacatctgaaggggtgaccaatgagaagggcactgattcccaagcaatggaggaggagaaaccagaaggacacgtatag

SEQ ID NO: 223385 - DNA, 807 bp, Artificial Sequence
  Description of Artificial Sequence: Synthetic coding sequence
atgacgactgacgagggagctaaaaacaatgaggagagccctacggctacggttgccgaacaaggtgaggatataacaagcaaaaaggatagaggggtgctgaaaatagtcaagagggtcggaaatggcgaagagacaccaatgattggtgataaagtctacgtccactataagggtaagcttagcaatggcaagaaattcgattcttcccacgatagaaacgagccattcgtgttttctctaggaaaaggacaggtcataaaggcctgggacatcggcgtcgccaccatgaaaaagggagagatttgccatctgctctgcaagccggaatacgcttacgggtcagccggaagcttgccaaagatcccgagcaatgccacgctgttttttgagattgaactcctcgactttaagggcgaggacctgtttgaagatggcggaattatccggagaacaaaacggaagggtgagggctatagcaatcctaacgagggcgcaacggtggaaatccaccttgaggggaggtgcgggggtaggatgttcgattgtagagacgttgcattcaccgttggcgaaggagaagatcatgatataccaataggaattgataaagccctggaaaagatgcaacgcgaggagcagtgtatactctacttggggccacggcctaaaaacccaggccgatggatccccaaaaagaattggtcaaggctgccgttgagcaagagaagggagccatacacgagtagatgcgtgtctccgtatgccatactgagcatatcaaagaacctgtttaagtgttggtag

SEQ ID NO: 223386 - DNA, 1263 bp, Artificial Sequence
  Description of Artificial Sequence: Synthetic coding sequence
atgactacggagcagggcgaggaaactcccatgatcggcgataaggtgtatgtccattacaagggcaagctatccaatggcaagaagttcgacagctcccacgatcgcaacgagccatttgttttcagtctgggaaaaggacaggtcattaaagcttgggacattggggtcgcaaccatgaagaagggggaaatttgtcatctgctctgtaagccagaatacgcttacggttccgctggtagcttacctaagattccgagtaacgccacactattcttcgaaatcgagctactcgatttcaaaggcgaagacctcttcgaagacggcggtatcataagacgtactaagcggaaaggcgaaggttatagcaatcccaatgagggggctacagttgaaatccacctggagggcagatgcgggggaaggatgtttgattgccgggacgtggcgttcacagtcggggaaggcgaggaccatgatattcccattgggatcgataaggctttagaaaaaatgcagagggaggagcagtgcatcctctacttggggcctagatatggctttggagaggccggaaagcctaagttcggaattgagccaaacgcagagcttatctatgaggttaccctgaaatcatttgagaaggccaaggaatcctgggagatggacaccaaggaaaagctcgagcaagctgcgattgtcaaagagaaaggcacagtttatttcaaagggggaaaatatatgcaggcagtgattcaatacgggaagatagtttcatggctggagatggaatacggactgtctgaaaaagaatctaaggcttccgagagttttttactggcagctttcttgaacctcgcaatgtgttatcttaagctccgagaatacacaaaggcagtggagtgctgcgataaagccttgggattggacagcgctaatgaaaaaggcctctaccgcaggggcgaggcgcaactgctgatgaacgaatttgagagcgcgaagggcgattttgagaaggtgcttgaagttaatccacagaacaaggccgcacggcttcagattagcatgtgtcagaaaaaggccaaagaacataatgaacgggataggagaatctatgctaacatgttcaagaagtttgccgagcaagacgcaaaagaggaagcgaataaggctatgggtaagaagacatctgaaggcgttaccaacgagaaggggacagactcacaagccatggaggaggagaagccggagggtcacgtgtag

SEQ ID NO: 223387 - DNA, 984 bp, Artificial Sequence
  Description of Artificial Sequence: Synthetic coding sequence
atggggggtagtgcacttaaccagggcgtgctggaaggagatgatgctcctgggcaaagcctgtacgagcggctcagccaaagaatgctagacatctcaggcgacaggggtgttctgaaagatgtgatcagggagggcgctggcgacctggtggcaccagatgcatccgtgttggttaagtacagcggctatctggaacacatggaccggccattcgacagcaactatttccgcaagacgccaaggttaatgaaattgggagaagatatcacgttgtggggcatggaactggggcttcttagcatgcggcgtggcgagctggccagattcctatttaagcccaattatgcttacggtacattgggctgtccaccactgataccccctaacacaacggtactttttgaaatcgagcttctagactttctggattgcgccgaaagtgataaattctgcgcgctttctgccgagcagcaggatcagtttccactgcaaaaggtgctaaaggtggccgcaacagagcgggagtttgggaactatctattccggcagaataggttctatgacgccaaagtgcggtacaagcgggctctgctgttactacgcagacggtcagccccaccggaggagcagcatctcgttgaggccgctaaactgcccgtgctgttgaacctaagttttacctatttgaagctagatcggcctactatcgccctgtgctatggagaacaggccctaattattgatcagaaaaacgccaaggccctatttcggtgcgggcaagcttgtctactcctcaccgagtatcagaaagcgcgagacttcctcgtgagggctcagaaagaacagcccttcaatcatgacatcaacaatgaactgaaaaagctggccagttgctaccgggattacgtagacaaagaaaaagagatgtggcatcggatgttcgctccttgtggcgatggttctactgcaggagaaagttag

SEQ ID NO: 223388 - DNA, 969 bp, Artificial Sequence
  Description of Artificial Sequence: Synthetic coding sequence
atgtctgcaagcagttggcctcaaaatgggatgcctccttcatcgctgtacgagcggctcagccaaaggatgttggatatcagcggggaccgcggagtcttaaaagacgtaatcagagaaggagccggagacctagtggcccctgatgcatctgtgcttgtgaagtactcaggctacctggagcatatggaccgcccttttgacagcaattattttaggaaaacgccacgactcatgaaactgggtgaggatatcaccctgtggggaatggaactgggcctgctctcgatgagaagaggcgaattggctagattcctctttaagccgaattatgcctacggaacattaggctgtcctcccctgataccacccaacactacagtcctgtttgagatagagctgctcgacttcttggattgcgctgaaagcgacaaattctgcgctctgtcagccgagcagcaggaccagtttccactccagaaggtgctgaaggtcgcagccaccgaaagggagtttggaaattatttgtttaggcagaacagattctacgatgccaaggtccggtataagcgtgccctgctgttgctgcggagacgttcagcgcctccagaagaacaacatctggtcgaggccgctaaactgcctgtcctgttgaatctatccttcacgtacctgaaactggatcgacctactattgctctttgttacggcgagcaggctttaatcatcgatcagaagaatgcaaaggcactgtttaggtgcggtcaggcctgcctgctacttaccgagtatcaaaaggccagggattttctggtccgggctcagaaggaacagccgttcaaccacgacattaacaatgaactcaaaaaattagcaagctgttaccgtgactacgtcgacaaagaaaaggaaatgtggcatagaatgttcgctccttgcggggatggatctacggctggcgagtcctag

SEQ ID NO: 223389 - DNA, 531 bp, Artificial Sequence
  Description of Artificial Sequence: Synthetic coding sequence
atggacttgcccgactccgcgtctagagtcttttgtggcaggatcctgagtatggtgaacaccgacgacgtgaatgcgattatcttagcgcaaaaaaatatgctggaccgctttgagaaaactaatgagatgctactcaatttcaataacctgagtagcgctaggcttcagcagatgtccgaaaggtttctgcaccatactcgcacactcgtcgaaatgaagcgcgatctcgactccattttccgtcggatcaggaccttgaaaggcaagctcgccagacaacaccctgaggcattttcacatattccggaggcgtctttcctggaggaggaagacgaggaccccattcctcctagcaccacgaccacgatcgccactagcgagcaaagcacgggatcctgcgacacttcacctgatactgtgagcccctccctgtcacccggatttgaagacctgtcacacgtacagccaggaagccccgctattaatggccgatctcagacagatgatgaagagatgacaggagagtag

SEQ ID NO: 223390 - DNA, 1326 bp, Artificial Sequence
  Description of Artificial Sequence: Synthetic coding sequence
atgggcgtgggggcaggcagagttagccaaagcggggctccatccccgggaggtgccggtcgggctaattcttgcccaccatctagcatggcatcgtgtgctgaaccatcagagccaagtgcgcctcttccggcaggtgtacctccattagaggattttgaggtgttggacggagtagaagacgctgagggcgaggaagaggaggaggaggaggaagaagaagaggatgacctcagcgagcttccacctctggaggatatgggccagccgcctgccgaagaggctgaacaacctggtgctctggcaagagagtttttagcggcaatggagcccgaaccagctccagcccctgccccagaggaatggttggacattctgggaaatggactgctgcgtaagaaaaccttagtccccggtccccctggctcatcaagaccagtcaaaggacaggtggtcactgtgcacctgcagacctctcttgagaacggaaccagagtgcaagaggaacccgagttggtgttcactctgggcgattgtgacgttattcaggccctggacctttccgtgccgctcatggatgtgggtgaaacggctatggtgactgcagactctaagtactgctacggaccacagggtcgctctccgtacattccaccacacgcagcattatgtctcgaggtcaccctgaagaccgccgtcgacgggccagatcttgagatgcttaccgggcaggagagggtcgctttagccaatcgtaagagagagtgcggtaatgcgcactaccagcgggcagattttgtccttgccgcaaacagctatgatctggccataaaagccatcacctctagtgctaaggttgatatgactttcgaggaggaagcacagctcttgcagcttaaggtgaaatgcctgaacaatttggcagccagccagctcaaactggaccattatagggccgcactgcgttcttgctcacttgtcctagagcaccagccagacaatatcaaagcgttatttagaaaaggcaaggtgcttgctcaacagggagaatactccgaggcgatccccattttgagagctgcactgaaactcgagccctcgaataaaaccattcacgccgagctttctaaactggtaaagaagcacgcagcccagcgttcaacggaaaccgcattgtaccggaagatgctggggaaccccagccgccttcccgcaaagtgccccggtaagggggcatggagcatcccctggaaatggctgtttggggcaactgccgttgccctgggaggcgtggcactatccgttgtgatcgccgctcggaactag

SEQ ID NO: 223391 - DNA, 762 bp, Artificial Sequence
  Description of Artificial Sequence: Synthetic coding sequence
atggcaagttgtgccgagccatccgaaccctccgcgcctcttcctgctggcgtgcccccactggaggattttgaagttttagacggagtggaagatgccgagggggaggaagaagaagaagaagaagaagaagaggaagacgacctgtccgagttaccaccactcgaggacatgggacagcctcctgcagaggaggcagaacagcccggtgcgctggcaagggagttcttagctgcgatggaacctgagcctgccccagctcccgcacctgaagagtggctcgatatcctcgtcgatatgactttcgaggaagaagctcagctcttgcagctgaaggttaagtgcctcaataacctggcagccagtcagctgaagttggatcattaccgcgctgctcttaggtcctgcagccttgtcctggagcaccagccagataatataaaggccctcttccggaaaggcaaggttttggctcagcagggggagtactctgaggccattcccatactcagggcagcccttaagctcgaaccaagcaataagacaatccatgctgaacttagcaagctagtaaaaaaacacgctgcccagcggtccactgaaacggcgctgtaccgcaagatgctgggaaatccaagccgcctacctgctaaatgccctggcaagggtgcctggtcaattccctggaaatggctgttcggtgccaccgccgtggcccttggaggcgttgctctttctgtagttatcgccgcacgcaactag

SEQ ID NO: 223392 - DNA, 1599 bp, Artificial Sequence
  Description of Artificial Sequence: Synthetic coding sequence
atggccaagcgcgttgctatcgtgggggcaggagtctccggactcgcctccattaaatgttgcctggaagaaggcctcgagcccacttgtttcgagaggtctgatgacttgggaggtctctggaggtttaccgaacacgtcgaggagggaagggcctccttgtataagagcgtggtgtcaaattcgtgtaaagagatgtcttgttactcagacttccctttcccagaagactacccaaattatgttccaaacagccagtttctcgaatacctgaagatgtatgccaatcactttgacctactgaaacacattcagtttaagaccaaagtttgtagcgtgaccaaatgctcagactcagccgtctcaggccagtgggaggttgttacaatgcacgaagaaaagcaggaaagtgctatcttcgatgctgtaatggtttgtaccggcttccttactaatccataccttccgctggacagtttccccggtatcaacgcgttcaaggggcagtacttccacagcaggcagtacaagcatcccgatatctttaaggacaagcgggtgctggtgattgggatgggcaatagtggtaccgacatcgcagtggaagcaagtcaccttgccgagaaggttttcctttctacaaccggaggagggtgggtgatttccaggatttttgactccgggtacccttgggacatggtatttatgacaagatttcagaacatgctgcgcaacagcctacctaccccaattgtgacgtggctgatggaaaggaagatcaataattggctgaaccacgcaaattacgggctcatccctgaagaccggactcagcttaaggagtttgtccttaatgacgaactccctggacgcataattaccggaaaagtttttatcagaccatctattaaagaggtgaaggaaaactccgtcatctttaataacacatcaaaagaggagcctattgacatcattgttttcgctacaggctacacatttgcatttccattcctagacgagtcagttgtgaaagtggaagatgggcaggctagtttatacaaatacatctttcccgctcacttgcagaaaccaaccctggccataattggcctgatcaaaccccttggatccatgattccaacaggcgaaacacaagcgaggtgggccgttagagtgctcaaaggcgtgaataaactgccacctccctctgtaatgatagaagaaataaatgccagaaaagaaaataaaccttcatggttcggcctgtgttattgcaaagccctgcagagcgattacattacatacatagacgagctcctgacctacatcaacgctaaacccaatctgttcagtatgctcctgacggacccccacctcgccttgactgtatttttcggaccctgtagcccctaccagttccgactgacgggaccaggtaagtgggaaggagcacggaacgctatcatgacccagtgggaccgaacctttaaggtcatcaaggctcgggtagttcaagaaagcccctcaccttttgaaagctttcttaaagtgttcagtttcttggcattgcttgtcgcgatctttctaatttttctgtag

SEQ ID NO: 223393 - DNA, 1599 bp, Artificial Sequence
  Description of Artificial Sequence: Synthetic coding sequence
atggccaagagggtggcaattgttggggctggagtctcaggtctggcatcgatcaagtgttgtctcgaagaaggactcgaaccgacttgctttgaacggtcggatgaccttggtgggctgtggcggtttactgaacacgtggaggagggcagagcctccctttataaatccgtggttagcaactcctgtaaagaaatgtcatgttactcagatttccctttccctgaagactacccaaattacgtcccgaactcccagttccttgagtacctgaagatgtacgctaaccactttgatctccttaagcacatacagtttaaaaccaaagtttgctcagtgacaaagtgcagtgattctgccgttagcggccaatgggaggtagtcaccatgcacgaggaaaagcaggagagcgctatcttcgatgccgtgatggtatgtactggcttcctaactaacccatacttgccactggacagtttccctggcatcaatgccttcaaagggcagtattttcactctaggcagtacaaacatcccgatattttcaaggacaaaagggtgctcgtgatcggcatgggcaacagtggaacagacattgcggtggaagcatctcacttggccgagaaagtcttcctatcaacgactggtggcggatgggtaatttcgcggatctttgattccggatacccctgggatatggtctttatgacaaggttccagaacatgttacggaactccctccctacgcctattgtcacttggcttatggagaggaagataaataattggctgaaccacgcgaactatgggctgatcccggaagatagaactcagctaaaggagttcgtattgaacgacgagctgcctggaaggatcattaccggcaaagtgtttattcgcccaagcatcaaggaggtgaaggaaaatagtgtcattttcaataacacttccaaggaagaaccaatcgatatcatcgtattcgctactggatacacatttgcattccctttcctggacgaatccgttgtgaaggttgaggacggccaggcgagtctctacaaatacatatttcccgctcacctgcagaaaccaacacttgcaataatcgggctcattaagcctctgggctcaatgatacctacaggagagacacaggctagatgggctgtgcgcgtgctgaagggtgtcaacaagttgcctccaccatctgtgatgattgaggaaattaacgcgaggaaagagaacaagcccagctggttcggcctgtgctattgtaaagcactacagtccgattatatcacttacattgatgagctgcttacgtacatcaacgctaaacccaacctctttagcatgttactaactgatccccacctcgcgcttaccgtattcttcgggccttgtagtccttatcagttccgacttaccgggcctggcaaatgggaaggcgctaggaatgcaataatgacgcagtgggataggacctttaaggtgattaaagcacgtgtagtacaggaatcaccctccccatttgagagctttctgaaagtattctcattcttagctctgttggtagccatcttcctcatttttctttag

SEQ ID NO: 223394 - DNA, 1410 bp, Artificial Sequence
  Description of Artificial Sequence: Synthetic coding sequence
atggctaagcgggtggccatcgtcggagccggagtcagcggactggcatccataaaatgttgtcttgaggaggggcttgaaccaacttgctttgaaagatccgatgacctggggggtctttggcgttttaccacgaaagtctgcagtgtgacgaaatgctctgactccgcagtgtccgggcagtgggaagtggtgaccatgcacgaagaaaaacaggaaagtgcaatcttcgacgccgttatggtgtgtaccggattcctcacaaatccatatttgcccctggacagcttcccagggattaatgcatttaaaggccagtacttccactcaagacagtacaaacatccagacatatttaaagacaagagagtccttgtgatcggcatgggcaactcagggacagatattgctgtagaagcttcacacctggcggagaaagtgtttctgtccactaccggaggcggatgggttataagccggatattcgattctgggtatccatgggatatggtatttatgactcgattccagaacatgcttaggaacagcctcccaactccaatcgtgacctggctgatggaacgtaagattaataactggcttaaccatgccaactacgggctgattcccgaggaccgtactcagctcaaggaattcgtactgaacgacgaattgcccggaaggattatcactggcaaagtcttcattcggccttcaatcaaggaagttaaagaaaactcagtcatctttaacaacacatccaaggaagaacctatcgacattatcgtattcgctactggctatacgtttgcattcccgtttctggacgaaagtgtagtcaaagtggaagacggacaggccagcttgtataagtatatatttcccgcacacctgcaaaaaccaaccctggcgataattggcctgatcaaacctctcggttctatgatcccgacgggggaaacgcaggccagatgggctgttagggttttgaaaggcgtgaacaagctccccccacccagcgtcatgattgaagagattaacgccagaaaagagaacaaaccatcttggttcggactgtgctactgcaaagcactgcagagcgactacatcacgtacatcgacgagctgttaacatatataaacgcgaagcccaatttgttttccatgttgctgaccgatccccaccttgccttgacggtgttctttgggccttgtagtccgtaccagttccgactcactggcccaggaaagtgggagggtgcacgcaacgctataatgacgcagtgggatcgtacgttcaaggtaataaaggccagggtggtgcaggagagtcctagtccttttgagagctttctcaaagtgtttagctttctggcccttctggtggcaatctttctgatattcctctag

SEQ ID NO: 223395 - DNA, 627 bp, Artificial Sequence
  Description of Artificial Sequence: Synthetic coding sequence
atggcaaaaagggtcgccatagtaggggctggagttagcgggctggcatcaataaagtgctgcttagaggaaggtctagagcccacctgctttgagcgctccgacgaccttggcggtctgtggaggtttactgaacacgtagaagaaggacgtgcttccctgtataagagcgtggtatcgaattcctgtaaggagatgagctgctactctgacttcccattccctgaggactacccaaattacgtccctaacagccagttcctggaatatctgaaaatgtacgccaaccacttcgaccttctcaaacatatccagttcaagacaaaagtgtgcagtgtgactaagtgttccgattccgcagtctccggccaatgggaggtggtgaccatgcacgaggagaagcaggaatctgccatctttgacgcagtgatggtgtgcactggattcctcacgaatccatatcttcctttggacagtttccccggtattaatgccttcaagggccagtactttcacagtcggcaatataaacaccccgatatcttcaaggacaaacgggtgttggtcattggcatgggcaattcagggactgacatagctgtggaggctagccacctcgccgagtag

SEQ ID NO: 223396 - DNA, 1830 bp, Artificial Sequence
  Description of Artificial Sequence: Synthetic coding sequence
atggaagggaaacccatgaggaggtgcaccaacattcgacctggagagactggtatggatgttacttcaaggtgtacactgggcgacccgaacaagctgcccgaaggcgtaccccagcctgctagaatgccctatatatccgataagcatccacggcaaactctggaggttattaatctcctcaggaaacatcgtgaactgtgtgacgtggtgctggttgttggagcaaaaaagatctatgcccatagagtgatactatctgcctgcagcccatattttagagcaatgttcacaggtgagctcgctgaatccagacagacagaggtggtcattcgcgatatagacgagcgggctatggagctccttatcgacttcgcctacaccagtcaaattacagtggaggaggggaatgttcagacgctcctccctgccgcttgccttctccagctcgctgaaattcaggaggcttgttgcgagtttttaaagcggcaactggaccctagcaactgcctaggaattagagcgttcgctgatactcactcgtgccgtgagctgctgcgtatagcagacaagtttacccagcataacttccaagaagtgatggaaagcgaagaattcatgttgttgcccgcaaatcagctgatcgacataataagtagtgacgagttgaatgtgcggagcgaagagcaggtctttaatgccgtcatggcatgggtgaagtactccatacaagagcgcaggccccagctaccacaggtcttacaacatgtgaggctccccctcttatcaccaaaattcctagtgggcaccgtaggctctgacccccttataaagagtgacgaggaatgtcgagacctggtggatgaagcgaaaaattacctgttactgcctcaggaaaggccactcatgcagggtcccaggacgcggcctagaaaaccaattcggtgcggggaggtgctcttcgcggtgggaggatggtgttctggagacgctatctcaagtgtagaaagatacgacccacaaactaatgaatggagaatggtagcctcaatgagtaagaggaggtgcggagtgggcgtgtctgtactggatgacctgctgtacgcggtgggtggccatgacgggtcttcgtacctgaacagtgtagaaaggtatgatccaaagaccaatcagtggagtagcgatgtcgctccgaccagcacctgcaggacttcggtcggtgtggctgtcttggggggttttctgtacgccgtcggcggacaggatggagtctcttgtctcaatattgtggagcgctacgatcccaaggagaacaagtggacacgagtggcatcaatgagcactcgcagactgggggtggcagttgctgttcttggcggattcctgtatgcagttggaggatccgatggaacttccccattgaatacagttgaaaggtacaatccacaggagaacaggtggcataccatagcacctatgggcactaggcggaaacatctgggatgcgccgtctatcaggatatgatatacgccgtggggggaagggatgacacaacagaacttagcagcgcagagcgttacaacccacgcacaaatcagtggtcccccgtagtcgcgatgaccagtcggcgatccggagtggggctggctgtagttaacggccagctgatggcagtagggggattcgatgggacgacctacctgaaaactatcgaggtcttcgatcctgacgctaacacatggcgcctttacggtgggatgaactatcggagacttggcggaggtgtcggcgtgatcaagatgactcattgcgagtcccacatctggtag

SEQ ID NO: 223397 - DNA, 1416 bp, Artificial Sequence
  Description of Artificial Sequence: Synthetic coding sequence
atggctaaaaaggtcgctgtcatcggggctggtgtctcaggcctgatttcacttaagtgttgtgtggatgagggactggagcccacatgctttgaaaggaccgaggatattggcggagtttggagattcaaggaaaacgtagaagacggcagagcgtctatttatcagagcgtcgtcactaacacaagcaaagaaatgtcatgcttttcggatttccccatgccagaggacttcccgaacttcttgcataatagcaagctgctggagtattttaggatttttgccaaaaaatttgacctgctaaagtacatacagttccagactacagtgttaagtgttcggaagtgccccgatttcagctctagcgggcagtggaaagtggtcacacagagcaatggaaaagagcaatccgctgtatttgacgctgtgatggtttgctctggccatcatatcctcccgcacatacccctgaagtcctttcctggcatggaacgtttcaagggccagtacttccactcccgtcagtacaaacaccccgacggcttcgaaggcaaacggatccttgttataggaatgggcaactcagggagcgacatcgccgtggaactaagcaagaatgcggctcaggttttcattagcactaggcatggcacttgggtcatgtctcggatatctgaggacggatatccatgggattcagttttccacacccgcttcaggtcaatgctgcggaacgttttgccccgtaccgccgtgaagtggatgattgagcagcagatgaatcgatggtttaatcacgagaattatggcctggaaccccagaataaatacatcatgaaagaaccagtattaaatgacgacgtgccctcacgcctgctatgcggggctatcaaagtcaaatccactgtcaaagaacttacagagacttctgccatatttgaggatggcactgttgaggagaatatcgatgttataattttcgccacagggtactccttcagtttcccattcctggaggatagcctcgtgaaggtggaaaataacatggtttccctctataaatatatattccccgcacatctggataagtcaaccctggcctgcatcgggctgatccagcctttaggctccattttccccaccgccgagctccaggccagatgggtgacacgggtgtttaaggggctgtgttccttaccctcagagagaaccatgatgatggacataatcaaacgcaacgagaagcgcattgatctatttggcgaatcccaatcccaaaccctgcagaccaattatgtagattacctggacgaactggctcttgaaattggcgctaaaccagatttttgttccttactattcaaggacccaaagctggctgttaggctgtactttggaccttgtaattcatattag

SEQ ID NO: 223398 - DNA, 1599 bp, Artificial Sequence
  Description of Artificial Sequence: Synthetic coding sequence
atgggaaagaaggttgcaatcatcggcgcaggggtgagcgggttggcatcgatacgttcctgcctggaggaggggctggagccaacgtgtttcgagaagtctaatgacataggtggcctttggaaattctctgatcacgccgaagaagggagagcatccatttataaaagcgtcttctctaactcgtctaaagagatgatgtgcttccctgatttcccctttcccgatgattttccaaatttcatgcacaacagtaagatccaggagtacatcatcgcgttcgccaaagaaaagaacctgttgaagtatatccagtttaaaacgttcgtttcctcggtgaataagcacccagattttgctacaacaggacagtgggatgtgaccactgaacgggacggaaagaaagagagcgccgtttttgatgccgtgatggtgtgtagcggccatcatgtttatcctaacctgcctaaggagagtttccctggactgaatcatttcaagggtaagtgctttcattcacgggattataaggaacctggggtgttcaatggaaaacgcgtcctggtggtggggctgggaaactcagggtgtgacatcgcaacagagttatcaagaaccgctgaacaggtcatgatttcaagcaggagtgggagctgggtaatgtcacgggtttgggacaacggatacccatgggatatgctcctggtgaccagattcgggaccttcctcaagaacaacctcccgactgccatctccgactggctctacgttaagcaaatgaatgccagattcaagcatgaaaattatggactcatgcccctgaacggcgtgctgagaaaggagccagtcttcaatgacgaactgcctgcatccatcctatgcggcatcgtttccgtgaagcctaatgtgaaggagttcactgagacctcggctattttcgaagatgggactatctttgaagggatcgactgcgtcatttttgcaacaggatactctttcgcctacccttttcttgacgagagcattataaaatctagaaacaatgaaattattctgttcaagggggtcttccctccacttctggagaagagcactattgctgtgattgggtttgtgcagtcactcggggcagccatacccacagtcgacctgcagtcccggtgggcggcacaggttatcaaaggaacttgcaccctgccatccatggaggatatgatgaacgacattaacgagaaaatggaaaagaagcggaaatggtttggtaaaagtgagacaatccagactgattatatagtttatatggatgaactgtcttctttcatcggcgctaagcctaatattccatggctctttctcaccgatcctaaattagccatggaggtatactttggcccttgttctccttaccagtttcggctcgtaggtcctggccagtggcccggtgctcggaacgccatcctgacccagtgggaccggtcccttaagccaatgcagactagagttgtgggcagactccaaaaaccttgctttttttttcactggcttaaactgttcgccattccaatactcctcattgcggtgtttctggttttgacttag

SEQ ID NO: 223399 - DNA, 1599 bp, Artificial Sequence
  Description of Artificial Sequence: Synthetic coding sequence
atggggaaaaaggtagcaattatcggggctggagtcagtgggcttgcctccattagatcatgcttggaagaaggcctcgaacccacatgcttcgaaaaaagcaacgatatcgggggtctctggaagttttctgaccacgcagaagaagggcgtgcgtccatatataagtctgttttcagtaacagctctaaagagatgatgtgcttcccagatttccctttcccggatgacttccctaacttcatgcataattcgaaaatccaagagtatattatcgcatttgctaaagagaaaaatttactgaaatatattcagtttaagacgttcgttagttccgtgaataagcatccagactttgctactactggccagtgggatgtcaccacggaacgggatgggaaaaaagaatccgctgtgtttgacgcagtgatggtctgtagcggccaccatgtttaccctaacctgcctaaagaatcttttcccggactgaatcacttcaaggggaaatgtttccacagccgggattataaggaacccggagtgttcaatggcaagcgtgtattagtggtcgggctggggaactccgggtgcgacatcgcgacggagctgtcacgaaccgcagagcaggtcatgatcagctcaagaagcgggtcttgggttatgtctcgagtctgggacaacggctatccatgggatatgctcttagtcacacgattcggcacttttttaaagaacaatcttccaacggctatttcagactggttgtatgtaaagcagatgaatgctaggttcaagcacgagaattatggtctgatgcccctgaatggtgtgctgaggaaagagcccgtctttaacgacgaacttcctgccagcatcctatgcggcatcgtgtctgtcaagccaaacgttaaagagtttaccgagacctcagccatattcgaggatgggacaatctttgaaggcatcgattgtgttatctttgctactggctatagcttcgcctacccctttctggatgagagtattatcaagtctcggaacaacgaaattattttattcaagggcgtctttcctcccctactggagaagtcaacaatcgccgtgattggcttcgtgcagtcgcttggcgcagcaattcccactgtcgacctgcagagtcggtgggccgcacaggtcattaaggggacttgtaccctgcccagcatggaagacatgatgaacgacatcaacgaaaagatggagaagaagaggaagtggttcggaaaaagcgaaacaattcagaccgactacatcgtgtatatggatgagctcagcagcttcataggagcaaagccgaacattccatggcttttcttgacagacccgaaacttgcaatggaagtctactttgggccatgctccccttaccagtttcgtttagtggggccaggccagtggcccggagctcggaacgctattctcacacaatgggaccgctccctcaagcctatgcaaacccgggtggttgggaggctccagaaaccctgttttttctttcactggctcaaactattcgcaatccctatcctcctgattgcagtgtttctggtgttaacatag

SEQ ID NO: 223400 - DNA, 1410 bp, Artificial Sequence
  Description of Artificial Sequence: Synthetic coding sequence
atgggcaagaaagttgcaatcatcggtgcaggcgtttctgggctggcctccatccgatcctgcttagaggaaggacttgagcctacctgtttcgaaaaaagcaatgatatcgggggtctgtggaaattctccacttttgtatcttccgttaataagcaccccgacttcgccaccaccggtcagtgggacgtcacaaccgaacgtgatggaaagaaggagagcgctgtcttcgatgccgtcatggtatgtagcggccaccatgtgtatccaaacctgcccaaggaatcctttcccggactgaaccacttcaaaggcaagtgcttccattctcgcgactataaagaacctggagtgttcaatggaaagcgcgtgctcgtggtgggtctgggcaattccgggtgcgacatcgccacagagctttccagaacggcagagcaggttatgatttcgtccaggtcagggtcttgggtcatgagccgagtgtgggacaacggatacccctgggacatgttgttggtgacacggtttggcaccttcttgaaaaacaacctgcccactgcaatttcggactggttgtacgtgaagcagatgaacgcacggtttaaacatgagaactacgggctgatgccactgaatggcgtgttgagaaaagagccagtcttcaatgacgaactccccgctagtattctctgtgggattgtctctgttaaaccgaatgtgaaggaattcaccgagacatcagctattttcgaggacggaaccatcttcgagggtattgactgcgttatctttgctactgggtacagttttgcctatccatttctcgacgagagcatcatcaagagtcgcaataatgaaatcatattgttcaagggggtttttcccccactgctggagaagagtaccatagctgtgatcggattcgttcagtctttaggcgctgcaatccccactgtggacctccagagccggtgggctgcgcaggttattaaagggacgtgcaccctgcccagcatggaggacatgatgaacgacattaacgagaaaatggagaaaaaacggaaatggttcgggaagtctgaaactattcaaactgattatatagtctatatggatgagctgtcatccttcattggcgctaaacctaatatcccctggctgtttctgacggatccaaagctggcaatggaggtctacttcggtccctgtagtccataccagtttcggctcgtggggcctggtcaatggcccggtgccaggaacgcaattctgacgcaatgggatcgatctctcaagcctatgcaaacgcgggtggttgggagattgcaaaagccatgcttcttcttccattggctcaagctttttgcaattcccatcctgctaatagccgtcttcctagtgttaacatag

SEQ ID NO: 223401 - DNA, 1539 bp, Artificial Sequence
  Description of Artificial Sequence: Synthetic coding sequence
atgccggcttccacccgctcacagaaacgacaggggatggactccctgctggagcctctaaagatgaacatggatcacgcagaggaaggccgagcctccatatataagagtgtgttttcaaatagtagtaaggagatgatgtgttttccggactttccatttcctgacgacttcccaaattttatgcataacagcaagatccaggaatatatcattgcttttgccaaagagaagaatctgttgaagtatatccagtttaagactttcgtttcctcagtgaacaaacatccagacttcgccactactggtcagtgggacgtcacaaccgagcgcgacggaaagaaggagtcagctgtgttcgacgcagtcatggtgtgctcaggccatcacgtgtacccaaatctcccgaaagagagctttccaggtctaaaccacttcaaggggaaatgcttccattccagagactataaggagcctggcgtcttcaacgggaagagagtgttagtggtagggctgggaaattccgggtgcgatattgcgacggagctctcgcgaacagctgagcaggttatgatcagtagtcggtcgggatcttgggtcatgagtcgcgtgtgggataacggctatccatgggatatgttgctggtcacccggttcggtacttttctgaaaaataatctgcctactgctatctctgactggctgtacgtgaagcagatgaacgccaggtttaagcacgagaactacggcttgatgcccctgaacggcgtgctgaggaaggagccggttttcaacgatgaactccctgcctccattctgtgcggtatcgtgtctgtgaaaccgaacgtcaaggaattcaccgaaacatccgcaatcttcgaggacgggaccatttttgaaggcatcgactgcgtcatttttgctacaggctactcatttgcctatcccttcttggacgaatccattatcaaatctcgtaataacgagattatcctctttaagggcgttttccccccattacttgagaaatccactattgcagtgattggatttgtacagagtctgggtgccgcaataccaaccgtcgacttacagtctcgttgggcagcacaggtgataaaggggacttgcacccttccaagcatggaagacatgatgaatgacattaacgaaaaaatggagaagaagagaaaatggttcggcaagtcagaaaccatccagacggattacatcgtgtatatggatgagttaagctcctttatcggggctaagccgaacatcccttggctattcctcaccgaccccaagctcgccatggaagtgtacttcgggccttgtagcccgtaccagtttaggttggtgggacccggacagtggcccggtgccagaaatgccatcttgacgcagtgggatcggtcattgaaacctatgcagacccgcgtggtcggcagactccagaaaccctgcttttttttccactggctgaagctttttgccatccccattctgctgatagctgtgttcctggtgcttacctag

SEQ ID NO: 223402 - DNA, 1677 bp, Artificial Sequence
  Description of Artificial Sequence: Synthetic coding sequence
atggccaagaaggttgccgtcattggagccggtgtttctgggctgtcctcaattaagtgttgtgttgatgaggatctggaacctacatgttttgaaaggtccgatgacatcggcggtctgtggaaatttactgagagttcaaaagatgggatgacaagggtgtataaatctttagtaaccaatgtgtgtaaagaaatgtcgtgctattcagattttccgttccatgaagactatcccaatttcatgaaccatgaaaaattctgggattaccttcaggaatttgccgaacattttgatttgcttaaatacattcagttcaagacaaccgtgtgcagtataaccaagcgtcctgattttagcgagactggacaatgggacgtcgtgactgaaaccgagggaaaacagaatcgggctgtcttcgacgctgtgatggtctgtactggccactttcttaatccccacctccccctggaagcctttccaggcatccataagttcaaggggcaaatcctgcactcccaggaatacaagattcccgagggattccagggcaaaagagtgcttgtgattggtctggggaacactggtggagacatagccgtggaactgtccagaactgccgctcaagtgctgttatcaacgcggaccggcacttgggtcctaggcaggtcatcggactggggatatccgtacaacatgatggtgacccggagatgctgtagcttcattgcccaggtgctgccgagcagatttctgaactggatccaggagaggaaactcaacaaacgcttcaaccatgaggactacgggctgagcataacaaaaggcaaaaaggctaaatttatagttaatgatgaactgccaaactgcatcctctgtggagccataacaatgaagacaagtgttatagagtttaccgagacctccgctgtctttgaggatgggaccgtggaggagaatatagacgttgtgatctttaccaccggatatacgttctccttcccgttctttgaagaacccctaaagtctctctgcaccaaaaagatctttttgtacaagcaggtgtttcctctgaacctcgaaagggccaccttggccattatcgggttaatcggcctgaaagggagcattttatctggaacagaacttcaggcccgatgggtgacaagggtcttcaaaggcctttgtaaaatccccccttcccaaaagctgatgatggaagccacggagaaggagcaactcattaaacggggagtgtttaaggatacatctaaagataagttcgattatattgcatatatggatgacattgctgcctgcatcggtacaaagccctcaattcctttgctgtttttgaaagacccacgcctggcctgggaggtgttcttcgggccttgcaccccctatcagtaccggctgatgggccctggaaaatgggatggcgcaagaaatgccatacttacgcagtgggatcgaacactgaaacctttgaagacaagaattgtgcccgactcctcaaagcctgcatcaatgagccattacttgaaggcttggggagcgccagttctgttagcctcactgctacttatatgtaagagtagtcttttccttaaattggtcagggataagctgcaagataggatgtctccatatctggtttccctatggcgtgggtag

SEQ ID NO: 223403 - DNA, 1602 bp, Artificial Sequence
  Description of Artificial Sequence: Synthetic coding sequence
atgactaagaaaagaatagctgtgattggaggaggtgtctccggactgagttcaatcaaatgttgcgtcgaggagggcctggaacctgtgtgcttcgagaggaccgatgatatcggtggactgtggcgtttccaggagaatcctgaagaggggagagcctcaatatacaaaagcgtgattatcaataccagcaaggagatgatgtgcttcagcgattaccccattcctgaccactaccctaacttcatgcataacgcacaagtcttagagtactttcggatgtatgctaaagagtttgatcttctgaaatacatcaggtttaagaccaccgtttgcagcgtcaaaaaacagccagactttgctacttcggggcagtgggaagtggtaactgaatctgaaggcaaaaaagagatgaacgtattcgacggggtgatggtgtgtactggccatcacaccaacgcacacttgcccctggagtcctttccaggcatcgagaaattcaagggtcagtattttcacagtagggattataagaaccctgagggctttaccggtaagagagttattatcattggaattggtaatagcggtggggacttggccgttgagatcagtcagacggccaaacaagtgttcctctccactaggcgaggggcatggattctcaaccgcgttggggactacggatacccggctgacgttttgttctcttctcggttgacccacttcatctggaagatttgtggccagtccctcgccaacaaatacttggagaagaaaatcaatcagcgctttgaccatgaaatgtttgggctgaagccgaagcacagagctttgtcacagcatccgacattgaacgatgacctaccaaatcgaatcatcagcggtttagtaaaagtgaaagggaatgtcaaagagttcactgaaacagcggctatattcgaggacgggtcccgtgaagatgatattgacgccgtcattttcgctacggggtactcttttgactttccatttttagaagacagcgtgaaggtcgttaaaaacaaaattagcctgtacaaaaaggtgtttcccccaaacctcgagcgacccactcttgcaattattggcctcattcagcctcttggggctatcatgcccatctccgagctgcagggacggtgggccacccaggtgtttaagggcttaaaaacgttgccgagccagagtgagatgatggccgaaatttcaaaggctcaggaggagatcgataagaggtacgttgagtcacagagacacactatccagggcgactacattgatactatggaagagctggcagatttagtgggcgtgaggccaaatttgctgtcgttagcatttacagatcccaagttggccttgcatttactgcttggcccttgtacaccaattcactacagagtgcaggggcctgggaagtgggacggcgctagaaaggccattctcaccaccgacgataggatccgcaagccacttatgacgcgtgtagtggagagatccagtagcatgacatctacaatgactattggtaagttcatgcttgccctggcatttttcgccataatcatcgcctatttctag

SEQ ID NO: 223404 - DNA, 858 bp, Artificial Sequence
  Description of Artificial Sequence: Synthetic coding sequence
atgaccaaaaagaggatcgccgtgatcggaggtggcgtcagtgggctgtcgagcattaagtgttgtgtggaggagggtctagagcctgtgtgctttgagcgaacggacgatatcggcggactctggaggttccaggaaaaccctgaggaagggagagcttcaatttacaaatccgtgatcatcaatacaagcaaggagatgatgtgcttttctgactatcctattccggatcactacccaaactttatgcataatgcccaagttctcgaatattttaggatgtacgccaaggaatttgatctgctcaaatatatccgatttaagacaacagtgtgctctgtgaaaaagcaacctgacttcgctacaagcgggcagtgggaagtggttaccgagtctgagggcaagaaggaaatgaacgtgtttgacggagtaatggtatgcaccggtcaccacaccaacgcccacttgcctctggaaagtttccctggcatcgaaaagttcaagggtcagtatttccacagcagagattataagaaccctgagggcttcaccgggaagcgtgtaataattataggaatcggcaacagtggcggagacctcgcggtggagatttctcagaccgcgaaacaagtcttccttagtacacggcgaggggcatggatcctcaaccgcgtgggagactatggataccctgccgatgtcctgttctcctctagactcacacatttcatctggaagatttgcgggcagtctctggcgaataaatacctggagaagaaaatcaaccagagattcgatcacgaaatgttcggattaaagccaaagcatcgcagcaaagacatcgctctcaccgaatag

SEQ ID NO: 223405 - DNA, 1395 bp, Artificial Sequence
  Description of Artificial Sequence: Synthetic coding sequence
atgactaagaaaagaattgcagtaatcggaggcggagtctctggactgagttctattaagtgttgcgtggaagaggggttggaacccgtatgcttcgagcggactgacgacatcggcggactgtggcgcttccaagaaaatccagaagagggaagggcaagtatctacaagtcagtgattattaacacgtccaaagagatgatgtgtttctcggactatcctatcccagatcattacccgaactttatgcacaacgcccaagtcctagaatactttcgcatgtatgctaaagaattcgacttgctgaagtacattcggttcaagaccaccgtatgctcggtgaaaaagcaacctgactttgccaccagcggccagtgggaggtagtgactgagtctgaagggaaaaaggaaatgaatgtttttgatggagttatggtatgcacgggacaccacaccaatgcccatctgccattggagtctttccccggtatagagaaatttaagggacaatacttccacagtcgcgactataaaaacccagagggtttcaccggaaaaagagttatcataatcgggataggcaactccggaggcgacttggccgtcgaaatatcacaaacagccaagcaggtctttctgagcactaggcgcggtgcatggattctcaaccgggttggagactacgggtatcccgctgacgtactgttttctagtcgccttactcactttatatggaagatctgtggccagtcactggctaataagtacctggagaagaagataaaccagagattcgatcacgagatgttcggcctgaaacccaagcaccgggcactgtcccagcaccctaccctgaatgatgatctccctaacaggataatatctgggctcgttaaggtcaaggggaatgtgaaagaattcacagagaccgccgcaatttttgaagatggatctagggaagatgatatcgacgccgtaattttcgcgactggctatagctttgacttcccgtttctcgaggatagtgtgaaagttgtcaaaaataaaatttcgctgtataagaaagtctttccacctaacctagagcgtcccacgcttgctattatcgggctgatccaaccattaggggcaattatgcccatcagtgaacttcagggcagatgggcaacgcaggtctttaagggactcaagaccttaccaagccagtctgagatgatggctgaaatttcaaaagcacaggaagaaatcgacaaatccctgactatgcgcaagacttcggacaagcctaaactgaagaacatcctccagatacccgactacctaaaaacggttaaaatcataaataaggagagcctgagaaactgtccaggaataaagggcccaaaagagacctag

SEQ ID NO: 223406 - DNA, 579 bp, Artificial Sequence
  Description of Artificial Sequence: Synthetic coding sequence
atgactaagaagagaatcgccgtgatcgggggaggagtgagcgggctgtcctctattaagtgttgcgtcgaagaaggcctggagccagtgtgcttcgagcggaccgatgacattgggggactatggcgctttcaggaaaatcccgaggaaggcagagcttctatttacaagtcagttattatcaataccagcaaagaaatgatgtgcttttcagactatccaattccagatcactaccccaacttcatgcacaacgcccaggtgctcgaatacttcagaatgtatgcaaaagagtttgatctgctgaaatacataaggtttaagactactgtttgttctgtgaaaaaacagccagacttcgccacctcaggacagtgggaagttgtaaccgagagcgaaggcaagaaggagatgaacgttttcgacggggtgatggtgtgtactggacaccacactaacgcacacctccctctggagtcttttcccggtattgagaagttcaaaggacaatactttcactcacgagattacaagaatccagagggctttacaggtaagagggtgattattatcgggtag

SEQ ID NO: 223407 - DNA, 438 bp, Artificial Sequence
  Description of Artificial Sequence: Synthetic coding sequence
atgaccaaaaagcggattgctgtcatcggcggtggagtcagcggcttgtccagtatcaaatgttgtgtggaggaggggctagaacccgtgtgttttgaaaggactgacgacatagggggactttggagatttcaggagaaccccgaggaaggacgagctagtatttacaagagcgtgattatcaacacatcaaaggaaatgatgtgcttctctgactaccccatacccgaccattacccaaacttcatgcacaatgcccaagtactggagtacttccggatgtacgccaaagaattcgacttgctcaagtacataaggtttaagaccaccgtctgtagcgtcaaaaaacagcccgacttcgccacttccggccaatgggaagttgttaccgaatccgagggtaaaaaagagatgaatgtcttcgacggagtaatgtag

SEQ ID NO: 223408 - DNA, 3810 bp, Artificial Sequence
  Description of Artificial Sequence: Synthetic coding sequence
atggaggcaacaggcgtgcttcccttcgttagaggcgtggatctgtctggcaatgattttaaggggggatattttccggaaaacgtaaaagccatgacttctttacggtggctgaaactgaatcgaaccgggctgtgttacctgcctgaggagctggcggcactgcagaagctggagcacttgagtgtgtcccataataatctgactacactccacggtgagctctcatcgctgccatctctgagagcgattgtggctcgcgctaatagcttgaagaatagcggagtgcccgacgatatattcaagttggacgacctttctgtgctggatctgagccataatcagcttaccgagtgcccaagggaactagagaacgctaagaacatgcttgtcctgaacctgtctcacaattctattgacactatccctaaccagctttttattaacctgacggacttgctctatttagacctgtctgagaatcgactggagagtttgccaccacagatgcggagactggttcacctccagaccttagttctcaatgggaaccctctgctgcatgcccaactgcgccagcttcccgcaatgaccgctttgcagactctccatttgcgctctacgcagagaactcagagcaacctccccaccagcctggagggactgagtaacctggccgacgtggaccttagctgtaatgatctgacacgtgtcccagagtgtctgtacactttgccttcacttaggaggctcaatctaagttctaaccagattaccgaactgtcactctgtattgaccagtgggtacacgtggaaaccctaaacctgtctaggaaccagctcaccagtctcccctcagccatatgcaagctcagtaaacttaaaaaactctatctcaattccaacaagctggatttcgatggtctgccatctggaatcggcaaactgactaatcttgaagagttcatggcggctaataacaatcttgagttggttcctgaaagcctgtgccggtgtcccaaattgcggaagctggtgttaaacaagaatcacctggttacgctgcctgaggccatccattttttgaccgagatagaggtgctcgacgtccgcgaaaatcctaaccttgttatgcctccaaaacccgctgaccgggcagccgaatggtacaatatcgacttctctctgcagaaccagcttcgtctggcgggagccagccctgccacagtcgcggcagctgccgctgcaggctccggccctaaggatcccatggccagaaaaatgcgtctgcggagaaggaaagactcagcccaggacgaccaggcaaaacaggtcctgaaggggatgagcgatgtggctcaggagaagaacaaaaaacaagaagaaagcgcagatgcgcgagcgcctagcggcaaagtccgacgctgggatcagggactggagaaacctagactcgactattctgaatttttcacagaagacgttggtcagctacccggtctgaccatctggcaaatcgagaactttgtccccgtgctcgtagaagaggcttttcatggtaagttttacgaagccgattgttacatcgtgctgaaaacattcttagacgactccggcagcttaaactgggagatatattattggattggtggagaggccaccctagacaaaaaagcatgctctgcaattcatgcagtgaacctcaggaattatctaggcgctgaatgccggactgttcgcgaggaaatgggcgatgagagtgaggagttcttgcaagttttcgacaatgatattagctacattgagggtggtaccgcatccggtttttacactgtggaggatacccactacgtgacgcggatgtatcgcgtgtatggaaaaaagaacatcaagcttgagccggtgcctcttaaaggaactagtctggatccacgctttgtgttcttactagaccggggactagatatttacgtgtggcgtggcgctcaggccaccctcagcagtactaccaaagcccgactgtttgctgagaagataaacaaaaatgagcgaaagggtaaagcggagattactctgttggtgcaggggcaggagcttcccgagttttgggaggccctgggaggagagcccagcgaaatcaagaaacacgtgccagaggacttctggccccctcagcccaaattgtataaggttgggcttggccttggctatctagagctgccgcagatcaactacaagcttagcgtcgaacacaagcaacgccctaaggtcgaactcatgccgagaatgcgacttctgcagtcccttctcgataccagatgcgtgtacattctggactgttggtccgatgtgttcatctggctgggaagaaagtctcccaggctggtccgggctgctgccctgaagcttggccaggaactgtgtggcatgctgcacagacctcggcatgctactgtgtcccggtcactagagggcacagaggctcaagtgttcaaggctaagttcaagaattgggacgatgtcctcacggtagattacacccggaacgctgaggccgtgttacagtcccctggcctatccggtaaagtcaagagggatgccgagaaaaaggaccagatgaaggccgatctgactgcactgtttctgccaagacagccaccaatgtcactcgctgaggcagaacagcttatggaggagtggaatgaggatttggacggaatggagggtttcgtgctcgaaggcaaaaaatttgccagactgcccgaggaagagtttggacacttttatactcaggactgttacgttttcctttgccgttactgggtccctgtggagtatgaagaggaggagaaaaaggaggataaggaagaaaaggccgaaggaaaagaaggggaagaagccaccgccgaggccgaggagaaacaacctgaggaggactttcagtgcatcgtctacttttggcaggggcgagaagccagtaacatgggttggctgacctttacattctctttacagaagaagttcgagagcctatttcctggcaaactggaagtggttcgtatgacgcagcagcaagaaaatccaaaattcctgtcccattttaagagaaagttcatcatccaccggggtaagaggaaagccgttcagggtgcacaacaaccctccctgtaccagattagaaccaacggctctgccttgtgtactagatgtatacagataaacactgactccagcctgctgaactctgaattttgtttcattctcaaggtgccctttgaaagcgaggacaatcagggcattgtgtatgcctgggtcgggagggcctcagaccctgatgaagctaagctggcggaggatatattaaacacgatgttcgacacttcctacagcaagcaggtcatcaacgagggcgaggagcccgagaacttcttttgggtcgggatcggcgctcagaaaccctacgatgacgatgccgaatacatgaagcacacccgcctgttcagatgctccaacgagaagggttactttgcagtgactgaaaagtgctccgatttctgccaagatgacctggcagacgacgacataatgctgttggataatggccaagaagtgtacatgtgggtggggacgcagacttcccaggtcgagataaaactctcattgaaggcatgccaggtgtacatccagcacatgcggtcaaaagaacacgagcgtcccaggaggctccgtttggttcgtaaggggaatgagcaacatgcatttacaaggtgctttcatgcttggtccgcgttctgtaaggcattagcttag

SEQ ID NO: 223409 - DNA, 3552 bp, Artificial Sequence
  Description of Artificial Sequence: Synthetic coding sequence
atgacctccctgagatggcttaaattgaatcgtactgggctgtgttatctgcccgaggaactcgcagcgctgcagaagttggagcacctcagtgtctcacacaacaaccttacgacccttcacggagaactatcgtccttaccctcgttgagggccattgtggctagagcaaactcgctgaaaaattcgggcgtgcctgatgacatcttcaagttggatgatctgtccgtccttgacctctctcacaaccaactgactgaatgccccagggagctggaaaacgccaagaacatgctggtcctgaatctgtctcacaatcggcagctgcccgcaatgacagccttgcagaccctccacttgcggagtacccagcgaacgcaaagcaacttacctacctctctggaaggcctgtctaaccttgctgatgtggacctcagctgtaatgatctgacaagagtgcctgaatgcctttacactctgcccagcctccgacgtctgaatctgtccagcaaccagattaccgaactttcactctgcattgatcagtgggtgcatgtggaaaccctcaatttatcaaggaatcagctcacttccctgccttcagctatttgcaaattgtctaaactgaagaaactctatcttaattcaaacaaactcgacttcgatggcctcccttccggtattggcaagctgaccaatctggaggaatttatggcagccaataacaacctggaactggtgcccgaatcactgtgtcggtgtcccaaactaagaaaacttgtgcttaacaagaaccacctcgttacactgccagaggccatccattttctcaccgaaatagaagttctggatgtgcgcgaaaaccccaaccttgtgatgccacctaaaccagccgacagagctgcagagtggtacaatatcgacttctccctccaaaatcaactgcgactagctggggctagtcctgcaactgttgctgctgcggcagccggatccggcccaaaggacccaatggccagaaaaatgcgcctgcgccgaaggaaggactccgcgcaggacgaccaggctaaacaggtcctgaagggtatgtctgatgtcgcccaggagaagaataagaagcaggaggaaagcgccgacgccagagcaccctctggcaaagtgcggaggtgggaccagggcctggagaaacccaggcttgactattctgaatttttcactgaagatgtcggtcagctgccgggattgacaatttggcagatcgaaaattttgtgcccgtgctcgtcgaggaagcgttccacgggaagttctatgaagccgattgttacattgtcctcaagacattcctggacgactccggcagtctcaactgggaaatttactactggatcggcggtgaggccactcttgataagaaagcctgtagcgctatccacgctgtgaatctccgcaactatctgggggcagaatgccgcacagtccgcgaggaaatgggagatgagagcgaagagtttcttcaggtcttcgacaatgatatttcctacattgaagggggaaccgcaagcggcttttataccgtggaggatacacattatgtgactcgcatgtatcgagtctacggaaaaaagaacatcaaactggaacctgtcccacttaaaggaacaagcctggaccctcgctttgtgtttctgctagacagagggttagacatttatgtttggaggggcgcacaggctaccctttctagcaccaccaaagcgaggttgtttgctgaaaagatcaacaagaacgagaggaaaggcaaagccgaaatcaccctccttgtccagggacaggagctgccagagttctgggaggccttaggcggtgaaccatcagagattaaaaaacatgttcccgaggacttttggccaccacagccaaagctttataaggtaggcctgggcctcggctacctagagcttccccagatcaattataagttgagtgtagagcacaagcagagacccaaggtggaattgatgccccgtatgaggcttctccagagtctcttagacaccagatgtgtgtacattctggactgttggagcgacgtctttatctggctagggaggaaaagccctcggctggttcgcgctgccgcactgaagctcggacaggagttatgcggcatgctacaccgccctcgccacgcaaccgtgagccgcagtcttgaaggcactgaagcgcaagtctttaaggccaagtttaagaactgggatgatgtcttgacagtcgactatactcggaacgctgaagcagttcttcagtctccaggcctgtctggaaaagtgaaacgggacgcggagaagaaggaccagatgaaggccgacctcactgcccttttccttcctagacagcctcccatgtcccttgcggaggcggagcagcttatggaagagtggaatgaggacctggatggaatggaaggctttgttctggaagggaagaagtttgctcgtctgccagaagaggaattcggacacttctacacgcaggattgttatgtattcctgtgtaggtattgggtacctgttgaatacgaggaggaggagaagaaggaagataaagaagaaaaagctgaggggaaggagggggaagaggccacagctgaggcagaggagaagcaaccggaagaggactttcaatgtattgtgtatttctggcaggggagagaggcatccaatatgggttggcttacatttacatttagtcttcagaaaaaatttgaatctctttttcctggcaagctggaggtggtgcgtatgactcaacagcaggagaaccctaagttcttatcccatttcaagcggaaattcattattcacagagggaaacgaaaagctgtgcagggagcccagcagccctctttgtaccaaattcggacaaatggttccgcactatgtacaaggtgtatacagataaacactgattcttccctgctcaattcagagttctgttttatcctcaaggttccgtttgaatccgaggataatcaggggattgtgtatgcctgggttggacgagcctctgaccctgacgaggccaagctcgctgaggatattttgaacacaatgtttgacacttcctacagtaagcaagtgatcaacgagggggaagagccggagaacttcttctgggttgggatcggagctcagaagccttatgacgacgatgccgagtacatgaagcacacaaggctgtttagatgctcgaacgaaaaggggtatttcgccgtgaccgaaaagtgttccgacttttgtcaggacgacctggctgacgacgacatcatgctgcttgataacggacaggaagtgtatatgtgggtgggcacacagacgtctcaggtcgaaattaagctctccttgaaagcatgtcaagtttatatccagcatatgcggagtaaggaacatgagagacccagacggctgcgactggtccgcaagggcaatgagcagcatgcatttactcggtgctttcatgcctggtcggccttctgcaaagctctggcgtag

SEQ ID NO: 223410 - DNA, 3447 bp, Artificial Sequence
  Description of Artificial Sequence: Synthetic coding sequence
atggaagcaacaggtgtgttgcctttcgtgaggggcgtggacttgagtgggaatgactttaaaggcggatattttcctgaaaatgtgaaagctatgacgtcactccggtggctcaagctgaatagaacgggtctctgctatctgccagaagagctggcagccctgcaaaaactggagcatttgtctgtcagccataataaccttacgacgctccatggagaattgtcatctctgccgtccctcagagctattgtggcgagagccaactccctgaaaaacagtggcgttcctgatgacatctttaagctggatgacctgtctgtgcttgacttgtcgcataaccagctgacagaatgcccgagagagttggagaatgctaagaatatgctagtgctaaatctaagtcacaacagtatcgacacaatacccaaccagttattcataaacctgacggatctgctctatctggacttgagtgaaaatcgcctagagagcctcccacctcagatgagaagattggtgcacctgcagacactggtgcttaacggcaatcccctcctacatgctcaattgaggcagttgccggctatgactgctctgcaaaccttgcatctgcgcagcacccagcgtactcaatccaacctgccaacctctctggaggggctttcgaatctcgccgacgtggacctgtcatgtaacgacctgacacgcgtgcccgaatgtttgtacacccttcccagtctcaggcggctcaaccttagcagtaaccagatcacagagttgagcctctgtattgatcagtgggtccacgtcgagactctgaatttatcacgcaaccagctcacatctctgcctagcgctatatgtaagctgtctaagcttaagaaattgtatctcaatagtaataaattggattttgacgggctgccgtccggaatcgggaagctgactaacctggaagaatttatggcagccaacaataatcttgaactggtgcctgaatctctgtgtaggtgtcctaaactcagaaagctcgtgctcaacaagaaccacctagttacccttccggaagcaatacacttcctcaccgagatcgaagttctcgatgtacgggagaatccaaacctggtgatgcctccaaaacccgcagatagggcggctgaatggtataacatagatttctcacttcaaaatcaactacgacttgcaggagcttctccagccaccgtggctgccgcagcagcggctggctctggacccaaggacccaatggctcggaaaatgaggcttcgccgaaggaaagattctgcccaggatgatcaggcaaagcaggtcctcaaggggatgagcgatgtggctcaagagaaaaataagaagcaggaagaaagtgccgatgccagagccccttccggtaaggttcggagatgggatcagggcctcgaaaaaccaaggttagattattccgagttttttacagaagatgtcggacagctgccagggctcacgatttggcagatagagaactttgtccccgtactggttgaagaagcttttcatgggaagttctacgaggcagactgctacatcgtgcttaagactttcctcgacgattctggatctctcaattgggaaatttattattggatcgggggtgaggccacgctggacaagaaggcatgcagcgccatccacgcggttaatttgcggaactacctcggggctgaatgtagaaccgttcgggaagaaatgggcgacgagtctgaagaatttctgcaggtgtttgacaacgacatttcctacatcgaagggggaacagctagcggtttctacacagtagaagacactcactacgtgacccgcatgtaccgtgtctacggcaagaaaaacatcaagctcgagcctgtccccctgaagggcacttcacttgaccctcggttcgtctttctgctggatcggggacttgacatctacgtgtggaggggcgcacaggctacactgtccagtaccaccaaggcaaggctgtttgccgagaagattaataagaatgagcgtaagggcaaagccgagatcaccctgttagtccagggccaggaactgcccgagttctgggaggctcttggtggcgaaccttctgaaatcaaaaagaactgggacgacgtgttgactgtggattacacccgaaacgccgaagccgttctacagtccccagggcttagtggaaaggtgaagcgggacgctgagaaaaaagatcagatgaaagctgacctgactgccctgtttctgcctcggcaacccccaatgtccctggccgaggccgagcagctcatggaagagtggaacgaagacctggatgggatggaaggcttcgtcctcgaaggcaaaaaattcgcaaggctcccggaagaggagttcgggcacttctatactcaggactgctacgtcttcctgtgccgctactgggtgcccgtggaatacgaagaggaggagaaaaaagaggataaagaggaaaaggcggagggcaaggagggtgaggaggccaccgcggaggcagaagaaaaacagccagaagaggattttcagtgcatcgtctatttctggcaggggcgtgaagcatcaaatatgggatggttgaccttcacctttagcctgcaaaaaaaattcgagagtctctttcctggcaaattggaggtggtgcgcatgacccagcagcaggagaatccaaagtttctaagccacttcaaaagaaagtttattatccaccgcggaaaacgcaaagctgtacagggagcacagcagccttcactgtatcagatcagaacaaatggcagcgcactttgcacacggtgcattcagatcaacaccgactcctccctactcaattcagagttctgcttcatcctcaaggttccattcgagagtgaagacaaccaaggaatagtgtacgcctgggtcggccgagcctctgatcccgacgaggcgaagctggctgaagatatcttaaatactatgttcgatacgtcttactccaagcaggtaataaatgagggggaggagcccgaaaactttttttgggtggggattggcgctcagaagccctatgacgatgatgccgagtacatgaagcacacccggttgtttcgctgttctaatgagaagggctacttcgccgtgactgaaaagtgcagcgatttttgccaagacgatctggcagacgatgatattatgctgctagacaacggacaggaggtgtatatgtgggtggggactcaaacaagccaggtggaaattaagctgagcctcaaggcttgccaagtctatattcagcacatgagatccaaagagcatgagcggcctagacggctccgactagtgagaaaagggaacgaacaacacgcctttacccgctgtttccacgcgtggtccgctttttgtaaggctcttgcctag

SEQ ID NO: 223411 - DNA, 1284 bp, Artificial Sequence
  Description of Artificial Sequence: Synthetic coding sequence
atgttctttacctgtggacctaatgaagctatggtggtaagcggcttttgccggtcaccacccgtcatggtggcgggtggccgagtgtttgtgctgccctgcattcagcagattcagcgtatcagcctgaacaccctcactctgaacgttaaaagcgagaaagtgtatacccgccacggcgtcccgatctccgtcacaggcattgcacaggtgaaaatccaagggcaaaataaggagatgttagccgctgcctgtcaaatgtttttaggtaagactgaggcagaaatcgcccacatcgcccttgagacactggaaggacaccaaagagccataatggctcatatgacagtcgaagagatctacaaggatcggcagaaattcagcgaacaggttttcaaggtagccagcagcgatctggtgaatatgggcatcagcgtggtcagctatacacttaaagatatccacgatgaccaggactacctacactccctgggtaaggcacggacagctcaggtgcaaaaggatgcccgaattggcgaagctgaggcaaaaagggatgccggaatccgcgaggccaaggctaaacaggaaaaggtgtcagctcagtacctgtccgagatcgaaatggccaaggcacagagggattatgagctgaaaaaagccgcatatgatatcgaggtgaacacacggagagcgcaggccgatctcgcttatcagctgcaagtcgccaagaccaagcagcagattgaagagcagcgggtgcaggtacaggtggtagagagggcccagcaagtcgcagtgcaggagcaggaaatagctcgccgagagaaggaactggaggcccgagttcgcaaacccgctgaggccgaacggtacaagcttgaaagactcgctgaagccgagaagtcccaacttattatgcaggccgaggccgaagcggcttctgtacgcatgaggggcgaagccgaagcattcgccataggagccagagccagagccgaggccgagcaaatggccaagaaggcggaagcgttccagctgtaccaggaggccgcacaattagacatgctgcttgagaagttgccccaggtggctgaagaaatctcaggacccctgaccagtgctaacaaaatcactctcgtgtcctcaggatcaggtacgatgggggctgccaaggtgactggcgaggtgctcgacatcctaacgaggctgcctgagtccgtcgagagactgactggagtctctatttctcaggtgaaccataagccattgagaactgcctag

SEQ ID NO: 223412 - DNA, 1284 bp, Artificial Sequence
  Description of Artificial Sequence: Synthetic coding sequence
atgttctttacatgtggtcctaatgaggccatggtggtgtctggtttttgtaggtcacccccagtcatggtggcagggggaagagtctttgttttaccttgtatccagcagatccaaagaatcagtctcaacactctcaccctcaacgtgaaatccgagaaagtctacaccaggcatggggttcctatttctgtgacaggtatcgcacaggtgaagatccaaggacaaaacaaggagatgcttgcggcagcctgtcagatgttcctggggaaaactgaagccgaaatagcgcatattgcccttgaaacccttgaggggcaccagcgggcaatcatggcacatatgacagtggaggagatttacaaagaccgccagaaattttcagaacaggtttttaaagtagcaagcagtgacctggtgaacatgggaatttcagtggtttcatacactctgaaggacatccatgatgaccaggactacttgcatagcctaggcaaggctcggactgcgcaggtgcaaaaagatgcccgaatcggagaggccgaggccaagagagatgcaggcatacgcgaagctaaggccaaacaggagaaggtctccgctcaatatttgtccgaaatagagatggccaaagcccagagagattacgaactgaagaaagctgcgtatgacattgaagtcaacacccggcgagctcaggcggatcttgcctatcagctgcaggtagctaagacaaaacagcaaattgaagaacagagagtacaggtccaggtcgtggaacgggctcagcaggtggctgtgcaggagcaggaaatcgcccgaagagagaaagaactcgaagcgagggtcagaaagcctgcagaagccgaacgctacaagctggaaaggctggccgaagcagagaagtcccagctgataatgcaggctgaagcggaggcagctagcgtgcgcatgagaggagaggccgaggcatttgctataggtgctagagcccgagctgaggccgagcaaatggctaagaaggccgaggcatttcagttatatcaggaggccgctcagcttgacatgctgctggaaaagctgccccaggtggccgaggaaatctcaggcccattgaccagcgccaataaaatcacactggtttcgtcggggagcgggacaatgggggcagccaaggtaaccggagaagtgctggacatcctaaccagactgcccgagagtgtcgagcgcctcaccggtgtgagtatttctcaagtcaaccacaagccactgcggacagcttag

SEQ ID NO: 223413 - DNA, 1284 bp, Artificial Sequence
  Description of Artificial Sequence: Synthetic coding sequence
atgttctttacttgtggaccaaacgaggccatggtcgtttccggcttctgccggtcaccacctgtaatggtggcagggggtcgagtcttcgtactgccctgtattcagcaaatccagagaatctcactgaacactctcactctcaatgttaaatcggaaaaagtgtacacccgtcacggagtacctatttctgtaaccggaatcgctcaggtcaagattcagggacagaataaagagatgttagctgcggcatgccagatgtttctgggtaagaccgaggccgaaattgcccatatcgcgctggagaccttggagggtcatcagagagctattatggcccacatgacagtggaagagatctacaaggacaggcagaagttctctgaacaggtatttaaagtggcctcttctgacttagtgaatatggggatctcagtggtttcgtacaccttgaaagacattcacgatgaccaggactacctgcactcactgggcaaagctcgaactgcacaagttcagaaagatgctaggatcggagaggcagaagccaaaagggacgctggtatccgcgaggccaaggccaaacaagagaaggtaagcgcccagtacctgtcagaaattgagatggctaaagctcagcgcgactatgaactcaagaaggccgcttatgatattgaggtgaacactcgcagggcccaggccgatctggcataccagcttcaagtcgcgaagacaaagcagcagattgaggagcaaagagtgcaggttcaggtcgtggagagagctcaacaagtcgctgtgcaagaacaggaaatcgccaggcgggagaaggagctggaagctcgcgtgcggaagccggcagaggccgagagatataagctcgagcggctggccgaagctgaaaaatcccagctgatcatgcaggccgaggccgaggcggcttccgttcggatgaggggcgaagctgaagcttttgctattggggcacgcgctcgagcggaggcagagcagatggccaaaaaggcagaagcttttcagctctaccaggaagccgcacagctggacatgctcctggaaaaattgccacaagtggcggaagaaattagcggccctcttacaagcgctaataaaattactctggtgtcctccggtagtggcaccatgggggcagctaaggtgacgggggaagttttggacatactgacgcggctccccgagagcgttgaacgactgacaggcgtgtcaatcagtcaggtaaaccacaagcccctaaggacggcatag

SEQ ID NO: 223414 - DNA, 438 bp, Artificial Sequence
  Description of Artificial Sequence: Synthetic coding sequence
atgggagtggagggaacagggagggggggttgcaggctaggaggccctgatggcaaaggcaagggatgggccccagtggacgctacggcacgccttccgcaccctcagaggctgagcctcccactgctccaactccagcctgaaccttgcttcagcctggtggctcaaatgcggccatggtggagcccagactacttgcattcgctcggtaaggctcgaacggctcaggtccaaaaagacgcccgaattggggaggccgaggctaagagagacgccggaatacgggaggccaaagccaaacaggaaaaggtgagcgcacagtatctcagtgagatagaaatggccaaagctcaaagggactatgagctgaagaaggcggcttacgatattgaggtgaacacccggagggctcaagctgacctcgcataccagctctag

SEQ ID NO: 223415 - DNA, 579 bp, Artificial Sequence
  Description of Artificial Sequence: Synthetic coding sequence
atgttttttacctgtggtccaaatgaagccatggtggtgagtggattctgcaggtccccccctgtgatggttgcaggcggacgggtcttcgtactgccttgtatccaacagatccagagaatctcactgaataccctgactctcaacgttaaatccgaaaaggtgaaaatacaggggcaaaataaggaaatgctggcagcagcgtgtcaaatgttcttaggaaagaccgaggccgagatcgcccatattgcgctcgaaactctggaagggcaccagcgcgcaattatggcccacatgacagtcgaagagatctataaggatcgtcagaaattttctgagcaggtgttcaaggtcgctagttcagatctggtgaatatgggtattagcgttgtcagctataccctgaaagacatccatgacgaccaggactatctgcacagcttgggcaaggccagaaccgcccaggttcaaaaggacgccaggatcggggaggctgaggccaagcgcgatgcaggcatacgagaggctaaggctaagcaagagaaggtgtctgctcaataccttagcgaaattgaatag

SEQ ID NO: 223416 - DNA, 579 bp, Artificial Sequence
  Description of Artificial Sequence: Synthetic coding sequence
atgtttttcacgtgtggccctaatgaagctatggtagttagcgggttttgccggtctccccctgttatggtagccggtggacgcgtgttcgtgttaccctgcatccaacagatccagcgcatcagcctgaacactcttacactcaacgtcaaaagcgagaaggtgaagattcaaggccaaaacaaagagatgctggcagccgcttgtcaaatgttcctcggcaagaccgaggctgagattgcgcatatcgcccttgaaacgttggagggacaccagcgggctataatggctcacatgactgtcgaagaaatctacaaggaccgacagaagttcagcgaacaagtgttcaaggtggcttccagtgatctcgttaacatggggataagcgtagtctcttacacactcaaagacattcatgatgaccaggactacttacactctctcggtaaggcccgaaccgctcaggtgcagaaggatgctcggattggcgaggccgaggccaaaagggatgctgggattcgggaggctaaggctaagcaggagaaggttagtgcccagtacctgagcgagattgagtag

SEQ ID NO: 223417 - DNA, 717 bp, Artificial Sequence
  Description of Artificial Sequence: Synthetic coding sequence
atgaggccttggtggtcccccgtgaagatacagggtcaaaacaaagaaatgctggctgcagcttgtcagatgttcttgggaaagaccgaggccgagatcgcccatatcgcccttgagaccctggaggggcatcagagggccattatggcccacatgacggtggaggagatatataaagaccgccaaaagttttcagaacaggtattcaaggtggcctcttcggatttggtcaatatgggcatttctgtcgtctcctacaccctcaaagacatccacgacgaccaggattacctgcactcgctgggtaaagcgaggacagcccaggtgcagaaagacgctcgaattggggaggccgaagccaaacgggacgctggaatccgcgaggcaaaggccaagcaggaaaaggtgagcgcccaatatctgagcgaaattgaaatggccaaggcacagcgagattatgaattgaaaaaggccgcatacgacatcgaggttaacaccagacgggcacaggccgacctggcctatcagctccaggttgctaaaacaaagcagcagatcgaagagcagagggtgcaggtgcaagtggtggagagggcccagcaggtcgcagtgcaggaacaggaaattgccagaagggagaaggaactcgaggcaagggtcagaaagcctgcagaggctgagagatataagttggagaggcttgccgaagcagagtag

SEQ ID NO: 223418 - DNA, 579 bp, Artificial Sequence
  Description of Artificial Sequence: Synthetic coding sequence
atgttttttacctgcggccctaacgaggctatggtcgtgtcgggtttctgtcggtccccgcctgtgatggtagccggaggaagggtcttcgtgctcccctgcatacaacagattcagcgcatcagcttgaacaccctgactttgaatgtgaaaagcgaaaaagtgaagattcaaggacagaacaaagagatgcttgctgctgcttgtcagatgtttttggggaagacggaggctgagatcgcccatatcgctctggaaactttggagggacatcagcgcgcaatcatggcccacatgacagtggaggaaatttacaaagacaggcaaaaattttcagagcaggtcttcaaggtcgccagcagcgacctggtgaatatggggatttccgttgtctcttataccctgaaggacatccacgacgaccaggattatttacactcactgggaaaggcacgcacagctcaggtacagaaagatgccagaatcggggaggccgaggccaaacgcgacgctggaatcagagaggccaaagcgaagcaggagaaggtgagcgctcaatatctgtcggagatcgagtag

SEQ ID NO: 223419 - DNA, 579 bp, Artificial Sequence
  Description of Artificial Sequence: Synthetic coding sequence
atgttctttacatgtggacctaacgaggccatggtcgtcagtggtttttgcaggtcacctcctgtgatggtagctggtggcagagtcttcgtcctgccatgtattcagcagattcaacgaatctcactgaacacacttaccctaaacgtaaagtctgaaaaggtgaagattcaagggcagaacaaagagatgttagccgctgcatgtcagatgttccttgggaagactgaggctgagatcgcgcatattgccctggaaacgctcgaaggacaccaacgagctataatggcacatatgacagtggaggagatttataaggaccgccaaaaattctctgaacaggtctttaaagttgccagttccgacctagtgaacatgggcattagcgtggtcagttataccttgaaggacatccatgacgaccaggattatctccacagcttgggcaaggcacgcacggcccaggtccagaaggatgcgagaatcggcgaagctgaggccaaaagggacgcaggcataagggaagcaaaggccaaacaagagaaagtgtcggctcaatacctgtcagagattgaatag

SEQ ID NO: 223420 - DNA, 438 bp, Artificial Sequence
  Description of Artificial Sequence: Synthetic coding sequence
atgggtgtcgaaggtacgggtaggggaggatgccggctaggcggacctgacggaaagggcaaaggctgggccccagtggacgcgacagcacggctgccccaccctcaacggctgagtctgcctcttttacagttgcagcccgagccatgttttagcctggtcgcgcagatgcgcccatggtggtcaccagactacctgcactccctgggtaaagctcggacagcacaggtccagaaagatgcccgtattggcgaggcagaggcaaagcgtgatgcagggatccgagaagccaaggcaaagcaggaaaaagtctctgctcagtacctgtctgaaattgaaatggccaaggctcaaagagattacgaattgaaaaaagcagcctacgacattgaggttaataccaggagggcacaggcagacctggcctaccagttatag

SEQ ID NO: 223421 - DNA, 273 bp, Artificial Sequence
  Description of Artificial Sequence: Synthetic coding sequence
tgagcaaaaaaggcagaggcatttcagctttatcaggaggctgcccaattggacatgctcctggagaagctgccccaggtcgctgaagagatttctggaccattgacatccgcaaacaagatcacattggtgtctagtggatcaggcactatgggagccgcaaaagtgactggcgaagtattggatattctgacccgtctccctgaaagcgtggaacggctcacaggcgtcagcatcagccaggtgaatcacaagcctctccggacggcatag

SEQ ID NO: 223422 - DNA, 708 bp, Artificial Sequence
  Description of Artificial Sequence: Synthetic coding sequence
atgttttttacctgcggaccaaatgaagctatggtggtctccggtttctgccggtccccaccagtcatggtcgcagggggaagagtgtttgtgctaccgtgcatccaacagatacagcgcatctctctgaacactctaacgctcaacgtcaaatcagagaaggtgtacacccgtcatggcgtccctatcagcgtgaccgggatcgctcaggtgaagatccaagggcagaacaaagaaatgctggccgcagcctgtcagatgtttctgggaaagacggaggcagagattgcacacatcgctctggagacgctggagggtcatcagcgcgctattatggctcacatgacagttgaagagatttataaagaccgccagaagttctctgagcaggtgtttaaggttgcttctagtgacctggtaaacatgggcatcagcgtcgtgagctacaccttgaaggatatacacgacgaccaagattatttacactctttggggaaggctcggacggcacaggtccagaaggacgcccgtattggagaagcagaggcaaaacgtgatgccggaattagagaagcaaaggccaagcaggagaaagtgtcggcacagtacctgtccgagatcgagatggccaaggcccagagagattacgagttgaaaaaggctgcctatgacatcgaggtgaacacgagaagagctcaggcggactag

SEQ ID NO: 223423 - DNA, 717 bp, Artificial Sequence
  Description of Artificial Sequence: Synthetic coding sequence
atgcgcccatggtggagccccgtgaagatacaagggcagaacaaagagatgctcgctgccgcatgtcagatgtttctgggcaagaccgaggctgaaattgcccatatcgcactggaaacactcgagggacatcagagggccatcatggcccatatgaccgtcgaagaaatctataaggatcggcagaagttcagtgagcaggtcttcaaggtcgcctccagcgatctggtcaacatggggattagtgttgttagttatacactgaaagatattcacgatgatcaagattatctgcactctctagggaaagcgagaacagcccaggtccagaaggacgctagaatcggggaggcagaggccaaaagagacgccggtatccgcgaggccaaggctaagcaggagaaagtgagcgcccagtatcttagcgagatcgaaatggctaaggcccaacgggattacgaactcaaaaaagcagcttatgatatcgaggtcaatactcgcagggcccaggctgacctcgcctatcaattgcaggtggctaaaaccaagcaacaaattgaggagcaacgagtccaggtacaggtcgtggaacgagcgcaacaggtggccgtgcaagagcaagagatcgcaaggagagagaaagagctggaagccagggtgcgcaaacccgctgaagcagagcggtataaactcgaacgtctggcggaggccgaatag

SEQ ID NO: 223424 - DNA, 417 bp, Artificial Sequence
  Description of Artificial Sequence: Synthetic coding sequence
gtgaagattcagggccagaacaaagagatgttagccgctgcttgtcaaatgtttctaggtaagaccgaggctgagatcgcccacattgcccttgagaccttggagggccatcagcgtgcaatcatggcccatatgaccgtggaagagatctacaaggatcggcagaaattctctgaacaggtctttaaggtggcctcctctgacctggtcaatatggggatatccgtggtatcctacacactgaaagatatacacgatgatcaggactatcttcactcgttaggcaaggctcggacggcgcaggtgcaaaaagatgctcgcatcggggaagctgaggctaaaagggatgctggcatcagggaagccaaagcgaagcaggagaaagtgtctgcccagtacctgtctgaaattgaatag

SEQ ID NO: 223425 - DNA, 558 bp, Artificial Sequence
  Description of Artificial Sequence: Synthetic coding sequence
atgttctttacttgtggacccaacgaggccatggtagtctccggcttctgtcgatcaccaccggtgatggttgctggcggacgggtctttgtcctaccatgcattcagcagatacaacgtataagcctgaatacattgacactgaatgtgaagtctgagaaggtgtataccagacatggagtccccataagcgtcacaggcattgcgcaagtgaaaattcaggggcaaaacaaagagatgctggctgctgcatgccagatgttcctaggcaaaaccgaggccgagatcgcccatattgcactggaaaccctcgaaggacatcagagggccatcatggcccatatgaccgtggaagagatctataaggatcgacagaagttttcggaacaggtcttcaaggttgcaagctcagacttagtgaacatgggtatctcagtcgtgtcatatacgctgaaggatatccacgatgatcaggattacctccactcgctgggtaaggccagaacggcccaggtccagaaggatgcaagaatcggcgaggcggaggccaaacgctag

SEQ ID NO: 223426 - DNA, 348 bp, Artificial Sequence
  Description of Artificial Sequence: Synthetic coding sequence
atgggagtagagggcacggggcgaggaggctgcagactcgggggacctgatgggaagggtaagggctgggctcctgtcgacgccacagccaggctgccccacccgcagcggctgtctctcccccttctccagctccagcctgagccttgtttttccttggtagcacagatgcgtccatggtggtctcccgactatctgcattcacttggtaaggcccgaacggcacaggttcagaaggacgccaggatcggagaggccgaggctaaacgagacgcaggaatccgggaggccaaagcaaaacaagaaaaagtgagcgcacagtacctgtcagaaatcgagatggcatag

SEQ ID NO: 223427 - DNA, 561 bp, Artificial Sequence
  Description of Artificial Sequence: Synthetic coding sequence
gtcgccaagacaaaacagcaaatcgaggaacagagagtccaggttcaggtggtggagcgggctcagcaggtggccgttcaagaacaagagatcgcaagaagggaaaaagaactggaggcccgtgtaagaaaaccggctgaagccgaaaggtacaagttggaacgtctcgctgaggcggagaagagtcaattgattatgcaggctgaagccgaggccgcatctgtcagaatgcgaggagaggccgaagcattcgcaataggcgcaagagcaagagctgaggccgagcagatggccaagaaagccgaggccttccagttataccaggaagccgctcagcttgatatgctgcttgagaaactcccccaggtcgccgaggagatatccggtccgctaactagcgcaaacaagattactctagtgagcagtgggagcggaaccatgggggcagccaaagtgacgggggaagtcctggatattctgaccaggctgccggaatctgtggagcgtctgaccggggtttccataagtcaggtaaaccacaaacccttgcgtaccgcatag

SEQ ID NO: 223428 - DNA, 438 bp, Artificial Sequence
  Description of Artificial Sequence: Synthetic coding sequence
atgggcgtggaggggaccggtagaggaggttgtcggctgggcggtcctgatggaaaaggaaaagggtgggcccctgtggacgccacagccagactgcctcatccacagcgactctccctgccactgctgcagcttcagcccgaaccatgcttcagtttagtggcccaaatgagaccttggtggtccccagattatctgcactccctcggcaaggcgagaaccgcccaggtgcagaaagatgctaggattggcgaagcagaagcaaaaagggatgctgggatcagagaggcaaaagcgaagcaggagaaggtcagtgcacagtacctaagcgagattgaaatggccaaagcccagcgagattacgaactgaaaaaggctgcttatgatattgaggtgaacacccgcagggcgcaggccgacctggcgtaccagctctag

SEQ ID NO: 223429 - DNA, 558 bp, Artificial Sequence
  Description of Artificial Sequence: Synthetic coding sequence
atgttctttacgtgcgggccaaatgaagctatggttgtatctgggttttgtagatcccccccagtgatggtcgctggtgggcgagttttcgtcctgccttgcattcagcagattcagagaatttccctcaatacattgacactcaacgtcaagtccgagaaggtgtatacaaggcacggtgtgccaatctcagttacaggcatcgcccaagtcaagattcagggccaaaataaggaaatgttagccgctgcctgtcagatgtttttgggcaaaaccgaagccgagattgcccacattgccttggagaccctcgaggggcaccagcgcgcaattatggcccacatgaccgtcgaagagatatacaaggatcggcagaagtttagcgagcaagtgttcaaggtcgcgagctcagatctggtgaacatggggatcagcgttgtttcatacacgctcaaggacattcatgacgaccaggattacttacactctctgggtaaggctcggaccgcccaagtacaaaaggacgcaagaatcggagaggctgaagccaagcgatag

SEQ ID NO: 223430 - DNA, 633 bp, Artificial Sequence
  Description of Artificial Sequence: Synthetic coding sequence
atgttctttacttgcggccctaatgaggccatggtcgtgagcggattctgccgctcacctccagttatggtcgcaggtggacgcgtgttcgtcctcccgtgcatccagcagatacagcgtattagcctgaatactctgactctaaatgtgaaatcggagaaggtgtacacgcgacatggagtaccaatttccgtgaccgggattgctcaggttaaaattcaaggacaaaataaggaaatgcttgctgccgcttgccagatgttcttgggtaaaaccgaagcagagatagctcacatagccctggaaacccttgagggccaccagcgggctatcatggcgcatatgacagtcgaggagatttataaagatagacagaaattttctgagcaggtgtttaaggtggcctccagtgaccttgttaacatgggcatcagcgttgtgtcatatacattgaaggacatccacgacgaccaagactacttgcacagtttggggaaggcacgcacagcccaagtccagaaagacgcgagaatcggggaggccgaagctaagcgggatgctggcatccgtgaggccaaagccaaacaagaaaaagtgagtgctcagtacctcagtgaaatcgagatggcttag

SEQ ID NO: 223431 - DNA, 633 bp, Artificial Sequence
  Description of Artificial Sequence: Synthetic coding sequence
atgttttttacctgtggccctaatgaagcaatggtggtgagcggtttttgtagaagccctccagtcatggtggctggcggaagagtgtttgtgctgccgtgcatacagcaaattcagaggatcagtctgaacacattaacactgaacgtaaagagtgagaaggtgtacaccaggcacggcgtgcccatcagcgtgaccggaatcgcccaggtcaagattcagggacagaacaaagaaatgctcgctgccgcttgtcagatgttcttgggtaaaaccgaggccgagatcgctcatattgcgttggaaactttagaggggcaccaacgtgccataatggcccacatgacagtggaagagatttacaaggacaggcagaagtttagcgaacaggtgtttaaagtcgcttccagtgacctggtcaatatggggatttccgtggtaagctatactctcaaggatatccacgacgatcaagattacttacacagcctgggtaaagcccgaaccgcacaggtccagaaagacgcccgtatcggagaagctgaagccaagagagacgcaggcatacgggaggccaaagccaagcaggaaaaggtgagcgcccagtacctgtccgaaatcgagatggcgtag

SEQ ID NO: 223432 - DNA, 759 bp, Artificial Sequence
  Description of Artificial Sequence: Synthetic coding sequence
atgttctttacatgtggccctaacgaggccatggtggtatctggattctgtcggtcccctccggttatggtcgcaggcggaagggtctttgtgctcccgtgtatccagcaaattcagcgcatctcactgaacacacttactcttaatgtgaagtctgagaaggtttacacccgacatggagtgcctatctcggttactggcattgcccaagttaagatccaaggccagaacaaggagatgctcgctgccgcttgtcaaatgttcttgggtaaaactgaggccgagatagctcacatcgccctggaaactctggaggggcatcagagagccataatggcccacatgacagtcgaggaaatctacaaggacaggcagaaatttagcgagcaggtgttcaaggtggctagctccgatctggtgaatatggggatttctgtcgtatcttatactctcaaagacatccacgacgaccaggattatttgcatagcctgggcaaagcacggacggcacaggtgcagaaagatgctagaataggtgaagccgaggctaaacgcgacgcaggtattcgtgaggcaaaagccaaacaagagaaggtgtccgcacagtatctctccgagattgaaatggcgaaagcgcagcgagattatgaactgaagaaagccgcatatgatatcgaagtgaacaccaggagagctcaggccgacctcgcctaccagttgcaggtggccaaaacaaagcagcagatcgaggaacagtag

SEQ ID NO: 223433 - DNA, 444 bp, Artificial Sequence
  Description of Artificial Sequence: Synthetic coding sequence
atgaggccatggtggtcgcccgtgaagatccaagggcagaacaaagaaatgcttgctgccgcatgccagatgttcttaggaaaaacagaggctgaaatcgcccatatagctttggagactctggaagggcaccaacgggctattatggctcacatgaccgttgaagagatatataaggaccgccagaagtttagtgagcaggtatttaaagtcgcctccagcgaccttgtaaacatgggcataagtgttgtgtcatacactctcaaggatattcatgacgatcaggattaccttcatagtcttgggaaagcacggaccgcccaggtgcagaaggacgcgagaatcggtgaggccgaagcgaagcgcgatgccggaatcagagaggccaaagcaaagcaagagaaggtgtccgcccaataccttagcgagatagaaatggcttag

SEQ ID NO: 223434 - DNA, 549 bp, Artificial Sequence
  Description of Artificial Sequence: Synthetic coding sequence
gtgaagattcagggacagaataaggagatgttggcagcggcttgtcagatgttcttggggaaaaccgaggccgagatagcgcacatcgcgcttgaaacattagaggggcatcagcgtgctataatggctcacatgacggtcgaggagatatataaggaccggcaaaagttttccgaacaggtgtttaaggtggcgtcctctgacttagtgaatatgggaatctccgtggtctcttacaccctgaaggatatccacgatgaccaagactatctgcactcactagggaaagctagaactgctcaggtacagaaggatgctcgcatcggtgaggccgaagccaagagggacgcgggaatccgagaagctaaagccaaacaagagaaggtgagcgcccagtatctctctgaaatagagatggccaaagcccagagagattatgaactgaagaaggcagcctatgacatcgaagtgaatacgcgcagggcacaagctgacttagcataccagctccaagttgccaagaccaagcagcaaattgaggagcagtag

SEQ ID NO: 223435 - DNA, 348 bp, Artificial Sequence
  Description of Artificial Sequence: Synthetic coding sequence
gttaagatccaaggacagaacaaagaaatgctggcagccgcttgccagatgtttctggggaaaaccgaagcagagatcgcccatatcgccctggagacacttgaaggacatcagcgcgcaataatggcacacatgacggtcgaggagatctacaaggaccgacagaagtttagtgaacaggttttcaaggttgctagttccgatctcgtcaacatggggatcagcgtagtttcatacaccctaaaggacatacatgatgatcaggactacctgcactctttgggaaaggccagaacggcccaggtccagaaggacgcccgaattggtgaagctgaggcaaaacgctag

SEQ ID NO: 223436 - DNA, 708 bp, Artificial Sequence
  Description of Artificial Sequence: Synthetic coding sequence
atgttctttacctgcggaccaaacgaggcaatggtagtgtctggcttttgtcgctccccgcctgtgatggtggcaggcggacgcgtttttgttttaccatgcatccagcagattcagcgcatcagcttaaatactcttaccctgaatgtcaagagcgagaaggtgtatacgcgccatggagtgcctatctcagttaccggcatcgctcaagtgaagatacaggggcagaacaaggagatgctggccgcagcctgccagatgttcctgggtaaaaccgaggccgagatcgcccacatcgccctcgaaacgctcgaaggccatcagcgcgctataatggcccacatgaccgttgaagaaatctataaagacaggcagaaattcagcgaacaggtgttcaaggtcgcctctagtgatcttgtcaacatgggtatttcagtcgtttcatataccctgaaggacatacatgatgatcaggattatcttcacagtctggggaaagcaaggaccgcacaagtccagaaggatgccaggataggtgaagccgaagccaagagagatgcaggcattagggaagcgaaggctaaacaggagaaagtgagtgctcaatacctgtcagagattgaaatggccaaggctcagcgggactatgagctgaaaaaggctgcctatgatatcgaggtcaacacaaggcgtgcgcaagctgattag

SEQ ID NO: 223437 - DNA, 1284 bp, Artificial Sequence
  Description of Artificial Sequence: Synthetic coding sequence
atgtttttcacctgtggccctaacgaggcaatggtggtgagcggtttttgcagaagccctccagtcatggttgctgggggtagagtttttgtgctaccttgtatccagcagattcagcggatttctctgaacaccctcacactgaatgtgaaatctgagaaagtatacaccaggcatggagtacccatctccgtgacaggcatcgcccaggtaaagatacaaggacagaacaaggagatgctcgccgcagcctgccaaatgttcctaggcaagaccgaggcagagatagcacacatagcactcgagactctggagggccaccagcgcgcaatcatggcccacatgaccgtcgaagagatctacaaagacaggcagaagttctcagaacaagtttttaaagtagcgtcaagcgacttagttaacatgggcatcagcgtagtgtcttataccctgaaggacatccatgacgaccaagactatctgcattctctgggaaaggcccgaaccgcgcaggtgcaaaaggacgcacggattggggaggccgaagcaaaacgtgacgcgggaatccgcgaagcaaaggccaagcaggaaaaagttagtgctcagtatctgtccgaaatcgaaatggccaaggcgcagcgagactacgagttaaaaaaagctgcgtatgatattgaagtgaatacccgtagggctcaggctgatctagcatatcagctgcaggtggctaaaacaaagcagcagatcgaggagcagagagtgcaggtacaggtcgtggagagggcacagcaggtggccgtgcaggaacaggagatcgcgagacgggaaaaagagttggaagccagagttcggaagccagcagaagccgagcgatacaaacttgaacgtcttgcggaggctgaaaagtcccagctgatcatgcaggccgaagctgaggctgcaagtgtgcgaatgaggggcgaggcggaagcttttgctatcggcgctagggccagagcggaagcagaacaaatggcaaagaaagccgaggccttccagctgtatcaggaggccgcacagctggacatgttgctcgagaagctaccacaagtcgccgaagagatttctggaccactgacatcagctaataagatcaccctagtcagtagcgggtccggcacgatgggcgctgccaaagtcaccggcgaggtcctggacattctcacaaggttacccgagagcgtagagaggctgactggagtcagtatttcacaggtgaatcacaagccactgagaacagcgtag

SEQ ID NO: 223438 - DNA, 498 bp, Artificial Sequence
  Description of Artificial Sequence: Synthetic coding sequence
gttaaaattcagggccagaataaagaaatgctggccgcagcatgccagatgtttcttggaaagactgaagccgagatcgcccatatcgcactggagacattggagggccatcagagggctatcatggcccacatgacagtcgaagagatctataaggaccgccagaaatttagcgagcaggtcttcaaggtggcaagtagcgatcttgttaatatggggattagcgtggtatcctacaccctcaaggacatccacgatgaccaggactaccttcactcactagggaaggccagaaccgcgcaggtacagaaagacgctcgaattggagaggccgaggccaagcgggacgcaggtataagggaggctaaagccaagcaagaaaaagtctctgcgcagtacttatcagagattgagatggccaaagcacagcgcgactacgagctgaagaaggccgcatacgatattgaagtgaacacacgacgcgcacaggccgactag

SEQ ID NO: 223439 - DNA, 438 bp, Artificial Sequence
  Description of Artificial Sequence: Synthetic coding sequence
atgggcgtggaaggtacaggacgtgggggttgcaggctgggcggaccggatggtaaaggtaaagggtgggctcccgtcgacgccaccgctaggctaccacatccccaaagactcagcctgcctttgctccagctccaacctgaaccatgtttcagcctagtggctcaaatgaggccatggtggagcccagactatctgcatagtctcgggaaagcgaggaccgcacaagtacagaaagacgcaagaattggggaagccgaagctaagcgagacgccggaataagagaggccaaggcaaaacaggagaaagtgtctgcccagtatctatcagagatagagatggccaaagcgcaaagagattatgaattaaaaaaagccgcatatgacattgaggtgaatactcgaagagcccaagccgatctagcataccagttgtag

SEQ ID NO: 223440 - DNA, 759 bp, Artificial Sequence
  Description of Artificial Sequence: Synthetic coding sequence
atgttctttacttgtgggcctaatgaagccatggtggtgagcgggttttgcaggtcacctccagtcatggtcgctggcggacgagtgtttgtccttccgtgcatccaacagattcagcggatatctctgaatactctcactctgaacgtgaagtccgagaaggtctatacccgacatggagtgccaatctcggtgactgggatagcacaggtaaagatacagggccaaaacaaggaaatgctagcggcagcatgtcaaatgtttttaggcaaaaccgaagccgaaattgctcatatcgccctggaaaccctcgaagggcatcagcgggcaattatggcccatatgaccgtggaagagatttacaaggatcggcagaagttttcagaacaagtgttcaaagtggcatcctctgacctggtgaatatgggaatttctgttgtcagttacaccctgaaggacatccatgatgatcaagattacctgcatagcctcggtaaagcaagaacagcacaagttcaaaaggacgccaggatcggtgaagcagaggccaaacgggacgccggaattagagaagccaaggcaaaacaggaaaaggttagcgcccagtatctttctgagatcgaaatggcaaaagcccaacgggactacgagttaaagaaggcagcctatgacatcgaggtgaacaccaggcgagcacaggctgacctggcctaccagctgcaggtggctaaaactaagcagcaaatcgaagagcagtag

SEQ ID NO: 223441 - DNA, 759 bp, Artificial Sequence
  Description of Artificial Sequence: Synthetic coding sequence
atgtttttcacatgtgggccaaacgaagcaatggtagttagcgggttttgccggtctccaccagtcatggtggctggaggccgagtcttcgtgctaccctgcattcagcagatccagcgaatatccctaaataccctaaccctgaacgtgaagagcgagaaggtatacactcgccacggagtgcctataagtgttacgggtatcgctcaggttaaaatccagggccagaacaaggagatgttggcagcagcctgtcaaatgttcctcggcaaaacggaggctgaaatagctcacatcgccttggaaacactggagggccaccagcgagctattatggcccatatgaccgttgaggagatctacaaagatcggcaaaaattcagtgaacaggtcttcaaagtggccagtagcgacctggtcaatatgggcatctctgtcgtcagttataccttaaaagatatacatgatgaccaggactatctgcattcgttgggtaaagcccgaacggcgcaggtgcaaaaagacgccaggatcggcgaggctgaggctaaacgcgacgcaggcatccgagaagctaaggccaaacaagaaaaggtgagtgcccagtacctgtcggaaattgagatggccaaggctcaaagagactatgagctgaagaaggccgcttatgacatagaggtcaacacgcggagggcccaggcagatctggcgtatcagctccaagtggccaagaccaaacaacagatagaagagcagtag

SEQ ID NO: 223442 - DNA, 249 bp, Artificial Sequence
  Description of Artificial Sequence: Synthetic coding sequence
gactatctgcactccctcgggaaggcccgaaccgctcaggtccaaaaggatgctcggatcggggaagctgaggctaagagagacgcaggcatccgagaagccaaggccaagcaagagaaggtaagcgcccagtacctgagtgagattgagatggccaaagcacagcgcgactacgaactgaagaaggcagcctacgatatcgaggtgaatactaggagagcgcaggcggacctcgcataccagctgtag

SEQ ID NO: 223443 - DNA, 558 bp, Artificial Sequence
  Description of Artificial Sequence: Synthetic coding sequence
atgtttttcacctgcggacctaacgaagccatggtcgtgtccgggttttgccggagtccccctgtgatggtcgccggagggagggtcttcgtcctgccatgcattcaacaaattcagcgaatcagcctcaataccctcaccttgaatgtgaagagtgagaaagtctataccagacacggcgttcccatcagtgtgacagggattgcccaggtaaagattcagggacagaacaaggagatgctagctgcagcttgccagatgtttctggggaagactgaagccgagatcgctcatattgccctggagacgctcgaggggcatcagcgcgctatcatggcccatatgacggtggaggaaatttacaaagacagacagaagtttagtgaacaggtcttcaaggtggccagttccgatctcgtgaatatgggaatcagcgtcgtatcctatactctcaaggatattcatgacgatcaggattacctgcattctttgggcaaagccaggacggctcaggtccaaaaagacgctcggatcggtgaagctgaggcgaagaggtag

SEQ ID NO: 223444 - DNA, 759 bp, Artificial Sequence
  Description of Artificial Sequence: Synthetic coding sequence
atgtttttcacatgcggacctaacgaggcaatggtagtgagtgggttttgccggagtccaccagttatggtggccggaggaagagtgttcgttttaccttgcatccagcagatccaacggatcagcttgaatactttaaccctgaatgtgaagagtgaaaaagtatatacgagacacggcgtgcccataagtgtgactggaatcgcccaggtcaaaattcagggacaaaacaaggagatgttggctgccgcttgccaaatgtttttgggtaagacagaggccgaaattgcacacatcgcactggagacactggaaggccatcagcgagccattatggcacatatgacagtcgaggagatttataaggatcggcagaaattttcagagcaggtatttaaggtggcctcttctgacctggtaaatatgggaatctccgtagtcagctacactttgaaggacattcacgacgaccaagactacttgcactctttaggcaaggcacgcaccgcccaggtgcaaaaggatgctagaattggggaagccgaagcaaagcgtgatgctggcattagggaggctaaggcaaaacaggaaaaggtctccgcccaatatttatccgagatcgaaatggccaaggcccaacgggactacgaactcaagaaggctgcatatgatatcgaagtgaacacccggagagcacaggccgatctggcgtatcagctgcaggtggcaaagactaagcagcagatcgaagagcagtag

SEQ ID NO: 223445 - DNA, 558 bp, Artificial Sequence
  Description of Artificial Sequence: Synthetic coding sequence
atgttctttacatgcggtcccaatgaggctatggtggtgtccggtttttgtaggtccccaccggtgatggtcgccggaggaagagtgttcgtcctcccgtgcattcagcaaatccagcgcatatcattgaacactctcaccctgaatgtaaagagcgagaaagtctatacccggcatggtgtcccaattagtgtaactgggatcgctcaggtcaaaattcagggccaaaacaaagaaatgctagctgctgcatgccaaatgttcctgggtaaaaccgaggctgagatcgcccatatcgcgctagagaccctggagggtcatcagcgggcaataatggcacacatgacagttgaagaaatctataaagaccggcagaaattcagcgagcaggtattcaaagttgcctcctctgacttggtcaacatgggaatctctgttgtatcatacacactgaaagatatccatgacgaccaggattacttgcactcgctcgggaaggcaaggactgcccaggttcaaaaagatgcccgtattggtgaggccgaggccaaaagatag

SEQ ID NO: 223446 - DNA, 717 bp, Artificial Sequence
  Description of Artificial Sequence: Synthetic coding sequence
atgcgtccgtggtggtcccccgtgaaaatccagggccagaacaaagagatgcttgccgctgcttgtcagatgttcctgggcaagactgaagccgagattgcccacatcgccctggaaacacttgaagggcaccagcgggctatcatggcacacatgaccgttgaggagatttataaggaccgtcagaagttcagtgagcaagtctttaaggtagcttcttccgacttagtgaacatgggaatcagcgtggtctcctacacactaaaggatatacatgacgaccaggattatctgcacagtctggggaaggcaaggacagctcaggtgcagaaggacgcaaggattggcgaagctgaagctaaaagggatgcagggattcgcgaagccaaggctaaacaggagaaagtttcagcccaatacctgtccgagatcgagatggctaaagctcagagagactacgagctcaaaaaggcagcctatgatatcgaggtcaacactagaagggcacaggccgatttggcctaccaacttcaggtggccaagactaaacagcagattgaggagcagcgtgtgcaggtacaggtagtagagcgcgcacagcaggtagctgttcaagagcaagagattgcaaggcgggagaaggagctggaggctagagtaaggaaacccgcagaggcggagcgctataaactagagagactcgccgaggcagagtag

SEQ ID NO: 223447 - DNA, 1284 bp, Artificial Sequence
  Description of Artificial Sequence: Synthetic coding sequence
atgttttttacatgcgggcctaacgaagctatggttgtaagtggcttctgcaggtcccctccagtgatggtggcagggggaagggtgtttgtcttgccatgcattcagcaaattcagcgcatctcgctgaatacccttaccctcaacgttaaaagtgagaaagtttatactcggcatggtgtccccatctccgttacagggattgcccaagtgaaaattcaggggcagaacaaggaaatgcttgccgctgcatgccagatgttcctaggcaagacagaagcagagattgcccacattgccttagaaacactcgaggggcatcagcgggctattatggctcacatgacagttgaagaaatttacaaggaccggcaaaagttctctgaacaggtatttaaggtggcttcgagcgacttggtcaacatgggtatttccgtcgttagttataccttgaaagatattcacgacgaccaggactatttacactccctcggaaaagcccgtactgctcaagtgcagaaggatgcccgaattggcgaggctgaagcaaaacgcgatgccggaattagagaggctaaagccaagcaggaaaaagtttctgcccagtatttgtccgaaatcgagatggccaaagcccagcgggactatgagttgaagaaagctgcttacgatatcgaggttaatacacgccgagcccaagcagatttagcatatcagctccaggtagcaaaaaccaaacaacagattgaggagcagcgtgtgcaggtgcaggtcgtcgaacgagcccagcaggtggcagtccaggaacaggaaattgcacgaagagaaaaggagctcgaagccagagtcagaaagccagccgaagccgaacgctataagctggagcggctggccgaggctgagaagtcccaacttattatgcaggctgaagccgaggctgcgtctgtccggatgagaggtgaagccgaagcgttcgccatcggagctagagcaagggctgaggcggaacagatggcaaagaaagccgaagccttccagctgtatcaagaggcagcacagttggatatgctgctggagaagcttccacaggtagctgaggaaattagcggacctctcacgagtgccaataaaattacattggtatcttctgggtcagggactatgggggctgcgaaagtgaccggagaagtactggacatcctgactcgactgccggagagcgtggaaagactgactggcgtttctatatctcaagtcaaccacaaacctctgaggacagcctag

SEQ ID NO: 223448 - DNA, 579 bp, Artificial Sequence
  Description of Artificial Sequence: Synthetic coding sequence
atgtttttcacttgcggccctaatgaagcaatggttgtctctggcttctgtaggtctccacccgtcatggtggcagggggacgggtatttgtattaccatgcattcagcaaatccagcggatttcactaaacacactgacccttaacgttaagagtgagaaagtcaaaattcagggtcaaaataaggagatgctggccgctgcttgtcaaatgttccttggtaaaacagaagcggagatagcgcatatcgccttagaaacactggagggacatcaacgcgctatcatggctcacatgaccgtagaagagatctacaaagaccgccagaagttctcggaacaagtttttaaggtggcatcatctgatcttgtgaatatgggaatatctgtggtgtcttataccttgaaggatattcacgatgatcaagattacctccactcactcgggaaggccaggacagcccaggtacagaaggatgccagaattggggaagctgaggccaaaagagatgcaggcattagagaagccaaggctaaacaggaaaaggtgtccgcacaatatcttagcgaaattgaatag

SEQ ID NO: 223449 - DNA, 708 bp, Artificial Sequence
  Description of Artificial Sequence: Synthetic coding sequence
atgttttttacatgtgggccaaatgaagcgatggtggtgtccggattttgtcgctcgcctcccgtcatggtggccggtgggagagtgttcgtgttgccctgcatccaacaaatacagcgcataagtctaaatacactcaccttgaatgttaaatccgagaaggtatacaccagacacggtgtgccaatttctgttactggcatcgcccaggtgaaaattcaggggcagaataaggaaatgctggctgccgcttgccagatgttcttaggcaagacagaagcagaaatcgcccacattgccttggaaaccttagaagggcaccaacgcgctatcatggcccacatgaccgtcgaagagatctacaaggaccggcaaaagttctccgaacaggtgttcaaagtcgcatcatcggatcttgttaacatgggaatttcagtcgtcagctatacactgaaggatatacacgacgatcaagactacctccactcccttgggaaagcgagaaccgctcaagtccagaaggacgctagaatcggggaagccgaagctaagagagacgccggaattagagaagccaaggccaagcaggagaaggtgagcgcccagtacttgtctgagattgaaatggccaaggcccagcgcgattatgaattaaagaaggctgcctacgatatcgaggttaacacgcgtagggcccaggcggattag

SEQ ID NO: 223450 - DNA, 183 bp, Artificial Sequence
  Description of Artificial Sequence: Synthetic coding sequence
gtcgccaaaactaagcaacagatcgaagagcagagagtgcaggttcaggtagtggagcgcgctcagcaggtggctgtgcaggaacaggagatcgccagacgtgaaaaggagctggaggctagggtgaggaagccagccgaggcggaaagatacaaacttgagagattagctgaggccgagtag

SEQ ID NO: 223451 - DNA, 717 bp, Artificial Sequence
  Description of Artificial Sequence: Synthetic coding sequence
atgcggccatggtggagtccggtgaagatccaggggcagaataaagagatgctcgccgcagcatgtcaaatgttcctcggaaaaacggaagccgagattgcacacattgctctggaaaccctggaggggcaccagcgcgcaataatggctcacatgactgtagaagagatatacaaggatcgacagaaattcagtgagcaggtatttaaggtggcaagcagtgatctggtgaacatggggatttccgtcgtgtcttatactctgaaagatatccatgacgatcaggactaccttcacagcctgggcaaggcgagaaccgctcaagtccagaaggacgcgagaattggcgaagccgaagcaaaacgcgatgccggaatccgggaagcaaaggcaaagcaggagaaggtgagcgcccagtacttgtcagagattgagatggctaaggctcaaagggactatgaattaaaaaaagccgcatatgacattgaagtgaatactagacgcgcacaggccgacctagcttaccaactgcaggttgccaagacgaagcagcagattgaggagcaacgcgtgcaggtacaagtcgtcgagcgtgcacagcaggttgccgtgcaagagcaggagattgcgaggcgcgaaaaagaactcgaagcccgagtccggaagcctgcagaggccgaacgctacaagcttgagcggctggctgaggctgaatag

SEQ ID NO: 223452 - DNA, 708 bp, Artificial Sequence
  Description of Artificial Sequence: Synthetic coding sequence
atgtttttcacatgtggccctaatgaagctatggtcgtctcaggattctgcagatccccaccagtgatggttgccggagggagggtcttcgtgctcccttgcattcagcagattcaaaggatctccctcaacaccctgactcttaacgtgaagtcagagaaagtctatacaaggcacggagttcccatcagcgtcacgggcattgctcaggtaaagatccaaggacagaataaggagatgctggccgctgcatgtcagatgttcttagggaaaacagaggccgaaattgcgcacattgcactggaaactctggagggccaccagcgcgctatcatggcacacatgactgtggaggagatatataaggaccgtcaaaagttctctgagcaagttttcaaagtcgcttcttctgatctggtgaatatgggaatctccgtggtctcatacacactgaaagacatacatgatgaccaggactatctgcatagcctggggaaagccagaaccgcccaggtgcagaaagacgcaaggataggcgaggctgaagcgaagagagacgcaggcatccgggaggctaaggcaaaacaagagaaagtaagtgcacagtatttatcagagatcgagatggcaaaagcacagcgtgattacgaactgaagaaggctgcttacgacatcgaggtgaatacacggagggcccaggccgattag

SEQ ID NO: 223453 - DNA, 1074 bp, Artificial Sequence
  Description of Artificial Sequence: Synthetic coding sequence
gtaaagattcaaggacagaacaaggagatgctcgctgccgcatgccaaatgtttctaggcaagaccgaggctgagatagcccatatcgcccttgaaacactggaaggacaccagagggctatcatggctcacatgaccgttgaagagatttataaagatagacagaaattctccgagcaggtgtttaaggtagccagctcagacctggtaaacatggggattagtgtcgtttcatacaccctgaaagatatacacgacgaccaggactacctacattccctcgggaaggcacgaacagctcaggtgcaaaaggatgcccgtattggggaagcagaagccaaacgggatgccggaattagagaagcaaaagccaaacaggaaaaagtttcagcccaatacctgagcgagatcgagatggcaaaagcccagagggattatgaactcaagaaagctgcctacgatatagaagtgaacacgagacgcgcacaggcagatctggcgtatcagctccaagtcgctaagaccaagcagcagatcgaagagcagagggtacaggtccaggttgtggagcgcgctcaacaggtcgcggttcaggagcaagagatcgccaggagggagaaagagctagaggccagggtccgcaaacccgctgaggcagaacgctataagctagaacggttagcggaggctgagaaaagccagctgataatgcaggccgaagctgaggcagcaagtgtgagaatgcggggagaggcggaggcgttcgctattggggctagggccagggctgaagccgagcagatggccaagaaagccgaagcctttcaactgtaccaagaggcagcgcagctggacatgttactggagaagctcccgcaggtcgctgaagaaatctcaggacccctgacaagtgccaacaagattactcttgtgtcaagcggcagcggtaccatgggggctgccaaggtcactggagaagtgctagatatcttgacacggctgcccgagtcagtggaacggctgaccggtgttagtatctcccaggtgaatcataagcctctgcgcaccgcgtag

SEQ ID NO: 223454 - DNA, 36 bp, Artificial Sequence
  Description of Artificial Sequence: Synthetic coding sequence
gttgccaagacaaagcagcagatcgaggagcagtag

SEQ ID NO: 223455 - DNA, 759 bp, Artificial Sequence
  Description of Artificial Sequence: Synthetic coding sequence
atgttttttacctgcggacccaatgaagccatggtcgtaagcgggttctgtagaagtcccccagtgatggtggccggaggccgtgtctttgtgctaccttgcatccaacaaatccaaaggatctctttgaacactctgacccttaacgtcaaatcagaaaaggtatacacaaggcacggcgtgccaattagtgtaactgggattgcacaggttaagattcaaggacagaataaagagatgctcgccgcagcttgtcagatgtttctggggaagacagaggcagagatcgcacacatagcactcgagacactcgagggacaccagcgggcaatcatggcccacatgacagtggaagaaatttataaagaccggcagaagttctctgagcaggtgttcaaagtagcgtcctccgatttagtgaatatgggaatatctgtcgtaagttatacactgaaggatatacatgatgaccaggactacttacactcacttggcaaagccaggaccgctcaggttcagaaggacgcacgtattggggaagctgaagccaagcgcgatgccggtatcagggaagcaaaggcgaaacaggagaaagtgtccgctcagtacctctctgagatagaaatggctaaagcacagagggactatgaacttaaaaaagccgcatatgacatcgaagtgaacacacggagagctcaggccgatttggcatatcaactccaagtggccaaaaccaagcaacagatagaagagcagtag

SEQ ID NO: 223456 - DNA, 708 bp, Artificial Sequence
  Description of Artificial Sequence: Synthetic coding sequence
atgtttttcacgtgcggaccaaatgaggccatggtcgttagtggcttttgtcggagcccgccagtgatggtggctggaggtcgggtgtttgtgctcccctgtatacagcagattcagcgaattagtctgaatactctcacactcaatgtgaaaagcgagaaggtatacacaaggcacggcgtaccaataagcgtcaccggaattgcacaggttaagattcagggacaaaataaagagatgcttgccgcagcgtgtcagatgttcctcggcaagaccgaagccgagattgcccatatcgctcttgaaacgctggaaggacatcaacgcgcaatcatggcccatatgacagtggaggaaatatacaaggatcggcaaaaattctccgaacaggtgttcaaggtcgcatctagtgatcttgttaatatgggtatttccgtcgtaagctacactcttaaagatattcatgatgaccaggactacctccatagtctgggaaaagccagaactgcgcaggtgcagaaggacgcccgtatcggcgaggctgaagccaaaagggacgccggaattagagaagcaaaggccaagcaagaaaaggtgagtgctcagtatctgtctgaaattgagatggccaaggcacagcgggactacgagttgaagaaagcggcatatgatatcgaggtcaacactaggcgggcacaggccgattag

SEQ ID NO: 223457 - DNA, 558 bp, Artificial Sequence
  Description of Artificial Sequence: Synthetic coding sequence
atgtttttcacttgtggcccaaatgaagctatggtcgttagcgggttctgccgctcacctcccgtaatggtggcgggtggacgtgtttttgttctgccttgtattcagcaaattcaaagaataagcttgaacaccttaacactcaacgtcaaatccgagaaagtctacacccggcatggcgtgcccatttccgtaactgggatcgcccaggttaagattcagggacagaataaagagatgctggccgctgcctgtcaaatgtttctcggcaagacagaagccgagatcgcccacatcgcacttgagacattagagggccatcagcgagctatcatggcccacatgaccgtcgaggagatttacaaggacaggcaaaaatttagtgaacaggtctttaaggttgcgtcatcagacctcgtgaatatgggtattagcgtggttagttatacactgaaagacattcacgatgatcaggactatcttcattccctaggcaaagcacgcaccgcacaggtacagaaagacgccaggattggcgaggcagaagcaaaacggtag

SEQ ID NO: 223458 - DNA, 438 bp, Artificial Sequence
  Description of Artificial Sequence: Synthetic coding sequence
atgggggttgaaggtacgggcagaggtggctgtcgcctcggaggaccagatgggaagggcaaaggatgggctcccgtcgacgcgacggccagacttccacatccccagagacttagtcttcctttgctgcagttgcagcctgaaccttgctttagccttgtggcgcaaatgcggccttggtggtccccagactatttgcattccctggggaaggccaggactgcacaggtgcagaaagacgcaaggatcggcgaagctgaagcgaagagagacgccggaattcgcgaagcaaaggccaaacaggaaaaagtgagcgcccagtacctgagcgagattgagatggcaaaggcgcaacgagattacgagctgaaaaaggctgcctacgacattgaagtaaacactcggcgagcccaggccgacctggcctatcagctgtag

SEQ ID NO: 223459 - DNA, 717 bp, Artificial Sequence
  Description of Artificial Sequence: Synthetic coding sequence
atgagaccctggtggtcacccgtgaaaatccagggtcagaacaaggagatgttggcggcagcctgccagatgtttctcggtaaaactgaggcagagatagctcatattgccctggagaccctggaaggacaccagagggccattatggcccatatgacagtggaggaaatctacaaggacaggcaaaagttctctgagcaagtgttcaaggtagcaagtagcgacctcgtcaatatgggtatcagcgtggtgagctatactctaaaggatattcatgacgaccaagattatctgcattccttaggcaaggctcgtaccgctcaagtccaaaaggatgctcgaataggcgaggccgaagccaaacgcgacgcagggatccgggaagctaaggctaagcaagaaaaggtctcagcccaatacctatctgagattgaaatggccaaggctcaacgggattacgaattgaagaaagcagcttatgacatagaagttaatactagacgcgcacaggctgatctcgcctatcaacttcaagtggctaagaccaagcagcagatcgaggaacagcgagtacaggttcaagtggtggagagggcacagcaggttgccgtgcaagaacaggagatagccaggagagaaaaagagctggaagcaagagtgcgcaaaccagcggaggctgaaagatacaaactggagagactagccgaggccgagtag

SEQ ID NO: 223460 - DNA, 1140 bp, Artificial Sequence
  Description of Artificial Sequence: Synthetic coding sequence
atgttttttacttgcggccctaacgaagcaatggtcgtgtcaggcttctgccggtccccacctgtcatggttgccggtggtagggtgttcgtgctcccatgtatccagcagatccagcgaatttcattgaacacacttactttgaatgtaaagtcagaaaaagtttacactcggcacggcgtccctattagcgttacagggatagcgcaggaaatttacaaggataggcaaaaattttccgagcaagtctttaaagtcgcctctagcgatctagttaacatgggaatctcagttgtttcttatactctgaaggacatccacgacgaccaggattatctgcattcgctcggtaaagcccgaaccgcacaggtgcagaaagacgcacgaattggcgaggctgaggctaagagggacgctggcatccgcgaggccaaagcaaagcaagagaaggtgagtgcccagtacctttccgagatcgaaatggcgaaagcacaacgggactacgagctaaagaaagccgcttatgacatcgaagtgaacacgcgaagagctcaggctgaccttgcctatcaactgcaagtggccaaaacgaagcagcagatcgaggagcaacgtgttcaggtccaagtcgtcgagagagcccaacaggttgccgtccaggaacaggagatcgctagacgcgaaaaagagctggaagctagggtaagaaagccagccgaggcggagcgatacaagcttgaaagacttgcagaagccgaaaaaagtcagctcatcatgcaggctgaagcagaagctgcaagcgtgaggatgcggggagaggcagaggcattcgcaattggggctagggcaagagctgaggccgaacagatggcaaagaaggcggaagcttttcaactgtatcaggaggcggctcagctggatatgctacttgaaaagttgccccaagtagcagaggagatctctggcccactgacctctgcgaacaagattaccctggtctccagtgggtccggtactatgggcgcagctaaggttaccggtgaggtcttggatatcttgacacgcctgccggaatcagtcgaacgcctgactggggtttcaatcagtcaggtgaatcataagcccttgcgcactgcctag

SEQ ID NO: 223461 - DNA, 558 bp, Artificial Sequence
  Description of Artificial Sequence: Synthetic coding sequence
atgtttttcacttgcggtccaaatgaggctatggtcgtgagcggtttctgtagatccccgcctgtgatggtcgctggaggaagggtttttgtactgccttgtatccagcagattcagcgtatcagcctaaacacattaaccctgaatgttaagtctgagaaagtgtatactcgccatggcgtgccaatctcggtcaccggcatagcccaagtgaagatccagggccagaacaaggagatgctcgccgctgcatgccagatgttcctcggaaaaactgaggccgaaatcgcccatattgcactcgagaccctcgagggccaccagagggctattatggctcatatgacggttgaggaaatctacaaggacaggcaaaagttcagcgagcaagtgttcaaggtggcttcatccgatcttgtaaacatggggatttctgttgtctcatataccctcaaagacattcatgacgaccaggactatctccactcattggggaaggcccgtaccgcgcaagtacagaaggatgccagaatcggggaggcagaagctaaacgctag

SEQ ID NO: 223462 - DNA, 696 bp, Artificial Sequence
  Description of Artificial Sequence: Synthetic coding sequence
gtgaaaattcaggggcagaacaaagaaatgcttgcagccgcatgtcagatgttccttggtaagacggaggccgagatcgctcacatcgcactggagaccctcgaaggacaccagagagcaatcatggcacatatgactgtcgaggagatctacaaagaccggcaaaaattttctgagcaagtttttaaagtcgcgtcctcagatcttgtgaacatgggtatctcagtagtatcgtataccctgaaggacattcacgacgatcaggattatctccacagtttgggaaaggctcgcacagctcaggtgcagaaagacgcccgtatcggcgaagcggaggccaaacgtgatgcaggcattcgggaagccaaagccaagcaggagaaggtgagtgctcagtacctgtccgaaatcgaaatggctaaagcacagagggactacgaactgaagaaggccgcttacgatatcgaggtgaacacacggagggcgcaggcagacttggcctaccaactccaggttgccaagaccaagcaacagattgaggagcagcgggtccaagtacaggtggtggagagagcgcaacaggttgcggtccaagaacaggaaattgccaggagagagaaggagctggaggccagggtgaggaaacccgctgaggccgagcggtataagctcgaacgactggctgaggcggaatag

SEQ ID NO: 223463 - DNA, 633 bp, Artificial Sequence
  Description of Artificial Sequence: Synthetic coding sequence
atgtttttcacatgcggaccaaatgaagccatggtggtgagcgggttctgtagatcacctccagtcatggtggctgggggacgggtcttcgtattaccatgcattcaacagattcagcggatttctcttaataccctgacactgaatgttaagtctgagaaggtatacaccaggcatggggttccaattagcgttactgggatagctcaggtgaaaatacagggccagaataaggaaatgttagcagctgcctgccaaatgttcttggggaagacagaggcagagattgcccatatcgctctggagaccctcgagggacaccagcgcgctatcatggcacatatgacagttgaggaaatttacaaagatcgtcaaaaatttagtgaacaggtgttcaaggtcgctagcagcgatttggtgaacatgggtatatctgtcgtgtcatataccctgaaagatatccacgacgaccaggactatctgcactctctgggcaaagcgaggactgcccaggtgcagaaagacgctaggattggggaagctgaggctaagcgggatgccggaattagagaagcaaaagctaaacaggaaaaggtttcggctcagtacttgagcgagatcgaaatggcgtag

SEQ ID NO: 223464 - DNA, 579 bp, Artificial Sequence
  Description of Artificial Sequence: Synthetic coding sequence
atgtttttcacgtgcggccctaacgaagcgatggtcgtgtccggcttttgccgatctcccccagttatggttgctgggggtagagtgtttgtcctgccatgtatccagcagatacagcgaatcagcctcaatactctcactttgaatgtaaaaagtgagaaagtgaaaatccagggacagaataaagagatgctggcagccgcttgccagatgttcttgggtaagaccgaggctgagatcgctcacatagccttggagacactcgagggccatcagagggccatcatggcccacatgaccgtcgaagaaatctacaaggataggcagaagtttagcgaacaggtatttaaggtcgcctccagcgatctcgtaaacatgggcatttccgtcgtgagttatactctgaaggacattcacgacgaccaggactatctgcattctctaggaaaagctagaactgcacaagtgcaaaaggacgctcgtattggagaagccgaggctaagcgtgatgccggtatccgagaagcaaaggctaagcaggaaaaggtcagcgcccagtatctctccgagattgagtag

SEQ ID NO: 223465 - DNA, 1140 bp, Artificial Sequence
  Description of Artificial Sequence: Synthetic coding sequence
atgtttttcacttgcggcccaaacgaggcaatggtggtctctggcttttgtagatctcctccagtgatggtagcagggggacgcgtgttcgtgctgccttgtattcaacagatccagaggatctcccttaatacactgacgctcaatgtaaagagcgagaaagtctatactcgccatggtgtgcccatctccgtgacagggatcgcccaggagatctacaaggaccgccagaagttcagcgagcaggtctttaaggtggcctccagtgacctcgtaaatatgggaatttctgtcgtcagctataccttgaaagatatccacgacgaccaggattatttgcactccctcggaaaagccaggacggcacaagtccagaaggacgcgaggatcggcgaggccgaggccaagcgggatgcaggtatcagagaagcgaaagccaaacaggagaaagtttctgctcagtacctgagcgagatcgagatggcaaaagcccagagagactatgaactgaaaaaagctgcctacgacatcgaagtgaacacgcggcgtgcacaggctgacctggcgtaccagctacaggtcgccaagaccaagcaacagatcgaggaacagcgggttcaggtgcaggtggtggaacgggcacagcaggtggcggttcaggagcaggagatagccagacgggaaaaagaactcgaggcccgagtgcggaaacctgcagaagccgagcgctacaaacttgaacggctggcggaggccgaaaaatctcaattgatcatgcaagcagaggctgaagccgctagcgtgagaatgcgcggagaagcagaagcatttgcgattggcgctagggctcgggctgaggcggagcaaatggccaaaaaggctgaggcctttcagctttaccaggaagccgcacagttggacatgttactggaaaaactgccccaggtggccgaagaaattagcggcccattaacaagtgctaacaagattacccttgtcagcagcggttccggcactatgggcgctgccaaagtgacaggtgaggttctagacattctgacccgtctgcccgaaagtgtcgagaggctgaccggagtatccatctcgcaggtcaaccacaagcctctgcgaactgcctag

SEQ ID NO: 223466 - DNA, 1140 bp, Artificial Sequence
  Description of Artificial Sequence: Synthetic coding sequence
atgttttttacctgcggccctaacgaagctatggtggtcagcgggttttgcaggagtcctccagtcatggttgccggtggacgtgtgttcgtactgccatgtattcaacaaattcagcggatctcactcaacaccctgactcttaacgtcaaaagcgagaaagtgtacacacgccacggcgttcccatttccgtaacgggtatcgcacaggaaatttacaaggatcgccagaaattttctgaacaggtctttaaagttgccagctccgacctggtgaacatgggtatatcagtggtgagctacacactgaaggacatccacgacgaccaagactacctgcatagtttgggcaaggctcgaaccgctcaagtccagaaagacgccagaattggagaagcagaggccaagcgggatgctggcatacgcgaagcaaaagccaagcaggagaaagtgtcagctcagtatctaagtgagatagagatggctaaagctcagagagactatgagttgaagaaagcggcttacgatatcgaggttaacacacgacgcgctcaagctgatcttgcataccaactgcaggtcgctaagaccaagcagcaaatcgaggagcaaagggtgcaggtgcaggtggtggagcgggcacagcaggtcgctgttcaggagcaggaaattgctaggcgcgagaaagaacttgaagcaagggttcgcaagccagcagaggccgagcgctacaagctcgaacgactggcagaggcggagaaatctcagttaatcatgcaggccgaggccgaagccgcatccgtgaggatgaggggggaagccgaggcctttgcgattggagcgagggcacgggcagaggctgaacaaatggccaagaaagcagaggcctttcaactttaccaggaagccgctcagctggacatgctcttggaaaaactgcctcaggttgcagaggagatttccggtccccttacaagcgcaaataagatcaccctggtgagctcagggagtggaactatgggagccgctaaggtaactggtgaggttctggacatcctcactagactgccggagtcagttgagcgtttaaccggcgtatccatctctcaggtgaaccataaaccccttaggactgcttag

SEQ ID NO: 223467 - DNA, 1140 bp, Artificial Sequence
  Description of Artificial Sequence: Synthetic coding sequence
atgtttttcacatgcgggcctaacgaggctatggttgtgagcggtttttgccggagtcctcctgtgatggtagcaggcggaagggtgttcgtgctgccatgtatacagcaaatccaacggataagccttaacacactcactctcaacgtgaaaagcgagaaagtgtataccaggcatggagtccccatatcggttacaggaatagcccaggagatatacaaagatcggcagaaattcagcgaacaagtatttaaagtcgcgtctagtgacctggttaacatggggataagcgtagtctcctatactctgaaagatatccacgatgaccaggattatcttcacagtcttggcaaagcaagaacagctcaagtccagaaggacgcacggataggagaagctgaggccaaacgtgatgcgggtattcgcgaggccaaagccaaacaagagaaggtgtctgcccaatatctgtctgaaatcgaaatggctaaggcccaacgggactatgaactgaaaaaagctgcgtatgatatcgaagtcaacactaggcgggcacaggccgatctggcataccagctgcaggttgctaaaaccaaacagcaaatagaggagcagcgcgtacaggtccaggtcgtggaacgcgctcaacaagtggccgttcaggaacaggaaatcgctcggagagagaaggaactggaggcacgggtcagaaagcccgctgaggctgaaaggtataaactcgagcggttggccgaggccgagaagtcgcagttaatcatgcaagccgaggctgaagccgcttcagtacggatgaggggcgaagcggaggcctttgctatcggtgcacgggctagagctgaggcggagcagatggctaagaaagcagaggccttccaactctatcaagaggcggcacaactagacatgctgctggagaaattgccacaggtggcagaggagatctcaggcccactgacctcggctaataaaattacactggtgtccagcgggagcggcacaatgggcgctgctaaggtgacgggcgaggttctcgatatcctcaccaggctacctgagagcgtggagagactgaccggggtttcaatatcgcaagtgaatcataagcccctccggacggcttag

SEQ ID NO: 223468 - DNA, 1140 bp, Artificial Sequence
  Description of Artificial Sequence: Synthetic coding sequence
atgtttttcacatgtggacccaatgaagccatggtggtgagcggtttctgcagatccccacccgtaatggtggctggcggacgcgtgtttgtactgccttgcattcagcagatccagagaataagcctcaacactctgactctgaatgtgaaatctgagaaggtttacacccggcatggagttcctatctcagtgactgggattgcacaagagatctacaaggatagacagaagttttctgaacaggtattcaaggtggcttccagcgatctcgtgaatatgggaattagcgtggtttcctatacattgaaagatatccacgatgaccaggattaccttcactctctcgggaaagctcgtaccgcccaggtccagaaggacgctcgtattggtgaagccgaagctaaacgtgacgctgggattcgggaagcaaaagcaaagcaagaaaaggtaagcgctcaatacctcagtgagatcgagatggccaaggcacagagagattacgaactaaaaaaagcagcttatgatatcgaagttaacacacgacgagcacaggccgacctggcctatcagctccaggtggcaaagacgaaacagcagatcgaagagcagagggtccaggtgcaggtcgtggagcgcgctcagcaggtcgcggtgcaagagcaggagatcgcccgaagagagaaggagcttgaagcaagagtgcggaagccagcagaagcagagaggtataagctggagagactcgccgaggcggaaaagtctcagctgatcatgcaggctgaagctgaagctgcgtcagtgagaatgaggggggaggccgaggccttcgcgattggcgctcgcgcaagggcagaagccgaacaaatggctaagaaggcagaggcattccagctgtaccaggaggccgctcagctcgacatgctcctggagaagctgcctcaagttgctgaagagataagcgggccacttacttccgccaataaaattaccctggtgagctcgggcagtggcacaatgggtgccgctaaggtcacaggcgaagtgctagatatcctgaccaggctgccagagtccgtagagcgcttaacgggcgtttcgatatcgcaggtcaatcataagcccctgaggacggcctag

SEQ ID NO: 223469 - DNA, 861 bp, Artificial Sequence
  Description of Artificial Sequence: Synthetic coding sequence
atgggaatctccgtcgtgagttacactctcaaagacatccatgatgaccaggattacctccactcgctcgggaaggctagaaccgcacaggttcagaaggatgcaaggattggagaagcagaagccaagcgtgatgcgggaattcgcgaagctaaggctaagcaggagaaggtgagtgctcaatatcttagcgaaattgagatggctaaagcccagcgtgactacgaactaaagaaggcggcttatgatattgaagttaacacaaggagagcccaggctgacctggcctatcaactgcaggtagccaaaacaaaacagcagatcgaggagcagcgcgtgcaggtccaggtggttgagcgggctcaacaggtggcagtacaggaacaagaaatagcccgtcgcgagaaggagctggaggccagggtcaggaaacccgctgaagctgaacggtataagctggaacgcctggctgaggccgagaagtcccagctcattatgcaggcagaggcagaggcggcatctgtgaggatgagaggggaagctgaggccttcgcaatcggggcaagagcaagggccgaggctgagcaaatggccaaaaaagcagaagcatttcaactttatcaagaggccgctcaactggatatgctgctggaaaagttgcctcaggtggcggaggagatctccggtcctctcactagtgcaaacaagatcacactcgtgtcttccggcagcggaacaatgggcgcagcgaaggtaaccggggaggtgctggatatcctgacccgtttaccagagtctgtcgagagactcacaggcgtttcaatctcacaggtcaaccacaagcccctgcggacagcctag

SEQ ID NO: 223470 - DNA, 1452 bp, Artificial Sequence
  Description of Artificial Sequence: Synthetic coding sequence
atgggcaactgtcatactgtgggtcctaatgaggccttggtggtctcaggcggatgttgcgggtccgactataagcagtacgtttttggcggatgggcttgggcatggtggtgcatatcagacacccaacgcttgagtctggaagtgatgaccatactgtgcagatgcgaaaatattgagacttcggaaggcgtgcctctatttgtcacaggcgtggctcaggtgccgtgtccctgtctgctcgattgtaagtgggggaactccaaaggtttctggaagctgtgccaggtgtgccaaatctcactggaaatcatgactcttcagcccaggtgcgaggatgtagaaacagctgaaggtgtggcacttactgtgaccggcgtagctcaggtcaagattatgactgagaaagagcttttggccgtggcatgtgaacagtttctgggcaaaaacgtgcaggacattaagaacgttgttcttcagacactggagggccatctgagaagcatcctgggcacgctgacggtcgagcagatatatcaggaccgggatcagtttgcaaaactggtgagggaagtggctgccccagacgtaggaaggatgggtatcgagatcctgagtttcactatcaaggacgtgtatgataaagtggactatctctcaagccttggcaagactcaaaccgctgtcgtacagagggatgccgatatcggagtggctgaagccgagagggatgccggtatccgcgaggcagaatgcaagaaagaaatgcttgacgttaaattcatggccgataccaaaattgctgactcaaagcgcgctttcgagttacagaagagtgcattcagtgaggaggtcaatattaaaaccgccgaagcacagttggcatacgaattgcaaggagcacgagaacaacaaaaaataagacaagaagagattgagatcgaagttgtgcagcgcaaaaagcagattgcagtcgaggcccaggaaattctgcggactgataaagaactgatagcgaccgtgaggcgtccagcagaggccgaagcgcatcggattcaacagattgctgagggagaaaaggttaagcaggtcttgctggcccaggcagaggccgagaagattagaaagattggggaggcagaggccgcagttatcgaggccatgggcaaagcagaggccgaacgcatgaagctgaaagcggaagcctaccagaaatacggggacgcagctaaaatggcccttgttttagaggcacttcctcagatcgcagcaaagatagccgcacccttgacaaaggtggatgaaattgtggtgctgtccggggataattctaaagtaacatctgaagtcaaccgacttctggccgagctccctgcctccgttcacgcactaacaggggttgacctgtcaaagatacccctaataaagaaagctacaggtgtacaggtttag

SEQ ID NO: 223471 - DNA, 1287 bp, Artificial Sequence
  Description of Artificial Sequence: Synthetic coding sequence
atgggcaactgccacacggtgggtcccaatgaggccctggttgtgtcagggggatgttgtggctcggactacaagcagtacgttttcggaggctgggcatgggcctggtggtgcatcagcgacacccaaagaatctccctagaaattatgacactacagcccaggtgcgaagatgtggagaccgctgagggcgtggcccttactgtgaccggtgtggctcaggtgaagattatgacagagaaagagctgctggctgtggcttgcgagcagtttctcgggaaaaacgtgcaggacatcaagaacgtcgtgctgcagacactggaaggacacttacggtccattttgggtaccctcactgtagaacagatctatcaggaccgggaccaatttgccaagctagttcgggaggtggctgcccctgacgttggtcgaatgggtatcgaaatcctgagcttcaccattaaagacgtgtacgataaagtcgattacttgagcagtttagggaaaactcagacagcggtggttcagcgggacgcggatattggtgtggctgaggccgagagggacgcgggaatcagagaggccgagtgtaaaaaggaaatgctcgacgttaaatttatggctgacaccaagattgccgactcaaaaagggctttcgaacttcagaagagtgccttcagcgaggaggtaaatattaaaacagctgaggcacagttggcctatgaactgcagggagctagagagcagcaaaagatccggcaggaggaaatcgagattgaggttgttcaacgtaagaaacagatcgccgtcgaagcacaggagattctccgcaccgacaaagagctgatcgccactgtccgccgtcccgcagaggctgaagcccacagaattcagcagatcgctgagggggagaaagtaaagcaggtgcttctggcacaagccgaggccgaaaagatccgcaaaattggggaagccgaagctgctgtgattgaggccatgggcaaggccgaggccgagcgcatgaagcttaaggctgaagcatatcagaagtatggcgacgctgccaaaatggccttagtactggaggccctgccccagatcgcagccaaaatcgctgctcccctgaccaaagtggatgagattgttgttctctctggcgacaatagcaaagtcacttccgaagtgaaccgcctcctggcggagctacctgcctcggtgcatgccctgaccggagtggatttgagtaagatcccactgataaagaaggccacaggtgttcaggtgtag

SEQ ID NO: 223472 - DNA, 2982 bp, Artificial Sequence
  Description of Artificial Sequence: Synthetic coding sequence
atgcccgctctggccagggacggcggacagcttcctctgctggtggtatttagcgctatgatttttgggactattacaaaccaggatcttccagtcatcaagtgcgtgctgatcaaccataaaaataacgatagcagtgtggggaaatcgagttcttacccaatggtctccgagagtccagaggacctgggttgcgcactgaggccgcaaagctctggcaccgtttacgaggcagccgcagtggaagtggatgtatcagcctctattaccctccaagtcttggtggacgcacccggaaacatcagctgcctgtgggttttcaagcactcctccctcaactgtcagcctcacttcgacctccaaaacagaggcgtggtgtctatggtgatactcaagatgactgagacgcaggccggtgagtacctgctcttcattcagagcgaggcaacaaactatacaatactgtttacagtgtccatccgtaatacactgctctacacattgaggcgtccctacttcaggaagatggagaatcaggacgccctggtttgcatttctgaaagtgtcccagagcccatagttgaatgggtcctttgtgattcgcagggagagagctgcaaggaagaatccccagctgttgtcaagaaggaagagaaggtactccatgagctgtttggaacggacattcggtgttgcgcaagaaacgaattgggccgagaatgtactagattatttactattgatttgaaccagactcctcagactaccctgcctcaactgttcctaaaagtcggcgagcccttatggatacgttgtaaagcagtgcacgtcaaccatggtttcggtttaacgtgggagctggaaaataaagccttggaggagggaaactactttgaaatgagtacatactctactaaccgcacaatgatccggattctgtttgcctttgtgtcctcggtggctcgcaacgacaccggctattatacttgtagcagctctaagcatcccagccagagcgcccttgtgacaatagtcgagaaggggtttattaacgccacaaattctagcgaggactatgaaattgatcaatacgaggagttctgcttttccgtgcgctttaaagcatatccccagatcagatgtacttggacttttagcagaaagtcctttccctgcgagcagaagggcttggataatggctactcaatttctaagttctgtaatcataagcatcaacctggggaatacatcttccacgccgagaatgatgacgctcagttcactaaaatgttcactctgaatattcggagaaagccccaggtgctcgctgaggctagcgcgagtcaggctagttgcttctccgatggctacccgctgccaagctggacctggaaaaagtgctccgataagagtccaaactgtaccgaggagataaccgaaggagtgtggaatcggaaggctaacagaaaggtcttcggccagtgggtctctagtagtaccctgaacatgtccgaagctatcaagggtttcctagtgaagtgctgtgcttataacagcctgggcacctcttgtgaaacaatcctgttgaatagtccaggtccattcccttttatccaggataatataagcttctacgcaaccataggggtatgcctgttattcatcgtggtgctgacccttctaatctgccacaaatataagaagcagtttagatatgagagccaattgcagatggtccaggttaccgggtcctcggacaatgagtatttttatgtggactttcgcgagtacgagtacgatttaaaatgggagtttccaagagagaacctcgagtttggcaaggtgctgggctctggcgcattcggcaaggtcatgaatgccactgcctatgggatctcaaaaacaggagtgagcatacaagtggctgtgaaaatgctgaaggaaaaggctgatagttcagaaagagaagccttgatgtccgaacttaagatgatgacacagttgggcagccatgaaaacatagttaatctccttggcgcatgcactctgtctggacctatctacctgatattcgagtactgttgctatggggaccttctcaactatctgcgctcaaagcgcgagaaattccaccgaacctggactgagatatttaaagaacataatttcagcttctacccaacttttcagtcacatcctaacagtagtatgccagggtcccgcgaggttcagatccaccctgactctgaccaaattagcggcctgcacggcaatagttttcactcggaagatgagatcgagtacgagaatcagaagcgcctggaggaagaggaagacttgaatgtgttgacatttgaggaccttctctgttttgcatatcaggttgctaaaggcatggagtttctggagtttaaaagctgcgtgcacagagatctagccgctcgaaatgtgctggttacacatgggaaagtcgtcaaaatttgcgacttcgggctagccagggatatcatgagcgacagtaattacgtagtaagaggcaacgctcgcctccctgtgaagtggatggcgccagaatccctgtttgagggcatttacactatcaagtccgacgtctggtcctacggcatattgctgtgggaaatcttctcgcttggagtgaacccttacccaggcattcccgtggacgccaacttttataagttgattcagaatgggtttaagatggatcagcctttctatgctactgaggagatctacatcatcatgcaatcctgttgggctttcgacagcagaaagcggccaagcttcccaaacctcacctcgttcctcgggtgtcaactggcagatgctgaagaagccatgtatcaaaatgtggatggccgagtttcggagtgcccacacacatatcagaacagacgccctttttcacgcgagatggaccttggcctgctcagtccccaggcccaggtggaagactcatag

SEQ ID NO: 223473 - DNA, 2991 bp, Artificial Sequence
  Description of Artificial Sequence: Synthetic coding sequence
atgcctgcacttgctcgcgacggcggacagttgccattgcttgtggtcttctctgccatgattttcggcaccataacaaaccaagacctcccagtcatcaagtgtgttttaatcaaccataaaaataatgattcaagcgtcgggaaatcaagttcttatccaatggtgtccgagtccccagaggatctgggctgcgctctccgccctcagtctagcggaactgtgtacgaagctgccgcagtcgaggtggatgtcagtgcctcaatcacactacaggtgcttgtagacgctcccggaaatatcagttgtctgtgggtgtttaaacatagctccctgaactgtcagcctcattttgatttgcagaatagaggggtggtgagcatggtgatccttaaaatgaccgagacacaagccggagaatacctcctcttcattcaaagcgaagcaaccaactacaccattctgttcactgtgagcattcgcaacaccctgctgtataccctgaggaggccttatttccgaaagatggaaaatcaggatgcacttgtttgtatctccgagtccgtgccggagccaattgtagagtgggtattatgtgattctcagggcgagtcctgtaaagaggaaagccccgctgtggtgaagaaggaggagaaagtgctacatgagctctttggaacggacatacgttgttgcgccaggaacgagctgggaagggaatgcactcgactgttcaccatcgatctgaaccagacacctcagaccacgttgccacagctctttctgaaggtcggggagcccttatggatcagatgtaaggcagtgcatgtcaaccacggctttgggctgacgtgggagctcgagaacaaagctctcgaggagggcaattactttgaaatgtccacgtatagtacaaaccggaccatgatccgaatactgttcgcctttgtgtccagtgtagcacgtaacgacacaggttactatacatgcagcagctcaaaacatcctagtcaatctgcactggttacaattgtggaaaaaggcttcattaatgcaactaactcctccgaggactacgaaattgaccagtatgaagagttctgcttctccgttaggtttaaagcttatccccaaattagatgcacatggaccttctcaaggaaaagcttcccatgcgaacagaagggccttgataatggttattccatcagcaagttctgcaaccacaagcatcagccaggggagtatatctttcatgccgagaatgatgatgctcagtttactaagatgttcaccctgaatattcggcgtaagcctcaggttctcgcagaagcctccgcctcacaggcttcctgcttcagcgatgggtaccccctgccttcttggacctggaaaaaatgtagcgataaatctcccaattgtaccgaggaaatcaccgagggggtgtggaataggaaggcaaaccggaaggtgttcggccagtgggtcagttctagtacactgaacatgtctgaggccattaaggggttcttagtaaagtgttgcgcatataactccctaggaaccagttgcgaaaccatcctgttgaattcaccaggcccattcccgttcatacaggataatatttcattctacgccacaattggtgtctgtctgttgtttatcgtggtgctgacactgctgatttgccacaagtacaaaaagcaattcagatacgagtcccagctgcagatggtgcaggtcactggctcctctgacaacgaatacttttatgtcgactttcgcgagtatgaatacgatctcaaatgggagtttcccagggagaatctcgagttcgggaaggtcctggggagcggagcctttggaaaagtgatgaatgcgactgcatacggtatcagcaagacaggcgtatctatccaggtcgctgttaagatgctgaaagagaaagcagatagcagcgagagagaagccttaatgtccgaactgaaaatgatgacgcagttgggatcgcatgagaatatcgtgaatttgctgggggcttgcacactgtctggcccaatttatcttatcttcgagtattgttgttacggcgatttgctcaactacctccggagcaagcgcgaaaaatttcacaggacctggactgaaattttcaaagagcacaacttctctttttacccaactttccaaagtcacccaaattcttcaatgcccggtagcagagaagtccagatccatccggattcggatcagatctctggcctgcacggtaacagtttccactctgaagatgagattgagtatgaaaaccagaagcgattggaagaggaggaagacttgaacgtgctgacctttgaagacttactgtgctttgcttaccaggttgcaaaggggatggagttcctggaattcaaatcttgtgtccacagagacttggctgctaggaatgtcctagtgacccatggcaaggttgttaagatctgcgattttggcctcgctcgggacatcatgagcgactccaattacgtggtgaggggaaatgtaagactcgccaggctcccggttaagtggatggcccctgagtcactgttcgagggaatttatactattaagtcggatgtttggtcctacggtatcctattgtgggaaatcttctcactcggcgtgaacccttacccaggtatcccagtagatgccaatttttataagttaatacagaacggatttaagatggatcagcccttctacgccacagaggaaatctatataattatgcagagttgctgggcctttgattcccggaagcggccaagtttcccaaacctcacatcctttctcgggtgccagctggctgacgctgaggaagcaatgtatcaaaatgtggacggcagggtgagcgagtgcccgcacacctaccagaaccgaaggcccttcagccgggaaatggacctcggactgttgagtccccaagcacaggttgaggactcctag

SEQ ID NO: 223474 - DNA, 2859 bp, Artificial Sequence
  Description of Artificial Sequence: Synthetic coding sequence
atgcccgcactcgctcgcgacggcggacagctccctctcctagtcgtgttttcggccatgattttcggaacgataaccaaccaggacctaccggtgatcaaatgcgtgcttatcaaccacaaaaacaacgactcaagcgttgggaaaagcagctcctatcctatggtgtccgagtccccagaggacctcggctgcgctctgaggcctcagagttccggcaccgtgtatgaagctgcagctgtcgaggtggatgtttcggcatcaataacactgcaggttctcgttgacgctcctggcaacatctcctgtctctgggtgttcaaacacagcagtttgaattgccagccacactttgacctacagaaccggggtgtcgtgagcatggttatcctgaaaatgaccgagactcaggcaggcgagtacctgctgtttatccagtctgaagcaaccaactacaccatcctgttcaccgtttcaattaggaacaccttgctctataccctgcgccgaccctatttcagaaagatggagaaccaggatgcactggtttgcatcagcgaatctgtccccgaacccattgtcgaatgggtactgtgcgattctcagggtgaatcctgcaaggaagagtcccccgcagtcgtaaaaaaggaggagaaagtgctccacgagctcttcggaaccgatatacgatgctgtgcccgaaatgaattgggcagggaatgcaccagactgtttaccattgacctcaatcagacaccacagacaacactcccccagctgtttcttaaggtcggcgagccactttggatccgatgcaaagccgtgcacgtgaaccatgggtttggcttgacatgggagcttgagaataaagccctcgaagagggaaactactttgaaatgtcgacttattctacaaatcggaccatgatcagaattttgttcgccttcgtgagctccgtggccaggaatgatactggctactacacttgctcctctagtaagcacccatcccaaagcgcgctggtgactattgttgagaagggctttataaatgctactaactcatctgaagactatgagatcgaccagtacgaggagttctgtttttccgtacgttttaaagcgtaccctcagataagatgcacatggaccttctccagaaaatccttcccctgtgagcagaaaggactggataatggatactccataagcaaattttgcaaccacaaacatcaacctggggagtatatcttccacgcggaaaacgacgacgcccagtttactaaaatgttcacactaaatattcggagaaaacctcaagtgctggcagaggcttcagcttctcaagcaagctgttttagcgatgggtacccgctgccctcatggacctggaagaagtgtagtgataagagtcctaattgtactgaggagattaccgaaggggtgtggaacagaaaagcgaatcgtaaagtgtttggccaatgggtgagctctagcacgctcaatatgtccgaggccattaagggatttctcgtcaagtgctgcgcttataactccctgggtacctcttgtgaaacgatcctgcttaattcacccggaccctttccctttatccaggacaatatcagtttctatgcaactatcggcgtgtgtctgctatttatcgtggtattaactctcctgatttgccacaaatacaagaagcagttccgttacgaaagccagctgcagatggtgcaggtgaccggcagtagcgataatgagtatttttatgtagactttagagagtatgaatatgatctcaagtgggagtttccaagggaaaaccttgaattcggtaaggtgttgggctctggtgccttcggcaaagtgatgaatgcgaccgcttacgggatctcaaagacaggggttagtattcaggtagctgtgaagatgctaaaggagaaggccgatagctctgaacgcgaagcactcatgtcagaactgaagatgatgacccaactgggatcccatgagaacatcgtgaacctgctcggagcctgtaccctgagcggcccaatttatcttatctttgagtattgttgctacggtgatcttcttaattacttgaggagcaagagagaaaaattccataggacttggactgaaatctttaaagaacataatttctccttctacccaaccttccagagtcaccctaattcctccatgccgggtagcagagaggtccagatccaccccgattcagatcagatttccggcttgcacgggaactccttccatagcgaagacgaaattgagtacgaaaaccagaagcggctggaagaggaagaagacctgaatgtgttgacattcgaggatctgctctgttttgcataccaggtcgcaaaaggaatggagtttttagagttcaagtccgccaggctccctgtaaaatggatggcgcctgaatcgctgttcgaaggcatatacaccatcaaatctgacgtctggtcctacggcattcttctatgggaaattttcagccttggggtgaacccgtatcccggtatccccgtggacgcgaatttctataaactaattcagaacgggttcaaaatggaccagccattttacgcgaccgaagaaatttatataattatgcagagctgttgggccttcgattcacggaagcgccctagtttcccaaatctcacatctttcttggggtgtcagctcgcagacgcagaggaggccatgtaccagaatgtggacggaagggtctctgagtgtccgcacacataccagaataggagacccttcagtagggagatggatctggggctgctctccccacaggcccaggtggaagactcttag

SEQ ID NO: 223475 - DNA, 2253 bp, Artificial Sequence
  Description of Artificial Sequence: Synthetic coding sequence
atgtggaacctcctacacgaaacagattctgcggtcgctaccgccagacggccaaggtggttgtgcgcaggcgcactggtgctagctggcggtttctttctgttagggttcctctttggatggtttattaaaagctccaacgaggccacaaacatcaccccaaagcacaatatgaaagccttcctggatgaacttaaagccgaaaacattaagaaattcttgtacaattttacacagatccctcaccttgcagggactgagcagaactttcaactcgctaagcagatccagagtcaatggaaagaatttggcctggactccgttgaattagcacactacgatgtcctgctcagctatccgaacaaaactcatcccaactacatctcaattataaatgaggatggaaacgaaatatttaacactagcctttttgagccaccaccccctgggtatgagaatgtttcagacattgtcccacctttctctgcattctcaccacagggaatgcccgagggggacctcgtatacgtcaactatgctagaacggaagacttctttaagttggagagggacatgaaaataaactgtagcgggaaaattgtgatcgcacgctacggtaaggtgtttcgcggaaacaaggtgaagaacgctcagctggctggagctaagggtgtcatactttattcagacccagcagactactttgcaccaggagtcaaatcttatcccgatggctggaacttgccaggcggaggcgtccagcggggaaatatactaaacctcaatggtgcaggtgacccactgacccccggataccctgctaacgaatatgcttacaggcggggaatcgcggaggcagtcggtctgccatccatacctgtccatccgatcggttactacgatgcccagaaactgctagaaaaaatgggaggaagcgctcccccagactctagctggagagggtcactcaaggtgccttacaacgttggccctgggttcacagggaatttttccactcaaaaggtaaagatgcatatccatagcaccaatgaagtcacgcggatttataacgtgatcggaaccctgagaggcgctgtcgaaccagatcgttatgtcattttgggcggacaccgtgactcctgggtttttggtggcatagatccccagtctggagccgctgtcgtacatgaaatcgtcagatcttttggcacacttaagaaagaggggtggcgtcccagacgcaccatactttttgccagttgggatgctgaggaatttggcctcttgggcagtactgagtgggcagaggagaatagccggttactacaggagagaggagttgcctatatcaatgcagacagctcaattgagggaaattacaccctgagggtggattgcacacccctgatgtactcacttgtgcataacttgacaaaagaacttaagtcccctgatgagggatttgagggaaagtccctgtacgaaagttggactaagaagtctccgagtccggagtttagtggaatgcccaggatctctaagctgggatctggcaacgatttcgaagttttttttcagagacttggcatagcttctgggcgtgctcgctatacaaagaactgggagaccaacaagttttccggctacccactttaccacagcgtctacgagacatatgagctcgtcgagaaattttacgatcccatgttcaaataccatttaacggttgcacaagttagagggggtatggtgttcgagctcgcgaatagtattgtgctaccctttgattgtagagactacgctgttgtgctgcgtaaatacgccgataagatctactcaatttccatgaagcacccccaggaaatgaagacgtattccgtcagctttgattctctgttctcagctgtcaagaattttaccgaaatcgcatctaagtttagtgaacggctccaagattttgacaagtctaatcctattgtgttgcggatgatgaatgaccagctcatgttcttggaaagggcctttatcgatcctttaggccttccggaccgaccattctaccgacacgttatatacgcgccatcaagtcacaataagtacgccggagagtcattccccggaatttacgacgctttgtttgacatagagagcaaagtggatccgagtaaggcctggggtgaggtgaagcggcagatttatgtggccgcattcactgtgcaggcagccgctgaaaccttgtctgaagtggcatag

SEQ ID NO: 223476 - DNA, 2208 bp, Artificial Sequence
  Description of Artificial Sequence: Synthetic coding sequence
atgaccgctggtagtagctacccactgtttctggctgcgtacgcatgcaccggctgcctcgcagagaggcttggctggtttatcaagtcttccaacgaagcaaccaatatcacccccaagcataacatgaaagccttcctcgatgagctgaaggccgagaacataaagaaattcttatacaattttacgcagatcccacaccttgctggcaccgagcagaattttcagctagccaaacagatccaatctcagtggaaggagtttgggcttgatagtgtggagttagcgcactatgacgttctgctctcttaccctaataagacccaccctaactatatttctataatcaacgaagatggcaatgaaatcttcaatacaagtctttttgaacccccaccccctggttatgaaaacgttagcgatatcgtcccccctttcagcgctttctctccgcagggtatgcccgagggagatctggtgtacgtaaactacgcgaggaccgaggactttttcaaattggaacgggacatgaagatcaattgtagtgggaagattgtcattgcgagatacggtaaggtgtttcgtggcaacaaagtcaagaatgcgcaactcgcaggcgctaagggggtgattctgtattccgacccagctgattacttcgctcccggagtgaagtcataccccgatggatggaacctccccggtggtggtgttcaaagggggaacattctcaatctcaatggggcaggggaccctctgacgccgggttatccagccaatgagtatgcgtacagaagaggtatcgcagaagccgttggcctgcccagcatccccgtgcacccgattgggtactacgacgctcaaaaactgctggaaaaaatgggaggctcagctccaccagactctagttggagaggttcgctgaaggtgccatataatgtcggacctgggttcaccggcaacttcagcactcagaaagtgaagatgcatatacactctaccaacgaagtcacgcgtatatataacgttattggaacccttaggggtgccgtggagcctgatcgctacgtcatactgggcggtcatcgggactcttgggttttcggcggaattgatcctcagagcggcgcagctgtggttcatgagatagttcgaagctttggcacactgaagaaagagggatggcggccaaggagaaccatcctgtttgctagctgggatgctgaagagtttgggctactcggcagcactgagtgggctgaagagaactcacgcttactgcaggaacgaggcgtggcatatatcaatgctgacagctcaattgagggcaactacaccctccgtgtggattgcacccctctaatgtattcactggtgcacaacctgacaaaggaactgaaatcaccagacgagggcttcgaaggaaaaagcctttatgaatcctggaccaagaaatcaccatctcccgaatttagtgggatgcctcggatctcaaaactggggtccgggaacgacttcgaggttttcttccagcgcttgggcattgcttctggacgtgcccgatacactaagaactgggagacaaataagttctctggataccccctctaccactctgtttacgagacatatgaattggtggagaagttttacgatcccatgttcaagtaccatttaaccgttgcccaggttagggggggtatggtgttcgaactggccaacagtatcgtgctgcccttcgattgtagggactacgccgttgtgctcagaaaatacgctgacaaaatttactccatatccatgaagcatcctcaagagatgaaaacttatagcgtgagctttgacagccttttttctgctgtcaagaatttcacagaaattgctagtaagttctccgagcgactccaggacttcgacaagtccaatcctattgtgctgcggatgatgaatgaccagttaatgttcttggaaagagcttttatcgaccctcttggcctacctgatcggccattctatagacacgtgatttatgccccatccagtcataataaatatgccggagagtccttcccagggatttacgacgcactgtttgacatagagagtaaggttgatccctccaaagcatggggcgaagtgaagaggcagatctacgtggctgctttcacagtacaggcagccgcagagacactatccgaagtggcctag

SEQ ID NO: 223477 - DNA, 1329 bp, Artificial Sequence
  Description of Artificial Sequence: Synthetic coding sequence
atgggcggttccgctccaccagacagtagctggagaggcagcctgaaggtcccctataacgtgggacctggctttacaggaaatttctccacccaaaaggttaagatgcatattcacagcacgaatgaggtaacacgtatatacaatgtcatcggaactcttcgcggagcggtcgaacccgaccggtatgtaatcctggggggacatcgggactcttgggtcttcggtggcatcgaccctcagagcggagctgccgtcgttcacgagatcgtgcgtagttttggcaccctcaagaaagagggatggaggcccagaagaacgatcttatttgcatcctgggatgcagaggaatttgggttgttgggttctacagagtgggctgaagagaatagcagacttctgcaggagcgaggggtcgcttatattaatgctgactctagtatcgaaggaaattacaccctgcgtgtggattgtacaccgcttatgtattctctggtccacaacctgactaaggagctgaagagccccgatgaagggtttgagggaaagtctctctatgaatcctggacaaagaaatccccaagtccggagtttagcgggatgccgcgaataagcaagctgggctcggggaatgactttgaagtgtttttccagagactgggaattgccagcggcagggctagatacactaaaaattgggaaactaacaagtttagcggataccctctctatcacagtgtgtacgaaacatatgaactggtggaaaagttttatgatccgatgtttaaataccacctgactgtagcccaggtccggggaggaatggtgttcgaactggcaaactccatcgtcctgcctttcgattgccgggactacgccgttgtattacggaagtatgctgataagatctacagtatctcaatgaagcaccctcaggagatgaaaacctattccgtgtccttcgactccctgtttagtgcagtgaaaaatttcacagagattgcttccaagttcagtgaacgtctccaagattttgacaaatctaatcctatcgtcctaagaatgatgaatgaccagttaatgttcctggagcgtgcattcatcgatcccctcggactccccgatagacccttttatagacacgtcatctacgccccatcatcccataacaaatatgccggagagagcttccctgggatttatgacgccctctttgatattgaatctaaagtggacccatcaaaagcatggggtgaagtaaaacgacagatttatgttgccgctttcacagtgcaagcagccgcagaaactttgtccgaggtggcttag

SEQ ID NO: 223478 - DNA, 2160 bp, Artificial Sequence
  Description of Artificial Sequence: Synthetic coding sequence
atgtggaacctcctgcatgaaaccgatagcgcggtggcgacagctcggaggcccagatggttgtgcgctggcgcattagtgctggccggaggattctttctcttggggtttctattcggatggtttatcaaatcatcaaatgaggctactaacatcacacccaagcataacatgaaagccttccttgacgaactgaaggcggaaaacattaaaaagtttctttataacttcacccagatcccccacttagcgggaactgagcagaatttccaactcgcaaagcaaatccaaagccagtggaaggaattcggactcgattccgttgagttggcgcactacgacgtactgttgtcctatccgaacaaaactcaccccaactacatatccatcatcaacgaagatggtaacgagatcttcaacacatccctcttcgagccccctcctccaggctatgagaatgtgtctgatatcgttccccctttcagtgcctttagcccccaaggaatgccggaaggggacctggtgtacgttaactacgcgagaaccgaggacttcttcaagcttgaacgcgatatgaaaattaattgctccggtaagatagtcatcgcaagatatggcaaggtgtttaggggcaacaaggtgaagaatgcccaactcgccggtgctaaaggcgtaattctatattcagatccagccgattactttgccccaggtgtgaagagctatccggacggatggaatcttccaggcggaggcgttcagcgagggaatatcctgaacctgaatggagctggagatcctctgaccccgggttatcccgctaacgaatatgcttacaggagaggaatcgccgaggccgtcggcttgcctagcatacccgtgcacccaattggctattatgacgcccagaaactacttgagaaaatgggcggatctgctcctccagatagcagctggcgaggatcactcaaggtgccgtataatgtgggaccaggctttaccggcaatttctcaactcagaaggttaaaatgcacatccatagcacaaacgaagttaccagaatttacaatgtgattggcaccttaagaggggcagtcgaaccagaccgatatgtgatcctgggtgggcaccgagatagctgggttttcggcggaattgatcctcagtccggcgcagcggtggtgcatgagatcgtgaggagtttcggcactctgaagaaggaaggctggagacctcgccgtacaatcctgttcgcaagttgggatgctgaggaattcggactcttggggagcacggaatgggccgaagagaactctcggctactgcaagagcgcggagtagcttacataaacgctgattcttctatcgagggcaattacaccctgcgcgtggattgtacccctctgatgtactccctagtgcataatttgacaaaagagttgaaatcccctgacgagggatttgagggcaaatcactctacgaaagttggacaaagaaatcaccctctcccgagttttctggtatgcccaggattagtaaactggggagtggcaacgattttgaggtgttcttccagaggcttggtatcgcttccgggagggcacggtacactaagaactgggaaacaaacaagttctccggctatccgctgtaccatagcgtgtatgagacctatgaactggtggagaagttctacgaccccatgttcaaatatcacctgaccgtggcacaggtccggggaggcatggtgttcgagctggccaactctattgtgctgccatttgattgccgggactacgccgtggtgcttaggaagtacgccgacaagatatattctatatcaatgaagcacccccaggaaatgaagacatatagtgtatcctttgactcacttttttccgctgtgaaaaattttactgagattgcctccaagttttccgagcgtctccaagactttgataaatcaaagcatgtcatatacgccccatcaagtcataacaagtatgctggtgagtcctttccaggtatctacgacgctctgttcgatatcgagagcaaggtagacccaagcaaggcttggggggaagtaaaaagacagatctatgtagctgcctttacagttcaggccgctgctgagaccctcagtgaggtggcgtag

SEQ ID NO: 223479 - DNA, 1638 bp, Artificial Sequence
  Description of Artificial Sequence: Synthetic coding sequence
atgtggaaccttttgcacgaaacagattcagccgtcgcaacagcccgacggccacggtggctgtgcgccggtgcgctggtattagccggaggcttcttcctgctggggtttttgttcgggtggtttattaagtcttcgaacgaggctacgaatatcacgccgaagcacaatatgaaggccttcttagatgagctgaaagccgagaatataaaaaaattcctgtacaacttcacccagattcctcacctagccggaactgagcagaacttccagctggcaaaacagatccagtcacagtggaaagagttcggccttgattcagtcgaattggcccattacgacgtgcttttgtcatatccaaataagactcacccaaattatatcagcatcatcaacgaggacggaaacgaaatcttcaataccagtttattcgagccaccaccaccaggctatgaaaacgtgtccgatatagtgccaccattctctgctttctcaccacaggggatgccagagggagacctcgtgtatgtgaactacgcaagaacagaagactttttcaagctggagcgcgatatgaagatcaattgtagcggaaaaatagtaattgctaggtacgggaaggtgtttcgcggaaataaagtcaaaaacgcacagctggccggagcaaagggcgtcatactgtatagcgatccagcggactatttcgcccctggggttaagagttatccagacggatggaatcttcctggcggaggagtacagaggggaaacattctgaatttgaacggggcaggagatccgttaacccctgggtacccagccaacgagtatgcctaccgccgtggcatagcagaggccgttggtttaccctcgataccagtgcatcccattggctactatgacgcccagaagctgctggagaagatggggggttcagcccctccggactcatcatggagaggctcattgaaagttccctacaacgttgggccaggctttactggaaactttagtacccaaaaggtgaagatgcacattcattccaccaacgaggtcaccaggatttacaacgtcataggcactctccgcggagcagtcgagcctgatcgttatgttatcctggggggacacagggactcctgggtgttcgggggaatagatccacaatccggcgctgccgtagtacatgagatcgtcaggtcatttggaacactcaagaaagaagatatcctgggttggagacctcgacgtaccatcttgtttgcctcctgggacgcggaagagttcgggttgcttgggtcaacagagtgggccgaggagaacagtcgcctcctccaagaaaggggagtagcttatatcaatgctgatagcagcatcgaagggaattatactctccgggtcgattgcacccctctgatgtattccctggtacataatctgaccaaagaactgaaaagcccagatgagggcttcgagggtaaaagtctctacgaatcctggacaaagaagagccccagccctgaattctccggaatgccaaggatcagcaaactggggagcggaaacgatttcgaagtgttctttcagagactggggattgccagtgggcgagccagatatacaaaaaaaaagaaatag

SEQ ID NO: 223480 - DNA, 2115 bp, Artificial Sequence
  Description of Artificial Sequence: Synthetic coding sequence
atgaccgctggaagtagctaccccctctttctggcagcctacgcctgcacaggatgtctggctgagcgactcggttggttcataaaatcatctaacgaagccacaaacatcactcctaagcacaatatgaaagccttcctggatgagctcaaagccgagaacatcaagaagttcctttacaacttcacccagatccctcacctcgctggaaccgagcagaactttcagctagctaaacaaattcagagtcagtggaaggagttcggccttgactccgtagaactagcgcactacgatgtgctgctgtcctatcctaataagactcatcctaattacatctctatcattaacgaagacgggaacgaaatctttaatacttcactgttcgagcctcctccacctggttacgagaacgtatctgatatcgtgcctccctttagcgcattctcaccccaggggatgcctgaaggagatctcgtttacgttaactatgccagaaccgaggacttttttaaactggagcgggatatgaagatcaactgtagcgggaaaattgtgatagctaggtatggtaaagtctttaggggcaacaaagtgaaaaatgcccaacttgcaggagccaaaggggtgatcctatacagtgatcctgctgattatttcgcccctggcgtcaagagttacccggacggatggaacttgcccggtggcggtgttcagcgaggcaacatccttaacttgaacggcgctggggacccactgacgccaggctacccagccaacgaatatgcctacagaagaggcatcgcagaggctgtgggcttgccttccattccagtccatcccattggctattatgacgcgcagaagctgttagaaaaaatgggtgggtccgcgcctcccgattcatcctggaggggatcactgaaggttccttataatgtgggtccaggttttaccgggaatttcagcacccaaaaagtcaaaatgcacatccactctacgaacgaagtgacacgcatttacaacgtcattggaacattacgcggtgccgttgaaccggacaggtatgttatcctcggcggtcatagggactcctgggttttcggtggcatcgacccgcaatccggcgctgccgtggtgcacgagatcgtgcgcagcttcggcactctcaaaaaagagggatggaggcctaggagaacgattctcttcgcaagctgggatgccgaggagttcggcctgctcggatctacagagtgggcagaggagaatagtcggctattacaggaacggggagtggcctacataaatgccgactcatctattgaaggcaattacacactgcgtgtcgattgcacaccactgatgtacagcctcgttcacaatctgactaaagagctcaaatctccggacgaaggtttcgagggtaaaagcctatacgagtcctggacaaagaaatcgcctagcccggaatttagcggaatgccgagaatctcaaagctgggcagtgggaatgattttgaggttttttttcagcgcctgggcatagctagcggaagggccaggtacaccaaaaactgggagaccaacaagtttagtgggtatccactctatcactcagtctacgagacgtatgaactggtcgaaaaattttatgacccaatgtttaaatatcatctaactgtagcccaggtgaggggcggtatggtgttcgagctggcgaactccatcgtgctgcctttcgactgcagggattatgcggttgtgttgaggaagtacgcggataagatctatagcataagcatgaagcaccctcaggaaatgaagacctacagtgtcagctttgactctttattctccgcagtgaagaattttactgagattgccagcaaattttctgaaagactgcaagactttgacaagtcaaaacatgtgatttacgcgccttcatctcacaacaagtacgcaggggagagctttccagggatctacgatgcattgttcgacatcgagtcaaaggtcgaccctagcaaagcttggggggaagtcaagaggcagatttacgtggcagccttcactgttcaagccgctgctgaaaccctgtctgaggttgcctag

SEQ ID NO: 223481 - DNA, 774 bp, Artificial Sequence
  Description of Artificial Sequence: Synthetic coding sequence
atggctcagagaatgaccacacagctgctcctgctgctggtttgggttgcagttgtgggagaggcgcagactagaatcgcctgggcacgcacagagttgcttaacgtctgtatgaatgccaaacatcacaaagagaagcctggtcctgaggacaaactgcacgagcagtgcagaccctggcgaaagaatgcctgctgcagtactaacacctctcaggaagcacataaggacgtttcttatctttatcgattcaactggaatcactgcggagaaatggcccctgcgtgtaaaaggcattttattcaggatacctgcctctacgagtgttcaccaaacctgggtccatggattcagcaagtggatcagtcatggcgaaaggaacgcgtcctgaatgttccgctgtgtaaggaggactgtgagcaatggtgggaggattgcagaacgagctatacgtgtaagtcaaattggcacaaagggtggaattggacatctgggtttaataagtgtgccgtgggcgctgcttgtcagccgtttcatttctatttccctactcccaccgtgctgtgcaacgagatatggacccatagctataaggtgagtaattactccagggggagcggacggtgtatccaaatgtggttcgaccccgcacaggggaaccccaatgaggaagtagcccgattctatgctgctgccatgagtggcgctggaccatgggcagcctggccgtttctgcttagtctcgctctcatgctgctgtggttgttaagttag

SEQ ID NO: 223482 - DNA, 774 bp, Artificial Sequence
  Description of Artificial Sequence: Synthetic coding sequence
atggcgcagcggatgaccacccaacttctccttctgctggtttgggtggctgtggtgggggaagcacagacgagaattgcctgggcccgaaccgagttgctcaacgtatgtatgaacgccaagcaccacaaggaaaagccaggtccagaggataagctgcacgaacagtgccgaccatggagaaagaacgcatgttgtagcacaaacacttctcaggaggcgcacaaagatgtttcatatctgtatcgtttcaattggaaccactgtggggagatggcccctgcctgcaagcggcatttcatccaagatacctgcctgtacgagtgcagccccaacctgggcccttggattcagcaggtggaccaaagctggagaaaagagcgcgtattgaatgtgcccttgtgcaaggaggactgcgagcaatggtgggaagactgtaggacttcgtatacatgcaaatcaaactggcataagggttggaattggacttctgggttcaacaagtgcgcagtcggggctgcctgtcaaccgtttcacttctatttccctacacccaccgtcctgtgcaatgaaatctggacccacagttacaaggtgtccaactactcacggggaagcggaaggtgcatacagatgtggtttgatcccgctcagggcaacccaaacgaagaagtggcacggttctatgcagctgccatgtctggggcaggtccctgggccgcttggccatttctgctgtctctggcattaatgctactctggctgctgtcctag

SEQ ID NO: 223483 - DNA, 774 bp, Artificial Sequence
  Description of Artificial Sequence: Synthetic coding sequence
atggcacagagaatgaccactcagttattactgctgctggtctgggtcgccgtcgtgggagaagcccagacccggatcgcgtgggctcgaacagagctgcttaatgtttgtatgaacgcaaaacaccataaagaaaagcccggacccgaagataaactgcacgagcagtgtcgaccatggcgcaaaaatgcttgttgcagtaccaacactagtcaggaggcccataaggatgtcagctacctgtatcgcttcaactggaaccactgcggggagatggcaccagcctgtaagcgccacttcattcaggacacatgcctctatgagtgtagtcctaatctgggcccatggatccagcaagtggaccagtcttggcgcaaagagcgcgtcctaaatgtccccctgtgcaaggaggactgtgagcaatggtgggaggattgccgcactagctatacttgtaagtcaaattggcacaagggttggaactggacgtccgggttcaataagtgtgccgtcggggctgcctgccagccgtttcacttctattttcccacaccaactgtactctgcaatgagatttggactcactcctataaggtctctaactacagcaggggctctggcaggtgtatccaaatgtggttcgaccccgctcagggcaaccctaatgaagaagtggccagattttacgctgccgctatgtcaggagccggtccctgggccgcatggcccttcctcctcagcttggccctgatgctgctgtggctacttagctag

SEQ ID NO: 223484 - DNA, 774 bp, Artificial Sequence
  Description of Artificial Sequence: Synthetic coding sequence
atggctcagaggatgacaactcagctgctgctgctgctggtatgggtggccgtcgtcggggaggctcaaacaaggattgcatgggccaggacagaactcctcaatgtgtgcatgaatgcgaagcaccacaaggaaaaaccgggacctgaagacaaactgcacgaacaatgccggccatggcgaaaaaacgcctgctgtagcactaacacatctcaggaagcacataaagatgtgagttatctctatcgttttaactggaatcactgtggcgagatggctccggcatgcaagaggcatttcattcaggacacgtgtctgtacgagtgcagtcctaatctgggaccctggatccagcaggtcgatcagtcttggagaaaagagcgagtgctcaatgtaccgctgtgtaaggaagattgtgagcagtggtgggaggactgtcgcacaagctacacctgcaagagcaattggcacaagggctggaactggacgtccggcttcaacaagtgcgccgtgggcgcagcttgccaaccctttcacttttactttccgaccccaacggtgttgtgtaatgagatttggacacacagctacaaagtctcaaactactccagaggcagtggcaggtgcatccaaatgtggtttgatcctgcacagggcaaccctaacgaggaagtggcccgtttctacgccgctgccatgtctggcgcagggccttgggcagcatggccctttctcctgtccctggccctgatgcttttgtggctcctgagctag

SEQ ID NO: 223485 - DNA, 768 bp, Artificial Sequence
  Description of Artificial Sequence: Synthetic coding sequence
atggtgtggaagtggatgcccctcctgctccttctggtgtgcgtggccaccatgtgttccgcacaggacaggacagacctacttaacgtttgcatggatgctaagcaccataagactaagcctggacctgaggacaagctgcatgatcaatgttctccgtggaaaaagaatgcatgttgcacagcctccacttctcaggagctccacaaagacacaagtcggctatataacttcaactgggaccattgcgggaagatggagcccgcatgcaagcgccactttatccaggacacttgtctgtacgagtgttcaccgaacttgggcccatggatccagcaagtgaatcagtcttggcgcaaggagcgcttcctggatgtccctctgtgtaaggaagactgtcagcgctggtgggaggattgccacacatcgcacacatgtaagagcaattggcatcggggttgggactggacgtccggtgttaataagtgtcctgcaggcgcactgtgtaggaccttcgaatcttatttcccaactccagccgcactgtgcgaaggtctctggtctcatagctacaaagtttccaactactcacggggttcaggaagatgtatccagatgtggttcgactcagctcagggcaatcctaacgaggaggtcgccaggttctatgccgcagctatgcatgtcaatgccggagaaatgctccacggcacaggagggttgctactctctctggcactcatgctccagttatggctgttgggatag

SEQ ID NO: 223486 - DNA, 729 bp, Artificial Sequence
  Description of Artificial Sequence: Synthetic coding sequence
atgttacccgctgcaacagaagtgcaattgcgcctgcaggggcagaaagacatggtctggaaatggatgcccttgctcctacttctcgtgtgcgttgccactatgtgctccgcacaggatcggacggacctgctcaacgtttgcatggacgcaaagcaccacaaaaccaagccagggcctgaagacaaattgcacgatcagtgctcaccctggaagaagaatgcttgctgtaccgcaagtactagccaagagctacacaaggacacaagcaggctgtacaatttcaactgggatcattgcggaaagatggagccagcctgcgctaccagctcaaggacacccgtgtcaatgtcggcgcaccctggagcactcgatccggcaggcgagagcgaattggctaaaaatgcatcctggatgtgtccctatgcaaagagaacagtgtcagcaggaggtaggatcgtaacgccgccaactagagccagggccaccgggacagaagatggtaccggaccccaggagctgactagtgcccagctgggcctgtctgcagccccactgagtcctacatcacctctccaacttccattcgtcaaagcaagtggggtcacccacactagatctgccacgaccgcagagggggctgctgctgcaagccgctgcgggcttatccagcctagggctaccccgaccaggaaatggagaggatcaatgcttcagccctgcatgtag

SEQ ID NO: 223487 - DNA, 516 bp, Artificial Sequence
  Description of Artificial Sequence: Synthetic coding sequence
atggtctggaagtggatgccgctgctgcttcttctcgtatgtgttgccactatgtgctcagcacaggatcgcacagatttgcttaacgtttgtatggatgctaaacatcataagaccaaacctggtcccgaagataagctacacgaccaatgttccccttggaaaaagaacgcctgttgtaccgccagcaccagccaggagttacacaaggatactagccggctgtacaatttcaactgggaccattgcggaaaaatggagcctgcctgcaaacggcactttattcaggacacatgtctgtatgagtgttcccccaatttagggccatggatacaacaagtaaaccagtcttggagaaaagagagattcctggacgtcccgctgtgcaaggaagattgccagaggtggtgggaagactgtcacactagtcacacgtgtaaatccaattggcatcgtgggtgggattggacatccggcgtgaacaaatgccctgcgggagctctgtgccgtacatag

SEQ ID NO: 223488 - DNA, 2010 bp, Artificial Sequence
  Description of Artificial Sequence: Synthetic coding sequence
atggcacttctcctcgtttccttgttagccttcctctcccttggcagtggctgccaccataggatttgtcactgttctaaccgcgtgtttttatgtcaagaatctaaggtcactgaaattccttctgatctgccaagaaatgcgattgagctgcgctttgtgcttactaaactccgtgtcattcagaagggagctttctcaggctttggagacctggagaagatcgaaatcagtcaaaatgatgtgctcgaggtcatcgaggccgatgtgttctctaatctgccaaagctgcatgagattagaattgagaaggccaataacctcctgtacatcaaccccgaggcctttcagaatcttcctaacttgcagtacctattgatttcgaacacaggaatcaagcatctgcccgacgtccacaaaatccactccttacagaaggttttgctgtggctgaataagaacggtatacaggagatccataactgtgcgtttaatggcacacaactggatgagttaaatctctccgataataacaacctggaggaactgcccaacgatgtgttccatggtgcctcagggcctgtgatactggacatctctcgtacccggattcatagtctcccttcttacggcttggaaaaccttaaaaagctgcgggcacgcagcacatataacttgaaaaaactgcctaccctggaaaaattggtggccctgatggaagcctctctgacgtacccaagccattgctgtgcctttgcaaattggcggagacagatatcggaacttcatcccatttgcaataagagtatcttacgacaggaggtggactacatgacccaggccagaggccaacgatcctccttggcagaagacaatgaatcaagctactccaggggattcgacatgacttacaccgaatttgattatgatctgtgtaacgaagtagttgatgtgacctgttcccctaaacctgacgcattcaacccctgcgaagacatcatgggttacaacatactgagagtgcttatctggtttattagtatcttagctattaccggaaacataattgttctggttatcttaaccacgtctcagtataagctcaccgtgcccaggtttctgatgtgcaacttggctttcgcggacttatgtatcgggatctatctgctcttgattgcctcagtcgacattcatactaagagccagtatcacaactacgctattgattggcagacaggggctggttgtgatgccgcaggattctttacagtctttgcctctgagctctccgtatacactctgactgccatcaccctggagaggtggcatacaatcacacatgccatgcaactggattgcaaggttcagttgagacatgctgcatcagtgatggtgatggggtggattttcgcgtttgctgctgccctgtttccaatattcggtatttctagctacatgaaagtgagcatctgcttaccaatggacattgatagccctctgagtcaactgtatgtgatgtctttgttggtcctgaatgtcttggcattcgtcgtcatttgcggctgctacattcacatctacctgactgtaaggaatcccaacattgtgagcagctcgagcgacactcggattgccaagcggatggccatgctaatttttacggatttcttgtgtatggcacccatttcgttcttcgctatttctgcctctctcaaagtgcctttaattaccgtgagtaaggctaagatcctgctggtgctgttccacccaatcaactcatgcgcaaaccccttcctatatgcaattttcacgaagaatttcagacgtgactttttcattctgctttctaagtgcggatgttatgaaatgcaggcccagatctacagaactgaaaccagctccacagtgcacaacactcatcctagaaacggacactgttcttcagcccctcgggtcacctcagggtcgacctacattctcgtacctctcagtcatctggcacagaattag

SEQ ID NO: 223489 - DNA, 1902 bp, Artificial Sequence
  Description of Artificial Sequence: Synthetic coding sequence
atggcgttgttactcgtatcattgttagctttcctctccctcggaagtgggtgccatcacaggatttgtcactgctctaatcgtgtattcctgtgtcaggagtcaaaggtgaccgagatcccaagcgacctcccgaggaatgctatcgagctgcggtttgtgctcaccaagctccgagttattcaaaaaggtgctttcagcggattcggcgaccttgaaaaaattgagatcagccagaatgacgtccttgaggttatagaagctgacgtgttttcaaatctgccaaagctgcatgagattcggattgaaaaagccaataaccttctgtacattaatcccgaggcgttccaaaatctgccgaatttgcagtatctccttatctccaacacaggtatcaagcacctccccgacgttcacaagatacatagcctccaaaaagtgctgttagatattcaggacaacattaacatccatacgatcgaaagaaacagctttgtgggcttatccttcgagagcgtgattctatggctgaataagaacgggatccaggaaattcataattgtgccttcaatggcactcagttagatgaattaaacctgtctgacaataataatcttgaagagttgcccaatgatgtcttccatggggcatccggcccagtcattctctctgagctgcatccaatttgtaacaagtctatcctgcgccaggaagttgattatatgactcaggcaagagggcaacgatccagtttagcagaagataacgagagctcatatagcagagggtttgacatgacctatacagagttcgattatgatctctgcaatgaggttgtcgatgtgacatgtagccccaagcctgatgccttcaacccctgtgaggatatcatggggtataatatcctgagagtactcatatggttcatttctattctagccattaccggaaatattatcgttcttgtgatacttactacttcccaatacaaactcacagtccctaggttcctcatgtgtaatctcgcctttgcggacctgtgtatcggcatatacctgctgctgatcgcctcagtcgatatccataccaagagccaatatcataactatgccatcgattggcaaacaggtgccggatgtgacgctgcagggttcttcaccgtgttcgcatctgagttgtcagtgtatacactgaccgccataactctggaacgctggcatactattactcacgccatgcagcttgactgtaaggttcaactccgccatgctgcctccgtaatggttatgggctggatattcgcattcgctgctgcactcttccccatctttggtatctcctcctacatgaaggtgtcaatctgcctgcctatggacatcgactccccattaagccagctatatgtgatgtctttgctcgtgttgaacgtgctggccttcgtcgttatctgtgggtgttacatacacatctaccttaccgtgcgaaatcccaatatcgtttcaagtagctcagatactcggattgccaaaaggatggccatgttgatttttaccgactttttgtgtatggctccaatcagtttctttgcaatctctgcttcgctgaaagtacccctaataaccgtcagtaaagccaaaatcctgttggtactgtttcatcccatcaacagttgtgctaacccgtttctctacgcgatttttactaaaaacttccggagggatttcttcatcttgctctctaaatgcggttgctatgagatgcaggcccaaatttaccggactgagacctcttcgactgtgcataacactcaccccagaaacggacattgctcatccgctccgagggtcacatctggctccacctatatcctggtgccgctctcacacttggctcaaaactag

SEQ ID NO: 223490 - DNA, 2088 bp, Artificial Sequence
  Description of Artificial Sequence: Synthetic coding sequence
atggctcttctgctggtcagtcttctggcattcctttctctcggatcaggttgtcaccaccgcatctgccactgttccaaccgcgttttcctttgtcaggaaagtaaagtcactgaaattccctccgatctacccagaaatgcaatagagctgcgcttcgtgctgacgaaattgcgggtcattcagaagggggctttctccggctttggggatctggaaaaaattgaaatctcccagaacgatgtcctcgaagtgattgaagccgacgttttcagcaatttgccaaagctccacgaaataaggattgaaaaagctaacaatttgctgtacatcaacccagaggcattccaaaacctcccaaatctgcagtaccttttaataagtaacaccggcattaaacacctacctgacgtgcataagatccactctctacagaaggtgctgcttgatattcaagacaatataaatatccacacaattgagcgcaattctttcgtaggtctctctttcgaaagcgttattctgtggctgaataaaaatggaattcaagagatccataactgcgcatttaatggtacacagttggatgaactgaacttgtcagacaataataatctggaggaacttccgaacgatgtcttccatggagcttctgggccagttatcctcgacatctcccggacccgcattcattcccttccttcttacggcttagagaacctgaagaagctcagagcacgatcaacctataaccttaagaaactaccaaccctggagaagctagtggctcttatggaagcttctctcacatatccatcacattgttgcgcttttgccaactggaggcgccagatctccgagttacaccctatttgtaacaaaagcattctgaggcaagaggtggattacatgactcaagcgcgtgggcagaggtcttccttagccgaagacaatgaatcatcctactcccgcggttttgatatgacatacacagagtttgactacgatttatgtaatgaggtggtggatgtgacttgcagtcccaagcctgacgcgttcaatccctgtgaagacatcatgggatacaacatcttacgcgttctgatttggtttattagcatccttgcaataaccggcaacattatagtcctcgtgatcttgaccactagccaatacaagctgaccgtacctcgcttcctgatgtgcaaccttgcatttgccgacctgtgtattggaatttacctgctgttgatcgcgagtgtagatatccatacaaaatcacagtaccacaactacgcgattgattggcagacaggcgctggctgcgatgccgctggattcttcaccgtgtttgcttccgagctcagtgtctacaccctgactgctattacgctggaacggtggcacaccatcactcacgcaatgcagttagactgtaaagtgcaactgcggcacgcggcttccgtgatggtgatgggctggatctttgctttcgctgcggctctcttcccaatctttgggatctctagctatatgaaagtctccatttgtctgcctatggacatagacagcccgctgtcgcagttatatgtgatgagcctgctagtgctgaacgtactcgcattcgtggtgatatgtgggtgttatatccacatctacctgaccgtccgaaatcccaacattgtctcctcaagttccgatacacggattgcaaaaagaatggccatgctgattttcactgactttctatgtatggcgcctatatccttcttcgccattagtgctagcctgaaggtcccgctcatcaccgtgagcaaagctaaaatcttgttagtgttatttcatcctatcaactcttgcgcaaaccctttcttgtatgctatattcaccaaaaactttcgtcgagatttcttcatcctgctttctaagtgtggctgttatgagatgcaagctcaaatctaccgcaccgaaacaagctcgaccgtccataatacacatccgaggaatggccactgttcctctgcccctcgggtgacaagcgggagtacttacatacttgtgcctctctcccatctcgctcaaaactag

SEQ ID NO: 223491 - DNA, 1296 bp, Artificial Sequence
  Description of Artificial Sequence: Synthetic coding sequence
atggaagcttcactcacatacccgagtcactgctgtgcatttgccaactggcggcgtcagatttccgagctgcaccctatttgtaataagagcatcctccgacaggaggttgactacatgacgcaagctaggggccagaggtcttccttggcagaagataatgagtcatcatacagtcgcggattcgatatgacttacactgaattcgactacgatctctgtaatgaagtggttgacgttacgtgcagtcctaagccagatgccttcaacccttgcgaggacatcatgggctataacatccttagggtgcttatctggtttatctccattctggccatcacaggcaacatcattgtgctggtgatcttgaccactagtcaatataagctgactgttcccagattccttatgtgtaatcttgcgttcgcggacctgtgcatcggtatttacctattgttgattgcctctgtggatatccacacaaaatcccagtatcacaattacgcgattgattggcagacaggggcaggctgtgacgcagcgggattcttcactgtgtttgcttctgaattgtctgtgtacacccttactgcgattaccctcgagcgctggcacactatcactcacgctatgcagctggactgcaaagtgcagctccgtcatgcggcttcggtcatggtcatggggtggattttcgctttcgctgcagccctgtttcccatcttcgggatctcatcctacatgaaagtctcaatttgtctgcccatggacattgacagtcccctgtcccagttgtacgtcatgtccctgctcgtgttgaacgtgctggcgttcgtggtcatctgcggctgttacatccatatttacctaaccgttagaaatcccaacattgtgtcctcctcatccgacacgcggatcgccaagcgcatggctatgctgattttcaccgatttcttatgcatggcacctatttctttttttgcaatctcagcaagtcttaaagtccccctgattaccgtaagcaaggctaagatcttgcttgtgcttttccatccaataaactcctgtgcaaacccctttctgtacgcaatattcacgaagaatttccggagagatttctttatcctcctgtcaaagtgcggatgttacgagatgcaggcacagatttatcgtacagagacgagtagtaccgtgcacaatactcaccccaggaatggccattgctcttccgcgcctcgagtgacatcaggctctacttatatcctggtgcctctgtcacatctcgcacaaaactag

SEQ ID NO: 223492 - DNA, 3417 bp, Artificial Sequence
  Description of Artificial Sequence: Synthetic coding sequence
atggccccaaccctgttccaaaagctgttctccaagaggaccgggctcggcgctccaggcagggatgccagagatcctgactgcggattctcttggccccttcccgagttcgacccgtctcagatccgcctgatcgtttaccaagactgcgaaagacgtgggagaaacgtgctgtttgactcatctgttaaacgccgtaacgaggacatcagcgtgtccaaactaggatcggacgctcaggtgaaggtcttcgggaagtgttgccagctaaaacccggaggcgatagctccagctctctggactcttcggtcacaagctctagcgacatcaaggaccagtgtctgaaataccaggggagcagatgttccagcgacgccaacatgctgggtgaaatgatgttcggatccgtcgcaatgtcctataaggggagcactctcaagatccaccagatcagatctcccccacagttgatgctctccaaagtctttactgcacggaccggctccagcatatgcggtagtttgaatacattgcaggattcactggagttcattaaccaggacaacaatacactgaaagcggataataatacagtcatcaacgggctccttgggaacattgttcactctaacccgatggatatgccgggtcgggagctaaacgaagatagagatagtggtatagctaggagtgccagcttatcaagtctgttgattacacctttccccagtccgaatagctctctgacgagatcctgtgcctcctcttaccagaggcgctggcggaggagccaaactacttccttggagaatggcgttttccccagatggtctatagaggagagctttaatctatctgacgagtcttgcggtccaaaccctggcattgtcagaaagaaaaagattgccattggcgtcattttttctctttccaaggatgaggatgaaaataacaaattcaacgaatttttttttagtcacttccccctattcgaatcgcatatgaataaattaaaatccgctattgagcaggccatgaaaatgtcccgccgttctgccgatgcaagccagagatccctagcctataatcgaatcgtcgacgccctcaatgaatttcgaaccacaatttgcaatctgtatactatgccccgtattggagaacccgtgtggctgacaatgatgtccggcaccccagagaaaaatcatctctgctatcgatttatgaaggaattcacctttctgatggagaatgcctcaaagaaccagtttctaccggctctcatcactgccgtcctaacaaaccatctagcttgggtgccaacggttatgcccaacgggcagccaccaataaaaatattcttggagaaacacagttcccagtctgtagatatgctggccaaaacacacccttacaatcccttgtgggcacagctgggagacctatacggagcgatagggagtccagtgcgcctggccaggaccgtcgtcgttggaaagcggcaggacatggtccagcgattgttgtatttcttaacatatttcatcagatgctccgaactacaggagactcacctgcttgagaatggcgaagatgaggccatagtcatgccgggaactgtgatcaccactacactggagaagggtgaaatagaggagtctgagtacgtactggtgaccatgcacagaaacaaatcttctctgctgttcaaggagagtgaggagattaggacgcccaactgcaattgcaaatactgcagtcacccacttctgggccagaatgtcgagaacatatcgcagcaggagcgcgaggacatccaaaacagcagtaaggagctgctcggaatctccgatgagtgccagatgatctctccctccgactgccaagaggagaatgccgtggatgtaaaacagtatcgggacaaactgcggacgtgcttcgacgccaagctggagaccgtcgtttgcactggctctgtgcccgtagataaatgcgctctctccgagtccggtctggagtcgacagaggaaacatggcagtcggagaagctgctggattccgattcccacacaggtaaggctatgaggagtactggaatggtggttgagaagaagccgccagataagatcgtgcctgcctccttcagttgcgaagccgctcaaacgaaagtcacctttctcatcggcgattctatgagtcctgacagtgataccgagctgcggtcacaagccgtggtggaccagatcacgcgacatcatactaaacccctcaaggaagaaagaggggctattgaccagcatcaggaaactaaacagaccaccaaggatcagagcggtgagtccgatactcagaacatggtcagtgaagaaccttgtgagctgccatgttggaatcactctgacccagaatccatgtctctgttcgatgagtatttcaacgacgattccatcgagacaagaaccatcgacgatgttccctttaaaacttctactgactctaaagatcattgttgtatgcttgaattttctaaaattctgtgcactaagaataataaacagaacaatgagttctgcaaatgtatcgagaccgtccctcaagactcatgcaaaacttgtttccctcagcaggaccagcgcgatactttaagcatactggtccctcatggcgacaaagagagcagcgataagaagatagctgtgggcactgagtgggatattcctaggaacgagtcatcagactcagccctaggagatagcgagagcgaggacaccggccatgacatgacacgacaggtgtcctcttattacggaggtgagcaagaagactgggccgaagaagatgaaattcctttccctgggagtaaattaatagaggtctccgcagtgcaacctaacatcgccaatttcgggcgttccttgctcggcggatactgcagcagctacgtcccagatttcgttctgcaaggtattggttccgatgagcgcttcagacagtgtttaatgagcgatctcagccacgcagtccagcatccagttcttgacgagcctattgctgaagctgtatgtatcatcgcagacatggacaagtggaccgttcaggttgcctcctctcagcgtcgagtaactgataacaagcttggtaaagaagtcctcgtgagttcattggtctcaaacctgctccactcaactcttcagctctacaagcataacctcagcccaaatttttgtgtgatgcaccttgaagatagactccaagagctttacttcaagtctaaaatgctatcagaatacttacgaggccagatgcgggtacacgttaaagaattaggcgtcgtactgggcatcgagtcttccgatctgcccctcctggccgctgtcgcaagcacacattccccatatgtggcccagattctgctttag

SEQ ID NO: 223493 - DNA, 3501 bp, Artificial Sequence
  Description of Artificial Sequence: Synthetic coding sequence
atggcacctaccctgtttcaaaagctgttttccaagcgcaccgggttgggggcacctggtcgggacgcgagggacccggactgtggatttagctggccgctgccagagttcgacccctcccaaatcaggttgattgtttatcaggattgtgagaggcggggtcgaaacgtcctttttgattcatcagtgaagcggagaaatgaagatattagcgtttctaagcttggctctgacgcacaggtgaaggtattcggaaagtgttgtcagttaaaaccgggaggcgattcaagctctagtcttgactctagcgtaacttccagtagcgatataaaggatcaatgcctaaagtaccagggcagccgatgctcaagcgatgctaacatgctgggcgaaatgatgttcggaagcgtggccatgagctataaaggctctactctaaagattcatcagatccgcagtccaccccaactcatgttgagtaaggttttcaccgcccgaaccgggtctagtatctgtgggagtctcaacaccttgcaggatagcctggagttcattaatcaagataacaacactctgaaggcagataataacaccgtgattaatggactgctgggaaacattggtctttctcaattttgctctccaagacgcgcattttccgagcaaggaccattgagactgataagatctgcttctttttttgcagtacattccaacccaatggatatgcccggacgggaactcaacgaggaccgtgatagcggtattgctaggtccgcctctttaagcagtctgctgatcacgcccttcccctcccctaattcttctttgacccgcagctgtgcctcaagttaccaacgcaggtggaggcgcagccaaactacttctctggagaacggtgtgtttccacgctggtccattgaggagagcttcaacctgagcgatgagtcatgtggcccaaacccaggaattgtgcgaaagaaaaaaatcgcaattggggtgatcttctctctgagcaaagacgaagacgagaacaacaaattcaacgagttctttttctctcactttcctttatttgagtcccacatgaacaaacttaagtcagccattgaacaggcaatgaaaatgtcaaggaggtcagcagatgcttcccagagaagccttgcatacaaccggatcgttgatgcactaaatgaattccgcaccactatctgcaacctgtataccatgccgaggattggggaacccgtatggctgactatgatgtcaggaacccccgagaaaaatcacctgtgttaccgattcatgaaggaatttacatttctcatggagaacgcatccaagaaccagtttcttcccgcattgatcactgccgttctcactaaccacctcgcctgggtcccgaccgtgatgcctaacggacagcctccaatcaagatcttcctggaaaaacactcaagtcaatcagttgatatgttggcaaagacgcatccttacaatcccctgtgggcccaactcggagatttatatggcgctatcggcagccctgtccgccttgccagaacggtggttgtggggaagcgccaggacatggttcagaggctgctgtactttctgacctatttcatacgctgcagcgagcttcaagagacccaccttctagagaacggagaggacgaagcaattgtcatgcccggtaccgtgattaccacgacactcgagaagggtgagatagaagagagtgaatacgtgctggtgactatgcaccgaaataagagttccctgctcttcaaagagagtgaggaaatacgcacacctaactgcaattgcaaatactgttcccatcctctactcgggcagaatgtggaaaacattagtcagcaagagagagaggatatccagaacagctctaaagagctcttggggatcagcgacgagtgccaaatgatctcgccaagtgattgtcaggaggaaaacgctgtggacgttaagcagtacagagacaaactgcgcacttgtttcgatgccaaactggagactgtagtgtgtacagggtctgtgcctgtggataaatgcgccctgagcgagtctggattggaatcaaccgaggagacgtggcagtcggaaaaactgctagactctgattcacacacaggaaaagccatgagatctactggaatggtcgtcgaaaagaagccacctgataagattgtgccagcgtcattctcatgtgaggctgcacaaaccaaggttaccttcctcattggcgatagcatgagcccagacagtgacacggagttacgaagtcaagcagtggtggaccaaatcactaggcaccacacgaaaccattgaaggaagagaggggtgcgatcgaccagcaccaggagaccaagcagaccaccaaagaccagtcaggtgagtccgacactcaaaacatggttagcgaggagccttgcgaactcccatgttggaaccactcggatccggagtccatgtcactatttgatgaatacttcaatgacgattccatcgagaccagaaccatcgacgacgtgcccttcaaaacctccaccgatagtaaggatcactgctgtatgctggagttcagcaaaatcctgtgtacaaaaaacaacaaacaaaataatgagttttgcaagtgtatcgaaacagtaccacaagatagctgtaaaacttgctttccccagcaagaccagcgcgataccctgtctatcctggtccctcatggcgacaaagaatcaagcgataaaaaaattgccgttggtaccgaatgggacatccctcggaacgaatcatccgactctgcactaggcgattccgagagtgaggacacaggccatgacatgacccgccaggtgagctcttactacggcggagaacaggaagactgggccgaggaggatgagattccgtttcccggatccaagttgatcgaggtaagtgctgttcagccaaatattgcgaatttcggcaggtctctgctgggcggatattgctcgagctacgtgcccgactttgttcttcaagggatcggtagtgacgaaagattccgtcaatgtctgatgtccgatttatctcacgctgtgcagcaccccgtcttggacgagccgattgcagaggctgtgtgtatcatagcggacatggacaagtggactgtgcaggtggccagctctcagagacgcgtgacggataacaagctcggcaaggaggtattggtgtcaagcctggtcagcaacttgcttcatagcacactccagctttataagcacaacctgtcacccaacttctgcgtcatgcatctcgaagacaggcttcaagagttgtacttcaaatctaagatgctctccgagtacttgaggggtcagatgagagtacacgtgaaagagctaggcgtggtgcttggcatagaaagctccgacctgccattactagcggctgtcgcctccacccattctccttatgtggctcaaatattactgtag

SEQ ID NO: 223494 - DNA, 1527 bp, Artificial Sequence
  Description of Artificial Sequence: Synthetic coding sequence
atggcgcctaccctgtttcagaaactgtttagtaagcggaccggcctaggtgctccaggcagggatgcacgtgacccggattgtgggtttagttggcccctgcctgagttcgacccatctcaaattcggctgatcgtgtatcaagattgcgaaagacggggtaggaatgtcttgtttgatagctctgtgaaacgtcggaacgaggatatcagcgtgtccaaactgggaagcgatgcccaggtgaaggtcttcggaaaatgttgccagctcaaaccagggggtgattcaagcagcagccttgattcatcggtgacctcttcgagtgacataaaggatcagtgcctcaagtaccaggggtcgcgctgttcttctgatgccaacatgctgggggagatgatgttcggttcagtggccatgtcctataagggcagcactcttaagattcaccagatccgctctcctccacagctcatgctcagtaaagttttcaccgcaagaaccggctcaagcatttgcggaagcctgaataccttgcaggacagccttgaattcatcaaccaggataacaataccctaaaagctgacaataacacggtaattaatggcctgcttggtaacatcggtctgtctcagttctgtagcccccgacgggctttttcagaacagggtcccctccggctgatcagatcagcatcattcttcgctgtgcatagcaatcccatggacatgcccggtcgcgaactaaacgaggaccgagattccggtatcgctagaagcgctagtctgtcaagcctgctgataaccccttttccatccccaaacagcagccttactagatcttgtgcctcgagctaccaacgacggtggcgtcgatcacaaactacaagtctggagaatggggtattccctcggtggagtattgaggagtcttttaacttatccgatgagagctgcggaccaaatccgggaatcgtgcgtaagaaaaagatagccattggggtgattttcagcctgtccaaggacgaggatgaaaataataaatttaacgaatttttttttagccactttcccttgttcgagagtcatatgaacaaactaaaaagtgctatcgagcaggctatgaaaatgagcaggagatctgccgacgcttcccagcgatcactggcctataatcggatcgttgacgctctaaacgagttcagaacaaccatatgtaacctatatacgatgccgcgaatcggcgagcctgtctggctgactatgatgagcggcaccccagagaagaaccatttgtgttacagattcatgaaagagtttacatttctcatggagaatgcaagtaaaaaccagtttttgcctgccctcatcaccgccgtgctcacaaaccatctcgcctgggtgcccacagtgatgccaaatggacaaccacctataaaaatttttctcgaaaagcattcatcccaatccgtggacatgctggccaaaacccacccgtacaatccactttgggctcaactcggaatgtag

SEQ ID NO: 223495 - DNA, 2757 bp, Artificial Sequence
  Description of Artificial Sequence: Synthetic coding sequence
atggacatgcccggtcgagagctgaatgaagaccgcgattcgggaatcgctcgctcagcatcactcagctccctgctaatcacacccttcccgagcccaaactcatctctcacccgcagttgcgcttcgtcatatcaacgcaggtggcggcgtagccagacaacaagtctggaaaacggagtatttcctagatggtcgattgaggagtcttttaacctcagcgacgaaagctgcggaccaaacccgggaattgtaaggaaaaagaagatcgcaatcggcgtgatatttagcttatcaaaagatgaagacgaaaacaataagttcaacgagttttttttttctcacttccccttgtttgaatcccacatgaataagctcaagtcagccatagaacaggcgatgaaaatgtccagacggtcagctgatgcttcacagagatcccttgcctataaccggatagtggacgccttgaacgagttccgcactacgatctgtaacctgtacaccatgccccgaatcggcgaaccagtctggttgaccatgatgtctggcactcctgagaagaaccatttatgttataggtttatgaaagaatttacctttctcatggagaacgcttctaaaaatcaatttctgccagcactgattaccgccgtgctgactaaccacctcgcatgggtgcccactgttatgcctaatggccagcctccaattaaaatctttctggagaaacacagttctcagtccgtggatatgcttgccaaaactcacccttataaccccttgtgggcccagcttggggatctttatggggcaattggctcccccgtgcgcctggcgaggaccgtggtcgtgggcaagaggcaggacatggtgcaaagactgttatacttccttacatactttatccggtgttcagagctccaggaaacccacctgctcgagaacggggaggacgaggccattgtgatgccgggtaccgtgatcacgactacactcgagaaaggggagatcgaggaatctgagtatgtgctcgtactcttattcaaggagtctgaagaaatccgcaccccgaactgcaattgtaagtactgcagtcaccctctgttaggacaaaacgtcgaaaatatttcccagcaggagagagaggacatccaaaattcaagcaaggagttactcgggatttcggacgagtgtcagatgatctccccctcggactgtcaggaagagaacgcagtcgatgtcaaacaatacagagacaagcttcggacctgctttgacgctaagcttgaaacagttgtttgcacagggtctgttcctgtggataaatgtgctttgagcgagtctggcctagagtctacagaggagacctggcagtcagaaaagctcctcgacagtgacagccacacagggaaagccatgagatccaccgggatggtggtggagaagaaaccccctgataaaattgtgccagcttccttctcctgcgaagccgctcaaacaaaagtgacattcctcatcggagattcgatgtctccagatagcgataccgaacttagatctcaggcagttgtggatcaaatcactaggcatcataccaaaccactcaaagaggaaagaggagccattgaccaacatcaggagacaaaacagaccacaaaggaccagtcgggggaatctgatacacagaacatggtgtcagaggaaccctgcgaactgccttgttggaatcatagtgaccccgagagcatgtccctgtttgacgaatactttaatgacgactcaatcgagacacgtacaatcgatgacgtgcccttcaagacttccactgactctaaggatcattgctgcatgctagagttctctaagatcctatgcactaagaataataaacaaaataatgaattttgtaaatgcatcgaaaccgtgcctcaagactcatgcaagacctgcttcccgcaacaggaccagagggataccttgtccatattggttccacacggagataaagagtcctcagacaaaaagatcgctgtgggcactgagtgggacatcccaaggaacgagagcagcgacagcgcactgggcgatagcgaatccgaggacactggacacgacatgacgcgtcaggtttcttcttactacggaggcgagcaggaagactgggctgaggaggatgagataccgtttcctggaagcaaattaatcgaggtttctgccgttcagcctaacattgctaacttcggacggtctttgctgggaggatactgctcttcctacgtgccagatttcgtgctccagggcattgggtccgatgaacgctttagacaatgcctgatgtcggacctgtcgcacgctgtgcaacaccctgttcttgatgagcctattgctgaagccgtctgtattatagcggacatggacaaatggactgttcaggtggcgagctcccagcgccgagtgaccgataataagttgggcaaagaggttctagtatcttcactagtcagcaatttacttcacagcactctacagttgtataagcataacctgtcgcctaacttttgtgtgatgcaccttgaagataggctgcaagagctttacttcaaaagcaagatgttatccgaatacctgcgcggtcagatgcgtgtccacgtcaaggagcttggcgtcgtgctggggattgaatctagcgatttgccactcctggcagctgtcgcttctacgcattctccttacgtcgcacaaatcttgctgtag

SEQ ID NO: 223496 - DNA, 3345 bp, Artificial Sequence
  Description of Artificial Sequence: Synthetic coding sequence
atggcgccaaccttgctgcaaaagctgttcaacaagagaggaagctcagggagttccgccgctgctagcgcccagggcagagcgccaaaggagggtcccgcttttagctggtcttgtagcgaatttgatttgaacgagattaggctgatcgtctaccaggattgtgaccgcagaggtaggcaggtgctgttcgactctaaggctgtacagaagatcgaggaggtcactgctcaaaaaacagaggacgtgcctataaagatctctgcaaaatgttgtcagggctcttcttctgtatctagttccagcagctcctccatctcctcccattcatccagcggaggctcaagtcatcacgccaaagagcagctccctaaatatcagtatacccgacccgcttcagatgtgaatatgctgggcgagatgatgttcggtagtgtcgctatgtcgtacaagggtagtactctgaaaattcattacatcaggtccccccctcagctgatgatctccaaagtgttcagcgccaggatggggtcattctgtggttctaccaacaacctgcaggattcgtttgaatatatcaaccaggaccccaatctggggaagctaaacactaatcaaaattccctcggcccatgtcgcacaggatctaaccttgctcacagcacacctgttgatatgccctctaggggacagaacgaggatcgcgactcgggaatcgcacgcagcgcctctctgtccagtctcttgataacacccttcccctcccccagcagttcgaccagcagctcgagctcatatcagaggagatggctgcgatcccaaacaacaagccttgagaatggcatcattccccgacgtagcactgatgagacattctccttggcggaggagacgtgctcttcaaacccagctatggtgagacgcaaaaagattgccattagtatcattttctctctgtgcgaaaaagaggaggcacaaaggaattttcaggatttttttttctctcacttccccctgtttgagagccatatgaatcggctgaagtcagccatcgaaaaggctatgatatcatgcagaaaaattgccgaatccagtctgcgggtccagttctatgtgagcagactgatggaggcattgggggagttcagagggaccatttggaatctctacagtgtccctcgaatcgccgagccggtctggttaaccatgatgtccgggacattagagaaaaaccaactttgtcagcgttttctgaaagaatttactctcctgattgaacagataaacaaaaaccagtttttcgcggctctactgacggcagtgctgacataccatctggcatgggtgcccaccgtcatgccagtggaccatccccctattaaagctttctcagagaagcgaacctcacagagcgtgaacatgctcgctaaaacgcacccctataacccgctatgggcgcaactcggagacctctatggtgccatcgggtcccccgtgagactcacacgcactgtagttgttggaaagcaaaaggacctcgtccaacgaattctctatgtcctcacatattttctacgctgtagcgagctgcaagaaaaccagctcacatggagcggtaatcacggggagggggatcaggtgctcaatgggtcgaagattataactgcccttgaaaagggagaggtcgaagaatccgagtacgtggtgatcacggttcggaatgaacccgcacttgtgcctccgattctgccaccaaccgctgctgaacggcacaacccttggcctacaggattcccagagtgcccggaaggaacggattcccgcgatctgggcctgaagcccgataaggaggccaataggagacctgagcagggatcagaggcctgcagtgcaggctgtctcggccctgcgtccgatgcttcttggaaaccgcaaaacgccttttgcggggatgagaaaaataaagaggcccctcaggatggtagctctagactgccatcctgcgaagtcctgggcgcaggcatgaaaatggaccagcaggccgtgtgtgagctgctaaaggttgagatgcccactcgactgcccgatagatccgtggcatggccgtgcccagataggcacctacgcgagaaacctagtctcgaaaaagtcaccttccagatcggaagctttgcgagcccggaatctgactttgagagccggatgaaaaaaatggaagagcgggtgaaggcatgcggcccatctcttgaagcctccgaagcggcagacgtcgctcaggatccacaagtttctcggagccccttcaagcctggtttccaggaaaacgtctgctgtccccaaaataggttaagtgaaggtgacgagggcgaatctgacaagggttttgctgaagatcgtgggagccgcaacgacatggccgcagacatcgccggtcagctttctcacgcagccgacctgggtacagcctcccacggggctggaggcaccggtggacgtcgtctcgaggctacccggggtctctatgtcaaggccgctgagggcccagtgctcgaaccagtcgcaccacggtgcgtgcagcgaggacccggacttgtggctggtgctaacatcccttgtggcgacgataacaaaaaggcaaatttccgaacagaaggcgatatccctcgcaatgagtcaagcgactccgccctgggagattccgacgacgaggcttgcgcaagcgcaatgcttgacctggggcacggcggtgatcgcacaggagggtctctagaagtcgagttgccgctgccccgaagccagagtatttcaacacaaaacgtgcgaaatttcgggcgtagtctgttggcgggttattgtcccacctatatgccggacctcgtacttcacggcacagggagcgatgaaaaactgaaacagtgtctcgtcgccgatctggtgcacaccgtgcaccaccccgttctggacgagcccatcgcagaggctgtctgcattatcgcggacaccgacaagtggtctgttcaggttgcgacttcacagcgaaaggtaaccgacaatatgaaactgggccaggacgtgctcgtctcttcccaggtcagcagccttctccagtccattctgcagctctataagctccaccttccagcagacttctgtattatgcatcttgaagaccgtttacaggagatgtatctgaaatctaagatgctctccgagtatctgcggggacatacacgagtccatgtgaaggagttaggagtcgtgctgggtatcgagagtaacgatctgccgctgttgaccgccatcgccagtacccattcgccctacgtcgcccaaatcctcttatag

SEQ ID NO: 223497 - DNA, 3414 bp, Artificial Sequence
  Description of Artificial Sequence: Synthetic coding sequence
atgtgtggcggaaccgccaatacgaccaaccagcccgagagctggcaagattccgctcggtgcgtttcagatgcagtcccaggagctgggcgaatctatcgagccctgctgtgtaccaagatcaaaaagcataccggggttgaccggtctaccgatcacactgagttagataattcatggtcctgtagtgaatttgatctaaacgaaatcaggctaatcgtctaccaggattgcgataggcgtggtcgccaggttctgttcgattctaaggcagtacaaaagattgaagaagtaacagcccagaagacggaggacgtgccaatcaagatttcagctaaatgctgccaaggcagcagttccgtgagctcctcgagcagttcaagcatttcctcccactcttccagcgggggaagtagccaccacgcaaaggagcagctgccaaaataccagtacacccgcccagcatctgacgtgaacatgcttggcgaaatgatgtttggctctgtcgctatgtcttacaaggggtctacgctgaaaattcattatatccgaagtcccccacagctgatgatctcaaaggttttttcagctaggatgggaagcttctgtggctccaccaacaatctccaggactcctttgaatacataaatcaggaccccaacttgggcaagctaaacacgaaccagaattccctgggaccttgtcggactggtagtaacctcgcccactccaccccggtggatatgccatctagaggccagaacgaggaccgcgattctggtattgccagatctgcgagcctctcgtcgttactcatcacaccttttccctcgccctcttcttcaacttcaagctctagctcttatcaacggaggtggttgaggtcacagacaacttcactcgaaaatggcatcattcccaggcgatccacagatgagacgttctccctggccgaggagacctgttcatctaaccctgccatggtgaggaggaagaagatagccatttccattatcttcagcctgtgcgagaaggaggaggcccagaggaattttcaggatttctttttttcccattttcccctgttcgaatcacacatgaatcgcttgaaatccgccattgagaaagctatgatatcctgtagaaaaatagccgaaagttctctgcgagtgcagttttatgtgagccgccttatggaagcactcggggagttcaggggaacaatttggaatctctattctgtgcccagaatagccgaacctgtgtggttaactatgatgtcagggactttggagaagaaccagttatgtcaacgcttcctcaaagagttcacattactcatagagcagataaacaaaaaccagttctttgcagcacttttgacggcggtgctaacctaccacctcgcttgggtgccaaccgtgatgccagtggaccacccccctatcaaggcatttagcgagaagaggacctctcagtcggtaaatatgctagcaaagacccatccctacaaccctctgtgggctcagctgggtgatctgtacggcgctatagggagccctgtgaggctgacaaggaccgtggtggttggcaagcagaaagacctggtgcaaaggatcttgtatgtcctgacatacttcctcaggtgttccgaactacaggaaaatcaactgacctggagcgggaatcacggggagggggaccaggtgcttaatgggtcaaagatcattactgcgctagagaagggagaggttgaagaatcggagtacgtcgtaataaccgtccgaaatgagcctgccctcgtccctcctatactgccccctaccgcagccgagcgccacaatccatggcctaccgggtttccggaatgccctgagggcaccgatagtagagacctgggcctgaagcccgataaagaggctaatcgcaggcccgagcagggatctgaggcctgcagcgccggttgtttaggtccagcttctgacgcaagttggaagccccagaatgccttttgcggcgacgaaaaaaacaaggaggcccctcaggatggatcttcaaggctcccttcttgcgaggtactgggggcaggaatgaagatggatcagcaggccgtttgtgaacttctcaaggtggagatgcctacacgcttaccagatagatctgtggcttggccctgtccggataggcatctccgggagaagcccagtcttgagaaggtgacttttcaaatagggtcctttgcaagccctgagtctgattttgagagcagaatgaagaagatggaagagagagtgaaggcctgtggcccatcgctcgaagcttcagaggccgctgatgtggcgcaggatccgcaggtcagcagaagtccttttaaaccaggattccaggagaatgtgtgctgcccacagaacaggttgtccgagggggacgagggcgagagcgataaaggttttgcagaagacagaggttctcgtaacgatatggctgccgatatcgccggtcagttaagtcacgctgcagatctggggactgcgtctcatggagccggtggcacgggagggcgacgccttgaagcaacccggggtctgtacgttaaagccgcagaagggccagtactcgaacccgtcgccccacgctgcgtccagcggggacctggtctggtggctggggctaatataccgtgcggtgatgataataagaaagccaattttaggactgaaggggatatacctaggaacgagtctagcgattcagctcttggggattccgatgacgaagcgtgtgcatccgctatgctggacctgggccacggcggagacaggactgggggttctctggaagtcgaattacccctccccaggtcacagtcaatctcaacccagaacgtgagaaacttcggcagaagcctgctagccggatattgcccaacgtacatgcccgacctggttctgcatggcacaggctctgacgagaaactgaaacagtgtctggtggccgacctcgtgcacaccgtgcaccatccagtgctggacgagcccatcgccgaagctgtctgcatcattgccgatacggataaatggagtgtgcaagtggcgaccagccagaggaaagtgactgacaatatgaagctgggacaggacgtgctggtgtcatctcaggttagcagcctcttacagagcattcttcagttgtacaagctccacctccctgccgatttttgtattatgcacctggaagaccggctgcaagaaatgtatctgaaaagcaagatgttatccgagtacctgagggggcacacaagggtccatgtgaaagagctcggtgttgtgctggggattgaatccaacgatctgccgctcctcacggctatcgcgtcgacccattctccttatgtggcacagatcctcctctag

SEQ ID NO: 223498 - DNA, 2022 bp, Artificial Sequence
  Description of Artificial Sequence: Synthetic coding sequence
atgtgcggaggcactgccaatacaacaaatcagcccgaatcttggcaagattctgccaggtgtgtgtctgacgcggtgcccggagcgggaagaatataccgggcactgttgtgtaccaaaataaaaaaacacaccggggtggatcgctcaaccgaccataccgaactcgacaacagttggagctgttccgaatttgaccttaatgagataaggttaattgtgtaccaggactgtgaccgaagaggccgacaagtgttgtttgactcaaaggctgtccagaaaatcgaagaagtgactgcccagaaaacggaggatgtgcccattaagatttccgcaaaatgctgccagggctcctcttccgtttcatcaagcagttcaagttctataagttcccattcttccagcgggggatcaagccaccatgctaaggagcagctgcccaagtaccagtacacccgcccagcaagcgacgtgaatatgctaggcgaaatgatgttcggctccgtcgccatgagctacaaggggagcaccttgaagattcattacatccgcagccctccacaactgatgatttccaaagtgttctcggccaggatgggatccttctgcggcagcaccaataatctgcaggatagctttgagtatatcaaccaggacccgaatcttggcaaactcaacaccaaccagaattctctagggccatgcagaactgggtcgaacttagcgcatagcacgccggtggacatgccttctcgaggacagaacgaggatcgcgactctggaattgcccgatccgcatccttgtcctctctcctgattacaccctttccatctccttcttcctccactagtagcagcagctcatatcaacgacgatggctaagatctcagacgactagcctggagaatggtatcattccgcgacgatccaccgacgaaacgttttctctggccgaggagacatgcagttcgaaccctgctatggtgcggaggaaaaaaatcgccatttctatcattttttccctttgtgagaaagaagaggcccagcgaaattttcaggacttcttcttttcgcacttccccctattcgagtcacacatgaatcggttgaaaagcgcaattgagaaggctatgatatcatgtcggaagattgcggaaagctcactccgggtccagttctacgtatctcggttgatggaggcattgggggagttccgtggtaccatctggaacctctacagcgtgcccagaatagcggaaccggtgtggttgacaatgatgtcaggcacacttgaaaaaaaccagttgtgtcagcggttcttgaaagagttcactcttcttatcgaacagatcaacaaaaaccagttctttgccgctctgctgacagcggtacttacataccatcttgcttgggttcccactgtaatgccagtggatcaccctcccataaaggcgtttagcgagaagcggactagccagagcgttaacatgctggctaagactcacccctacaatccactgtgggctcagctgggcgacctgtatggggcaatcgggtcccccgtgcgcctgactcggaccgtggtggtgggcaaacaaaaagacttggtccagagaatcttgtacgtgttaacttactttctgcggtgcagcgaactccaggagaaccaactgacttggtccggaaaccatggtgagggcgatcaggtactcaacggttcaaagattatcacagccctagagaaaggggaagtggaggaatccgaatatgtcgtgatcacggtcagaaacgagcctgccctcgtccctcctattttaccacctactgctgcggaacggcataatccttggccgactggattcccggaatgccccgaaggtaccgattcaagagatctcggcttaaagccggataaagaagctaacaggcggcctgaacagggatctgaggcttgcagcgcaggatgtctgggtcccgctagtgacgcatcatggaaacctcaaaacgcattttgcggttag

SEQ ID NO: 223499 - DNA, 660 bp, Artificial Sequence
  Description of Artificial Sequence: Synthetic coding sequence
atggatccagccccaggcgtgttggatccacgggctgctccgcctgcgctgctgggtactccccaggctgaggtcctggaagacgtcctaagggagcaattcgggcctctcccgcagttggccgctgtttgccgcctgaaacggctgcccagtggcggatacagcagtactgagaaccttcagctagttctcgaacgccgtagagttgccaacgccaaagagcgggagcggataaaaaatctgaaccggggattcgctagactcaaggccctggtccctttcttaccccagagccgcaagccaagtaaggtggatatccttaagggagctacagaatacatccaagtgttgtctgacctcctggaaggcgctaaggattccaagaaacaagaccccgatgaacagtcatattcaaacaactcttcagagtctcatacctcatctgcacggcagttgagcagaaacatcacacagcacatcagctgcgcattcggtctaaagaacgaggaagagggcccttgggctgatggaggtagcggggagccagctcacgcctgtagacattctgtgatgagcactacagaaatcataagcccgaccaggtctcttgaccggttccctgaagtagagctgttgagccacaggctcccccaagtatag

SEQ ID NO: 223500 - DNA, 1035 bp, Artificial Sequence
  Description of Artificial Sequence: Synthetic coding sequence
atggtgcgggctagacatcagcctggaggcctttgcctgcttttgctgttgctgtgccagttcatggaagaccgcagtgcacaggcaggtaactgctggctgagacaggccaagaatggcagatgccaggttctgtataagaccgagttgtctaaagaagaatgttgtagcacgggaaggttatcaacgagttggactgaggaggatgtaaacgataacactttgttcaaatggatgatcttcaacgggggtgctccaaactgcataccttgcaaggagacatgcgaaaatgtagattgcgggccaggaaagaaatgccgtatgaacaaaaaaaacaaaccaagatgtgtgtgcgcacccgactgttcaaatattacttggaaggggcctgtgtgtggacttgatgggaagacatacaggaacgagtgcgcactcctcaaggccaggtgtaaagaacaacccgaattagaggtgcagtaccaaggacgctgtaagaaaacgtgtagagatgttttctgcccaggaagctctacatgcgtggtggatcaaacaaataatgcctattgtgttacgtgtaatcgaatctgtccggaacccgcaagcagcgaacagtatttgtgtgggaacgatggcgttacctatagctccgcgtgtcacctgcgaaaggccacctgtctgcttggcagaagcatcggcctggcctacgaagggaagtgtatcaaagctaaaagctgtgaagacatccagtgcaccgggggaaaaaagtgtctctgggacttcaaagtgggacgtggccgatgtagcctgtgcgatgaactctgccctgactctaagtctgacgagcctgtgtgcgccagtgataatgccacctatgcctccgagtgtgctatgaaggaggccgcttgctctagcggtgtactacttgaggtaaagcacagtggttcttgcaactcaatctcagaggacacagaagaggaggaagaggacgaagaccaagattatagcttccccatttcgtcaatccttgagtggtag

SEQ ID NO: 223501 - DNA, 954 bp, Artificial Sequence
  Description of Artificial Sequence: Synthetic coding sequence
atggtcagagccaggcatcagcccggaggtctgtgcctcctgctccttctcttatgtcagttcatggaggacagatccgctcaagcaggcaactgttggttgaggcaggcaaaaaatggcagatgccaggttctttataagaccgaattgtctaaggaagagtgctgctcaactgggagattgagcacgagctggaccgaggaagacgtaaatgataacactttgttcaagtggatgattttcaacggaggcgcacccaactgcattccttgcaaggagacttgcgagaacgtcgactgcggccctggcaagaagtgtagaatgaacaaaaagaacaaacccagatgtgtgtgtgccccagattgttcgaatatcacttggaagggaccagtgtgcggcctcgacggcaaaacataccggaatgaatgcgcacttctgaaggcacgatgcaaagagcagcctgaattagaagttcaatatcagggcaggtgcaagaaaacgtgccgcgatgtgttctgtcctggaagcagtacatgtgtggtcgatcagacaaataatgcatattgcgttacttgtaacaggatctgtcccgaacctgctagtagtgagcaatacctctgtggcaacgatggagtgacgtactccagtgcctgtcacctgagaaaagcaacatgtttgctggggcgatccattgggctggcttatgaagggaagtgcattaaagccaagtcttgcgaagatattcagtgtaccgggggaaaaaaatgtctctgggatttcaaggtaggccgtgggcgttgcagcctgtgcgacgaactttgccctgacagcaagtctgacgagccggtctgcgccagcgacaatgcaacatacgctagcgaatgcgccatgaaggaagcagcatgcagtagtggtgtgctgctcgaggtgaaacacagtgggagctgcaattag

SEQ ID NO: 223502 - DNA, 1023 bp, Artificial Sequence
  Description of Artificial Sequence: Synthetic coding sequence
atggtccgagctcggcaccagcctggagggctctgtctgttgttattgttgctgtgtcagttcatggaggatcgctccgcccaggctggtaattgctggctacggcaagctaagaatggcaggtgccaagtcctatacaagactgagcttagcaaagaagagtgttgctccacaggtcgcctgagtacaagctggacagaggaggacgttaatgacaacacactgttcaagtggatgatcttcaatggcggagcaccgaactgcatcccttgcaaagaaacctgtgagaacgtggattgcggacccggtaaaaagtgccgaatgaataagaaaaataagcctcggtgcgtgtgcgcgcctgattgttccaatatcacttggaaggggccagtatgcggactggacggaaagacttatcgcaacgagtgcgctctcctgaaggcccgttgcaaggaacagcccgagctcgaggttcagtaccagggccgatgtaaaaagacatgtcgggatgttttttgccccggatcttccacatgtgtggtggaccagactaacaacgcctactgcgtgacctgtaacagaatctgccccgagcccgcaagcagcgagcagtacttatgtgggaacgacggtgttacgtacagtagcgcctgtcatttaaggaaggctacctgcttgctgggcagaagcattggcctggcttacgaagggaagtgcatcaaggcgaagagctgcgaagatatacagtgcactggcggaaaaaagtgtctttgggacttcaaggtgggtagaggaaggtgttccctgtgcgatgagctgtgtcctgattctaaaagcgatgaacccgtgtgtgcttcggacaacgcgacatacgcctccgagtgcgctatgaaggaggcagcttgtagttccggagtgttactggaggtcaagcacagtggcagctgcaactacactgaggaagaggaggaagatgaagatcaggattatagcttccctatctcatcaatcctcgagtggtag

SEQ ID NO: 223503 - DNA, 927 bp, Artificial Sequence
  Description of Artificial Sequence: Synthetic coding sequence
atgtggaagcgttggttggccctggcactggcccttgtggctgtggcctgggtgagagccgaggaggaactccgctccaaatccaagatctgcgctaacgtcttctgcggagcaggaagagagtgtgccgtgaccgagaagggagagcctacttgtctttgtattgaacagtgcaagccccacaagcggccagtgtgcggctctaatggcaaaacttatttgaatcactgcgagctgcatagagacgcatgcctgactggctcgaaaatacaggtggactatgatggacactgtaaggaaaaaaaaagtgtcagcccgagtgcctctccagtcgtctgctaccaaagcaacagagatgagctcagacgacggattattcaatggctcgaggccgaaatcatccctgatggatggttctccaaaggcagcaactatagtgagattctggacaagtacttcaagaattttgacaatggcgatagccgactcgactcctccgaattcttgaaatttgtggagcagaacgagaccgccattaatataaccacttatcccgaccaagagaataacaaacttctccggggactgtgcgtggacgcgctcattgagctgtctgacgaaaatgccgattggaaattgagcttccaggagtttctgaaatgcctgaatcccagttttaaccctcctgagaagaagtgcgctctagaggatgaaacctacgccgatggtgccgagaccgaggtggactgtaaccgttgcgtctgtgcctgtggcaactgggtttgtaccgcgatgacttgtgacggcaaaaatcagaagggggctcagactcagacagaagaggagatgactagatacgtgcaggaactccaaaagcaccaggaaaccgccgaaaagacaaagcgggtcagtactaaggagatttag

SEQ ID NO: 223504 - DNA, 423 bp, Artificial Sequence
  Description of Artificial Sequence: Synthetic coding sequence
atgtggaagaggtggctggcccttgccctcgcgctggtagcagtcgcctgggtacgggcagaggaagagctaagaagtaaaagtaaaatttgtgccaacgttttctgcggtgcaggtagagaatgcgctgtgacagaaaaaggagagcctacttgcctctgtatcgagcagtgtaaaccccacaaacgaccagtgtgcggcagcaacggaaaaacatacttgaaccattgtgagctacacagagacgcctgtctcactggatcgaagatccaggttgactatgatgggcattgtaaagagaagaagtccgtgagcccctctgcaagccctgtggtgtgttatcagtctaaccgagacgaactgagaaggcgtattattcagtggttagaagcagaaattatcccggacggttggttctcatag

SEQ ID NO: 223505 - DNA, 756 bp, Artificial Sequence
  Description of Artificial Sequence: Synthetic coding sequence
atgtgttttgtggagcccgcagggaatgtgcaaagccagaggaagggaaacccaccagtgagtgctctttccaatgcaaacctcacaggaagtaaaatccaggtagactatgacggccattgtaaggagaaaaaaagcgtgtccccgagcgccagtccagtggtgtgttatcagtccaatcgtgacgagttacgaagacgaatcatccagtggctggaggccgagattatccctgacggctggttttccaaggggtctaattattccgaaatactggacaagtactttaaaaacttcgacaacggagacagccgcctcgacagttctgagttcttgaagttcgtagaacagaacgagacagccatcaacatcactacatatcctgatcaagagaacaacaagcttctgcggggactctgtgtcgatgcacttatagaactgtccgacgaaaacgccgattggaaactaagtttccaggagtttctgaaatgcctgaatcctagcttcaacccccctgaaaaaaaatgcgctcttgaagacgaaacctacgctgacggcgcagagactgaggtggattgtaacaggtgcgtctgtgcctgcggaaattgggtgtgtaccgcaatgacttgtgacggcaagaatcagaagggcgctcaaacccaaacagaagaggagatgacccggtacgtgcaggagctgcagaagcaccaagaaacggctgagaagacgaaacgtgtctctacgaaggagatctag

SEQ ID NO: 223506 - DNA, 792 bp, Artificial Sequence
  Description of Artificial Sequence: Synthetic coding sequence
atgagacctggcgctcctgggccactgtggcctcttccatggggggcactggcctgggccgtcggctttgtgtcttcaatgggctccggcaacccggctcccggaggtgtgtgttggttgcagcaggggcaagaggcgacctgctcacttgtactgcagaccgacgtcactagagctgaatgctgtgcaagcgggaatatcgatacggcctggtcgaatctgacacatcctggaaataaaattaacttactcgggttcctggggctagtccattgcctcccatgtaaggattcttgtgatggagttgaatgcggcccagggaaagcctgcagaatgcttggtggccgaccacgctgtgaatgcgcccctgattgttccggcctgcctgccaggttgcaggtgtgtggatctgatggagccacataccgggacgaatgcgagctgcgggcagcaaggtgtcgcggtcatccagacttgtctgtcatgtacaggggcaggtgtcgaaagtcctgtgagcacgttgtctgccctcgaccccaaagttgtgtggttgaccagactggatctgcccactgtgtggtatgcagagctgcaccatgcccagtccccagctctcccggtcaggaactgtgtggaaacaacaatgtgacttacatttcatcatgccacatgagacaggccacttgcttcctcggtagatcaattggcgtccgccacgccggtagttgtgctgggacacctgaggaaccgcctggcggtgaatccgcggaggaggaagagaactttgtctag

SEQ ID NO: 223507 - DNA, 1614 bp, Artificial Sequence
  Description of Artificial Sequence: Synthetic coding sequence
atgctgaacacattgcagacgaacgcgggttacctggagcaggtcaaacggcagcgcggagacccacagacccagttggaagcgatggaactctacctggccaggagtggcctccaggttgaagacctggataggctgaacatcatccacgtgaccggcactaaaggcaagggtagcacctgtgcatttacagagtgcattctgagaagttacgggctgaaaaccggattcttcagtagcccccacctggtccaagtacgcgaacgaattcgaataaacggacagcccattagtcccgagctgttcacgaagtacttctggcgtctgtatcacagacttgaggaaactaaggacggtagctgcgtgagcatgcctccttacttccgctttctcacacttatggccttccacgtgtttcttcaggaaaaggtggatctggcggtggttgaggtcgggattggaggagcctatgattgcactaatatcatcaggaagccagtcgtgtgcggcgtctcttctttaggcatcgaccatacctctctcctaggtgatacagttgaaaagatcgcatggcaaaagggtggaatatttaaacagggcgttcccgctttcaccgttctgcaaccggaggggccactcgctgtgttacgggaccgcgctcaacagatttcttgtccgctgtacctttgccccatgcttgaggcactggaagaaggcggacctccgctgacactgggattagaaggggagcaccagaggtccaacgctgcactcgcactgcaattagcccactgttggctccaaaggcaggacaggcatggagctggcgagcctaaggccagcagaccaggtctgctgtggcagcttccgttggcgccagtttttcagcctacctcccatatgcgcctcggactccggaacacggagtggccgggaagaacacaagttctcagacggggacccctgacatggtacctggatggcgcacacactgctagcagcgctcaggcttgtgttcggtggtttaggcaggcacttcagggaagggaacgtccatccgggggaccagaagtcagagtgctgttgtttaacgcaactggggaccgggatcctgcagcattgctgaagctgttacagccctgccagttcgattatgcagtcttttgcccaaacctcaccgaggtgtcgtcgaccggcaatgctgatcagcagaacttcaccgttaccctggatcaggtcctgctcagatgtctcgagcaccagcagcattggaaccatctggatgaagagcaggcctcacccgacctctggagtgctccatccccagagccaggtggtagcgcttctctcctgcttgccccacacccccctcacacatgttctgcaagctctttggttttctcttgcatttctcatgcactgcagtggatctcccagggcagggaccctatttttcagcctcccagtcctccaaaggggctgctgacgcatcccgtcgctcacagtggcgcaagtattctcagggaggccgctgcaattcacgtgcttgtgactggctcactgcatttggtgggtggggttctcaaactgctggagcccgcactgtcccagtag

SEQ ID NO: 223508 - DNA, 1128 bp, Artificial Sequence
  Description of Artificial Sequence: Synthetic coding sequence
atgagccgggcacgcagccatcttcgggctgcgcttttcctggccgctgcttctgcccgtggaatcacaactcaggtggcagcaaggcgaggtctgagtgcctggcccgtgcctcaggaaccctctatggagtaccaggacgccgtcagaatgctgaatacactccaaactaacgcgggatatcttgaacaggtgaagcgccagcgaggagacccccaaacacaattagaggcaatggaactttatttagctaggtccggccttcaggtcgaggatctggaccggctgaatattatccacgttaccggcaccaaaggcaaaggctccacatgtgcttttacagagtgcatactgcggtcttacggacttaaaacaggtttcttttcatctccacaccttgtgcaagtgagagagcgcatccgtattaatggacagcccatctctcccgagctgtttacaaaatatttttggcgtctgtatcatcgtctggaggagacaaaagatggttcgtgcgtctccatgcccccatacttccgatttctgacattgatggctttccacgttttcctacaggaaaaggtggacttggcagtagtcgaggtgggtattggaggcgcatacgattgcaccaacatcatccgcaagccagttgtgtgcggcgtgagttcgctcggcattgatcacactagcttgcttggtgatactgtggagaagatagcctggcagaaaggagggatctttaagcagggcgttccagccttcactgtgctacagccagagggccctctggccgtcttgcgcgaccgtgcacagcagatttccgtactcggcagccagcggcatccagggcagggttcatgcggaagctgcccctggcacctttgctcctcacctcacccgacatgcggatcaggtttcgggaccaggtctgggagggctggaaggcgatgctgtggggcaggcccatcacccggaacttggacagtgcgaacccctcccgctgcacggagaccagcttgtgcgggtagcgccagaaggtgcagagccgcacgaggcagggccgtggctcctcgatttgaatcctgctcctccatgctgcccggtacaggaacaaggcggccatgctag

SEQ ID NO: 223509 - DNA, 1128 bp, Artificial Sequence
  Description of Artificial Sequence: Synthetic coding sequence
atgtcacgcgctagaagccacctgcgcgctgcgttatttctggctgctgcaagcgccaggggaataaccactcaggtggccgctcgacggggactatccgcctggcctgtcccacaggaacccagtatggaataccaagatgcagtgcgcatgctaaatactttacagaccaacgctggatacctggaacaggtaaaaagacagcgaggagacccccagacccagcttgaggcaatggagctttatctggctagatctggattgcaggtggaggatctcgataggctgaatattatccatgtgaccggcacaaaaggcaagggctctacgtgtgcatttactgagtgtatcttacgcagctatggcctcaagaccggattctttagctccccacatctcgtgcaggtgcgagagcgcattcggatcaacggacagcctatatcccctgagctgttcaccaaatatttctggcgcctttaccacaggctcgaggagactaaagacggcagttgtgtcagcatgcctccctattttcgatttttgacactgatggcctttcacgtgttcctacaggagaaggtggacctggcagtggttgaggttggtattgggggagcttacgattgtacgaacatcattcgcaagcccgttgtgtgcggtgtctcttcactgggcatagatcacacctcactactgggggacactgtggaaaagatcgcctggcaaaagggtgggatcttcaaacagggcgtgcccgcattcaccgtcctgcagccggagggacccctggcagtccttagagatcgagctcagcagatctctgttttgggtagtcagcgacacccaggtcagggaagctgtgggagctgtccatggcatttgtgctccagtcctcatcccacctgtgggtcagggttcggaactagatcaggccgtgccggacgcaggtgctgtggggcaggaccgtccccaggcacttggaccgtgcgaaccccccctgctgcccgaaggcccgcatgcgccggatccgccagacggtgccgagccgcaagaggaagagccgtggcccctcgattcgaaagctgtagcagcatgttacccggtaccggtactcgcagaccatgctag

SEQ ID NO: 223510 - DNA, 1764 bp, Artificial Sequence
  Description of Artificial Sequence: Synthetic coding sequence
atgagtcgcgcacggagccacctccgggcagccttgtttctcgctgccgcttctgctcgtggcatcaccacccaggtggctgctcgcagaggcctctccgcttggcccgtacctcaggagccctcaatggagtatcaggacgctgtcagaatgctgaatacactgcagacaaatgcagggtatctcgagcaggttaaacgccagcggggagacccgcagactcagctggaagccatggagttgtatctggccagatccgggcttcaggtggaggacctggatcgtctgaacattatccatgtgacggggaccaaaggaaaaggtagcacctgtgccttcactgagtgcatcttaagatcctatggattgaaaaccggcttcttctcttcccctcacctggtccaagtccgcgagcggatccggatcaacggccagcctatttccccagaactgttcacaaagtacttctggcggttgtatcaccgtctggaggaaacaaaggatggctcctgtgtgagcatgcccccatattttcggttcctgacactaatggcattccatgtttttttacaggagaaggtcgaccttgcggtcgtcgaagtgggcattggaggcgcatatgattgcacaaatattatccgaaagcctgtggtctgcggagtctccagtttgggcatcgaccatacctcgctacttggcgacacagtggaaaaaatcgcatggcaaaagggcggtatcttcaagcagggggtcccagcttttaccgtcttgcagccagaagggcctctcgccgtgcttagagatagggcccaacagatatcttgccccctgtacttgtgccccatgctcgaggccctggaggaaggtggcccaccgctcacattggggctggagggggagcatcagcgatccaatgccgcactggctcttcagctggcacattgttggttgcaacgccaggatcgccatggcgcaggtgaacccaaggccagtaggcctgggctgctgtggcagctcccgctggctcccgtgtttcagcctaccagccatatgaggctcgggctgcgcaacacagaatggcccggacggactcaagttctgagacggggaccactgacctggtatctagacggtgcgcatactgcgtcatctgcccaagcttgcgtgaggtggtttagacaggctttacaggggagggaaaggccgtccggtggaccagaggtgcgcgtactgttattcaatgcgaccggggaccgggatccagctgctctcctgaagctactccagccatgtcaattcgattatgcggtgttctgtcccaacctaacagaggtgtccagcaccgggaatgccgaccagcagaacttcactgtcaccctggatcaagtgctcctgaggtgcttagagcaccagcagcattggaatcacctggacgaagagcaggcctcccccgacctgtggagcgccccttcccccgaaccgggagggtccgccagcctcttgcttgcgccacatcctcctcacacctgcagcgcttcaagcctagtcttctcgtgcatttcgcatgctttacagtggatatctcaggggagagaccccatctttcagcccccaagtccacctaaaggtcttctgacccaccctgttgcccatagcggggcatcaatcctgagggaggccgcagccatccacgttctggttacggggagcctccacttggttggcggagtgctgaagctactcgagcctgcactcagtcaatag

SEQ ID NO: 223511 - DNA, 1686 bp, Artificial Sequence
  Description of Artificial Sequence: Synthetic coding sequence
atgtcccgggctaggagtcatttgagagcagccctgttcttggccgctgcgagcgcacgtgggatcacaacccaggtagctgccagacgaggcctctccgcttggcccgttccgcaggaaccatcaatggagtatcaggatgcggtgaggatgcttaataccctgcagacaaatgccggatatctcgaacaggtgaagcggcagcgaggggatccgcagacacagctagaggccatggagctgtacctggccaggagcggcctgcaagtggaggatttggaccggctgaacatcatccatgtaaccgggacgaaggggaaggggtccacctgcgcctttactgaatgcatcctgaggagctacggactgaaaaccgggtttttctcatcccctcacctcgtacaggtccgtgaacgcataagaattaacggacagcccatctctccggaactcttcaccaagtacttttggcgtctatatcataggctggaagagactaaagtggatctggcagtagtggaggtgggtattggaggggcttatgattgcacaaatattataagaaagccagtggtgtgcggggtgtctagccttgggatagaccatacaagcctgctgggggacacagtcgaaaagatcgcatggcagaaggggggtatatttaagcaaggggtgccagcttttacagtgcttcagcctgagggcccactggccgttctgagagatcgtgcacaacaaatctcatgtcccctttacttatgccccatgctcgaggccctcgaggagggtgggcctccactgaccctgggcctggagggagagcaccagcgttccaacgcagctctggccctacagctcgctcactgctggctgcagcgacaggacaggcatggggcaggtgaacccaaggccagcaggccaggattactgtggcagttaccactggctccagttttccagcctacaagccatatgagacttggcttgaggaacactgagtggcccggtcgcacacaggtgctgcgccgaggaccacttacttggtacctggatggggctcacaccgcgagcagcgctcaggcatgcgtgcgctggttccgacaggccttacagggcagggagcgaccttccggaggcccagaagttcgagtattattgttcaacgccacaggcgaccgagatccggcagctcttcttaagcttctgcaaccttgccagttcgattatgccgtcttctgtccaaatctgactgaggtgagtagtaccgggaatgcggaccaacagaacttcacagtaaccctggaccaagtgcttcttcggtgcctggaacaccaacaacactggaaccacctcgatgaagagcaggcctccccggatttgtggtctgcaccatcacctgaacctggtggtagcgcaagtctcttactggccccacaccctccacatacatgctcagcatctagccttgtcttctcttgtatcagccacgcactgcagtggatctcacaggggagggatccaattttccagccaccctcccctcccaaagggctattaacccaccccgtcgcacatagcggcgctagcattctcagagaggcagccgctattcacgtgctagtcacaggcagtctgcacctggtcggcggagtattaaagctgctggagccagcactcagccaatag

SEQ ID NO: 223512 - DNA, 585 bp, Artificial Sequence
  Description of Artificial Sequence: Synthetic coding sequence
atgttgaacacactgcaaacaaacgctgggtacctggagcaggtcaagaggcaacgtggagaccctcagacccagctggaagccatggagctatacctcgccaggtccgggttgcaggtggaggatttggatcgtcttaatattatacacgtgactggcaccaaaggtaaaggctcaacatgcgcttttaccgagtgtatcctcaggtcctacggactgaagacaggctttttttcatctccacacctggtgcaagtgcgtgaacgcatcaggataaacggtcagccaatttctccagagctatttacaaagtacttttggaggttgtaccaccgcttagaggagaccaaggttgatctggccgtcgtggaggttggaattggtggggcatatgactgtactaacatcatccgtaagccagttgtgtgcggggtgagctctttggggatcgatcacactagtttgctgggagatacagtggaaaagatcgcttggcaaaaaggaggcatctttaagcagggggtcccggcattcaccgtgctgcaacctgaaggccctctggccgtcctccgagacagagcatag

SEQ ID NO: 223513 - DNA, 798 bp, Artificial Sequence
  Description of Artificial Sequence: Synthetic coding sequence
atgctgaatacattacagacaaacgcgggttatttagagcaggtcaaacgccagaggggagatccacaaactcagctggaggccatggaactgtacctagcgcgatctggcctgcaggtcgaggatctagacagattgaacatcatacatgtcacaggcacaaaaggcaagggcagcacttgcgccttcacagagtgcattcttcgttcttatgggctcaagactgggttcttctcttcgcctcacttggtgcaggtccgggagagaatccgcattaatgggcagcctatttctcccgaactgtttacgaagtacttttggagactgtatcaccgactggaagagacaaaggacggatcttgcgtgagtatgcctccatacttccgtttcctgaccctaatggctttccacgtgtttctgcaggaaaaggtagatttggccgttgtggaggtaggcatcgggggagcttatgactgcactaatataatccggaagcccgtagtgtgcggagtctcgtccttagggatcgaccacaccagcttgctgggagacaccgttgaaaagatcgcatggcagaaggggggtattttcaaacagggggtcccggctttcacggtcctccaaccagaggggccattggccgtgttgcgcgatcgcgctcagcagatctccgttctgggcagccagcgccatccaggccaaggtagttgcggatcctgcccctggcatctctgctcatctccacatcccacctgcggttctggatttgggacccggtctggtagggcaggacgctag

SEQ ID NO: 223514 - DNA, 1392 bp, Artificial Sequence
  Description of Artificial Sequence: Synthetic coding sequence
atgcattcagccagcagtatgctaggagccgtgaaaatggagggacacgagccttcagattggtctagctactacgccgagcctgaggggtattcttctgtctccaatatgaacgcaggattgggtatgaacggtatgaatacatatatgtcaatgtccgcagccgcaatgggcagtggttctgggaacatgtccgcagggtccatgaacatgtccagttatgtaggcgctgggatgagtccatccttggccggaatgtctccgggagccggagcaatggccggaatggggggaagtgcaggagccgcaggggtggccggaatgggtcctcacctgtctccttcactctctcctttaggcggacaggccgcaggcgctatgggaggcctggctccatatgccaatatgaattccatgtcaccaatgtacggacaggctggcctctcccgggctcgagaccccaagacctaccggaggtcttacactcacgccaagccgccatactcttatatcagcctcattactatggccatccagcagtctcccaacaaaatgttgactttaagcgagatctatcagtggattatggatctgtttccgttctatcggcaaaatcagcagcgatggcagaattccattcgacattccctcagcttcaacgactgcttcctaaaagtgcccagatctcccgataagcctggtaaggggtcattttggaccctccatccagattccggcaacatgtttgagaatggttgctatcttagaagacaaaagcgtttcaagtgcgagaaacaattggccctgaaagaagccgcaggcgctgccggaagcggtaagaaggccgctgctggggcacaggcctcccaggcccagttgggtgaggctgctggaccagccagcgagactccagcagggactgagtcccctcacagttccgcaagtccatgtcaagagcacaagagaggcggattaggagagctaaaaggcaccccggcagccgctttgtctccgccagaaccagccccatcccccggacagcagcagcaggccgcagcccacctgctgggccctccgcaccatcctggacttcctccagaggcccatcttaagcctgaacaccattacgcttttaaccacccctttagcatcaataacctcatgtccagcgagcagcaacaccaccatagtcaccaccaccatcagcctcacaagatggacctgaaggcctacgagcaggtgatgcattatcccggatatggatctcccatgcccggttcgttggccatggggccagtcacaaataaaaccggcctcgatgcttccccactggctgccgacacaagttactatcagggcgtttactcgcgcccaataatgaatagtagttag

SEQ ID NO: 223515 - DNA, 1374 bp, Artificial Sequence
  Description of Artificial Sequence: Synthetic coding sequence
atgcttggcgctgttaagatggaaggacatgaaccctctgactggagttcctactatgcagagcccgagggctacagcagcgtgtccaatatgaacgccggactgggaatgaacgggatgaatacttacatgagcatgtccgctgccgcaatggggagcgggtctggaaatatgtccgccggttctatgaacatgtctagctacgtcggggctggcatgtctccttctctggccggtatgtcacccggagcaggcgctatggccggaatgggtggttcagccggagcagcgggagtcgcaggcatgggtcctcatctttccccctcactttcccctttggggggtcaagcggcaggtgcaatgggcggtctcgcaccatacgctaacatgaacagtatgtcccccatgtacgggcaggctggtctgtcacgggctcgggatccaaagacgtataggcggtcttacacgcacgccaaacctccctactcttacatatctctcattacgatggccatacaacaaagccctaataaaatgcttaccctgagcgaaatataccagtggatcatggatctctttcccttctatcgacagaatcagcagcggtggcagaatagcatccgtcactcactctcgtttaatgattgttttctgaaggttccccgatcaccagataagcccggaaaggggtccttttggaccctccaccctgactccgggaacatgtttgagaacggatgttacctcagacgtcagaaacgtttcaagtgtgagaaacagttagccctgaaggaggccgcaggtgcagccggttccggaaaaaaggccgcagctggggcacaggcgagccaggcacagctgggggaggcagcaggacccgcttcagaaacccctgccggtaccgagagtccacactcttccgcctcaccttgccaggaacataagcgaggtgggttgggcgagctaaagggcacacctgccgctgctctgagtcctcccgagcctgccccatctcctggccagcaacaacaggcagcggctcacttgcttggcccaccacatcatccgggactgcctcccgaggcgcatttaaaacccgagcaccattatgcctttaaccatcccttctccatcaataaccttatgtcctctgaacagcaacatcaccattcacaccatcatcaccagccccacaaaatggacctgaaggcctacgaacaggtgatgcattacccaggctacggatcccctatgcccggatccctcgcgatgggtcccgttacgaacaaaaccggtttagacgcctcacccctggcggctgacacaagttattatcagggcgtttacagtcgcccaatcatgaattccagttag

SEQ ID NO: 223516 - DNA, 1374 bp, Artificial Sequence
  Description of Artificial Sequence: Synthetic coding sequence
atgctgggagccgtgaagatggaagggcacgagcccagtgactggtcaagttactatgccgaaccagaaggatatagctcggtgagcaatatgaatgctgggttaggaatgaacggcatgaacacatatatgtcgatgtccgccgctgctatggggagcggaagcggcaatatgagcgcaggcagtatgaacatgtctagttatgtcggcgctggcatgagtccttctcttgcagggatgagcccgggtgccggtgccatggccggaatgggaggatctgccggtgcggcaggggtggctggaatgggccctcatctgtctccgagtctgagtccgcttggagggcaggccgctggagcaatgggagggcttgctccctacgcgaacatgaatagtatgtcgccaatgtacggccaggcagggctgtcaagagcacgggatcctaagacttaccggaggagctatactcacgctaaaccaccttacagctacatctctctgatcacgatggccatccagcagtctccaaacaaaatgttaacactaagcgagatctaccagtggatcatggatttattccctttctacagacaaaaccagcagaggtggcagaattcaatcagacactccctgtcttttaacgattgcttcctcaaagtgcccaggtcacccgacaagccgggaaagggaagcttctggacgctgcatcccgattctggtaatatgttcgagaacggatgctatctgcgacgtcagaaacgcttcaaatgtgagaagcagctggcgcttaaagaagcggcaggcgctgccggtagtgggaagaaggccgctgctggagcccaagcgagtcaggcacagttgggagaggccgcaggcccagcaagcgagacacctgcagggaccgaaagtccccattctagtgctagcccgtgtcaggagcataaacggggagggcttggcgagctaaagggaactcccgctgcagccttatcccccccagagcccgctcccagcccagggcagcagcagcaagctgccgcacacctgctcggccctccacaccatcccggtctgccgcctgaggcccacttgaaaccggagcatcactacgccttcaaccacccattctccattaataacctaatgtctagtgagcaacagcaccatcacagccatcatcaccaccaaccacacaagatggatcttaaggcttacgaacaagtaatgcactatccgggttacggctcacctatgccaggatcactggctatgggaccggtgaccaataagacagggctcgacgcaagccccctggctgcagatacgtcttactatcagggtgtgtattctcgtccaattatgaacagctcttag

SEQ ID NO: 223517 - DNA, 1032 bp, Artificial Sequence
  Description of Artificial Sequence: Synthetic coding sequence
atgctcggggctgtgaaaatggagggacacgaacctagcgattggagtagctactacgctgaacccgagggatactcttctgtatcaagagctagagacccaaagacataccggaggtcctatactcacgcgaaaccaccgtattcctatatttcactgatcacgatggctatccaacagtccccaaacaaaatgctcactttgtccgaaatataccagtggatcatggatctctttcccttctacaggcaaaaccaacagaggtggcaaaatagtatccggcactctctgagtttcaatgactgttttctgaaagtgccgaggtctccagacaagcctggtaagggcagtttctggacgcttcacccagacagcggaaatatgttcgaaaacggctgctacctgagaaggcaaaaacgatttaagtgcgagaagcagctggcactcaaggaagcagcgggagcggcaggcagcggcaagaaagcggctgccggagctcaagcctcccaggctcagcttggagaagctgcaggcccagcctccgagacaccggcaggcacagaaagtccccactcctctgcttctccctgccaagagcataagaggggtggtctgggcgaactgaaaggtactcccgcagctgccctcagtcctccagaacccgcaccgagcccaggacaacagcagcaagctgccgctcacttactgggccctccccaccacccaggcctccccccagaggctcacctgaagcctgagcatcattacgcgttcaaccatccattctccataaacaacctcatgagctctgaacagcaacaccaccattctcaccatcaccatcagcctcataagatggatcttaaggcttacgagcaggtgatgcattatccagggtatggaagccccatgcctgggagcctggccatgggaccagtgaccaacaagaccgggctggatgccagccctcttgccgctgacacaagctattatcagggggtctactctcggcctatcatgaattcttcatag

SEQ ID NO: 223518 - DNA, 1053 bp, Artificial Sequence
  Description of Artificial Sequence: Synthetic coding sequence
atgctaggttcagtgaagatggaagcacacgatctcgctgagtggtcttactaccccgaggccggagaggtgtactcccctgtcactccagtgcctacaatggccccattgaatagctatatgacattgaacccacttagcagcccatatccacccggaggcctcccagccagcccactgccctcgggacccctggcccctcccgctcccgctgcgcctctcggcccaacatttcccggtctgggcgtgtctggcggaagtagttcgtccggttatggcgctcccggacctggtctcgtgcatggtaaggagatgccaaagggatataggcgacccctcgcacacgcaaagcccccttattcgtatatctctctcattaccatggccatccagcaggccccagggaagatgttgacgttgtcagagatttatcagtggatcatggatctgttcccttattaccgggagaaccagcagaggtggcaaaatagtattaggcacagcctcagttttaacgattgttttgtcaaggttgccaggtctcctgataaaccaggcaaaggctcttattgggccctgcacccttcctcaggtaatatgttcgaaaacgggtgttacctcagacgccagaaacggttcaagctggaagaaaaagtgaagaagggagggtccggagccgctacaacgacaaggaatgggaccggttcggccgcaagcactaccacacccgctgccaccgtgacttcacctccacaacctcctccccctgccccagagcccgaggcacagggcggtgaggacgtcggagcactagactgtggatcgcccgcaagttctactccatatttcacaggtctggaactgccaggtgaactgaagctcgatgccccatacaactttaaccaccctttcagcatcaataacctgatgtctgaacagactcccgctccacctaaactggacgtggggtttggaggatacggcgctgagggaggtgagccaggggtgtattaccaggggctttactctaggtctctcctaaacgcctcctag

SEQ ID NO: 223519 - DNA, 1662 bp, Artificial Sequence
  Description of Artificial Sequence: Synthetic coding sequence
atgcaggccagatacagtgtgagctcgcctaactctctgggcgtagtgccgtacctgggcggagaacagagctactaccgggctgcagctgcagccgcaggcggtggatacacagccatgcctgcaccaatgagcgtctacagtcatccagcccacgctgagcaatacccaggtgggatggctcgggcatatggcccatataccccacagccgcagcctaaagacatggttaaacccccatatagctatatagcccttatcacgatggcgatccaaaacgcccctgataaaaagattactttgaatgggatttatcagtttatcatggataggtttcccttctaccgtgacaataaacagggatggcagaatagtattcgccataatctcagcctaaacgagtgctttgtcaaagtcccgcgagatgacaaaaagcctggaaaaggcagctactggacacttgacccggattcatataatatgtttgagaacggatccttcctccgtaggagaaggcgctttaaaaaaaaggatgctgtaaaagacaaagaggagaaagataggctacacctaaaagagcccccaccaccgggtagacagcctcctcccgctccaccggagcaagcagatggcaatgcccctggccctcagcctccacctgtgaggatacaggacattaagacagaaaacggtacctgcccctctccccctcagcctctcagtcccgctgctgcgctaggcagcggatccgccgctgcggtacccaaaattgagtctcccgattctagctcaagctcccttagcagtggaagcagcccgccagggtccctcccatcagctcggcctctctctctagatggcgctgactcggctccccctcctccagcgccttctgctcctccacctcaccactcccaggggttctccgtcgataatattatgacttcacttagggggagcccccagtctgcggcagctgagttaagttccgggctgctggcttccgcagccgcatcctcccgcgcaggcatcgcacctcccctcgctctgggggcttactcacccggtcagtcaagcctgtatagctccccatgtagccagacttcaagcgcaggatcaagtggcggaggagggggaggcgctggcgcagcgggaggcgcaggcggtgcaggcacttatcattgcaatctccaggctatgagcctgtatgcagccggagagaggggaggccacctgcagggagccccaggaggggctggcggaagcgccgtggatgaccctctcccagactattcacttcctcccgtcacgtcaagctctagttctagcctgtcgcatggagggggaggcggaggcggtgggggagggcaggaagccggtcaccacccggcagcccatcaaggaagactgacttcttggtatttgaatcaagcgggaggcgatctggggcatctggcaagcgctgccgctgcggcagcggctgccggttaccccggtcagcagcagaacttccacagtgtgagggaaatgtttgagtctcagcggataggtctgaataattccccagtgaatggaaattcctcctgtcagatggctttccccagctcccaaagcctgtacagaacctccggggctttcgtctacgactgtagcaagttctag

SEQ ID NO: 223520 - DNA, 639 bp, Artificial Sequence
  Description of Artificial Sequence: Synthetic coding sequence
atgcaggccagatactcagtgtcatcgccgaactctttgggcgtggtaccatacctggggggagaacagtcttactaccgagcagcagccgcagcggcaggcggtgggtacaccgcaatgcccgctccgatgtccgtgtatagccatcccgcacacgccgagcaataccctggcggaatggccagagcctatgggccatatactccccagcctcagccgaaggatatggttaaacctccgtactcatatattgcactcatcacaatggcaatacagaacgcaccagacaaaaaaataaccctcaatggtatctatcagttcatcatggatagatttcccttctaccgcgataataaacagggctggcagaacagcatcaggcacaatttgagcctaaacgagtgtttcgtaaaggttcctagagatgataagaagccgggaaaaggatcctactggactcttgaccccgattcttataacatgttcgagaatggcagtttcctaaggcgtaggagaagatttaagaagaaggatgcagtgaaggacaaagaagaaaaagaccgaccacaagcaacaagagctagtagccgtacctcaactcggtgcggtcgatgctcgagccaccgcggttcagcttag

SEQ ID NO: 223521 - DNA, 1488 bp, Artificial Sequence
  Description of Artificial Sequence: Synthetic coding sequence
atgaccctaggctcttgttgttgcgagatcatgtcttctgagtcctctcctgccgcactgtccgaggctgacgcagatattgatgtggtgggcggtggctctggcggaggggagcttcccgctagatccggtccacgggctccacgcgacgtcctgccccacgggcatgaaccccctgccgaagaagccgaggcagatctcgctgaagatgaagaggagtcaggaggttgcagcgacggggagccccgagctctagctagccgtggagctgcagccgcagctggctccccaggtcctggcgctgccgctgcacgcggagccgctggtcctggcccaggtcccccatccggcggagcagctacccgctccccccttgttaagcccccatactcatacattgctcttatcaccatggctatactccagagccccaaaaagagactgaccttgtctgaaatctgcgagttcatctcaggacgcttcccctactacagagaaaagttcccggcatggcagaattccatccgccataatctgtccctcaacgactgtttcgtgaaaatcccgcgagagccaggcaatcccggtaaggggaattactggacgctcgacccagagtcagccgacatgttcgataatggttcgtttctgcgcagacgcaagcgattcaagcgccagcctctgcctccaccgcacccgcatcctcatccccatccagagctgctgctgaggggtggcgcagctgcagcgggtgatcccggtgcttttctgcccggattcgctgcttacggagcctacggttacggatacggactcgccttgccagcctatggagctcctcccccaggcccagcccctcacccccatcctcatccgcacgcgttcgcttttgctgccgctgcagcggctgccccatgccagctgagcgtcccaccgggacgagctgcggctcccccacctggccctcctacagccagtgtatttgcaggcgctggctcggctcccgctcctgcgccagccagtggaagcgggcctggtccgggtccagcagggcttccagccttccttggcgctgaattgggatgtgcgaaggcattttacgccgcttcgttatcaccacctgctgccggaaccgcagccggtctgcccaccgccctcttaagacaagggttgaagacagatgcagggggaggcgctggcggtggaggagcaggcgctggacagaggcccagcttctcaatcgatcatatcatgggacatggcggtgggggagccgcacctccaggggcaggcgaaggcagtcctgggccaccctttgctgcagcagcaggcccaggcggacaggcccaggtgctcgcaatgttgaccgctcctgcgttggcacctgtggcgggacacattagactgagccatcccggtgacgccctactgagcagcggttcaaggtttgctagcaaggtcgctgggctgagtggatgtcacttctag

SEQ ID NO: 223522 - DNA, 1437 bp, Artificial Sequence
  Description of Artificial Sequence: Synthetic coding sequence
atgacactatccggcggtggtagcgcatcggatatgtctgggcagacagtgcttactgctgaggacgtggatatcgatgtcgttggggagggtgacgatggtctggaagaaaaagatagcgacgccggatgtgactctcctgcaggcccacccgagctccggctggatgaggctgatgaggtcccacctgccgctccacaccacgggcagccccagccaccacaccagcaaccactgacgcttcctaaagaggcagccggtgcaggggctgggccaggcggagatgtgggtgccccagaggcggatggatgcaagggtggtgtgggcggagaggaagggggagcgagcggtggtggcccaggagcgggaagcggatctgcgggagggctcgcaccgtcaaaacctaaaaacagcttggtgaagcctccctatagttatatcgccctcatcacaatggcaatcttacaatcacctcagaaaaagcttaccttatccggtatctgcgagttcatcagcaatcggttcccatactacagggagaagttcccagcgtggcagaactccatcaggcataacctgagtctcaatgactgttttgttaaaatccccagggaacctggaaatcccggaaaggggaactactggacccttgatcctcagagtgaagacatgttcgacaatggaagcttccttcggagaaggaaacggttcaagcgtcatcagcaggagcacctgcgtgagcaaactgctcttatgatgcagagctttggggcatactccctggcagcggcagccggagccgctgggccttatggacgcccatatggcctgcacccagctgcggcagccggtgcctattcccatcctgctgccgctgccgctgccgctgctgccgctgctctccaatacccctatgcccttcctcccgttgcacctgtcctcccccctgctgtcccactcctaccttctggcgagctggggcgtaaggcagcggcttttggcagtcaattgggacctggtttgcaactgcaattgaatagtttaggagccgctgcagccgctgcaggaacagctggagcagcaggaactacagcgtccctcataaaatcagaaccttcagctaggcctagcttcagtatcgagaacatcattggtggaggtccagcagctcctggaggttcagcagtcggagccggagttgccggtggcacaggaggcagcggtggagggagcacagcacagagttttctcaggccaccgggaactgtccagtccgccgcactcatggcaacccatcagcctctgtccttatctagaaccacagcaacaatagcacccatcctatctgtgcccctgagtgggcagttccttcagcccgcagcttcagccgcagccgcagctgccgcagctgcgcaggcaaaatggcccgctcaatag

SEQ ID NO: 223523 - DNA, 1320 bp, Artificial Sequence
  Description of Artificial Sequence: Synthetic coding sequence
atgaatctgccgagagcggaaagactgaggtcaaccccgcaaagatctcttcgcgattccgacggagaggacgggaaaatcgacgtgctcggtgaggaggaggacgaagatgaggaggaagctgcctcacagcagtttctggagcagagcttgcagcctgggctgcaggttgcacggtggggcggtgtggcccttccacgggaacacattgaggggggaggcggacccagtgacccgtctgaatttggcactgagtttagggctccacctagatctgccgcagctagcgaggacgccagacagcccgcaaagccccctagttcctacatcgccctgatcacaatggctatcctgcagtccccccacaaaagactgactctgagcggcatctgtgcattcatatcggacagatttccctactaccggagaaaattccctgcatggcaaaatagtatccgccataacctgagcctcaacgactgcttcgttaaaattcctcgagagcctgggaggccaggcaagggcaattactggagcctggatccggcttctcaagacatgtttgacaacggatccttcctacgaaggcgaaagagatttcagagacatcagcctacacccggtgcccaccttccccacccattccccttgccagccgcacacgccgctctgcataaccccagacccggtcctctgctgggtgcacccgctccaccccagcctgtgcctggggcttaccctaacacaggcccaggcagaagaccatacgctctactgcatccacaccctcctagatatctcttgctttcagcacctgcttacgcaggggcacctaaaaaggccgagggggcagacctggcaacccccgctccctttccgtgctgtagtcctcatctggttttatctctgggcagacgcgcacgtgtctggagacgccaccgtgaggcagatgccagtctcagtgccctacgtgtgtcctgtaaaggctccggtgagcgagtacaaggactgaggcgggtctgccccaggccgagaggagccactgcaccttgcagctcggatcgacaggcttgtcggacaatcctccagcagcagcagcggcatcaggaagaggactgcgcaaacggatgcgctccaacgaaaggagccgtgttaggcggacatctgtctgcggctagcgccctcctaaggtatcaggccgtcgccgagggatcagggttgacatctctcgctgcccctttagggggagaaggaaccagtcctgtcttcctcgtatcccctacacccagttctctcgccgaatctgccggtccatcctag

SEQ ID NO: 223524 - DNA, 1227 bp, Artificial Sequence
  Description of Artificial Sequence: Synthetic coding sequence
atgaaccttccacgggcagagagacctcgaagtacacctcagcgatcactccgagactccgacggagaggacgggaagatcgacgtgttaggagaagaagaggatgaagatgaggtagaggatgaagaggaagaagcctctcagaaattcttagagcaatccttacagcccggtcttcaggtggctcggtggggcggtgtcgcactgccacgtgagcacattgaaggagggggaccgtcggatcctagcgaattcggcactgagttccgtgccccaccgagatccgccgctgcctctgaggacgctcgtcagccggctaaaccaccttacagctatatcgccctgatcacaatggccatcctccagagtccacataaacgtctcactctgagcggaatatgcgcttttatttccggcaggttcccttactataggcggaaatttccagcatggcagaactctattcggcacaacctgtctttgaacgactgttttgtgaaaatccctagagagccaggacacccgggtaagggaacctattggagtcttgaccctgcctcgcaggacatgttcgacaatggcagcttcctcaggcgccgtaagagatttaagcggcatcagttgacccctggcgcacacctaccacatccctttccactcccagctgcacacgcagcactgcacaacccaagaccagggccactcctgggcgctcccgcactgccccaaccagtgccaggggcttaccctaacactgctccaggccgtcggccatacgctctactacaccctcacccgcctaggtacctgctgctctccgctcctgcatacgccggagccccaaaaaaagccgaaggtgcggaccttgcaacccctgggactctccccgtgctccagccatcacttggccctcagccctgggaagaaggcaagggcctagcttccccgcctggaggcggttgcatctccttcagcatagagtctatcatgcagggggtgaggggagccggaacgggcgcagctcagtctttgtctcctaccgcatggtcctattgcccgttactgcagcggcctagcagcctcagtgacaacttcgcagccaccgcagctgccagtggcggaggcttgaggcagaggttacgtagtcaccaggggagaggcgcagggagagcgccagtggggagggtgggggctgctgcagtcagcggcggtggcagaggattgtag

SEQ ID NO: 223525 - DNA, 1251 bp, Artificial Sequence
  Description of Artificial Sequence: Synthetic coding sequence
atgaaccttcccagggctgaacgccctcgttctacgccgcagcgcagcctcagggactccgacggtgaggacgggaaaatagacgtattgggtgaggaagaggatgaagacgaggtcgaagatgaagaggaggaagctcgtcaacaatttctggagcaaagtctacagccaggattgcaagtggcaaggtgggggggtgtggcgctgccacgggaacacattgaggggggtgggggaccttcggatcccagcgaatttggtaccaaattccgggctccacctcggtcggccgctgcctccgaggatgctcggcaacctgccaaacctccctactcctacattgctctgattaccatggcaattctgcagaacccccacaaaaggcttacactatccgggatttgcgcctttatttctggacgttttccctactatcggaggaagttccctgcatggcagaactctattcgccataatctgagtctgaatgactgttttgttaagattcctcgggagccaggccatcctggtaaagggaattactggtcattggacccggcttctcaggatatgttcgataacggctctttcctccgacgcaggaagcggttcaagagacaccagctcacccccggtgcacatttaccccatccttttcccttgcctgctgctcacgccgcattgcataatccacaccccggaccccttctgggcgcaccagctccaccacagccagtgccaggcgcttatccaaatacggcgcctggcagacgcccatacgccctcctgcaccctcaccccctgagatatctgttactctctgccagagtatatgcaggcgcaccgaagaaagcagagggtgctgatctcgccacacctgccccattcccgtgttgcagtcctcacctggtgctgtcattaggtagacgggctcgtgtctggcggagacacagagaggctgacgcgtcactgagcgccttgcgagtcctgtgtaaaggctccggagaacgcgtgcaggggctgcgcagagtttgccccagaccaaggggggctacggctacctgcagcagcgatcaccaggcctgttgcatcccaaaacccctgcccctgtgttgcaaatgtcctccgccacttctcctgggccagttctgttctaatagctctagtatcaggagaaccgctccaaccgcggcattgccgccacgggctaggtgttgggccggaacttgtagacccaggcgtcggtgctag

SEQ ID NO: 223526 - DNA, 1254 bp, Artificial Sequence
  Description of Artificial Sequence: Synthetic coding sequence
atgaatttgcctcgcgcagagcgcctccgtagcacaccacagcggtccctcagggacagcgatggggaggacggcaaaattgacgttttaggggaggaagaagatgaagacgaggttgaagatgaggaggaagcggcatctcagcagttccttgaacagtccctgcagccaggactgcaggttgcacggtgggggggagtggcccttcctcgggagcacattgagggaggtggaggcccaagcgacccatctgagtttgggaccaagttccgcgctccccctcgaagtgcagcagccagtgaagatgccaggcagccggctaaacccccttacagttacatcgccctgattactatggcgatcctgcagaacccccacaagaggcttacacttagcggtatttgtgctttcataagtggacgttttccctattataggaggaaattccccgcttggcagaatagcatcagacacaacctctcgcttaacgattgctttgttaagatcccacgcgaacccggacatcccggtaaggggaactattggtccctcgaccctgcctcccaggacatgttcgacaatggttccttcctgagaaggaggaagaggtttaaacggcatcaattgaccccaggcgctcacttgcctcaccctttccctttgcccgctgctcatgcggctctgcacaatcccagacccggaccgctgcttggggctcccgctccccctcagcccgtgcctggagcttaccccaataccgcacctggtagaaggccctatgccctgctgcacccccacccattaaggtatctccttttatcggcacctgtatatgcaggggcaccaaaaaaagctgagggcgcagccctagccacgccagctcctttcccctgttgttcgccacatctggtgctgtctctaggccgtcgcgctagagtgtggaggcgccacagagaagccgatgcctcgctttctgccttgagagtcctctgcaaaggaagcggcgaacgcgttcaaggacttcggagaatctgccccagaccacgaggagcaactgccacctgctcaagcgaccaccaagcatgctgtataccaaggccactccccttgtgttgcaaatgcccacccccacccctcctaggccaattctgtagcaattcctcatccatccgacggaggactgcccctaccgcagctctgccaccgagggctaggtgctgggcaggaacatgccgaccgcgacgcccttgttag

SEQ ID NO: 223527 - DNA, 1122 bp, Artificial Sequence
  Description of Artificial Sequence: Synthetic coding sequence
atgaccgcagaaagcggcccaccaccaccccaaccggaagttttggctaccgttaaggaggaacgcggagagactgcagccggagccggtgtcccgggtgaggctacaggaagaggcgcaggcggtagacggagaaagaggccgctccagcgcggaaagcccccttacagttacatcgcattgatagccatggcaattgcccacgccccagagcgtagattgaccctgggcggtatctacaaattcataacagagaggtttccattctatcgggacaacccgaaaaagtggcagaacagcataagacacaatttgaccctgaatgactgcttcttaaaaatcccaagagaagccggtaggcctggtaaggggaattattgggcattagatccgaacgctgaagatatgtttgagagtggcagctttctcaggcggaggaaaaggtttaagagatcagacttgagcacttatcctgcttacatgcacgacgccgcagccgctgctgccgctgccgcagccgctgctgccgctgctgcaatattccccggtgctgttcctgctgcgagacctccgtaccctggggcagtgtacgctgggtatgcccctcccagccttgctgcgcctccgccagtgtattacccagccgcttcacctgggccatgtcgcgtgttcggcctggtgcccgaaaggcccctgagcccagagcttggaccagccccatctgggcctgggggaagctgtgcatttgcgtccgcaggcgcaccagcaactacgaccggttatcaaccagccggatgtacgggtgcgcgacccgctaatccttctgcgtatgctgcagcttacgcgggtccggatggagcttacccccaaggggctggctcagccatttttgctgctgcaggcagattggcaggaccggcttcacctcctgccggtggctccagcggaggcgttgagaccacagtcgacttttacggacggaccagccccggtcagtttggagcccttggagcctgctacaaccccggaggccaactcgggggtgcatctgccggtgcgtatcacgctcggcacgcagcagcctatcccggtggcattgacagattcgttagcgccatgtag

SEQ ID NO: 223528 - DNA, 960 bp, Artificial Sequence
  Description of Artificial Sequence: Synthetic coding sequence
atggcaggtagatccgatatggaccctcccgctgccttctcgggatttcccgcactccctgccgtggccccttccggacctccaccctcccccctggctggagccgaaccagggagagaaccagaggaggccgctgcagggaggggggaggcagcccctacccctgcccctggacctgggcgacgcagacgaagacccctgcagcgtggaaaaccgccttattcatacatcgcactgattgccatggctctggctcacgccccaggtcgaaggctcacactcgctgctatatatcggtttattacagaacggttcgcgttttaccgagatagcccacggaaatggcagaactccatcaggcacaatctgacactgaatgactgcttcgtgaaagtacctagggagcccggaaatcccggaaaggggaactattggacactggatccagccgctgctgacatgttcgataacggttcatttttgaggcgaaggaaaaggttcaagagagctgagctccccgctcacgcagcggcagcacccggtcctcccttgccattcccctatgccccatacgctccggcacctgggccagcccttctggtgcccccaccaagcgccggtccgggaccaagtcccccagccaggctgtttagcgtcgattcgctcgtgaacttgcaacccgaactggcgggactcggcgctcccgaacccccatgttgcgccgctccagatgccgctgccgcagcctttcccccttgtgcagctgccgcatcaccgcctttgtattctcaggtccctgacaggctggtattgcccgctacgcgcccaggcccagggcctctgcccgctgagcccctccttgcactcgccggacctgcagctgccctgggtcctttaagccctggggaggcgtatcttagacagcctgggttcgcttctggacttgaacgctacctgtag

SEQ ID NO: 223529 - DNA, 1335 bp, Artificial Sequence
  Description of Artificial Sequence: Synthetic coding sequence
atgactacagagggcggaccgcctcccgctcccctgagacgcgcatgttcacccgtaccgggtgcacttcaagcagcgctaatgtcacctccacccgctgccgctgccgctgccgcagctgcgccagaaacaaccagtagctcttcttcttcaagttccgcttcctgtgcttcctcatccagttccagtaatagcgcgagtgctccatcagccgcttgcaagagcgccggaggcggaggcgcaggagctggaagtggtggtgccaagaaagcctcttctggactgcgtcggcctgaaaagcctccctatagttatatcgccttgatcgttatggcaattcagtccagccccagcaagcggcttacactcagtgaaatatatcagttcctgcaggcccgatttccattttttcggggtgcttaccaggggtggaagaacagtgtgcgccacaacctgtctctcaacgagtgctttattaaactgccaaaaggcttaggccgacctggtaaagggcactattggaccatcgacccggcatctgagttcatgtttgaggagggatctttccggaggagaccgagagggttccggaggaaatgtcaggctctgaagcccatgtaccaccgcgtcgtgagtggcctgggttttggagcttcactgctgccccaggggttcgactttcaggcccctccatccgccccactgggctgtcactcccagggcggatatggcggtctcgatatgatgcccgctgggtacgatgccggagcaggggcaccatcccacgcccacccacaccaccaccatcaccaccatgtccctcacatgtcaccgaaccccggaagcacttatatggcgagctgcccggtgccggctggcccaggcggagtcggagctgccggtgggggaggcggaggggattacggtccagactcctcttcatcgccggtgccaagcagtccggcaatggcatccgccatcgaatgccactctccatatacaagccctgccgcacactggagttctccaggggcttcgccctatctgaagcagccacctgcgttgaccccaagttctaatccagcagctagcgccggactccattcttcaatgtcctcatactcactggagcaatcttatctgcatcagaatgctcgtgaagacctctcagttggactgccaaggtatcagcaccactcaacaccagtttgcgacagaaaagacttcgtgctgaactttaacggtatctcaagcttccacccctccgcttccggctcctattaccaccaccaccaccaatctgtatgccaggacattaagccctgtgttatgtag

SEQ ID NO: 223530 - DNA, 1470 bp, Artificial Sequence
  Description of Artificial Sequence: Synthetic coding sequence
atgttggatatgggggataggaaggaagtgaagatgatccccaagtcctccttctccatcaacagtcttgttccggaagccgtgcagaatgacaaccaccacgcttctcacggacatcacaacagtcaccacccccagcaccaccaccaccaccaccaccaccaccatcatcctccacctcctgcaccacagccccctccgccaccccagcagcagcagccacccccacccccacctcccgcaccccagccaccccaaacgcggggagcaccagcagccgacgatgataaaggaccccaacagctgttgctgcccccacccccacctcctccacccgctgcagccctggatggtgccaaggcagacggcctcgggggtaagggcgaacctggcggaggaccaggcgaactcgcgcctgttggacctgacgaaaaagaaaagggggcaggcgcaggaggggaggaaaagaagggggctggggagggcggaaaggatggcgaaggcggaaaagagggtgagaagaagaatggtaagtatgagaagcctccctttagctataacgcacttatcatgatggccatccgtcagtcgccagagaagcggctgaccctaaatggcatctatgagtttattatgaaaaattttccttattatagagagaacaagcagggctggcagaactcaatcagacataatttaagccttaacaagtgctttgtgaaggtgcctagacactacgacgaccccggaaagggcaattattggatgctggacccatcaagtgatgatgttttcataggtggaaccacgggcaagctgagacggagatccaccacgagccgggctaaactagcatttaaacggggagccagacttacatccactggccttacgtttatggaccgcgcaggctccctgtactggccaatgagccccttcctgtccctccatcaccccagggcgagttctacactaagttataatggaaccacctccgcttaccctagtcacccaatgccctacagctctgttctcacccaaaactccctcggcaacaatcattctttttccacagctaacggcctctctgtggacaggctggtgaatggggagattccttatgccacacaccatctcaccgctgctgcattggcggcaagcgtcccctgtgggctcagcgtgccttgttctggcacctactctctaaacccctgcagcgttaacctgttagctggtcaaacgtcctactttttcccgcacgtgccccacccgagtatgaccagtcagagttcgacatccatgagtgccagagctgcgagcagctctacctccccacaggcgcctagcaccctgccctgtgagagcttacgcccatcattaccctccttcaccactggcctgtccggcggacttagtgactactttacccaccagaaccaggggagttccagcaatcctctaattcactag

SEQ ID NO: 223531 - DNA, 1470 bp, Artificial Sequence
  Description of Artificial Sequence: Synthetic coding sequence
atgctagacatgggggatcggaaagaggttaagatgatcccaaagtcgtccttctccatcaacagcctggtgccggaagccgtgcagaacgacaatcaccacgcctcacacggccaccataacagtcaccacccccagcaccaccaccaccatcaccatcatcaccatcaccccccacctccggcaccacagccccctccccctccccagcaacagcagcctccacccccaccacctcctgccccacagccaccccagacacggggtgctcccgctgctgatgatgataaaggcccacagcagttattgctgcccccaccgccaccaccacctccagcagctgctctcgacggggcaaaggccgatggattgggaggaaaaggagagcccggtgggggtccaggggagttggccccagttggcccagatgagaaagagaagggcgctggggctgggggagaggagaagaagggggcaggagaaggagggaaagacggtgagggtgggaaggagggagaaaagaagaatgggaaatacgaaaaaccgcctttcagctataacgctctcatcatgatggcaatcaggcagtcccctgaaaagcgactcacactaaatggtatctatgagttcatcatgaagaacttcccgtattatagagaaaataagcagggctggcagaattccattagacacaacctgagccttaataagtgcttcgtcaaggtcccccgacactacgacgatccgggaaaagggaattactggatgctagacccatcttcggatgacgtatttatcggcggaacaactggtaagcttcgacgtagatcaaccacctccagggcaaagcttgcctttaagcggggagctcgtctgacaagtacagggctgacgtttatggatcgggctggatctctttactggcctatgagccccttcctgtccctgcaccatccacgggcaagttctacactgtcctacaacggtactacctccgcatacccatctcatcctatgccttacagctcggtgcttacccagaactcactgggtaataaccatagcttctccactgccaatggattgagtgttgatagactggtgaatggtgagatcccatatgccacccaccaccttacagccgcagctctggcggcaagcgtgccatgtggcctaagtgtgccttgtagtggcacctactcgctgaatccttgctcggtgaatctactggcaggccagacctcctatttttttccacatgtgcctcacccatccatgacatctcagagcagcaccagcatgagcgctagagcagcatcttcaagtactagcccccaagccccaagcacgctgccctgtgaatccctcagaccatctctccctagcttcacaacaggactgtccggaggccttagcgattacttcacacaccagaaccagggaagttcttccaacccgctgatacactag

SEQ ID NO: 223532 - DNA, 1137 bp, Artificial Sequence
  Description of Artificial Sequence: Synthetic coding sequence
atgagctcttttgaccttcctgcaccatccccacctaggtgttcaccccagttccccagcatcggtcaggagccccctgagatgaacctgtactatgaaaattttttccatccccagggagtcccgtcccctcaaaggcctagcttcgaaggtggaggcgaatatggcgcaaccccaaatccctatctgtggttcaatggacctaccatgaccccacctccttacctgcccggacctaacgcctcgccattcttgccccaggcttacggtgttcaacgcccactgctcccatccgtaagcggactggggggatcagatcttggctggctgcctatcccctctcaggaagagctcatgaagctggttaggccaccttactcgtattccgccctgatagccatggcgattcacggcgcacccgacaagagactgacgttgtcacaaatataccagtacgtcgcggacaatttcccattttataacaagtccaaggctggatggcagaatagcatacgacataacctgtccttgaatgattgctttaaaaaggtgcctcgggacgaggacgatccgggaaaaggcaattattggacattggaccctaattgcgagaagatgttcgataatgggaacttcagaaggaagaggaagcgcaaatccgatgtgtcctcctctaccgcctcacttgctctggagaagaccgaaagttctttgcctgttgattcacctaagaccaccgaaccccaggatattttggacggtgcctctcccggtgggactacctcatctcccgaaaagcgaccgtctccgccacccagcggagctccttgcctcaatagctttctaagctctatgacagcctacgtctcagggggttcacctacaagtcatcctctggttacccctgggctctctcccgaaccatctgataagaccggtcaaaacagcttaactttcaatagctttagccccctgaccaatctttctaaccactccggtggcggagattgggccaaccctatgcccaccaacatgttaagttacggtggttccgtgttaagccagttctctccgcatttttacaatagcgtcaatacctctggcgtgctgtaccctcgcgaagggaccgaggtgtag

SEQ ID NO: 223533 - DNA, 852 bp, Artificial Sequence
  Description of Artificial Sequence: Synthetic coding sequence
atgagcagttttgacctaccagctccaagcccccctcggtgtagcccccaattccctagcattgggcaggagccaccagaaatgaacctctactacgagaacttttttcatccgcagggcgtgccttcaccccagcgtccaagctttgagggtggtggggagtatggagctaccccaaacccatacctatggttcaacggccctacaatgaccccaccaccttatctgccgggtccaaatgcctcgcccttcctgcctcaggcctacggggtccaacgtccactgttgccatccgtctctggcctcgggggatctgacctgggttggctgcccatcccatcacaggaagaactgatgaaactggtgaggcccccttattcatattctgctcttattgccatggccattcatggagccccagacaagcggttaactctgagccagatctaccagtatgttgccgataactttcccttctataacaagtccaaagctggttggcagaatagcatccggcacaatctgagtctgaacgactgctttaagaaagtccctcgagacgaggatgaccctgcctacgtgtccggcggatcacctacatctcatcccttggttactccagggctaagcccagagcccagcgataagactggccagaattctctgacctttaactctttctctccactgactaacctgtccaaccacagcggcggaggcgactgggccaatcctatgcctactaatatgctgtcatatggagggtcagttcttagtcaattttccccccatttttataactccgttaatacatccggagtcttatatcctcgcgaaggaactgaagtctag

SEQ ID NO: 223534 - DNA, 1266 bp, Artificial Sequence
  Description of Artificial Sequence: Synthetic coding sequence
atggctgagtcctggctccgcctctccggagccggtcctgctgaggaagccggacctgaaggaggtctcgaagaaccagatgccctcgatgactccctgacgtctttacaatggctgcaggaattctcaatcctgaacgccaaggctcccgctttgccccctggcggaactgatccccacggttatcaccaagtgccgggatctgccgcacccggtagcccccttgccgctgacccggcatgcctaggtcagccccatacacctggtaaacctacatcgtcctgcacatcacgttctgccccaccaggcttgcaagcccctcctcccgacgatgttgattacgccacgaatcctcatgtgaagcccccttactcttacgccacactgatctgcatggccatgcaagctagtaaggcaacaaagatcacactctccgccatctacaaatggattacagacaacttttgctacttccgtcacgcggacccaacctggcagaacagcatccgacacaacctctctctgaacaagtgcttcataaaggtgccacgggaaaaagacgaaccaggtaagggtgggttctggaggatcgatcctcagtatgccgagcggctgctctccggagcattcaagaaaaggcgcctcccaccagtgcacattcaccctgcatttgctcggcaggccgcacaggaaccatctgcggtccccagagctggcccactgactgtgaacacggaggcccagcagctcctgcgtgaatttgaggaggccaccggggaggcgggatggggcgcaggcgaaggccgacttggccacaagaggaaacagccactgcccaaacgcgttgctaaagtccctagaccgccttctacgttattgcccacccctgaggagcagggggagttggagcctctgaaagggaacttcgactgggaggctatcttcgatgccggtacactaggtggggagctgggagctttggaagcattggaactctcaccgcctctttcccccgcttctcacgttgacgtagaccttacgatacacgggaggcacattgattgtcccgcaacttgggggccatcagtcgagcaggctgccgattccctcgatttcgatgaaacattcctggctacaagctttctgcagcacccatgggacgagtctggaagcggctgcctgccaccagagccgctctttgaggccggagacgccaccttggcatctgacctccaggattgggcttctgtaggagccttcttgtag

SEQ ID NO: 223535 - DNA, 987 bp, Artificial Sequence
  Description of Artificial Sequence: Synthetic coding sequence
atggctgcggctgcagccgcactcagcggagccggtacacccccagctgggggaggcgctggaggcggaggagctggagggggtggatcgcccccaggtgggtgggccgtggctcgtctggagggtcgggaattcgaatacctgatgaagaagcggagcgtgaccatcggtcgcaactcctcccagggcagtgtggacgtgagcatgggccacagtagctttataagtcggcgtcacctggagattttcactcctccagggggaggaggacatggaggagctgcccctgagttgcctccagcccaacctagaccagacgccggtggagacttctatctgcgctgcctcggcaaaaacggagtttttgtggatggcgtttttcagcggcgtggggcaccccctctgcaactgccacgtgtctgcacctttcgatttccaagcacaaatatcaagatcacctttacagctctaagctccgagaaaagggaaaagcaggaggcttcagagtctcctgtgaaagctgtgcagcctcacattagccctctgacaataaatataccagacactatggcccatctcatatccccactgcctagcccaactggaaccatcagcgccgcaaattcatgcccatcttcccctagaggtgccggatcgtcagggtacaaagtgggcagggtcatgcccagcgacttaaaccttatggcagacaactctcagccagaaaacgagaaagaggcaagtggtggtgacagtcccaaagacgattccaagcctccttactcctacgcccagctaattgtacaagcgattacgatggcccctgataagcagctcacattgaacggaatctacacccacatcacgaagaactacccatattacaggactgccgataaaggctggcagaggggcgagagctttgctcatgtgggaaatactcggatacggatcggcctgcctgctcacaaagcaccacagcgatag

SEQ ID NO: 223536 - DNA, 1983 bp, Artificial Sequence
  Description of Artificial Sequence: Synthetic coding sequence
atggccgcagccgcagccgctcttagtggggcaggcacccctcccgcaggtgggggagccggaggaggtggggcaggcggtggcggtagtccccctggcggatgggccgtcgcccgtcttgaaggtcgagaattcgaatacctcatgaagaagcggtctgtcacaattggtaggaatagctcacagggatctgtcgatgttagtatgggacacagctccttcatctcaaggcgacacttagaaatattcacgccaccaggtggaggaggacacgggggtgcagctccagagctccccccagcacaaccccgtcccgacgcaggaggagatttctatctgcggtgcttggggaaaaacggcgtgtttgtcgacggcgtcttccaacggaggggcgcacccccactgcagctccccagagtttgcactttcagatttccaagcactaatataaagattactttcaccgccctgtcctcagaaaaaagagaaaaacaagaggcatctgagtctccagttaaggctgtgcaaccacatatctcccccttaacaatcaatataccagacacaatggcacacctgatctctccattgccatctcccaccggcaccatttccgcagctaacagttgtccctcctccccgagaggggcaggttctagcgggtataaggtgggccgtgtgatgccatcggatctaaatttgatggcagacaattcgcagccagaaaacgaaaaggaggcatccggaggggattcgcctaaagacgactcaaaacctccctatagctacgcccagctgattgtgcaggccataacaatggcgccagataaacagctgacgcttaacggcatctacacacacatcacaaagaactacccctattacagaaccgcggataagggttggcagaactccattcgtcataatctgtccctcaacagatattttatcaaagtccctcgctcacaggaggaaccaggaaaaggttctttctggcggatagatcccgctagtgaaagtaagctgatcgagcaggctttccgtaagcgacggccaagaggcgttccctgtttcaggacacctctgggccctctatcatcaagaagcgctcctgccagccccaaccacgccggagtgctgtccgcccattcatccggagcccagacaccggagtccctgagccgggagggatcccccgctccactggagccagaacccggtgccgcacagccaaaacttgccgtaatccaggaggctcggtttgcccagtcagcccctgggtcgccactgagctctcagccagtgctcattacagtgcaaagacaactgccacaggccataaaacccgtcacatatacagtcgcaacgcccgtgacaacttccacaagtcagcctcccgtggtccaaactgtgcatgtggtccaccagatcccagcagtatccgttacttccgtggccggtcttgctcccgcaaacacttacaccgtgagcgggcaggcagttgtcactcccgcagcagtgctcgctccaccgaaagcggaggcacaggagaatggtgaccatagggaagtgaaggtgaaggtcgagcccatacccgctatcgggcacgccacgctcggtacagccagccgaattatccagaccgcgcaaaccacccctgtgcagactgttaccatcgttcagcaggcacccttagggcagcatcagctccccatcaagaccgtgacacagaatggcactcatgtcgcatcagtgcctaccgccgtgcacggacaggtcaataacgcagccgcatccccactgcatatgttggccacccacgcctcggcttcagcctcgcttcccacaaaaaggcataacggcgatcaaccagagcagccagagttaaaacggatcaagaccgaggacggcgaagggatagtcattgcactgtccgtggatacacctcctgccgcagtaagagagaagggcgtgcagaactag

SEQ ID NO: 223537 - DNA, 1833 bp, Artificial Sequence
  Description of Artificial Sequence: Synthetic coding sequence
atggccgctgccaggcgtgcattaggcgcaggcacaccccgagctagaggtaggggtcggggagcgggtggtggaggaagtcgtcgagcccttggaaggggagccccaggaggtccccgagtcagggtgagcgacgaggaagctctgggtgaccaccggccacagctggtcgcgggtctaggcggtcgcgaacacgggccactcgagctccatttgcctgcaccacccagggaccttcacgcaccgggaaggagggggcacggaggagcggcacctgagcttcccccagcccagcccagaccggatgctgggggagacttttatctcagatgtttgggtaaaaatggcgtgttcgtggatggcgtattccaaaggaggggcgcacctcccctgcaactgcccagagtatgcaccttccgttttcccagcaccaacataaaaatcacatttactgccctctcttccgagaagagggaaaaacaggaagccagtgagtccccagtcaaggctgtgcagccccacatttcccccctgaccataaacatccctgacacaatggctcaccttatttctcccttacccagcccaacggggactatctccgcggctaattcctgtccaagttcccctcgaggcgcaggcagcagtggttataaggtcggcagggtgatgcccagtgacctaaatctgatggctgacaattctcagccagagaatgagaaagaggcctctggaggcgactctcctaaggacgattctaagcctccctactcttacgcacaactcatcgttcaggccattacaatggctccggataagcaattgactctgaacggcatctacacacatatcactaaaaactatccttactatcggactgctgataagggttggcaaaattctatccggcacaacctgagtctgaaccggtactttattaaggtgccgaggtctcaggaagagcccggaaaggggagcttttggcgcatcgatccggcatccgagtcaaaactcattgagcaggcctttaggaaaaggcggcctaggggcgtcccttgttttagaacacccctcgggccactttcctcccgcagtgcccctgcctcacctaatcatgctggcgttctgagcgcgcattcaagtggcgctcagactccagaatctctttccagagagggaagtccggctccactcgagcccgagcctggggctgcacaacctaaactcgccgttattcaggaggcgagattcgcccagtctgctcccggatctccattgtcatctcagcccgtcctgataacagtgcaaagacaactgcctcaagctataaagcccgtgacatacacggtggcaacccctgtgacaacaagcacctcccagccccctgttgtacaaactgtgcatgtggtccatcagatccccgcagtgtcagtgactagtgtggcaggattggcacccgctaatacatacaccgtcagcgggcaggccgttgtaacacccgcagctgtgctcgcgccaccaaaggcagaggcccaagagaacggcgaccatagggaagtgaaggtgaaggtcgaaccaattcccgctattggtcacgctacactcggcacggccagccgtatcatccagacagcgcagaccactcctgtgcagactgttactatcgtccagcaggcaccacttggacagcaccaactacctatcaagacggttacacagaatggaacacacgtggcctctgtgcccacagctgtacatggccaggtgaacaatggacccctgggactgcgccgaccaccttgcgcatcatcagactggagttgtcttagctag

SEQ ID NO: 223538 - DNA, 1038 bp, Artificial Sequence
  Description of Artificial Sequence: Synthetic coding sequence
atgtctcacctgtttgacccaaggttgcctgccttggcggctagtcctatgctttacctgtatggcccagagcgccctggccttcctttggcctttgccccagccgcagctttagccgcttccggcagggcagagacaccgcaaaagcctccatatagctacattgcactgatcgctatggcgatccaagacgccccagaacagagggtcactcttaacgggatctatcaattcatcatggataggttccctttttaccacgataaccgccagggttggcaaaattctatcaggcacaacctgtctctaaatgattgcttcgtgaaggtccctagggaaaagggtagacctggcaaaggtagctactggactctggacccaaggtgcctagacatgttcgagaatggcaattacaggaggagaaagcgcaagccgaaacctggcccaggagcgccagaagccaaacggccacgcgcagaaactcatcagcggtcagcggaggctcagcccgaggctggctctggtgcaggaggaagcggtcccgcaatcagcagactgcaagcggctccggcaggtccttcccctctcttggatggaccatctccccctgccccactgcattggcccggtacagccagcccgaatgaagacgctggagatgcagcccagggggctgccgctgtggcagtaggccaggcagccagaaccggcgacggacccggaagccctctccggccagcatctaggtcctcccccaaatccagcgataagtccaagagcttttccattgattctatcttagccggtaagcagggacaaaaacctccctccggggacgagcttctgggcggagctaagccaggtccaggcggtcggctcggcgcaagtctgcttgcagcttcttcttcgttgcggccaccatttaacgcatctcttatgctcgatccccacgtgcaaggaggcttttatcaattaggaatcccttttttaagctactttcctttgcaggtacccgataccgtgcttcatttccagtag

SEQ ID NO: 223539 - DNA, 1131 bp, Artificial Sequence
  Description of Artificial Sequence: Synthetic coding sequence
atgatggcctcctaccccgagccagaagacgcggcaggagcgctactcgcacccgaaactggaagaacagttaaggaacccgagggccctccacccagcccgggaaagggaggaggtgggggaggcggtacagccccagaaaaaccagatccagcacagaaacctccgtattcgtatgtggcactgattgctatggcaataagggaaagtgcagagaagcgcctgactttatcagggatatatcagtacataatcgcgaaatttcccttctacgagaagaataagaagggatggcagaatagcattagacacaatctcagcctgaacgaatgcttcattaaagtccccagagaaggaggcggagaaaggaaaggaaattactggacactggatccagcatgtgaagacatgttcgaaaagggtaattataggcgtagaaggagaatgaagcgccctttcagaccccctcctgcacacttccagcccggaaaggggctttttggcgcaggcggagccgcaggaggctgtggggtggccggagccggtgccgatggatacgggtacttagcacctcctaagtacctgcagagcggctttctgaataactcctggcctctgcctcagcctccgtccccaatgccttacgcctcatgccagatggccgctgccgctgcagcggctgcagctgcagctgcagcagctgggcctgggtcccccggtgcagccgctgtggtgaaaggcctcgctgggccagccgcttcatacgggccatacactcgcgttcagtcaatggcactgcctcctggcgtagtgaattcatacaacggcttgggcggaccacccgcagccccaccccctcccccacacccccatcctcatccacatgcgcaccatctacacgctgcggctgccccaccccctgcccctccgcaccatggcgctgccgctccacccccaggccagctaagtcccgctagtcccgctaccgcagctcccccagccccagccccaacgagtgcccctgggctgcagtttgcatgcgccaggcagccggagctggcaatgatgcattgctcatactgggaccacgactcaaagactggagcccttcatagtcgactggatctctag

SEQ ID NO: 223540 - DNA, 810 bp, Artificial Sequence
  Description of Artificial Sequence: Synthetic coding sequence
atgatggcctcttaccccgagcccgaggatgcagctggtgcactgttagcccctgagactggaaggacagtcaaagaacccgaaggcccacccccttctccagggaaggggggaggcggtggcggtggcacagctccagagaaaccagaccccgctcagaagcccccatactcttatgtagcactgattgcaatggcaattcgggagtccgcggaaaaacgtctaactctcagcgggatctatcagtatatcatagcaaaattccctttctatgagaaaaataaaaagggctggcaaaatagtatcaggcataatctatccctgaatgaatgttttataaaagtcccgagggaggggggaggggagaggaaggggaactattggaccctggacccggcatgtgaagacatgtttgaaaagggtaattataggcgtagaagaagaatgaagcggcctttcagacctcctcctgcacacttccagcccggtaaagggctgtttggcgctggcggtgcggcaggcggttgcggggtcgcaggggcaggcgcagacgggtacgggtatctcgccccacccaaatacctgcagtccgggtttctgaataactcatggccacttccccagccaccatctcccatgccctatgcgtcatgccagatggcagcagctgccgcagcagctgctgccgctgctgctgctgctggtcccggatcccttgctcgccctctgtggtccagaggttggagggcccgtccccctcgcacgggaagaacccacgcatgtcgagcctggcggtgtcccccagcctag

SEQ ID NO: 223541 - DNA, 2406 bp, Artificial Sequence
  Description of Artificial Sequence: Synthetic coding sequence
atgaaaacctcccccaggcggcctctgattctcaaaaggcgccgactgccactgcctgtgcagaacgcgccttcagagacatcagaggaggaacccaagcgttcaccggctcagcaggagtccaatcaagccgaagcttcgaaggaggtcgccgagtccaactcctgcaagttcccggctgggatcaaaataatcaaccatccaactatgccaaatactcaggtcgttgcgattcccaacaatgctaatatacacagtatcataaccgcccttaccgccaagggcaaagaatccggatccagtggaccaaataagtttattctcatctcttgcggcggagccccaacgcagcccccagggttgagaccacaaacccagacaagttatgacgctaagagaactgaagtgacgctggagacgttaggcccaaagcctgcagcacgggacgtcaatctccccaggcctcccggtgcactctgcgagcagaaacgggagacgtgcgccgatggggaagcagctggctgtaccatcaataacagtttgtctaatattcagtggctccggaagatgagtagcgatgggctgggatctcggtcaataaagcaggaaatggaggagaaggagaattgtcaccttgagcaacgacaggtgaaggtggaagaacctagtcggccatctgcatcatggcagaattcagtcagtgagcggcctccgtattcatatatggccatgatacaattcgctatcaactccacggagcggaagcgcatgactcttaaggacatctatacatggattgaggaccactttccgtacttcaagcacatcgcaaagcccggatggaaaaactcgattaggcacaacctctctctgcatgacatgtttgtgagagagacaagcgccaacggaaaggtctctttttggacgatccacccttctgctaaccgatatttgaccctggatcaggttttcaagccgctcgacccaggttctccacagcttcccgagcatctagagtcgcaacagaagcgaccaaaccctgagttgcgcaggaatatgacaatcaaaacagagctccccctgggcgctcgaaggaagatgaagccacttttgccccgagtgtctagttatctagtgcccatccaattcccagtaaaccagtcacttgtgttgcagccttccgtcaaggtccctcttcctcttgccgcatctcttatgagctccgaactagcgcgacatagcaagagagtgcgcatcgcccctaaggtatttggtgaacaggttgtattcggatatatgtctaagttctttagtggcgatctccgggacttcgggacacccataacatctctgtttaatttcatttttctgtgtctcagcgtgctgctagcagaagaagggatcgctcctttgtcttctgccggtcccggaaaggaggagaagctcctctttggtgaaggattctctcccttgttacctgtgcaaacgatcaaggaggaggagatccagccaggcgaggaaatgccacatctagctcgacccattaaagtggaatccccccctctggaagaatggccatcacctgccccatcttttaaagaagaaagttcccatagctgggaagatagctctcagtctccaacgccacgacctaagaaaagttacagcggcctccgaagcccaaccagatgcgtgagcgaaatgttggtgatccaacacagggagcgacgggaacggtcccggtccagaagaaagcagcatctgctgcccccatgcgttgacgagcctgagctcttattctcagagggcccatccacttcccggtgggccgctgaactaccattccctgccgattctagtgaccctgccagtcagctgtcttattcccaggaagtgggagggccatttaagaccccgatcaaagaaacgctcccgatcagcagcaccccctctaagagtgtcctgcctaggacaccagagtcctggcggctaaccccacctgctaaagtgggaggcttagattttagtcccgtccagacgtctcaaggcgcttctgaccctctccccgatccattgggcctgatggatctgtccacaacccccctgcagagcgctccacctttggagagcccgcagcggttactgtcttccgagcccctcgatctcataagtgtgccctttggtaactcttcccccagcgatatcgatgtgcctaaacccggttctcctgagccccaagtctcgggtctggctgcgaatcgctccctgaccgagggactggtgctcgacaccatgaacgacagcctttccaagattttgctcgacatttcattcccagggctcgacgaggacccgttagggccagacaatatcaattggagccagttcataccagagcttcaatag

SEQ ID NO: 223542 - DNA, 2292 bp, Artificial Sequence
  Description of Artificial Sequence: Synthetic coding sequence
atgaaaacatcccccagaaggccccttatcctaaaacggagacggcttcccctgcccgtgcaaaatgcgccttctgaaacgtctgaggaggagcctaaaagatcccctgcacagcaggaaagcaatcaggctgaggcatccaaggaggtagctgaatctaactcttgcaaatttcccgcaggaattaaaatcatcaaccacccgacaatgccaaatacacaggtagtcgccattcccaataatgcaaatattcactctatcattaccgccttgacagctaaaggaaaggaaagcggctcttccggcccaaacaaattcatacttatctcctgtggaggtgccccaactcagcctcccggattgaggccccaaacccagacttcctatgatgcgaaacgcaccgaagtgacattagaaacactgggtcctaagccagctgcgagggatgtcaatctgccaagaccgcctggggcactgtgcgagcagaagagagaaacctgcgcggacggtgaggcagcaggctgcacaattaacaattccctcagtaacattcagtggttgcggaagatgagtagtgatggtctcggctctcggtcaattaagcaggaaatggaagaaaaagaaaactgccacttggagcagcgacaagttaaggtcgaggaaccctcaagacctagcgcctcatggcagaattccgtttcagaaaggcccccatatagctatatggcaatgatccagttcgctataaactctacggagcgcaaaagaatgaccctaaaggacatttacacttggatcgaggatcatttcccctactttaagcatatcgcaaaacccggatggaaaaattcaatcaggcacaacttgtccctgcatgacatgtttgttcgggagacgtcagctaatggtaaggtgtccttttggaccattcatccaagcgcaaataggtacttgacacttgaccaagtgttcaaacccctggaccctggttcacctcagctcccagagcacttagaatctcagcagaagcgtcccaatcccgagctgcgtaggaacatgacaatcaagacggaactgccgctgggtgccaggcgcaagatgaagcctctgctcccgagagttagctcctacctggtgcccattcaattccccgttaatcagagtctggtgctgcaaccaagcgtcaaggtacccttgcccttggccgcttcgctcatgagcagcgagctggccaggcactccaaacgcgtcaggatcgccccaaaggttctattagctgaggagggtattgcacccctgagtagcgccggacccggtaaagaagagaagttgctgtttggcgagggcttttcgcctcttctgcctgttcagacgattaaagaggaggaaatacagcccggtgaagaaatgccacacctagcgaggcctatcaaggttgagagcccgccacttgaagaatggccctctcctgccccttcctttaaggaggagagcagccactcctgggaggacagcagtcagtcaccgactccacggccaaaaaagtcatacagcggtctcagatctcccaccaggtgcgtttctgagatgctcgtcatccagcatcgtgaacgaagggaaagatcgcggagcaggagaaaacaacatctgctgcctccatgcgtcgacgaacctgaactgcttttttctgaaggcccaagcacttcaagatgggctgcagaactgccatttcccgcagattccagcgacccggcatctcagctgtcctacagtcaggaggttggcggtccatttaaaactcccataaaagagacccttcccatcagtagcaccccatctaaatctgttctgcctcgcaccccggaatcctggagacttacccccccagccaaagtgggaggtctggatttcagccccgtccaaacaagccagggtgcaagcgatcccctgcctgacccattagggctcatggacctgagcaccactccgcttcagtccgcccctcctctggaatccccacagaggctgctctcatccgaacctttggatcttatttctgttccgtttggtaatagcagtccatcggacatagatgttcccaagccaggatccccagaaccacaggtaagtggactggccgctaaccgttctcttactgagggcctggtgctggatacaatgaacgatagtctctcaaagatcctgttagatataagttttcctggcctcgatgaagacccactgggccctgacaatatcaactggtcacagtttatccctgagttgcaatag

SEQ ID NO: 223543 - DNA, 2247 bp, Artificial Sequence
  Description of Artificial Sequence: Synthetic coding sequence
atgaaaacttcacctcggaggccactcatcttgaaacgacgaagactgcccctaccggttcagaatgccccaagcgagacctccgaagaagaaccgaaacgctctcccgctcaacaggagagcaatcaggccgaggcttcaaaggaggtggctgagtccaattcttgcaagttccccgctggtatcaagatcattaaccacccgaccatgccaaatacccaggtggtagctattcctaataacgcaaacattcactctattatcacagccctgaccgccaagggcaaggaaagtggaagttccggcccaaacaaatttattctgatctcttgcggcggtgcccctactcagcccccaggcctgaggccccagacacagaccagctatgacgcaaaacggaccgaggtgacattagaaaccctgggccctaaaccggcagccagagacgttaacttgccacgcccaccaggggcactgtgcgagcagaaacgggaaacctgcgctgacggcgaggcggctggctgtacaataaacaactctctctcgaacatccaatggctgcggaagatgtcaagcgatgggttgggttccagatcaatcaagcaggaaatggaagaaaaagaaaactgccatttagagcagcgacaggtcaaggtcgaagagcctagccggccatccgcttcttggcagaactctgtgtccgaaagacccccttattcctatatggccatgattcaattcgcgatcaactctaccgagcgcaaacggatgactttgaaggatatttatacctggattgaagaccacttcccatactttaagcatatagctaaaccagggtggaaaaatagtatacgccacaatctatccctgcacgatatgtttgtccgggagacgtctgctaacgggaaagtgagcttttggacaatccacccaagcgctaatcgttatcttaccttagatcaggtgtttaagcagcaaaaaagacctaatcccgagttacggagaaacatgactattaaaactgagctcccactaggagccagacgcaagatgaagcccctcctcccccgagtctctagctatttggtacccatccagttccctgtgaatcaatcactggtgctgcaaccctcggtcaaagttcctctaccactggctgcttccctgatgagctcagaactcgcccgacactcaaagcgcgtcaggatcgccccaaaagtcctcctcgctgaggagggtattgcacctctgtcctccgctggtcccggtaaggaagagaaactgctctttggggaaggtttcagtcctctgctgccggtgcaaactattaaagaggaggaaatacagccgggagaggaaatgcctcacctggcccgacctattaaggtggagtctccacctctggaagagtggccgtccccagctccgtcttttaaagaagagtcaagccattcatgggaagatagctcccagagtccgactcccagaccaaaaaagtcatactcaggcctgaggtcgcccaccagatgtgtctccgaaatgcttgtgattcagcatagggagcgcagggagcggagcagaagtcggagaaagcagcacctacttccaccctgtgtagacgaacctgaactgcttttcagtgaaggccctagcaccagtaggtgggcagccgaactgcccttccccgcagactcctcagacccagcaagtcagctctcatacagtcaagaggtggggggtccattcaagacccccatcaaggaaaccctgcctatatcatcgactcctagcaaatctgttttaccgcgaactcctgaatcctggaggctcacaccgccagctaaagtaggcggactggactttagtccagtgcaaaccagccagggcgcttcagatccactgcctgaccccctgggcctaatggatctgagtacaaccccactccaaagcgcacccccacttgagtcaccccagaggttgttatcatcagagccacttgaccttatctcagtgcccttcgggaatagctccccctccgatatcgacgttccaaagcctgggagccccgagccccaggtttctggattggccgctaaccgaagtctcacagaaggacttgtcctggacactatgaatgatagcctctctaagattctcctggatatcagctttcccggactggacgaagatccactgggaccagacaacataaactggagccaatttatccccgaattacagtag

SEQ ID NO: 223544 - DNA, 531 bp, Artificial Sequence
  Description of Artificial Sequence: Synthetic coding sequence
atgggggctcccgcaacaagacggtgtgttgagtggcttttaggactgtacttcctaagccacatcccaattacacttttcatggacctgcaggctgtcctgccaagggaactctaccccgttgagttccggaatctgctcaaatggtacgcaaaagagtttaaagatccattgctgcaggagccaccagcatggtttaagtccttcttattttgtgaattagtgttccagctgccatttttccctatcgccacttatgctttcctcaaaggtagttgtaaatggatcagaaccccagctattatatacagtgttcatacaatgacaacgctcatccccattctgtctacattcttgttcgaagatttcagcaaggcctcagggtttaaaggccagagacccgaaacactgcacgagcgtctcaccttagtgagcgtgtatgctccttaccttctcatccccttcatcttactaatctttatgctccgtagcccttactataagtatgaggagaagcgcaagaaaaagtag

SEQ ID NO: 223545 - DNA, 1473 bp, Artificial Sequence
  Description of Artificial Sequence: Synthetic coding sequence
atggggccagtgatgcccccttctaagaaaccagaatcctccggaatttcagtatccagcggcttaagtcagtgttatggaggaagtggctttagtaaagcgctgcaagaggacgacgacctcgatttttcccttccggacattaggctggaggaaggggctatggaggacgaggagctgacaaatctgaattggctgcatgaatcaaagaatctgttaaaaagctttggagagagcgtactcagatcagtaagtcccgttcaagatctagacgacgatactccgccaagccctgcgcacagcgacatgccttatgacgcccgtcaaaatcccaactgcaaaccaccctattccttttcttgtctcattttcatggcaatagaggacagccccactaaaaggttacctgtcaaggatatctataattggattctggaacacttcccttactttgccaatgcgccaaccggctggaagaacagcgtgcgccataatctcagcctcaacaaatgttttaaaaaggtggataaggagaggtcccagagcatcggcaaaggctccctgtggtgtatagatcctgagtacagacagaatctaatccaggccctaaaaaagacgccataccacccccacccccacgttttcaacaccccacctacgtgtccccaagcttaccagtccacgtccggccctccaatttggcctgggtccaccttttttaagagaaatggggcattgctccaagaccctgatattgatgcggcaagcgctatgatgctgctgaacacaccgccagagattcaggctggtttcccccctggcgtcattcagaatggagccagggtcctctccagaggactgttccctggcgtgagaccattgccaataacgccaattggggttactgcagccatgaggaatggcataacatcatgtcgcatgcggacagaatcggaaccctcatgtggtagccctgtggtaagtggtgaccccaaggaggatcacaactattcctcagctaagtcgtcaaatgcaaggtccacctccccgaccagtgattctatctcgtcctcttcatccagcgcggacgatcactatgaattcgccaccaagggcagccaggaaggctctgaaggcagcgaggggtctttccggagtcacgaatcaccgtctgatacagaagaagatgatcgcaaacactcacagaaggagccgaaggatagcctgggggattctggctacgctagccagcacaagaagcgtcagcactttgccaaggccagaaaggttccttctgacaccctcccactcaaaaagcggagaaccgagaaacctcctgagagcgatgacgaagaaatgaaagaagccgcagggtcgttgctacacctggcaggcatccgtagttgtcttaataacatcaccaaccgcactgctaaggggcagaaagagcagaaggaaacaacaaagaattag

SEQ ID NO: 223546 - DNA, 1473 bp, Artificial Sequence
  Description of Artificial Sequence: Synthetic coding sequence
atgggccctgtaatgccaccctctaaaaaaccggaaagctccggcatctcagtctcttccggactctcacagtgttacggaggcagcggatttagtaaggccttacaagaagacgacgaccttgatttttcactgccagacatccgcttagaggagggcgctatggaggacgaagaattaactaacttaaattggctgcacgaatccaagaacctcctcaaatccttcggagaatcagtcctaagaagtgtcagcccggtgcaggacttagacgatgacacccccccaagcccggcacactccgacatgccgtatgatgccagacagaatccaaactgtaagccaccctactccttttcatgtcttatctttatggccattgaggattcgcctacaaaacgcttacccgtgaaggatatatataactggattctggagcacttcccctacttcgctaacgctccaactggctggaagaattcagtgcgccacaatctgtcactgaacaaatgtttcaagaaagtcgacaaggaaagaagtcagtccataggaaaagggtctctgtggtgcatcgatcctgaatatcgacaaaacctgatccaggcccttaagaaaaccccctatcatccgcacccacatgtctttaatacgccaccaacatgtcctcaggcttatcagagcacatccgggcctccaatatggccagggtcaacctttttcaagcggaacggggctctcttgcaggatccagacatcgacgcagcatcagcaatgatgctacttaacactcctcctgagatacaagctggcttccctcccggagtgatccagaacggggcacgggtcctaagccgtggactgttccccggtgtgcgtcccctcccaattactccaatcggggtgactgctgccatgcgaaatggtataacaagctgccggatgcggacggagtccgaaccctcatgcggatcccccgtggtgagtggggatcctaaggaagatcataattactcctctgctaaatcctcaaacgcccgttccacaagtcccacatctgacagcatttcttcatcaagctcatcagccgacgaccactatgagttcgccactaagggatcacaggaggggtcagagggttcagaaggatcatttagatcacatgaatctccgtcagatactgaggaagatgatcgaaagcatagtcagaaggaaccaaaagatagcttgggtgattcagggtatgcctctcagcataagaaaaggcagcacttcgccaaagctagaaaggtgccatccgatacactgccattgaaaaagaggaggactgagaaaccaccagagagcgacgacgaggaaatgaaggaagcagccggatctctgcttcacctcgctggtatcagaagttgcttgaacaacattacaaataggacggcaaaggggcaaaaagaacagaaggagacaacaaaaaactag

SEQ ID NO: 223547 - DNA, 165 bp, Artificial Sequence
  Description of Artificial Sequence: Synthetic coding sequence
atggggcctgtaatgcctcccagcaagaagcctgaaagtagcgggattagcgtgagctcaggcctgagccaatgctatggcggtagcggctttagcaaggccctgcaggaggacgatgatttggatttcagcttgcctgatattcgcctcgaagaaggggcatag

SEQ ID NO: 223548 - DNA, 282 bp, Artificial Sequence
  Description of Artificial Sequence: Synthetic coding sequence
atgggcccagtcatgccgcctagcaaaaagcccgaaagttccggaatatccgtgtctagtggcctgagccagtgttacgggggaagcggcttcagtaaggcactccaggaggacgatgatctcgacttcagcttacctgatatccggcttgaggagggcgcaatggaggacgaggagctcaccaatcttaattggctccatgagtcaaagaacttgcttaagagttttggcgagagtgtgttacggtcagtgtcccctgtgcaggatctcgatgacgattag

SEQ ID NO: 223549 - DNA, 1407 bp, Artificial Sequence
  Description of Artificial Sequence: Synthetic coding sequence
atgggaccagtcatgcctcctagtaaaaagcctgagtctagtggcatctcagtctcgagtggactgtctcagtgttatggcggttctggattctcaaaagcactacaggaggacgacgatctggattttagcctccccgatattagattagaagagggagccatggaggacgaagagttgacgaacctgaattggcttcatgagagcaagaacctactgaagtcctttggggagagcgtcttgcggtccgtgagtcccgtgcaggacctcgacgacgacacacccccatctcccgcacactctgatatgccctatgacgccagacaaaatccgaactgcaagccgccatattcctttagttgcctgatttttatggcaatcgaagacagtcccacaaagcgtctgccagtcaaagacatatacaactggattctggaacactttccttacttcgccaacgcacccacaggttggaagaattcggtgaggcacaatctgtcactcaataaatgtttcaagaaggtcgacaaagaacgctcacagtctattggaaaaggatccctgtggtgtattgatccagaataccggcaaaatcttattcaggccctcaagaaaaccccataccacccacatcctcatgtgttcaatacgccacctacttgccctcaagcctaccagtctacatccggaccaccgatctggcctgggtctaccttcttcaaacggaatggggcactactgcaggttccgccaggtgtgatccaaaacggcgctagagtgttgtctcgtggccttttccccggagttaggccacttccaataactcctataggcgttaccgccgcaatgagaaatggtatcacctcgtgccggatgcgaaccgagtcagaaccctcctgcggatccccggtcgtgagcggggaccctaaggaagatcacaattactcatcagccaaatcatccaatgccaggtctactagtcctacatcagactcgatctcttcctcgtcatcctctgccgatgaccactacgagtttgcaaccaagggtagccaagaggggtctgagggcagcgaaggaagcttccgcagccatgagtctcccagcgacaccgaggaggacgataggaagcatagtcaaaaagagccgaaggattccctgggcgatagtgggtatgcctcacaacataaaaaacgtcagcacttcgctaaggcacgcaaagtgccttccgacactttgcccctcaagaagagaagaaccgagaaacccccagagtccgacgatgaggagatgaaggaggctgctggcagcctgttgcacctcgccggtatccgctcctgtctcaataatatcacgaacagaacagccaagggacagaaagaacaaaaggaaacaaccaagaattag

SEQ ID NO: 223550 - DNA, 627 bp, Artificial Sequence
  Description of Artificial Sequence: Synthetic coding sequence
atgggtcctgtcatgcccccatccaagaagcctgaatcatccggaatcagtgtgagctccggactgagtcagtgttacggtggctccggattttcaaaggccctccaggaagacgatgatctggatttctcactgcccgacatcagattggaggagggcgcaatggaagatgaagaactgacaaacttgaattggctgcatgagtctaagaatctcctaaagagctttggagaaagcgtgcttcggagcgtgtccccagtccaggatctcgatgacgacaccccaccctcaccagcccacagcgacatgccatacgacgcccgacaaaatcctaactgcaaacccccatactccttctcctgcctgatatttatggccatagaggactcaccaaccaagagattacctgtgaaggacatttacaattggatcttagagcacttcccctatttcgctaatgccccaaccggttggaaaaattcagttaggcataatctctccctgaataagtgtttcaaaaaggtcgataaggagagatcacagtcgataggcaagggctcattgtggtgtatcgatcccgagtaccgacagaacttgatacaagctcttaaaaagactccctattag

SEQ ID NO: 223551 - DNA, 1407 bp, Artificial Sequence
  Description of Artificial Sequence: Synthetic coding sequence
atgggtcccgtgatgcccccaagcaaaaagccagagtcttcaggcattagtgtgagcagtgggctgtctcagtgttatggcggatccgggttttccaaggccctccaggaagacgacgatctggatttttccctgcctgatatcaggcttgaggagggtgcaatggaggacgaggaactgactaatctgaattggctgcacgaatcaaaaaacctgctgaaatccttcggcgaaagcgtccttcgctctgtttcccccgtgcaggaccttgatgatgacaccccccctagccctgctcactcggacatgccctatgatgcgagacagaatcctaattgcaaacccccatactccttttcatgtctcatcttcatggcaattgaggattcccccaccaaacgtctgcccgtgaaagacatttataactggatcttggagcactttccttatttcgcaaatgccccaacaggttggaaaaacagtgtcagacacaacctgagtctaaataagtgcttcaagaaggtggataaggagaggagtcaatcaatcggaaaaggctcactgtggtgtatcgatccagagtacagacaaaatcttatccaagcactcaagaagacaccgtaccatcctcacccccacgttttcaatacgcctcctacctgcccgcaagcctatcagtctacaagcgggccaccaatctggcctggcagcaccttttttaaaagaaatggagcactcctccaggtgcccccaggggtgattcagaacggtgcaagggttctttcaaggggcttgttcccaggtgtgcgacctttacctattacgccgattggggttaccgccgcaatgaggaacggaatcacatcttgtagaatgcgaaccgaaagtgagccatcctgcggatctccagtagtaagtggggatccgaaagaagaccacaactattcctccgccaagtcttccaacgcacgcagcacttcaccaacatcagactcaatatcctcatcctcctcaagcgccgatgatcactatgagtttgctactaaggggtctcaggaaggctctgaaggcagcgagggcagtttcaggagccacgagtcacccagcgataccgaagaggacgatcgcaaacattcccagaaagaaccaaaggacagcctgggtgattccgggtacgcttcccagcacaagaagcggcagcacttcgctaaggcacgcaaggtgccatcggacactttgcctctgaagaaaagaaggacagagaaacccccagaatccgatgacgaggagatgaaagaggctgcagggagccttctgcacctcgccggaatccgcagctgcctgaacaatatcacaaaccggacggccaaaggacaaaaagagcaaaaggagaccaccaaaaattag

SEQ ID NO: 223552 - DNA, 777 bp, Artificial Sequence
  Description of Artificial Sequence: Synthetic coding sequence
atgattgaatctgacaccagctctatcatgtcggggatcattcggaattctgggcaaaatcatcacccaagcccacaggagtaccggcttctggcgaccacatctgacgacgatctccccggagacctgcagtctctgtcatggttgaccgctgtggacgttcctcgcttgcagcagatggctagcggcagagtcgatctcggaggtccctgcgttcctcacccgcatccaggggcactggctggcgttgcagatctgcacgtgggggctacgccatctccgctgctgcatggcccagccggaatggcaccccgtggtatgccaggcctgggacccatcacaggacaccgcgatagccaaatgagccagttccccgtgggcggacagccctcttcaggcctccaagatcccccacatctttattcccctgccacacagccgcaatttcccctgccgccaggcgctcaacaattgtcagatagacatgggcctgaggagcagcaggatcgccaaccagcgtgcgagcgggacctgcagctccacgagggggctctgcctctgttgcaggacggccctaggcgtgtagaggagctgggggctgcacagcccgtctccgagcaggttctgcgggaggggggtgagcaggacgagaggctactaccacagggactccctgttggtagcgagccaggaccacatcgacaggacggcggaggggatgcccaggtggaggaagagggccctggttgtcatccaccggaatatggacagccatag

SEQ ID NO: 223553 - DNA, 1554 bp, Artificial Sequence
  Description of Artificial Sequence: Synthetic coding sequence
atgattgagtccgacacttcctctatcatgagcggaattatccgcaatagcggacagaaccatcatccaagtcctcaggaatatcgcctgctggctacgacatccgacgatgacctcccaggcgacctccagagcctgtcatggctcactgcagttgacgtgccccgactgcagcagatggctagcggaagagtcgatctcgggggaccctgcgtgccgcatccccatcccggagcgctggccggagtggccgacctgcatgtgggagccacgccctcccctctactgcacggcccagcaggaatggctcctcgtggaatgcccggactgggtccaatcactggtcaccgggactcaatgtctcaatttcctgttggcggtcagcccagcagcggtctgcaggacccaccacatttgtacagccctgcaacgcaaccgcagtttccccttcccccaggtgcgcagcaatgtcctcctgttggactgtacgggccacccttcggggttaggcctccctacccacagccacacgttgctgtgcattcatcccaggaactgcacccaaagcactacccgaagcctatctattcctattcctgcctcatagccatggctctgaagaactctaagactggcagtctcccggtctccgaaatctattcattcatgaaggaacacttcccttactttaagaccgccccagatggctggaaaaacagcgtgagacacaacctgagtcttaataagtgcttcgagaaagtagaaaataagatgtccgggagtagccgcaaggggtgcctctgggccctgaatctagcacgtattgataagatggaggaggagatgcataagtggaagagaaaggacctggccgcaattcacaggagtatggcaaacccagaagagctagacaagctgatctctgaccgaccagaatcatgtcgcaggcctggcaagccaggcgagcccgaggcaccagtacttactcacgccacgacggtcgccgtggcacacggttgtttggccgtctctcagcttcccccacagccccttatgacgttgtccctccaatccgttcctttgcaccatcaagttcagcctcaggcccacctagctcctgatagccctgcacctgctcagacacctcccctgcacgccctcccagacctgtccccaagtcccctgccgcaccccgctatgggcagggcgccagtcgattttattaatattagcaccgacatgaatacggaggttgacgccctggatccttcaattatggactttgctctgcaggggaatttgtgggaggagatgaaggacgagggtttctccttagacaccctgggtgcattcgcagactctcccctaggctgtgatctgggagcctccggccttacaccagcctcaggaggttcagatcaatcctttccggatctccaggttactggtctctatacggcgtacagtacgcccgactccgtagctgccagtggaacttctagcagcagccagtacctgggggcacaaggaaataagcccatcgcattgctatag

SEQ ID NO: 223554 - DNA, 1014 bp, Artificial Sequence
  Description of Artificial Sequence: Synthetic coding sequence
atgcctggactaccgtgtcccgctcttccttgtcccgctccaccgccagcccctagctgcctaatcgccatggcccttaaaaacagtaagacaggcagcttacctgtttcagagatctacagcttcatgaaggagcatttcccgtatttcaagaccgcccctgacggctggaagaactctgtacgtcataatctgagcctcaacaagtgtttcgagaaggtggagaataagatgagtgggtcctctcgaaagggatgcctctgggcccttaacctggcccgtatcgataagatggaagaggaaatgcacaagtggaaaagaaaagatctggccgcaatacaccgaagtatggctaatccggaagagctggacaagctgattagtgataggccggaatcctgtcgaaggcccggaaagcccggtgaaccagaggctcctgtgctcacccacgccactactgtagccgttgcccacgggtgcctggcggttagccaactgcccccacaacccttgatgaccctttccctacagagtgtgcctctgcaccatcaggtgcagccgcaggctcatctggcccctgattctcctgcgccagcccagaccccgcctctgcatgcccttccggaccttagtccaagcccactgcctcaccctgctatgggccgagcacctgtggatttcatcaacattagcaccgatatgaatacggaagttgatgcactcgatccttcaattatggacttcgcgttgcaggggaatctctgggaagagatgaaggatgaggggttctccctggatacattgggcgcatttgcagattcgcccctgggatgcgatctcggcgcatcaggcctgaccccagcctcaggtggatctgatcaatcgtttccagacctgcaggtcacaggactctacaccgcttacagcacgcctgactctgttgccgcatccggaacctcctcgtcctcacaatatctgggggctcaggggaataaacctattgcgctgttgtag

SEQ ID NO: 223555 - DNA, 1680 bp, Artificial Sequence
  Description of Artificial Sequence: Synthetic coding sequence
atggccgcaaaacttagagcccaccaggtcgatgtggaccccgactttgcaccccaaagtaggccccgatcctgtacatggcccctgcctcaaccagacttggcgggtgatgaggacggtgccctgggcgctggggtggcagagggagctgaagattgtggtcccgagagaagagcaacagcgccagctatggccccagctccacccctgggagcagaggtgggtcccctgaggaaagcaaaaagctcgaggcggaacgcctggggtaatctgtcatacgctgatctgataactaaggctatagagagcgccccagataagcgacttacactgtcccaaatctacgactggatggtccgctacgttccatattttaaagacaagggtgactcgaactcctcggcagggtggaagaattcaatccgacacaacctttctcttcacaccagatttatccgggttcaaaatgaggggacgggcaaatcatcatggtggatgctgaatccggaaggagggaagaccgggaagacgccacggcgacgcgcagtgagtatggataatggcgctaaatttttgagaatcaaaggaaaggccagcaagaagaagcagttgcaagcaccagagcgcagcccagacgactccagcccgagtgcaccagcgcctggtcccgtgcctgccgctgccaaatgggctgccagtccagcaagccacgcatctgacgactacgaagcctgggctgacttcaggggcggaggtcgtcccctgctcggcgaggcagcagaactcgaggatgacgaagccttagaagccctggcaccatcttctcccctcatgtacccttctccggcaagcgcgctatccccagctctaggctcgcgttgcccaggcgagctgccgaggctggcagaactaggcggacctctggggctgcacggcggaggtggtgccggtcttcctgagggtcttctcgacggtgcacaggacgcttacgggccacgggctagagcgcaagcgcgaccaggggcaggatgcgctggcggtgcgggagccggaggcaggtcccggaggcttcctcgacaacgaggcggacctgtaagagccgcaagagccctcgcccagtgtcttagccctccccaccagccttatgatgctgcaaggaggggcggacgcagaggcccaggaaccgctggtcctagaagacgcctccgcggaccagccaggagacctcctgccggacggtctgcaggtgccctgagatgtagacgccgtcgcgctgccggacggagggccagaccgctcccgggtcgtccagggccacgccatgtgcagcgtgaacccagagtgaggcgaggggtgcatcacccacagcgccttcacggccagagaaggaacggcctgcaactccggttcggaccagcatccgctgcagccggacccggacgaggtcccgcacctcaacctgagctgggcgcaggactccgagccgcaagtcgactacgcgcaccgagacctgtaccgagaggcccactttcatctcaccccgattcacgggtgccggcacctgactctagctcccccggagggggaccaagtcctgctagggatcccagtaggcgacctgccgcaggcgagggagagggtggcgcaggcgctccccattgttcatgcccccactcttag

SEQ ID NO: 223556 - DNA, 2034 bp, Artificial Sequence
  Description of Artificial Sequence: Synthetic coding sequence
atgatgcaagaatccggcacagaaaccaaatccaatggttccgccatccaaaatggctccgggggatctaatcatcttctggagtgcggcggattgcgcgagggcagaagcaatggagagacacccgctgtggacatcggtgccgcagatctcgcacacgcccaacagcagcaacagcaggcgttacaggtggctcgccagctgctcctgcagcagcaacagcagcagcaagtgtcgggtctcaaaagtcccaagaggaatgataaacaacctgccctacaagtgcccgtctccgtggctatgatgaccccgcaggtcattactccccaacagatgcagcaaatactgcaacaacaggtactgtctccgcagcaactgcaagttctgcttcagcagcagcaggccctgatgctccagcagcagcaactccaagagttttacaagaaacaacaagagcaactccagcttcagctcttgcagcagcagcatgcaggcaagcagcctaaagagcagcagcaggtcgcaacccagcagctggcttttcagcagcagttgctccagatgcaacagcttcaacagcagcacctgcttagtctgcagcgtcagggactgctgacgatccagccaggtcagcctgctcttcccctgcagcccctcgctcaaggcatgatcccaaccgagctgcagcagctttggaaggaagtgacctcagctcatactgctgaggaaacaacagggaataaccactcctctctggatctgacaaccacctgcgtgagtagttcagcgccatctaaaacctcccttatcatgaacccccatgccagcacaaatgggcagctgagtgtacacacccctaaacgggaaagtctgtcccatgaagaacatcctcattctcaccccttgtatgggcacggggtgtgcaagtggcctgggtgtgaagccgtctgtgaagacttccagagttttctgaaacacctgaattcggagcatgctttggatgatcgctcgacagcccagtgcagagtgcaaatgcaagttgtgcagcagctcgagttgcagctcgccaaggataaagagcgccttcaagcaatgatgacacacctgcatgtcaagtcaactgaaccaaaagcagctccgcagcccctgaatttggtgtcatccgtcacactgtccaaatccgcaagtgaggcatctccccaatcgctgccccatactcccaccacccctacagccccactgacgcccgtcacccaaggcccttccgtcatcaccaccacctctatgcacactgttgggccaatcagaaggcgctactctgacaaatacaatgtccctatttcttcggccgacatcgcacaaaatcaggagttttataagaacgcggaagtccgtccaccatttacctacgcttcactgatccgtcaggcaatcctggagagccccgagaaacaactgactttgaacgaaatctacaattggttcaccagaatgttcgcctactttaggagaaatgccgctacctggaaaaacgcagtccgtcataatctgagcctgcataaatgttttgtaagggtggaaaatgtcaaaggggctgtctggacagttgatgaggtcgagtttcagaagagaaggccccagaaaattagcggcaaccctagtctgatcaagaacatgcagagctcacacgcttactgcactcctcttaacgccgctctgcaggcctctatggctgaaaacagtatacccttgtacactaccgccagcatgggaaacccaactttgggaaatctagcttcggccatccgggaggagttgaacggcgctatggagcatactaacagcaatgaaagtgatagctcacctgggaggtctcctatgcaggccgtacatccagtccacgtgaaagaggagccgctggatcctgaagaggctgagggacctctatcactggtgaccactgctaatcacagtccagattttgatcacgaccgggactacgaagacgaaccagtcaacgaggacatggagtag

SEQ ID NO: 223557 - DNA, 1077 bp, Artificial Sequence
  Description of Artificial Sequence: Synthetic coding sequence
atgatgactccccaggtgattactcctcagcagatgcagcaaattctacagcaacaggtcctgtcccctcaacagctgcaagtgctgcttcagcaacagcaagctctcatgcttcagcagcagcagttgcaggaattctacaagaaacaacaggagcagctccagctccagctactgcaacagcagcatgccggaaagcagccaaaagagcagcagcaggtcgccacccagcagctggcgttccagcagcagctgctgcagatgcagcagctgcagcagcaacatctgttgtcacttcagcggcagggcctgttaacaattcagccaggccagccggctctgcccctgcagccacttgctcagggcatgatacctaccgaactgcagcagctgtggaaggaggtgacctccgcccatacagcggaagagactactggtaataatcatagcagcctagacctgactaccacatgcgtgagtagctccgctccttccaaaaccagtctaattatgaatccacatgcttctacaaacggccagctgtcggttcacacccctaagagagagtctctgagtcacgaagaacaccctcatagtcacccactgtacgggcacggagtctgtaagtggccgggttgcgaggcagtttgtgaggactttcaatcatttctgaaacacctcaacagtgagcacgccctggacgacaggagcactgcccagtgccgggttcagatgcaggtagtccagcagctggaattgcagctggccaaggacaaggagcgcctgcaggccatgatgactcatcttcatgtgaagagtactgaaccaaaagcggcaccacagcctcttaatcttgttagctccgtaaccctaagtaagtcagcgagtgaggcaagtccgcagagtctccctcacacccctaccacccccacccccccagatagccgccaccctcgccctctttgccatcacaatcaccagcatgcgcatggcggaactcatccgcaggccgtgttgcgccagattcagagagcccattttgtgtcacgttattgcgctgaaccacggattctgtag

SEQ ID NO: 223558 - DNA, 1509 bp, Artificial Sequence
  Description of Artificial Sequence: Synthetic coding sequence
atgatgcaggagtcggggactgaaacgaagtcgaatggatctgcaattcagaatggttctggcggaagcaatcatctgctggagtgtggaggattacgcgaagggaggtccaatggggaaacacccgctgtggacatcggcgcagcagatctggcacacgcacagcaacagcagcagcaagcactgcaagtagccaggcagcttttattacagcagcagcagcagcagcaggtctcgggcttgaaatcaccaaagagaaacgataagcagccagccctgcaggttcctgtctccgtcgctatgatgacaccgcaggtgatcacaccccaacagatgcagcagatcttacaacagcaagtcctgtctcctcagcagctgcaggtactcctgcagcagcagcaggcgctaatgctgcagcaacagcaattacaggagttttacaaaaaacagcaagagcagctgcagctccagcttctgcagcaacagcacgccggaaagcagcccaaagaacaacagcaggttgcaactcagcagcttgcctttcagcaacaactgcttcagatgcagcaactgcagcagcagcatctgttgagtctgcagcgccagggcctgctcactatccagcctggacaaccagccttgccattgcagcccctggcccagggcatgatccccacggagctgcagcagttgtggaaggaggtcacatctgcccacacagctgaagagaccactggaaacaaccattcctcacttgatctcacaactacatgcgtaagttcttccgctccgtcaaaaaccagcctgattatgaaccctcacgcttcaactaatggccagttgtccgtccacacccccaagcgcgagtctctgtcccacgaagagcatccgcattcgcaccccctctacggacacggagtctgtaaatggcctgggtgcgaagcagtatgcgaagacttccagtctttcctgaaacacttgaattccgagcacgcacttgacgaccgatcaactgcacagtgcagggttcagatgcaagtggttcagcagttggaactacaattagcgaaggataaggaacggttacaggccatgatgactcacctgcacgtgaagtctaccgaacccaaagctgcaccccaaccgttaaacttagttagctctgtcacactgtcaaagagcgcgtcggaagcatccccccaatccctacctcacacccctacaacaccaacggcaccccttacacctgtaacccagggcccatctgtgatcactacaacgtccatgcacaccgttggacctattcggcgtaggtactccgataagtacaacgtgccaatttcaagcgccgacattgcccagaaccaggagttttataagaacgctgaagtgcggccaccttttacctacgcatctttgatccgtcaggcgattctcgagtcgcccgagaaaaaaaagaaagaacgccagaccttaggcacgatgccaatccactcaacgcagcaatag

SEQ ID NO: 223559 - DNA, 1470 bp, Artificial Sequence
  Description of Artificial Sequence: Synthetic coding sequence
atgatgactcctcaagtgatcaccccgcagcagatgcagcagatactccagcagcaggtgttgagcccacagcaattacaggtcttattacagcagcagcaggcccttatgctacaattgcagcagctgtggaaggaagtgaccagtgctcacaccgctgaagagactactggaaataatcactcgagcctggacctgacgactacgtgcgtgagcagttctgccccttccaagacctccctgatcatgaacccacacgctagcacaaacggccagctcagtgtgcatacccccaagagagagtccttaagccatgaggagcatccccattctcatccgctctatgggcatggggtgtgcaagtggccgggttgtgaggcggtatgcgaggattttcagtcatttcttaaacatctgaatagcgaacacgctttggacgaccggtctaccgcacagtgccgggtgcagatgcaggtggtgcaacagctggagctgcagctggcaaaggacaaggagcggctgcaggccatgatgacccacctccatgtgaaatccactgagccaaaggcagcccctcaacccctgaacttagtctcttccgtcacattaagcaagagcgcctccgaggcatctccacagtccctccctcataccccaacaacccccacagccccactcacccccgtgacacagggacctagcgtgattacaactaccagcatgcataccgttggcccaatccggcgacggtactccgacaaatataatgtcccaatttcaagcgccgatatcgcccaaaaccaggaattctacaagaacgctgaggtgaggcccccttttacatacgcatcccttatccgccaggccatcttagagtccccagaaaagcaactgacattgaatgaaatttacaactggttcaccagaatgtttgcttactttcggcgaaatgctgccacatggaagaacgcagtcagacacaatttgagcctgcacaagtgcttcgtgcgcgtcgaaaatgtgaaaggggcagtatggacagttgatgaggtggagttccaaaagcgccgtcctcagaaaatctccgggaacccctctttgatcaagaacatgcagtcaagtcacgcatattgtacccccctgaacgcagctctgcaagcttcaatggctgagaattctatcccactctacaccaccgcctcaatggggaacccgacactggggaatctggcctctgcgatccgcgaagaactgaatggggcaatggaacacaccaatagcaacgaatccgatagctcaccgggtcgctcccctatgcaagcggtgcaccccgtccacgtcaaagaagaacccctggaccccgaggaagccgaaggccctttatctctcgtcaccaccgctaaccacagcccagacttcgaccacgacagggactatgaggacgagcctgttaacgaagacatggaatag

SEQ ID NO: 223560 - DNA, 2034 bp, Artificial Sequence
  Description of Artificial Sequence: Synthetic coding sequence
atgatgcaggaatccggaaccgaaacgaagtctaatggctcagccatacagaatggctccggaggcagtaatcatctgttggagtgcggtggccttcgagagggtcgctccaacggagagacacccgcagttgacattggggctgctgacctggctcacgcccagcagcagcagcaacaggctttgcaggtggccagacagctgctgctccagcagcagcaacagcagcaggtttcaggcctgaagtctcctaaacgtaacgacaaacagccagccctccaggtgcccgtgagcgttgccatgatgacacctcaagtgattactccacagcagatgcaacagattcttcagcagcaggtgctctcaccacaacagctgcaagtccttctccagcaacagcaggcgttgatgctacagcagcagcagctccaggaattttataagaagcaacaggagcagttgcaactgcagctgttacagcagcagcatgcaggcaagcagccaaaagagcagcagcaagttgccacacagcagttggcctttcagcaacagctgctccagatgcagcagcttcagcagcagcatctgttgtctctccagcgtcaaggcttgcttaccatccagcccggtcagccggcactgcccctccaacccttagcccaggggatgataccaacggagctgcagcagctgtggaaggaggtgacaagcgcacacacggccgaagagactacagggaataaccattccagcctggatctaacaacgacctgcgtcagctcctcagcacccagcaagactagcctgatcatgaacccccatgcgtcgacaaatgggcagctctccgtccacactccaaagagggaatcactgtcccacgaagagcaccctcatagtcaccctctctatggacacggagtttgcaaatggccgggttgcgaggccgtatgcgaggactttcagtctttcttgaagcacttaaacagcgagcatgcactggatgaccgttccactgcccagtgccgggtccaaatgcaggtcgttcagcagctggagttgcaactggcgaaagacaaggagagactgcaggccatgatgacgcacttgcacgtcaagtccaccgaacccaaagctgccccacagccactgaacttggtttctagcgtcaccctttcgaaatctgccagtgaggcatcaccacagtccctcccacacacccctactacgcctacagcccctctgacacctgtcacgcagggcccttccgtcataaccactaccagcatgcatacagtgggaccgattcggagaaggtactcagacaagtataacgtgccgatttcctctgctgacatagcccagaaccaagaattctacaagaatgcagaggtacgcccaccatttacgtacgcctccctcattcgtcaggctatactcgagtcccctgagaaacaattaacactgaacgaaatctataattggtttacgcggatgttcgcatatttccgcagaaatgcagccacatggaaaaatgccgttcggcacaatttaagtttacacaaatgttttgtgagggtggagaacgtgaaaggtgccgtgtggacggtagatgaggtggagtttcagaagcgaagacctcagaaaatcagcgggaatccctctctgatcaagaatatgcagtcatctcacgcgtactgtacacctctcaacgccgctctgcaagccagcatggccgaaaactcaattccattatacaccaccgcctctatgggaaatcccactctaggcaacctggcctctgccattcgggaggagctgaacggggcaatggagcacactaatagcaacgaaagtgatagctctcctggaagaagcccaatgcaggctgtccatccagtacacgtcaaggaggaacccctggatcccgaggaggccgaagggcctttaagtctcgtaaccaccgcgaatcatagtccagattttgaccatgacagggattatgaagatgagccggtaaacgaagatatggagtag

SEQ ID NO: 223561 - DNA, 1806 bp, Artificial Sequence
  Description of Artificial Sequence: Synthetic coding sequence
atgatgcaagagagtgggacggagaccaaaagcaatgggtcagccattcagaacggcagtggtggatcaaatcacctgctggagtgtggcggactaagagaaggtcggtcaaatggggagacaccagccgttgatatcggcgctgctgatttagctcacgcacagcaacagcagcagcaagctttgcaagtcgccagacagcttctgctgcagcagcaacaacaacagcaagtgagtgggctgaagtcaccaaagcggaacgataagcagcctgctctccaacagcaacaagtggccacccagcaattggcttttcagcagcagcttctgcaaatgcagcagttgcagcagcagcacctgctgtctttgcaacgccagggtctcttgaccattcaacctgggcagcccgctctgcccctccagcccctggcccagggaatgattcccaccgagcttcagcagctgtggaaggaggtaacgagcgctcataccgcagaggaaacaacgggaaataatcacagctctctcgatttaaccaccacctgcgtgtctagcagcgctccaagcaagacctccttaataatgaacccccacgccagtaccaatgggcagctgtccgtgcatactcccaagagagagtccctgtcccatgaggagcatccacacagccatcccttgtacggccacggcgtatgtaaatggccaggctgcgaagccgtctgtgaggacttccaatccttcctcaagcacctgaatagtgaacatgctctcgatgaccgatcaaccgcccagtgccgggtccagatgcaagttgtgcagcagctggaactccagttagccaaggacaaagaacggttacaggcgatgatgactcacctgcatgttaagtccactgaacccaaagcggctccacagccacttaacctggtgtcatctgtgacactgagcaagagtgcatccgaagcatccccccagtctcttcctcacacaccaacaaccccaactgcacccctgacgcctgtcacccagggcccatcggtgattacaacaacaagcatgcataccgtcggacctatcaggaggagatacagtgataaatataacgtgcctatatcctctgcagatatcgcccagaaccaagagttttacaaaaacgcggaagtgcgaccccctttcacttacgcctctctgatcagacaggcaattctcgagtctcccgagaaacagctgaccctgaacgagatttacaactggtttacacggatgtttgcgtactttcgacgaaatgccgctacgtggaaaaatgcggttcggcacaatctgagcctccataaatgctttgtgcgggttgaaaacgtgaagggtgctgtgtggacggtggatgaggtcgagtttcagaagcgcaggccacaaaagatcagtggcaacccttcgctcatcaaaaacatgcagagcagccacgcatattgtacacctctgaatgccgctctgcaggcttcaatggccgagaatagcattcctctgtatacaacagcgagcatggggaatccaactctggggaacctggcctcagctattcgcgaggagttaaatggcgcaatggagcataccaatagcaacgagtccgattccagtcctggcagatcccccatgcaggctgtccatcccgtgcacgtgaaggaggagccgctggaccctgaggaggccgaggggccactgagcctagtcaccaccgcaaatcacagtccggatttcgatcatgaccgcgactacgaggatgagcctgtgaacgaggacatggaatag

SEQ ID NO: 223562 - DNA, 675 bp, Artificial Sequence
  Description of Artificial Sequence: Synthetic coding sequence
atgatgacaccccaggtgattactccccagcagatgcagcagatattacaacagcaggtattaagcccccagcagctccaagtgctcctccagcagcaacaagctctgatgctgcagcagcagcagcttcaggagttttacaaaaagcagcaggaacagctgcaactgcaattactgcaacagcaacatgccggaaaacagccaaaagagcaacagcaagtcgctactcaacagctcgcttttcagcagcaactgctccaaatgcagcagctccaacagcagcacctactgagcctacagcgccagggccttctcactattcagccaggccagccagctctacccctacagcccttggcacagggcatgatacctaccgaattacagcagctttggaaggaagtgacctcggctcacaccgctgaggagacgacaggcaacaatcacagttctttagacctaaccacaacttgcgtgtcttcatcagccccttcaaagacaagcctcatcatgaacccacatgctagcacaaacgggcagctctcagtgcatacgcccaaaagagagagcttgtcacacgaagagcatccacacagtcacccactgtacggccatggagtctgcaagtggccaggatgtgaggcagtctgcgaggacttccagagctttttgtag

SEQ ID NO: 223563 - DNA, 2040 bp, Artificial Sequence
  Description of Artificial Sequence: Synthetic coding sequence
atgttccagtgcgtgttcagcagcagtgtgctgcagcctcactccaccagctgtctgttcaagcacttgttttaccactccgccacccccgcatctcaaaagcagccggagccgatctattccaagaagacagaaatacaacgccagacagtgcgggcacccttcgctaagctgttcatctttagcgcactgcaggtggcacgccaactcttgctgcagcagcagcagcagcaacaggtcagcggcctgaaatcccctaagaggaatgacaagcagccagcactccaggtcccagtgtctgtggccatgatgacaccccaggtgattactccacagcaaatgcagcagatcttacagcaacaggtcttgtcacctcagcagctccaagtgttgctacaacagcagcaggccctaatgctgcagcaacaacaattacaggaattctataagaagcagcaagaacaactgcaacttcagttgctccagcagcagcacgctggaaaacagccgaaggagcaacagcaggtggctacccaacagctggcattccagcagcagctcctacagatgcagcagctgcaacagcagcatcttttgagcctccagcggcaagggcttctgaccatccaaccaggacagccagctttgccattgcagcccttagcccagggcatgatccctacagaactgcagcagttgtggaaggaggtcacttccgcacacacagcagaggagactacaggtaacaaccactcttctctggacctgaccacaacatgcgtgtccagcagcgctccctctaaaaccagcctaataatgaacccccatgcctcaaccaacgggcagcttagtgtgcacactcccaaaagggagtccctgagtcatgaggagcatccccactctcacccgctctacgggcacggagtttgcaaatggcctggctgtgaagctgtctgtgaggatttccagagtttcctgaagcaccttaatagtgaacacgctttagacgacaggagcacagctcagtgtcgagttcagatgcaggtcgtgcagcaacttgaactgcagctcgccaaagacaaagagaggctgcaggccatgatgacccatttgcatgtcaagtctaccgagccgaaagccgcacctcagcctttgaacctcgtgtctagtgtcactctgtctaagagtgcctcggaagcttccccacagtcactccctcatactccgactaccccaaccgctccactgactccggtgacacaggggccatcagtcattactacaacaagcatgcacactgtcggcccaatccggcgacggtatagtgataaatataatgtgcctatttcctccgccgatatagcccagaatcaagaattctataaaaacgctgaagtaagacccccttttacttacgcttccttgattcgccaggctattttggaatcaccagaaaagcagttgacactgaacgagatctacaactggttcacgcgcatgtttgcatacttccgaagaaacgccgctacatggaagaacgctgtccggcataatttgtctctccacaagtgctttgtcagggtggaaaacgtgaaaggcgcagtatggaccgtagatgaggttgaatttcagaaacgaaggccccaaaagatctccggcaatccttccctgatcaaaaatatgcaaagcagtcacgcatattgcactcctttgaatgcggctttgcaggcatccatggcagagaactccatacccctctacactacggcctccatgggaaatccaacactaggcaatcttgcctcagcaatccgggaggagctcaatggagcaatggaacacactaattcaaacgaaagcgactcttcccctggccgatcccctatgcaggctgtgcacccagtacatgtaaaggaggaacccctggacccggaagaagccgaggggcctcttagtttggtgacaacagcgaatcactcccctgactttgatcacgaccgtgactacgaggatgaaccagttaacgaggatatggagtag

SEQ ID NO: 223564 - DNA, 372 bp, Artificial Sequence
  Description of Artificial Sequence: Synthetic coding sequence
atgatgactcctcaggtcatcaccccccagcagatgcagcagattctgcagcagcaggtgctatccccccagcagctgcaggtgttgctgcagcaacagcaggcattaatgctacagcagcaacagctgcaagagttttataagaagcaacaagagcagctgcaactccagttgttacagcagcagcacgccggaaagcaacccaaagagcaacaacaggtggcgacacagcagctggcattccagcagcagctcttgcaaatgcaacagctccagcagcaacatctgcttagtctgcagcgccaagggttgttgaccattcagccgggacagcccgctctcccattacaaccactagcccagggtatgtag

SEQ ID NO: 223565 - DNA, 2034 bp, Artificial Sequence
  Description of Artificial Sequence: Synthetic coding sequence
atgatgcaggagtcagggaccgaaaccaaaagcaatggaagtgcgatacagaatgggtcaggtgggtcaaatcaccttctcgaatgtggcggactgagggagggaaggagcaatggggaaacacccgctgtggatataggcgctgctgacctagctcatgcgcaacaacaacaacagcaagcattacaagtggcacggcagcttctcctgcagcaacagcagcagcagcaggtgtcaggactaaaatcccccaagcgcaatgacaaacagcctgcactgcaggtccctgtgagcgtagcgatgatgacgcctcaggtgattaccccacagcagatgcagcagatcctgcaacagcaggtccttagcccccagcaactgcaggtcttgttacagcagcagcaggctttaatgctgcagcaacaacaactgcaggagttttacaagaagcagcaggaacagctgcagctacaactcctccagcaacaacatgctgggaaacagcctaaagaacagcagcaggtggccacccagcagctggcctttcaacagcagttacttcagatgcagcagcttcagcagcagcatctgctgtctttgcagcgccaaggacttctcacaattcagccgggacaacccgctctacctcttcagccgttggcacaggggatgatcccaactgaactccagcagctctggaaggaagtaacaagcgcccatacagccgaggagacaacagggaacaaccactctagcctcgatctgaccacgacctgcgtctccagtagcgctccctcaaagacgtcactgatcatgaatccccacgcctccaccaatggccaattatccgtgcacactccgaagcgagagagcttgtcgcatgaagagcatccgcacagccatcccctgtacggccacggcgtctgcaagtggcccggatgcgaagccgtctgcgaggacttccaaagcttcctaaagcatctaaattccgagcacgcgctggacgaccggtcaaccgcccaatgccgtgtgcagatgcaagtggtgcagcaattagagctgcagctcgctaaggacaaagagaggctgcaggctatgatgacacacttacatgttaagagtaccgaacccaaggcggctccacaacctctcaacctggtgagctccgtgactctgagtaaatccgcatctgaggcctcaccccagtcccttcctcacacgccaactacaccgaccgcccctcttacgcctgtgacccagggcccaagcgtcatcactacaacgtccatgcacaccgtggggcctattcggcgacggtatagcgacaaatacaacgtgcccatcagctcagcggacattgcccagaatcaagagttttataagaatgcagaagtcaggcccccttttacctatgcctcgcttataaggcaggctatcctggagtcccccgaaaagcaactgacacttaacgagatctacaattggttcactcgaatgtttgcttactttaggcggaacgccgcaacctggaagaacgctgttcgccataatctgtctctgcacaaatgttttgtgcgtgtcgagaacgttaagggggctgtttggaccgtcgatgaggtggagttccagaaacggcgtccacagaagatctccggaaatccatccttgatcaaaaacatgcagtcctcgcacgcctactgtacaccacttaacgccgctcttcaggcttcgatggcagagaattcaattcctctttacaccaccgcatctatgggcaatccgacactcgggaaccttgcctctgccatacgagaagagctgaacggcgctatggaacacaccaattctaatgagagcgattcatctccaggccgttcccctatgcaggccgtacaccctgttcacgtgaaggaggagcctctcgacccagaggaagcagagggccctctgtccttggttactactgcaaaccactcaccagacttcgatcacgaccgcgactatgaagacgaaccagtgaacgaggacatggagtag

SEQ ID NO: 223566 - DNA, 345 bp, Artificial Sequence
  Description of Artificial Sequence: Synthetic coding sequence
atgatgcaggagtcaggtaccgaaacaaagagcaacggtagcgccatccaaaatggatcaggtggaagtaaccatctccttgaatgcggcggtctgcgcgagggccgtagcaatggagagacaccggcagtcgacataggcgcagccgacctggcacatgctcagcaacaacaacagcagtggcatttgattaatcaccaaccctccagatccccatctagctggctcaaacggctcatatccagtccctgggaactggaggtgctacaggttcctttgtggggggcagtggcggaaaccaagatgtcaggcccagtgtgccaacccaatccttcccctttttag

SEQ ID NO: 223567 - DNA, 669 bp, Artificial Sequence
  Description of Artificial Sequence: Synthetic coding sequence
atgatgcaggaatctgcaaccgagacgatcagtaacagttctatgaaccagaatggcatgtcaacactatcgagtcagctggatgccggatcacgcgatggcaggagctctggtgacactagtagcgaggtttccaccgttgaactcctgcatctccagcagcagcaagccctgcaggccgctaggcagttattattgcagcagcagacttctggactcaagtcaccgaagtcctccgataaacagagacccctgcaggtcccagtgtcagtggccatgatgaccccccaagtcatcactccccaacagatgcaacagatcctgcagcagcaggtgctctctccccagcagctgcaagccctacttcagcagcagcaagctgtgatgctccagcaacaacaacttcaggaattctataagaagcaacaggaacagctgcacctgcagctgttgcagcaacagcagcagcagcagcaacagcagcagcagcaacaacaacagcagcaacagcagcagcaacagcaacagcagcagcagcaacaacagcagcagcagcagcagcagcagcagcagcatcctggcaaacaggccaaggagcagcagcaacagcagcagcaacagcagcagctggcagcccaacagttggtgttccagcaacagctgctgtag

SEQ ID NO: 223568 - DNA, 2148 bp, Artificial Sequence
  Description of Artificial Sequence: Synthetic coding sequence
atgatgcaggaatcagctaccgagactatcagtaactcctctatgaatcagaatggaatgagtacgctgtcgagtcaactagacgcaggctccagggacggacggtcttcaggagatacaagctctgaagttagcaccgtggagctgctgcatctgcaacagcagcaggcactgcaagctgctaggcagctgctattacagcagcagacgtcaggcttgaagagtcccaaatcctctgataagcagcggcctctgcaggtgcccgtatcagttgcaatgatgacaccccaggttattactccacagcagatgcagcagatactccagcagcaagttctgtctcctcagcagcttcaggccctgctccaacagcagcaggctgtaatgttgcagcagcagcagttgcaagaattctataagaaacagcaagagcagctgcacctgcagcttcttcaacagcagcaacagcagcagcaacagcagcaacagcagcagcagcagcagcagcagcagcaacaacaacagcagcagcagcaacagcaacagcagcagcagcagcagcaacaacagcaacatcctgggaagcaggctaaggagcagcagcagcaacagcagcagcagcaacagctggccgctcagcagcttgtgtttcaacagcagctgctgcagatgcaacagctgcagcagcagcagcaccttctgtccctgcagaggcagggcctgatcagcatccccccagggcaagcggctctgccagtgcaatccctaccacaggccggactcagccctgccgagatccagcaattgtggaaggaggtcactggagtgcacagtatggaggacaacgggataaagcacggcggactcgatctcaccactaacaacagcagttccactacttcttcaaatacctcaaaggctagcccaccaattacccatcactctatagtcaatggccagagctcagttctcagcgccaggcgcgactcaagcagccatgaagaaaccggagccagccatactctgtacggccatggggtttgtaaatggcccggttgcgagagcatctgcgaagactttgggcagttccttaaacacctgaacaacgagcacgctttggatgacaggagcaccgcacagtgcagagtccagatgcaggtggtccagcagctggaaatacagttgtccaaagagagagaacgcctgcaggccatgatgacgcatcttcatatgcggcctagcgagccaaaacccagccccaaaccactcaacctggttagttccgttaccatgagcaagaacatgttagaaacctcaccccagagtctcccgcaaacgcccaccactccgacggccccagtaactccgattactcaagggccttccgtaatcacgcctgccagtgtgcctaatgtgggcgcaattcggcgtcgtcactccgacaagtacaatatcccaatgagctccgaaatagcacctaactacgagttttataagaacgcagacgtgaggccgccattcacctatgctactttgattaggcaagcaattatggagtcttcagaccgccagcttaccctgaacgaaatctattcctggtttaccagaacatttgcatacttccggagaaacgctgccacctggaaaaacgccgtgaggcacaacctctctctacataaatgtttcgtccgggtggagaacgtcaagggcgctgtatggactgtagatgaagtggaataccagaaaagacggtcacagaaaatcactggatctcccacactcgtgaagaatattccaaccagcctcggatacggcgcagctctcaatgcctccctccaggctgcgctggcagagtccagccttccgctgctttctaacccagggctgataaataacgcgagctctggccttctgcaggcagtgcatgaagacctaaacggctctttggatcacatcgattcaaacggcaattcttctcccggttgctctccccagcctcatatccactcaatacacgttaaagaggaacccgtgatcgcggaagacgaagactgccccatgagcttggtgaccacggccaatcatagtcccgaattggaggacgaccgggaaatcgaggaagaaccattgtctgaggatctggaatag

SEQ ID NO: 223569 - DNA, 1299 bp, Artificial Sequence
  Description of Artificial Sequence: Synthetic coding sequence
atgatgcaagaaagcgcaacggagacaatatccaactcgagcatgaaccagaacggcatgtctacactatcttctcagttggatgccggttcccgcgatggccgttcttctggtgacacctccagcgaggtctccacggttgagctcctacacctgcagcagcagcaggctcttcaggccgctcgccaacttctgctccagcagcaaacatctggactcaagtcccccaaaagtagcgataagcaacgacctctgcaggtgccagtgagtgtggcgatgatgacaccccaggtgataactccacagcagatgcagcagatcctacagcaacaggtcctctctccgcaacagctgcaggccctgttacaacaacaacaggccgtcatgttgcagcagcagcagcttcaagaattctacaagaaacaacaagaacagctgcacctgcagcttctgcagcagcagcaacagcagcagcagcagcagcaacaacagcagcagcagcagcagcagcagcagcagcagcagcagcagcagcagcagcaacagcagcaacagcagcagcagcagcaacagcatccaggtaagcaggctaaggaacagcagcagcagcaacagcagcagcaacagttggccgcacagcaactcgtgtttcagcagcaactgctgcaaatgcagcagctccaacagcagcagcacttgctgtctcttcagcgtcaaggactgatatccatcccgcctgggcaggcagctctgccagtgcagagccttccgcaagcgggactgtcccccgctgagatccagcaattatggaaggaggtgacgggtgtccatagcatggaggacaacggcattaagcatggcggacttgacctcaccactaacaattctagctctaccaccagctcgaacacctccaaggccagtccaccaataacccatcacagcatagtgaatggccagtcttcagtcctatcagccaggagagatagctcttcacatgaggagacgggcgctagccacacactgtacggccacggagtgtgcaaatggcccggatgcgaatctatttgcgaggactttggccaattcctcaagcacttgaacaacgagcacgccttagacgaccgttccactgcccagtgccgggtccagatgcaggttgtgcagcagctcgagatccagcttagcaaagagcgcgagcgcctgcaggccatgatgacccatctgcatatgaggcccagcgagccaaaaccctccccaaaaccagtgagcgcctattgtttcataaactccaagtag

SEQ ID NO: 223570 - DNA, 1371 bp, Artificial Sequence
  Description of Artificial Sequence: Synthetic coding sequence
atgcaggagtcagccactgagacgatctcaaactctagtatgaaccagaatggcatgtcgacactgagtagtcagttggatgctggcagccgggatggcagaagttctggcgacacctcttcggaggtgagcaccgtggaactgttgcacctgcagcagcagcaggccctccaggccgcacgacagctcctgctgcagcagcaaacgagcggcctcaaatctcccaaatcttctgataagcagaggcctctgcaagaactgctgcccgaaactaaactgtgcatatgtgggcactcgagcggggatggacacccccacaatacctttgctgtacccgtttccgtggctatgatgacgccacaggtaataacccctcaacagatgcagcaaatactccagcagcaggtgctttccccgcaacagctccaagcgctcctccagcagcagcaagcagtgatgcttcagcagcagcaactacaggagttttacaagaagcaacaggagcagttgcacttacagctcttgcagcaacagcaacagcagcagcagcagcaacagcaacagcagcagcagcaacagcaacaacagcagcagcagcagcagcaacagcagcagcaacaacagcaacagcaacagcagcaacagcaccctggaaaacaggctaaggaacagcaacagcagcagcagcagcagcagcaactcgccgctcagcaactcgtattccagcagcagctcctgcaaatgcaacagctgcagcagcagcaacacctcctctccctgcagaggcaaggacttatttcgattccacccggacaggctgcactgccagttcagtcccttcctcaggcgggtctgagtcccgcagaaattcagcaactctggaaggaggtgacaggtgttcacagtatggaagacaacgggattaaacacggaggacttgatcttaccacaaataactcttcaagcacaacatcctcaaatacatccaaagctagccctcccatcacccaccacagtattgtgaacggtcagagcagcgtcctgtcagccaggcgggacagctcttcgcatgaggagacgggcgcatcccacaccttgtacggacatggcgtatgtaaatggcccggttgcgagagtatttgtgaggacttcggccagttcctgaagcatcttaacaatgaacacgcactggatgatagatctacagcccaatgtcgggtccagatgcaggtggtgcagcagctggagatccagctgtccaaggagagagagcggttacaggcaatgatgacacacttacacatgagaccctccgagcccaagccctctcccaagccggtgagtgcttactgtttcattaattccaagtag

SEQ ID NO: 223571 - DNA, 1872 bp, Artificial Sequence
  Description of Artificial Sequence: Synthetic coding sequence
atgatgacccctcaggtgattacacctcagcagatgcaacagatactgcagcagcaggtcctgtccccccagcagctccaggcactattacagcagcagcaggccgttatgctgcaacaacagcagctgcaggaattctacaagaagcagcaggagcaactgcatctccagctgctccagcagcagcagcagcagcagcaacagcagcagcaacaacaacagcaacagcagcaacaacagcaacaacagcagcagcaacagcagcaacagcagcagcagcagcagcagcaacagcagcatcctggaaagcaagctaaagagcagcaacagcagcagcaacagcagcagcaactcgcagcccagcaactcgttttccaacagcagctcttacaaatgcagcaattgcagcagcaacagcaccttctaagcttacagcgacaagggttgatctccatcccgccaggtcaggcggctctgccggtgcaaagcctgccacaggcgggtctttccccagccgaaatccaacaactgtggaaagaggttaccggagtccattcaatggaagataatgggatcaaacatggcggtctggatctgaccactaataacagcagttcgactacatcttcaaacacatctaaggcatctcctcctattacacatcatagtattgtgaacggacagtcttcggtcctttctgctcgacgagacagcagctctcacgaggagacgggggcaagccatacgctgtatggacacggggtttgtaagtggcccggatgtgagtcaatttgcgaagacttcggtcagtttttgaagcacctgaataacgaacacgccttggatgacagaagcactgcacagtgtcgcgtgcagatgcaggtggtacagcagctcgaaatccagctgtcaaaagagagggaacgcctccaggccatgatgactcacctgcatatgagaccaagtgaacctaagccttctcccaaaccactgaatctagtgtcctctgtgacaatgagtaaaaacatgctggagacctctccacaatctctcccacagacccctaccactccaaccgcacccgtgacccccatcacccagggcccaagtgtcatcacacccgcttctgtaccaaatgtcggcgcaattaggcgaaggcatagtgacaaatataatattcccatgagtagcgagattgcccctaactacgagttttacaaaaacgcggacgtccgcccaccttttacatatgcaacattgatacggcaagccattatggaatcctctgaccgccagttaactctgaatgagatatattcctggtttacaaggacattcgcttatttccgccgaaacgctgcaacctggaaaaacgcggttcgccacaatctatctttgcacaaatgttttgtgagggtggagaatgtaaagggggctgtgtggaccgtggacgaggtagaataccagaagaggcggagtcagaagatcaccggtagcccaactcttgtgaagaacatccctacaagcttaggctacggcgctgcacttaacgcgtccttacaagccgcactagcggagagcagcctgccactgctttccaatcctggtctgattaataacgcctctagcggcctgctccaagcagtacacgaggacctgaatggttctctggatcatatagactcgaatgggaattcctcaccgggatgctctccacagccacacatacattccattcatgtaaaagaagagccggtgatcgccgaagacgaggattgccccatgagtctggtgactactgcaaatcactcccccgagttagaagatgatagggaaattgaggaagaacccctcagcgaagacctcgagtag

SEQ ID NO: 223572 - DNA, 1593 bp, Artificial Sequence
  Description of Artificial Sequence: Synthetic coding sequence
atgatgacaccgcaggtgatcactccccagcagatgcagcagatcctccagcaacaagtgctgtctccccagcagctgcaggcgttgctgcaacagcaacaggccgtcatgcttcagcagcagcagctgcaggaattttataaaaagcagcaggagcaactgcacttgcagctgctgcagcaacaacagcagcagcagcagcaacagcagcagcagcagcagcagcaacagcaacagcaacagcaacagcagcaacaacagcagcagcagcagcagcagcagcagcagcagcagcagcaccccggaaagcaagcgaaggagcagcagcagcaacaacagcagcagcaacaactggctgcccagcagctggtgtttcagcaacagctactgcaaatgcagcaactgcagcagcagcagcatctcttgtctctgcagaggcagggcctgattagtatacctcccggacaggccgctctgcctgtgcagtcactgccacaggccggactgtcaccagcagagatccagcaactgtggaaggaggtgacgggcgtccactctatggaagataacggcattaaacatggaggcctggacttgaccactaacaatagtagctcgaccactagctcaaacacgagcaaagcgtctccacccattactcatcattctattgtgaacggacagagctccgtcctctctgctaggagggattcttccagtcacgaggaaaccggcgcatcacatactttgtatggacatggggtgtgcaagtggcccggatgcgaatccatttgcgaggactttggacaattcctaaaacatctgaacaacgagcatgcacttgatgacaggtcaaccgctcagtgtagggtacagatgcaagtggtccagcagttggagatccaactcagcaaggagagagagaggttgcaggcaatgatgacccatttacacatgcgtccatcagaacccaaaccaagccccaagccagctatcatggagtcaagtgaccgccaactgacactgaatgaaatttattcatggttcactagaactttcgcctacttccggaggaacgccgctacatggaaaaatgccgttcgccataatctttcactgcataagtgtttcgtgcgagttgaaaacgtgaagggcgcagtctggacggtagatgaggtggagtaccagaagaggagaagccagaaaatcaccggctcgcctactctggtcaaaaacataccgacctccctggggtatggagcagcgctaaatgcatccctacaggccgctctggccgaatcttcccttcccctcctgtccaaccctggattaataaacaatgcttcatccggactgttacaggcggtccacgaagacctgaacggcagtcttgatcacatcgattcgaatgggaactcgtcaccaggctgctcacctcagcctcacattcactctatccatgtcaaggaagaacccgtaattgctgaggatgaagattgtcctatgtcattggttaccaccgctaaccactctcctgagctagaagatgatcgcgaaatagaagaagagcccctgagtgaagatcttgagtag

SEQ ID NO: 223573 - DNA, 2148 bp, Artificial Sequence
  Description of Artificial Sequence: Synthetic coding sequence
atgatgcaggagagcgccaccgagacaatcagtaatagtagtatgaaccagaatgggatgtcaacgctgtcatcacagcttgacgccggaagccgcgacggacggagtagcggtgatacttccagcgaagtgagtaccgtagaactgctgcatttacaacagcagcaggccctgcaggccgctcgacagctgctcttgcaacagcagacaagcggtctgaagtcacccaagagttcggacaaacagaggccgcttcaggttcccgtgagcgtagccatgatgactccacaagtgatcactccgcagcagatgcagcagatcctgcagcagcaagtcctgtcccctcagcagctgcaggctttgctgcaacagcagcaggcagtgatgctacagcaacagcagttgcaggaattttacaaaaaacagcaggaacagctccatttgcagctgctgcagcaacagcagcaacagcaacagcaacagcagcagcagcagcagcagcagcaacagcagcagcagcaacagcagcagcaacagcaacagcagcagcagcaacagcagcagcaacaacagcaccctggaaaacaagcgaaggagcagcagcagcagcagcagcagcaacagcagctggcagctcagcagcttgtattccagcagcagttactgcagatgcagcaattgcagcagcagcagcacctactctcactccagaggcaggggctgatctcaattcctccaggccaggcagcgctgcctgtacaatcacttcctcaggccggactttcacccgctgagatccagcagttatggaaggaggtgacaggagtacacagtatggaagataacggaatcaaacacgggggactggacctgacaacaaataactcaagtagtacaaccagttccaatacatcaaaggcatcccctcccattacccaccactccattgtcaacggccaaagttccgtcctgtcagcccgtcgggacagctcctctcacgaggagaccggcgcttcacacacgttgtatggtcacggtgtttgtaagtggccagggtgtgagtctatttgtgaggacttcgggcaattcctgaagcaccttaataacgagcatgctctagatgatcgctccacggcgcagtgccgggtccaaatgcaggtggtgcagcagcttgagattcagctgtccaaggagagagagaggctgcaggcaatgatgacacacttacacatgaggcccagtgagccgaaaccatccccaaagccattgaatttggtatcaagtgtaacaatgagcaagaacatgctggaaacctctccccagtccctgccccaaacacctacaactcctacagccccagtcacccctataactcaggggccatccgtgattacaccagcctccgtccccaacgtcggggctatcagacgcaggcacagtgataagtacaacatcccaatgagcagcgagattgcccctaactatgaattttataagaatgccgatgtgcgccctcctttcacttacgctactctgatacgccaggcgatcatggagtcatctgacagacaactgacccttaacgaaatttacagctggtttacacggacttttgcgtacttcagaaggaatgctgccacttggaaaaacgcagtacgtcacaacttgagcttacacaaatgctttgtgagggtcgaaaatgtcaagggtgccgtttggactgtggacgaggtggagtatcagaagcgacgcagtcagaagatcacaggcagtccaaccctggtcaaaaatatccccacatcgctaggttacggggctgcactgaacgcttccctgcaagccgcattagctgaatccagtctgccgctgctgtcaaatcctgggctgatcaataacgcgtctagtgggctgttacaggctgtccacgaagatctgaacggaagcctggatcatatcgacagtaatggcaattcctcccccggttgttctccacagcctcacatccacagtatccacgtaaaagaggaacccgtgattgcagaagacgaggattgccccatgtcgctggtgacaactgctaaccattccccagagctggaagacgatcgggagattgaggaggagcctctgtccgaggatctagagtag

SEQ ID NO: 223574 - DNA, 1149 bp, Artificial Sequence
  Description of Artificial Sequence: Synthetic coding sequence
atgatgactccccaggtcatcaccccacaacaaatgcaacagattctccagcaacaggtgttgagcccacagcaattacaggccttgctgcagcagcagcaggccgtgatgctgcaacaggatttcctggattcaggtctggaaaactttagggccgctctggaaaagaaccaacaattgcaggaattttacaaaaaacaacaggagcaattgcaccttcaactgctccagcagcagcaacagcaacagcaacaacagcaacagcagcagcagcagcagcaacagcagcaacagcagcagcagcagcagcaacaacagcagcagcagcagcaacagcagcagcaacaacaccccggaaagcaggccaaggaacagcagcagcagcagcagcagcagcagcaactggccgctcaacagctggtgtttcaacagcaacttttacagatgcagcagctgcagcagcagcagcatctcctgtccctacagcgacagggcctcatctccattccacctgggcaggctgccctccccgtgcagtcactacctcaggcaggtttgtccccagctgagattcagcagttatggaaagaggtcactggggttcacagcatggaagacaacgggattaagcacggaggcctggatttgacgaccaataacagcagttcaactacctcaagcaacaccagcaaggcctccccccctatcacccaccactctatagtgaatggtcagtcttcagtcttatccgccagacgagacagtagctcacacgaagagaccggcgcttcccacactctgtatgggcatggcgtgtgtaaatggcctggatgcgagagtatctgtgaggattttggacaattcctgaagcacttaaataatgagcacgcccttgacgacaggtccaccgcccaatgtcgggtgcaaatgcaagtggtgcagcaattagagatccaattgtcaaaggaacgcgagcggcttcaggccatgatgacccatttgcatatgcgcccaagcgagccaaagcctagtcccaaaccgaacatttgcaaagttacctatcgatgcatttggatgttcctacgattcagcaactacgcagaggtcttgctctatattcctgaaaaactgacaccagtggcgctctag

SEQ ID NO: 223575 - DNA, 2199 bp, Artificial Sequence
  Description of Artificial Sequence: Synthetic coding sequence
atgatgcaagaatctgccaccgagacaatttcaaatagctctatgaaccagaatggcatgtcaacactgagttctcaactggacgctggcagtagagacggcaggtcatccggcgacacatcttcagaggtgagtactgtcgagctgcttcacttacaacagcagcaagccctccaggctgcccgacaacttttgctgcagcagcaaacgtccggactgaagtctccaaagtcctctgacaaacagcggccactgcaggtgcctgtatccgtggccatgatgactccccaggtgattacaccacagcagatgcaacaaattcttcaacagcaggtgctctctccccaacagctacaagctttactgcagcagcagcaagccgtgatgctgcagcaggactttctcgatagcggcttagagaattttcgggcagccctagaaaagaaccaacagcttcaggaattctacaagaagcaacaagagcagctccacctccagctgctgcaacagcaacaacagcagcagcagcaacagcagcagcaacagcagcagcagcagcagcagcagcagcagcagcagcagcaacagcaacagcagcagcagcagcaacagcagcagcagcaacaccccggaaaacaggcaaaggagcagcagcaacagcagcaacaacagcaacagttagctgcccaacagttggtatttcaacaacaacttctccagatgcagcagctccagcaacagcagcatctactgtcactgcagagacaggggctgatatcaatcccgccaggccaggctgccttgccggtgcaaagcttgcctcaggccggactgtccccggctgaaatacagcagttgtggaaagaggtgactggcgtgcacagtatggaagacaatggaattaagcacggcggtctagacctcactacaaacaatagcagttcaactacctccagtaatacaagcaaagcgtcccccccaatcactcatcatagcattgtcaacggacagtcctccgtgcttagcgccaggcgggactcctcatctcatgaggagaccggcgcatctcatactctgtacggccatggcgtttgcaaatggccgggttgcgaaagcatttgtgaggactttggccagtttctaaagcacctcaacaacgaacatgctttggacgatcggagcacagcccagtgccgagtgcagatgcaggtggtccaacagttagaaatacagttatctaaagaacgcgagaggctgcaggcaatgatgacccatctgcatatgaggccaagtgaaccgaaaccatcgccaaagccattgaatctggtttcaagtgtgacaatgagcaagaacatgctcgagacttccccacagtctctcccacagactcctaccaccccaaccgccccagtgactccaatcactcaaggcccaagtgtgatcacaccagcgtccgtgcccaacgtgggggcaattaggaggcggcattcagataaatacaatatacccatgagcagcgagattgcccctaattacgaattttataagaacgccgacgtaagacctcccttcacttatgctaccctcatccgacaggccattatggagagtagcgatcgacagctgacactgaacgagatctattcatggttcaccagaacctttgcatactttagaaggaacgcagccacctggaagaatgccgtacgccacaacctgagcctccacaaatgtttcgtcagggttgagaacgttaaaggagctgtttggacagtggacgaagtggagtaccagaaacgtcggtcccagaaaataaccgggtctcccactctggtcaagaacatcccaaccagtcttggatatggagctgcgctgaatgcgtctcttcaggccgcattagccgagagcagtcttcccctgctcagcaaccccggtctgattaataacgcttcctccggcctgctgcaagcagtccatgaggacctgaacgggagcctcgatcatatagattccaatggcaattcctctcctggctgtagccctcagccacacatccattccattcatgtaaaagaagagccagtcatcgccgaggacgaggattgtcctatgtccctggtgactacagcgaatcactctcccgaattggaggatgacagagagatcgaggaggaaccactgtctgaagacctcgagtag

SEQ ID NO: 223576 - DNA, 2223 bp, Artificial Sequence
  Description of Artificial Sequence: Synthetic coding sequence
atgatgcaagagagcgctactgaaacaatctcaaactctagtatgaatcaaaatgggatgtctacactgtcatctcagctggacgcaggctctcgagatggtagatcatctggcgatacaagtagtgaggtgtcgacagtggagctgctgcatctgcagcagcagcaggcactgcaagccgcaaggcagctgctcctccagcaacaaacaagcggactcaagtccccaaaaagttcagacaagcagaggccgctccaagagctcttgccggaaaccaagctttgcatatgtggtcactcttctggagacggacacccacacaacactttcgccgtgcccgttagtgtggccatgatgaccccacaggttatcaccccccaacagatgcagcagatccttcagcagcaagtactgtccccacagcaactgcaagcattattacaacagcaacaggcagtgatgttgcagcagcaacagcttcaggagttctataaaaagcagcaggaacagcttcacctccagctactgcagcagcagcagcagcagcagcagcaacaacaacagcagcaacaacagcaacagcagcagcagcagcagcaacagcaacagcaacagcagcaacagcagcagcaacagcagcagcaacagcaccccggaaaacaggctaaggaacagcagcaacagcagcagcagcagcagcagctcgctgcgcagcaactggtatttcagcagcaattactccagatgcagcagctgcagcaacagcaacacctgctctctctgcagaggcagggcttgattagcattcctccgggtcaggctgcccttcccgttcaaagtctcccacaggcaggcctgtcacctgccgagatccagcagctctggaaagaggtcacaggcgtacacagtatggaagacaatgggataaaacatggtggtttagatttgacgacgaacaacagctcaagcacaacatcaagcaataccagcaaggcatctccccctataacgcaccactctatagttaacggccagtcaagtgttctgtccgcaaggagagactcgtcaagccacgaggagactggtgccagtcatacattgtacggacatggtgtctgtaagtggcctggatgcgagagtatctgtgaggatttcgggcagttcctgaaacatctgaacaatgagcatgccctggacgacaggtcaaccgcccagtgcagggtgcaaatgcaggttgtgcaacagctcgagatacaactgagtaaggagcgcgaacggctccaggccatgatgacacatctgcatatgaggcccagcgagcctaagccttcacctaagcccctaaaccttgtgtctagcgtgactatgtcgaaaaatatgctggagacctcccctcagtcactccctcagacacctacaactcccactgcacccgtgaccccaatcactcagggcccttccgtgataacgccggcaagcgtcccaaatgtgggggctattagaagaaggcactctgacaagtacaatatccccatgagttcggaaatagctcctaactacgaattttacaagaacgctgatgttaggcctccttttacatatgccactctaattcgtcaggctattatggaaagctccgacaggcaactgaccctgaatgaaatctacagctggttcacacgcacattcgcctactttcgcagaaacgccgcaacctggaagaatgctgtgcgccacaatctgtctttgcacaaatgtttcgtacgcgttgaaaatgtgaaaggagctgtgtggacggtggatgaagtggaataccagaagcggagatcgcagaagatcacggggtcaccaaccctcgtaaaaaacatccctacttccttaggttatggagcagcactaaacgcgtcgttgcaggctgcgctggcagagagctctctgcctttattgtctaatcctggactgataaataacgccagttccggcctcctgcaggctgtccacgaggatctgaacggttcgctagatcacatagatagcaacggcaactcaagtccgggttgttccccccagccccacatccactccattcatgtgaaggaggaacctgtgatagccgaagacgaagactgcccaatgagcctcgtcacgacagccaatcattccccagagctcgaagacgatcgagagatagaagaggaaccactaagtgaagatctggaatag

SEQ ID NO: 223577 - DNA, 1191 bp, Artificial Sequence
  Description of Artificial Sequence: Synthetic coding sequence
atgcctaaccccagaccaggcaaaccaagtgcgccttcattggctctggggccatctccaggagcttctccctcctggcgcgctgcccctaaagcgtccgaccttctaggtgccagggggcctggaggtacattccaagggagagacctccggggtggtgctcatgcctctagctcttcactaaaccccatgcccccttcccagctccaactaagtaccgtcgatgcgcacgctcggacccctgtgctccaggtgcaccccctagaatctcctgcgatgattagcctgaccccacccacaaccgctacaggcgtgttctcactgaaagctcgccctggcctccccccaggcattaacgttgccagcttggaatgggtgtcaagggagccagcattattgtgcacattccccaacccatcagcccctaggaaagatagcactttgtccgcggtgccgcagagctcttatcctctgctcgctaatggcgtgtgcaagtggcctggatgcgagaaagtcttcgaagagcccgaggacttcctcaaacattgccaagccgatcaccttctcgacgaaaaaggcagggctcaatgtcttctgcagagggagatggtccagtcacttgaacagcaacttgtgctcgaaaaagagaaactgtcagcaatgcaggctcacctggctggtaagatggcacttaccaaggcatccagcgtggccagctcagataagggtagctgctgtatagtggcggcaggcagccaggggccagtggtgcctgcttggagcgggcctagggaagcgcctgattctttgttcgccgtgaggcgacatctctggggtagtcacggcaattccacgttccctgaattcttacataacatggattacttcaaattccacaatatgaggcctcctttcacttacgctacgttgattagatgggccatactggaagcacctgaaaaacagcgcacactgaatgagatttatcattggttcacacgaatgttcgccttcttccggaatcatccagctacatggaaaaacgctatacgacataatctctcccttcacaaatgcttcgttcgagtggagtcggaaaaaggcgcagtgtggactgttgacgagcttgagtttaggaaaaaacggagccagcggccatcgaggtgcagtaatccaacccctggaccttag

SEQ ID NO: 223578 - DNA, 1296 bp, Artificial Sequence
  Description of Artificial Sequence: Synthetic coding sequence
atgccaaaccccagacctggtaagcctagcgccccatccctggccctcgggccttctccaggcgctagtccttcatggagagccgctccaaaagcctcagacctcctgggcgcacggggacctggaggcacgttccagggccgagacctccgcggaggcgcacatgccagcagctcctctttgaatccgatgccaccgtctcagctgcaactcccaaccctgcctctcgtcatggtcgctccaagtggggcaaggctcggtcccctgccacatctgcaggcgctacttcaggacaggccgcatttcatgcatcaactcagcaccgtggacgcccatgcaagaacaccagtgttacaggtgcaccctctggaaagcccagccatgatttctctgactccacccactactgcgaccggcgttttctccctgaaggccagacctggactccccccagggattaatgtagcctctctagagtgggtgagccgagaaccagctctgttgtgtaccttccccaacccttctgccccaagaaaggacagcacattgtccgctgtcccacagtcaagctatcctttgctagccaacggagtgtgtaagtggccgggatgcgagaaggtcttcgaggagccagaggacttcctaaaacactgtcaggccgatcatttactcgacgagaagggcagagcacagtgcctgctacaaagggaaatggtccagtcactcgagcagcaactcgttctggaaaaagaaaaactttctgctatgcaggctcaccttgctgggaagatggctcttacgaaggcctcttccgttgcatcctctgacaaaggttcctgttgtatcgtggctgctggttctcaaggaccagtagtgcccgcttggagcgggcctcgggaggcaccagattctctgttcgccgtgcgaagacatttgtggggctcgcacggtaacagcacatttcctgagttcttgcataatatggactattttaagttccataacatgcgacctccgttcacatacgccactctcatccggtgggccatcctggaggccccagagaaacagaggacactgaacgaaatatatcactggttcacacgcatgttcgctttttttaggaaccacccggctacatggaagaacgcgattcggcacaatctttccctacacaagtgcttcgtgagggtggaatccgaaaagggggcagtatggactgtggacgagttagaattcaggaagaaacgatcacagaggccgagcaggtgttccaatcccacgcccggtccttag

SEQ ID NO: 223579 - DNA, 1215 bp, Artificial Sequence
  Description of Artificial Sequence: Synthetic coding sequence
atgcctaatccccgtccaggcaagccttcagcaccttccctagccttagggccatctcccggagcaagtccttcatggcgagccgctccaaaagcgtccgatctgctcggcgcacgtgggcctggaggaactttccagggaagagatttacgaggcggtgcccacgcaagtagcagctccctgaacccaatgccacctagtcagctgcaactgcctaccttgcccctggtgatggttgccccttccggtgccaggctcggccctctcccacacttacaggctctgctgcaggacagacctcatttcatgcaccaactgagtaccgtggacgcacatgcaagaacccctgtcctgcaggtgcaccctttggaatctccagccatgatcagcttgactcctcccaccactgccacaggtgtcttctctttgaaagctcggcctggtcttccccctggcatcaacgtggctagtttagagtgggtgagccgcgagcctgccctcctgtgcacattccctaacccatccgctccacgaaaggattcaaccctgagcgcagtgccccagtctagctacccgcttctggccaatggagtctgcaagtggccaggctgtgagaaggtgtttgaggagccggaggacttcctgaaacattgccaggccgaccacctgctcgatgagaaggggagggcccagtgccttctgcagcgagagatggtccagtctctggaacagcaagcttctagcgataaggggagctgctgcatcgtcgcagctggatcgcaggggcctgtcgtgccagcctggtcaggcccaagagaagcccctgattccctctttgccgttagacgccatctctggggtagccacgggaactctactttccccgaatttttacacaatatggattatttcaagtttcacaatatgcggccacctttcacgtacgctactctgataagatgggccatacttgaagcaccagaaaagcaacggactttgaacgagatttaccattggtttactcgtatgttcgcgttctttagaaatcaccctgcaacctggaagaacgcaattcggcacaatctgtccttgcataagtgttttgtccgggtcgaatccgagaaaggggcagtctggaccgttgacgagctggagttcaggaaaaagcgatcccaacgcccaagccggtgctcgaaccccactcctggcccttag

SEQ ID NO: 223580 - DNA, 1191 bp, Artificial Sequence
  Description of Artificial Sequence: Synthetic coding sequence
atgcccaatcctaggccaggaaagccctccgccccaagcctagccctgggcccaagtcccggagctagcccttcatggcgcgctgcgcctaaggcctccgacctccttggggctagggggccaggcggtaccttccagggcagagaccttaggggtggggctcatgcctcgtcttcatcgttgaatcctatgcccccaagccagctgcaactgtccacagtggacgcccatgctcgaacccccgttctgcaggtgcaccctctcgagtctcccgcaatgatatcactgactccaccaactaccgctaccggcgttttttctttgaaggccagaccaggcctgccacccggaattaatgtggcctcacttgagtgggtatcacgggagcccgctctcttatgcacctttcccaatccctccgcccctcgaaaggacagtacgctgtcagcagtgcctcaaagctcttatcccctgctcgctaacggcgtgtgcaagtggcctggctgcgaaaaggtttttgaggagcctgaggatttcctgaagcactgccaggcagatcacttgctggacgaaaaaggtcgggcacaatgcctactccagcgggagatggtacagagccttgaacagcagctggtccttgagaaagaaaagctgtccgctatgcaggcccatctggccggaaagatggcactgacaaaggcatcaagcgtggcctcaagtgataaaggtagctgttgcatcgtggccgctggcagtcaggggcctgtcgtgcctgcgtggagtgggccaagggaagcgccagattctctctttgcggttagacgacacctgtgggggagccacggcaatagcacattccctgagttcctccataacatggattattttaaattccacaatatgcgacctcccttcacatacgctacattgatccgctgggccatattagaagccccagagaaacagaggacacttaatgagatctaccattggtttacccggatgttcgcattctttcggaatcaccccgcaacttggaagaatgctattcgccacaacctatctctgcacaagtgcttcgttcgagtagaatcagagaagggtgctgtctggacagtggacgagctggaattcagaaagaagcgctcacagcgcccatcccggtgcagcaaccctactcccggaccttag

SEQ ID NO: 223581 - DNA, 2043 bp, Artificial Sequence
  Description of Artificial Sequence: Synthetic coding sequence
atgatggtggaatccgcatccgagactatccgaagcgcccctagcggtcagaacggagtgggctctctctctggacaggctgacggctcttcaggcggtgccaccggtacaaccgcctctggtacgggccgagaggttaccacaggtgcagacagtaatggagagatgagccctgccgaactgttgcacttccagcagcagcaggcgctgcaagtggcccgacaatttctgcttcaacaggctagcggactgagctcacccggtaacaatgattcaaagcaatcagcatcagccgttcaggtacccgtgagcgtggccatgatgtcaccccaaatgttaacgccacagcagatgcagcagatactgagcccacctcagttacaggcactgttgcaacagcagcaggcactgatgctgcagcagcttcaggagtactacaaaaagcagcaagagcagctgcacctacagcttctgacacagcaacaagccggtaaaccccagcccaaagaagcattgggtaataagcagctggcatttcaacagcagctgcttcagatgcagcagctgcagcaacagcacctgcttaatctgcagcgccaggggttagtttccctgcagcccaaccaggcgagtgggcctttgcagaccctaccacaggccgctgtgtgccccaccgacctaccacagctctggaagggagagggcgcacctggtcagcctgccgaggacagcgtgaagcaagaagggcttgatctaactgggacagctgccacagccacgagcttcgcagcacctccaaaggtttctcccccacttagtcatcataccttgcccaatggccagcctactgtgctgacttcacggagagactctagcagccatgaggaaacccccggttcgcaccctctctacggtcatggtgaatgcaagtggccaggctgtgagacactgtgtgaagacttgggacagttcatcaagcacctgaacaccgagcacgctttagacgacaggtctacagctcaatgtagggtgcagatgcaagtagtccagcagctagaaatccagctggcaaaagagagcgagcggctgcaagctatgatggcacatcttcatatgcggccttccgaacctaagccattctctcaaccgctcaatcccgtacccggatcctcttcatttagcaaggttactgttagcgcagctgacagcttccccgacggcctcgtccatccacctacttcagccgcagcgcctgtgacaccactgagaccccctggactgggctcagcttcccttcacggcggaggaccggcacgccgaagatcaagcgataagttctgcagcccaattagttctgagctggcccagaatcacgagttctacaaaaatgccgacgtgaggcctcctttcacctacgcttcgctcattcgccaggccattttggagacccctgatcggcaactgacactgaatgagatttataattggtttactcggatgttcgcatatttccgacgcaacacggccacttggaaaaacgccgttcgccacaacctgtctcttcacaaatgctttgttcgggtcgaaaacgtcaagggagccgtgtggacagtggatgaaagagagtaccagaaacgtagacccccaaaaatgaccggatctcccacactggtcaagaacatgatctcaggattaagttatggcgcattgaacgcctcctaccaggccgctcttgctgagtcatctttcccgctcctgaacagcccgggaatgctgaaccccggttcggcatcatcactgttgccgctgtctcacgatgacgtgggcgctcctgtcgaaccactgccatcgaacggctcaagtagcccccctcgcctcagtccaccccagtacagccaccaggtgcaggtgaaggaggagccagctgaggcggaagaggatcgacaaccagggccaccactgggcgcaccaaacccgtcggcttccggacccccagaggaccgcgacctcgaggaagaactgcccggagaagaactgtcttag

SEQ ID NO: 223582 - DNA, 2037 bp, Artificial Sequence
  Description of Artificial Sequence: Synthetic coding sequence
atgatggttgagtccgcgtcagagactattaggtctgctcccagtgggcagaacggtgttggatccctcagtggccaagctgatgggtcctctggtggcgctaccggtactaccgcgagcggaacgggtcgcgaggtcaccactggcgcagactcaaacggggaaatgtctccagcagagctccttcactttcagcagcaacaggctctacaggtggcccgtcagttcttgttacaacaggcctctggtctcagcagcccaggtaacaatgatagcaagcagagtgctagtgcagtacaagtccccgttagtgtagccatgatgtccccccagatgctgacgcctcagcaaatgcagcagatcctgagtcccccacaactgcaggcacttctgcagcagcagcaagctctaatgctgcagcaagaatactacaagaagcagcaagagcagctgcatctgcagttgctgactcagcaacaggctgggaagcctcagcctaaagaggccctgggtaataaacagctggccttccagcagcagctcctgcaaatgcagcagcttcaacagcagcacctacttaatctgcagcgccagggcctagtgtcgctgcagccaaatcaggccagcggtcctcttcaaacgctgccccaggcagccgtctgcccgactgacctgccccagctctggaagggcgaaggcgcaccaggtcagcccgctgaggacagcgtgaagcaggaggggctagacctgaccggcacagcagctacagcaacatccttcgccgcaccgcctaaagtgagcccacccctcagccaccacaccttgccgaacggtcaacccactgtcctgacctcaaggcgcgacagctcctcacacgaagaaacccccggatctcacccattatacgggcatggcgagtgcaagtggcccggttgcgagaccctgtgtgaagatctcgggcaatttatcaaacacctcaataccgaacacgccctggacgacaggagcaccgcccagtgccgggttcagatgcaggtagtacagcagcttgagatccagctagccaaggaaagtgaacggctccaggctatgatggctcatctccacatgcggccttccgaaccgaagccattctctcagccactgaacccagtgcccggatccagcagcttttccaaggtgaccgtgtcggcagccgacagctttcctgacggactagtgcaccctccgacaagcgcggcagcccctgtcacccccctgagaccaccgggacttggaagtgcttccctgcacggaggtggacctgctagacgtcgtagtagcgacaagttttgctcccccatcagctctgaattagcccagaatcacgagttttacaaaaatgcagacgtcaggccccctttcacatacgcctccctcattcgacaagcaatcctggaaaccccagatcggcagctgacgctcaacgagatttataattggttcacaagaatgtttgcttacttcagaaggaatacggcaacatggaaaaacgccgttaggcataatttatctctccataagtgcttcgttagggttgagaacgttaagggcgcagtgtggactgtggatgagcgggagtatcaaaaacgcagacctcctaaaatgaccggctcccctaccctagttaaaaacatgatatcagggctgtcatatggggctctcaatgcatcctaccaagccgctctcgctgagtctagttttcccctcctgaattcacccggaatgttgaaccctggttctgcctcttctctgttgcccctgtctcacgacgatgttggcgctccagttgagcccctcccgtcaaatggcagcagctcacccccacgcctgagccccccacagtattcacaccaggtgcaggtgaaggaggagccagctgaggcagaagaagatagacaaccaggcccacctttaggcgctccaaaccctagcgcctctggccctcccgaggaccgtgatttggaggaggagctccctggggaggaactatcctag

SEQ ID NO: 223583 - DNA, 2043 bp, Artificial Sequence
  Description of Artificial Sequence: Synthetic coding sequence
atgatggtggagagcgctagtgagaccatccgttcggccccatctgggcaaaatggtgtcggctccctctctgggcaggccgacggatcgtccggaggagcgactgggactaccgcatccggcaccggccgtgaagttacaacaggggcagattcaaatggcgaaatgagccctgcagaactgctccattttcaacagcagcaagctcttcaggtggctaggcagtttcttctgcagcaggcttctggacttagtagtcccggtaataatgactccaaacagagtgctagcgccgtccaggttcccgtatcagtggccatgatgtcaccacagatgctgaccccccagcagatgcagcagatcctctctcctccccaactccaggcccttcttcagcagcaacaagctttgatgcttcagcagctccaggaatactacaaaaaacagcaagagcagcttcacctgcagctgctgacacagcaacaggccggaaagccccagccgaaggaggctctgggaaataaacaactggctttccagcagcaactgctgcagatgcagcagctccagcagcagcatctcttaaatctgcagaggcagggactggtgtcactccaacccaatcaggcttccggccctctgcaaacattaccccaggcagcagtttgccccacggatctcccgcagctgtggaagggcgaaggtgctcctggccagcctgccgaagactctgttaaacaggagggactcgacctgaccgggacagctgcaaccgccacgtcgtttgcagctccaccaaaggtcagcccacctcttagccatcacacgctgccaaatggccagcctaccgtgttaactagccgtcgcgacagctcctctcacgaagagacgcccggtagtcaccctctttacggtcacggcgaatgcaaatggcctggctgcgaaacactctgcgaagatttaggacaatttattaagcaccttaataccgaacacgccctggatgacaggtctaccgctcaatgcagggtccaaatgcaggtggtgcagcagttggagattcaactggctaaggagagcgaacgcttgcaagcaatgatggctcaccttcacatgcggccatctgagccaaagcccttttcacagcccctcaatcccgtccccggaagctctagcttcagcaaggtgaccgtatcagccgctgatagttttccagacgggcttgtccaccccccaacaagcgcagctgctccagtgactccactccgaccacccggactcggctcagcctctctgcatggcggtgggcctgcaaggcgccgtagtagcgacaagttttgtagtccaattagtagtgagctcgctcagaaccacgaattttacaaaaacgccgacgtcaggcctccttttacctatgcgtctttaattaggcaggcgattttggaaacacctgacagacagctgactcttaatgaaatctataactggttcacccggatgtttgcctatttccggagaaacaccgctacctggaaaaacgccgtgcggcataacctttccctgcataagtgctttgtccgagtggagaatgtcaaaggcgctgtgtggaccgtggacgagcgcgagtaccagaagcgccgtccacctaagatgaccggtagcccaactcttgtgaagaatatgatcagcggcctctcttacggggctttgaatgccagctaccaggcggctctagccgagagcagcttccctctgctgaattctccgggtatgctgaaccccggtagcgcttctagcctgctcccattatcacatgacgacgttggcgcacccgtggagccattgcctagtaacggctcatcatcacctcccaggctgtctccaccacagtacagccatcaggtacaggttaaggaagaaccagcagaggccgaggaggaccggcaaccaggtccacccctgggggcaccaaacccatctgcctctggccctccagaagatagggatctggaagaggaattaccgggagaggaactgagctag

SEQ ID NO: 223584 - DNA, 2004 bp, Artificial Sequence
  Description of Artificial Sequence: Synthetic coding sequence
atgatggtcgagagcgcgagtgagactataaggagtgctccttcgggccagaatggggtggggtctcttagcgggcaggcggacgggagtagcgggggagctaccggtactaccgcctcgggcaccggacgtgaggtgacaaccggagcagattcgaatggcgaaatgtctccagcagagctgctgcatttccagcagcaacaggcgctgcaggtggcccgacagtttctactccaacaggccagtgggctcagcagccccggaaataacgattccaagcagagtgcctcagccgtgcaagtgcctgtgagcgtcgctatgatgtcaccccagatgctcacccctcaacagatgcagcaaattctgtcaccacctcagctccaggccctcctgcagcagcaacaggcgctaatgctgcagcagttacaagagtactacaaaaagcagcaagagcagctccatcttcagctcctcacccagcaacaggcagggaaaccccagcctaaggaagcccttggcaataagcaattagcatttcaacagcagctgctacaaatgcagcagcttcagcaacagcatcttcttaatttacaacgtcaaggcctagtctcactgcagccaaaccaggctagtgggcctctccagacgttgccccaagcggtctgcccaacagacctaccacaactgtggaagggcgagggcgcacctgggcagccagctgaggatagtgtgaagcaagagggtctggacttaaccggcacggcagctaccgctacttccttcgcagcaccccctaaagtctccccacctctgagccaccatacgctgcccaacgggcagcccactgttttgacatcccgccgagactctagttctcatgaggaaacaccaggctcccacccactgtacggccacggagagtgtaagtggcctggctgtgagacactttgtgaagacctcggtcagtttattaaacacctcaacactgagcatgctctggacgacaggtcaaccgcacagtgtagagttcagatgcaggtcgttcagcaactggagatacagttggctaaagagtctgaacgcttacaagcgatgatggcccacctgcatatgagaccttctgagcctaagcccttcagccaacccgtgactgtttcagctgccgactcattccctgacggcctggttcatcctcccacctctgccgctgccccagtgacgccactgcgaccccctgggttaggtagtgccagtctgcacggcggaggtcccgcaaggagacgatcttctgataagttctgttcaccgatatcctctgaactggcacaaaaccacgaattttacaagaatgccgatgtacggcctccttttacctatgcgtctctgatcagacaggccattctcgaaacacccgatcgccaactgaccctgaatgaaatatataactggttcactagaatgtttgcgtacttcaggcggaatacagccacctggaaaaacgcagttagacacaacctgtcactccacaagtgtttcgttcgggttgagaacgtgaagggcgctgtgtggactgtggatgagagagaatatcaaaaaaggagacctcccaaaatgaccggctcccctaccctggttaaaaatatgatatccgggctctcctacggtgctttgaacgcctcttaccaggctgcactggcagagtcatcttttccccttcttaatagcccgggtatgctgaaccctggttcagcgtcttccttgttgcctctctctcatgatgacgtgggagcgcctgtcgagcctctgccaagcaatgggtctagctcgcctccccgattgtctccgccacagtactcacaccaagtacaagtaaaagaggaacctgccgaagccgaggaggaccggcagccgggacctcccctgggagccccaaatccgagcgcttccggtcctcccgaggatcgtgaccttgaggaggaactcccaggagaagaattaagctag

SEQ ID NO: 223585 - DNA, 2007 bp, Artificial Sequence
  Description of Artificial Sequence: Synthetic coding sequence
atgatggttgagtcagcttccgagaccatccgaagcgcaccttctgggcagaacggtgttggatctcttagcgggcaggccgacggctcctccggcggagctacaggaaccacagcctcggggacggggcgagaggttacgacgggggctgacagcaacggtgagatgagccccgcagagctccttcattttcaacagcagcaggccctacaggtggcccgacagttcctgttacagcaggcatccgggttatcgtcccctggcaacaacgactccaaacagtcagcttccgctgtacaggttccagtctctgtcgctatgatgagtcctcagatgcttacaccccagcagatgcagcaaatattgagtccaccgcagttgcaggccttactccagcaacagcaggctcttatgctgcagcagcttcaagagtactacaaaaagcaacaggagcagctgcacctgcagctgcttacccaacaacaggctggcaaacctcaacccaaggaggcactgggtaacaagcaactggcattccagcagcaactcctccagatgcaacaactccaacagcagcatcttctgaatcttcagaggcagggtctggtctccctgcaacctaaccaggcctcagggccattacaaacactcccccaggccgcagtttgcccaaccgacttaccccagttatggaaaggcgagggcgcacccggacagcctgcagaggattccgtcaaacaggaggggcttgacctgactgggaccgcggcaaccgcaacgagctttgctgccccacctaaggtgtcgccgccattaagtcatcatacgctgcctaacggacagcctaccgttctaacctcacgtagagactcaagctcccacgaagagacaccaggatcgcatcctctttatgggcatggcgagtgcaaatggcctggatgtgaaacattatgtgaagatttgggtcagttcataaagcacctgaataccgagcacgccctggacgaccgatccacggcccagtgtcgagtgcagatgcaggtggttcagcagctggaaatacagctggctaaggagtctgaaagactacaggctatgatggcccatctgcatatgcggccttccgagcctaagccctttagccagcccgtgacagtgtccgcggctgacagctttccagatggcttagttcatcctcctacaagtgcggcagccccagtcacccccctgagaccaccagggctcgggtctgcctccctgcatggcggaggcccagccagacgcaggagcagcgacaaattttgctcaccaatctccagcgaactcgctcagaatcacgaattttacaaaaatgcagatgtgagaccaccgttcacatatgcatccctgatcaggcaggccatactcgagactcctgatagacagcttactctgaatgagatttacaattggttcacccgaatgttcgcctacttcaggcgaaacaccgccacttggaagaatgcagttagacataacctgagcttgcataaatgttttgtacgggtcgagaatgtcaagggagccgtctggaccgtggacgagagggaatatcagaagaggcgccctcccaagatgacagggtcacccacactggtcaaaaatatgatcagtggactctcttatggtgctctgaatgccagttaccaggctgccctcgcggagagctccttcccacttcttaattctccgggaatgctgaatcccggtagcgcgagttcacttctcccactcagtcacgacgacgtaggcgcacctgtagaaccactgcctagcaatggctctagctctccaccccgtctctcaccaccccaatattcacaccaggtacaggtgaaggaggaaccagccgaagccgaggaggatcggcaacccggtccaccattaggggcacccaaccctagcgcctctggcccacctgaagatcgcgacctggaagaggaattacccggagaggaactgtcatag

SEQ ID NO: 223586 - DNA, 1212 bp, Artificial Sequence
  Description of Artificial Sequence: Synthetic coding sequence
atgaagttggaagtattcgtgccccgtgccgctcacggggacaaacagggttctgacctggaaggggctgggggttctgacgcacctagcccgctgtctgcggctggggatgacagtctggggtcagacggagactgtgctgctaatagtcccgcagctggtggcggtgccagagacactcagggagatggagagcagtcggcagggggtggaccaggagccgaagaggctatccctgccgctgccgctgctgctgtcgttgctgaaggagccgaggccggtgccgctgggccaggagctgggggagccggaagtggcgaaggagctcggagcaagccttatacacggaggccaaaaccaccttacagctatatcgctctgattgctatggcaatcagagatagcgcaggcggacggttgaccctcgccgaaattaacgagtatctaatgggaaaattccctttcttccgaggcagctataccgggtggaggaatagtgtccgccataacctttcgctaaatgactgtttcgtgaaagtgctgagagatcctagccggccatgggggaaggataattattggatgctgaatcccaactccgagtatacctttgcagatggcgtgttcagacggcgtaggaaacgcttgagccatcgcgcacctgttcctgctcccggactccgcccagaagaggcccctggcttacccgcagcacctcccccagcgcctgccgctccggctagccctagaatgaggtcccctgcgcgtcaggaagaaagggcgagtcctgccggtaagtttagtagctcgttcgctatcgacagcattctgcgaaagcctttcaggagcaggcgtctgcgggataccgcccctggcaccacattgcagtggggcgctgctccatgtcctccattgcccgcttttccagcactgctgcccgctgctccctgtcgtgccctgttgcccctatgcgcctatggagccggtgagcctgccaggctgggggctcgagaagccgaagtgcctcctaccgctcctcctttactccttgctccacttccagcagccgcaccagccaagccgctgcggggacctgctgcaggcggagcccatctgtactgccccctaaggttacctgccgcacttcaggccgcatcagttagaaggccgggacctcatttaccctacccagtcgaaaccctgctagcctag

SEQ ID NO: 223587 - DNA, 1626 bp, Artificial Sequence
  Description of Artificial Sequence: Synthetic coding sequence
atgagccaacttgtagagtgcgtaccaaactttagcgaaggcaaaaatcaagaggtcatcgatgcgatctccggcgcaataactcagactcctggatgcgttctgcttgatgtagacgcgggaccaagtacaaaccgcacagtatacacctttgttggacctcctgagtgtgtggtcgaaggagccctgaacgcagctcgtgttgcctcccgactcatagatatgagcaggcaccagggggaacatccacggatgggagcacttgacgtgtgcccattcatcccagtgcggggagtttcggtggatgagtgcgtcctttgcgcacaagcctttggccagcgtctagcagaggagctggatgttcccgtgtacctctacggcgaagccgcaaggatggactctaggaggactctacccgctatccgcgcaggcgaatacgaagccctcccaaaaaaattacagcaggcagattgggcgccagacttcggtccttcatccttcgtgccttcgtggggggctaccgccactggggctcggaagttccttattgcctttaacattaatcttctggggactaaggagcaggctcaccggatcgcacttaaccttagggagcaaggacggggtaaagatcagcccggacgactgaagaaagtgcaaggaataggctggtatctcgatgagaaaaacttggctcaggtttccacgaatctcctggatttcgaagtgaccgcactgcataccgtttatgaagagacgtgtagggaagctcaggaactgagtctacctgttgttggaagccagctggtgggcctcgtgcccctcaaggcacttctcgacgcagctgccttttactgcgaaaaggaaaatttattcatcttggaagaagagcaaaggatcaggcttgttgtatcccgtttagggttggactccctgtgcccgtttagtccaaaggagaggatcattgagtatctggtcccagagagaggcccagagagggggttaggctctaaaagtttacgcgctttcgtaggagaggtaggagctaggagtgcagctcctggaggcggaagtgtggcagccgctgcggctgccatgggggcagcactcgggtcaatggtggggttgatgacgtacggtcggagacagttccagtccttagacaccaccatgcgtcggctcatccctcctttcagggaagcatccgcgaaactcacgacactcgtggacgcagatgctgaagccttcacagcctatctggaggctatgcgtctgccaaaaaacacccccgaagagaaggacagaaggacggccgctctgcaggaaggcctcaggagagctgtgagcgtgccactgacactcgccgaaacggtagcatccctctggcctgcactgcaggagctggctcggtgtggaaacctggcctgtcgatctgatctccaggtagctgccaaagccctggaaatgggggtgttcggcgcatattttaatgtcctgatcaatcttagggacattaccgacgaggcctttaaggaccagattcaccaccgagtcagtagccttctgcaagaagctaaaactcaggcagcactcgtgttggactgcctcgaaaccagacaggagtag

SEQ ID NO: 223588 - DNA, 1488 bp, Artificial Sequence
  Description of Artificial Sequence: Synthetic coding sequence
atgagccagcttgttgagtgcgtgcctaacttcagcgagggcaagaaccaggaagttatcgacgcaatttctggcgcaatcacccagacacctggttgcgtgctgctcgacgttgacgctggtcccagtacgaatcgtacggtttatacatttgttggacctccagagtgcgtcgtggaaggggctttaaacgcagccagagttgcatcccgtctgattgacatgagccgtcatcagggcgagcatcctcggatgggcgctctggacgtctgcccatttatccctgtgcggggtgtttctgtggacgagtgtgtgctgtgtgctcaggcatttgggcagcgccttgcagaggaactggatgtaccggtgtacctgtatggcgaggccgctcgcatggatagtcgtcgaaccctgcctgcaatcagagccggagaatacgaggccctgccgaaaaaactgcaacaggctgactgggctccagatttcggcccaagctccttcgttccttcctggggagccacagcaaccggggcaagaaagttcttaatcgcctttaacatcaatcttctcggtaccaaggagcaggcacacaggattgcactgaatttacgggagcagggcagaggtaaggaccagccaggccgtcttaagaaagttcagggaattgggtggtatctcgatgaaaagaatctggcccaggtaagcacgaacctcctggatttcgaagtgactgccttacatacggtgtacgaagagacctgcagagaagcacaagaattaagtctgcccgttgtggggtcacagctcgtcggcctggtgccgttgaaggcgctacttgacgcagccgcattttactgtgaaaaggagaacctctttattctcgaggaggagcagcgcattcggcttgttgtttccagactgggcctggattccctttgtccatttagcccaaaggagcggatcattgaatacctggtcccggagaggggcccagagcgcggactggggtctaagtccctgagggcttttgtcggggaggtgggcgcaagaagcgccgctcctggtggcggtagtgtggccgctgccgcagcagcaatgggggcagcactcggttcaatggttgggctcatgacttacggaaggcgtcagtttcagtccctcgacaccacaatgaggcgcctaattcccccttttcgggaagcatcggccaagcttacaactctggtcgacgctgacgcagaagcttttacagcttacttggcgcacgggggtcccacagggggatccgaagcaggatcactgtgcgccgcagatgctgggggtgacgggggtcttgcagtggccggtcccgctggtacagggcctgtatgggagccagggttgccggtccgccctcctggcggaggtcagtctcctggcgatgggcgagtttggaggatatttcaacgggctcaccagcccgagggtcaccacagacgcggaatctag

SEQ ID NO: 223589 - DNA, 1719 bp, Artificial Sequence
  Description of Artificial Sequence: Synthetic coding sequence
atgagccaattggtggagtgcgtgcccaacttctctgaagggaagaatcaggaagttattgacgcaattagtggcgctatcacccagacccctgggtgtgtactgcttgacgtcgacgccggtccatcaacaaaccgaactgtctacacgttcgtcgggcctcccgaatgtgttgtggaaggcgctctgaacgcagcacgagtagcatcacgattgattgacatgtcgagacatcagggcgaacaccctagaatgggagccctggacgtgtgcccattcattccagtgcgtggagttagtgtggacgaatgtgtactgtgcgcacaggctttcggacagaggctcgctgaggagctggacgtccccgtctacctctacggagaagccgctaggatggatagccgacggacccttccggctatacgggctggggagtacgaggcactccccaagaaactgcagcaggctgactgggcgcctgattttgggccatcctcattcgtgcccagctggggagctacagctacaggtgctaggaagttcttgattgccttcaacatcaacttacttgggaccaaagagcaggcacaccgaattgcactcaatctgcgggaacagggacgcggtaaagaccagcctggcaggctgaaaaaagtgcagggaatcggttggtatctggacgagaagaatctcgcccaggtgtccacaaacctcttagatttcgaagtaactgcgctccatacggtgtacgaggagacttgcagggaagcccaagaactgtcattgcccgttgtgggctctcagctggtaggacttgttccgctcaaagccctcctcgacgcagcagccttctactgtgagaaagaaaacctgtttattttggaggaggaacagcgaatccggctcgtagttagtcgccttggtctggattctctgtgccccttttcccccaaagaaaggatcatcgagtatctcgtgcccgagcgcggaccggaacggggactagggtcaaaaagcttgagggccttcgtcggagaggtaggggctcgcagcgctgcccctggtggcggaagtgtagcagccgcagcagccgctatgggggcagctttggggagcatggtcggccttatgacctatggacgaagacagtttcagtcacttgacacgacgatgcggcgattaatcccccctttccgagaggcgtcagccaaactcaccacactggtagatgcggatgctgaggcttttacagcatatctcgaagctatgaggctgcctaaaaacactcctgaggaaaaggacagaaggacagctgccttgcaagagggcctcagacgagctgtgagcgtcccccttactctcgccgaaacagtggcttcgctgtggcccgcactgcaagaattggctcggtgcgggaatcttgcctgtcgcagtgatctgcaagtcgcggcaaaggccctggaaatgggcgtgtttggcgcttactttaatgtcctgatcaatctgcgcgacattaccgacgaagcatttaaagaccagcctcctgccggatctcaggatcctgggtgcacgggagccggtctcttaggtgaccccgctggagtgacagtgagagaggcctccccaggcagtgttgcgccaccctcgcccataccaagaggccagagttgcgatctagagacaccgggaactgctggaccgtctactctagaggggtag

SEQ ID NO: 223590 - DNA, 1488 bp, Artificial Sequence
  Description of Artificial Sequence: Synthetic coding sequence
atgtctcagctcgtggagtgtgttccaaattttagcgaggggaagaaccaggaggtaattgatgctatctcgggggctattacccagactcccggttgcgttctgttggacgtcgacgccggacccagtaccaaccgcactgtgtatacctttgtgggccctcctgagtgtgtggtcgagggggctctcaacgcagcgagagtggcttctaggctaattgatatgtctcgacaccagggggagcatcccaggatgggagctcttgacgtttgtcctttcattcctgtcagaggagtttccgtggatgagtgtgtgctctgcgcgcaagcattcgggcagagactggctgaggaactggatgtgcctgtctacctgtacggcgaagctgcacggatggattcccggaggacactgcctgccatacgcgctggcgagtacgaggcacttccgaaaaagctgcaacaagcagattgggccccagatttcggtccttcttcatttgtcccctcctggggcgcaacggcaactggggcacggaaattcctgattgcatttaacatcaacctcctgggcaccaaggagcaggctcatcggatagcacttaaccttcgggagcagggtaggggcaaagatcagcctgggcgtctcaagaaggtccaggggatcgggtggtacctggacgagaaaaaccttgcacaggtcagcactaatcttctcgacttcgaggtcactgccttacataccgtatatgaggagacgtgtagggaggcccaagaactgtcgttgcctgtcgttggctcacagctcgtgggtttggtacctcttaaagctctgctcgacgccgcagcgttctactgtgaaaaggaaaacctatttatactagaggaggaacagaggatcaggttggtggtgagtaggctcggacttgactcactgtgtccgttctctccaaaagaacgcataatcgagtaccttgttcctgaacgaggaccagagcggggtctgggctctaaatcattaagagcgttcgtgggggaggtcggcgctcgatcggctgccccaggcggaggttctgtggccgctgcagcagcagcaatgggggcagctctgggctccatggttggcttgatgacatacggaagacgccaatttcagtctcttgatacgaccatgcgaaggcttatccctccatttagggaagcttcagcaaagttgacaactctagtcgatgcagacgccgaggcctttaccgcttatttagctcatggaggcccaacaggaggctcagaagctgggtcactgtgcgcagctgacgcgggaggcgatggcggactggcagtggcgggtcccgcaggaaccggaccagtttgggaacctggcctgcctgtccgtccgcctgggggtggccagagcccaggggatggaagggtgtggcgtatttttcagcgcgcacaccagcccgaggggcaccataggcgtggaatatag

SEQ ID NO: 223591 - DNA, 1626 bp, Artificial Sequence
  Description of Artificial Sequence: Synthetic coding sequence
atgtcacagctcgtggaatgtgtgcccaacttctccgaggggaagaatcaagaagttatcgacgccatatccggagctatcacccagactccagggtgtgtcttgctggatgttgatgcgggtccatctacaaatagaacagtgtataccttcgtcggacctccagagtgtgtggtagagggagcattgaacgcagctcgagtcgcctctcgactgatagacatgagccggcaccaaggcgagcatccaaggatgggcgctcttgatgtttgtccgttcatccccgtgcgtggggtctctgtcgatgagtgcgtcctgtgtgcacaggccttcggtcagaggctagccgaggaactggacgtgcccgtttatctatacggagaagctgccaggatggactcccgtcggaccctcccggctattcgagctggagaatatgaagccctgcctaaaaagctccagcaagccgattgggcccctgactttggtccttcttcctttgtcccaagttggggggctactgctaccggggctcggaaattcttgattgcttttaatatcaatctattggggactaaagaacaggcccaccgcatagccttgaacctccgagaacagggcaggggcaaggatcagccgggaagattgaagaaagttcaaggaatcgggtggtacctcgatgaaaagaacctggcccaggtgtctactaatctcctcgattttgaagtgactgccttgcacacggtgtacgaggaaacttgtagagaggcacaggagttaagcctcccagtggtgggctcccagcttgtcggcctcgtccctctaaaggcacttctcgatgccgcagccttctactgcgagaaggagaatctcttcatcctcgaggaagaacagaggattcgcctggtggtgtctagactggggctcgatagcttatgtccttttagtcccaaagaacgaattatcgagtatctggtcccagaacgtggtccggagcgagggctcggttccaagagcctcagagctttcgtaggagaggttggggcaagaagcgccgcacccggaggaggatcagtggccgctgctgcggctgccatgggcgctgccttgggcagcatggtcggcttaatgacatatggcagaagacagttccaatcccttgatacgaccatgcggcgacttatcccaccgttccgtgaagcttccgcaaaactgacgactctagtcgacgccgatgctgaagcatttactgcatatctggaagccatgcgcctgcctaaaaacactccagaagagaaggatagaagaaccgccgcactgcaagagggactgcgccgtgcagtttcagtgcccctgacgctggccgaaaccgtcgcctctctgtggcctgcgctgcaggagctcgcaaggtgcggaaatctcgcatgccgcagtgaccttcaggtagcggcaaaggcgctcgagatgggggtgttcggggcttactttaacgtcctgatcaaccttcgagacatcaccgacgaggccttcaaagaccagattcatcaccgtgtttctagtctcctgcaggaggctaagacacaggcagcgctcgtgctggactgtttggaaacccggcaggaatag

SEQ ID NO: 223592 - DNA, 1719 bp, Artificial Sequence
  Description of Artificial Sequence: Synthetic coding sequence
atgtcccaactggtcgagtgcgtccccaacttttctgagggcaagaaccaagaagtgattgacgccatttccggagcgataacccagaccccaggctgcgtgttgctggatgtggatgctggcccatccactaatcggacagtgtacactttcgtcggacctccggagtgcgtcgttgagggcgctctgaacgctgccagggtggctagcagactgattgatatgtcacggcaccagggcgaacacccacgcatgggcgctctggacgtctgcccatttattcctgtcagaggcgttagtgtcgatgagtgcgtgttgtgtgcccaggcattcgggcagagacttgccgaggagcttgacgtgccagtttatctgtatggggaagccgcacgcatggattcgagacgaactctgccagctatccgggcaggtgagtatgaggctttaccaaaaaagttgcagcaagcagactgggcccctgattttgggccttcttcattcgtcccaagttggggggctaccgctaccggtgcaaggaaattcttgatcgcatttaacataaatttgctgggcacaaaagagcaggcacatcggatcgccctgaacctgagggagcagggcagaggtaaggatcaacccggaaggttgaaaaaagtgcagggcatcgggtggtacctggacgagaaaaacttggcccaagtcagtactaatttgttggattttgaagtcacggcactgcacaccgtgtacgaggagacatgtcgggaggctcaggaattgagtctgcctgttgtcggatctcagctggtcggactggtgcctctgaaggccctacttgatgctgccgctttttattgtgagaaggaaaacctgtttatacttgaagaagagcaacggataagattggtcgtttctcggctgggccttgatagcctgtgcccattttctcccaaagagaggatcatcgaatatcttgtgcctgagaggggcccagagcgtgggcttggctcaaagtcactcagggccttcgtgggtgaagtcggggcacgcagtgctgccccagggggtggcagtgtggccgctgccgcagccgcaatgggcgcagccctgggctccatggttgggttgatgacatacggaaggcggcaattccaaagtttggacaccacaatgcggagattgataccacccttccgtgaggcttcagctaagctgaccacactggtggatgcagacgccgaggcatttaccgcgtatctggaggccatgagactgccaaaaaatacacccgaagagaaggatagacggaccgccgctctgcaagagggactccgcagggccgtctcagtcccactgacactggcagaaaccgtggcctccctgtggcctgcactgcaggagctggccaggtgtgggaatctcgcctgtaggtcggacctgcaggtggccgctaaagccctggagatgggagtgttcggggcttactttaacgtgctgattaacctaagagacataacagacgaggcttttaaagatcagcccccagccggatcccaggatcccggatgcacaggtgctggccttctcggcgatcccgctggcgtgaccgtacgagaggcatctcccggttcagtggcgcctccttccccaatcccaagaggccaatcatgcgaccttgagaccccaggaactgctggtccatcaaccctagagggatag

SEQ ID NO: 223593 - DNA, 1779 bp, Artificial Sequence
  Description of Artificial Sequence: Synthetic coding sequence
atgagctggggcacggagctgtgggaccagttcgataacttagaaaagcatacgcaatgggggatagatattctggaaaagtatatcaagtttgtcaaggagcggactgaaatcgagttgtcttatgccaaacagctcagaaacctgagcaaaaagtatcagccgaagaagaattccaaggaggaagaggagtataagtacacgtcatgcaaagctttcattagcaacctgaacgaaatgaacgactatgcagggcagcatgaggtcatctcagagaatatggccagtcagattattgtcgatctggctaggtatgtgcaggagctcaaacaggaaagaaaaagcaactttcacgatggaaggaaggcacagcagcatatcgagacatgttggaagcagctggagagctccaaacgaaggttcgaaagagattgtaaggaggcagaccgcgcacagcagtattttgagaagatggacgcggatattaatgtgaccaaagccgacgtggaaaaggcccgtcagcaggcccaaatcaggcaccagatggccgaggatagtaaagctgactatagctcgattctccaaaagtttaatcacgagcagcacgagtactaccacactcacatccccaatattttccagaagatccaagagatggaggagcgacgtatcgttcgcatgggcgaatcaatgaagacgtacgccgaggtcgaccgacaggttatccccatcatcggaaaatgtttggatgggatcgtgaaagctgcagaatctatcgaccaaaagaacgatagtcaactcgtgatagaagcttataaatccggcttcgagccccctggcgacattgagtttgaagattacacacagcctatgaaacgtacagtctctgataactcgttgagtaactcccgcggagaaggcaagcctgacctgaagtttggcggaaaatctaaaggaaaactctggccttttattaagaagaataaatctccaaagcagcagaaggagcctctttcccatcggtttaatgaatttatgacctccaagccaaaaattcattgcttcagaagtctgaaacgcggacactctcttttaaagggggctacccctgaagattttagtaacctgcccccagagcaaagaaggaagaagctccagcaaaaggttgatgagcttaacaaggagatccaaaaggagatggatcagcgcgatgctattaccaaaatgaaggacgtctatctgaagaatccccaaatgggcgaccctgctagtctcgaccataagctagcagaagttagccagaatatcgagaagttgcgagtagagacgcagaaatttgaagcctggctggcggaggtggaaggaagactccccgctcggtcggagcaggccaggcgccaaagcggcctgtatgactcccaaaatcctccaactgtgaacaactgtgctcaggaccgggaatccccagacgggagctacacagaggagcagtcccaagagtcagagatgaaagtgctcgcaaccgacttcgacgatgaatttgacgatgaggaacccctcccagccattgggacctgtaaagcattatatactttcgaggggcagaatgaaggaacaattagtgtcgtggaaggggagactctgtatgtgatcgaagaagataaaggcgacggatggacaagaataagacgaaacgaggacgaggagggctatgtgcccacctcttatgtggaggtttgtctggataaaaatgcaaagggggctaagacttacatatag

SEQ ID NO: 223594 - DNA, 1854 bp, Artificial Sequence
  Description of Artificial Sequence: Synthetic coding sequence
atccgatggactgacgaactctgggaccagttcgataacctggaaaagcacactcagtggggcatcgatatcctggagaaatacatcaaatttgtcaaagagcggactgagattgaactctcctacgccaaacagctgaggaatctcagtaagaagtaccagccaaagaaaaacagtaaggaggaagaagagtacaaatacacatcctgtaaagcctttatttccaatcttaacgagatgaatgactatgctggacagcacgaggtgatttccgaaaacatggcatctcagattattgtagatcttgcccgttatgttcaggagctgaagcaagagcggaaatccaattttcacgatggccgaaaggcccagcagcacattgaaacctgttggaaacaattggaaagttcgaaaagaaggttcgagcgcgactgcaaggaggccgaccgggcacagcagtatttcgaaaaaatggatgccgacatcaacgtaacgaaggcggatgtggaaaaggcccgacaacaagcccagatcagacaccagatggctgaagattctaaggcggactacagcagcatcctgcaaaaattcaatcatgaacagcatgagtactatcatacacacattcctaacatatttcagaagattcaagagatggaagaaaggaggattgtgcgcatgggcgaatccatgaagacttatgctgaagtggatcgtcaggttattcccatcatcgggaaatgtctcgacggcatcgtcaaggcagctgaatccatcgatcagaaaaacgacagccaattggtgatcgaggcctataaaagtggatttgagccccctggtgatatcgagtttgaggattacacccagcccatgaaaagaaccgtgagcgacaattcactttcaaattcacggggagaagggaagcccgatctgaaattcggaggaaagagtaaggggaagctctggccttttattaaaaagaacaagctgatgtctctgcttacaagcccacatcaacctccacctcctcccccagcgagcgcctcgcccagtgccgtgccgaacgggcctcaatccccaaagcagcagaaagagcccttaagccacagattcaatgaatttatgacgtccaagcctaagatccattgctttaggtctttgaaaagaggacccagttttaaacaaggggcaactcctgaggattttagcaacctacctcctgagcaaaggaggaagaaactgcagcagaaagtggacgagttgaacaaagagatccagaaagagatggatcagagggacgctatcactaaaatgaaggacgtatatctaaagaacccacaaatgggggatcccgcatctctggatcacaagctggcggaagtcagtcagaatattgaaaagctgagggtggaaacacagaagttcgaggcttggctcgctgaggtggaagggagacttcccgcacgatccgagcaagctcgacgccagagcggtctatacgactctcaaaacccaccaacagtcaacaattgtgctcaagatagagaaagccctgacgggtcgtacaccgaagagcagagccaagagtccgagatgaaggttctggctacagacttcgatgatgaatttgatgatgaggaacctctaccggctatcgggacttgtaaagcgctctatacctttgagggccaaaatgagggtaccatctctgtcgttgaaggtgagacactatacgttatagaagaggacaagggggacggctggacaagaatcagaagaaacgaagacgaggagggttacgtccccacatcttatgtggaggtttgcttagacaaaaatgcgaaggacagttag

SEQ ID NO: 223595 - DNA, 1854 bp, Artificial Sequence
  Description of Artificial Sequence: Synthetic coding sequence
atgtcttggggcacagaactgtgggaccagttcgataacctggagaaacacacacagtggggaatagacattctagaaaaatatattaagttcgtaaaggagaggacagagattgaactctcctatgcgaaacaactaaggaatctaagcaagaaataccagcctaagaagaacagtaaggaggaggaagaatataagtacactagctgtaaggcttttatcagcaacctgaacgaaatgaacgattacgcaggccagcacgaagtcataagtgagaacatggctagtcagatcatagtcgatctggcgaggtacgtacaagaactcaagcaggaacgtaaatctaattttcatgacggcagaaaggctcagcaacatatcgaaacctgttggaaacagctggagtcgagcaaaaggcgcttcgagcgtgactgtaaagaggcggaccgagcccagcagtattttgagaagatggacgctgatatcaacgtgaccaaagccgacgtggagaaggccaggcagcaagcacaaattcgtcatcagatggccgaagattcaaaagccgactattcatctatcctccagaagttcaaccacgagcaacacgagtattatcacacacatatccccaatatctttcagaagattcaggagatggaagagagaaggatagtgcgcatgggggagtcaatgaagacctacgctgaagtggataggcaagtcatcccgattatcggcaagtgtttggatggcatcgtgaaggccgcagaatccattgaccagaaaaacgattcacagctcgtcattgaggcttacaagtccggattcgagccaccaggagacattgaatttgaagattatacacagccgatgaagcggacggtgtctgacaattctctgtccaattcgagaggagagggaaagccggacttgaaattcggaggaaaaagcaaggggaaactgtggcctttcattaagaagaataaactgatgtctctgctgacctctcctcatcagcccccaccccctcccccagcatccgcctcacccagcgctgtccctaacggccctcaatccccaaagcagcagaaagagcctctcagtcacagattcaacgagttcatgacctccaaacctaagattcattgctttaggtccctaaaaagagggcattccttactgaagggggcaacacctgaggatttcagtaacctaccacctgagcagcggagaaagaaactgcaacagaaagtggacgagctcaacaaagagattcagaaagaaatggaccagcgagatgctatcaccaagatgaaggatgtctatcttaagaacccacagatgggggacccggctagcctggatcataagctcgcagaggtgagtcaaaacattgagaaactcagggtcgagacccagaagttcgaggcctggctggctgaagtggagggcaggctccctgctagatctgagcaggcccgaaggcaatctggcctgtatgacagccagaatcccccaactgtaaataattgcgcccaggatcgagagtccccagatggtagctacaccgaggagcaatctcaggagtccgagatgaaggtcctggccaccgactttgatgacgagttcgacgacgaagaacctctacccgcaatcgggacctgcaaggccctgtacactttcgaaggccagaacgagggaacgatcagcgtggtggaaggcgagacgctgtatgtcattgaggaagacaagggcgatggctggactagaatccgcaggaatgaggatgaggaaggatatgtgccaaccagttacgtcgaggtatgcctggataagaatgctaaagactcctag

SEQ ID NO: 223596 - DNA, 1827 bp, Artificial Sequence
  Description of Artificial Sequence: Synthetic coding sequence
atgtcctgggggacagagttatgggaccaattcgataacctggagaagcacactcagtggggcattgacattctggagaaatacatcaaattcgtgaaggaaaggacagaaattgaattgagctatgcaaagcaactccgtaacctgagtaagaaataccaacctaaaaagaacagcaaagaagaggaagaatacaagtatacgagttgcaaagctttcattagcaacctgaatgaaatgaacgattatgcgggtcagcacgaggtgatatccgaaaacatggcctcccagatcattgtggatctagcgcgatacgtccaggaactcaaacaggaacgtaaaagcaacttccacgacgggagaaaagcacaacagcacattgagacatgctggaagcaattggagtccagtaaaagaagattcgagcgcgactgtaaagaagccgaccgcgctcagcagtattttgagaagatggatgcagacattaacgtcactaaagccgacgtagagaaggctcgccagcaggcacaaattagacatcagatggccgaagacagcaaggctgactacagtagtatcttacagaaattcaatcacgaacagcatgaatattaccacactcatataccaaacatctttcaaaaaatccaggaaatggaggaacggaggatagtgcggatgggggaatctatgaagacatatgcggaggtcgacagacaagtaattccgattattggcaaatgcctggatggtattgtgaaggctgcagagagcatcgaccagaagaatgacagtcagctggtgatcgaggcctacaagtccggctttgagcctcccggtgatatagagtttgaagattacacacagcccatgaagagaacggtgagcgataacagtctctcaaactctaggggggaggggaaacccgacctgaaattcgggggtaaatccaagggaaagctttggccgttcatcaaaaagaacaagccaccaccgcctccgcctgccagtgctagcccatccgctgttccaaatgggccacagtctccaaagcagcagaaagaacccctgagccaccgctttaatgaattcatgacctccaaaccaaagattcattgcttccgatcactgaagcggggacatagcctcaccctgcaaggagctacccctgaggattttagtaatctgcccccagagcagcgacgcaagaaactgcagcagaaggtcgacgaattgaataaggagatccaaaaagaaatggaccagagggatgctatcactaagatgaaggatgtgtatctgaagaaccctcaaatgggcgatcccgctagtcttgatcataagttggccgaggtctctcaaaacatcgagaagttacgcgtagaaacccaaaagtttgaggcatggctcgcagaggtagaaggcaggttgccagcaaggagcgaacaggcgcgaaggcagtctggtttatatgattcgcaaaaccctcctaccgtgaataattgtgcacaggatagagaatcacccgacggcagctataccgaggaacagtcccaggaaagtgagatgaaggtattggccacagattttgacgacgagttcgatgatgaagaacccttgcctgcaattggtacatgcaaagcgctgtatacgtttgagggtcagaacgaagggacgataagcgttgtggaaggggagactctatacgttatagaggaagataaaggcgatggctggacccggattcgcaggaatgaagatgaagagggttacgtacctacttcctatgtggaagtgtgtctggataagaacgcgaaggacagttag

SEQ ID NO: 223597 - DNA, 738 bp, Artificial Sequence
  Description of Artificial Sequence: Synthetic coding sequence
atgaagcgcaccatagggaaacccacctatgcattcgaggctagggattacgtgctgtccctcaagctgggagcgaccccggaggattttagcaacctgcccccagaacagcgcagaaagaagttgcagcagaaagtggatgagcttaacaaagagattcagaaggaaatggatcagcgtgatgccatcactaagatgaaggatgtgtacctgaaaaacccccagatgggggatccggcatcccttgatcacaaactggcggaagtgagccagaatatagaaaaacttcgtgtcgagactcagaaattcgaagcatggttagccgaggtggaggggcgactgccagctaggtccgagcaagcgcgtagacagtctgggctgtatgacagccaaaaccctccaaccgtcaataactgtgcccaagacagggagagccctgatggcagctacaccgaggaacagtcccaggagtctgagatgaaggtgctggctaccgactttgacgacgagttcgatgacgaggaaccactacctgccatcgggacctgcaaggcactgtacacttttgaaggccaaaatgaaggcacaatcagcgtggtggaaggtgagacattgtatgttatcgaggaggacaaaggtgatggctggactcgaataagacggaatgaagatgaagagggatacgtgcccaccagctatgtggaagtctgtttggacaaaaatgccaaggactcctag

SEQ ID NO: 223598 - DNA, 1854 bp, Artificial Sequence
  Description of Artificial Sequence: Synthetic coding sequence
atgtcatggggtaccgaactttgggatcagtttgacaatcttgaaaagcacactcaatgggggatcgatatccttgaaaaatatatcaaattcgtgaaagaacggacggagattgaattatcttatgccaagcagctgcggaatctttccaagaagtaccagcctaagaagaactcgaaggaggaggaagagtacaagtatacctcttgcaaagcctttattagcaatttaaatgaaatgaatgactacgctgggcagcacgaagtgataagcgaaaatatggccagtcagataatcgtggacctcgccaggtacgtccaggagctaaagcaagaacgtaagtcaaactttcacgatggcagaaaggcccagcagcatatcgaaacatgctggaaacagttggagtcaagtaagaggaggtttgaacgcgactgcaaggaggctgatagagctcagcaatactttgaaaaaatggatgccgacattaacgtcactaaggcagatgttgagaaggctcgtcaacaggcccagattaggcatcagatggccgaagacagcaaagccgactactcgtctattctccagaagttcaatcacgagcaacacgaatattaccatactcatatccccaacatattccagaaaatccaggaaatggaggagcgcaggatcgtccgtatgggagagtcaatgaagacttacgctgaagtagatagacaggtaatcccaatcataggcaagtgtctcgacgggatcgttaaggccgctgagagtatcgatcagaagaatgacagtcagttagtcattgaggcctataagtcagggtttgagcccccaggagatatcgaattcgaggattatacccagcctatgaaaagaacggtttccgataatagcctgtccaactcccgaggtgaaggaaaacccgacctgaagttcgggggtaaaagcaagggcaaactgtggccattcataaagaagaacaaactgatgtcactgctaacatccccacaccagccacccccacccccacccgcttcggcgtcaccttccgccgtgcctaacggaccacagagcccgaaacaacagaaggagccccttagccataggtttaatgaatttatgacatccaagcctaaaattcactgttttcggtctctcaagagagggttgtctctgaagttgggcgctacacccgaggattttagcaatttacctcccgagcagaggaggaagaagcttcagcagaaagtcgatgaacttaataaggaaatccagaaagaaatggaccagcgggacgcaattacgaaaatgaaggacgtctatttgaagaatccacagatgggcgatcctgcctcactcgaccataaactggccgaagtcagccaaaacattgagaagctgcgcgtggaaacacagaagttcgaagcttggctcgcagaggtggaaggaagactgcccgctaggagcgagcaggctagacggcagtctggcctctatgactctcagaatcccccaacagtgaacaattgcgcacaggaccgagagtcaccagatgggagctacactgaagaacaaagtcaggaaagtgagatgaaggttttggctaccgatttcgacgatgagtttgatgacgaggaacctctgcccgcaattggtacctgtaaagcactctacacattcgaagggcagaatgaaggaactatcagcgttgtcgaaggggaaaccctgtacgtcatcgaggaggacaagggggatggatggacccgaattaggagaaacgaggatgaggaaggatacgtccccacctcttacgttgaggtgtgcctggacaaaaacgctaaagactcctag

SEQ ID NO: 223599 - DNA, 1722 bp, Artificial Sequence
  Description of Artificial Sequence: Synthetic coding sequence
taactcagttacgctaagcaactgcgcaacctcagtaaaaagtaccagcccaagaaaaattccaaggaagaggaagaatataagtacacaagttgtaaagcatttatcagcaacttgaatgagatgaacgactatgctgggcagcatgaagtcatttcagagaatatggcctcccagattatagttgatctggcacgatatgtgcaagagctgaagcaagagcgaaagtcgaatttccatgatggacgcaaagcccagcagcacatcgagacctgctggaaacagcttgaatcgtcaaaacgcagattcgagcgcgattgtaaggaggctgatagagcccagcagtacttcgaaaagatggacgcagacattaacgtgaccaaggcagatgtcgaaaaggccaggcagcaggctcaaatacgccatcagatggctgaagattccaaggccgactatagtagcatattgcagaaattcaatcatgagcagcacgaatattatcacacgcacattcccaatatattccaaaagattcaggagatggaggaacgcaggattgtgcggatgggtgaatctatgaaaacttatgccgaagtggatcggcaagtgatccctattatcggtaaatgcctcgacgggatcgtgaaagccgctgagtcgatcgatcagaaaaacgactcacagctcgtgatagaggcgtataaaagcggcttcgagccacctggagacattgaattcgaggattacacccaacctatgaagaggacagtctccgacaactcattgagcaatagccgtggcgaaggcaagccagacctgaaatttggagggaaatccaagggcaaactgtggcctttcattaagaaaaataaaccccctcctcctccccctgccagtgccagccctagtgctgtgcccaacggccctcagtctccaaagcaacagaaagagccattatcccacaggttcaatgagttcatgacctcaaaacccaaaatccactgttttcgtagcttgaaaaggggccacagcctgctgaaaggagcaactcccgaggacttcagcaatctgccgcctgaacaaaggagaaagaagttgcagcaaaaggtggatgagctcaataaggagatacagaaggaaatggatcagagggatgctatcaccaaaatgaaggacgtttatctaaaaaatcctcagatgggtgatcctgcctctttagatcacaaactggccgaggtgtctcagaacatcgagaagctgagggtcgagactcagaagttcgaagcttggctcgccgaagtcgagggacgacttcccgctagatctgaacaggccaggcgccaaagcggtctgtacgatagccagaatcctcccaccgtgaataattgtgctcaggacagagaaagcccagatggcagttatacagaggagcaaagccaggagagcgaaatgaaagttcttgctacagattttgatgacgagtttgacgatgaagagcctctccctgctattggcacttgcaaggcgttgtatacgttcgagggacaaaacgaaggtactatttcagtagtcgagggggaaactctctatgtcatagaggaagacaaaggagatggttggactcgtattaggagaaatgaggatgaagaaggatacgtgccaacaagctatgtggaagtgtgtctagacaaaaatgcaaagggcgcaaaaacgtatatctag

SEQ ID NO: 223600 - DNA, 3495 bp, Artificial Sequence
  Description of Artificial Sequence: Synthetic coding sequence
atggccggtggggaggatcggggtgacggggagcccgtgtccgtcgtcaccgttcgggttcaatatctcgaggacacagaccccttcgcctgtgctaattttcccgaaccgagacgggctccgacctgttccttggatggggctctcccactgggggcacaaattccagctgttcataggttgcttggagcccctctcaaactcgaggattgcgccctgcaggtgtctccgtcaggatactatcttgacaccgaattgtccctagaagaacagcgagaaatgctggaggggttttatgaagagatttccaaggggcgaaagcctaccctgatcctgagaacacagttaagcgtgcgcgtgaatgccatccttgagaagctgtactcatctagcggaccggagctccggcgatctttgttcagtttgaagcagatctttcaagaggataaagatcttgtgccagagtttgtccactcagaggggctgtcctgcctgatccgggtcggggcagctgccgaccataactaccagtcttatatcttgcgggctctcgggcagctcatgctgtttgtcgacgggatgctcggagtagtcgctcacagcgacacaatccagtggttatatacactctgcgcatcactctccaggctggtggttaaaaccgcgctgaaacttctgttggtgtttgtggagtactctgagaacaacgcacccctgttcattagggctgtgaatagtgtggcttcaactacaggggcacccccttgggcaaacctggtcagcattttggaggagaaaaatggggctgacccagaactcctcgtctacactgtgacattgatcaacaagacattggccgctctgccggaccaagacagtttctatgatgttaccgacgctctggaacaacaaggcatggaggcccttgtgcaacggcaccttggcactgcaggtacagatgtggacctccggacccagctggttctctacgaaaatgcacttaagcttgaggacggggacatcgaagaggctccaggagcaggaggacgcagggagcggaggaaacctagtagcgaagagggcaaacgcagccgacgtagcctcgagggaggagggtgccctgcgagggcccctgagcctggccctaccggtcctgcttcccctgtgggccctacatcctctaccggccctgctcttctcacaggtcccgcatcctcccccgtgggccctccttcaggcctgcaggcttccgtaaacttgttccccacaatttccgttgccccttcggcggataccagcagcgagagaagtatttacaaagcacggttcctggagaatgtcgcggctgcagagactgagaaacaagtagcactggcccaaggaagagccgagacacttgcaggcgcaatgcccaacgaggcaggcggacatcccgacgcccgtcagttgtgggacagccctgaaaccgccccagctgccaggacacctcaaagtcccgcaccatgcgtcctcctccgggcacagcggagcctggcaccggaacctaaggagcctcttatcccagcaagcccgaaggccgagcctatatgggagttgccgactagagcacctcgtcttagtattggggatcttgacttttctgaccttggcgaggatgaggaccaggacatgctgaacgtcgaatccgtggaggctggaaaagatatacctgcgccatccccaccgttgccgttattgtccggtgtcccaccgcctcccccactgccaccgccaccccctataaagggtccttttcccccaccccctccactcccattagcggcaccactacctcattccgtaccagatagctcggcccttccaacaaaacgcaagactgtgaagctattctggagagagttgaagctggccggtggccatggagtgtccgcctcacggttcgggccatgcgcaactctgtgggcatcactggacccagtctcggtcgacacggctagactagaacatctgtttgagtctagggcaaaggaagtcttgccttctaagaaggccggagagggaagaagaacaatgactactgttcttgatcccaagaggtctaatgccatcaacataggcctgacaacattgccacctgttcacgtaatcaaggcagcactattgaatttcgatgagttcgccgtatcaaaagacggcatcgagaagctccttaccatgatgcctacagaagaggagagacagaaaatagaggaagcacaacttgctaatccagacattccgctgggcccagccgagaactttctgatgacgctcgcctccatagggggtctggccgcacgtttgcagctgtgggccttcaagttggactacgattcaatggagcgcgaaattgccgagcctctcttcgacttgaaagttggcatggaacagctggtgcagaatgccacctttcggtgcatcctggctaccttgctggcagtgggcaattttctgaatggttcccaatcatctgggtttgagctctcctacctggagaaagtatctgaagtgaaggatacagtccgcaggcagtcactgctacaccacctgtgctctttagtgctgcagacgcggccagagagctccgatctctatagcgaaatcccggctctgactcgatgtgctaaggtcgacttcgagcaacttaccgagaatctggggcagctggaaagacgctcaagagccgctgaggagtccctgcgctcgcttgccaagcacgaacttgcgccagccttgcgggctagactcacgcactttctggaccagtgcgctagacgggtcgccatgctccgtatcgtccaccgtagggtgtgtaaccgatttcatgcttttcttctctatctggggtataccccccaagccgcaagggaagtgagaatcatgcagttttgtcacaccctgcgggagtttgccctcgagtatcggacctgtcgagaacgggttcttcagcagcagcaaaagcaggcgacgtaccgggagcggaacaagactcgcggtagaatgattacggagaccgagaagtttagcggcgttgctggcgaggctcctagtaatccttctgtgcccgtggccgtttctagtggacccggaagaggtgacgcggactctcatgcaagcatgaagtctttgctgaccagccgcccagaagacaccacccacaaccgacgcagcagggggatggtgcaatcctcgtccccaattatgcccacggtcggccctagcaccgcctcaccggaagagccccctgggtccagcttgccctcagataccagtgatgaaataatggacctattagttcagtcagtcactaaatcctccccgagggcactggctgcaagagaacggaagcgatcccggggaaaccgcaagtcgctccgaagaaccttaaaatctggattaggcgacgatctggttcaggccctcggcctaagcaaaggcccaggactggaggtttag

SEQ ID NO: 223601 - DNA, 4320 bp, Artificial Sequence
  Description of Artificial Sequence: Synthetic coding sequence
atggccacgctggcttgtagagtgcagtttcttgatgacaccgacccatttaactctactaatttcccagaaccatccagaccacctctatttacctttagggaggacctcgcattgggcactcaattagcgggagtgcaccgccttctccaggctccccacaagctggacgattgcaccctgcaactcagtcacaacggcgcataccttgatttggaggccaccctggctgagcaacgggatgaattagaaggcttccaggatgatgcgggtcgcggaaaaaagcatagtattatcctgcgcacacagttgtccgtccgcgtccacgcctgcatcgaaaaattgtataatagttccggcagggatttacgacgcgctttattcagcctcaaacaaatttttcaggatgacaaggacctggtacacgagtttgtggtagccgaagggctcacctgcttgatcaaggtgggggcagaggcagaccaaaactatcagaactacatccttcgcgcacttgggcagatcatgctgtacgtggacgggatgaacggcgtcatcaatcggaatgaaacgattcagtggctctacactcttataggatcgaaatttcgcctcgtcgtgaaaactgcactgaagttgcttctggtcttcgtagaatattctgagtccaacgccccattgttgatacaggccgtaaccgccgtggatactaagcggggtgtaaagccatggtcgaatatcatggaaattcttgaggagaaagatggcgtggacacagaactcctggtatatgccatgactctcgtgaataagaccttgtcaggcctccccgaccaagacaccttttatgatgtggtggattgtctcgaggagctgggaatcgcagcagtctcacagcgccatctgaataaaaagggaacagatctcgacttagtcgagcaactgaatatttatgaggtggccctccggcacgaagatggagatgagaccactgaacctcccccatccggctgtcgcgacaggcgcagagcatcagtgtgctcttccgggggtggcgagcaccggggtcttgaccgaaggcgctccagaagacacagcgtccagtccatcaaatcgaccttaagcgcacccaccagtccctgctcccagtctgcgccttcgttcaagcctaaccaggtgagggacctgagggaaaaatactccaacttcggcaataacagttatcattcgtcaagacccagtagcggaagcagcgtgccaactaccccgacctcatcagtgtcacctccacaggaggccagactggagaggtcttctccgagcgggcttctgacaagctcgtttcgccagcatcaggaaagcctcgccgcagagagagagcggcgtcgccaagagcgagaggaaaggctacagcggatcgaaagggaagagaggaacaagttctctagggattaccttgacaagcgcgaggaacagcggcaggccagggaggagaggtacaagtacctagagcagctcgccgctgaagaacacgagaaggagttgagaagtaggagcgtgtccaggggcagggcagacctctctctagacctcacgagccccgcagcgccagcttgcctggcccctttgtctcatagtccatcatcttcagatagccaagaagctttgaccgtgtccgcaagctccccaggcactccacatcatccccaggcctccgcaggagatccagaaccagaatcagaggccgaacctgaggccgaggctggcgcagggcaggtcgcagatgaggcgggacaggacatcgcaagtgcacacgaaggtgccgagaccgaggtggagcaagcgctcgagcaagagccagaggaacgagcctcattatctgaaaaagagaggcagaatgaaggagtaaacgagagagataattgcagtgcaagttctgtctcgagttcgagtagcaccctcgaacgtgaagaaaaagaggataagctgtcccgcgatcggactacgggattgtggccagctggcgtgcaggatgctggtgtcaacggtcagtgcggggatatactcactaacaaacggttcatgctcgacatgctttatgcccacaaccggaagtctccggatgatgaggagaagggggacggagaagccggaaggacccaacaggaggccgaagcagtagcatccctggccacgcgcatatccacgctccaggctaactctcagacacaggacgaaagcgtgcggcgtgtggatgtcgggtgtttagataaccggggtagcgtgaaggcattcgctgagaagttcaattccggagatttgggccgaggatcaattagccccgacgccgaacctaatgataaggtgcctgagactgcccctgtacagcctaagaccgagtcagattacatctgggatcagctcatggcaaaccctcgagagttgcggattcaggatatggattttacagatcttggcgaagaagatgacattgacgtcctggacgtggatctgggccacagagaagcccctggaccccctcctcctccgccaccgacctttctggggctgccaccccctcctccgccaccgttgctggattccatcccaccccctcccgttcctgggaatttgttagtgcccccacccccagtgtttaatgccccacaaggacttggatggagccaggtgccgagaggtcagcccacctttactaaaaaaaaaaagactatcagacttttctggaatgaggtgcgcccatttgactggccatgcaaaaataatcggaggtgccgggaattcctgtggtctaagctggagccaattaaggtcgacacctctaggctggaacacttgttcgagtccaagagcaaagagctcagcgtcagtaaaaagactgcggctgacgggaagcgacaagaaattattgttcttgactccaaacgcagcaacgccattaatatcgggcttacagtgttgccacctccacggaccattaagatcgccattttgaacttcgatgaatacgctctcaacaaggaggggattgagaagatcctcacaatgattccaacagatgaggaaaagcagaaaattcaggaggcccagctcgctaatcccgagatcccactagggagcgccgaacaatttctgctgaccctcagctcaatttctgagctctctgcgaggttacacctgtgggcattcaaaatggattatgaaaccaccgagaaggaggttgctgagcccctcctggacctgaaagaaggaatcgatcagcttgaaaacaacaaaaccttgggtttcatcctcagtactttgctggcaataggcaactttctgaacggcacgaacgcaaaggcctttgagctcagttaccttgagaaggtgccagaagtgaaagataccgtccataaacagagcctgcttcaccacgtttgcacaatggtggtcgagaattttcccgattcttctgacttgtattccgaaatcggcgcaattactagatccgccaaagtggatttcgatcagctccaggacaatctctgccagatggaaaggcgttgcaaggcttcctgggaccatctgaaagcaattgccaaacacgagatgaaaccggtgctgaaacagaggatgagtgagtttctgaaagactgtgccgaacggataatcatacttaagattgtgcatagacggattataaatcgtttccactccttcttactgttcatgggacacccgccttatgccattcgcgaggtgaatataaataaattctgtcgtattatttccgaatttgccctggaatacaggaccacgcgagaacgggtgcttcagcagaagcaaaagagggccaatcaccgcgaacggaacaagactcgaggaaagatgatcaccgactccgggaagttttccgggtcgtctccagccccaccttcacaaccccaagggctaagctacgccgaggatgctgcagagcacgaaaacatgaaagctgtattgaagactagcagcccaagcgtagaggatgccacacccgctttgggagtcagaacaaggtcacgcgcttcccgcggaagcacctctagttggaccatgggtaccgatgattctcccaatgtgacagacgacgcggcagacgagatcatggatagaatagtaaaatcagccacccaggtgcctagtcaacgtgtggtgccgagagagcgaaaacgctctcgtgccaaccggaaatcgctgcgacggaccctcaaaagcggcctcacgccagaggaagcgcgtgcactgggcctggtcggtacctccgaacttcagctttag

SEQ ID NO: 223602 - DNA, 4269 bp, Artificial Sequence
  Description of Artificial Sequence: Synthetic coding sequence
atggccactctggcttgtcgggtacagtttcttgacgacacagatccgttcaatagtactaactttcccgagccaagcagaccacccctttttacattcagggaagatctggcattaggaactcagctcgcaggcgtccaccgtctgcttcaggcgccacacaagctagatgactgtactctccagctttctcacaatggcgcatatttggatttggaggcaaccctggccgagcaacgagatgaactggaagggtttcaagatgacgccggaaggggcaaaaagcattcgataatactgagaactcagctctcagtgagggtccacgcttgcattgaaaagctatacaattccagtggaagagacctgagacgcgcactcttcagccttaaacagatatttcaggatgacaaggacctggtgcacgagtttgtcgtggcagagggcctcacctgcttaataaaagtgggagcagaagccgatcaaaactatcagaattacatcctgcgggctctggggcagattatgctatacgtggacgggatgaatggagtgatcaatagaaacgagacaattcaatggctttataccttaattggtagtaaattccgcctggtcgtcaagactgctctcaagttactgcttgtgttcgtggagtatagcgaatccaacgccccacttctgatccaggcagttaccgcagtggacacaaaacgaggagtgaaaccctggagcaacatcatggagatccttgaagaaaaagacggagtggatacagagctcctcgtttacgctatgaccctcgtgaacaagaccctgtctgggctcccagaccaggatacattttatgacgtggtcgattgcctcgaggagctgggaatagccgcagtcagccaacggcatctcaacaagaaggggaccgacctggatctcgttgagcaactgaacatctatgaagtcgccctgcgtcatgaggacggggatgaaaccacagagccaccccctagcggatgtcgcgaccggagaagggccagtgtttgttcatcggggggtggtgagcatcgtggcctggatagacgcaggtctcgccgacattccgtgcagtcgattaaatcaactttaagtgctccgacatctccctgcagccagagcgcgccttccttcaaaccgaatcaggttagagacctgagagaaaaatacagtaattttggaaataattcctatcacagctctagaccctccagcgggagctcagtgccaactacacctacctccagcgtctccccaccccaggaagctcggcttgagcgcagttcaccttccggcctcctcacctcttcatttcgccagcaccaggagagcctagccgctgagcgagagagacggagacaggagcgggaggaaaggctgcagcgaatcgagagagaagagcgaaataaatttcgatacaagtacctggagcaacttgctgctgaggagcatgaaaaggaactcaggtccagatctgtgagcaggggaagagcagatctgtctctggacttgacctctccagccgctccagcgtgtttggccccactctcacacagcccttcctctagcgatagccaggaagcgctgactgtttctgccagctccccaggaacacctcaccacccccaggcttccgcaggagatcccgagcctgaatccgaagcggaaccagaggccgaggcaggtgccggacaggtggccgacgaggccggacaggatattgcctccgcacatgagggcgcagagactgaggtggagcaggccctggagcaggagcctgaggagagggctagtttgtcggagaaagaaaggcagaatgaaggcgtaaatgagcgcgataactgtagcgcatcctccgtgagctcttcttcttccaccctggaaagggaggaaaaagaggacaagctcagccgagatagaacgaccgggttatggccggctggtgtgcaggatgcaggggtcaacggacaatgcggcgacattttaaccaacaaaagattcatgctggacatgttatatgctcacaaccggaaatctcctgatgatgaagaaaagggcgacggggaagctggcaggactcagcaggaagccgaggccgtggctagtctggcaacccgcattagcaccctgcaagcgaactcccagacccaggacgaatcagtgcgtagggtcgacgtgggctgtctggataacagaggctccgtaaaggcatttgctgaaaagtttaattcaggagacctggggaggggttctatatcacctgacgcagaacctaacgacaaagttccagagaccgccccagttcagcccaagaccgaaagcgactatatctgggaccaactgatggccaaccctcgggagctacgtatccaagacatggacttcactgatcttggcgaggaagacgatatagacgtgcttgacgtagacctcggccacagagaagcgcctggtccgccacccccacccccacctaccttcttgggtctaccacccccaccacctccacccctcctggattcaatcccccctccaccagtgcctggcaaccttttagttcctccacccccagtgttcaatgcccctcagggacttggttggtcacaggttcctagggggcagcctacgttcaccaaaaaaaagaagacaatacggttgttctggaacgaagttagaccattcgattggccttgcaagaacaaccggcgttgtcgtgagtttctttggagcaagctggagcctatcaaggtggacacctctaggttagaacatctgtttgaaagtaaatcaaaagaactgagcgtgtctaagaagacggcagcagacggaaaaagacaggaaatcattgttctggacagtaaaagatcgaacgcaatcaacatcggactgacagtcctgcccccacctcgcacaatcaagatcgccattctaaatttcgacgaatacgccctgaataaagaggggatcgagaagatactcacaatgatccccaccgatgaagagaaacagaaaatacaagaggctcagctggccaatcccgaaattcctcttggtagtgcagaacagtttctgcttacattgtcgagcatcagcgaactctccgctcgcctgcatttgtgggcttttaaaatggattatgagaccacagaaaaggaggtggccgagcccctcctcgatcttaaggaaggcatagaccaacttgaaaacaataagacactgggcttcatactgtccacacttctggcaatcggaaacttcttaaacggaacaaacgccaaagccttcgaactttcttatctagaaaaagtccccgaggtcaaggatacggtacacaagcagagccttctccatcacgtctgcacaatggtagtagagaatttcccagattcatctgatctctacagcgaaattggcgctattacacggtctgccaaggtggactttgatcagttgcaggacaacctctgccagatggaacggagatgtaaggcctcctgggatcatctaaaggcaatagcgaaacacgaaatgaaacctgtccttaaacagcgcatgtccgaatttctcaaagattgcgctgaacgaatcatcatcctgaagatcgtgcatcggaggattatcaatagattccactcatttttactgtttatgggccacccgccatacgcaatacgggaggtcaacattaataaattctgtcggatcattagcgaattcgcactagagtataggacaacccgagagagagtgcttcagcaaaagcagaagcgggctaatcaccgcgagcggaataagacccgaggaaaaatgattacagatagtgggaagtttagcgggtcatcccctgctcctcctagccagcctcaagggctgtcctacgctgaggacgcagccgaacacgaaaacatgaaggcagtgctcaagacgagctctccctcagttgaagacgcgacacctgccttaggggtgcggactagatccagggcctctcgtggatccacttctagctggactatggggacagatgactctccaaatgtcactgacgatgccgcagatgagataatggatcgtatcgtcaaatcagcaacgcaggttccgtcgcagagggtcgtgcctcgtgaacgaaagcgatcccgggcaaacaggaaatccctgcggcgaaccctgaagagcggcttgacgccagaagaagcacgcgcactggggcttgtcggaaccagcgagctgcagctctag

SEQ ID NO: 223603 - DNA, 4206 bp, Artificial Sequence
  Description of Artificial Sequence: Synthetic coding sequence
atggccacacttgcttgccgtgtacagtttctggatgataccgacccctttaattctacaaacttccccgagccctctcgaccaccactgttcacgttccgggaagatctcgcattggggacccagctggcaggcgtacaccggcttctgcaggcaccccataagcttgacgactgcacgctgcagctgtcacacaacggcgcatacctcgacttggaggctacattagctgaacaacgcgatgaattggagggattccaggatgacgccggtcgtggtaaaaagcactcaattattttgagaacgcagctgtccgttagagtccacgcctgcattgaaaagctctacaatagctctggcagagacctgcggagagccctcttttcccttaaacagatctttcaggatgacaaggacttggtccacgagtttgtggttgccgaaggcttaacatgtctgattaaagtgggagcagaagcggatcagaattatcagaactatatcctgcgcgctttaggccagattatgctgtacgtggacgggatgaacggtgtaattaataggaatgagacaatccagtggttgtatactcttatcggatcgaagtttcgactggtggttaagacagccctgaagttgctgctggtatttgtggagtactcggagtctaatgcaccgcttctaatccaagccgtgaccgcagttgatacaaagaggggcgtcaaaccatggagtaatattatggagatcctggaagagaaggacggtgtggatacagagcttctagtatacgccatgaccttggtcaacaagaccctgtccggattgccagaccaggatactttctacgatgtggttgattgcctcgaagagctcgggatcgctgctgtgtcgcagagacacctgaataagaaaggtactgacctggatcttgtggagcagctgaacatttacgaggtagcactaaggcacgaagacggcgatgaaacgaccgaaccacccccaagcggctgtcgtgatcgccgaagggcctcagtgtgctctagcggcggtggggagcaccgcggtctggatcgacgcagatcacgaagacattccgtacagagtatcaagtctaccctgtcagctcctactagcccgtgcagtcagtcagccccaagctttaagcccaaccaggtgcgcgatctgcgggaaaagtctagcccctctggcctactgacttcctcatttagacagcaccaagagagtctcgccgctgaaagggaacggcgtcgtcaggagcgggaagaacgcctccagcggatcgaaagagaggagcggaacaaattttctcgggattacctcgacaagagggaagaacagcgtcaagctagagaggagagatacaaatacctggaacagctcgcggcagaagaacatgagaaggagctgagaagccgaagcgtatcgcgtggtcgggctgatctctcactggatctgacaagccctgcagcgccagcatgccttgcacctctgagccactcccctagttcttcggattcacaggaggcacttactgtatccgctagcagccctggaactccacatcacccccaggcttctgccggagatcccgaaccagaaagcgaggctgagccagaggccgaggccggagccggacaggtggcagatgaagccggacaggacattgcctccgcacatgagggcgcagagactgaagtggaacaggccctggaacaggagcccgaggaaagggcttcactgtccgagaaggaacgtcagaacgaaggggtgaacgaacgtgacaattgctcggccagtagtgtgtcaagttcaagcagcacactcgagagggaggaaaaggaggacaaactgtctagggaccgcacaaccgggctgtggccagcaggagtccaagatgccggtgtcaacggacagtgcggcgacattttgaccaataaaaggtttatgctggacatgctctatgcccataatcgcaagtctcctgacgacgaggagaagggcgacggggaagcaggcagaacccaacaggaagccgaagccgttgcttcccttgccactcggatctccacactccaggctaatagccaaactcaggatgagtccgtgagaagggtagacgttggctgcctggataaccggggtagcgtgaaggcctttgccgagaagttcaactctggagacctggggaggggtagtatttcccccgatgcagaacccaacgacaaggttcccgagaccgccccagttcagcctaagacagagagcgattatatttgggatcaattaatggcaaaccctagggaactaaggattcaggatatggacttcaccgacctgggagaggaggatgatatagatgttctggatgtcgaccttgggcacagagaggccccaggcccaccgccacctccgccacccacttttctgggcctcccccctccacctcccccaccgctgctggactctattcctcctcctccggtcccagggaacctcctggtgccaccgcctcccgtatttaacgccccacagggcttaggctggagccaggtacccagggggcaacccacgtttacaaagaagaaaaagacgattcggctgttctggaatgaagtgcgacccttcgactggccttgcaagaacaatagacgatgccgagagtttctctggtctaaactagagccgatcaaagtggatacctcccgtttggaacaccttttcgagtcaaaatctaaggaactgtcagtctcaaaaaagaccgcagccgatggaaagcggcaggagatcattgtcctggacagtaagcgatctaacgccattaacatcggcctgactgttcttccacctcccaggacgatcaagatcgccattcttaactttgacgagtatgcactgaacaaggaagggattgagaaaattctgaccatgatacctactgatgaggagaagcagaaaatccaggaggctcagctcgctaatccagagattccactgggcagcgctgagcaatttttactcaccctctcttcaataagtgaacttagcgcgcgtctacacctgtgggccttcaaaatggattacgaaaccactgaaaaggaggttgctgagcctctgctcgaccttaaggaaggaattgaccagcttgagaataacaagactctgggcttcattctttcaactttgctcgcaatcggtaacttcctcaatggcacgaacgcgaaagcatttgagctgtcttatctggaaaaggtgcctgaagtgaaggacacagtgcacaaacagagtctgctgcaccacgtctgcacaatggttgtggaaaacttccccgatagctcagatctttattctgaaattggggctattactcgcagcgcaaaagtcgacttcgaccagctccaggataacctgtgtcagatggagcggaggtgcaaggcttcctgggaccacctgaaagcgatagcgaaacacgagatgaaaccggttttgaagcaacgcatgtccgagtttttgaaggattgcgcagaaagaattatcatactcaaaatcgtccaccgcagaatcataaaccggttccattctttcctgctattcatgggacacccgccatacgctattcgcgaggtgaacatcaacaaattctgtagaattatcagcgaatttgctctcgagtaccgaaccacaagagagcgggtgctgcagcagaaacaaaagcgtgccaaccaccgagagaggaataagacgcgcggtaagatgatcacagatagcggtaagttcagtggctcatcgcccgcaccacccagtcagccacagggattgtcctacgccgaggatgcagccgagcacgaaaatatgaaagctgtgttgaagacctcctcaccaagcgtggaagacgcgaccccggcactaggagtaaggaccaggagtcgtgcttcaagagggtcaacttcgtcttggaccatgggcacagacgactcacccaacgtgaccgatgatgccgcagacgaaatcatggaccgcatcgttaagagtgcaacccaggtccccagccagagggtggtgccacgtgagagaaaacgtagccgagccaatcgtaagtccctccggaggacccttaaatcaggactaacaccagaagaagctagggcacttggcctggtgggcacgagcgagctccagctatag

SEQ ID NO: 223604 - DNA, 1053 bp, Artificial Sequence
  Description of Artificial Sequence: Synthetic coding sequence
atggaaaccaactcaagcttacccaccaacattagtggcggtacgcccgcagtttcagccggttatttgttcttagacatcatcacctatctggtgttcgccgtcacgttcgtgctaggtgtcctgggaaacggtttagtgatctgggttgccggattccgtatgacacatacagtgacaacgatttcctacttaaacctggcagttgccgacttctgcttcacctctaccctgcctttttttatggtgagaaaggcaatggggggacactggccatttggctggttcctgtgtaaattcgtgtttaccatcgtggatataaacttgttcggtagcgtatttcttatagctcttatcgccctcgacaggtgcgtctgtgtcctgcatccggtgtggactcaaaatcacaggacagtgagcttagccaaaaaagtgataatcggcccttgggtgatggccttacttttaacgctccctgtgattatacgtgttacgacagtgcctggaaaaacaggtacggtcgcttgtacattcaatttttccccatggactaatgatcctaaggaaaggatcaacgttgcagtggccatgctgacagtgcggggtatcattcgttttattatcggattttccgcacccatgtctattgttgccgtctcttacgggctcatagcaacaaaaatacataaacagggtttaattaaatccagtcgaccattgagggttttaagctttgtagcggctgcatttttcttatgttggagcccttatcaggttgtagccttaatcgccacagtcagaattagagagctgctccagggcatgtataaggagatcggtatcgccgtggatgtgaccagcgctctagctttttttaattcctgtcttaaccccatgctttatgtgtttatggggcaggactttcgcgagcgactgatccacgccctccctgctagtctggagcgggcattgacagaagactccacccaaacgtctgatactgctaccaacagcacccttccttcagccgaagtggagctgcaagccaagtag

SEQ ID NO: 223605 - DNA, 1053 bp, Artificial Sequence
  Description of Artificial Sequence: Synthetic coding sequence
atggagaccaactcctcattgcctactaacatctctgggggtacacccgcagtttctgctggatacctgtttctggacatcataacctatctcgtgtttgccgttacattcgtgctgggcgtgttaggcaacggacttgtgatttgggtggcaggttttaggatgacccatacagtcactacgatttcctatcttaacctggccgtcgccgacttctgttttacctcaaccctgcccttcttcatggtgcggaaggctatgggaggacactggccctttgggtggtttttatgcaaattcgtcttcactattgtagatatcaacttatttggctccgtgtttttgatcgcattaattgcactggataggtgcgtgtgtgtccttcacccagtatggacacagaaccaccggacggtgtctcttgccaagaaggttattattggcccttgggtgatggctctgctgttgactctcccagtgatcatcagggttaccaccgtccccggtaaaacgggaaccgtggcttgtacttttaatttctccccctggacaaatgacccgaaggagcgcattaatgtggccgtggccatgctcacagtgagaggcatcatcaggttcattatcggattcagcgcacccatgtccatcgtggctgtatcatacgggctgattgctacaaaaattcacaagcagggacttatcaagagctccagacctctccgcgttctgtcatttgtggcagccgcattctttttgtgctggagtccctatcaggtggtcgccctaatcgccacagtcagaatcagggagctcctgcagggaatgtataaggagatcggtattgccgtggatgtcacttcagctcttgccttcttcaactcatgccttaaccccatgctctacgtcttcatggggcaggacttccgggagaggctcatccacgccctacccgcaagcttggaacgggcattgactgaagattctacacagacaagtgacactgccacaaattcgacacttccctccgcagaggtcgaactgcaggctaagtag

SEQ ID NO: 223606 - DNA, 1056 bp, Artificial Sequence
  Description of Artificial Sequence: Synthetic coding sequence
atggagacaaactttagcacccccttaaatgaatatgaagaagtgagctacgagagtgcaggctatacagtgttgcgaatactgcccctggtagttctcggcgtgacttttgttttaggtgtgctgggaaatggactggtcatctgggtggccggtttcaggatgacaagaaccgttacaactatatgctacctcaatttggccctcgcagacttctccttcactgccacattgcccttcctaatcgtttcaatggccatgggggaaaaatggccttttggatggtttctgtgcaagctgatccatattgtcgtggacatcaatctgttcggatcagttttcctgataggctttatagctctggatagatgcatttgtgttctgcacccagtgtgggcacaaaatcatcgcaccgtttccctggcgatgaaagtgatcgttggtccatggattctcgctcttgtactcaccctgcctgtgttcctgtttttaacaacggtgaccatcccgaacggggacacctattgcaccttcaatttcgcctcttgggggggaacacctgaggaaagactgaaagtcgcgattacaatgttgactgccagggggattattcggtttgtgattggcttctcgcttccgatgtccatcgtcgcaatctgctacggcctcatcgccgctaagatccataaaaaagggatgataaagtcctctagaccgctgcgcgtactcacggctgtcgtggccagtttttttatctgctggtttccgttccaactagtggctttgctggggaccgtctggttaaaggagatgttattctacggaaagtataagatcatagacatcttggtgaacccgacaagtagcctcgccttttttaattcctgtctgaatcccatgctttatgtgttcgtgggtcaagactttcgggagcgactgattcattcacttcctaccagcttagagcgtgcgctcagtgaagactccgcgcctactaatgacacggccgctaacagtgcttccccacctgcagaaaccgagttacaggcaatgtag

SEQ ID NO: 223607 - DNA, 1056 bp, Artificial Sequence
  Description of Artificial Sequence: Synthetic coding sequence
atggaaactaacttctccacacctcttaacgagtacgaggaagtaagctacgagtccgccggatataccgtgcttcgtattctgcccctggtggtgttaggagtcacattcgtgcttggcgtcttgggaaatggcctggtcatctgggtcgctggattcagaatgacccggacagtcactaccatctgctatttaaatctggcgcttgccgacttttcttttaccgccacgcttccattcttaatagtgtcgatggccatgggggagaagtggccattcgggtggttcttgtgcaagctgattcatattgttgtagatattaaccttttcggttctgtgttcttaatcggattcatcgccctggatagatgcatttgtgtactacatccagtatgggctcagaatcacaggacagtgtcgctggctatgaaggttatagtgggcccttggattctcgcacttgttcttacgctacccgtgttcctcttcttaaccaccgtaacaattccgaatggtgatacatattgcacctttaactttgccagctggggcggtacccccgaggaacggctcaaggtggcaataactatgcttaccgcccgaggaatcattcggttcgtgattgggttcagtctgccaatgagtattgtggccatctgctatggcctgattgccgcaaaaatccacaagaagggaatgataaagtcatctagacccttgcgggtgctgaccgccgttgtagcaagctttttcatttgttggttcccatttcagcttgtagcactgctcgggactgtgtggctgaaagagatgttgttttatggcaaatacaagatcatagatattctcgtcaatccaacgagcagcctggcattctttaacagctgcctaaacccgatgttgtatgtcttcgtggggcaagacttcagggagcggctgatccactctctgcctacttctttggagagggcgctcagcgaagacagcgccccaaccaacgacacagcagctaactccgcctcaccaccggctgagacagagctccaagctatgtag

SEQ ID NO: 223608 - DNA, 1062 bp, Artificial Sequence
  Description of Artificial Sequence: Synthetic coding sequence
atggagacaaacttctccatcccgctgaatgagacagaagaagttctgccagagcctgcgggacatacggtattatggatcttttctctgttggttcatggagtcacttttgtcttcggtgtcctcggcaacggacttgtaatctgggtggccggattcagaatgaccaggactgtgaatacaatctgctacctcaacctggccctcgccgacttctcctttagcgcaatattacctttccgcatggtttcagtcgccatgcgggagaaatggccttttggtagtttcttatgtaaactggtgcatgtcatgatcgacatcaatctgttcgtgagcgtgtacttgattaccatcattgcactagatagatgcatttgtgtactgcaccccgcttgggcacaaaaccataggaccatgtcgctggcaaaacgggtcatgaccggcctttggatcttcacaatcgtgctgacactgcccaacttcatattttggaccacaatttctaccactaacggcgatacatactgtatctttaacttcgccttttggggtgacacagccgtcgagcgcctcaacgtgtttattactatggcgaaagtctttcttattcttcattttattatcgggttcagcgtcccaatgagcataattacagtatgttatggtatcatcgccgcaaagatccataggaaccacatgatcaaaagctccagaccgctgagagtgtttgcagctgttgtggcaagtttcttcatctgttggtttccttacgagctgatcggcatcctgatggcagtctggctaaaggaaatgctgctcaacgggaagtacaagataattctggtcctaatcaaccctacctcctcgctggccttcttcaatagctgcttgaaccctattctctacgtctttatgggccgaaacttccaggagcgactcatccgcagtttgcccacctctcttgaaagggcactgactgaagtcccagactctgcccaaacctctaataccgacaccacttcagcttctcccccagaggagactgagcttcaggccatgtag

SEQ ID NO: 223609 - DNA, 816 bp, Artificial Sequence
  Description of Artificial Sequence: Synthetic coding sequence
atgttccgtgatttcggcgagccaggccctagcagcggcaacggaggaggatacggcggtccagcccaacctcccgcagctgcccaagccgctcaacagaagtttcacctagtgccaagcatcaacaccatgtctgggtctcaggagctgcagtggatggtgcagccgcatttcttggggcctagcagctacccgagaccactaacctacccgcagtattcccccccacagccccgacccggtgtgatacgcgcattgggccctccacccggagtgagacggagaccctgcgaacaaatctcaccagaagaagaggaaaggcggagagtgcggagagagcgcaataagcttgccgctgctaagtgccgaaatagacggaaagagcttacggatttcctccaggccgagactgacaaattggaggatgagaagtccgggcttcaaagggagattgaggaactccagaagcagaaagagcggctggagcttgtactggaggcgcaccgtcctatatgcaaaattcccgagggcgctaaagagggcgataccggaagcacatccgggacttctagccctcctgctccctgtaggcctgttccttgtattagtttatcccctggacccgtccttgaaccagaagccttgcacacccccacacttatgactaccccatcactgacaccctttacaccctctcttgtgtttacttacccttccacacctgagccctgtgcatcagcgcatcggaagtcatcgtcgagtagcggcgaccccagtagcgacccattgggctcacccactctgctggccctctag

SEQ ID NO: 223610 - DNA, 510 bp, Artificial Sequence
  Description of Artificial Sequence: Synthetic coding sequence
atgttcagggacttcggagagcccggacctagttcgggcaatggaggtgggtacgggggaccagcccagccccctgccgctgctcaagcggcacagcaagaaactgataaacttgaggatgagaaaagtggcctgcagagagaaatagaggagctccaaaagcagaaggaaagattggaactcgtcctggaggcacatcggcctatttgtaaaatcccagaaggcgcaaaagagggcgatactggaagcaccagcggaacatcctcccctcccgctccttgcagaccggtcccgtgcattagcctctcaccaggtccagtgctcgagcctgaagccctgcacaccccaaccctgatgacgacaccctcactaacgcctttcacgccctccttagtgtttacatatccttccacgcctgagccttgtgcctccgcgcacaggaagtcctcatctagcagcggcgacccctccagtgaccctctcgggagtcctaccctgttggcactgtag

SEQ ID NO: 223611 - DNA, 351 bp, Artificial Sequence
  Description of Artificial Sequence: Synthetic coding sequence
atgttccgagactttggcgagcctgggccttctagcgggaacggagggggttacgggggtcccgctcagccacctgccgcagcccaggctgcccagcaaaagttccacttggttccgtccatcaataccatgtccggatctcaagagctgcagtggatggtccagccacactttctaggccctagttcataccctcgccctctcacttatccccaatactccccccctcagcccaggccaggagtgattcgcgctctgggcccaccacctggggtgcggaggcgtccatgtgaacagatctcccctgaggaagaagagagctggcaacctcgggactttgtagacccgtag

SEQ ID NO: 223612 - DNA, 981 bp, Artificial Sequence
  Description of Artificial Sequence: Synthetic coding sequence
atgtaccaggactaccctggaaatttcgatacttcatctcgaggctcatccggctccccagcccacgctgaatcctacagctctggcggaggtggccaacagaaatttagggttgatatgcccggatctggatctgcattcatccctacaataaatgctattacgacatctcaggatctacaatggatggtacagcccaccgtaatcacatctatgagcaacccttatccaagatcgcatccttatagtcccctgcctgggttagcaagcgttcctggccacatggcgctgccacgtcctggcgtgataaaaacaataggcaccaccgtcgggaggcgacgtcgagatgaacagttgagccctgaggaagaagagaaacgcaggattagacgcgagcggaacaagctggcagccgcaaaatgtaggaatcggcgacgggagctcactgagaaacttcaggccgaaaccgaggagctggaggaagaaaaaagcggtttgcaaaaagagatagccgaattacagaaggagaaggaaaaactcgagtttatgttagtggcacatggcccagtgtgtaaaattagccctgaagaacgccgttccccaccagccccaggtctgcagccgatgaggagtggaggagggtcagtgggcgcagtagtcgtcaagcaagagcctctcgaagaagacagtccatctagctcatcagcaggcctggacaaagcccagagatcagtgataaagccaatcagcattgccggaggcttctacggcgaggagccactgcacacgcctatcgtggtgacctctaccccagctgtgactccaggaaccagtaatctggtgttcacctacccatctgtgctggagcaggagagccccgcttctcctagtgagtcatgctcaaaagcccaccggaggagctcgtcatctggggatcagtcatccgacagtctcaattcaccaacgctgctggctctatag

SEQ ID NO: 223613 - DNA, 864 bp, Artificial Sequence
  Description of Artificial Sequence: Synthetic coding sequence
atgccaggatcaggctcagctttcataccgaccattaacgctattaccacaagtcaggatctccaatggatggtgcagccgaccgttatcacgtcgatgtcaaacccttacccgcgaagtcacccttactcccccttgccaggacttgcttctgtaccgggacacatggctctgccacgacctggtgttatcaaaaccatcggcactaccgtggggagaaggcggcgagatgaacagcttagcccagaagaggaggaaaaaaggcgcatccggcgtgagcgtaacaaactggcagccgctaagtgtagaaatcggcgaagggaactcaccgaaaaacttcaggccgaaaccgaagagctggaggaggaaaaaagcggcctgcaaaaagagatcgcggaactgcagaaggaaaaagagaaattagagtttatgcttgtagcccatgggccagtttgtaagatctctcctgaggagcggaggtctcctccagcccctggtctgcaaccgatgcggtcaggaggcggttctgtcggtgccgtggtcgtgaagcaagaaccactggaagaagattcccccagctcctcgagtgctgggctggacaaagctcaacggtccgtgattaagcccatcagcatcgccggagggttttacggtgaagaacctttgcatactcccattgttgtgacttctacccccgctgtcactccaggcaccagcaacctcgtctttacttacccatccgtgctggagcaggagagcccagctagcccatccgagtcatgttctaaagcacaccggaggagttccagcagcggagaccagagctctgactccctgaactctcccacactcttggccctgtag

SEQ ID NO: 223614 - DNA, 972 bp, Artificial Sequence
  Description of Artificial Sequence: Synthetic coding sequence
atggcagagaagtttgactgccattactgccgagacccactgcagggtaagaagtatgtgcagaaggacggtcatcactgttgcttaaaatgctttgataaattctgcgctaacacctgtgtggaatgtcggaagccaatcggtgcggattctaaggaagttcattacaagaatagattttggcatgatacatgctttaggtgcgcgaagtgcctgcatcctctcgcaaatgaaaccttcgtggcaaaagataacaagatcctctgtaacaagtgcaccacccgtgaggacagtccgaaatgtaagggctgcttcaaagccattgtggcaggggatcagaacgtggagtacaaagggactgtttggcacaaggactgctttacctgctcaaactgcaagcaggtcatcggaaccggctcattttttcctaagggggaagacttctattgtgttacatgccatgagaccaaatttgccaagcattgtgtcaagtgcaacaaagccatcacttcgggtggaatcacctaccaggaccagccttggcacgcagactgtttcgtttgcgtgacttgctctaaaaaactcgctggccagagatttaccgccgtggaggaccagtactactgcgtagactgttacaagaatttcgtagcaaagaaatgtgccggatgtaagaacccaatcaccggtaagagaactgtctctagagttagccatcctgtaagtaaggctcgcaagcccccagtttgccatggcaaacgactgcctttaaccctcttcccctctgctaatttgcgcggtcgtcacccaggaggagagcgcacatgtccatcctgggtggtggtcctgtaccgcaaaaacaggagcctcgccgctccccgaggcccaggcctggtcaaggctcctgtgtggtggcctatgaaggacaatccgggaaccaccacagctagcaccgctaaaaatgccccatag

SEQ ID NO: 223615 - DNA, 774 bp, Artificial Sequence
  Description of Artificial Sequence: Synthetic coding sequence
atggctgagaagttcgactgtcattattgcagggatccgctccagggcaagaagtacgttcagaaggatggacatcattgctgcctaaaatgtttcgacaaattctgcgctaacacatgcgtggagtgtaggaaaccaatcggagcggacagtaaagaggtccactacaagaatcgcttctggcacgatacatgctttagatgtgcaaagtgcctgcacccgctcgctaatgagacattcgtggctaaagataataagatcctatgcaacaaatgtactaccagagaggattcgcctaagtgcaaggggtgtttcaaggcaatagtggccggtgaccagaatgtcgagtacaagggcaccgtgtggcacaaggactgctttacatgttcgaattgtaagcaagtgatcggcactggttctttcttccctaagggagaagatttctattgtgtaacttgtcacgagacaaagttcgcaaaacattgtgtgaaatgcaacaaggctattacctccgggggtattacctatcaggaccaaccctggcacgcagattgcttcgtctgcgtgacctgttctaagaagctcgccggacaacgcttcaccgccgtggaagaccagtattactgtgtggactgttacaagaattttgtggccaagaaatgcgctggctgcaagaatccaatcacaggcttcgggaaggggtcctctgtggtggcctatgagggccaatcctggcacgattattgcttccattgcaaaaaatgtagcgtatag

SEQ ID NO: 223616 - DNA, 633 bp, Artificial Sequence
  Description of Artificial Sequence: Synthetic coding sequence
atggccagccatcggcactccggtccttcatcctacaaggtggggacaatggctgaaaagtttgactgccattactgccgcgaccctctgcagggcaagaagtatgtgcagaaggacgggcatcattgctgcctgaagtgttttgacaaattttgtgcaaacacatgcgtcgagtgtcggaagcctatcggggctgattccaaagaggttcactataagaatcgcttctggcatgatacctgctttaggtgtgcgaagtgtctgcaccctctggcaaatgagacatttgtggctaaggacaataagattctgtgcaacaaatgtactactcgggaggacagcccaaagtgcaaagggtgctttaaggctatagtagctggcgatcagaacgtcgagtacaagggcaccgtctggcacaaggattgcttcacatgttcgaattgtaaacaggttatcggcactggaagttttttccctaaaggggaagacttctactgcgtgacctgccatgaaacaaagttcgctaagcactgtgtcaaatgcaacaagggtcttgtgaaggcaccagtgtggtggcctatgaaagacaaccctgggactaccactgcttccacggccaagaatgcgccttag

SEQ ID NO: 223617 - DNA, 891 bp, Artificial Sequence
  Description of Artificial Sequence: Synthetic coding sequence
atggcatcccacaggcacagtggaccaagttcatacaaggtggggactatggcagaaaagtttgattgccactactgtagagaccctctgcagggcaagaagtacgttcagaaggacggccatcactgttgtttaaagtgtttcgataagttctgcgccaacacctgcgtcgagtgcaggaaaccgatcggcgctgacagcaaggaagtacactacaagaaccggttttggcatgatacatgttttagatgtgcaaagtgtctgcatccgctggctaacgagacctttgtggccaaagacaacaagattctctgcaataaatgcaccaccagggaggatagcccgaaatgcaaggggtgcttcaaggctatcgtagctggcgaccagaatgttgagtataagggcacagtgtggcacaaggactgttttacatgctcgaactgcaagcaggtgatcggcacaggctctttttttccaaagggagaggacttttactgtgtcacatgccatgagacgaagtttgcaaagcactgcgtgaagtgtaacaaagcaattaccagtgggggaattacctatcaagaccagccctggcatgctgattgttttgtctgcgtcacgtgtagtaagaagctggccggtcagcggttcacagccgttgaggaccaatattactgtgtggactgttataagaatttcgtagcaaagaagtgtgccggatgtaagaatcctatcaccgggttcgggaagggttcatctgttgtagcttacgagggacagtcttggcacgattattgtttccattgtaagaagtgttctgtgaacctggccaacaagcgctttgtgtttcatcaagagcaagtctactgccctgattgcgcaaaaaaattgtag

SEQ ID NO: 223618 - DNA, 843 bp, Artificial Sequence
  Description of Artificial Sequence: Synthetic coding sequence
atggctgagaagtttgactgccattactgccgagaccccctgcaggggaagaagtatgtgcagaaggacggacaccattgctgccttaagtgtttcgataagttctgcgctaacacttgtgttgagtgccgcaaacccatcggcgctgatagtaaggaggtgcactataaaaataggttttggcatgatacttgctttcgatgcgctaaatgcctgcaccctctggctaatgagacttttgttgccaaggataataagattctgtgcaacaagtgcactactagagaagactcccctaagtgtaagggttgttttaaggccatcgtggctggtgaccaaaatgtagaatataagggaacggtgtggcataaggattgtttcacctgttcgaattgcaagcaggtcatcggaactggaagcttttttcctaagggggaagatttttactgcgtgacctgccacgagactaagtttgctaagcactgcgtgaagtgtaataaggcgataacatcaggcggaattacttatcaggaccagccatggcatgccgactgttttgtttgtgtcacatgttccaagaagctggccggacaacgctttactgccgtggaagatcaatactattgtgtggactgttataagaattttgttgccaaaaagtgtgccggatgtaagaaccccattaccggtttcggcaaggggtccagcgtggtcgcttatgaaggtcaatcatggcatgattactgcttccactgcaagaagtgttctgtgaacctggcgaataaaagattcgtgtttcaccaggaacaggtttactgccccgattgcgcaaagaagctgtag

SEQ ID NO: 223619 - DNA, 843 bp, Artificial Sequence
  Description of Artificial Sequence: Synthetic coding sequence
atggccgaaaaattcgattgccattactgccgcgatcctctgcaggggaagaagtatgtgcagaaggacggccatcactgttgtcttaaatgttttgacaaattctgtgctaatacctgtgtggagtgtcgaaagccaatcggtgccgactctaaggaagttcactataagaaccgattttggcacgatacctgctttaggtgcgcaaaatgtcttcatcccctggccaacgaaacatttgttgccaaagataacaagatcctatgtaacaagtgcaccacacgagaggatagcccaaaatgtaaggggtgcttcaaggcaatcgtggctggggaccagaacgtggaatacaaagggactgtctggcacaaggattgtttcacctgctcaaattgtaaacaggtaatcggtaccggctccttctttcctaaaggcgaagacttttactgtgttacgtgccacgaaaccaagttcgccaagcactgtgtgaagtgcaataaggctattacttctgggggtattacataccaagatcagccatggcacgctgactgttttgtatgtgtgacctgttcaaaaaagttggcagggcagagatttactgctgtcgaagatcaatattactgtgttgactgctataagaacttcgtcgccaaaaagtgcgctggttgcaaaaaccccataaccggatttggcaaaggatcaagtgttgtagcatacgagggccaatcctggcatgactactgctttcactgtaagaaatgtagcgtcaacctggcgaataaaaggtttgtctttcaccaagagcaggtgtactgccctgattgcgcaaaaaagttgtag

SEQ ID NO: 223620 - DNA, 972 bp, Artificial Sequence
  Description of Artificial Sequence: Synthetic coding sequence
atggccgagaagtttgattgccactactgtcgggaccctcttcaaggcaagaaatatgtgcagaaagatgggcaccactgttgtctgaagtgtttcgataagttttgcgccaatacttgtgtggagtgccggaaacccataggggcagattctaaagaggtccattataaaaatcggttctggcatgatacttgctttcggtgcgccaaatgcctacaccctctcgcaaacgaaacgtttgtggcaaaggacaacaaaatcctctgtaataaatgcaccacccgcgaggacagtccaaaatgtaagggctgtttcaaggctatcgtggccggtgatcaaaacgtcgagtataaagggacagtgtggcacaaggattgttttacgtgctctaattgtaaacaagttattggaaccgggagtttctttcccaagggcgaggatttctattgcgtgacttgtcacgagactaagttcgcaaaacactgtgtgaagtgcaataaagcaattacaagcgggggaatcacctaccaggatcagccatggcatgccgactgtttcgtttgtgtgacatgctctaagaaattggctggacagcgcttcacagccgtcgaggaccagtactactgtgtggattgttacaagaatttcgtggctaagaagtgcgccggttgtaagaatccaatcactggcaaaaggacggtatccagggtcagccaccccgtctccaaggccaggaagccccctgtttgtcatgggaaacgcctgcctttgacactgtttcctagcgcaaatctgcgcggaagacatccgggaggcgaacgaacctgtccctcctgggtggtggtcctctaccggaagaaccgatctctggcagcgccacggggtccagggctcgtgaaggcaccagtgtggtggcccatgaaagataatccaggcactacaaccgcgtctaccgccaagaacgccccatag

SEQ ID NO: 223621 - DNA, 615 bp, Artificial Sequence
  Description of Artificial Sequence: Synthetic coding sequence
atggctgaaaagttcgactgccattattgtcgggatccactgcaagggaagaaatacgtgcagaaagacgggcatcactgctgcctgaaatgtttcgacaaattttgcgccaacacatgtgtagagtgtcggaagccaattggggctgattccaaggaggtgcactataagaatcgtttttggcacgacacttgttttcgctgtgccaagtgtctgcacccgctcgcaaatgaaactttcgtggcgaaggataacaaaatcctgtgtaataagtgtactaccagagaagattctcctaaatgcaaagggtgttttaaggctatcgtggcgggtgaccaaaacgtagaatacaaggggaccgtgtggcataaagactgctttacctgtagtaactgcaaacaagtcattgggactggcagttttttccctaaaggcgaggatttttactgtgtgacgtgtcatgaaacaaagtttgctaaacattgtgtgaagtgcaataaagcgattacgtcaggagggattacataccaagatcagccctggcatgccgactgctttgtatgcgtcacatgtagtaagaagctcgctggacagaggtttaccgcagtggaatag

SEQ ID NO: 223622 - DNA, 624 bp, Artificial Sequence
  Description of Artificial Sequence: Synthetic coding sequence
atggccgagaagtttgattgccactactgcagggatcccctccagggaaagaagtacgttcaaaaggacggtcatcattgctgtctcaagtgctttgacaagttctgtgcgaacacttgtgtcgagtgccggaagcccataggagctgacagtaaagaagttcattacaagaaccgtttctggcatgatacatgctttcgctgtgccaaatgtctccatccccttgccaatgagacctttgtagctaaggacaacaagatcttatgtaacaaatgtactacccgagaggattcaccaaaatgcaagggatgcttcaaggccatcgtggcaggagaccagaatgtagaatacaaaggcactgtctggcataaagactgtttcacatgttctaactgtaagcaggtaattggcacaggctcttttttccctaagggcgaggatttctattgtgtgacatgtcatgaaaccaagttcgcgaagcattgcgtgaaatgtaacaaggcaatcacctccgggggtatcacctaccaagatcaaccatggcacgctgactgcttcgtctgtgtaacgtgtagtaagaagctcgcagggcaaaggttcactgcagtggaggaccaatattag

SEQ ID NO: 223623 - DNA, 426 bp, Artificial Sequence
  Description of Artificial Sequence: Synthetic coding sequence
atggctgaaaaatttgactgtcattactgtagggaccccctgcagggtaaaaagtacgtgcagaaagacggtcaccattgttgtctgaaatgtttcgataagttctgcgcaaacacctgcgttgaatgtcgtaaacccattggggctgatagcaaagaggtccactacaagaatcgtttctggcacgacacgtgctttcgctgcgccaagtgcctgcaccccctggccaacgaaaccttcgtggctaaggacaataagattttgtgtaataagtgtaccacaagggaagattctcccaagtgtaaagggtgtttcaaggccattgtcgctggtgaccagaacgtcgaatacaaggggacagtctggcacaaagattgcttcacttgttctaactgtaaacaggtgatcgggacgggctccttttag

SEQ ID NO: 223624 - DNA, 624 bp, Artificial Sequence
  Description of Artificial Sequence: Synthetic coding sequence
atggctgagaagttcgattgccactactgccgcgaccccctccaaggcaaaaagtatgtgcaaaaggacgggcatcattgttgcctgaagtgctttgataagttctgtgcaaatacatgcgtcgagtgccgaaagccaattggggctgatagtaaagaagtgcattacaagaaccgcttctggcatgacacttgtttccgatgcgccaaatgtctccaccctctggcaaatgaaactttcgtcgcaaaagataataagatcctttgtaataagtgtaccactagagaggatagccctaagtgtaagggttgtttcaaggcaatagtggcgggtgatcaaaacgttgaatataaaggcactgtgtggcacaaagactgctttacatgtagtaattgcaagcaggtgattggaacaggctccttttttccgaagggggaagatttctactgtgtgacctgccacgaaaccaagttcgctaaacattgtgtgaaatgcaacaaggcaattacttccggagggattacgtatcaggaccagccatggcacgcggactgttttgtgtgcgtaacgtgttcgaagaaactcgctggacagcgtttcaccgccgtggaagatcagtattag

SEQ ID NO: 223625 - DNA, 963 bp, Artificial Sequence
  Description of Artificial Sequence: Synthetic coding sequence
atgagccacttcatcctcagacacctgggctcctgctttcagccctatcccgctttcgcggaatatatcctttctgcgacacatcccgcaagcggtccatcatcctacaaagtcggcacgatggcagaaaagttcgactgccactattgcagggacccgctgcaggggaaaaagtacgtccagaaagacggacatcactgttgcctgaaatgcttcgataagttttgcgcaaacacttgcgtggagtgtaggaaaccaatcggcgcagacagtaaagaagtacactataaaaaccggttctggcatgatacctgttttagatgtgccaagtgtctgcatcctctcgctaacgagacgttcgtcgcaaaggataacaaaatactgtgtaataaatgcactacacgggaggattcccccaagtgtaaagggtgtttcaaggccattgtggcaggggaccagaacgtggaatataaagggaccgtgtggcacaaagactgctttacctgttcgaattgtaagcaggtgatcggaaccggatccttcttcccaaagggcgaagacttctactgcgtcacctgtcatgaaacgaagttcgctaaacactgcgtgaagtgcaacaaagccataacctctggcggtatcacataccaggatcagccgtggcacgcggactgcttcgtgtgcgtcacttgctctaaaaagctggcgggtcaacggttcacagccgtggaagaccagtactactgtgttgactgctataagaatttcgtggcgaaaaagtgtgccggatgcaaaaatccaattactggatttgggaagggctcttccgtagtcgcttatgagggacaatcctggcatgactattgctttcactgtaaaaagtgcagtgtcaacctcgccaataaaagatttgtgttccaccaggagcaggtctattgccccgattgtgccaaaaagctgtag

SEQ ID NO: 223626 - DNA, 618 bp, Artificial Sequence
  Description of Artificial Sequence: Synthetic coding sequence
atggccgagaagtttgactgtcactattgccgggacccgcttcaggggaagaagtacgttcagaaggacggtcaccactgttgcttaaagtgtttcgataaattttgcgccaacacctgtgttgagtgcaggaagccaatcggggctgacagtaaggaagtccattacaagaaccggttctggcacgatacatgttttcggtgtgccaagtgcctgcacccgctggcgaacgagacctttgttgccaaagataataagatattatgcaacaaatgtactacgcgcgaagattctccaaaatgtaaaggatgcttcaaagctatcgtggctggggatcaaaatgttgagtacaaagggactgtctggcacaaagattgttttacatgttcaaattgcaagcaggtgattggcactggctcgttcttcccaaagggcgaggacttctattgtgtgacatgtcatgaaacaaagtttgctaaacactgcgtcaaatgcaacaaagcgattacttccggcggtatcacgtaccaggatcagccctggcacgcagactgttttgtatgcgtaacctgcagcaaaaagcttgcaggacaacgcttcaccgcagttgaagattag

SEQ ID NO: 223627 - DNA, 468 bp, Artificial Sequence
  Description of Artificial Sequence: Synthetic coding sequence
atggccgagaaatttgactgtcactattgtagggatcccctgcaggggaaaaaatacgttcaaaaggatgggcaccactgttgcttgaagtgttttgacaagttttgcgcgaatacctgcgtggagtgccggaaaccaattggagcagactcaaaggaggtccactacaaaaaccgtttctggcacgatacttgtttccgttgtgcaaagtgcttgcaccccttggcgaatgagaccttcgtggccaaggacaacaaaattttgtgtaataagtgtacaactcgcgaggatagcccaaagtgtaagggctgctttaaggcgatcgttgcgggagatcagaatgtcgaatacaagggcacggtgtggcacaaggactgttttacatgcagcaactgcaaacaggtgatcggtacaggttcctttttccctaaaggcgaggacttctattgcgttacatgccatgaatag

SEQ ID NO: 223628 - DNA, 843 bp, Artificial Sequence
  Description of Artificial Sequence: Synthetic coding sequence
atggccgaaaagttcgattgccattactgtagggatcccctccagggcaagaaatacgttcagaaggacgggcaccattgctgtctgaagtgtttcgacaaattttgcgccaatacatgcgtcgaatgtcgaaagcccatcggtgccgatagcaaggaagtgcactataagaaccgattttggcatgatacatgttttcggtgcgcaaagtgtctccacccattggccaatgaaactttcgttgccaaggataataagatcctgtgcaataagtgtacaactcgcgaagactcccctaaatgtaagggatgcttcaaagctattgtggcaggcgatcaaaatgttgagtataagggcacagtttggcacaaggattgctttacgtgcagcaattgcaaacaggtgatcgggacaggttctttctttccgaaaggtgaagacttctactgtgtgacctgccacgagaccaagtttgccaaacattgcgtgaaatgcaacaaagccatcaccagtggcggtatcacgtatcaggaccaaccctggcacgccgactgctttgtttgcgtaacctgcagcaaaaagctggccggtcaacgcttcaccgccgtcgaagaccagtattattgtgtggattgctacaagaactttgtcgcgaaaaagtgcgccggatgcaaaaacccgataactgggttcggcaaggggagcagtgttgtagcctatgaagggcagtcctggcacgattactgcttccattgtaaaaagtgtagtgtgaatctagcaaacaagaggtttgtgttccatcaggagcaggtctattgtcccgattgtgctaaaaagctgtag

SEQ ID NO: 223629 - DNA, 783 bp, Artificial Sequence
  Description of Artificial Sequence: Synthetic coding sequence
atggctgaaaagttcgattgctgtctcaaatgcttcgataagttttgcgctaacacttgcgtcgagtgccgtaaacccattggcgcagactcaaaggaagttcattacaaaaacaggttctggcatgatacctgctttcgctgcgctaagtgcttgcaccccctggctaacgaaacttttgtggccaaggataacaagattttgtgtaataaatgtaccactcgcgaggactcccctaaatgtaagggatgcttcaaagctattgtcgccggtgaccagaacgttgaatataaaggaactgtgtggcacaaggattgtttcacttgcagcaactgtaagcaagtaattggtactgggtcgtttttcccaaaaggggaggacttctattgtgtgacttgtcacgaaacgaagttcgcaaagcactgcgtgaagtgtaataaagcgattacttctggaggaatcacctatcaggaccagccctggcatgcagactgcttcgtgtgcgtgacctgcagcaaaaagcttgcaggtcagcgctttaccgccgtcgaagaccagtattactgcgtcgactgttacaagaactttgtagctaagaaatgcgccggttgtaagaaccctattaccggattcggtaaaggttccagtgtcgttgcctacgagggacaaagttggcatgactactgtttccattgcaaaaagtgttcagtgaacctggccaataaacggtttgtgtttcaccaggagcaggtgtactgtcccgactgtgcgaaaaagctgtag

SEQ ID NO: 223630 - DNA, 930 bp, Artificial Sequence
  Description of Artificial Sequence: Synthetic coding sequence
atgacattttacgtcgccagtttagcactggagctgatttggatgctgagcagcccggctgggccttccagctataaagttgggaccatggccgagaagttcgattgccattactgtagagacccactccagggaaagaagtacgtgcagaaagatggccatcactgttgtctcaaatgctttgataagttctgcgctaacacctgcgtggagtgtagaaagcctatcggcgctgacagtaaggaagtccattataaaaacaggttttggcatgatacttgctttcggtgcgcaaaatgtctccacccactggctaacgaaaccttcgtggccaaagataacaagatcctatgtaacaagtgcaccacaagagaagattctccaaaatgtaaggggtgcttcaaggctattgtggccggagaccagaacgtggaatacaagggtacggtatggcacaaagattgttttacatgctccaattgtaagcaggtaatcggaacgggatccttcttccctaaaggggaagatttctattgcgtcacctgtcacgaaacaaagttcgctaaacactgcgtaaaatgtaataaggcaatcacttctggcggaattacttaccaggaccagccctggcatgcggactgctttgtttgcgtgacttgctcaaagaagctggcagggcagagatttactgcggtagaagaccaatactactgcgtcgactgctataagaacttcgtggccaagaagtgcgccggttgcaaaaaccccattaccgggttcggcaaaggttcttccgtggtcgcgtacgaggggcaaagttggcacgactattgtttccattgtaaaaagtgttctgttaacttggcaaacaagagattcgtcttccaccaggagcaggtctattgccccgattgtgctaaaaaactgtag

SEQ ID NO: 223631 - DNA, 828 bp, Artificial Sequence
  Description of Artificial Sequence: Synthetic coding sequence
atggcctcccaccggcactcagggccatcttcctataaggtggggacaatggccgagaagttcgattgtcactactgtagggacccacttcagggaaagaagtacgtgcagaaggacgggcatcactgctgcttgaaatgctttgataaattttgtgccaacacgtgcgtcgagtgtcgcaagcccatcggagccgattccaaggaagtccactacaagaaccggttctggcacgacacttgctttagatgtgcaaagtgtactacacgggaagacagccctaagtgcaaggggtgcttcaaggccatagtggcaggagaccagaacgtcgagtataaagggactgtttggcacaaagactgctttacatgctcaaattgtaaacaggttattgggacaggctcattttttcctaaaggggaggatttttactgtgtcacatgtcacgagacaaagtttgcaaagcattgcgtgaaatgtaacaaagccatcacctctggagggattacctaccaagaccagccatggcatgccgattgtttcgtatgcgttacttgtagcaaaaagctggccggacagcgtttcaccgccgtggaggaccagtattattgcgtggattgctataagaacttcgtcgcgaagaaatgcgctggatgtaaaaatcctattacgggcttcggtaaaggaagttcagtggtggcgtacgaagggcagtcctggcacgattactgcttccactgcaagaagtgctccgtgaatctagccaacaagcgctttgtgtttcatcaggagcaggtttattgtcctgattgtgccaagaagttatag

SEQ ID NO: 223632 - DNA, 843 bp, Artificial Sequence
  Description of Artificial Sequence: Synthetic coding sequence
atggccgagaagttcgattgccattactgccgggacccgctgcagggaaagaagtacgtccagaaggacgggcatcactgttgcctcaaatgctttgataaattttgtgcaaatacctgtgtggaatgtaggaaacccatcggcgcagactcaaaggaagtgcactacaagaatagattttggcacgacacttgcttccgatgcgcgaaatgtttgcacccgcttgccaacgagaccttcgtagcaaaggacaataagatactttgtaataaatgtacgactcgggaggatagtcccaagtgtaagggatgcttcaaggcaattgttgcaggggatcagaacgtggagtacaaggggaccgtgtggcataaggactgtttcacttgttcaaactgtaaacaggtcatcggaactggcagcttctttcctaagggggaagatttctactgcgtcacctgccacgaaacaaagttcgcaaaacattgcgtgaagtgcaacaaggccataacatcagggggtattacataccaggaccagccctggcatgctgattgctttgtttgcgtgacctgttccaaaaaattagctggacaacggttcaccgccgtggaggaccagtattattgtgtggattgttacaagaatttcgtagccaagaagtgcgctggctgcaagaatccaatcaccggttttggcaaagggagctctgtggtagcttacgagggccaatcatggcacgactactgcttccactgcaagaagtgctcagtaaatttggcgaacaaacgcttcgtgttccaccaagagcaggtgtactgccctgactgtgcaaagaagctgtag

SEQ ID NO: 223633 - DNA, 840 bp, Artificial Sequence
  Description of Artificial Sequence: Synthetic coding sequence
atgacagagaggttcgattgccaccactgcaatgaatcactgtttggcaaaaaatacatcctcagagaggagtccccatactgcgtcgtgtgtttcgaaactttgtttgccaatacttgcgaggaatgcggcaaacctatcggttgtgactgcaaggacttgtcttataaggatagacactggcacgaagcctgcttccattgctcccagtgccggaattcactcgtcgataaaccatttgcagccaaagaggatcagttgttatgtactgattgctactctaacgagtactcctctaagtgccaggaatgcaaaaagaccataatgccaggcacaaggaaaatggagtacaaagggtcctcctggcatgagacctgctttatctgccacaggtgccaacagcccatcggaaccaagtcttttatccccaaggataaccagaacttctgtgtgccatgctacgagaagcagcacgccatgcagtgcgtgcagtgtaagaagccgatcacaacgggaggggtgacatatcgagagcagccttggcacaaggagtgctttgtctgcactgcctgccgtaagcagctctccggtcagagattcaccgcaagggacgattttgcctactgtctgaactgcttttgcgatttgtatgccaagaagtgcgccggttgtacaaatcctattagcggactgggcggaactaagtatatcagctttgaagaaaggcagtggcacaacgactgcttcaactgcaagaaatgttctctgagcttggttgggcgaggcttcttgaccgaaagagatgacatactgtgccccgattgcggaaaggacatctag

SEQ ID NO: 223634 - DNA, 456 bp, Artificial Sequence
  Description of Artificial Sequence: Synthetic coding sequence
atgacggagaggtttgattgtcatcactgcaacgagtccctgttcggaaaaaaatacatcctgcgggaagagagcccatactgtgtggtatgttttgagaccctgtttgctaatacttgtgaagaatgcggtaagcccatcggctgcgattgtaaagtcccagcaaggtggtccacccgcgctgccgcaggcatgagacccgcatcatctgccaccgccgcatccagccagcttgaaccacgggtatcaagccccaagacaatccgtatcagcgtatgtcctgccatgcgaaacaacatgccctgctccgccttttccgccaagtcacctagtcctagggaaggctcactgaccggcagctctcctggcactcgctcagctagttgcgcccctcctgcaggatcaagttgcctgggatccgcgagccagctggcgatgactcttcctacagcttag

SEQ ID NO: 223635 - DNA, 1170 bp, Artificial Sequence
  Description of Artificial Sequence: Synthetic coding sequence
atgaccaggcggggattcagtagagcgggtgccgcacagagatctactcgccctgccgcagaaccccagcctcctgcagctcgggcactgcagcccagaccaggcgtccccggacccctgaggtgtcgtgaatatctacagccccctgcgcctaggcgggaggccgaaggcctctcacaccagggaagcgaagtgggcgcagaaagtggcgctaggcccaaggaaagaggcgcagagcctgaattgggcaggctttggctgcgaacagtgagcagttggcgcctgggatggcacttcgacttcggggtagcagagaaacccggtgtcaagatgaccgagagattcgactgccatcactgtaacgagtcattgtttggaaaaaaatatatcctgcgggaagaaagcccatattgtgtggtttgctttgagacactctttgcaaacacctgcgaagaatgtggaaagccgattggttgtgactgtaaggatctctcctacaaagacaggcactggcacgaagcatgttttcactgttcccaatgcagaaactctttagtcgacaagccttttgcagccaaagaggatcagctgttatgtaccgattgctattccaacgagtattcctctaaatgccaggaatgcaagaagacaatcatgccaggaaccaggaagatggaatataagggttcaagttggcatgagacctgcttcatttgccacaggtgtcagcaacccatcggcacgaagagttttataccaaaggataatcaaaatttttgtgtgccctgctacgagaagcagcatgctatgcagtgtgtccagtgtaagaagcccatcactaccggcggtgttacctaccgcgaacagccctggcataaggagtgctttgtatgtaccgcttgcagaaagcagctgtctggccagcgttttacagcaagagatgactttgcatactgcctgaattgcttctgcgacttgtatgctaaaaaatgcgctggttgcacaaatccgatttcaggcttaggcggtactaagtatataagttttgaggaaagacaatggcacaacgactgcttcaactgcaagaagtgttctctatcactggttgggagaggctttcttaccgaaagggacgatattctctgtccagattgtgggaaagacatttag

SEQ ID NO: 223636 - DNA, 840 bp, Artificial Sequence
  Description of Artificial Sequence: Synthetic coding sequence
atgaccgagcggtttgactgccatcactgcaacgagagcctgttcggcaaaaagtacattctaagggaagagagcccctactgcgtcgtttgtttcgaaactttgttcgctaatacttgtgaggaatgcggcaaacctattggctgcgactgtaaagaccttagctacaaagaccgccactggcacgaggcctgctttcactgttctcagtgccggaatagcctcgtcgataagcccttcgcagctaaagaggaccagctattgtgtacagattgctactctaatgagtactctagtaagtgccaggaatgcaaaaagactattatgcctggcaccagaaagatggagtacaaaggttcctcttggcatgagacttgcttcatttgccaccgttgccagcaacctatcggtacaaagagttttattcctaaagacaaccagaatttttgcgtgccttgctatgaaaaacagcacgccatgcagtgtgtgcagtgcaagaaacccattacaacaggcggagtcacttatcgggagcaaccgtggcataaggagtgtttcgtgtgtactgcatgtagaaaacagctgtccggccagcgtttcacggccagagatgattttgcctattgcctgaactgcttctgcgacctgtacgcaaagaaatgtgccggatgcacgaatcccatatccggtctcggaggaaccaagtacataagctttgaggagaggcagtggcacaacgactgtttcaactgtaaaaagtgttctctttccctggtggggagggggttcctgactgaacgcgatgatattctgtgtcccgactgtgggaaagatatctag

SEQ ID NO: 223637 - DNA, 840 bp, Artificial Sequence
  Description of Artificial Sequence: Synthetic coding sequence
atgaccgaacggtttgactgtcaccactgtaacgagtccttgtttggaaagaaatacatactgagagaagaatcaccttactgtgtggtgtgcttcgagaccctttttgcaaacacctgtgaagaatgtggtaagcctatcggctgtgactgcaaagacttgagctacaaggacagacactggcatgaggcatgctttcactgctctcagtgtcgaaactctttggtcgacaagccctttgctgccaaggaagaccagctcctgtgtacagactgctatagcaatgaatattcctcaaagtgtcaggagtgcaagaagactatcatgcccggaactaggaagatggaatacaagggaagtagttggcacgaaacctgctttatttgtcacaggtgccagcagcccatagggaccaagagctttatcccaaaagataaccagaacttttgcgtgccgtgctatgagaaacagcacgctatgcagtgtgtgcagtgcaaaaagcccatcacgactgggggagtgacctatagggaacagccttggcataaggagtgctttgtatgcactgcctgtaggaagcaactgtctgggcagaggttcaccgccagagacgacttcgcctattgcctgaattgtttctgtgacttgtatgccaagaagtgtgctggctgcactaaccctatttctggcctgggaggtaccaagtatatttcctttgaggagagacagtggcacaacgactgctttaattgtaaaaaatgcagtttgtctctcgtcgggagaggctttctcaccgagagggatgatattctgtgcccggattgcggaaaagatatctag

SEQ ID NO: 223638 - DNA, 840 bp, Artificial Sequence
  Description of Artificial Sequence: Synthetic coding sequence
atgaccgagaggtttgattgtcaccattgcaatgaatctctgtttggaaaaaagtacatcttgagggaggagtctccttactgcgtggtgtgcttcgaaacactttttgctaatacctgtgaagaatgtggaaagccaataggatgcgattgcaaagacctgagttataaggacagacattggcatgaggcatgtttccactgctcacagtgccgcaactctttggtggataagccatttgccgctaaggaggatcagctcctatgtaccgactgctactccaacgaatattcctctaaatgtcaggagtgtaagaagaccataatgcctggtaccaggaagatggagtataaaggctctagctggcatgagacttgctttatttgtcaccgctgtcagcagcccataggcacaaaatccttcatcccaaaagataatcagaacttttgtgtgccatgctacgagaagcagcacgcaatgcagtgcgtccaatgcaagaagcccattactaccggaggcgtaacctaccgggaacagccttggcacaaagagtgctttgtctgtaccgcttgtagaaagcagctctcaggccagagattcactgcaagagacgatttcgcatactgtcttaactgtttttgcgacctgtacgccaaaaagtgtgccggatgtactaacccaatctcaggacttgggggaacaaaatacatatctttcgaggagcgccagtggcataacgattgctttaactgtaagaagtgtagcctcagtctagtgggaagaggatttttaactgaaagagatgacattttatgtcctgactgcgggaaagatatctag

SEQ ID NO: 223639 - DNA, 840 bp, Artificial Sequence
  Description of Artificial Sequence: Synthetic coding sequence
atgactgagcgattcgactgccaccattgtaatgagtcactgttcggcaagaagtacattttgagagaggaatctccctactgcgttgtttgctttgaaaccctgttcgctaacacttgtgaggaatgtggcaagccgatcggatgtgactgcaaggatctgtcctataaggacagacattggcatgaggcgtgctttcactgtagccagtgtcggaacagcctggtggacaagccttttgctgctaaagaagaccagcttctctgtacagactgttatagcaatgaatactcctccaagtgccaagagtgcaagaagactattatgcccggtacacgcaagatggagtataaaggcagctcctggcacgaaacctgcttcatctgccaccggtgtcaacaacctatcggaacaaaaagttttatacccaaggacaaccaaaacttctgtgtgccatgttatgaaaagcagcacgccatgcagtgtgtgcaatgtaaaaaaccaattacaaccgggggagtcacataccgggagcaaccctggcataaggagtgcttcgtctgcacagcctgtagaaaacagttgtcagggcagcggttcactgcacgcgatgatttcgcctattgtctcaactgcttctgcgatctgtatgccaagaaatgcgcaggttgtaccaatccaatctcaggactaggaggaacaaaatatattagcttcgaggagaggcaatggcataatgactgcttcaattgtaagaagtgctccctgagcctcgtaggtcgtggcttcttaaccgaacgtgacgatatcctttgccccgactgcgggaaggacatttag

SEQ ID NO: 223640 - DNA, 840 bp, Artificial Sequence
  Description of Artificial Sequence: Synthetic coding sequence
atgaccgagcggttcgattgccatcactgcaatgaaagcctgttcggaaagaaatatattctgcgggaggagagtccatactgcgtggtgtgcttcgaaacactgttcgccaacacctgcgaggaatgcggaaaaccaatcggatgtgattgcaaagatcttagttataaggaccgccattggcacgaagcttgctttcactgctcacagtgtcgcaacagccttgttgacaagcccttcgcggctaaagaggatcagctcctgtgcactgattgctatagtaatgagtacagctcaaagtgtcaggagtgcaaaaaaacaatcatgcctggcaccagaaagatggagtacaaggggtcatcctggcacgaaacttgtttcatctgtcaccgttgccagcagcctattgggacaaagtctttcattccaaaggataaccagaatttttgcgtcccatgctatgagaagcagcacgctatgcaatgtgtacagtgtaaaaagcccatcacaacaggtggcgtgacttaccgcgagcagccttggcacaaagaatgttttgtatgcaccgcctgccgcaaacaactgagcgggcagcgcttcacagcgagggatgactttgcctattgtctgaattgcttttgtgatttgtacgccaaaaaatgtgcagggtgcaccaaccccatctctggactggggggaaccaagtacatcagctttgaggagcgccaatggcataacgattgttttaactgcaagaaatgctccttgtctctggttggacgcggtttcctcaccgagagggacgatatcctgtgccccgattgtggaaaagatatctag

SEQ ID NO: 223641 - DNA, 840 bp, Artificial Sequence
  Description of Artificial Sequence: Synthetic coding sequence
atgacagagcggttcgactgccatcactgtaatgagagcttatttggtaagaagtacattctgcgggaagagtccccttactgtgtcgtatgttttgaaactctgtttgcaaacacatgtgaagaatgcgggaagcctatcgggtgtgactgcaaggatctgtcctataaagatagacactggcacgaggcttgctttcactgttctcagtgccggaactcactagtggataaaccattcgctgccaaagaggaccagctgctgtgcaccgactgctacagcaatgagtattcctccaaatgtcaagaatgcaagaagacaataatgcctggtacaagaaagatggagtacaagggaagcagctggcatgagacgtgctttatctgccaccggtgtcaacaacccattggaactaagtcgtttatccccaaggataatcagaatttttgcgtcccctgctatgagaaacagcacgcaatgcagtgtgtgcaatgcaaaaaacctataaccacaggaggcgttacctaccgggaacagccttggcacaaggagtgctttgtgtgcacagcctgccgcaaacagctgagtgggcagcgattcactgctagggatgattttgcttattgtttaaattgcttctgtgacctgtacgcgaaaaaatgtgcaggatgcacaaacccaatctctggcctaggaggcaccaagtacattagttttgaagagcggcagtggcacaacgactgcttcaattgtaaaaagtgctcccttagccttgtagggcgtggattcctgactgagcgggatgacatcctgtgcccggactgcgggaaagacatctag

SEQ ID NO: 223642 - DNA, 60 bp, Artificial Sequence
  Description of Artificial Sequence: Synthetic coding sequence
atgacagagcgcttcgactgtcaccactgcaatgaatcactctttggcaaaaaatactag

SEQ ID NO: 223643 - DNA, 435 bp, Artificial Sequence
  Description of Artificial Sequence: Synthetic coding sequence
atgaccaggcggggtttcagtagggctggcgcagcgcagcgcagcacacgtcccgcagccgaaccccagccacctgcggctagagctctgcagccgcgaccaggagtccccggacccctgcgatgtcgagagtatcttcagccccctgcgcctagacgggaggccgaaggactaagccatcagggaagcgaggtgggtgcagagagcggtgcccgacccaaggagcggggagccgagcccgagttgggtcgcctatggctccgcacagtctcatcgtggagattgggttggcacttcgatttcgggaccgagagcaggttcgttgcacaagcaggagtgcaatggcatgacctctccagtctgcaagctctccctctaggatctcgccactccccggctcccgcatcccaggtcgccggaacgactggctgttag

SEQ ID NO: 223644 - DNA, 843 bp, Artificial Sequence
  Description of Artificial Sequence: Synthetic coding sequence
atgtccgagtcattcgactgtgccaagtgtaatgaatccctgtacggaaggaagtacatccagacggatagtggcccatattgcgttccgtgctacgataacacatttgcaaacacctgtgcggaatgtcagcaactgatcggacacgattcaagagaactattttacgaagatagacacttccatgagggctgttttcgatgctgcaggtgtcaacggagcctggccgacgagccatttacctgtcaggatagcgaattgctgtgcaacgattgctactgtagtgccttctcctcccagtgcagcgcatgcggcgagaccgtaatgcctggaagccgcaagcttgagtacggcggtcagacttggcacgaacactgcttcctgtgttctggctgcgagcagcccctaggcagcaggagcttcgtgcccgataagggcgctcactattgcgttccctgctatgagaacaaattcgccccacggtgcgcgagatgctccaagacactcacccagggaggggtaacctaccgcgaccagccttggcaccgggagtgcctggtctgtacgggttgccagaccccactggctggacagcagtttactagtagggatgaggacccttactgtgtagcctgtttcggtgagttgttcgcgcctaagtgctctagttgcaagagaccaatagtgggcctgggaggtggtaaatatgtatctttcgaagaccggcactggcaccataactgctttagctgtgccaggtgttcaaccagtctggtgggccagggattcgtgcccgacggcgatcaagtactgtgccagggttgttcgcaggcaggcccttag

SEQ ID NO: 223645 - DNA, 855 bp, Artificial Sequence
  Description of Artificial Sequence: Synthetic coding sequence
atgactaccgcccacttttactgtcagtattgtaccgcctcactgctcgggaaaaagtatgtcctcaaggacgatagcccctactgcgtgacttgctacgacagagtgttctcaaactattgtgaggaatgtaagaaacccatcgaatcagatagcaaagacctgtgttataaggataggcactggcatgaaggttgctttaagtgcaccaagtgcaatcatagtctggtggaaaagcccttcgctgccaaagatgaacggctgctttgtacggaatgctacagcaacgagtgcagctctaagtgtttccattgtaagagaactatcatgcctggctctcgcaagatggagtttaagggcaactattggcatgagacctgtttcgtgtgcgagaattgtcggcaaccgatagggactaaacctctaatatcaaaagaatcgggtaattattgtgttccctgctttgaaaaggagttcgcacactattgtaatttctgcaagaaagttatcacctccggtggcattacattctgcgatcagttatggcacaaggaatgtttcctatgttcaggttgccggaaggacctgtgtgaagagcaatttatgtccagagacgactaccctttttgtgtggactgctataaccatctctacgcaaacaagtgtgtggcttgcagtaaaccgatatccggtttgactggtgccaaattcatatgctttcaagatagccagtggcatagcgagtgcttcaattgtggtaaatgcagcgtatctttagtgggcaagggctttctgacccagaacaaggagattttttgtcagaaatgtgggtctggcatggatactgacatatag

SEQ ID NO: 223646 - DNA, 633 bp, Artificial Sequence
  Description of Artificial Sequence: Synthetic coding sequence
atgaccaccgcccacttttattgtcaatactgcacagcgtctcttctgggcaagaagtatgtgctaaaggatgattctccttattgcgtgacgtgctatgaccgagtttttagcaactattgtgaagaatgcaagaagccaattgaatcagattcaaaggacttatgttacaaggatcggcactggcatgaaggctgtttcaaatgtaccaaatgcaaccactccctagtagagaaacctttcgctgctaaagacgaacggttgttatgtaccgagtgttactccaatgaatgctcctcaaagtgcttccattgtaaacggaccatcatgcccggtagtagaaagatggaatttaaggggaactattggcatgagacatgctttgtgtgcgaaaactgcagacagccaatcggtacaaagccactgatttccaaggagtccgggaattactgtgtcccttgtttcgaaaaagaatttgctcattattgcaacttttgtaagaaagttattacatccggcggaatcacattctgtgatcagttgtggcataaagaatgctttttgtgttcgggctgcaggaaagatctttgcgaggaacagtttatgtcccgggacgactacccgttttgctag

SEQ ID NO: 223647 - DNA, 855 bp, Artificial Sequence
  Description of Artificial Sequence: Synthetic coding sequence
atgaccaccgcccatttctactgtcagtactgtaccgcatccctgttaggcaagaaatacgtgctgaaggatgatagcccctactgtgtgacttgttacgaccgagtgttttctaattactgcgaagagtgtaaaaagcccatagagtctgactccaaggacctctgttacaaggatcggcactggcatgagggctgttttaagtgcaccaagtgtaatcactctctggtggagaaaccattcgccgcaaaagacgagagactgctgtgtactgagtgctactcaaacgagtgttctagcaagtgctttcactgtaagagaaccatcatgcccggatcccgaaagatggaattcaaaggcaattattggcatgaaacgtgctttgtgtgtgagaattgtcgccagcccatcggaaccaagcctttgattagcaaagagtctgggaactactgcgtgccgtgcttcgagaaagagtttgcccactactgtaatttctgtaagaaagtcataacaagtggtgggatcactttctgtgaccagctgtggcacaaagaatgctttctgtgctccgggtgcagaaaggacctgtgtgaagaacagttcatgagcagagacgattacccgttctgtgtcgactgctataaccatctatacgcaaataagtgtgtggcttgttccaaacccatctcggggctgacgggggctaaattcatttgctttcaagattctcagtggcactccgagtgttttaactgtggaaagtgttctgtgtcattagtaggcaaggggttcctgacccagaacaaggagatattttgccagaaatgcggctcaggcatggatactgatatttag

SEQ ID NO: 223648 - DNA, 1314 bp, Artificial Sequence
  Description of Artificial Sequence: Synthetic coding sequence
atgggtcgtagaatgcggggagctgccgctacagccggactgtggttgctggctctggggtctctgttagccctgtgggggggtctgctgcccccacggaccgagctccccgcaagccggccacctgaggaccggctgcccagaagacctgccagatctggcggacctgcccctgcccctaggttccccctgccccctccgttggcctgggatgctcgagggggatccctgaagacttttcgggcactacttaccttggctgcgggtgctgacggacctcctcggcagtcgagaagcgagccgagatggcatgtgagcgccagacaaccccgtccagaagaatccgccgcagtacacggaggcgtgttttggtcccgaggactggaggaacaggtgcccccaggcttttccgaagcccaggcagcggcttggttggaggctgctaggggggcaagaatggtggccctggaacgtggaggctgtggcaggagtagcaatcgacttgccagatttgccgatggtacccgcgcatgcgtgagatatggcatcaaccctgaacagattcagggggaagcactgagttactacctggcaaggcttctgggcttacagagacacgtaccaccccttgcccttgcaagagtggaggcacgtggtgctcagtgggcgcaagtgcaggaggagctgcgcgcagcacattggacagaaggctctgtcgtgtcactcacgcgctggttacccaatttgaccgacgtcgtcgtgccagctccatggcggtccgaggatgggaggttaaggccactacgcgacgcaggcggagaattggcgaatttatcgcaggccgagctggtcgatctggtgcagtggacagacctcatcctgtttgattatctaaccgcaaactttgatcgactcgtctctaacctgtttagcctgcagtgggatccaagggtaatgcagagagctacatccaacctgcatcgcggacctgggggagccttggtgtttctggacaatgaagccggacttgtgcacggttatcgcgtggcaggcatgtgggacaaatataatgagccacttcttcagagtgtgtgcgtattccgcgagagaaccgcccgaagggtgttagagttacaccgcggtcaagatgcggcagcacgtctgttgaggctctatcggaggcacgagccaagatttccagaactggccgctctggcagatcctcacgctcagttgctgcagagacgcctggatttcctggccaagcacattctccattgcaaggctaaatatggaaggaggtctgggacctag

SEQ ID NO: 223649 - DNA, 312 bp, Artificial Sequence
  Description of Artificial Sequence: Synthetic coding sequence
atggagagacagcagcagcagcaacagcaactgagaaacctcagagactttctcctggtgtataacaggatgacagaactgtgcttccagagatgtgtgccttccctgcaccatcgcgcacttgatgccgaggaggaggcttgcctgcactcatgtgctggcaaactgatccacagcaatcatcgactgatggccgcttatgtacaacttatgcctgctctggtgcagcgcaggattgccgattacgaagccgcttcagccgtgccaggggttgccgcagagcagcctggggtttcaccaagcgggagttag

SEQ ID NO: 223650 - DNA, 312 bp, Artificial Sequence
  Description of Artificial Sequence: Synthetic coding sequence
atggagaggcagcagcaacagcagcagcagctccgaaacttgagggattttctcctggtgtacaatcgaatgacagagctctgcttccagagatgtgtgccttccctccaccacagggccctcgatgccgaggaggaggcatgcctccattcttgcgcaggaaaactaatccattccaaccaccggctgatggctgcatatgttcagctgatgccagccctggtccagcgacgcatcgccgactatgaagccgctagcgcggtgcctggcgtcgcggcagagcagccaggagttagcccatcaggcagctag

SEQ ID NO: 223651 - DNA, 312 bp, Artificial Sequence
  Description of Artificial Sequence: Synthetic coding sequence
atggagcgccagcaacagcagcaacagcagttacgaaatctgcgcgattttctgctggtgtacaaccgcatgactgagttatgctttcagcgctgtgtgccatctctccaccatagggcactggatgctgaggaggaggcatgtctgcacagctgtgcaggcaagctcatccacagtaatcatcgactgatggccgcatatgtgcagctgatgcctgccctagtgcagcggaggatcgcagactatgaagcagccagtgccgttcctggcgtggcggctgagcagcccggagttagtccatccggtagctag

SEQ ID NO: 223652 - DNA, 948 bp, Artificial Sequence
  Description of Artificial Sequence: Synthetic coding sequence
atgcacggccatggtggatacgatagtgacttctctgacgacgaaaggtgcggggagtcaagcaagcgtaaaaagagaacagtcgaggacgaccttctgctgcagaaaccgttccagaaagagaagcacggtaaggtggcccataaacaagtcgccgctgaattgctcgatcgcgaggaagcccgtaatcgcaggtttcatctcatcgccatggatgcgtatcagagacacactaagtttgtgaacgattacatcctgtactacggaggcaaaaaggaagatttcaaaaggctgggcgaaaatgataagacagatttggatgtgattagagaaaaccatagatttctctggaatgaggaggacgagatggatatgacatgggagaagagactcgccaaaaaatattatgacaaactgttcaaggaatactgtatcgctgatctgtcgaaatataaagagaacaagttcggctttaggtggagggtcgagaaagaggttatttccgggaagggacaatttttttgcggcaacaaatactgtgacaagaaagaagggttaaagtcatgggaggtgaactttgggtacatcgagcatggtgagaaacgaaatgccctcgtgaaactacgactctgtcaagagtgttcaattaagttaaattttcatcatcggagaaaagaaatcaagtccaagaagagaaaagacaagacaaagaaggactgcgaagaaagctcccacaaaaaaagcagactgagtagcgcggaggaagccagcaagaagaaggacaaggggcacagtagttccaaaaagagcgaggattcactcctgaggaattccgatgaagaagagagcgcctctgaaagcgagctgtggaaggggcctctgcctgagaccgatgaaaaatcccaggaggaggagtttgacgagtactttcaggacctctttctttag

SEQ ID NO: 223653 - DNA, 948 bp, Artificial Sequence
  Description of Artificial Sequence: Synthetic coding sequence
atgcatggccacggcggatatgattccgacttctcagacgatgaacggtgcggggaatcctcaaagcgtaagaaaagaaccgtggaagatgatttgctgttgcagaaaccctttcagaaggagaaacatggcaaggtcgctcacaaacaggttgcggctgagctcctcgacagggaggaagcaagaaacagaaggtttcatctgatcgccatggatgcctatcagagacataccaagtttgtgaatgactacatcctctattacggcggaaagaaagaagatttcaagcgcttgggcgagaacgacaaaactgacctggacgtgattagggaaaaccaccggtttctctggaatgaggaggacgagatggatatgacctgggaaaaacgcctggccaagaaatactatgacaagctgttcaaagaatattgcatcgcagacctgtccaaatataaagagaacaaattcgggtttcgctggcgggtggagaaggaagtgatcagcggcaaaggccagttcttctgcggcaacaagtactgtgataagaaagaaggccttaaaagctgggaggtgaatttcggttatatcgaacatggcgaaaaaaggaacgccttagttaaactgaggctctgccaagagtgtagcattaagctaaacttccaccatcgcaggaaagaaataaagtcaaaaaagagaaaggacaagaccaagaaggactgtgaagagagttctcacaaaaaaagcaggctatcctccgcagaggaagcttcaaagaagaaagacaagggccacagctcctcgaagaagagtgaggattcccttctcaggcggatgttggaggagctgcaaatgtttacttgggaaaagagtgagcgcatgggtggtaaaagactgatcatcattatcggcgaagagctatctgccaatgtgacaacgtttaaaatgtag

SEQ ID NO: 223654 - DNA, 942 bp, Artificial Sequence
  Description of Artificial Sequence: Synthetic coding sequence
atgcatgggcacgggggttatgatagcgattttagcgacgacgaacgttgcggcgagtcatccaaacggaagaagcgcacggtagaggacgatttgttgctgcagaaacctttccagaaggagaagcacggcaaggtagcccacaaacaagtggctgccgagctgcttgacagagaagaggcccgtaaccgcagattccatctgattgcaatggacgcctatcagcgccataccaagttcgttaacgactatattctatactacggaggcaagaaggaggattttaaacgtctgggagagaatgataaaactgatctggacgtgattcgggaaaatcaccgcttcctgtggaatgaagaggacgaaatggacatgacctgggaaaagagactcgcaaagaaatactatgataaactcttcaaagaatactgcattgccgaccttagtaaatacaaggaaaataaattcgggtttcggtggcgagtagagaaagaggtaatcagcgggaagggccaatttttctgtggcaacaaatattgtgataagaaggaaggccttaaatcctgggaagtgaactttggatatatcgagcacggggaaaagcgcaatgccttagtgaaattaaggttgtgtcaagagtgttccatcaaacttaactttcaccaccgtcgtaaagagatcaagtcaaagaaacggaaggataaaacaaaaaaagattgcgaagagtcatctcacaagaaatcacgcctatcaagcgcagaggaggcctctaagaagaaggacaagggacacagcagctccaagaagtctgaagatagtcttctcaatggcgtgatgctgttccaccccggttggtctgcggtggctcgttctcaactaacagccgcacccgcatcgcaagtgcagactaataatcactactggcgcggtgttgtctgctag

SEQ ID NO: 223655 - DNA, 879 bp, Artificial Sequence
  Description of Artificial Sequence: Synthetic coding sequence
atgcatggacatggcggttacgactcagatttctctgacgacgagagatgcggggaatcgagcaaacgcaaaaagcgcaccgtcgaagacgacctgctgctccaaaaacccttccaaaaggagaaacacgggaaagtcgctcacaagcaggtggccgctgagctgctggaccgagaggaagctcgaaaccggagattccatctgatcgccatggatgcctatcaacggcatacaaaatttgttaatgactatattctgtactacggaggcaagaaagaggactttaagagactgggggagaatgacaagactgatctcgacgtaattagggaaaatcatcgttttctgtggaatgaggaagacgaaatggatatgacatgggagaaacggctagccaaaaagtactatgacaaactgtttaaggagtattgtatcgcggacctgtcaaaatataaagagaataaatttggcttcagatggagagtggaaaaagaggtcatctctggcaaagggcagtttttctgtggcaacaagtattgcgataaaaaagaaggcctgaaatcctgggaagtgaacttcgggtatatcgaacacggcgaaaagcgaaatgccctggtgaagctgcggctgtgccaggaatgttccatcaaactcaacttccaccaccgaaggaaggaaataaaatcaaaaaaacgcaaggacaagaccaagaaggactgcgaagaaagttcacataaaaaatcaagactgtccagcgcagaagaggccagtaagaagaaagacaaggggcatagttcctccaagaagtcagaagattctctgttgaaaacttactttgtgggtttattgagcgagtcaaacgagaagacctatatgtag

SEQ ID NO: 223656 - DNA, 831 bp, Artificial Sequence
  Description of Artificial Sequence: Synthetic coding sequence
atgcacggccacggcggttatgacagcgacttctccgacgacgagcggtgtggagagagctcaaagcggaagaaacggacagttgaggatgatctgctgcttcaaaaacctttccagaaggaaaaacacggtaaggtagcccacaaacaggtggcagcagagttgttagaccgcgaggaggctaggaacagaaggttccatctaatcgccatggacgcatatcagcgccatacaaagtttgtgaacgattacatactgtattatgggggtaagaaggaagacttcaagagattaggagagaatgacaagactgacttggatgtcattcgcgaaaaccacagatttttatggaacgaagaagacgagatggatatgacttgggaaaagcgcttggcaaagaagtattacgacaagctgtttaaagagtattgcatcgctgacttaagcaagtacaaagaaaacaaattcggcttccgctggcgtgtggagaaagaagtgattagtgggaaggggcagttcttctgtggcaataagtactgcgacaagaaggaaggtctgaaaagctgggaagtgaattttggatatatcgagcacggcgaaaaacgcaatgcactggtcaaattgagattgtgccaggagtgtagcattaaactgaacttccaccatcggcgaaaagaaattaagagcaaaaagaggaaagataagaccaagaaagactgcgaggaatcctctcacaagaagtccagactaagtagcgctgaggaagcgagtaagaaaaaggataaaggacattcttcgagtaagaagtcagaagacagcttgctaaattag

SEQ ID NO: 223657 - DNA, 978 bp, Artificial Sequence
  Description of Artificial Sequence: Synthetic coding sequence
atgggcatctttccgggtatcattctcattttcctgagagttaaatttgccaccgctgccgtgattgtcagtggacaccagaagagtaccaccgtgtcccacgagatgtctggattaaattggaagccatttgtctatggaggtctcgcttctattgtcgcagagttcggcacattccccgtggacttgacgaaaactcgccttcaagtccaggggcagtctattgacgcgaggtttaaggaaatcaaatatcggggtatgttccatgcactttttagaatttgtaaggaagagggtgtcctggctttgtactcaggcatcgcacccgcactgttacggcaggcctcctatgggacaattaagatagggatttaccaatccctgaaacgcctgtttgtggaacgcctagaagacgagactttactgattaatatgatctgcggggtggtgagtggagtcattagcagcactatcgcgaatcccacagacgtacttaagatccgcatgcaggcacagggtagcctgtttcagggcagcatgatcggttcctttatcgatatataccagcaggagggcacacgaggcctatggcgaggcgtggttcctaccgcacagcgtgctgccattgtcgtaggagtggaactccccgtgtacgacatcacaaaaaaacatctcatcctgtccgggatgatgggcgacaccatcctcacgcattttgtgagctccttcacttgtgggttagccggtgccctggcgtccaatccagtcgacgtggtacgcactcgcatgatgaatcagagagcgatagtgggccacgtagatctgtacaaaggaactgttgatggcatcctgaagatgtggaagcatgagggcttcttcgccctgtataagggtttctggcccaactggctgcggctggggccttggaatattattttcttcatcacttacgaacaactgaagcgtctccagatctag

SEQ ID NO: 223658 - DNA, 894 bp, Artificial Sequence
  Description of Artificial Sequence: Synthetic coding sequence
atggaggaactggtcgtggaggtccggggttccaatggcgcattttataaggcttttgtcaaagacgtgcatgaagactctatcactgttgcctttgaaaacaactggcagcctgaccgccagattccatttcatgatgtacgttttccacctccggtgggatacaataaggacattaacgagtcggacgaggtggaggtgtactctcgggcaaacgagaaggaaccctgctgttggtggctcgccaaagttcgcatgattaagggggagttctatgtcattgagtatgccgcatgtgatgctacatataacgagattgttaccatcgaacgtctgcgttcagtgaaccccaataaaccggctacaaaggatacgttccacaaaatcaagctggatgttccggaggacctccgacagatgtgtgctaaggaggctgcccacaaggactttaaaaaggcagttggtgcttttagtgtgacctacgacccggaaaattatcagctcgtgattctctccatcaacgaggtgacctccaaaagagcacacatgcttattgacatgcattttagaagcttgcgcaccaaactatctttgataatgcggaacgaagaggcctccaaacaactggagtcatcaaggcagctcgccagtcggttccatgaacagttcattgtgagagaggatcttatgggtttagcgatcggtacccatggagctaacattcagcaggccagaaaggtcccaggcgtcactgcaatcgatctcgatgaggatacttgcacctttcatatctacggcgaagatcaggatgctgtgaagaaggccagatcattcctggaatttgctgaggatgtgattcaggttcccaggaacttagtgggcctgaagatctag

SEQ ID NO: 223659 - DNA, 1773 bp, Artificial Sequence
  Description of Artificial Sequence: Synthetic coding sequence
atggaggagctggtcgtagaagtgagagggagcaatggggctttctacaaggcatttgttaaagatgtgcatgaagattctatcacagtggcctttgaaaataattggcagcctgatcgccagataccctttcatgatgttaggtttccccctcccgtgggctacaacaaggatatcaatgagtccgatgaagtcgaggtgtactctcgagctaatgagaaagagccatgttgttggtggctggcgaaagttcgcatgattaagggagaattttacgtaatcgaatacgccgcatgtgacgccacatacaatgaaatcgtcacaattgagcgcctgagaagcgtgaaccccaataaacccgcaactaaggatacttttcataagatcaagcttgacgtacccgaagacctcaggcagatgtgtgcaaaagaggccgctcacaaagattttaagaaggccgttggcgctttctcggtgacatacgacccggaaaactaccagttagtgatactcagcatcaacgaggtgacatctaaacgcgcacacatgcttatagacatgcattttagatcgctccggacaaagctttcattaatcatgagaaacgaagaagccagcaaacagctcgagagcagccggcaacttgccagccgcttccatgaacaattcatcgttcgagaggatttgatggggcttgctattggcacacacggggctaatattcagcaagcaaggaaggtgccgggtgtcacagcaattgacctcgacgaagatacctgtacctttcacatatacggagaggaccaggacgccgtgaaaaaagcacgaagctttctcgaattcgccgaggacgtaatacaggtgccacgaaacctggtgggtaaggttattggcaagaatggcaaactaattcaagagatcgtggataaatctggcgtagtacgggtgcgcattgaagccgaaaacgagaagaacgtgcctcaggaggaagagattatgcctccaaatagcctccctagcaacaattcacgtgttgggccaaacgccccagaagagaaaaagcacctcgatatcaaagagaattctacacacttttcacagccaaattctacaaaggtacagcgggtcctagtggccagcagcgtggtcgcgggagaaagccaaaaaccagaactgaaggcctggcagggcatggtgccgttcgtcttcgtgggcaccaaggattccatcgcaaatgctacagtgcttctggattaccacttaaactatctcaaagaggtcgatcaactaaggctggagagattgcagatcgacgaacagctgcgccagatcggcgctagcagccggccaccacccaataggaccgataaagagaaatcttatgtaactgatgacggacaggggatgggcaggggaagtcgcccttaccggaaccgaggacacggcaggaggggccctggttacaccagcgcgcctaccgaagaggaacgcgaaagtttcctgcgcaggggtgacggtaggagaaggggtggtgggggtcggggacaagggggtcgcggacggggtggcggattcaaaggaaatgacgatcattcccgcactgataacaggccgcgaaaccctagagaagccaaaggcagaacaactgatggtagcctgcagaatacatcaagcgaaggctcaagactcagaacaggcaaggatcgaaatcagaagaaagagaagccggactctgtggatggacaacagcccctggtaaatggggtcccatag

SEQ ID NO: 223660 - DNA, 1614 bp, Artificial Sequence
  Description of Artificial Sequence: Synthetic coding sequence
atggaggagctggtggtggaggtgaggggaagtaacggcgctttttacaaagcctttgtgaaagacgtgcacgaagatagtattaccgtggcctttgaaaataattggcaacctgacaggcaaatccccttccacgacgtgcgcttccccccacctgtggggtataataaagatattaacgagagtgatgaagttgaggtatacagccgcgctaatgagaaggagccctgctgctggtggctggcaaaagtgagaatgatcaaaggagagttttacgtgattgagtacgctgcatgtgatgcaacttacaatgaaatcgtgacgatcgaacggctcaggagtgtcaatccgaacaagccagccaccaaggatacattccacaaaataaagctggatgttcccgaagatctgaggcagatgtgtgctaaggaggccgctcataaggacttcaagaaagcggtaggagctttcagtgtaacttacgatcccgaaaattatcaactagttatactgtccataaacgaagtgacatctaaacgcgcacatatgctaatcgacatgcactttaggtccctgcgaacgaagctcagcctcattatgcggaacgaagaagcgagcaagcaactcgaatctagtaggcagctggcgtcacgttttcacgagcagtttattgtgcgcgaggatttgatgggtctcgccatcggaactcacggggcaaatattcagcaggcgagaaaggtccctggcgtcacagccatcgatttggatgaggatacgtgcaccttccacatctatggcgaggaccaagatgccgtaaagaaggcaagaagcttcctggaatttgcagaagacgttattcaggtgcctcgcaatttggtaggaaaagttattgggaagaatgggaagctgatccaggaaattgttgataagtcaggagtggtccgagtcagaatagaagcagagaacgagaagaacgtgccccaggaggaggagatcatgcccccaaacagcctgcctagcaataacagtcgagttggccctaatgcccctgaggaaaaaaaacacctggatatcaaggagaacagtacccatttttcccaacccaactcaacaaaagtccaaagggtgctcgtggctagctcagttgttgccggtgagagtcagaaacctgagctcaaagcttggcaagggatggtgccttttgtgttcgtgggcactaaggacagcatagcaaacgcaaccgtgttactggattaccacctgaactatctgaagctgcagcagcggaagcggggacgcgcatcttgcgctgaagagacggatggcggtgttgaaggtgaggaggaggacaaagaggaggaagatgtcgaggaggcgtcgaaagagaccactattactccagaacagatcattgtgcacgtcatccaggaaaggctgaaggaggagcagcagatggacccttttaggagtgagctgaccgccattatgaagggagtctctacgttgaagcattacagaatccctcccgtgaaagtggtcggatgtgcccgtgtgaagattgtgacacgaagaaaacggagccagaccgcatggatggtcagcaatcacagctag

SEQ ID NO: 223661 - DNA, 1899 bp, Artificial Sequence
  Description of Artificial Sequence: Synthetic coding sequence
atggaggagctagtcgtggaagttcgaggctccaatggtgccttctataaggccttcgtcaaggacgtccatgaagatagtattaccgtggcttttgaaaataactggcagccggatcggcagatacctttccacgatgtgcggttccctccacctgttggctacaacaaggatattaatgaatccgatgaggtggaagtgtacagccgcgcaaacgaaaaagaaccctgttgttggtggctggctaaagtgaggatgattaagggcgaattctatgtaattgaatacgccgcttgcgatgccacatataatgagatcgtgactattgagcgcttgagatccgtcaaccccaacaagcccgctacgaaggatactttccataagattaaactcgatgtacccgaggacctgagacagatgtgtgccaaggaagcagcccataaggactttaagaaagccgttggggcttttagcgtaacctatgacccagagaattatcagctcgtgattttatctatcaatgaagtaactagtaagagggcgcatatgctcatcgacatgcattttagaagtctgcgaacaaaactgagtctgataatgcgaaacgaagaggcctctaagcagctggagtcctcaaggcaactggcatccagatttcacgagcagtttattgtacgggaggatctgatggggctggccatcggcactcacggagccaacattcagcaggcacgaaaagtccctggcgtgactgctattgatctggatgaggatacttgcacattccatatttatggcgaagatcaagatgctgtaaaaaaggctagaagcttcctggaattcgccgaagatgtgattcaggtgcctcgaaaccttgttggaaaagtgattggcaaaaacggaaaattgattcaggaaatagtcgacaaatcaggagtagtccgagtgcggatcgaggctgaaaatgagaagaacgtgcctcaggaagaagagattatgccacccaattctctcccgtctaacaatagtagggtcggacccaacgcccctgaggagaagaaacaccttgacattaaagagaacagcacccatttcagccagcctaatagcaccaaggttcagcgggtattagtggcaagttccgtggtagccggtgaatctcagaaaccagaactcaaggcttggcaagggatggttcctttcgtgtttgtgggcacaaaggatagcatcgcaaacgccacagtgttgcttgattaccacctgaactatcttaaagaggtcgaccagctgcgcttggagagattacagattgacgaacagctccgtcagattggagctagttctcgaccacctccaaatcgcacagacaaagagaaatcatatgtcaccgatgacgggcaaggcatggggcgagggtcccgaccctaccggaatcgcggacacggaaggagaggtccaggttacacatcgggcaccaattctgaggccagtaacgccagcgaaaccgaaagcgaccaccgcgacgagctgagcgactggtcactcgcccctacagaagaggaacgtgaatcatttctgagaaggggcgacggcaggcgtagagggggagggggaagaggccaggggggtcgcggtcgcggaggtggttttaaaggcaatgatgaccattccagaactgataataggccaagaaacccaagagaagctaagggccgaactactgatggctctctgcagatcagagttgactgcaacaacgagcggtccgtacatacaaaaaccctgcagaacaccagctccgaggggtccagactgagaactggcaaagaccggaaccagaaaaaggaaaaaccagactcagtcgatggccaacagcctctagttaatggagtcccctag

SEQ ID NO: 223662 - DNA, 1749 bp, Artificial Sequence
  Description of Artificial Sequence: Synthetic coding sequence
atggaagaattggtcgtggaagtcagaggctcaaacggcgcattctacaaggcctttgtcaaggatgtgcatgaggacagtattacagtcgcttttgagaataactggcaacccgaccgacagattcccttccatgacgtgcgcttcccccctcctgtcgggtacaacaaggatattaacgagagcgacgaggtggaggtatattctcgcgcaaatgagaaggaaccctgttgttggtggcttgccaaagtgcggatgattaagggcgagttttacgtaattgagtacgctgcctgcgatgcaacctacaatgaaatagtgaccatcgaaagactgagatccgtgaatcccaacaagcccgctaccaaggacacctttcacaagatcaaactagacgtgcctgaggacttaagacagatgtgcgctaaggaggcagcgcataaggacttcaagaaagccgtgggagcgtttagcgtgacatatgatccagaaaactaccagttggtgatccttagcattaacgaagtgacctcaaagcgggctcatatgctcattgatatgcacttccgttcactcaggacgaaattgtctttaatcatgagaaacgaagaggcctctaagcagttggagtctagcagacagctggcaagccgatttcacgaacaatttattgtccgtgaggacctgatggggctagctattggtactcacggggctaacatccagcaagcaaggaaagtccccggagtgactgcaatcgacctggacgaggacacatgcacattccatatttatggagaggatcaggatgccgtgaaaaaagcaaggtcattcttggaatttgccgaggatgtgattcaggtgccaaggaatttagttggcaaagtaattggcaagaacgggaaactgatccaagagatcgttgataagtctggcgtcgtaagggtgaggatcgaggcggagaacgaaaagaatgtcccccaggaggaggagatcatgcccccaaactctttaccctccaacaacagcagagtagggcctaacgctccagaggagaagaagcacctggatataaaggaaaactccactcatttttctcagcctaattccacaaaagttcaacggggaatggtgccttttgtcttcgtaggaaccaaggacagtatcgccaacgctacggtgctgctcgattaccatctcaattacctgaaagaagtcgaccagcttagacttgaacgactgcagatcgatgagcaattgcgccaaatcggggcttccagcaggccgcctcctaataggactgataaagaaaaaagctatgtgaccgacgacggacaagggatgggtcggggatcccgaccgtacagaaaccgcggtcacggcaggcgaggaccaggctatacaagcgaatccgaccaccgcgatgagctcagtgattggtccctcgcccctacagaagaggagcgggaaagttttctgcgccgaggggacggcagacggaggggcggaggcggaagggggcaaggaggcagggggagaggtgggggattcaaaggtaatgacgaccatagtagaaccgacaataggcccagaaatccaagggaggccaagggaagaacaacggacggctccctacagaatacatctagcgaaggatccagactgaggacaggcaaagatcgaaaccaaaaaaaggagaaaccagattcagttgacggacagcaaccattggtcaacggtgtgccctag

SEQ ID NO: 223663 - DNA, 1779 bp, Artificial Sequence
  Description of Artificial Sequence: Synthetic coding sequence
atggaagagctggtggtggaggtgcggggaagcaatggcgcattctataaagcttttgtgaaggatgtccacgaagactccatcacagtcgctttcgagaataactggcagccagatcggcaaatccccttccacgacgtgagattcccaccacctgtcggctataacaaggacatcaacgagtccgacgaagtcgaggtctattctagagcaaacgagaaggaaccctgttgttggtggttggccaaagttaggatgataaaaggtgaattttacgttattgagtacgctgcctgtgatgccacctacaacgagattgttacaattgaaaggctacggagtgtgaatcccaacaagcccgcaacaaaagacacattccataaaattaagctggatgtacccgaggatctgcggcagatgtgcgccaaggaggccgctcataaagatttcaagaaggcagtgggcgcattttcagtcacctatgatccggaaaattaccagctggtgatattgtccatcaacgaagtcacttcaaagcgagcccatatgctcatagatatgcacttccgatccctgaggaccaagctgtctctgattatgcggaacgaggaagctagcaagcagctggagagcagccgccaactagcatccaggttccacgagcaatttattgtgcgtgaagaccttatgggactagccattggcacacatggggctaacatccagcaggccagaaaggtccctggcgtaaccgccatcgatctggatgaagacacctgtaccttccacatttatggggaggatcaggacgccgtgaaaaaagcgaggtctttcctagaatttgccgaggatgtcatccaagtgcctaggaatcttgtggtaataggcaagaatggcaaactgattcaagaaatcgtggataaaagtggggtggtgagagtgcggatcgaggcggaaaatgagaaaaatgtgccacaagaagaagaaattatgccccctaatagcctccccagtaacaattcaagggtcgggcctaatgccccagaagaaaagaagcacctggatataaaagagaatagtactcacttttcccaacctaatagcacgaaagtgcagcgcggaatggtgccctttgtgtttgtggggacaaaggattctattgccaatgctacagtactgctcgactaccacttaaactatttaaaagaggtggaccaactgagactggagcggttgcagattgacgaacagttaaggcagattggcgcaagttcccggccaccacctaacaggacagacaaagaaaagagttacgttacagacgatggacagggaatgggacgcggatcgagaccttaccgaaaccgcggtcacggccgtcggggacccggttacacttccggcactaacagtgaagcctcgaacgcttcggaaactgaaagtgatcaccgcgacgagctgagtgattggtccttagctccgacagaggaggagcgggagtcctttttgcggagaggcgatggccgaagaagggggggaggaggtcgaggccagggtggtcggggtaggggtggcggattcaagggtaatgatgaccactctcggacagacaaccgccctcggaatcccagagaagctaaaggcaggacaacagacgggtcgcttcagaacacatcaagcgagggaagccgccttcggaccgggaaggataggaaccagaaaaaagaaaagcccgacagtgtggatgggcagcagcctctggtgaatggagtaccttag

SEQ ID NO: 223664 - DNA, 789 bp, Artificial Sequence
  Description of Artificial Sequence: Synthetic coding sequence
atgccgcctaacagccttccatccaataatagccgtgtcggtcccaacgctcccgaagagaagaagcacctggatatcaaagaaaactcaactcatttttcacagccaaatagcacaaaggtgcagcggggaatggtcccatttgtattcgtcgggacaaaggatagcatcgccaacgcgacggtcctgctggactatcacctgaattacttgaaagaagtggatcagctgaggcttgaaaggctgcagattgacgagcaattgcggcagatcggtgctagttctcgcccaccacccaatagaactgataaggagaagtcgtacgtcactgacgatggacaggggatgggcaggggatcacgaccctacaggaaccggggacacggacgacgcggtcccggatatacttcaggcaccaactcggaggcgtcgaatgccagtgagactgagagtgatcatcgcgatgagctgagcgattggtccctcgcacccaccgaggaggaaagagagtcattcctgcgtagaggcgacggtaggaggcggggtgggggtgggaggggccaaggcggacgtggtaggggagggggattcaaaggcaatgacgaccactcccgcacggataaccgcccaaggaatccaagggaagctaaggggcgtacaactgatggctctctgcaaaatacctccagcgaaggctcgcgactaaggaccgggaaggatcggaatcaaaagaaggaaaagccggatagtgttgacgggcagcagcctcttgtaaatggagtgccctag

SEQ ID NO: 223665 - DNA, 1611 bp, Artificial Sequence
  Description of Artificial Sequence: Synthetic coding sequence
atgatgaagggagaattctatgtgatagaatacgccgcttgtgacgcaacctacaacgaaatagtaacgttcgagaggctccgacctgttaatcagaataagactgtcaagaagaacacattcttcaagtgcactgtggacgtgccagaagaccttcgcgaagcatgcgctaacgaaaatgcccacaaagattttaaaaaagctgtcggtgcttgcaggatcttctaccacccagaaaccacacagttaatgattctctcagcctctgaagccacggttaagcgcgtcaatatacttagcgatatgcatctgcggtccattcggacaaagcttatgttgatgagtcgcaacgaggaagccacaaaacacctggagtgtaccaagcagttggcagccgctttccacgaggagttcgttgttcgcgaggatttgatgggattggcaataggtacgcacggctcgaacatccagcaggctaggaaagttcctggagtcacagcaattgaactcgacgaggatactgggacctttcgaatctatggtgagtcagcagatgctgttaaaaaggcccgtgggtttttggaattcgtcgaagacttcatccaagtgccacggaatctggtcggcaaagtgattggaaagaacggcaaggttatccaagagatcgtcgacaagagtggtgtggtgagagtaagaattgaaggtgataatgagaataaattgcctagagaggacggtatggtgccgtttgtattcgtcgggaccaaggaatctatcggcaacgtgcaggtgttactcgagtaccatatcgcatatttgaaagaggttgagcagctccgaatggagaggttgcaaatagatgagcaattgagacagatcggaagccggtcctattcaggcagaggaagaggaaggagggggcctaactacaccagcgggtatggtacaaactccgagctaagcaatccaagtgagaccgagagtgagcggaaggacgaactgtccgactggagtctcgcgggagaagatgaccgcgactcgagacatcaacgcgactcccgcaggagacctgggggaaggggcagaagtgtcagtggagggagaggacgaggaggccctcgcggaggtaaatcttcaattagctcagttcttaaggatcccgatagcaatccctatagcctgctggataatacagagagcgatcagactgctgataccgacgcctctgagtctcaccactccactaaccggagacgccgtagccgtcgcaggcggactgatgaggatgcagtgttgatggacggaatgacggagagcgatactgcgtcagttaacgagaatgggctggtaaccgtggccgattacatttcccgggcagagagccaatccagacagcgcaatctgccccgagagacattggccaaaaacaagaaagagatggcaaaggacgtcatcgaggagcacggcccatctgaaaaggccataaatgggcctacaagcgcttcaggagacgacattagtaaacttcagcgcactccgggagaggaaaaaattaacacacttaaggaggaaaacacccaggaagccgctgtgctcaatggcgtgagctag

SEQ ID NO: 223666 - DNA, 1866 bp, Artificial Sequence
  Description of Artificial Sequence: Synthetic coding sequence
atggccgaacttacagtcgaggtacggggtagtaatggcgcattttacaagggctttatcaaggacgtgcacgaggatagccttactgtggtcttcgaaaataactggcaacccgagaggcaagtgcctttcaacgaggtgcgccttccaccaccgccagatataaaaaaagaaatctctgaaggcgatgaggttgaggtgtactcacgggcaaatgatcaggaaccatgcggatggtggctcgctaaggtccggatgatgaagggagagttttatgtgattgagtacgctgcgtgcgatgcaacctacaacgagattgttacctttgagagactccggccagtgaaccagaacaaaacagttaaaaagaacacctttttcaagtgtactgtggatgtccctgaggacctccgcgaggcctgcgctaatgaaaacgcacacaaggacttcaagaaagctgtgggtgcatgccgcatcttctatcacccggagactacacagttgatgatacttagcgcatctgaagctaccgtgaagagggtaaacatcctctccgacatgcatcttaggagcataagaactaaactcatgcttatgagccgtaatgaggaagcaaccaagcacctcgagtgtacaaagcaactggctgcagccttccatgaggaattcgtggtgagggaggacctaatggggctggctataggaacacacggatctaatatccagcaggctcgcaaggtccctggcgtaaccgccattgaattggatgaggatacaggcactttcagaatctatggcgaatccgccgatgccgtgaagaaagcacgcggattcctggaattcgtcgaggactttatccaagtaccacggaatctggtagggaaagttatcggaaaaaatggcaaggtaatccaggagattgttgataaatctggcgttgttcgggtgaggattgaaggagacaacgaaaataagctccctagagaagatggtatggtccctttcgtattcgttggaaccaaggagtcaattggaaacgtgcaggtgctgctggagtatcacatagcctacctgaaagaggtggaacagctgcgcatggagaggctccagattgacgaacaactgcgtcagatcggcagtaggtcttactcaggcaggggacgaggacggagggggcctaactatacctctggctatggaacaaactccgaactgagcaatcccagcgaaacagaaagcgaaagaaaggacgaactatccgattggagcttagccggagaggatgatagggactcccgtcaccaaagggacagtcgccgacggcctggagggcgaggcaggtctgtgagcggcggaaggggacgtggcggtccaagaggcggtaagtcgtctatatccagcgtcctcaaggaccccgacagcaatccctattctctgcttgataacacagaatctgaccaaaccgctgacacagacgctagcgaatcacatcattccacaaacagaagacggcgaagccgaagaagaaggaccgatgaagatgccgtcctgatggatggaatgaccgagagcgatactgctagcgtgaatgagaatggtctcgtgactgtggctgactacatctctagagcggaatcgcaatctcgacaaaggaacctcccccgagaaaccttggctaaaaacaagaaagagatggccaaggacgtgattgaggaacacgggccaagcgagaaggccatcaatggccctacaagcgcctccggtgacgatatcagcaagctgcagaggactcccggtgaagagaagatcaatactttaaaggaggaaaatacccaagaggcagcagtcctcaatggtgtgagctag

SEQ ID NO: 223667 - DNA, 1620 bp, Artificial Sequence
  Description of Artificial Sequence: Synthetic coding sequence
atggccgagctgacagtggaggtgcgaggctctaatggggctttctataagggtttcattaaagatgttcatgaggatagcctgacagtggtgttcgagaataactggcaacccgaaagacaagttcccttcaatgaagtaagattgccacctccccctgatatcaagaaagagattagtgaaggcgacgaagtggaggtgtactctcgagccaacgaccaagaaccttgcggctggtggctggcaaaggtaagaatgatgaagggggagttttacgtcatcgagtacgccgcttgcgatgccacctacaatgaaatagtcacgtttgaaaggctgcgaccagtcaaccagaacaaaactgtgaagaaaaatacattctttaagtgcactgtcgacgtgcccgaggatcttagggaggcatgtgcaaatgagaacgctcataaggacttcaaaaaagctgtgggagcctgccggatcttttatcaccccgagacaacccaactgatgatcctgagcgcaagcgaagcgactgtcaagagggtcaatatcttaagtgacatgcatcttcgctcaatccggaccaagctgatgctgatgagccggaacgaggaggcaaccaagcacctggaatgtaccaaacaactcgctgctgccttccacgaagaattcgtagttagggaggatctgatgggtctggctatcgggacccacgggtcgaatattcagcaggctaggaaggtgcccggagttacggccatcgagttggacgaggacacaggtacttttcgaatctacggagaatccgcggatgctgttaagaaagctaggggcttcctggaatttgttgaggattttatacaagtgcccagaaacctggtgggtaaagtgataggcaagaatgggaaagttattcaggagattgtggacaaatccggcgtggttagagttcgtattgaaggggacaacgagaacaaactccccagagaggatgggatggtgccctttgttttcgtgggtacgaaagaatccataggaaacgtccaggttctgctcgagtaccacatcgcatatttgaaggaggtggaacagctgcgcatggagcggctgcagattgacgagcagctaagacagattggatcacggagctatagcggccgagggaggggtcggcgtggaccaaactatacatcaggctacggaaccaatagcgagctgtcgaacccaagtgagactgagagtgagcgcaaagatgagctctctgattggtcgctcgccggagaggacgatagggatagtcgacatcagcgtgattctaggaggaggccaggcggtcgcggtagatctgtttccgggggaagaggcagagggggaccaagagggggaaagtccagtatcagctctgtgctcaaggacccggactctaatccttacagcttgctagacaataccgagtcagaccagaccgccgacaccgatgcatccgaaagtcatcatagcaccaatagaaggaggcgatcccgccgacgccgaacagatgaggacgccgtactgatggatggaatgacagaatccgacacggcttctgttaacgaaaacggcctcggtaagagatgcgattag

SEQ ID NO: 223668 - DNA, 1827 bp, Artificial Sequence
  Description of Artificial Sequence: Synthetic coding sequence
atggtcaccgaggggttcattaaggacgttcatgaagactccctcacggtcgtgttcgaaaacaattggcagcctgaacgtcaagtgccgtttaatgaggttaggctgccccctcctccagatattaagaaagagattagcgaaggcgacgaagtggaggtgtactcccgcgcaaatgaccaggagccatgtgggtggtggctagctaaagtacggatgatgaagggagagttttacgtgatcgaatatgctgcctgcgacgctacgtacaacgaaattgttacatttgaaaggctccgcccagtgaatcaaaataaaactgttaagaaaaatacattctttaaatgcacagtagatgttcctgaagacctgagagaggcctgtgccaatgaaaacgcccacaaggattttaagaaagccgtgggcgcttgtcggattttttaccaccccgaaaccacccagcttatgattctctctgctagcgaagcaacagtcaaaagagtgaacatactcagcgacatgcacctcaggtccattcgaactaagttgatgctcatgagtagaaatgaagaagctaccaaacatctagaatgcacaaaacaactggcagccgcatttcacgaagaatttgtggttagagaggacctgatggggctggccatagggactcacggatccaacattcagcaggccagaaaagtgcccggtgtgaccgctatcgagttagacgaggatacagggacgttccgcatttacggggaaagtgctgatgccgtcaagaaggctcgtgggtttctggaatttgtagaggattttatacaagtccccagaaaccttgttggtaaagttatcggaaaaaatggtaaagtgattcaggagatcgttgacaagagcggggtggtgagggtgcgcattgagggcgataacgagaacaagttaccccgtgaggacggtatggtgccgttcgtgtttgttgggaccaaagagtccatcgggaacgtgcaggtcttactcgagtatcatatcgcctatctgaaggaggtggagcaactgagaatggagagactgcagatcgacgagcagttgcggcagataggctcccggtcctactctgggaggggacgtggacggcgtgggccaaattacacgtctggctatggtacaaatagcgagctctccaacccatctgaaacagagtctgagcggaaagatgagctgagtgattggtccctcgccggagaagacgatagagatagtaggcatcagagggactctaggcgccgaccaggcggacgcggtaggagcgtaagtggtgggagaggcaggggtggacctagggggggaaagtcatcaatcagctctgtcctgaaggacccagattcaaacccgtactcccttctcgataatactgaatccgaccagaccgccgacaccgatgcttccgagagccaccactcaacaaacaggcgtcgacggtccagacgcagacgcaccgatgaagatgcagtgctgatggacggaatgactgaaagcgacaccgccagcgtgaacgaaaacggcctcgtcactgtggcagattacatcagccgcgcagaaagtcagagcaggcaacgtaacctccctagagagacccttgctaagaataagaaggaaatggcaaaggacgtcatagaggagcacggtccttccgagaaagcaattaacggcccaactagcgcgtccggcgacgatatttcaaaacttcagcggacacctggggaggagaagatcaataccctgaaggaggagaacacacaggaagccgctgtactaaatggcgtcagctag

SEQ ID NO: 223669 - DNA, 2022 bp, Artificial Sequence
  Description of Artificial Sequence: Synthetic coding sequence
atgggcggactcgcttctggtggcgacgtcgaacctggtctccccgttgaagtcagaggctcgaacggtgctttttataagggtttcgtgaaagatgtgcatgaggatagcgtcacgatcttctttgagaataattggcagagcgagcgtcagatcccgtttggagacgtgagattaccacccccagcggactacaacaaggaaattaccgagggcgacgaagtggaggtgtatagtcgcgctaatgagcaggagccctgcgggtggtggctggctagggtacggatgatgaaaggagatttttacgtgatcgagtacgccgcttgtgatgccacctataacgagatcgtcacactagagaggttaaggccggtgaatcctaatcccctcgccactaaaggatcgttttttaaagtgacaatggccgtgcccgaagatctgcgtgaagcatgcagcaacgaaaacgtgcataaggagtttaaaaaggcactgggggctaactgtatcttcctgaacataactaatagcgagctctttattctgtcaactaccgaggcccctgtgaagagggcttccttactcggagatatgcatttccgcagtcttagaacaaagttgctgttgatgtcgagaaacgaagaggctacgaaacatttggagactagtaaacagctggcagccgcatttcaggaagaatttaccgtcagagaggatctgatggggttggccataggaactcatggtgctaacattcaacaggctaggaaggtacccggtgttactgccattgagctcggggaagaaacatgtacgttccggatttatggcgaaaccccggaggcatgcagacaggcgagatcatacctggaatttagcgaagattctgtgcaggttcctcggaaccttgtgggaaaggtaatcggcaaaaacggaaaagtcatccaggaaatcgtcgataaaagcggtgttgtccgggttcgggtggagggggataacgacaaaaagaaccctagagaagagggtatggtgccattcatatttgtgggcactcgcgagaacatttctaacgcccaagctttgctggagtaccacctgtcctatcttcaggaggtagaacaactcaggctggagaggctacagatcgatgaacaattgcggcagatcggtcttgggttcagaccacccggaagcggacggggtagtggtgggtcagacaaagccggatactcaactgacgagagctcgagctctagcttgcacgcaacgaggacctatgggggatcatatgggggtcgtggtagggggagaaggaccggaggtcccgcttacgggcctagttccgatgtgtcgaccgcgtccgagactgagtccgagaaacgcgaggagcccaaccgagcagggccaggtgatagggatcctcccacaagaggcgaagagtctaggcgaaggcccaccggcggaaggggaagagggccaccaccggctccaagacccacctcacggtataattcaagctcgatttcctccgtattaaaagatcccgactccaacccatattctctcctggataccagcgaaccagagccaccagtggatagcgaaccaggggaaccacctcctgcgagtgccaggcggcgacggagccggaggcgtaggaccgacgaggatcgaactgtgatggatggcggtctcgagtccgacggcccaaatatgactgagaatggacttgaggatgagagcagaccacagaggaggaacaggtcacgacgcaggcgcaaccggggtaacaggacggatggcagtatcagcggggaccgtcagcccgtgactgtggcggattacatcagccgggctgagtcgcaatccagacaaagaccaccactggagcgcacaaagccatctgaggatagtctgagcggtcaaaaaggcgatagcgtgtcaaagctgcctaagggtccctccgagaatggcgaattgtcagctccactggagttgggcagtatggtgaatggcgtgtcatag

SEQ ID NO: 223670 - DNA, 6539 bp, Artificial Sequence
  Description of Artificial Sequence: Synthetic coding sequence
atgaattctctgagctggggagccgctaatgccgtgctgttgcttctgcttctcgcctgggccagccctacctttatttctataaaccggggagtgagagtgatgaaaggacattctgcgtttctgtcaggcgatgatctgaaattcgccattcctaaggagaaagacgcgtgtaaagtggaggtggttatgaatgagcccatcacgcagcgggtgggtaagctgaccccccaggtttttgactgtcactttctgcccaatgaagtgaaatatgtccataacggctgcccgattctggatgaagacaccgtgaaactaaggttgtatcggttcaccgaaagggatacattcatagaaacattcattttgtgggtgtacctattggagccggattgcaatatcatccacatgagtaacaatgtgctcgaggttcccgagtttaacggcctgtcccaggctattgacaagaatctgctccggtttgattatgatcgcatggcaagcctggagtgtaccgtgtcgctggataccgccaggacccgactgcccgctcacggccagatggtgcttggagaacccaggcctgaagagcccaggggcgaccagcctcactcctttttccccgagtcgcagctccgcgctaaacttaaatgcccagggggtagttgcaccccaggcctgaagaaaatagggtccttgaaggtgagttgcgaagagttcctgcttatgggactgcgctatcagcatctcgacccaccatccccaaacatcgactatatttctatccaactggacctgacagatacacgcagcaagatcgtctacaaaagcgaatcggcttggttacctgtttacatacgggctggcatacctaatcagattccaaaggcagctttcatggccgtctttatactggaggtggatcagtttatcttgactagcctgacaacctcggtacttgactgcgaggaggatgaaacccccaaacctttgcttgtttttaacatcactaaagcccctctccagggatatgtgactcacctgctggaccacacccggccaattagcagtttcacttggaaagacctttccgatatgcagattgcttatcagcctccaaacagctctcactccgaacgcagacatgacgaggtggagctagaggtgtacgattttttcttcgaacgtagtgcccctatgaccgttcacataagtataaggaccgctgatacgaacgcgcctcgggtctcttggaataccggtctgagtctcttagaaggtcagagtcgcgcaattacttgggagcaatttcaggtagtagacaatgacgatatcggagcggttagactggttactgttggtggactacagcatggctggctgaccctgcgcggaggtaaaggctttctgtttacagtcgccgacttacaggctggagtggtacgttaccatcacgacgacagtgattcaaccaaggattttgttgtctttagaatctttgacggtcaccattctatcaggcacaaattcccaattaacgtcttgccaaaggatgactccccgccattcttaatcacaaatgtcgtgattgagctggaggaggggcagactatacttattcagggctctatgctgagagcctccgacgttgatgcatctgatgattatatattctttaatatcacaaagccgccacaggcaggcgagataatgaagaagcccggacctggcttgatcggataccccgtgcatgggttcctgcaaagggatctttttaacggcattatatactatagacattttgggggagaaatctttgaggatagtttccagttcgtcctctgggactctcacgagcccccaaacctaagcgtgccgcaagtggccacgatacacataacacctgtggacgatcaacttccgaaagaggcccctggagtttctagacatttggtcgtcaaagaaactgaggttgcctatattaccaaaaagcagctgcatttcatcgattcagaaagctatgatagggagctggtctatacaattaccactccccctttcttttcattctcacaccggcatctggatgccggaaagctttttatggttgactcaatccctaaagtggtgaagaatcctacggctttagagcttaggtctttcactcagcacgccgtgaattatatgaaagtggcctacatgccccctatgcaggacatcggtccacattgccgcgacgtgcagtttaccttttcggtgtcaaatcagcatggcggaacacttcacggcatctgctttaatattactattctgccagtggataatcaggtgcctgaagcgttcaccaatcctctcaaggtcacagaaggtggccagtccatcataagtaccgaacatatcctgatctccgacgccgatactaagttggacaatattgacctgtcactgagagagctccctctccacggaagagtcgagctgaacgggtttcctctgaattccggcggtacatttagctggggagaccttcatactctgaaggttcggtaccagcacgacggtaccgaggtgcttcaggatgatctgctcttagaggtgactgatggcacaaattctgcggaattcgtcctgcatgtcgaagtgttccctgtcaacgatgagccacctgtcctcaaagcagacctgatgccagtgatgaattgcagcgaagggggtgaggtagtgatcacatcggagtacattttcgcaacagatgtggacagcgacaacctgaagctgatgttcgtcatcgcacgagaaccccaacatggggttgtgagaagggcaggagtgacggtcgaccaattctctcagagagatgttatatcggaggccgtaacatataagcacactgggggtgagattggcttaatgccctgtttcgataccattacgttggtggtttctgacggggaggctggacctttcgttaatggatgttgctataatggcccaaatccctctgtgccattacatgcgtcttttccggtctatgatctcaacatcacagtttaccctgtggacaaccagcccccatctattgccattgggccagtgttcgtggtagatgaaggttgttctaccgctctgaccgtgaaccatctgagtgctactgacccggacaccgctgctgacgatctggaatttgtgctggtgagccctccacagtttgggtatctggaaaacattttgccatcagtcggctttgaaaaaagtaatatcggtatctcaattgactcctttcaatggaaggatatgaacgcattccatattaactatgtacagagcagacacctccggatagagcctacagcggaccagtttaccgtctatgtgactgacgggaaacaccactctctggaaattcctttcagcattattattaacccaacaaatgatgaggcccctgacttcgtggttcagaatatcactgtgtgtgagggacagatgaaagaactggattcctcaatcatttctgctgtagacttggacatcccccaggatgcattgctgttttccatcacacagaagccaaggcatggactgttgatagaccgcggattttctaaggatttcagcgagaataaacaaccagctaatccccatcagaagcacgctcctgtccattctttctcaatggagctgcttaagacgggaatgagactgacgtacatgcatgatgattccgagtctttggccgacgatttcacgattcaactcagcgatggaaagcacaagatcttaaagaccattagcgtcgaagttattccagtgaatgacgaaaagcccatgctaagcaagaaagcggagatcgccatgaacatgggggagactcgcatcataagcagcgctattttgtccgcaatcgatgaggattctccacgggaaaagatctattatgtattcgaaagattgccccagaacggccaactgcagctcaagattgggagggactgggtgcccctgagcccgggaatgaagtgcacccaggaagaggtcgatctgaacctcctccgctacactcacaccggagcaatggatagccaaaatcaggattctttcaccttctacttgtgggacgggaacaaccggagtccagcacttgactgtcagatcaccattaaagatatggagaagggtgacattgtgatcttgaccaagcccctggtggtttccaagggggatcgcggatttctcacgacgactaccctgctggcagtggatggcaccgacaaacctgaggaactgttgtatgtgatcactagtcctcccaggtatggccagattgagtacgtgcattatcctggcgttccaattaccaacttttctcagatggacgtcgtaggccagacagtatgttacgtgcacaagtcaaaggtgaccgtctctagcgatagattccgctttataatctcaaatggtctgagaacagagcacggggttttcgagataaccttagagacagtcgaccgtgccctccccgtagttacccgtaataaaggcctgcgccttgctcagggcgctgtagggttgttatcccctgacctcttgcagctaacagatccggatacccccgctgaaaacttaacctttcttcttgtgcagcttcctcagcacggacagctgtacttgtggggaacgggattgctacagcacaacttcacccagcaggatgtggacagcaaaaacgtggcctaccgccattctggcggagatagtcaaaccgactgctttacctttatggccactgatgggacaaatcaaggatttattgtaaacggaagggtgtgggaagagcccgtcttgtttacaattcaagtggaccagctcgacaagactgcgcctcgaattacactgcttcacagtccatcacaggtgggcctgctgaagaacgggtgctacggcatctatatcaccagtcgagtgctgaaagcctctgatccagacacagaagacgaccagatcatctttaagatcttgcagggccctaagcatggtcacctggagaacacaacaactggagagttcatccatgagaaattctctcagaaggacttgaatagcaagaccattctatatattattaatccttctctcgaagttaatagcgacactgtggaattccagataatggatcccacaggcaacagtgcgactccccagattctggagttgaaatggagccatatcgagtggtcccagactgaatacgaggtgtgcgagaatgtcggattgttgcccctggagatcattcgacggggatactccatggattcagcctttgtggggattaaggtcaatcaggtatccgcagcagtcggaaaggacttcacagtcatcccgtcaaaactgattcagttcgatcccggtatgtcaaccaagatgtggaacatcgccatcacctatgacgggcttgaggaagacgatgaggttttcgaggttattctgaactccccagtgaatgccgtcctgggtaccaagaccaaagccgctgtgaagatcctggacagtaaaggcggacagtgtcatccatcctattcctctaatcagtcaaagcattcaacctgggagaaaggcatatggcatctgctgccacccggtagctccagctccaccacttctgggtccttccaccttgagcgaagaccactgccatcatcgatgcaacttgcagtaatccggggagacaccctacggggattcgatagcactgatctctcccagcggaagctgaggactaggggcaatggaaagaccgtgcgaccgtcctccgtgtaccggaacggtaccgacatcatttacaactatcacgggatagtgagcctgaagctggaggacgactcattccctacccataaaagaaaagcgaaggtctctattatctcacaaccgcagaaaacaataaaggtcgccgagctccctcaggcagacaaagtggagtccacaaccgactcccatttccctcgccaggatcaacttccaagcttccctaagaattgtactctcgaactgaaggggctgtttcacttcgaggaagggattcagaagctgtaccagtgtaacggcattgcatggaaagcatggtccccgcagaccaaagatgtcgaagataagagctgccctgccggttggcaccagcactccgggtattgtcatatattaatcaccgagcaaaaggggacctggaacgctgccgcacaagcctgtagagagcagtacctgggaaacctggtcactgtcttttctagacagcacatgaggtggctatgggacattggcggtaggaaatcattttggattggtctcaatgatcaggtgcacgcagggcattgggagtggataggaggtgaacccgttgccttcaccaatggccgacggggaccaagtcaacgcagcaaactcggcaaatcatgcgtgctcgtgcagcggcagggtaaatggcagaccaaggattgtagacgggctaagcctcacaattatgtgtgtagccggaaacttta

SEQ ID NO: 223671 - DNA, 6542 bp, Artificial Sequence
  Description of Artificial Sequence: Synthetic coding sequence
atgaattcactgagctggggggcagcgaatgcagttttgctcttattgctgctggcctgggcctcccccaccttcatctccattaacaggggggtccgagtaatgaaaggccacagtgctttcctgtctggagatgatttgaaatttgccatcccaaaggagaaggacgcctgcaaggtggaagtcgttatgaacgagccaataacacaaagagttgggaaactgactccgcaggtatttgattgccacttcctgcctaatgaagtgaagtacgtgcacaatgggtgtccgattctggatgaggacaccgtaaagcttcggctctataggttcacagaaagagataccttcatcgagaccttcattctttgggtgtacctgctcgagccagactgcaatattatccacatgtcaaacaatgtcctcgaggtgccagagttcaacggcctatcccaggcaatcgacaagaacctgctccgtttcgactacgaccggatggctagcctcgaatgcactgtgtccctggatactgctcgtactcggttacccgctcacggccaaatggtgctgggagagccccgtcctgaagagcccagaggtgaccagcctcatagctttttcccagaatcacagctccgggctaagcttaagtgccctggcggtagctgtacacctggtctcaaaaaaatcggctctttaaaggtgagttgtgaagagttcctgttgatgggccttagataccagcatctcgaccctccttcccccaatattgactatatttccattcagctggacttgaccgacacgagatccaagatcgtctataagaaatctgagtctgcttggcttccagtttatatcagagcgggaatcccaaatcagatacctaaggcagcatttatggcggtgtttatactcgaagtagaccagtttatcctgacatctctgaccaccagcgtcttagactgtgaagaggacgagacaccaaaaccattgttggtatttaatataaccaaagccccattacagggctacgttactcacctactggaccatacacgcccaatctcctccttcacctggaaagatctcagcgacatgcagattgcgtaccagcccccaaatagttctcattcagagcgaaggcacgatgaggtcgagcttgaagtatacgacttcttcttcgaacggtcagctcctatgacagtgcatatctcgatccggaccgcagacactaacgctcctcgggtgtcatggaatactggcctcagtttgctcgaaggccaatcccgtgccattacctgggagcaattccaggtcgtggacaacgatgacattggtgcggtgcggctggtcacagtggggggtcttcagcacgggtggttgactctgcgaggaggtaaaggattccttttcacggtcgccgatctgcaagctggcgtggtgcgttatcatcatgatgacagtgactctacgaaagacttcgtagtatttaggatttttgatggacaccatagcattcgccacaaatttcctattaacgtgctgcctaaagatgacagtcctccatttctgattaccaatgtcgttattgagctggaagagggacagacaattttgattcaaggttccatgttgcgcgcttcagacgttgacgcaagtgatgattatatatttttcaacataaccaagccgccacaggctggagaaatcatgaaaaagcccggtcccggtttgataggctatccagtgcatgggtttctccaaagagatttgtttaatggaatcatttactataggcatttcgggggagaaattttcgaggactcgttccagttcgtcttgtgggactcccacgagccgccaaacttgtcagtccctcaagtcgccaccatccacattacaccggtcgatgatcagctgcctaaggaagcacctggcgtgtctagacatctcgtggttaaggagacagaggtcgcttatatcactaagaagcagctgcactttattgattctgagtcatatgatagagagctggtgtatacaatcaccacccctccattctttagcttctcgcatagacacttagatgctggcaagctgtttatggtggattccatccccaaggtggtgaagaatcctacagcactggaactgaggtcattcacacagcacgctgttaattatatgaaggtggcctatatgcctccaatgcaggacatcggccctcattgccgggatgtgcagtttactttcagtgtgagtaaccaacatggaggaacgctgcatggcatctgtttcaacatcacgatacttcctgttgacaatcaggtcccagaagctttcacaaaccctctgaaagtgaccgagggcggtcagtcgatcatcagtacagagcatatcctgattagcgacgcagacacaaaattggacaacatcgatctgtccctgagagaactgcctctgcacggccgagtggaactaaacgggtttcccttgaacagcggcggtaccttcagttggggcgacctgcacactctaaaagtgcgctaccagcatgatgggaccgaagtccttcaagacgatttactccttgaagtcacagatgggactaactcggcagagtttgtgcttcacgtcgaagtatttccagttaacgatgaaccaccagtgctcaaagcagacttgatgcctgtgatgaactgttcggagggcggtgaggtggtcatcacttctgaatacattttcgctaccgacgttgattccgacaacctgaagttaatgttcgtcatcgcaagggagccacagcacggtgttgttagaagggctggggttactgtggaccagttctcacagagggatgtgatcagtgaggccgtcacctataagcacactggcggtgagattgggcttatgccttgtttcgatacgatcaccttagttgtctcagacggcgaagctgggccatttgtgaacggatgttgctataatgggcctaacccaagtgtgcctctccacgcctccttccctgtgtacgacctcaatattaccgtctacccagtagacaatcagcctccctctatcgcaatcgggcctgtgtttgtggtcgacgaggggtgtagcactgccttgaccgtgaatcacctgtccgcgactgacccagataccgcagccgacgacctggagttcgtactcgtatcccccccacaattcggctatctagaaaatatactccccagcgttggcttcgaaaaaagtaatattgggatcagcattgacagttttcagtggaaggacatgaacgcatttcacataaactacgtgcagtcgcggcatctccgcatcgagcccaccgctgatcagttcactgtgtatgtcactgacggtaagcaccacagcttggaaatcccattttcaatcattatcaatccgacaaatgatgaggccccagactttgtcgtgcaaaatatcacagtatgtgaaggccagatgaaggagctggattcctctatcatatctgcggtagacctggacattccacaggacgcgctgctgttttctattacacagaaaccacgccacgggctgttgattgatcgtggattctccaaggatttttctgagaataagcagcctgccaatccgcaccaaaagcacgcacctgtgcactcgttttccatggagcttctgaagacaggcatgcgactgacgtatatgcatgacgactccgagtcactggcggacgattttacaatacagctgagtgatggcaagcacaaaatcctaaagaccatctccgttgaagtcattcctgtgaatgatgagaaaccaatgctctccaaaaaggcggaaattgcaatgaacatgggtgaaaccagaatcatctcaagcgcgatactctccgctatcgacgaggactcccccagggagaagatctattatgtgttcgagcggctccctcagaatgggcaactgcaactgaaaattgggagagattgggtgcctctgagcccaggaatgaagtgtacccaggaagaggtggatctcaacctacttaggtatacacataccggggcaatggattcacaaaatcaagacagcttcaccttttatctgtgggacggcaataatcggagccccgctcttgactgtcagattactatcaaggatatggagaagggcgatattgttattttgaccaagccactcgtggtgagtaaaggggaccggggattcctgacaacaacaacactgctagcagtcgacggcacagacaaacccgaggagttgctgtatgttattactagtcctccacggtatggtcagatcgaatacgttcattatcccggtgtcccaataaccaatttcagtcagatggacgttgtgggacaaacagtctgctacgttcacaagtccaaagttacagtgtcctctgacagatttaggttcattattagcaatggccttcgaactgagcatggcgtgttcgaaatcactctggagacagttgacagggccctccccgttgtaacccgcaataagggacttcggctggcacaaggagctgtggggctgctcagtcccgacttgttgcagttgacagatcccgacaccccagccgagaacctgaccttcctcctggttcagctgccacaacatggacagctgtacctgtgggggacaggtctgctgcagcataatttcactcagcaggatgtggacagcaagaatgtcgcctacagacacagcggaggggattcacagactgattgtttcaccttcatggccacggacggaacaaaccagggctttatcgtaaatggcagagtctgggaggagcccgtgttgtttaccatacaagtggatcagctggacaagacagccccacggatcactctgctccactctccttctcaggttggcctcttgaaaaatggatgttacggaatttatatcacgtcaagggttctcaaggcttccgatcccgacacagaagatgatcagattatattcaagatcttgcaggggcctaaacacggccacctagaaaacactacaacaggtgagttcattcatgagaagtttagccagaaagatctcaattctaagacaatcctctacatcatcaatccaagcttagaggtgaattctgatacggtagaattccaaatcatggaccccacaggcaactctgctacccctcagatccttgagcttaagtggtcacatattgagtggtcgcagactgaatacgaagtgtgcgaaaatgtaggcttgttaccgttggagatcattcggcgaggctatagcatggatagcgcttttgtgggaatcaaagtcaatcaggttagcgccgcagttggtaaggattttaccgtgattccttctaaacttattcagtttgaccctgggatgtctactaagatgtggaatatcgctatcacttatgacggtctagaggaagacgatgaagtcttcgaggtaatcctgaactcgcctgttaatgcagtactgggcaccaaaacgaaggctgccgtgaaaatcctggacagcaagggcggacagtgtcatcctagctatagcagcaaccagtccaagcactccacatgggagaaaggaatctggcacctgcttcccccaggatctagctcctcaacaacatcggggtcattccacttggaacggaggcctctgccgtcatccatgcagcttgcagtgatccgcggagataccctccgaggcttcgacagcaccgacttatctcaacggaaactgagaacacggggaaatggaaagaccgttcggccaagttctgtctacaggaatggaaccgacattatatacaattaccacggcatagtcagcctcaagctcgaagatgactcattccctacgcacaagcggaaggctaaggtgtcaatcatctcgcagccccagaagaccatcaaggtggccgaacttccgcaggctgacaaggtagagtcaacaaccgactcacacttcccacgccaggaccagctgccgtcatttcctaagaattgtacacttgaactaaaagggttattccatttcgaagaggggatccaaaaactctaccagtgtaatggaatcgcttggaaagcctggagcccacagacaaaagacgtggaggataaaagttgccctgctgggtggcaccagcattctgggtactgtcatatccttatcacagagcagaaagggacatggaatgctgctgcccaggcctgtagagaacagtaccttgggaaccttgtgaccgtcttctccaggcagcatatgagatggctctgggacatcggcggtcggaagtcattctggataggactcaatgatcaggtacacgccggacactgggaatggattgggggtgagcctgtggcattcaccaacggcaggagaggcccttctcagaggtcaaaactgggcaaatcatgtgttctcgtgcagagacagggaaagtggcagaccaaagattgtagacgggctaagccgcacaactatgtgtgctctaggaaattgta

SEQ ID NO: 223672 - DNA, 648 bp, Artificial Sequence
  Description of Artificial Sequence: Synthetic coding sequence
atgctggatgagagcctggctgttaggagaagtaagaaatgcaaggagatgattatgcactgggaaaaaaaggaggatatcgatatcgtcaacacagtggaccaacttgataaaacagcgcctaggatcacattactacattcaccatcccaggtaggacttctgaagaatggttgctacgggatttacatcacttcccgggtgttaaaggctagcgatccggacaccgaggatgaccagataattttcaagatccttcagggacccaagcatggccatcttgaaaacacaaccactggtgagttcattcacgaaaagttcagccagaaagacctgaatagcaagacaatcctgtatatcattaacccatccctcgaagtcaactccgacaccgtggagtttcagataatggatcccacaggcaacagtgcaaccccacaaatcttagagctgaaatggagccatatagagtggagccaaaccgaatacgaggtttgtgagaatgtgggtttacttcctttagaaatcataaggcgcggttattcgatggacagcgctttcgtggggatcaaggtgaatcaggtgtccgctgccgtaggcaaagactttaccgtgattcccagtaaattgattcagttcgatccttag

SEQ ID NO: 223673 - DNA, 2148 bp, Artificial Sequence
  Description of Artificial Sequence: Synthetic coding sequence
atggtaacccaggagagcatgctcaaggccgcactgcccttgtttactagattcataatctcaaatgggctgcggacagaacatggcgtgtttgagataaccctcgaaaccgtggacagagccctgcctgttgtcactcgcaataaaggtctcaggcttgcccagggtgccgtcgggctgctgagtccagacctgctccagttaactgatcctgatacaccagctgagaatcttacctttctgctcgtacaacttccacagcatgggcagctgtacctgtggggcaccggccttctgcagcacaactttacacagcaagacgtggacagcaaaaacgttgcttataggcactctggcggtgactctcaaactgactgctttaccttcatggcaacggacggaactaatcagggttttattgtcaatgggcgagtttgggaagaacccgtgttgtttacaattcaggtagaccaactggacaagaccgcccctagaattacactgctccattcaccctctcaggtggggttactaaagaacggctgttacggaatatacattaccagtcgagtgcttaaggcctcagacccagacacagaggatgatcaaataatctttaaaattctgcaggggccaaaacatggtcacctggagaacaccaccacgggcgaatttatccacgagaaatttagccagaaggatctgaatagcaagaccattctgtatattatcaatccctccctggaggtgaattctgatacagtggagtttcaaatcatggatcccacgggaaacagcgcaacccctcagattttggaacttaagtggtcccatattgaatggtcccagactgaatacgaggtctgcgaaaatgtgggcctgctacccctggaaattatccgtaggggttattctatggattccgccttcgtaggcataaaggtgaaccaagttagcgccgcagtgggcaaagatttcactgtgattccctctaagctgattcagtttgatcctgggatgtctaccaaaatgtggaatattgctataacctatgatgggctggaagaggacgatgaagtcttcgaagtcatcttgaattcccctgtgaacgccgttctgggcacaaagacaaaagcagccgtcaagattttagactccaagggagggcagtgccatccctcttattcatccaaccagtctaaacacagtacctgggagaagggaatctggcacctgttgccgccaggaagtagtagctccacaacctccggctcctttcatctcgaaagacgaccactaccgtctagcatgcagttagcagtgattagaggggatacactccggggattcgattccacagacctgtcacagaggaagctccgtacgaggggaaatgggaaaaccgtgagaccatcatcagtctatcgtaacgggaccgacattatttataattaccatggcatagtgagcctcaaactggaagacgacagctttcccacacataagaggaaagcaaaagtgtccatcatttcgcagccgcagaaaaccatcaaagtagcagaactacctcaagcggataaggttgagagcactacagactcccatttcccacgtcaggaccaactgcctagcttcccaaaaaactgcacactggaactgaaaggactctttcactttgaggaggggatacagaaattatatcagtgtaatgggatcgcttggaaagcttggtctccccagacaaaggacgtggaggacaagagttgccccgcaggatggcaccaacattctgggtattgtcacattttaattaccgagcagaaagggacctggaatgctgccgctcaggcttgtcgagaacagtacctggggaacttagtcaccgtgttctcacggcaacacatgcggtggctgtgggatattggaggacgcaaatctttctggatcggactgaacgatcaggtgcatgcgggacactgggagtggatcgggggagagccagttgctttcacaaacggcagacgcggaccatctcagcgctctaagcttggtaagagttgtgttttggttcagaggcagggaaagtggcagaccaaggactgtcgacgcgctaagcctcataactatgtgtgctctaggaaactgtag

SEQ ID NO: 223674 - DNA, 6539 bp, Artificial Sequence
  Description of Artificial Sequence: Synthetic coding sequence
atgaatagtttgtcttggggagccgcaaatgccgtgctgctgctcttattactcgcttgggctagcccaaccttcatcagtattaataggggcgtaagggttatgaagggccactccgcattcctgtccggagacgatctgaagttcgctatccccaaagagaaggacgcctgtaaagtggaagtcgtgatgaatgaacctataacgcagagagtggggaagctgacaccgcaggtgttcgactgtcatttcttgcccaacgaggtgaagtatgtgcataatggatgcccaattctcgacgaggacacggtgaaactcagactctacagattcactgaaagagacaccttcatcgagaccttcatactgtgggtctatctgctggagccggactgtaatataattcacatgagtaataatgtactcgaggtgcctgaatttaatggactctcgcaggccattgataagaacctgctgaggtttgattacgatcgaatggcatccctggaatgtacagtctctctggacacggcccgaacccgactccccgctcatggacagatggttctgggggagcctcggcctgaggagcctcgaggagaccaacctcactcgttcttcccagaatctcagctgcgggctaagcttaaatgccctgggggatcttgcaccccaggtctgaagaaaattggatcgttaaaagtgtcctgcgaagagttcctgctgatgggattgaggtaccagcatcttgatcccccatcacccaacatagattacatttccattcagctggatctcactgatacacgctctaaaattgtgtacaaatcagaaagtgcatggctgcccgtctacatcagagccggaatccccaaccagatccccaaagccgcttttatggccgtttttatcctggaagtggatcagtttattctaacctctctgaccaccagcgttctggattgtgaggaagacgagactcctaaacccctgctggtctttaatatcactaaggcccctctgcagggctatgtgacccatcttctagatcatacacgtcccattagctctttcacctggaaggatctttctgatatgcagattgcttaccaaccccctaatagctctcactcagaacggaggcacgacgaagtcgagctggaggtgtacgattttttttttgagagaagcgcccctatgacagtccacatcagtatcaggacggccgatactaatgcacctcgtgtgtcttggaacaccggattgtcacttctggagggacaatcacgggcaattacatgggagcaatttcaggtagtagataatgatgatatcggggctgtacgcctcgtgacagttgggggactgcagcacggatggctgaccttgcggggaggtaagggttttctgtttaccgtggctgatctccaggcaggggtggtgaggtaccatcacgatgactccgattctacaaaagacttcgtagttttccggatcttcgatgggcaccacagtatcagacacaagttccccattaacgtgcttccaaaagacgactcgcccccattcctgatcaccaatgtggtcatcgagttggaagaggggcagaccattttgatacagggaagtatgctccgtgccagcgatgttgatgcatcagacgactatatcttcttcaatatcactaaaccaccccaggccggtgaaattatgaaaaaacctggccctgggttgattggctatccggtccatggtttcctccagcgcgacctatttaatggcattatttattataggcacttcgggggagaaattttcgaggactctttccagtttgtgctgtgggattctcatgaaccccctaacctaagcgtcccccaggtggccaccatacacataacgcccgttgacgaccaacttcctaaagaagccccaggcgtaagccggcatcttgtagtcaaagaaacggaagttgcctatattaccaaaaagcaactgcacttcatcgatagcgagtcatacgaccgcgaactcgtttacaccataaccacacctcccttcttttcgtttagccatcgtcacttggatgccggaaaactcttcatggtcgattctatacccaaggtcgtgaagaatcctaccgcgctggaactgcgatcttttacccagcacgccgtcaattacatgaaagtcgcttacatgccacccatgcaggacatcggcccacattgcagggacgttcagtttacattttctgtctccaaccagcacggtggcacactgcatggcatatgctttaacatcacaatcttaccagttgacaatcaggtaccagaagctttcacaaaccccttgaaggttacagagggcggtcagagcatcatctccactgaacatatcctcattagtgatgccgataccaaattggacaatatagacctcagtctgagagaattacccctgcacggcagggtggaattaaacgggtttccattgaactctggcggaaccttctcttggggcgacctgcacactctcaaagtccgctaccagcacgatggaacagaggtactgcaggacgacctgctgctggaggtcaccgacggcactaactccgcagaattcgtgctgcatgtggaagtcttccctgttaatgatgagcctccagtcttaaaggctgatttaatgccagtcatgaattgtagtgaaggcggagaagtcgtcatcactagtgaatacatcttcgctactgacgtagattcagacaatttgaaacttatgttcgtgatcgctcgcgagccacagcacggagttgtcagacgtgccggtgtcactgtggaccaattttctcaaagggatgttataagcgaggcagtaacctacaagcacactgggggagagataggactgatgccttgctttgacacaatcaccctggtggtgagtgacggggaggcgggacccttcgtaaatggctgttgttataatggcccaaaccccagcgtgccactccatgcgtccttcccagtttacgacttgaacattacggtttacccggtggataatcagcctccctccatagctatcgggcctgtcttcgttgtggacgaggggtgctcaaccgcgctgacagtcaatcatctgagcgccacggacccagataccgctgccgatgaccttgagtttgtgcttgtctccccacctcagtttgggtacttggaaaatattctgccctctgttggattcgagaagtcaaatatcgggatctcaatagattctttccagtggaaggatatgaacgcctttcatattaactacgtgcaatcccgacatctcaggattgaacccacagccgatcagttcacagtctacgtgactgatggaaaacaccacagcctggagattccattttctatcattattaaccctaccaatgacgaggccccagacttcgttgttcaaaacataaccgtctgcgaagggcagatgaaggagctagacagttcaattataagtgccgtggacttggatatcccccaggacgccctgcttttttcaatcacccaaaagcccagacatggtttacttattgacagaggattcagtaaggacttcagtgaaaataagcaaccggctaaccctcatcagaaacatgcgcctgtccactcgttttctatggagcttctgaaaaccggaatgcgactgacctacatgcacgatgacagtgagtctctggccgacgatttcacaattcaactcagcgatggcaagcataagattcttaaaactattagtgtcgaagtcatcccagtgaatgacgaaaaacccatgctgtctaagaaagccgagattgccatgaacatgggggagactcgaatcatctctagtgcgatcctgtcggctattgacgaggactcacccagagaaaaaatttactatgtgttcgagcgtctgcctcaaaatggtcagctgcagctcaagatcggacgggattgggtgcctctctcccccggaatgaaatgcacacaggaggaggtcgatcttaaccttcttcggtacacacacactggcgcaatggattctcagaaccaggactcgtttacattctacctatgggacggaaataaccggagccccgcactcgactgccagattactatcaaggatatggagaaaggggacatagtgatcttgacgaaaccattggtggtttctaaaggagaccggggattccttaccaccaccacccttttggcagtcgacggcacggataagccagaagaattactttacgtcattacctctccccctaggtacggccaaattgagtacgtgcattaccctggagtgcccattacaaacttctcacagatggatgtcgtgggccagaccgtctgctatgttcataaaagcaaagtcactgtgtcctccgacaggttccggtttatcattagcaatggtcttaggactgagcacggtgtcttcgaaatcaccctggaaacagttgatcgcgctctccccgtggtaacacggaacaagggcctgagactggcccagggcgcagttggtttgttaagcccagaccttctgcagctgaccgatccggacacgccagctgaaaatctgaccttcctgctcgtgcagttacctcagcatggtcagctatatctatggggcaccgggctactgcagcataactttacccagcaggatgtggattcaaagaatgtggcctaccggcacagcggtggcgatagccagactgattgctttacattcatggctactgatggtacaaatcaagggtttatcgtgaacggacgggtgtgggaagaacctgtcctgttcacaattcaggtagaccagcttgacaaaacagctcctagaataactctcctgcacagcccctctcaggtcggcttacttaagaatggctgttatgggatatacattacatcaagggtgttaaaagcgtctgatcctgataccgaggatgaccagattatctttaaaatcctccagggaccaaagcacggacacctggagaatacgactactggtgaatttattcatgagaagttctctcaaaaagatctcaactccaaaacaattctgtacatcatcaatccgtccctggaagtaaactccgatacagtggaattccagatcatggaccccaccggaaacagtgccaccccacagatcctagagctgaagtggtcgcatattgagtggtctcagactgaatatgaagtgtgcgagaacgtggggctattgccacttgaaatcatccgcaggggctactctatggactccgcttttgtgggcattaaggtcaatcaggttagcgccgcagtagggaaagactttacagttatccccagcaagctcatccagttcgaccctggcatgtccacaaagatgtggaatatagccatcacctatgatggcctggaggaggacgacgaggtgtttgaggtgatccttaatagtcccgtgaacgccgtgctagggacaaaaaccaaagcggcagttaaaatactcgacagtaaaggaggtcagtgccacccatcctattcttctaatcaaagcaagcacagtacatgggagaaagggatatggcatctccttccacccggaagctcctcatccactacatccgggagctttcacctagaacgacgaccactgccctccagcatgcagctggccgtcatccgcggagatacactgcgaggttttgactccaccgatctcagccagaggaaacttcggacccggggtaacggcaagaccgttcgcccatcatctgtctatcgtaatggaaccgatatcatatacaactatcatgggattgtgtctttaaaactggaggacgattcttttccgacacataagcgcaaagccaaagtgagcatcatctcacaaccccagaaaacgattaaagtcgccgaactccctcaggctgataaggtcgaaagcaccaccgactctcatttccccagacaagatcagctgcctagcttccctaaaaattgcactctggaactaaaaggactgttccacttcgaggagggaatccaaaagttgtaccagtgcaatgggatcgcatggaaggcatggtctccgcaaacaaaggacgtggaggacaaaagctgcccggcaggttggcaccagcattccggctactgccacattctgataacagagcagaagggcacctggaacgcggctgctcaagcatgccgagagcaatatctgggtaatctggttacagtattctcccgccaacacatgaggtggctgtgggacatcggaggacgcaaatcgttttggatcggtctgaacgatcaggtgcatgcaggacattgggaatggataggcggagaacctgttgcctttaccaacggaagaagaggaccatctcagcgctccaaattaggtaagtcttgcgttcttgtgcaacggcaggggaaatggcagacgaaagactgtcggagggcaaagccacataactatgtttgttcaaggaagttgta

SEQ ID NO: 223675 - DNA, 9510 bp, Artificial Sequence
  Description of Artificial Sequence: Synthetic coding sequence
atgcattcagcagggacgcccggactgagttctcggcgaacaggcaatagcactagtttccagcctggcccacctccaccgccaagacttctcctgctccttctactgctgctgtcattagtctcaagagtccctgcccaacccgcagccttcggcagagcccttttgagcccaggtttagccggtgccgcaggcgtccccgctgaggaagccattgtcttggctaatcgcggtttaagggtaccctttggtcgcgaggtttggttagaccctctccatgacctggtactccaggtgcagccaggcgacagatgtgcggtgtcggtccttgataacgacgcattggcccaacgccctgggaggttgtctccgaaacggtttccatgtgatttcggccctggcgaagtcaggtactctcacctcggagctcgttctccatcaagagatagagtgcgtttgcagctcagatatgacgcacctggtggcgcagtagtcctgccattagtgcttgaagtggaagtggtgttcactcagcttgaggtcgttactcgcaatctgcctctcgtggtagaagagctgctgggaaccagtaatgctttagacgccagatcccttgagttcgccttccaacccgagactgaggagtgccgcgtgggaatcttaagcggattaggagccctgcctagatacggagagttgcttcactacccccaagtgcctgggggagccagagaggggggagccccagagaccctgcttatggattgtaaagcattccaggaattaggtgtgagataccggcatacagcagctagtcgctcgccaaacagggactggataccaatggtggtcgagctgcggagcaggggcgcacccgtgggaagccctgcattaaaacgggagcatttccaggtgttggttcgcattagggggggagccgaaaataccgcgccaaagccgtcattcgtggccatgatgatgatggaagtggaccaatttgttctaaccgcactgacacctgacatgctggcggcagaggatgccgagagcccgtctgatctgctcatctttaatctcacaagcccgtttcagcccggacagggctatttggtgagtaccgatgatcggagtctccccttgtcgtctttcacccaacgggaccttagactgctcaagatcgcgtatcagcctccttccgaggattccgaccaggaacggctgttcgagctggaactggaggtcgtagaccttgagggcgcagcctccgatccgttcgcttttatggtggtagtgaagcccatgaacacaatggccccagtggtcactcggaatactggtctaatcttgtacgagggccagagcaggcccctcacaggcccagccggttcaggacctcagaatctggtcatcagcgatgaggatgacctggaagccgtccgattggaagtcgttgctggtctgcgccacggtcatttggtcatattaggcgcatccagtggatcaagcgctccaaagtcttttactgtcgccgagctcgcagccggacaggtcgtgtaccagcacgatgaccgagacggctcactgtcagataatctcgtcttgcgaatggtggacggtggagggcgtcatcaggttcaatttttgttcccaatcacattggtgccagtggacgatcagcctccagtcctgaatgcaaacaccgggcttaccctggcagaaggggagaccgtgcccatcctgcccttgtcgctttcagcgacagatatggattcagatgacagcctccttctttttgtgctggagtcacccttcctgaccaccggacatctgctcctcagacagactcacccaccacatgagaagcaggagctgctacggggtttatggaggaaggaaggtgcattctatgagaggacggtcaccgagtggcagcagcaggacatcacagaaggccgtctgttttacagacactccgggcctcactctccgggacctgtgacagaccagtttacatttagagtgcaagacaatcacgatccacccaaccagagtgggctgcagcgatttgtgatccgtatacatcccgtagaccggctccctcctgagttaggatccggatgccccctgagaatggtggttcaggaaagtcaattgacacctctccgcaagaagtggttacgttatacagatctggacacagacgacagggaattacgctatactgtaacacaatcacctaccgacactgacgagaaccacctgcctgctcccctgggaactttggtgctcacagataacccttccgtagtcgtgacccactttacacaggctcagatcaaccatcacaagatcgcttatcggccaccaggacaggagctcggagttgctactagagtggcccaattccagttccaggtggaagaccgagcaggaaacgtggcaccagggactttcaccctgtatctgcatcctgtggacaaccagccacccgagatactcaacactggattcaccattcaggagaagggtcaccacatcctaagcgaaacagagctacacgttaatgacgtggataccgatgttgcccacatctcattcactctcactcaggctcccaaacatgggcatatgcgcgtgagcggccagatcctccacgtgggcggactcttccacctggaagatatcaagcagggtcgggtgagctacgcacataatggagataagtcactgacagattcctgctctttggaagtttcagatcggcaccacgtcgttcctatcactctgcgcgttaacgtgcgaccggtagatgatgaggtaccgatactgtctcacccaactggaacactggaatcatacctggacgtcctggagaatggggcaacagaaatcaccgccaacgtcatcaaaggtacaaatgaagaaacagatgacctgatgctgactttcctactagaggacccccctctgtacggtgagatcctggtcaacggcatccccgctgagcagttcactcagcgggacatcctagaggggtcggtggtgtacacccataccagtggtgaaatcggcctgctccccaaggctgattcgtttaatctctctctgtccgatatgtcccaagagtggcgcattggtggtaatactatccagggagtaacaatttgggtcacgatattaccagtggatagtcaggcacccgagatattcgtgggggaacagttaattgttatggagggcgacaagagcgttatcacatcagttcacatcagcgccgaagacgtcgacagcctgaacgacgatattctctgcactattgtcattcagcccacctcaggctatgtcgagaacataagcccagcccctgggtcggagaaatctagggcgggtatcgctatttctgctttcaacttgaaagatttgagacagggacatataaattacgtccaatccgtgcacaaaggagtggaacctgtggaggaccggtttgtgttcaggtgtagcgacggtattaatttttctgaaagacagtttttcccaattgtcataattccaactaatgacgagcaacctgagatgtttatgcgcgagttcatggtgatggaggggatgtcactggtcatcgacacacctatcttaaatgctgccgacgcggacgtccctctcgatgatctcacgtttaccattacacaatttccaacacacgggcatatcatgaatcagctaatcaatgggactgttctggtggagagttttaccctagatcaaataattgagagctcttccatcatttacgaacacgacgattccgaaactcaggaggacagctttgttattaagctgacggacggtaaacattctgtggagaagaccgtgcttataatcgttatccctgtggatgatgagacacccagaatgaccattaacaatggtttggaaatcgagatcggggacaccaagataattaacaataaaatcttgatggcgaccgatttggattctgaagacaaatcgctggtgtacattataaggtacgggccaggtcacggattacttcagcggagaaaacccacgggcgcttttgagaacatcacccttggtatgaacttcacacaagacgaagtcgatcgaaacctcattcagtacgtgcatttggggcaggaaggcatacgggatctcatcaagtttgacgtcactgatggcataaatccccttatcgacagatacttctacgtctcgatcggttccattgatatcgtatttccggatgtcatttcaaagggagtcagccttaaggagggcggaaaggttacgctgacaacagacctcctctcaacttcagacctgaactcgcccgatgaaaacttggtcttcactatcactcgagcgccaatgcgcggacatctggagtgtacggaccagccaggcgtctcaattacctccttcacacagctacagcttgcgggaaacaaaatctattatatccatacagctgacgatgaagtgaagatggactctttcgagttccaggttaccgacggacgcaacccggtgttccgaacattcagaataagcatcagtgatgtggacaacaagaaaccagtagtgacgattcataagttagtggtgtcggagagcgaaaataagttgataacaccgtttgaattaaccgtcgaggatagggatacgccagacaaacttctaaagttcacaattactcaggtccccattcatggacacctactgttcaataacactcggcctgtgatggtgtttacgaagcaggacctgaacgagaacttgatctcatataagcatgatggcaccgagagctctgaggattcattttcttttactgtgaccgatggcacacatacggatttctacgttttcccggatactgtttttgaaacacgtaggccacaggtgatgaaaattcaagtgctggctgtagacaacagtgtaccacaaattgccgtaaataagggggctagcactctgcgaacccttgccacaggccacctgggtttcatgattacctccaaaatcttaaaagttgaggatagagactctctgcatatttctcttagatttattgttaccgaggcccctcagcatgggtatttacttaacctggataagggtaatcattccattacacaattcacgcaggctgacattgatgacatgaaaatctgctatgtgttgcgggagggagccaacgctacgtccgacatgttctacttcgctgttgaggatggcggagggaataaactaacttaccagaatttcaggctgaactgggcctggatttcattcgagaaggaatactatctggtgaatgaagacagtaagttcctagatgtcgtcttgaaacgacggggttatcttggcgaaacttcattcatttccataggcactcgggaccggacagccgagaaggataaggatttcaaaggaaaagcgcagaagcaggttcaatttaaccctgggcagactcgcgcaacttggcgggtgagaattttgtcagatggtgagcatgagcagagcgagacattccaggtcgtactttccgaacctgttctggccgcactggaattccctaccgtcgcgaccgtcgagattgtggaccccggtgatgaacctactgtgtttataccacaaagcaaatatagtgtggaagaggacgtcggcgaactcttcataccaattagaaggtcaggggatgtctctcaggaattgatggtggtgtgttacacgcagcaggggaccgctacgggaacggtgcctacatctgtcttatcctactctgattatatctctagacccgaggaccatacctccgttgtgaggtttgataaagacgagagggagaagctctgcaggatcgttattatcgacgactctctgtatgaagaagaggagaccttccatgtgctactgagtatgccgatgggcggaaggatcggcagcgagtttcccggagcccaggtgactatcgtgccagataaggacgatgagccaattttttatttcggggatgtggaatactctgtggatgagtctgccggatatgtggaagttcaagtctggaggaccggaacggatctgtcaaaaagctcctctgttactgtcaggagcaggaaaaccgatccaccatccgctgacgcagggactgactacgtcggaatctccaggaacttggactttgccccaggcgtaaatatgcagcctgtacgcgttgtaattcttgatgacttgggccagcctgcccttgagggcattgaaaaattcgagcttgtactgcggatgcccatgaacgccgcattgggtgagccctctaaagccactgtttcaattaatgattccgtgagcgatctgcccaaaatgcagtttaaggagcggatctacaccggatccgaatccgatggacagattgtgaccatgatccatcgaacgggcgacgtacaatacagatcttccgtcaggtgctacacacgccaaggctccgcccaggtgatgatggacttcgaggagcgtccaaatacagatacctccatcataactttcttgcccggtgaaaccgagaagccctgtattctcgaacttatggacgacgtgctgtacgaggaggtggaggaattgcggctcgtactcggaactcctcagtccaactctcccttcggcgctgcagtgggcgagcagaacgaaactctcatccgcatacgcgatgacgcagacaagacagttatcaaattcggggagaccaagttttctgtcaccgagccgaaagaacccggagagtcagttgtgattcgtatcccagtgatcaggcagggggacacatcaaaagttagcattgtgagagtccacacaaaggacgggtcagcaacatcaggtgaggattatcaccccgtttccgaagagatcgagttcaaggagggggagacacaacacgttgtggagatcgaggtaaccttcgatggagtgcgcgagatgagggaggcgtttacagttcatcttaagcctgatgaaaacatgatcgcagagatgcaactgacgaaagcgatcgtctacatagaggagatgagctcgatggccgacgttaccttcccatcggtaccacaaatcgtgagtctgctcatgtacgatgatacctcaaaggccaaggagagcgctgagccaatgtccggctatccggtcatatgcatcactgcttgcaatcccaagtactccgactatgataaaacaggatccatatgcgcctctgaaaatatcaacgatacactgacccgatatcgctggttgatctccgctccagctgggcctgatggagtgacgtcacctatgagagaggttgactttgataccttcttcacatctagtaaaatggtaacactcgattctatttattttcagcccggatcccgtgtacagtgcgccgcaagggcagtgaatactaacggagacgaaggattagagttaatgagccctatcgtgacaattagcagagaagagggactatgccagcctagagtgcctggagtggtcggcgcagaacccttctctgctaaactgcggtataccggaccagaggatgctgattacactaacttaattaaactgaccgtcaccatgccccacattgatggtatgctgcccgtgattagcacaagagagctcagcaacttcgaactcaccctgagcccagacggcacgagagttgggaatcacaagtgctcaaacctcctggattataccgaggtgaaaactcactatggctttctcaccgacgcaacaaaaaaccccgaaataatcggcgaaacatacccttaccagtacagtctgagtattcgcggatctacaacacttcgcttttatcgcaatctgaatctggaagcctgtctatgggagtttgtgagttactacgacatgagcgaacttttggccgactgtggtggaacaattggtacagacggtcaggttctgaatctcgtacagagctacgttaccctcagagtacccctgtacgtcagttatgtctttcatagcccagtcggtgtgggaggctggcagcattttgatctgaaaagtgaacttagacttaccttcgtgtacgatacggcaatactctggaacgatggaataggctccccacccgaggccgagcttcaaggtagtttgtaccccacttctatgcggataggggatgaggggagactggcagttcacttcaagactgaggcacagtttcatggactcttcgtactcagtcatcctgcttcatttacaagttccgtgatcatgtcagctgatcatcctggcttgaccttttcattacggctgattcgcagcgagccgacctacaatcagccagtgcagcagtggagcttcgtgtctgattttgctgtgagagactactcaggaacttacaccgtaaagctggtgccgtgcacagccccaagccatcaggagtatcggctgcccgtaacatgcaaccctcgtgagcctgtgaccttcgacctcgatattaggttccagcaggtgtcagatcctgtcgctgccgaattctctctgaatacccagatgtacctgctgtccaaaaagtccctctggctctctgatggatcaatgggatttggccaggagtccgacgtggcattcgcagagggcgatataatttacggcagggtgatggtcgatcccgtgcaaaacctcggcgattccttttattgctctatcgagaaagtgttcctatgtacaggggctgatgggtatgtacccaaatattctcccatgaatgccgaatatggctgcctggctgattcgccttccctgctgtaccgcttcaaaatcgtcgacaaggcgcagcctgaaactcaagcaacatcgttcggcaatgttttgttcaacgccaagctggccgtggatgatcctgaagcaatcctcctagtgaaccaaccaggaagtgatggatttaaagttgattcgactccactctttcaagtcgcactgggcagggaatggtatatccatactatatataccgtgcggagcaaggacaatgcaaatagggggatcggtaagcggagtgttgaataccacagtctcgtgagccaagggaaaccacaatcaaccaccaagagccgtaagaagcgtgagatccgatccacaccctcccttgcatgggaaatcggggctgaaaatagtagaggtaccaacatccagcacatcgccctggatcgtaccaagcgacagattcctcacggtcgggcaccccctgacggaatactgccttgggagctgaatagcccctcatctgccgtgtcgctggtcacggtggtgggtggcaccacagttggcctgctcacaatttgtctcactgtaatcgcggtgctcatgtgcagaggaaaagagagctttagaggcaaggacgcgccaaaaggatcctcatccagcgagccaatggtgccacctcagagtcatcataatgacagtagcgaagtttag

SEQ ID NO: 223676 - DNA, 12039 bp, Artificial Sequence
  Description of Artificial Sequence: Synthetic coding sequence
atgggagtgctgaaagtgtggttaggattagccctagcattggccgagttcgcagtgctcccacaccacagcgagggagcttgcgtatatcaggattctctcctggccgacgccaccatctggaaaccggacagctgccagagttgtaggtgccacggagacattgtaatatgcaaacctgccgtttgtcggaaccctcagtgtgcctttgaaaagggcgaggttctgcagatcgctgcgaaccagtgttgcccagaatgcgtgctccgtacaccaggctcatgtcaccacgagaagaagattcacgagcatgggaccgagtgggcatcatctccctgcagcgtgtgttcatgcaaccatggcgaagtacggtgcacgccccaaccctgcccccctctgtcttgcggccatcaggagcttgccttcatcccagaaggcagctgttgccctgtgtgcgtcggccttggaaagccctgcagttatgaaggccatgtgtttcaggatggggaagactggcggttgtcgcggtgcgcgaaatgcctgtgcagaaatggcgtcgcccaatgtttcactgcccagtgtcagcccttgttctgtaaccaagatgaaaccgtagtgagagttcccggaaagtgttgcccgcaatgcagcgcccgttcatgttctgccgcaggccaagtgtacgaacacggcgaacagtggagtgagaatgcatgcaccacttgcatttgtgatcgcggagaggtgaggtgccacaagcaggcttgcctgcctctgcggtgcgggaaaggccagtcgagagcccgacgccacggtcagtgctgtgaggaatgcgtcagccccgctggatcttgctcgtacgatggcgttgtgagatatcaagacgaaatgtggaagggaagcgcgtgcgagttttgtatgtgcgaccacggccaggtaacctgccagacaggtgaatgtgctaaagttgagtgcgccagggacgaagaactgatccacctggacggcaagtgctgtccagagtgtattagtagaaacggttactgtgtgtacgaagagaccggcgagtttatgtctagcaacgcctccgaggtgaagaggattcctgaaggcgaaaaatgggaggatggtccttgtaaagtgtgcgaatgcagaggcgctcaggttacctgttatgaaccatcctgcccaccatgtcctgtgggcacattggcccttgaggtgaagggccaatgttgccctgactgcacatccgtgcattgtcaccctgactgtctgacctgctcccagtccccagatcattgcgatctgtgtcaggaccccacaaaactgttacagaacgggtggtgcgtccacagttgtggcctaggtttttaccaggctggatcactgtgtctcgcatgtcagccacaatgctccacatgtaccagcggactggagtgttctagctgccaaccacctctgctgatgagacacgggcagtgcgttcccacctgcggggacggattttatcaggaccgacactcttgcgctgtttgtcatgagtcctgcgctgggtgctgggggcctacggagaaacattgcctggcatgccgggatcccttgcatgtgctgcgtgatggcggatgcgaaagcagctgcggcaagggattttacaaccgacagggaacttgttctgcatgcgatcagtcttgtgactcttgtggaccctccagccctcggtgtcttacatgtactgagaagactgtcctgcacgacggaaaatgtatgagtgagtgtcctgggggatattacgctgacgcgacaggtcgttgcaaggtctgccacaattcttgcgcctcatgtagcggtcctaccccctcacactgcacggcctgctcaccacctaaggcactgcgacagggccactgcctaccccgatgcggagaggggttttattcagatcatggagtgtgcaaggcgtgtcatagttcatgcctcgcttgtatggggcctgccccttcacactgcactggttgtaaaaagcccgaagaaggccttcaggtggagcagctttcagatgtcggaatcccaagcggcgagtgcttggcacagtgtagggcccatttctatctagagagtactggcatttgcgaggcatgtcatcagagctgctttcgctgcgccggtaaaagtccccataactgtacggattgcgggccttcccatgtgctactcgatggccaatgcctgtctcagtgcccagatggatacttccaccaggaaggtagttgcactgagtgccatcctacttgccggcagtgtcacggcccacttgaatctgattgcatttcttgttatccacacatttctctcacaaacggcaactgcaggaccagctgtagggaagagcaatttttaaacctggtcggatactgtgcagattgtcaccatctttgccagcattgtgctgccgatttgcacaatacaggaagcatttgccttagatgtcagaatgcgcattacctactgctgggggatcattgcgtgcccgactgtccgagcggctattacgccgagaggggtgcctgcaagaagtgtcatagtagctgccggacctgtcagggtcggggacccttctcttgtagctcatgcgatactaacctcgtgctctcccacacagggacatgttccaccacttgctttcctggccactatttagacgacaatcacgtgtgccagccttgcaatacacactgtggttcttgcgactcacaagctagttgtacttcctgtcgtgatcctaataaggtcctcctgtttggtgagtgccagtatgagagctgcgccccacaatactatctcgatttttctacgaatacatgcaaagagtgcgactggtcttgctcagcatgctcagggccactcaagacggactgcttacaatgcatggatgggtatgtcctgcaggacggcgcatgtgtcgaacagtgcctgagctccttctatcaggacagtggtttatgcaagaactgcgactcctactgcctccagtgtcagggtccccacgagtgtacccgctgcaagggtccgtttctgctgttggaagcacagtgcgtgcaggagtgtggcaagggatattttgctgaccacgccaagcacaagtgcaccgcctgccctcaaggctgtcttcagtgctcgcaccgcgatagatgtcatctgtgcgatcacggcttttttttgaaatctggtctgtgtgtgtataactgcgttccgggtttttccgtacacacttctaacgaaacatgctctgggaaaattcataccccctctttgcacgtaaatggatcccttatcttgccaatcgggtccataaagccactggacttctcattgctcaacgtgcaggatcaggaggggcgtgtggaagacctcctgtttcacgttgtctctacccctaccaacggtcagctcgtgctttcgcggaatgggaaggaggtacagttagataaagcagggcgtttttcctggaaagacgtgaatgaaaaaaaggtaaggtttgttcattctaaagagaagctgagaaaaggctacctgtttctcaagatctcagatcagcagtttttctccgaacctcagttaattaacatccaggccttctctacccaggccccatacgtcctaaggaacgaagttttgcacatttctaggggagaaagggccacaatcacgactcagatgcttgacatccgggatgatgacaatccccaggacgttgtgatcgaaattatcgatccacctctccacggacagctcctgcagactctgcaatccccagctaccccaatctatcagtttcagctggatgaattgtcccggggactgctgcactacgcacacgatggctctgactcaacttcggatgtcgcggtgctccaggctaatgacggacactctttccacaacatcctgttccaggtcaagacagtcccacagaacgacagaggcctccagttggtggctaattctatggtgtgggtgcccgaaggtggcatgctgcagattacaaacagaattctgcaggctgaagcaccaggtgcaagtgccgaagagatcatttacaagatcacacaggattacccccagttcggggaagtggtgcttcttgtgaatatgccagccgactcccctgccgacgaggggcagcacctgccagacgggcgaacagctactcccacctccacattcacccagcaggacatcaacgagggtatcgtctggtatcgccattctggcgctcctgcccagtcagactccttcaggttcgaagtctcatcagcttcaaatgcacaaacgcgactcgagtcccacatgtttaatatcgcgattcttccccagactcctgaagcaccaaaggtgtccctggaggccagcctgcatatgaccgcgagagaagatggtctcaccgtcatccagccccactccctgtcttttataaacagcgaaaagccatccgggaagattgtctataatatcactttgccactgcatcctaaccagggcatcatagagcaccgggaccacccccactcccctattcgctactttacccaagaggacatcaatcagggcaaagtcatgtacaggccccctccagcagccccacatcttcaggaactgatggccttctccttcgctggtcttccagaaagcgtgaagttccactttaccgtcagtgatggtgagcatacctctccagaaatggtgctgaccattcatctcttgccgtcagaccaacagctgcctgtcttccaggtgactgcccctaggctggctgtttcaccaggaggcagcacttcagttgggctgcaggtcgttgttcgcgatgcggaaactgccccaaaagagctgttttttgaactgaggagacctcctcaacatggagtattgcttaagcacacagccgaatttcgaagacctatggctacaggggacactttcacttatgaggacgtggagaagaatgctttgcagtatattcatgatgggtcttcaacacgggaggacagcatggaaatatcagtgacagacggtttgacagttaccatgttggaggtgcgcgttgaagtatctctgtccgaagatagggggcctcggctggcggcagggtcatccctcagcataaccgtggcatcaaagagtacggctatcatcacccgctcacacctggcttatgtggacgatagtagccctgatcctgagatctggatccagctgaactaccttcccagctacggaacactcctgagaataagtggctcagaagtggaggagctctcagaggtaagcaactttacgatggaagatatcaataataaaaaaattagatatagcgctgtgttcgaaaccgatggacacctggtcacagactctttctacttttctgtgtcggatatggaccataatcatctcgataatcaaatctttactatcatgataacaccagcagagaacccgcctcctgtcattgctttcgcagacctgattactgtggacgaaggcggtagggcccctctgtcttttcaccatttttttgccaccgacgacgacgataacctacagagagacgctatcatcaagctgtcagcactcccaaaatacgggtgtatcgagaacactggaaccggcgacaggttcgggcctgagacggcttccgatcttgaggcctcctttcctatccaagacgtgctggaaaattacatatactactttcagagtgtgcatgagtccatcgaacccactcacgatatattttccttctatgttagtgacggcacctctcggtctgagattcattctatcaacataacaattgagagaaaaaacgacgaacctccacggatgaccttgcagcctctgagggttcagttgtcctcgggggtggtcatttctaatagttccttgtccttacaggacctggatacccctgacaacgagctcattttcgtgctcacaaaaaagcccgaccacggccatgtgctgtggcgccagactgccagtgagccgctagagaacggacgtgtgctcgtgcaaggctccacatttacatatcaggacatactcgccggactagtcgggtacgtcccaagcgttcccggaatggttgtcgacgaattccagttctcactcaccgacggtcttcacgtggacacggggcgtatgaaaatctacactgagcttcccgcaagcgacaccccacacttagcaatcaaccaggggctgcagctgagcgcaggaagcgttgcccgtataaccgaacagcacctgaaagtcacggatattgactccgatgatcaccaagtgatgtacatcatgaaagaggatccaggggcagggcgactccaaatgatgaaacatggcaacctggagcagatttctattaagggtcccattcgttcctttacgcaagccgatatcagtcaaggtcacgttgagtattcgcacgggaccggtgagcctggcggttcttttgcattcaagtttgatgtcgtagacggagaaggaaaccgcttaatcgacaaaagcttctccattagtatcctggaggacaagtcccctccagtcattactacaaataagggacttgttctggatgaaaatagtgtaaagaaaatcaccaccctgcaactaagtgcaaccgaccaggactccggccctactgagcttatctaccgtatcacccgtcagcctcaactgggacacttagagcacgcagcctcccctggcatccagatttctagcttcacccaggctgacctcaccagccgcaatgtccagtacgttcatagttctgaggctgagaagcatagtgatgccttttcattcacactctccgacggagtgagtgaagtgacccagaccttccatattactcttcaccccgtggacgattcactccccgtggttcaaaacttgggcatgcgcgtacaggagggtatgagaaagaccattacggaatttgaactcaaggcagtggacgccgataccgaagcagagagcgtgactttcacgatcgtgcagccaccaaggcatgggaccatcgagaggacatccaatggacagcatttccacttgacatcgacttttacgatgaaggatatctaccagaatcgcgtcagttacagccacgacggatcaaactctctcaaagacagattcactttcacagtgtcggatgggaccaatcctttcttcatcatcgaagaggggggtaaggagatcatgactgcagcaccccagccttttagggtggatattctccctgtcgatgacggtacgcctcgaatcgtgaccaatctgggcctgcagtggctggagtatatggacgggaaagcaacgaatctgattactaaaaaggagttactgactatggacccagataccgaggatgctcagctggtctatgaaataacaaccggccctaagcacggctttgtggagaataaattgcagcctggacgcgcagcagccacctttacgcaggaggatgttaatctcgggctgattaggtatgtgctgcacaaggaaaaaattagagagatgatggacagttttcagttccttgttaaagactccaaacctaacgtggtgtctgacaacgtttttcacatccagtggtccctaattagcttcaaatacacgtcctacaacgtgagcgagaaggcgggatctgtgagcgtgaccgtgcaaaggacgggaaacttgaaccaatacgccatcgttctctgtaggactgaacaggggaccgcgtccagtagttcccgggtgagtagccaacccggacagcaagattacgtggaatacgctggtcaagtgcagttcgatgaacgcgaagataccaaatcctgcaccattgttatcaacgatgatgatgtttttgagaatgtggagtccttcaccgttgaactgtcgatgcctgcctatgcactgttgggcgagtttacccaggccaaagttattattaatgataccgaggacgagccaactcttgaatttgacaaaaaaatctactgggttaacgagtccgccggatttctgttcgccccaatcgagcgcaagggtgatgctagctcaatcgtaagtgccatctgttacaccgtaccaaaatctgccatgggctcttctttgtatgcgttggaaagtggatcggatttcaagtccagaggcatgagcgccgcttcacgcgtcatttttgggcctggtgtgacaatgtctacgtgcgatgtgatgttaattgacgatagcgaatacgaagaggaggaggaattcgaaatcgcgctcgcagatgcgtccgataacgcccgaatcggcagggttgcaaccgccaaagtgctgatcagcggacccaatgacgccagcactgtttcactgggtaacaccgccttcactgttagcgaagacgcaggcaccgttaaaattccagtgattagacatggaactgacttgtctacattcgcatctgtctggtgtgccacaagacccagtgaccccgcatccgcgacccctggggtggactacgttccgagctctcggaaagtggagttcgggccaggagttatcgaacagtattgcactttaactattctggatgatacgcagtatccagtcattgaaggccttgaaacctttgtggtcttcctaagctctgctcagggagcagagcttaccaagccgtttcaggccgtgatcgctattaacgacacatttcaagacgtaccctctatgcagtttgccaaggacctcttgcttgttaaagaaaaggagggagtgctgcacgtccctattacacgttctggggacttatcttacgagtcttctgtaaggtgttatacacagagtcattcagctcaggtgatggaggactttgaggagcggcagaatgccgactcttccagaatcacttttctgaagggtgataaggtgaagaactgcacagtgtacatacacgacgatagcatgttcgagcccgaagagcagtttagagtctacctcgggttaccgctggggaaccactggagcggggctaggataggcaagaacaacatggctaccatcaccattagcaatgacgaggacgctccaaccatcgagtttgaagaggcggcttaccaggtgcgtgaacccgctggccctgacgcaatcgccatccttaatataaaagtaatccgtagaggcgaccagaatcgtacctccaaagttcggtgcagtactagggatggatccgcacagtctggggttgattactaccctaaaagtcgggtgctaaaattttcccctggcgtcgatcacattttcttcaaggtagaaatattgtctaatgaagacagagaatggcatgaatccttctccctcgtcttggggccagacgatccagtggaagccgtgctgggcgatgttaccaccgctacagtgaccatcctcgaccaggaggcggctggaagcctcatcctccctgctccccctatagttgtgacgctggctgattacgaccacgtagaggaagtgaccaaggaaggcgtgaaaaagtctccaagcccagggtatccattggtctgtgtgacaccatgtgatccccactttcctagatacgcagtgatgaaggaaaggtgtagcgaggccggaattaatcagacatctgtgcagttttcctgggaggtggcggctcctaccgacgggaacggcgctaggtccccctttgagacgataactgataacaccccctttactagtgtaaaccacatggtgttagattcaatctatttcagtaggagattccacgtgcgctgtgtggcgaaagcagtagataaagtaggacacgtagggaccccactcagatctaatattgtgacaattggaacagacagtgctatctgccacacccctgtggtggcgggaacctctagaggtttccaggcccaatcctttatcgcaactctgaagtatttggatgttaaacacaaggaacatcctaatcgtatccacatttctgtccagataccacaccaggacggtatgctaccgcttatatctacgatgccattgcacaatctgcattttcttctgtccgaaagcatttataggcaccaacacgtttgcagcaatctagtcactacttatgacctccggggaataagcgaggccggtttcctagacgatgtggtgtacgattccactgccttagggcctggatacgatcgcccattccagtttgatcccagcgtgcgcgagcccaaaaccatacaattatacaagcaccttaatctgaaaagctgcgtctggacctttgatgcgtactatgacatgaccgaactgatagatgtgtgtggcggttccgtaaccgcggacttccaagtccgtgattcagcccagtctttcctgacagtccatgtacccctctacgtgtcctacatctacgtcacagctcccagggggtgggcatcattggagcaccacacggagatggagttcagttttttttacgacacggttctttggcgcacaggcatccagaccgacagcgtactgtctgctcggctccagattattcggatctacataagggaagatggcaggctggtgatcgaatttaagactcacgccaagttcagaggccagtttgtcatggaacatcatacactccctgaggtgaagtcttttgtcctgacccctgaccacctcgggggaatagagtttgatctacagttgttatggtcagctcagactttcgactcaccacaccagctgtggagggctacttcatcttataacagaaaggactattcaggagaatacaccatatacctgatcccatgcacagtccagccaactcagccttgggttgaccctggcgaaaagcctttagcttgcaccgcacacgcacccgagaggttcttaatccctatcgccttccagcaaactaatcggcctgtgcccgtcgtatattccttgaacactgagttccagctgtgtaacaatgagaaagtgttccttatggatcccaacacttccgatatgagcctggccgagatggattacaagggtgcattctctaagggtcagattctgtatggcagagtgctgtggaatccggagcagaacctgaattcggcctataagcttcagcttgaaaaggtttacctgtgcaccggaaaagatggatatgtgccattcttcgatccaacagggaccatctataacgaggggcctcagtatgggtgtattcagcccaacaaacacctcaaacatcgatttttgcttctcgatcggaatcagccagaagtaacagataagtattttcacgatgtgccgttcgaagcacatttcgcttctgagttgccagacttccatgtagtctccaacatgcccggagtagacggtttcactctgaaagtagatgctctgtataaagtggaagctgggcatcagtggtatctgcaggtcatctacattattggacccgacacgatttctgggccacgcgtccagaggagtttgaccgcccctctacgtagaaataggagggaccttgtagagccagacggccagcttatactcgatgattcccttatttacgataacgaaggcgaccaggtgaagaatgggaccaacatgaaatcgctcaacctagagatgcaagaactggccgtggctgcctcactgtcacagaccggtgcttccattggatctgctcttgctgccataatgctgttacttctggtcttcctcgtggcttgttttattaacaggaaatgccaaaagcagaggaagaagaaacccgcagaggatatcctggaagaataccctctgaataccaaagtcgaagttccaaagcggcatcccgaccgggtggagaaaaatgttaaccgccactactgcaccgtgaggaacgtgaacatcttaagtgaaccagaagctgcctatacttttaagggtgccaaggtgaagaggctgaacctggaagtccgagtacataacaatttgcaggacggaaccgaagtgtag

SEQ ID NO: 223677 - DNA, 2214 bp, Artificial Sequence
  Description of Artificial Sequence: Synthetic coding sequence
atgggagtgctgaaggtgtggctcggactcgctttggccttggccgagttcgctgtcctgcctcatcattcggagggcgcttgcgtgtatcaggacagcctgctggccgacgcaactatttggaagccagattcttgtcagagttgcagatgccacggtgacattgtgatatgtaagcctgccgtctgtcgtaaccctcaatgcgcgtttgagaaaggagaggtgctgcaaatcgccgcaaaccagtgttgccctgagtgcgtcctgcgcaccccgggtagttgtcaccacgaaaaaaaaatacatgaacacggaaccgaatgggctagctcaccgtgctctgtctgcagctgtaaccacggagaagtgcgttgtacgccacagccatgccctcccctgagttgcggtcaccaggaactcgccttcatacccgaaggctcgtgttgccctgtgtgtgtgggattgggcaaaccctgctcgtatgagggccatgtttttcaggacggagaggactggaggctgagtcgatgcgcaaagtgtctatgccggaacggtgtggcccagtgtttcacggcccagtgccagccccttttctgtaatcaggacgagaccgtggttcgagtgcctggaaaatgctgtcctcagtgtagcgctcggagctgtagcgctgccggacaagtttacgaacacggcgaacagtggtcagaaaatgcctgtactacatgcatctgtgatcggggagaggtgcgctgccataagcaagcgtgccttccgctgagatgcggtaaaggacagtctcgggctcggagacacggtcaatgttgcgaagaatgtgtaagccccgctggcagctgctcttacgatggagtagtaagataccaggatgaaatgtggaaagggtctgcttgcgaattctgtatgtgtgaccatggacaggtcacatgtcagaccggcgagtgtgctaaggtagagtgcgcgcgtgacgaggagctgattcatctagatggcaaatgttgccctgagtgcatatcaaggaacgggtattgcgtatatgaggagaccggagagtttatgtcttcaaatgcttcggaggtgaaacgtatccctgaaggagaaaagtgggaggacggcccttgcaaggtctgcgaatgtcgaggcgctcaggtgacatgttacgagccatcgtgtccaccttgccctgtcggcaccctggcccttgaggtgaagggccagtgttgcccagactgtacatctgtgcactgccaccccgattgcttgacctgttcccagtctcccgatcactgtgatctgtgccaggatccgaccaagctactccagaacgggtggtgcgtacacagctgtggactgggtttctaccaagctggaagcctttgccttgcctgccagcctcagtgttcaacttgtaccagcggactcgagtgctccagttgccagcctccgcttctcatgcgccatgggcaatgtgtgcctacctgcggtgacgggttttaccaggacaggcattcatgtgctgtttgccacgagagctgcgctgggtgctggggccctaccgagaagcattgcctggcctgcagagaccctctgcatgtgcttcgcgacgggggatgcgaaagctcttgtggcaagggcttctataaccgacagggtacatgctcggcatgtgaccagtcgtgcgactcctgcggtccaagctctcctaggtgcctgacctgcaccgaaaagaccgtcctccacgacggtaagtgcatgtcagagtgccctggaggctattacgcagatgcgaccggtcggtgcaaggtctgtcacaactcctgcgcttcttgttctggacccacgccatcacactgcacagcatgctcccctcctaaggctctgagacaggggcattgcttacctcggtgcggcgaaggcttttactcggaccatggggtgtgcaaggcctgtcatagcagctgcttagcctgtatggggccagccccaagccattgcacagggtgtaaaaagcctgaggagggcctgcaggtggagcagctttcagacgttggtattccaagtggcgaatgtctggctcagtgccgagcccacttctacctcgagtcaaccgggatttgcgagggtcaaaacctggacttctgccagaacttagaagtgatcagcgcagtgtgtctcggaatctcaagcactgagaactag

SEQ ID NO: 223678 - DNA, 954 bp, Artificial Sequence
  Description of Artificial Sequence: Synthetic coding sequence
atgggcgttcttaaggtttggctgggtttggccctggctctggctgaatttgccgtgctgccacatcattctgagggtgcctgtgtgtatcaggatagcttgcttgccgacgccacgatctggaaaccagacagctgccaaagctgtagatgtcatggcgacatcgtgatttgcaaacccgcagtctgcagaaacccacagtgtgcattcgagaagggggaagtgctgcaaatcgctgcgaaccaatgttgccctgaatgcgtactgaggacacctgggagttgtcatcacgaaaagaagatccacgagcacggtactgaatgggcttcctctccctgctcagtgtgctcctgtaatcacggagaagttcggtgtacaccacagccctgccctcccctgtcttgcggccaccaggaactggctttcattcccgagggcagttgttgtcccgtgtgcgtaggtctgggcaagccctgctcttacgaagggcacgtattccaggacggagaggattggaggttgtctcgctgtgctaagtgcctctgccggaatggagtggcccagtgctttaccgctcagtgtcagcccttgttttgcaaccaagacgagaccgtagtccgggtccctggtaaatgttgtcctcagtgtagcgccaggtcttgttcagccgctggtcaagtgtacgaacatggggaacagtggtccgagaatgcttgtaccacgtgtatatgtgatcggggagaagtccggtgtcataaacaggcctgtttgcccctacggtgcgggaagggacagagcagagctagaaggcacggacagtgctgtgaggagtgtgttagcccggctctggcctcgcagtcagtgggaattactggaatgtctcaccatgcccaaagtctgcttgggccattcttaacccaaattaaaaaaccgcactttagctgcctggaatag

SEQ ID NO: 223679 - DNA, 6725 bp, Artificial Sequence
  Description of Artificial Sequence: Synthetic coding sequence
tgatccgaggtttctaatttcactatggaggatatcaacaacaaaaaaatacgatactctgccgtctttgagacagacggccacttggtcaccgactccttttatttctcagtgtccgatatggatcataaccatctggataaccaaatctttaccattatgatcacccctgctgaaaatccacctcctgttattgcatttgccgaccttatcaccgttgatgaggggggacgggcaccactgagcttccaccactttttcgctactgatgacgacgataatctccagcgcgatgcaatcattaagctgtccgccctgcctaaatacggttgcatcgagaacaccggcaccggagacagattcggacctgagacagcaagtgatctcgaagcaagcttccccatccaggacgtgttagagaattacatctactattttcagtccgtgcatgaatccatagaaccaacccatgacatcttcagcttctacgtttcggatgggacatctcgcagcgagatccacagcatcaacatcaccatcgaacgtaagaacgacgagccacctcgaatgactttacagcccctccgcgttcaactgagctctggcgtggtcatatctaattcctctttgtcccttcaggatctggacacacctgataacgaattgatcttcgtgctcacaaaaaagcccgatcacgggcacgtgctgtggcgccaaactgcatccgaacctctggagaatggtcgggtactggtgcaagggtccacatttacctatcaggatattctggccggattggttggttatgtgccatcagtccctggaatggtcgttgacgaattccagttttctctgaccgacggactgcacgtggataccggcagaatgaaaatctatacggagttgccagcctctgacaccccgcatctggcgatcaaccaaggcctgcagctgtcagcgggaagtgtggcgagaataaccgagcaacacctgaaggtgaccgacattgattcggatgaccaccaggttatgtacataatgaaggaggaccccggagcagggagactgcaaatgatgaagcatggcaacttggaacaaattagcatcaagggcccaatacgatcgtttacccaggctgatatctcccagggtcacgtcgagtattctcatgggacaggcgagcctgggggaagtttcgcctttaagtttgacgtggtggacggagagggaaatagacttatagataagagtttttccatttctattctggaggataagagtccacccgtaatcactacaaacaagggcttagtactggacgaaaatagcgttaagaagataaccacattacagcttagcgccacagatcaggatagtggtcctaccgagttgatctacaggatcacaagacagcctcagctgggccatttagaacatgcggcaagtcctggtatccagattagctcctttacacaggctgacttaacaagcaggaatgtccagtacgtgcacagctccgaagctgagaagcactctgacgcgttctcgttcactctttccgacggagtgtcagaggtgacccagacctttcacattacgttacaccccgtggatgacagcctccctgtggtgcagaacctgggcatgagagtccaggagggaatgcgcaagacgattacagaatttgagttaaaggccgtggatgcagataccgaggcagagtctgtcacattcaccatcgtccagccccctcggcatgggactattgagcgaacttccaacggccaacactttcacctaacctcgacatttaccatgaaggatatctatcagaaccgagtgagctattcccacgacgggtcaaactcactgaaggataggtttacatttaccgtaagtgacgggaccaacccattttttataattgaagaagggggtaaagaaatcatgacagctgccccacaaccatttagagtggatatcctccctgtcgacgacggtacgccccgaattgtgaccaatctgggactgcagtggttagaatacatggacggaaaggccacaaacctgatcaccaaaaaagagcttcttacaatggaccccgatacagaggacgcacagctcgtgtatgagatcaccaccgggccaaagcatgggttcgttgaaaacaagctgcagccagggcgagccgctgcgaccttcacccaggaggatgtcaacttaggtctcatcaggtacgttctgcacaaggagaagatcagggaaatgatggattctttccagttccttgtgaaggacagtaaacccaacgtcgttagcgataacgtgttccatattcagtggagccttatctcttttaaatacacatcctataatgttagtgaaaaggctggatccgttagcgtgaccgtgcaaagaacggggaacttgaatcagtatgctattgtgctatgcagaacagaacaaggcacagccagttctagctcaagagtgagctctcagccgggacagcaggactacgtggagtatgcgggtcaggtacagtttgacgagagggaggacactaagagttgtacgattgtaataaatgatgacgatgtgtttgagaacgtagagtctttcaccgtagagctgtccatgcctgcctacgccctgctgggtgagtttacgcaggctaaggtgattattaacgatacggaggatgagccgactctggagtttgacaagaaaatctactgggtgaatgaatccgctggctttctcttcgcacccattgagcggaagggagacgcctcctccatcgtctccgccatttgctatacagtacccaaaagcgccatgggctcatctttgtatgctctagagagtggctccgattttaagagccggggaatgtccgccgcatctagggtaatcttcgggcctggagtgacgatgtcaacctgcgacgtgatgctaattgacgacagtgagtatgaagaggaagaagaattcgaaattgcactagcagacgcatctgataatgccaggatcggaagagtggcaacggcaaaggttttgatctccggcccaaatgatgcctctacagtgtctctgggaaatactgccttcacagtgagtgaagacgccggaactgtgaagattcccgtcattcgccatgggacagacctgtccacttttgccagcgtgtggtgcgccacacgcccttccgaccctgcttcagccaccccaggtgtagattatgttccctcctcaagaaaagtcgagtttggccctggtgtcatagagcagtactgtacgctgacgatcctggatgacacacaatatcccgtgatcgagggcctggaaacctttgtagtgtttcttagcagtgcccagggagccgaacttaccaagcccttccaggcagtaatcgcaatcaatgacacattccaagacgttccaagtatgcagtttgcaaaagaccttctcctggtgaaggagaaggagggagtgttgcatgtacctatcactcggtctggtgacctgtcttatgagtcgtctgttaggtgttacactcagtcccactcggctcaagtgatggaagacttcgaggagcgacagaacgccgattcaagccgcatcacatttttgaaaggtgataaagtcaagaactgtactgtgtacattcatgacgacagtatgttcgaaccagaggaacaatttcgagtatatctgggactgcccttaggaaaccattggagtggtgcgagaatcggcaagaataacatggcgaccatcacgatttctaacgacgaggacgctcctacgattgagttcgaggaggccgcttatcaggtgcgtgagcccgctggccctgacgcaatcgcgattctcaacattaaggtcattcggaggggcgaccaaaatcggacttccaaagttaggtgcagcacaagagatggcagcgcgcaaagtggggtggattactaccctaaatcaagagttctgaagtttagccccggagtggaccacatcttttttaaggtggaaattctctctaacgaagatcgggagtggcatgagtcattcagcctcgtcctgggacccgacgatccagttgaggccgtgcttggggatgtgacgactgctacggtgacgatcctggaccaggaggcagcaggatccctcatcctgccggctcctcctatcgtggtgacactggccgattacgaccacgtcgaagaagtgaccaaggagggcgtgaagaagtcgccgagccccggatatccactggtttgcgtcactccttgtgatccacacttccctaggtatgccgtgatgaaagagagatgctcagaggcgggtatcaaccaaacaagcgtacagttcagttgggaagtagccgctcccaccgatggcaatggggctcgttcaccatttgagacaattaccgacaatactccatttaccagcgtgaaccacatggtactcgatagcatctatttctcgcgacgctttcatgtccgatgtgtagccaaagccgtggacaaggtgggccacgtgggcaccccactgcgctcaaacatcgttacgatcggcaccgatagtgccatctgtcatacaccagtagtcgcaggtacaagtagaggatttcaagcgcagagcttcatcgctaccctgaagtatctggacgtgaaacacaaggaacatcctaacagaatacatatttctgtccagatcccgcatcaggacggcatgctgccactgatttctactatgccgctgcataatcttcacttcctgctcagcgaaagtatctatcgccatcagcacgtgtgcagtaatctcgtgaccacctatgacctgcgtggtatctccgaggccggttttttagatgatgtagtgtatgacagtaccgccttggggccaggctatgatcgaccctttcaattcgatccatctgtcagagaacctaagaccattcagctgtataaacacttaaacctcaaaagctgcgtttggacgttcgatgcctactatgatatgacggagctgatcgacgtgtgcggtggtagcgtcacggccgacttccaggtgagagattccgcacaaagtttccttaccgtgcacgttccactgtacgttagttatatctatgttactgctcctcgagggtgggcatcgttggagcaccataccgagatggagtttagcttcttttacgatactgtcctttggcgcacaggcattcagactgactctgtgctgtccgcacgcctgcagatcatacgcatctatattcgcgaggacgggagacttgttatcgaatttaagacgcatgccaagtttagaggccaatttgtaatggagcatcacaccctccccgaggtaaagtcctttgtactaaccccagaccatttaggaggtatcgagtttgaccttcaactactctggtctgcccagacatttgactcccctcaccagctttggcgggctacctcttcatataaccggaaagactactcaggtgagtatacaatctaccttattccatgtaccgttcagcccacacagccgtgggtggacccgggtgagaagccgctcgcctgcacagctcacgcgccagagcgttttctgatacccattgcttttcagcagacaaatcgacccgtgcccgttgtctactccctgaacactgagtttcagttgtgtaataacgagaaggtgttcctcatggacccgaataccagcgacatgagtctggctgagatggattataagggtgccttcagtaaagggcagatattatatggaagggtcttatggaaccccgaacagaacctgaacagcgcatataagcttcagctggagaaggtctacctctgcacaggaaaggacggttatgtaccattttttgacccgaccggaactatctataatgagggtcctcagtacggatgcatccagccaaataagcacctcaagcataggtttttgctgctggaccgaaaccagcctgaggtgaccgataaatactttcatgacgtcccattcgaggcacacttcgcttctgaattgcctgattttcatgtagtgtctaacatgcctggagtggacggcttcacgcttaaagtagatgccctgtataaggtcgaggccggacatcaatggtacctgcaagtgatttacattatcggtcccgacacaatcagcggtccccgtgtacagagaagcttaacagctccgttacgtaggaacagaagggacctggtggagcccgacggacagcttatcctggacgattcgttaatctatgataacgaaggcgaccaggtgaaaaatggtaccaatatgaaatccctaaatctggaaatgcaggagctggcagtggctgcatcactctctcagactggggcatctatcggctcggcactggccgcaatcatgctactgctacttgtgttcctggtggcgtgctttataaatcgaaaatgtcaaaaacaaaggaagaaaaagcctgccgaagatattctcgaagagtacccattgaacacaaaggtggaagtgcctaagaggcatcctgaccgggtggagaaaaacgtcaataggcattactgcactgttcggaacgttaatatcctgtcagagccagaggctgcctatactttcaagggggctaaagtgaagcgtctgaacctggaggtgagggttcataacaacctgcaggatggtacagaagtcta

SEQ ID NO: 223680 - DNA, 768 bp, Artificial Sequence
  Description of Artificial Sequence: Synthetic coding sequence
gagcgccagggccagagtcgggcacgcagacacgggcagtgctgcgaagagtgtgtctcccccgcaggctcctgctcttatgatggcgtcgttcggtaccaggatgaaatgtggaaaggttccgcctgcgaattctgcatgtgcgatcacggtcaggttacatgccaaaccggcgaatgcgccaaagtcgaatgcgctagggatgaggagttaattcacctagatggcaagtgttgcccggagtgtatttcccgcaacggctactgcgtgtacgaagagaccggggagtttatgagctccaacgccagtgaagtgaaacggattccagagggcgaaaaatgggaagatggcccatgtaaagtgtgcgaatgccgtggagcacaggtgacttgctacgagcctagttgccccccatgtcccgtggggacccttgcactcgaagtgaagggccagtgctgtcccgattgtaccagcgtacactgccaccctgactgtctcacttgtagccaatccccagaccactgcgacctgtgccaggatcctaccaagctgctgcagaatgggtggtgtgttcactcctgtgggctcggcttctaccaggcgggttccctgtgcctcgacgacgggttcagtctcccagcacccgttctccacgtgtaccagtgggcaggcgtgttgatccttccagcttctccggctgacgccgctcgcgctgtgtgcgcatacctgtggggcaggctcctcccaaggtctccctttctgtgctag

SEQ ID NO: 223681 - DNA, 840 bp, Artificial Sequence
  Description of Artificial Sequence: Synthetic coding sequence
atggtactgaccatccacctactgccttcagatcagcagttaccggtgtttcaggtgaccgctccgaggctggctgtatcacccggaggctcaacgagcgtcggactccaggtcgtggttcgcgacgcagagactgccccaaaggaactgttcttcgaactgcgccgaccgccacagcacggagtgctgctgaagcatactgctgagtttcgccgacccatggccacgggtgacacctttacctatgaagatgttgaaaagaacgcattacagtacatacacgatggcagctctactcgggaggattctatggagattagcgtcactgatggcttgacggtcaccatgctcgaggtgcgtgtcgaggtatctttaagcgaggacaggggaccaagattggctgcgggatcaagcctgtccattacagtggcatctaagtcaacagcaattatcacaaggagccacttggcctacgttgacgacagctctcccgacccagaaatttggatccagctgaactatctcccttcatatggcacccttctgcgcatctcaggttccgaagttgaagagctgtctgaggtgagcaatttcacaatggaggatataaataataaaaagattcgatactcggccgtgttcgagaccgacggtcatctggttaccgattcattctacttcagtgtttccgatatggatcacaatcatctcgacaatcagatctttacaataatgattacacccgcagagaacccacctcccgtcatcgcatttgccgatctgattacagtggacgagggcggtagggcgcctttgtcttttcaccacttttgctactag

SEQ ID NO: 223682 - DNA, 5930 bp, Artificial Sequence
  Description of Artificial Sequence: Synthetic coding sequence
atgggtgtgcttaaagtgtggctcggcctggccttggctctagccgaatttgccgtgcttccacatcatagcgagggcgcatgcgtctatcaggacagtctcttggctgacgctaccatctggaaacccgactcgtgccagtcttgccgctgccacggggacatcgttatctgtaaacccgctgtgtgcaggaatccacagtgtgctttcgagaaaggggaagtcttacagatcgccgctaaccagtgttgtcccgaatgtgtactgcggactcccggatcttgtcatcacgagaagaagatccacgagcatggcacggaatgggcttcatcgccctgcagcgtctgttcttgcaaccacggggaggtgagatgcaccccccaaccctgcccacctctatcctgcggacatcaggaactggcctttatccccgaaggaagctgctgtcccgtatgtgtaggactcggcaagccctgcagctatgaggggcacgtgtttcaggacggagaagattggagactctctcgctgcgccaaatgcttatgtcgtaatggagtcgcacagtgttttacagcacaatgccagcctctcttctgcaaccaggacgaaaccgtcgttagagtacctgggaaatgttgcccccagtgttctgctcgaagctgtagtgccgcaggacaggtgtacgaacatggggagcagtggagtgaaaatgcctgcacaacgtgtatttgtgaccgcggtgaggtgcgttgtcacaagcaggcctgcctgccacttaggtgcggcaaaggccaatctcgtgccagacggcacggtcagtgctgtgaggagtgcgtgtctcctgccggatcctgctcgtacgatggggtagtccgataccaagacgagatgtggaaaggcagcgcatgtgagttctgtatgtgtgaccatggccaggtgacatgtcaaaccggggagtgcgctaaagtggagtgcgcgagggatgaggagctcatccacctcgatggaaagtgttgtcccgaatgtatcagcaggaacggttactgcgtctatgaagaaaccggagaattcatgagctccaatgcgagtgaagtgaaacgaattccggaaggggagaaatgggaggatggcccttgtaaagtttgcgaatgtcggggagctcaggtgacttgctacgagccttcatgccccccttgtcccgtgggcacactggccctggaagtcaagggtcagtgctgtcccgactgcacgtccgtccactgccaccctgactgtctcacgtgctcccagagtccagatcactgcgatctctgccaagacccaacgaaactcctacagaatggctggtgcgtgcactcctgcggcctgggattttatcaggcaggctcactgtgtctggcatgccagccccagtgcagcacatgtaccagcggtttggaatgctcatcctgccagcctcccttgctaatgcgccacggacagtgtgtcccaacctgcggtgatgggttctatcaggatagacattcttgtgcagtgtgtcacgagagctgcgccggatgttggggtccaaccgagaagcactgcctggcgtgcagagacccattacacgtcctccgggacggagggtgcgaatcctcttgcggtaaaggcttttataatcggcagggtacatgctcagcatgtgatcaatcttgcgatagctgtggtccatcaagccctcgctgccttacctgcacggaaaaaacagtcctgcatgatgggaagtgcatgtccgaatgcccaggagggtattacgcggatgctaccggccgatgcaaggtatgccacaattcttgtgctagctgttctggcccaaccccctcccattgtaccgcctgttcaccgcctaaggcattacgacagggccattgcctccccagatgcggagaaggattctatagtgaccatggcgtctgtaaagcttgtcactccagttgtctggcatgtatgggaccagctccgtcccactgcactggttgtaaaaaacccgaggaaggcctacaggtggaacagctgtctgacgtcggcatcccttctggagagtgcctggcacaatgcagagctcatttctatctggagtccacaggcatctgcgaggcatgccatcagagctgcttccgctgcgccggtaaaagtccccacaattgtaccgactgtggtccatctcatgtgttattagatggccagtgcctatcacagtgcccagacggctatttccatcaggaggggtcctgtactgaatgtcatcccacttgtcgacagtgccatgggcctcttgagtccgattgtatttcatgttatcctcatataagtttgaccaatgggaattgcaggacgtcatgcagggaggagcagtttctcaaccttgtgggttactgtgccgattgccatcacttgtgccagcattgcgctgccgacctccataatacaggatctatctgtctcaggtgccagaatgctcactaccttctgttaggggatcactgcgtcccagattgccctagcgggtattacgctgagaggggcgcttgtaaaaagtgccattccagctgtaggacatgccaaggaagagggcctttcagctgtagctcctgcgataccaacctcgtgttgagccacaccggtacgtgtagtaccacttgtttcccaggtcactacctggatgacaatcatgtgtgccaaccctgtaatactcactgcggctcttgtgacagccaagcaagttgtacctcatgcagggacccaaataaagtgctgctgtttggcgaatgtcaatatgagagctgcgccccacaatactacctggacttctcaaccaacacctgtaaggagtgtgattggtcgtgctcggcatgcagcggtccactcaaaaccgattgtttacagtgtatggacgggtatgtattgcaggacggtgcctgtgtggagcaatgtctgtcatctttctaccaggactccggactgtgtaagaactgcgattcatactgtctgcagtgccaggggcctcatgagtgcaccaggtgcaaagggcctttcttgttgctggaagcccagtgcgtgcaagagtgtggcaaaggctacttcgctgatcacgccaagcataagtgcacggcctgtccccaaggctgcctacagtgtagtcaccgtgacagatgtcacctttgcgatcacggtttttttttgaagtccgggctgtgtgtctataactgcgtgccaggattctcggtgcacacatctaacgagacctgcagcggcaagattcacacacccagcctccatgtgaacggatctctgattctacctatcgggagtataaaacccctggactttagtctgctgaacgtgcaagatcaggaaggacgggttgaggatcttctgttccacgtggtgtccacaccgaccaatggtcagctggtcctctccagaaatgggaaagaggtccaactggataaagctggtcgcttcagctggaaagacgtgaatgagaaaaaagtccggttcgtgcactcaaaggagaagctgaggaaagggtacctgtttttgaagatctcagaccagcagtttttctccgaaccgcaactgatcaacatacaggcattcagtacacaggctccgtacgtgctgcggaatgaggttcttcacataagtcggggtgaacgagccacgattaccactcaaatgttggatataagggatgacgataacccacaggatgtggtgatcgagatcatagatcctcccctgcacggccaactgctccagacactgcaatcaccagccacacccatttaccagttccagttagacgagctgagccgcggactgctgcattacgctcacgacgggagcgatagtacctctgacgtcgccgtcctgcaggccaacgacggacacagtttccataacattttgtttcaggtgaagactgtgccccaaaacgatcggggtctgcaactcgtcgctaattccatggtgtgggtaccggaggggggaatgctgcagatcacaaaccggatcctgcaggctgaagcccctggggcatctgccgaagaaattatctacaagatcactcaggattacccgcagttcggcgaagtggtgttgctggtcaacatgccagctgactcacccgctgatgaaggtcagcaccttccagacggacgtacagccactcccacctcgacttttacccagcaggatatcaatgaaggaattgtctggtaccgacacagtggcgcaccggctcagagcgatagcttccggtttgaggtgtcttcagcctctaatgcccagacaagactggaatctcatatgttcaatattgcaatcttaccccagacccctgaagcacctaaagtctcactggaggctagcctgcatatgaccgcccgtgaagacgggctaaccgtgatccaaccacacagtctgtcctttatcaacagcgagaagcccagcgggaaaatagtatacaacattaccctgccattgcaccctaaccagggcattattgaacacagggatcatccccacagcccaatcaggtatttcacacaggaagatattaatcagggaaaagtaatgtaccgacctcctccagctgcccctcacctgcaggaattgatggcctttagcttcgctggcctgccagaaagtgttaaattccacttcactgtcagcgacggggaacatacatcccccgaaatggtgcttacaatccacttactcccctctgaccagcagctgcctgtgttccaggtgactgccccaaggctggcagtgtcacccggtggctctacctccgtcggtctgcaggtcgtggtgagagatgccgagacggccccaaaggagctcttctttgaactgagaaggcctcctcagcatggagtcctgctgaaacatactgccgagtttaggcgacctatggccaccggagacacattcacatacgaagatgtggagaaaaacgccctccagtacatacatgatgggagctccacacgcgaagacagtatggagatcagcgtgactgatggcctgaccgttaccatgctggaagttcgtgtggaagttagtctgtcagaggatcgaggacctcggctcgccgcaggctcctcactgtcaataaccgttgcgtcaaaaagtacagctattatcaccagatctcacctggcgtacgttgatgatagtagccccgatcccgaaatttggatacagctgaattatttgccttcctatgggactctattgagaatttctgggtcagaagtggaggaactgtcggaggtgagtaatttcactatggaggacatcaataacaaaaagatccgctattcagccgtgtttgagacagacggccacctcgtaacagactcgttctacttctccgtgtctgatatggaccacaaccatctcgataatcaaatcttcaccattatgatcacccccgcagagaatcccccaccggtgatcgccttcgccgacctgataaccgtcgacgaggggggaagagcccctctctcctttcaccactttttcgccacagacgacgacgacaatctgcagcgcgatgctatcataaagctctcagctctgccaaagtatggctgcatagaaaacactggcactggcgatcgtttcgggccagagactgcatctgatctggaagcctcattcccaattcaggacgtcctcgagaattatatctattatttccagtccgtccacgagtcaatcgaacctacccatgatatcttcagcttttatgtgagtgatggcaccagtcgaagcgaaatccatagcattaacatcacgattgaggtgaaaacactagaagttggcaaagttgagccactcactactatttttcacaccatcagggaattgtccctgta

SEQ ID NO: 223683 - DNA, 633 bp, Artificial Sequence
  Description of Artificial Sequence: Synthetic coding sequence
atgtggactttagggagaagagcagtggccggtctgctcgcgagcccaagcccggctcaggcgcagaccttgacgcgcgttcctcgacctgccgagctcgcaccactttgcggaagacgcggtctgcgaaccgacattgacgctacgtgcacccccagaagggcgagtagcaatcagcggggactcaaccagatctggaatgttaagaaacagagcgtgtatctgatgaatctcagaaagagcggtacactggggcatccgggatccctggatgaaacaacatacgagcgcctggcagaagagaccttggattcactggccgaatttttcgaggacctcgccgacaagccatataccttcgaggactatgatgtctcctttggctccggagtgttgacagttaaattggggggagacttgggaacatatgttattaacaagcagactccaaacaaacagatttggttgtctagccctagctcaggcccaaaaagatatgattggaccggaaaaaattgggtctattcccatgacggcgtgtccctccacgaattgcttgctgccgaacttaccaaagccctgaagacaaagctcgatctttcatctctggcctacagtggaaaagacgcgtag

SEQ ID NO: 223684 - DNA, 516 bp, Artificial Sequence
  Description of Artificial Sequence: Synthetic coding sequence
atgtggacgttgggcagaagggcggtagccggtctattagcgagtccaagcccggctcaagcacagaccctgacccgggtccctaggcccgcagagctcgctcctctctgcggaaggcgcggactgagaacagacatagatgccacatgtactccaaggagagcatcctcgaatcagcggggtctgaatcaaatttggaatgtgaagaagcagtccgtgtacctcatgaacctcagaaagtctggcacgctcggccatcctgggagcctggatgaaacaacgtatgagcgcctggccgaggaaactttggacagtttagccgagtttttcgaagacctggccgacaagccatacaccttcgaggactacgatgtctctttcggcagcggggtcctcactgtcaaacttgggggagaccttggtacctacgtgattaacaaacagaccccaaacaaacagatctggctcagtagcccttctcggctgacctggctcctgtggctatttcatccctag

SEQ ID NO: 223685 - DNA, 591 bp, Artificial Sequence
  Description of Artificial Sequence: Synthetic coding sequence
atgtggaccctcggacggcgagccgttgccggactgcttgcttctccatcccccgctcaggcccagacactgaccagagtgcctcggcctgcggaactggcccctctctgcggtaggaggggtcttagaacagatattgatgctacatgcacaccacggagggcctcctctaatcagcgcggactgaatcagatttggaacgtgaaaaagcagtccgtgtatctcatgaacctgaggaaaagcggcacactgggacatcccggatccctcgatgaaaccacctacgaacgcctcgccgaagagactctagatagcttagccgagttttttgaagacttggcggataagccatacaccttcgaagactacgacgtatcctttggatctggcgtgttgactgttaagctcggcggagatctgggtacctacgtgatcaacaagcagacaccgaacaagcaaatctggcttagctcaccatcacgatatgtggtcgacctcagcgtgatgacaggactgggaaaaaccggctgcactccaaccaccgcctgtccatctatgtcctgttggccacagtcgtcccttaaaccatag

SEQ ID NO: 223686 - DNA, 702 bp, Artificial Sequence
  Description of Artificial Sequence: Synthetic coding sequence
atgccatgtcggcgagaggaagaagaagaagctggtgaagaagcagagggcgaggaggaagaggacgattcattcttgctcctgcagcagagcgtgacactgggctcgtccggggaagtggacagacttgtcgctcaaattggagaaacacttcaactggacgccgctcaggacagccccgcttccccctgtgcccctcctggcgtgcctctgagagcacccggacctttagctgcagccgtgcccgctgacaaagctagacctccagctgttccactgctcctgcccccagcgtccgccgagaccgtgggacccgcaccttcaggcgcattgcggtgcgctctcggcgacagaggcagagtgcgtggccgagccgctccgtattgtgttgccgaggttgccgctggcccaagcgcactcccaggaccctgtaggcggggatggctgagagatgctgtgacgagtcgtaggcttcagcagcggcgatggacccaggccggtgctagggctggagacgacgacccccaccggctactgcagcagctcgtgctcagcggcaacctaataaaagaagccgtgcggcgtctccagcgcgcagtagccgcagttgccgcaactggcccagccagtgcgccagggccagggggaggacggtcgggtcccgatcggattgcactccagccgtcaggctcactgctgtag

SEQ ID NO: 223687 - DNA, 1161 bp, Artificial Sequence
  Description of Artificial Sequence: Synthetic coding sequence
atggaggggggtctcgccggtgaaagagccagagaaagcccagtggactgcagtgtcagcaaatgctcaaaactggtgggtggcggagaatccaaccccatgaactacaattcttacatggacgagaaaaatggacctccaccacccaacatgaccaccaacgagcgcagagttatagttccggctgatcctactctttggacacaagaacatgtcaggcagtggctcgagtgggccataaaggaatatagtctgatggaaatagacacatccttcttccagaatatggatgggaaggagctgtgcaagatgaacaaagaggacttcttaagagccactaccctctataacacagaagtgctcttgagccacctgtcttacctgcgggaaagctccctgttggcttacaataccacctctcatacagaccagagctctcgactgagcgtcaaggaagatccctcctacgatagcgtaagaagaggggcttggggaaataatatgaattctggactaaataagtccccccctctcggaggtgcacaaactatttcaaagaacacagagcagcggccacagccggatccctaccagattttggggccaacttcgtcacgattggccaatcctggaagcggccagatacaactgtggcaattcctcctggagctcttgtctgattcggcgaatgctagctgtattacctgggaaggcaccaacggggagtttaaaatgacagaccccgatgaggtcgcacgcaggtggggcgaacgcaagagtaagcccaacatgaactacgacaagctgtccagggcactgagatattattacgataaaaatatcatgacaaaggtgcatggaaaaagatatgcatataaatttgactttcacggcatagcccaagcattgcagccccacccgacagagtcttctatgtacaagtatcctagtgatatctcctacatgccttcctaccacgcacaccagcagaaggtcaattttgtgccaccacacccaagctctatgcctgtcacctccagcagcttctttggcgctgcatcacagtactggacttcccccacaggagggatatacccaaaccccaacgtacctcggcatccaaatacccacgtacctagccacctgggtagttattactag

SEQ ID NO: 223688 - DNA, 1260 bp, Artificial Sequence
  Description of Artificial Sequence: Synthetic coding sequence
atgaccgcttcagggagccctgactatggccagcctcacaaaataaatcctcttccgcctcagcaggaatggatcaaccagcccgtgcgtgtgaacgtgaaaagggaatatgaccatatgaatggatcccgcgagtctcccgtggattgctctgttagtaaatgctccaaactcgtgggaggtggagagtcaaaccccatgaactataatagctatatggatgagaagaacggccctcctcccccaaatatgactactaatgagaggcgcgtaatcgtgccggcagatcccaccttgtggactcaggagcatgtgcgacagtggttggaatgggcaattaaagagtattccttgatggaaatagacacttctttcttccaaaacatggatggcaaagaattatgcaagatgaataaggaagatttcttgcgcgcaactactctgtataacacagaggtcctgttgtcccatttgagttatctgcgagaaagctcactgttggcttataataccacctcacacaccgatcagagctccagactgtctgtcaaggaagatccatcttatgatagcgtgcgccgtggagcctggggtaacaacatgaacagcggcttgaacaagagcccccctcttgggggtgcccagacaatctccaaaaacactgagcagcgccctcagcctgatccgtaccaaatcttaggtccaacctcatcacggttagctaatccgggatctggtcaaattcagttgtggcagtttctgcttgagctgctttcggactcagcaaacgctagctgtatcacatgggagggtaccaatggtgagtttaaaatgacagacccagacgaagtcgccaggcgctggggtgagcgaaaatccaagccaaatatgaattatgacaaactcagccgggctctgcggtattactacgataaaaacataatgactaaagttcacggcaagaggtacgcgtacaaattcgactttcatgggatcgcacaggcccttcagccacatcctactgagtcgagtatgtataagtaccctagcgacatctcctacatgccatcttatcacgcgcatcaacagaaggtgaattttgtgccacctcacccatcgagtatgcccgtcacttctagttctttcttcggagcggcttcgcagtattggacgtcacctaccggaggaatctaccctaaccccaatgttcctcggcaccctaacactcatgtgccttcgcacctaggcagctactactag

SEQ ID NO: 223689 - DNA, 1359 bp, Artificial Sequence
  Description of Artificial Sequence: Synthetic coding sequence
atggacggcacaatcaaggaagctctgagtgttgtgtccgacgatcagagtctgtttgatagcgcgtatggggctgccgcacatcttcccaaggctgacatgactgccagtggcagccccgactatgggcagcctcacaaaatcaatccgctgccacctcagcaggagtggatcaaccagcctgttcgcgtgaacgtgaaacgtgaatatgaccacatgaacgggtcaagggaatcccccgttgattgctccgtgtctaagtgttccaagctggtggggggaggcgagtccaacccaatgaattacaattcttacatggacgagaaaaacggcccacctcctcccaacatgacaacaaacgagcgacgggtgatcgtgcctgcggaccctaccttatggacacaggagcacgtacggcagtggctcgagtgggctatcaaagagtactccctgatggagattgatacaagtttttttcagaatatggacggaaaggagctgtgtaagatgaataaagaagactttttacgcgcaacgacactgtataacacagaagttctgctctcccacctctcctatctacgagagtcctctttattggcgtacaatactacctcgcataccgaccaaagctcgcgcctatctgtcaaggaagatcctagctacgattccgtgagaagaggtgcctggggcaacaacatgaacagtgggctgaataaatctcctcctctgggtggggctcagaccatctccaaaaatacagaacaaagacctcagcccgatccctatcagatcctcggtcctaccagttcaagactcgcgaatccaggtagcggccagattcagctttggcagttcctgcttgagctgctcagcgactctgcaaacgcatcgtgcattacttgggaaggtaccaatggggagttcaaaatgacagaccccgatgaggtggccagacgctggggtgagcgtaaaagtaaaccgaacatgaattacgacaaactgtccagagcgttgcgatactactatgataagaacatcatgaccaaggttcacggaaagcgctatgcctataaattcgacttccatgggattgcacaggcactgcaacctcaccctactgagtcctcaatgtacaagtatccaagcgatatttcgtatatgcctagttatcacgctcaccagcagaaggtgaacttcgtccctccccacccttcttcaatgcctgtcacatctagttctttctttggggctgccagtcagtattggacatccccaacaggaggtatatatccaaatccaaatgttcctcgccaccctaatactcatgtcccgtcccacctggggtcttattattag

SEQ ID NO: 223690 - DNA, 780 bp, Artificial Sequence
  Description of Artificial Sequence: Synthetic coding sequence
atggacccagggtccctgctggcatacaacacaacaagccatacagatcagtcatctcgtctgagcgtgaaggaggacccttcatatgactcggtgcgcaggggcgcttggggtaacaacatgaattctggtctcaacaaatcccctccacttgggggagcgcagacaattagtaaaaacacggaacaacgccctcagcctgatccctatcagatactgggccctaccagcagccgcttggctaacccaggatctggacaaatccagctgtggcagttcttgctggagctcctctctgatagcgctaacgcctcctgtattacatgggagggcaccaacggcgaattcaaaatgaccgatcccgatgaagtggccagacgttggggggaacgtaaatccaagcccaatatgaattacgataagttgtcccgtgctttgagatactactacgacaagaacatcatgacgaaggtccacggaaaaaggtacgcctacaaatttgactttcacggcatcgcccaggcattgcagcctcaccccacggagtccagtatgtataagtacccctcggacatttcttatatgccgtcctaccatgctcatcagcagaaggtaaattttgtgccaccacatccttcaagtatgccagtgacatctagctctttcttcggggcagctagtcaatattggacctccccgacagggggaatttaccctaatcctaatgttccccgtcatccaaatacccatgtaccgagccatctggggagttattattag

SEQ ID NO: 223691 - DNA, 1944 bp, Artificial Sequence
  Description of Artificial Sequence: Synthetic coding sequence
atggccgaagaggaggcacccaagaaatcaagagctgcaggaggtggcgcatcttgggagctctgtgcaggggctctgtcagcccgactggctgaggaaggctcaggtgacgcaggaggcaggaggagacctcccgtggatcctcggagactcgccagacagctgcttctgttgctatggctgctggaagcgccactcctactcggcgttcgcgctcaagctgccggtcaggggccagggcagggcccagggccaggccagcagccccctccaccaccacaacagcaacagtccggccaacagtacaatggcgaacggggaatctccgtacccgaccatggctattgtcagcccatcagtatccctctttgcaccgacatcgcttacaaccagacgataatgccaaacctgctgggccatactaaccaggaggatgcaggtctggaagtgcaccagttttaccccctggtgaaagtccagtgttcggctgagctgaagttctttctttgttccatgtacgcacccgtttgcactgtgcttgagcaagcactacccccttgtcgatccttgtgcgagcgggctcgtcaagggtgtgaagctctgatgaataaatttgggttccagtggcctgataccctgaaatgcgaaaaatttccagtccacggtgcgggagagctctgtgtgggtcagaataccagcgacaagggtacaccaacaccttcccttctaccagaattctggacctctaaccctcagcatggaggcggtgggcatcgcggtggttttccaggaggcgcaggtgccagcgaaagggggaagttcagctgccctagagcactcaaagtgcctagctatctcaattaccatttcctgggagaaaaggactgcggagcaccttgcgaacctactaaggtgtacgggcttatgtatttcgggcctgaggagttgcggtttagcaggacctggataggcatctggtcggtgctttgctgtgcaagtaccctctttacggtccttacttatctggtagacatgaggcggttcagttacccggaacggcctattattttcctgtcggggtgctatacagctgtggcagttgcctatattgccggttttttgctggaagatagggtggtgtgcaacgataaattcgcagaggacggcgctagaaccgttgcccaaggtacgaagaaagagggctgtacaatcttgttcatgatgctctatttcttttcaatggcgtcatctatctggtgggtaatcttgtctctgacatggttcctggccgctggaatgaaatggggccatgaagcaatagaagctaatagccagtacttccaccttgccgcttgggctgtgccagcaatcaaaacgatcaccattctggcattgggccaggttgatggggatgtgttgagcggagtctgtttcgtgggcctcaataatgtggacgcgctgcggggtttcgtcctcgcacctttgtttgtttatttgtttatcgggacaagctttctgctagccggattcgtgtccctgtttcgaatcaggaccatcatgaagcacgatggcactaagactgaaaagctggagaaactgatggtgaggattggggtgttctcggtgttatacactgttcccgctactattgtaatagcatgctacttctacgagcaagcatttagagatcagtgggagcgtagttgggtcgcgcaatcatgcaaatcctatgccatcccttgccctcatcttcaggccggagggggagctccccctcaccctccgatgtcacctgactttactgtgttcatgatcaagtacctgatgactcttattgtgggcatcacatccgggttttggatatggtcaggtaagactttgaactcatggaggaagttttataccaggttaactaattcaaagcagggggaaactaccgtgtag

SEQ ID NO: 223692 - DNA, 1284 bp, Artificial Sequence
  Description of Artificial Sequence: Synthetic coding sequence
atggaagcaatggctgcaagcactagcctgcccgatcctggggacttcgacaggaacgtgccacgaatttgtggcgtctgtggcgatcgcgcaactggcttccacttcaacgctatgacctgcgaaggatgcaagggatttttcagaagatcgatgaagaggaaggcgctctttacatgccctttcaatggcgactgcagaatcacaaaggataatcgacgtcactgtcaggcttgtcgactgaagcgatgtgttgatattggcatgatgaaggaattcattcttaccgacgaggaagtacagcgtaagcgcgagatgatcctgaaacggaaagaagaggaggcattgaaggattccttgagaccaaagttgtctgaagaacagcagagaattatcgccattttgttggacgcgcatcataaaacctacgatcctacatactctgatttttgccaatttcggcctcccgtgcgagtaaacgatggcggaggatctcacccttctcgccctaattcgcgacataccccatctttttccggtgactcctcttcctcctgtagtgaccactgtatcacaagtagcgacatgatggattcctctagcttttcaaacctcgacctgagcgaagaagattcggacgacccctccgtcaccctggagctgtctcagcttagtatgttgcctcatctcgccgatctagtgtcctattcgatccagaaggtgattggcttcgccaagatgattcctgggtttagagacctcaccagcgaagaccagattgttctgctaaagtcaagcgctattgaggtgattatgctcaggagcaatgaatcatttaccatggacgatatgtcatggacatgcgggaaccaggattataagtacagagtctccgatgtgaccaaagctggacactccttagagctcattgaacctctgatcaaatttcaggttggattgaagaaactgaatctgcacgaagaagagcatgttctgttaatggctatttgcatagtgagccctgaccgtcccggtgtgcaggatgccgcacttatcgaggcaatccaagatagattgtcgaacaccttacagacatacatcagatgcagacaccctccacctggctctcacctactttacgcgaagatgatccaaaaacttgctgatctgcgctcactgaacgaagaacattcaaagcagtaccgatgcctttccttccagcccgagtgctcgatgaagcttactcctctagttcttgaggtgttcggaaacgagatatcttag

SEQ ID NO: 223693 - DNA, 1365 bp, Artificial Sequence
  Description of Artificial Sequence: Synthetic coding sequence
atgccagcccatagggatcctgacgttcaaggccatagattgcagcatgacagctacgctcagccagatgggccacgcgaacctgcacgaggatcccatcctgtggcccgtgtgcgggctgccggtggcgtccggcttcctcgtcctcctcccctgctgcctgtgctggcagttcgcgcagacgtgcatcgggcagggctctatccccatccacggctccctgggcacgtgcgcgcaggtccggctcaggtgctcccagactatggagcagtgcagctgcaggttgctcggctccctggcctccccgagacacctcagcaagagagaccacagctacccgttcacggaggtgctcagcagcggctcggcagggctcacccagggcttggacctgtgccagccgctgtgccggcagccgcagccccacagcgggcaggtgcgccagccgaagggaggggcccacgcgcaaggcggctgcgccagccaggacaggtcccaccccgaggagaagaaagagtggtgcgggctgctctgcacgccaggcgcggacgtgtgctggaaccacgtgggcaggcgctgcgctccggactggccggacacttgggcggagccgtgttactgctacaaaggctgcatcgggcacatctgccacacaggcccggacccttaccactgccgcgagccccacatcatctgcccttgcatgttctgctgcgcttgctccgaggcctccctcaccccccattacggaggcgcagggagcatcggcttagacctggccagcggccagctctgtgtcatcctggtggcactggcgaacaccgcttgcatgcaggcctccccggacctctcctacttcgtcatggacagctggccgtggtgggtgggccacacgcccacttggtacctggacggagacaagaagtaggccctcgtggtcataggagccagcagcaactgctgccccctgggtccttgggtcacccaggcggtgaagaccaccccgatcctggccacgcccaaggcggaggcggaagagcacacaggggactgctgcgcggacagcacggtcggcaacgggctcataggctgagggcacactcgcctgggctgctgccaggacataggcatgtcctgcacccccttggtctccgcggacctgtcccacaccctgaaggcgacgaagatggcagacgggaacacgggcaggccggagaagcgcatggggcatacagagccttactgtgcgccgtacaccgggcaggacatttgtgtgaccggctgctgctgctacggacaccacaacacggcctcctggaggatcctggcggtgcagctcaggtgcagaatgagcagccagattag

SEQ ID NO: 223694 - DNA, 1698 bp, Artificial Sequence
  Description of Artificial Sequence: Synthetic coding sequence
atgaggcccaggagtgcgcttccccgtctgttattgcccctgcttcttctgcccgcagccggtccagcccaatttcatggcgaaaaaggtatctcaattcccgatcacgggttctgtcaacccataagcatcccactctgcaccgatatcgcatacaaccagaccataatgcccaatcttcttggacacaccaaccaggaggatgctggcctggaggtacatcaattttacccactggtgaaggtgcagtgttcccccgagctgaggttcttcctatgcagcatgtatgcccctgtctgcacggtcctggaacaggcaattcctccttgtaggagcatatgtgagcgcgctcgacagggatgtgaagcacttatgaacaaatttgggtttcaatggccagagagactgcgctgcgagcatttcccccgacatggggctgagcaaatatgcgtaggtcaaaaccactccgaggacggtgctcctgcgctgctgacaacggcgccaccacctggccttcagcctggggcaggcggaacccctggtgggcctggtggtggcggagcccctccacggtacgcaacactggagcatccgttccattgtcctagagtgctcaaggtgcctagctatctgtcgtataagtttctgggcgagcgggattgtgccgctccatgtgagccagcgaggccagatggatccatgttttttagtcaggaggagaccagatttgcacgcctatggatactgacctggtcagtactctgttgtgcctctactttcttcactgtgaccacctacctggtggatatgcagaggtttaggtatccagagaggccaatcatcttcctttccgggtgttacacgatggtgtcggtcgcttacattgccggattcgtgttgcaggagcgggtggtatgtaacgagcgcttcagcgaagatggatacaggaccgtcgtacagggaacaaagaaggagggctgtaccatcctttttatgatgttgtattttttttctatggcttcctccatctggtgggtaattctgagcctgacctggttcttagcagctggtatgaaatgggggcacgaggccattgaagccaattcccagtatttccacctggccgcttgggcggtgcctgccgtgaaaaccataactatcctagcaatgggccagattgatggcgatctcctatctggcgtgtgcttcgtcgggctgaactctctggaccccctaaggggctttgttctcgccccactgttcgtgtacctctttatcgggacatcttttctgctagcaggatttgtcagtctctttcgcattcggactattatgaagcacgacggaacgaaaaccgagaaactcgagcggctcatggtacggattggagttttcagtgtgctgtacaccgtcccggcaaccatcgtaatcgcatgctatttctacgaacaggcatttagggagcactgggaaagatcctgggtttcccaacactgcaaaagcctggctattccctgcccggctcattacacaccacggatgtcccctgattttaccgtctacatgatcaaatacctgatgacacttatcgttgggataacttccgggttctggatttggtccgggaaaacgttacactcatggcggaaattctacacccggttgaccaactcacgacacggcgagaccacagtgtag

SEQ ID NO: 223695 - DNA, 1926 bp, Artificial Sequence
  Description of Artificial Sequence: Synthetic coding sequence
gcacgcggagtgtcagggtgcagcgtgaggcctcggcaggccagcggccaggcgcatcgacccctgcccaggcctgctagcccaactcttaggcccagggtgaagttcgccaaacggagggggcgaagacagcctcagcgtgggggaggcggagaggaggcccagtcaccaggttgggggcgtggtagggggggacgccaaggcgctggatggggagcggctgcgtccatgagacccaggagcgccttgcctaggttgcttctccccctgctcttactgcccgctgcagggcctgcccagttccacggggagaaggggatatccatccctgaccatggtttttgccagcccatttccattcccctttgtaccgacatagcctacaaccaaaccataatgccaaatctgctaggccacacgaaccaagaggacgcaggactcgaggtgcatcagttttatcccctggttaaagtgcagtgttcaccggagttaagattttttctatgttccatgtacgcccctgtgtgcacagtgctggagcaagccatccccccatgtcggagtatttgcgaaagggctagacagggttgtgaagcactgatgaacaagttcggcttccaatggcctgagaggctgcgttgcgaacactttcctagacatggggcagagcaaatctgcgtcggtcaaaaccacagcgaggacggcgctcccgctctgttaacaactgcacccccacccggattgcaaccaggcgcagggggtacaccaggaggacccggaggcggtggggcacctcctaggtatgcaaccctagagcatccgtttcactgcccacgcgtgcttaaggtgcctagttatttgtcttacaagttcctgggtgagcgcgactgtgcagctccatgtgagcctgcgcgtccagacgggagtatgttcttctcacaagaggagacacgctttgcacgcttgtggatactcacttggtccgtcctgtgctgcgcttccacctttttcacagttacgacctaccttgtcgatatgcaacgttttcggtaccctgagcgtcccattattttcctgagcggctgctataccatggtttctgttgcttacatcgctggctttgtcttgcaggagcgcgttgtgtgcaacgaaaggttcagcgaagacggctaccgcactgtggtgcagggcaccaagaaagaggggtgcactatcctgtttatgatgttatactttttttccatggcgtcttccatatggtgggtcatattgagtctaacatggttcctagcggctggtatgaagtgggggcatgaagccatagaggcgaacagccaatactttcatctggccgcatgggccgtgcctgcagtgaagactataaccatcctcgcgatgggccagatagacggcgacttactttccggagtgtgtttcgtcggattaaatagcttagaccccttgcggggtttcgtgttagcccctcttttcgtgtacctcttcatcgggacctccttcctgcttgcaggatttgttagtctattccggatcagaaccataatgaagcacgatggcactaagaccgaaaagctcgaacgtttgatggtgaggatcggggtattttccgttctgtataccgtgcccgcaacaattgtcatcgcatgctacttttatgagcaagccttcagagaacattgggaacggtcttgggtgagccagcactgcaagagtctcgcgatcccttgccctgctcattacactccgcgtatgagtcccgactttaccgtgtatatgatcaaatatctaatgacattaattgtagggatcacttcagggttttggatctggtctggcaagacgctgcacagttggcgcaaattctacacaagactgaccaactcacgacatggagagacaactgtttag

SEQ ID NO: 223696 - DNA, 2001 bp, Artificial Sequence
  Description of Artificial Sequence: Synthetic coding sequence
atggcaatgacatggatcgtattctcactctggcctctcacagtttttatgggtcacatcgggggacattctctcttttcttgcgaacccattacactgaggatgtgtcaggacttaccttataacaccacgtttatgccaaacctgctcaatcattatgaccagcaaacggcagcactcgccatggaacccttccaccctatggtgaatcttgactgctcccgggacttccgaccttttctgtgtgcactttacgcccctatctgcatggagtatggaagggtcaccctgccttgccgacgcctgtgccagagagcgtattccgagtgtagcaagctgatggagatgttcggggtcccctggcccgaggacatggaatgctcaagattcccagattgcgacgaaccctatccacgactggtggatttgaatctcgcaggcgaacccacggagggtgccccagtggcagtccagagagactacggtttctggtgtccgcgtgaactgaaaattgatcccgacctcggttactcttttctgcacgtgcgggattgctcacctccatgccccaacatgtactttcgcagggaagagctgtcattcgcacgatatttcattgggctgatctcaattatctgtctgtcggcgacgctgttcacttttctcacctttctcatcgatgttacgcgcttcagataccccgagcgcccaataattttttacgcagtttgttatatgatggtgtccctgatatttttcattggcttcctgctggaggatagggtcgcctgcaacgcatccatccctgcacagtacaaggcctcaaccgtgacccagggctcacacaacaaagcatgtaccatgctcttcatgatactgtacttcttcacaatggctggcagcgtgtggtgggtcatcctgaccattacctggttcttagcggctgtccccaagtggggttccgaagcgatcgagaaaaaagccttgttgttccacgctagtgcttgggggattcccggtacacttaccatcattcttttggccatgaacaagattgagggagataacatcagcggcgtgtgttttgtaggcctctacgacgttgacgcactcaggtatttcgtgcttgcccctctttgcctgtacgtcgtggtgggagtgagtctgctcctagctggtattatcagcctaaatcgtgttcgcatagagatcccgcttgagaaagagaatcaagataagctagtgaaattcatgataagaataggggtgtttagcattttgtatctagtccccctgcttgtggtgatagggtgctacttctacgagcaggcgtatcgaggaatttgggaaacgacttggatacaggaacgctgccgtgagtatcacatcccgtgcccataccaggtaactcagatgtcgcgtcctgacttaatacttttcttaatgaaatacctaatggccctcatcgtaggtattccctctgtgttctgggtcggttctaaaaaaacttgcttcgagtgggcttctttttttcacgggaggcgtaagaaggagatcgtcaacgaaagtcgccaggtgctgcaagaaccagacttcgctcagtcgctcttgagagaccccaatactccaatcattagaaagagcagaggcaccagcacccaggggaccagtacccacgcctcatccacccaactcgcaatggtagatgaccagcgttctaaagccggaagcattcattccaaggtctccagttatcacggttctctgcatcggtctcgtgatgggagatacacaccttgtagctacagaggcatggaggagcggttgcctcatggcagcatgtcccggctaaccgatcactcacggcatagctctagtcacagactgaacgaacagtctcggcacagcagcattcgggatctgtctaacaatccgatgacacacatcacacatggcaccagcatgaaccgcgtcatcgaagaggacggaacgtcagcttag

SEQ ID NO: 223697 - DNA, 108 bp, Artificial Sequence
  Description of Artificial Sequence: Synthetic coding sequence
atggctatgacttggatcgttttctccctgtggccactgaccgtctttatgggccacattggtggtcacagcctgttcagttgcgagccaattacgttgcgcatgtag

SEQ ID NO: 223698 - DNA, 2001 bp, Artificial Sequence
  Description of Artificial Sequence: Synthetic coding sequence
atggcaatgacgtggatcgtgttcagcctgtggcccctgaccgtgttcatgggacatatcggcggacacagcctgttctcttgtgaacctattacactgagaatgtgtcaagatctcccatacaatactactttcatgccaaatttgcttaaccattacgatcagcaaacagctgccttggccatggaaccgtttcaccccatggtgaaccttgactgcagccgcgacttccgtccatttttatgtgcgctctacgcccctatctgcatggagtatgggagggtaactttaccatgccggcgtttgtgccagagagcatactcagaatgctcaaaactgatggaaatgttcggcgtcccatggcctgaggatatggagtgttcacgatttcctgactgtgatgagccttatcctaggttggttgatctcaacttagcaggtgagcccaccgaaggcgcacccgtggcagtgcagcgggactatggtttttggtgccctagggagctgaaaatcgatccagacttagggtatagttttttacacgttcgggactgtagcccaccatgtccaaatatgtatttccgccgtgaggagctttcctttgccagatacttcatagggctgatcagcattatatgcctgtccgctaccctgttcacatttctcactttcctcattgatgtgacgaggttccgataccccgagagaccaattatcttttacgctgtatgttatatgatggtttcactgatatttttcattggttttctgctggaagacagggtagcatgcaacgcttcaatccctgcccaatataaggcatccactgttactcagggcagccacaacaaagcttgcaccatgttatttatgattctatatttcttcacaatggccggtagtgtgtggtgggttatcctgacaatcacatggtttttggctgcggtccccaaatggggcagcgaggctatcgagaaaaaagctcttttgttccatgcaagcgcttggggcatcccgggaacactcacaatcatcctcctggccatgaataagattgagggcgataacatcagcggcgtgtgtttcgtcgggctgtacgacgtggacgctctgaggtattttgtcctcgcacccctgtgcctttacgtggtggtcggtgttagcctacttttagcaggtataatcagtctgaaccgcgtgagaatcgagattcctctcgagaaagagaaccaggacaagttagtgaagttcatgatccggattggagtttttagtattctgtatttggttcctctgttggtggtgatcggatgctacttttatgagcaggcatataggggcatctgggagacaacatggattcaggaaagatgtagagaataccatattccatgtccttaccaggttacacagatgagccggccagatctgatattgtttttgatgaagtatttaatggcactaattgtcgggattccgtcagttttctgggttgggtctaagaaaacctgttttgaatgggccagcttcttccacggcaggcggaaaaaggaaatagtaaacgagagcagacaagtcctccaagagccagactttgctcagtctctcttgcgggatcctaacaccccaattattcgaaagtcgcgcggaacctctacccagggcactagtacacacgcctcgagtacccagctggcaatggtggacgaccaaaggtctaaggcaggctccattcactccaaggtgagctcataccacggctccctccatcggtcccgggatggcaggtacacaccatgttcttatcgcggaatggaagaacggctgccacacgggagtatgtccagattaaccgaccattcccgccactctagcagtcaccgtctgaatgagcaatcaagacacagcagcattagggacctcagtaataatcctatgacgcacattacccatggcacgtctatgaacagggtgattgaagaagatgggacctcagcctag

SEQ ID NO: 223699 - DNA, 1614 bp, Artificial Sequence
  Description of Artificial Sequence: Synthetic coding sequence
atggcctggcggggtgccggtccatcagtccccggagcacccggtggcgtgggcctctcactgggcctattgttgcagctccttttgttactcgggccagcacgcggattcggagacgaggaggagagacgttgtgatccaattcgcattagtatgtgtcaaaacctgggttataacgtaaccaagatgcctaacctggtaggccacgagcttcagacagatgctgagttacagctaactacctttacgcctctgattcagtacggctgctctagtcagctgcagttctttttgtgcagcgtgtatgtgccaatgtgcaccgaaaagatcaacattccaatcgggccatgtggtggaatgtgtctgagcgtgaagaggcgatgtgagccagttttaaaggaatttggtttcgcctggcctgagagcctcaactgctcgaaatttccgcctcagaatgaccacaaccatatgtgcatggaagggcctggcgacgaagaggtgcctctcccccataagacgcctattcagcctggcgaagagtgccatagtgttggcaccaactcagatcagtacatttgggtcaaacgcagtctgaactgtgttctcaagtgtggttacgatgccggattgtattctcgttctgctaaagagttcaccgatatttggatggctgtttgggcgtccctttgcttcatctctacggccttcaccgtactgacattcctcattgactcctctcgcttctcctaccccgagcggcctatcatcttcctgagtatgtgctacaatatctacagcattgcgtacattgttagactcacggttggcagagaacggatctcctgtgactttgaagaggccgcagaaccagtcctgatacaagaagggcttaaaaacaccggctgcgcgattattttccttctcatgtacttcttcggcatggcctcaagcatctggtgggtcatcctgacacttacttggttcctcgcggcagggctgaagtggggacacgaagccattgagatgcactctagctactttcacattgccgcttgggcaatccctgctgttaaaacaatcgtcatcctgatcatgcgcctagtcgacgctgacgaactgaccgggctgtgttatgtcggcaatcaaaacctggacgcgctgacaggttttgtggtggcacccctgttcacctaccttgtgatcgggaccttattcatcgccgctgggcttgtggctcttttcaagataagaagtaacctacagaaggacggtacgaaaaccgacaaactggagcgactgatggtgaaaatcggcgtgttcagcgtgttgtatactgtgccggcaacctgcgtgattgcatgctatttctacgaaatttctaactgggcgttgttccgctattcggccgacgacagtaatatggctgtagagatgctgaaaatcttcatgagccttctggtgggcattacttccggaatgtggatatggagcgcaaagactctccatacgtggcagaagtgcagcaacaggttggtgaactctggcaaggtgaagagggaaaaacgcggaaatggatgggtgaaacctgggaaggggtcggaaaccgttgtttag

SEQ ID NO: 223700 - DNA, 2121 bp, Artificial Sequence
  Description of Artificial Sequence: Synthetic coding sequence
atggagatgttcacctttctcctcacttgcatttttctgccattgctgaggggtcacagtctgtttacctgcgagcccataacggttccccgatgtatgaaaatggcgtataacatgaccttctttccaaacctgatgggacactatgaccagagtatcgctgctgtggaaatggagcacttcctgcccctggccaacttagagtgcagtcccaacattgaaactttcctttgtaaggctttcgtgcccacttgcatcgagcagattcacgttgtgccaccatgccgaaagctctgtgaaaaagtgtattccgattgcaaaaagttgattgataccttcgggatccggtggcctgaggagcttgaatgtgaccgcctgcaatactgcgacgaaaccgtacctgttactttcgatccccataccgagttcctcggccctcaaaagaaaaccgaacaggtgcaaagggacatcggattctggtgtccaagacacctcaagacaagcgggggtcagggttacaagtttctcgggattgaccagtgtgctccaccctgtccaaatatgtacttcaagagcgatgaactcgaattcgctaaaagcttcatcggtaccgtttccattttctgtttgtgcgctactctgtttacctttctgactttccttatcgatgtgagaagattcaggtatccagaacggcctataatttactattcagtgtgctactccatcgtgagcttaatgtactttattggtttcctgctgggggacagtaccgcgtgtaataaagccgacgaaaagctcgaactcggtgatactgtcgtgctgggcagccagaacaaagcttgcacagtgctcttcatgttgctttatttcttcacaatggccggtacggtttggtgggtgattctcacaattacatggttccttgcagcaggacgcaagtggtcctgcgaggcaatcgagcaaaaggccgtctggttccacgctgtggcttggggcacccccggattcctgacggtgatgctgctggcgatgaacaaagtggaaggtgacaatatcagcggagtgtgcttcgtcggcttgtacgatctggacgctagtaggtacttcgtgctactacccttgtgtctgtgcgtctttgtcgggctctccttactcctagcaggcatcattagtcttaatcacgttcggcaagtgatccagcatgacgggagaaaccaggagaagctgaagaaattcatgatacggatcggagtcttctccggtctttatctggtgcctttagtgacccttctcggatgttatgtatatgagcaggtgaatagaatcacctgggagatcacatgggtttccgaccattgccgccagtatcatattccttgtccctaccaagctaaggccaaggctcggccagaactcgccctattcatgattaagtacctgatgacactaattgtcgggatctcagctgtgttttgggtgggtagcaagaaaacttgcactgagtgggcagggttttttaagcgtaaccggaagagggatccgattagcgaatcgcgcagggttctacaggaatcatgcgaattctttttaaagcataacagcaaggtgaaacataagaaaaagcattataaaccttctagccataagctgaaagtcatctctaaatccatgggcacgagcacaggtgcaaccgccaaccacggcacatctgctgttgccataaccagccatgattatctggggcaggagactttaaccgagatacagacaagccccgagaccagcatgagagaggtgaaagcagacggcgcttccacaccccgactacgcgagcaggattgcggagagcccgcaagcccagctgcctccatcagcagactttccggggagcaagttgacggtaaaggtcaagccggatccgtgagcgagtccgcgcgaagcgaaggaagaatctctccgaaatccgacataactgacaccgggctggctcagtccaacaatctccaggtgcctagttcgagcgaaccatccagcttaaaaggctcaacaagtctgctggtgcaccccgtcagtggagtgcgcaaagagcagggagggggttgccattccgacacctag

SEQ ID NO: 223701 - DNA, 2121 bp, Artificial Sequence
  Description of Artificial Sequence: Synthetic coding sequence
atggagatgtttacctttcttctgacttgcatttttttgcctttgcttcggggtcactccctatttacgtgcgaaccaatcaccgtccctcgttgtatgaagatggcctacaacatgacttttttccccaatttgatgggacactatgatcagtctattgccgctgtcgagatggaacactttctgcccctggccaatttagaatgtagcccgaatattgagacatttctctgtaaagcatttgtcccaacttgtatcgagcagatacacgtagtgccaccctgcaggaagctgtgcgaaaaggtttacagtgactgcaaaaaacttatcgataccttcggcataagatggcctgaggaactggaatgcgatcgccttcagtactgcgatgagactgtcccagtgactttcgacccgcatactgaattcctcggtccacagaaaaaaaccgagcaggtgcagcgggacatcggattttggtgcccacggcatcttaaaacatcaggcggacaaggctataagttcctaggcattgaccaatgcgcgccaccgtgccccaatatgtatttcaagtctgatgagctagagttcgccaaatcttttatcggcacagtgtcgatattctgtctttgcgctactttgtttaccttcctgaccttccttatagatgtcagacgattccgctaccctgagaggccaataatctattattccgtgtgctattcaattgtttctctcatgtactttatcggatttctgctgggggattccactgcatgtaataaggccgacgagaagctggaattaggagacacagtagtactggggtctcagaacaaggcgtgtacagtgctctttatgctcctttatttttttacaatggcaggcactgtatggtgggtaatattaacaatcacctggtttttagccgcaggcaggaaatggtcctgcgaggctattgaacaaaaagcagtttggtttcatgccgtcgcatggggcacccccggtttcctcaccgtgatgttactggccatgaacaaagttgaaggagacaacataagcggagtctgctttgtagggctgtatgatctggacgcatcacgatatttcgtcctccttcctctgtgtctctgtgtgtttgtcggactgtcccttctgctggcaggcattataagtctgaaccatgttagacaggttattcagcatgacgggaggaaccaggagaagcttaaaaaatttatgataagaataggcgttttcagcggattatacttggttccactggtcacactcctgggttgttacgtctacgagcaggttaaccgcataacctgggaaatcacttgggtgagcgaccactgtagacagtatcatatcccgtgcccttaccaggctaaggcaaaggctcggcctgagctggccctctttatgatcaaatatttaatgacactcatcgtcgggattagcgccgtgttttgggtggggagtaaaaagacatgtacagagtgggccggtttctttaaacgcaatcgaaagcgcgaccccatttccgagagtaggagagttctccaggagtcttgcgagttctttttgaaacacaactccaaggtgaagcacaaaaaaaagcactacaaaccttcttcccacaaattgaaggttattagcaaatcgatgggcacaagcacaggcgcaacagcgaaccatggcacttccgctgtagcaattaccagtcatgattaccttggtcaagaaaccctgaccgaaattcaaacatcacctgaaaccagtatgcgtgaagtgaaggcagacggcgcttccactccacgcctgcgcgagcaggactgtggtgaaccagcttctcctgcagcttcgatcagccggctgagtggggagcaggtggacggtaaaggccaagccggttctgtgagcgaatccgctcggagtgagggacgtatttccccaaagtcagacatcaccgacacgggtctggcccagagtaataacctgcaggtcccgtccagctcagagccaagcagcctgaaggggtctacatctctcctcgttcacccagtgtcaggggtaagaaaggagcaaggaggtggatgccactcagatacttag

SEQ ID NO: 223702 - DNA, 2025 bp, Artificial Sequence
  Description of Artificial Sequence: Synthetic coding sequence
atgaaaatggcatacaacatgacgttctttccaaatctgatggggcactacgaccaaagcatcgccgctgtggagatggaacacttcctccctcttgcaaacctggaatgtagccctaacatcgaaacattcctttgtaaagcttttgtacccacatgtatagaacaaatccacgtggtccctccttgcaggaagctgtgcgagaaggtgtactcagactgcaagaaacttattgatacatttggtatacgatggcctgaggagcttgaatgtgacagactgcagtattgtgacgaaacagtccccgtcaccttcgatccacacacggaatttctaggaccacagaagaagacagagcaggtgcagagagacatcgggttctggtgccctcggcacctgaagacgtcaggcggtcaaggatataaattcctagggattgaccaatgtgcacctccttgccccaacatgtacttcaagtctgatgaactggagttcgccaagagcttcatcggaactgtgtccattttttgcctgtgcgctaccctttttacattcttaacttttctgatagacgtacggcgatttcggtacccagagaggcccatcatatactattcagtgtgctacagcattgttagcttaatgtacttcattggattcctcttgggagactccactgcctgcaataaggctgatgagaagctggagttgggcgacaccgtggtcttagggtcacagaataaggcatgcaccgtgctctttatgctgctttatttcttcactatggccggaacagtgtggtgggtcatcctcactattacttggttcctggctgcaggaagaaagtggtcatgtgaagcaatcgaacagaaagccgtttggtttcatgctgtcgcctggggtacccccggatttctgaccgtgatgcttcttgcgatgaacaaagtagaaggcgataatatctctggggtctgcttcgtcggtttgtacgatctggacgcctcccggtatttcgtcctcctgcctctgtgcctttgcgtgttcgtcggcctttctctactcctggccggtatcataagcctgaaccatgttcgacaggtgatccagcacgacgggcgaaaccaggagaaattgaaaaaatttatgattcggataggagtttttagtgggctgtacctggtccccttggtcaccttgctgggatgctacgtctacgagcaggtaaaccggatcacttgggagatcacctgggtctctgaccactgccgccaataccatatcccatgtccctaccaggcgaaggcgaaagctcgcccagaattggccctattcatgattaagtatttaatgactttgatcgttggaatcagcgccgtcttctgggtgggctccaaaaaaacgtgtacggagtgggccggtttctttaagaggaatcgcaagcgggacccaataagtgagtcgaggcgtgtgctccaagagtcgtgtgaattctttctgaagcacaactccaaggttaaacataagaaaaagcattataagccatcttcccataaactcaaggtcattagtaaatctatgggcacgagtacaggagcaactgcaaatcatgggacatcagccgtagccatcacaagccatgactatttaggtcaggaaacccttacagagatccagacttcacctgaaacctccatgagagaggtaaaagctgacggagcaagcaccccacgcctgcgtgagcaggattgtggtgagccagcgagcccagccgcatcaattagcagactgtcaggtgaacaagtggatggcaagggtcaggctgggagtgtcagtgagagcgccaggtcagagggtaggataagtccaaaatctgatattactgacactgggcttgcccagtccaacaacttgcaggttccatcatcgagcgagccctcctctctgaaagggagtacatctcttcttgtgcacccagtgtcaggagtgcgcaaagaacagggcggaggatgccacagcgacacttag

SEQ ID NO: 223703 - DNA, 1956 bp, Artificial Sequence
  Description of Artificial Sequence: Synthetic coding sequence
atgctagcccagcactttctacctctggcgaatctggagtgctcccccaatattgaaacatttctgtgtaaggcttttgtgccaacatgcattgagcagattcacgtggtgcccccatgtcgaaagctctgtgagaaagtgtactcagattgtaaaaaactgattgatacattcggaatccgttggccagaggagctcgaatgcgaccgcttgcagtattgtgatgaaacagtgccagtaacctttgatcctcacacagaatttcttggcccacagaaaaaaacggagcaggtccaacgggacattgggttttggtgtcccaggcatctgaaaactagcggtgggcaaggttataaatttttgggtattgaccaatgcgctccaccttgccctaacatgtacttcaagtccgacgagctagagtttgctaaatccttcataggaacagtgagtattttctgtctgtgtgctaccttgtttacattcttaacatttttaatcgatgtcagacgctttagatacccagagcgccctatcatctattattccgtctgctacagtatagtgagcctcatgtactttatagggttcttgttaggagacagtaccgcgtgtaataaggctgacgagaaactggaactcggagatactgtggtcctgggctcacagaacaaagcctgcaccgtgcttttcatgctcctctattttttcacaatggccggaactgtttggtgggttatattgaccatcacctggttcctggcagccggtaggaagtggtcttgcgaagccattgagcaaaaagccgtctggtttcacgcggtagcatggggcactccaggctttttgactgtgatgctgttagcgatgaacaaggtcgagggggataatatttctggggtctgctttgtgggcctgtacgatctcgacgcgagcagatacttcgtactgctgcctctgtgcctgtgtgtgtttgttggcctgtcattattactcgctggtatcataagccttaatcatgttagacaggtgatccagcacgacggtcgcaatcaagagaaattgaagaagttcatgataagaatcggggtgttttctggcctttacctagtgccactagtgacgcttctcggctgctatgtttatgagcaagtcaatcgaatcacgtgggagatcacgtgggtgtcagatcattgcaggcagtaccacattccttgcccctaccaggctaaagcaaaggcaaggccagagctggccctgttcatgatcaagtaccttatgactctgattgttggcatttcagccgtcttctgggttggtagcaagaaaacttgtactgagtgggcaggctttttcaagaggaatcgcaaacgggatccaataagtgagtccagaagggtcttacaggaaagttgtgaattttttctgaagcataattcaaaggtcaaacataaaaaaaaacactataaaccctccagtcacaagctgaaagtgatatcaaaaagtatgggcacctcaacaggagccaccgcaaaccatggcacttccgctgtagccattacatcgcatgactatttgggtcaggagaccctgacagaaattcagaccagtcctgagactagtatgcgggaagtgaaggctgacggcgcttccacgccgcgattaagggagcaagattgcggagaaccggcttcaccggcagcctcaatctctcgcctttcgggcgaacaggtggacggtaagggccaggccggaagcgtgagtgaatcggcaaggtctgaaggcaggatcagtccaaaatcagacatcactgacaccggacttgcacaatccaacaacctccaggtaccgagctccagtgagcccagcagtttaaaaggctctactagcctgctggttcacccagtcagcggcgtgcggaaggaacagggcggtgggtgccacagcgatacctag

SEQ ID NO: 223704 - DNA, 1206 bp, Artificial Sequence
  Description of Artificial Sequence: Synthetic coding sequence
atgacacgggtgttgcctcgctggaagtggagctgcgaggccattgagcagaaggctgtgtggtttcacgcagttgcttgggggacacccggattccttactgtgatgctgctggcaatgaataaggttgagggggataacatctctggagtgtgtttcgtcggattatatgacttggacgcttcaaggtattttgtgcttctccctctgtgcctttgtgtgtttgttgggctgtccctgctgttggcaggcatcatctcacttaatcatgtgcgccaggtgatccagcacgatggtcgcaatcaggaaaaactgaagaaatttatgatccgcatcggcgtgttctctggcctttatctggttcctctggtcactctgctcggatgctatgtgtacgaacaggtaaaccgcatcacatgggagataacgtgggtgtcagaccattgcagacagtaccacatcccatgcccatatcaggcaaaggcaaaagctcggccagagcttgccctgtttatgattaagtacctgatgactcttatcgttggaatcagcgcagttttctgggtgggcagtaagaaaacatgcaccgaatgggcgggattttttaaacgcaacaggaaaagagacccgatctccgagtcccggagggtcctgcaggagagctgcgaattttttttgaaacataattccaaagtgaaacataaaaagaaacattacaaaccctctagtcacaaactgaaagttatcagcaaaagcatgggcacatctaccggtgccaccgccaaccacggcacatcagcagtcgccattacttcacatgattacttgggacaagaaacattgacagaaattcagacctctccggagacgtctatgcgagaggtgaaagctgatggggctagtacacccagactccgggaacaagattgtggagagcccgcaagcccggctgcctcaattagccggctgagtggtgagcaggtggacggaaagggacaagctggaagcgtgtccgaaagcgcgaggtccgagggacggataagcccgaagtcggacatcaccgacacgggactggctcaaagcaataatttacaggttcctagctccagcgaaccatcatccctgaagggctctactagccttctggtgcacccagttagtggagtaaggaaagagcagggtgggggatgccattcagatacctag

SEQ ID NO: 223705 - DNA, 2085 bp, Artificial Sequence
  Description of Artificial Sequence: Synthetic coding sequence
atggaatggggatatttgctggaggtcaccagcctgctcgcagctctggccctcttacagcggtcctcgggagcggcagcggcaagcgcgaaggaactggcatgtcaggaaatcacggtgcccctttgtaagggcatcggatataattacacctatatgcctaatcaatttaaccacgatacccaggacgaggcaggacttgaagtccaccagttctggccattagtggaaatacaatgctctccagatctaaaatttttcctttgttcgatgtatacccccatctgccttgaagactacaaaaaacctcttcctccttgcagaagcgtttgcgagcgggcaaaggccggatgtgcacccttgatgcgacagtacgggtttgcttggccagatcgcatgaggtgcgatcgcctgcccgagcaaggcaatccagatactttatgtatggattacaatcggactgacctgacaaccgccgcaccgtcccctcctcggcgactgccccctccccctcccggagaacagccaccttcaggaagcggccacggcagacccccaggagccagaccccctcaccgtggcggaggtcgtggagggggagggggtgatgcagctgctccccctgcaagggggggaggcggagggggaaaagcgcgtccgccagggggaggggctgcaccatgcgaaccagggtgtcagtgcagagcccctatggtgtccgtttctagcgaaagacatcctctctataatcgggtgaaaacaggacaaatcgctaactgtgcgctcccttgccataatcctttcttctcacaggacgagagagccttcaccgtattttggatcggactgtggagtgtactctgctttgtgtccacattcgctacagtgtccactttcctgatagatatggagaggtttaaatatccagagagaccaatcatctttctgtccgcctgttatctgttcgtcagtgtcggttacctggtgcgtctggtagccggtcatgaaaaagtcgcatgctctggcggagcaccaggggcaggcggtgccggaggggctggaggggctgctgccggtgctggagcagctggtgccggagcaggagggcctggcggtcgcggtgaatacgaagagctgggtgcagtggaacagcacgtccggtatgagacaaccggaccagcgctgtgtaccgttgttttcttactggtttatttttttggaatggcatcctccatttggtgggtcatcctgtcacttacttggttcctcgcggcaggcatgaagtgggggaatgaagcaatcgcaggctactctcagtactttcatctcgcagcatggctggtgccatcagtgaaaagtatcgccgttttagctctgagctcagtagatggtgaccctgtcgccggaatttgttatgtgggcaatcagtctttagacaacctaaggggcttcgtattagccccactagtcatctatctgttcattggaaccatgtttctcctggccggatttgtgtctctattcaggatacggtccgtgattaagcaacaggacggcccaactaaaactcacaaattggagaagctgatgatacgactcgggctcttcacggtcctctatacggtgccagctgcagtggtggtagcctgcctgttttacgaacagcacaaccgccctagatgggaggctacacacaactgcccctgcctgcgggatctgcagcctgaccaggctcgacgcccagactacgctgtgttcatgttgaaatatttcatgtgccttgtcgtgggcattacatctggggtctgggtgtggtcgggaaagaccctagaatcctggcggtcactgtgtacgagatgctgttgggcaagtaagggcgctgcagtgggaggtggtgctggtgcaacggccgctgggggtggaggtggacctggcggtgggggaggtggaggacctggcggtggcggaggtccgggaggaggcggtgggagcctgtactctgacgtgtctaccggccttacgtggcgatccggaaccgcctcctcagttagttacccgaaacagatgcctctgtcgcaggtgtag

SEQ ID NO: 223706 - DNA, 1776 bp, Artificial Sequence
  Description of Artificial Sequence: Synthetic coding sequence
atggccgtcgcgccattgagaggcgcactcctactgtggcagctgctggcggctgggggagccgctcttgagataggtaggttcgacccggagagagggagaggcgctgccccttgccaagcggtcgagattccgatgtgccggggtatcggctataatctgactcgtatgcccaatctgttaggacacaccagccaaggggaggccgctgctgagctagctgagttcgcgccattagtgcagtatgggtgtcattcccatctacgcttttttctctgcagcctgtatgctcctatgtgtacagatcaggtttctaccccgattcccgcatgtagacccatgtgcgagcaggctagattacgatgtgccccaattatggagcagttcaacttcggctggccagatagcctcgattgcgccagactgccaacccgcaacgatcctcacgccttatgcatggaggcccctgagaatgctacagcgggacccgctgagccacataagggcctaggtatgctcccagtggctccacggcctgctcgcccaccaggcgaccttggacctggcgctggcggatcgggaacatgcgagaatccagagaagttccaatacgtagagaagtcacgctcttgtgctccgagatgtgggcctggagtggaagtgttttggtctaggcgcgataaggattttgcactggtgtggatggccgtgtggtcagccctgtgtttcttctcaacggctttcacagtgctgactttcctgctcgagccccaccgatttcagtaccccgagcgacccatcattttcctgtctatgtgctataacgtgtatagcctggctttcttgatccgggcagtagctggggcacaatctgtcgcatgtgatcaggaagccggagctttgtacgtcattcaagaagggctggaaaacaccgggtgtacgttggtatttctcctgctttattactttgggatggcttcttctctgtggtgggtcgtgctgaccttgacctggttcctcgctgccggtaagaagtggggacatgaggctatagaggcacacggcagctatttccacatggcggcttggggcctccctgccctgaaaaccattgtcattctcacactgaggaaagtcgcaggcgatgagctgacagggctgtgttacgtggctagtactgacgccgctgccctcaccggctttgttcttgttcccctgtccggttacctggtgctgggtagctctttccttctgacgggattcgttgccttgtttcatattagaaagattatgaagacagggggaaccaacactgaaaagctggagaaattgatggttaaaatcggcgtttttagcatcctctacacagtgccggctacctgcgttatagtatgctatgtgtacgagcggctgaatatggacttttggagactaagagccactgaacagccttgcgctgcggctgccggtcctgggggtaggcgagactgtagtttaccaggaggaagcgtgcccacagtggccgtgttcatgctgaaaatctttatgagcctggtggtcggaattacctctggggtgtgggtctggtcctcaaaaacattccagacttggcagagcctgtgctaccgcaagattgcggctgggcgtgctagagctaaagcgtgcagggccccaggcagctatgggagaggaacccattgccactataaggccccaaccgtcgtgctgcatatgactaagacagatccctctttggagaaccccacacacctgtag

SEQ ID NO: 223707 - DNA, 978 bp, Artificial Sequence
  Description of Artificial Sequence: Synthetic coding sequence
atggtttgtggtagccccggtgggatgttattactccgcgctggcctgctcgctctcgcagcgctgtgtcttctgcgcgtcccaggcgcaagagccgctgcctgtgagccggttcggattccgctttgtaagtcactcccttggaacatgactaagatgcccaaccatctccatcactctacgcaagcaaatgccatacttgctatcgagcagtttgagggacttcttggcacacactgctctccagatctcctgttcttcctgtgcgctatgtacgcacccatttgcactatagattttcagcatgagcctatcaagccctgcaagtccgtctgtgagcgcgctcgccaaggctgcgaacctattcttatcaagtacagacacagctggcctgaaaatttggcctgcgaggagctgcccgtgtacgatcgcggtgtgtgcatcagtcccgaagctattgtgacagccgacggcgctgatttcccgatggactcctccaatggaaactgccgcggtgcatcatcagagcgttgcaagtgcaagccaatcagagccacccagaagacttatttcagaaataactacaactacgtgattagggcaaaggtcaaagaaatcaaaaccaaatgccatgacgtgactgctgtagttgaggtgaaggaaatactaaagagcagcctggtgaatatcccacgagacaccgttaatctttatacttcatctgggtgtttgtgcccaccccttaacgtgaatgaggagtatattatcatgggctacgaggatgaggagaggtctcgcctcctcctggtcgaaggcagcattgctgagaaatggaaggaccggctcggcaagaaggtgaaacgttgggacatgaagctccggcacctgggcctgagtaagagcgacagtagcaacagcgattcaactcagagtcagaagtccggtaggaactccaacccgaggcaggcgcgaaactag

SEQ ID NO: 223708 - DNA, 930 bp, Artificial Sequence
  Description of Artificial Sequence: Synthetic coding sequence
atggaagaactgctaaggagagaattggggtgcagtagtgttcgggcaaccggccattcaggcggaggctgtatctctcagggaaggagttacgatacagaccagggtagggtgtttgtcaaggttaaccctaaagccgaggcaaggcgcatgtttgaaggcgagatggcatccctaacagcaatattgaagaccaatacagttaaagtccccaagcccattaaggttctagatgccccaggtggtgggagcgtgctagtaatggagcatatggatatgcggcacttgtcgtcccacgcggctaagttgggcgctcaattagccgacctgcacttagacaacaagaagttaggtgaaatgcgtcttaaggaagccggaaccgttggaagggggggtggccaggaggaacgcccattcgttgctaggttcggcttcgatgttgtgacatgctgcggttacctgccccaggtcaatgattggcaggaggactgggtcgtgttctatgcaaggcagaggatccaaccccagatggacatggtggaaaaagagagcggagaccgagaggcactccagctctggtccgcactgcagttgaagatccctgatctgtttagagacctcgagatcattcccgctttgctccatggcgatttgtggggaggtaatgtggcggaggatagttcaggccctgtaattttcgacccagcaagtttctatggacacagcgagtatgagcttgcgattgccggaatgttcggaggcttttcttcctctttttactccgcctatcacggaaagatccctaaagcacccggtttcgaaaagagacttcagctgtatcagttgtttcattacttgaaccattggaatcactttggcagtggttacaggggatcgtccctaaacattatgagaaatcttgttaaatag

SEQ ID NO: 223709 - DNA, 780 bp, Artificial Sequence
  Description of Artificial Sequence: Synthetic coding sequence
atgttcgagggtgaaatggcatcgctcactgcaattctgaaaactaacactgtaaaggttcctaaaccaatcaaagtactggacgcccctggaggaggatccgtccttgtgatggagcatatggatatgaggcatctatcatcccacgctgcaaaacttggggctcagctcgcggatcttcatctcgacaataagaaacttggcgaaatgcgcctgaaagaggcaggcacagtcggcaggggaggtggccaggaagagcgtccattcgtagcgagatttggtttcgacgtcgtgacatgctgcgggtatctgcctcaagtgaatgattggcaggaggactgggtagtattctatgccaggcagaggattcaacctcaaatggatatggtggagaaagagtccggagacagagaagccctgcaactgtggagcgccttacaactcaagatccctgatctgttccgcgatttggagattatccctgctttgttacatggcgacctgtggggaggaaacgtagcggaagactcctcggggccagtcatttttgatcccgcaagcttctatggccactccgaatatgaattagccatcgcaggcatgttcggagggtttagctcctctttctacagtgcatatcatggaaagatccctaaggcccctggttttgaaaagaggctacagttgtaccagttgttccattacctaaaccattggaaccactttgggtccggctaccgtggatctagcctcaatataatgcgcaatctcgtgaagtag

SEQ ID NO: 223710 - DNA, 1017 bp, Artificial Sequence
  Description of Artificial Sequence: Synthetic coding sequence
atggccgatcaagcccctttcgatacggacgtaaataccttgacacggttcgtcatggaggaaggtcgcaaggctcggggaactggcgagctgactcagctcctgaatagtctgtgtacggccgtgaaagctattagctccgctgtccgcaaagctggcattgcccacctgtatggaatcgccggttccaccaatgtgacaggggaccaggtgaagaaactggatgttctctctaacgatctcgtgatgaatatgttaaagagctctttcgcaacttgcgtgctggtgagcgaggaagataagcatgctattatagtggaaccagagaaaagaggtaaatatgttgtttgttttgaccccctggacggttcctccaacatcgactgtctggtttccgtgggtacgatctttggcatttatcggaagaagtcaacagacgagccctctgagaaggatgccttacagccaggtcggaacctggtggctgctgggtacgccttgtacggctctgcaacaatgctggtacttgctatggactgcggcgtgaactgctttatgctcgacccggcaattggcgagtttatccttgttgataaggacgtgaagatcaagaagaaaggaaagatctacagtctgaacgagggctatgcacgcgatttcgatcctgcagtgaccgagtacattcaacgaaagaagtttccaccagataacagtgcgccatacggcgctcgatacgtgggctccatggtcgccgatgtacaccggaccttagtgtacgggggaatttttctttaccccgcaaacaagaagtcccctaacggcaagctccggctgctgtacgagtgtaaccccatggcctacgtaatggagaaggctggcggaatggccactacaggcaaggaagccgtgctggacgtgatcccaacagacatccaccagagagcccctgtcattttaggctctcccgatgacgtactggagtttctaaaagtttacgaaaagcactctgcccagtag

SEQ ID NO: 223711 - DNA, 456 bp, Artificial Sequence
  Description of Artificial Sequence: Synthetic coding sequence
atgctgaagagttcttttgctacctgcgtgctggtttccgaagaggacaaacatgcaatcatcgttgaacccgagaaacgaggaaagtacgtggtgtgtttcgaccctctcgacggatcttccaacatcgattgtttggtttccgtgggcactatatttggaatttataggaagaagagtacggatgagccatctgagaaagacgcgttacagccagggaggaacctggtggcggctggctatgccctttacggcagcgctactatgctggtgctcgcaatggactgtggcgtgaactgttttatgcttgatcctgcaattggggagtttatattagtcgataaggatgtcaagatcaaaaagaaaggaaagatttacagtctaaacgaagggtatgcgcgtgactttgaccctgcagtgaccgaatatatccagaggaaaaaattccctccctag

SEQ ID NO: 223712 - DNA, 1017 bp, Artificial Sequence
  Description of Artificial Sequence: Synthetic coding sequence
atggctgaccaagccccttttgatacagatgtgaatacactgacccggttcgtgatggaagagggcaggaaagcaaggggaaccggtgaacttacacagttgctgaattcactatgcactgccgtcaaggccatctccagtgcggtccggaaagcgggaattgcccacctgtatgggatagccggaagcacgaatgtaaccggggaccaagtgaagaaactggatgtactctctaatgatctagtaatgaatatgttgaaaagttcttttgccacatgtgtgctcgtgtctgaggaggacaagcacgctattatagtcgagccagaaaaacggggaaaatatgtggtctgttttgatcccctcgacgggtcctccaacattgattgcctggtgagcgttggaactatattcggaatatatcggaagaaatctaccgacgagccgtccgagaaggacgctctgcagccaggcagaaatttggtggccgctggctatgctctgtacggatctgcaaccatgctggttctcgccatggactgcggggtgaactgcttcatgctcgatccagctataggggaattcattttggtggataaggatgtaaaaataaaaaagaaaggcaaaatttattcactgaacgagggctatgcccgagacttcgacccggcagtgaccgagtacatccagaggaaaaagttccctcctgacaattccgcaccctacggagccaggtacgtgggctcaatggtggccgacgttcacaggaccttggtgtacggaggcatcttcttatacccagctaataagaagtccccaaatggaaaattgaggttattgtatgaatgcaacccaatggcgtacgtgatggaaaaggcaggcggaatggccaccacgggcaaggaagccgtattggacgtgattcctacagacatccaccagcgtgctccggtgatcctggggtctcctgacgacgtgcttgagtttctgaaggtctatgagaaacattctgctcagtag

SEQ ID NO: 223713 - DNA, 1020 bp, Artificial Sequence
  Description of Artificial Sequence: Synthetic coding sequence
atgacagacagatctccctttgagaccgatatgctgactttaacacgatatgtcatggagaaaggcaggcaggcaaaggggacaggcgagctgacccagctgctgaacagcatgctaacggcgattaaagccatcagcagtgccgtgcggaaagcaggattggcacatttatacggcatagccggatctgtcaatgttacaggggatgaggtgaagaagctagatgtcctctctaatagcctggttatcaatatggtgcagtcgtcctactccacctgcgtgcttgtgtccgaggaaaataaggacgccatcataaccgctaaggaaaagaggggcaagtacgtggtgtgttttgatccactcgatggatcttccaacatcgactgtcttgctagtatcgggacaatcttcgccatttacaggaaaacaagcgaggatgaacctagtgaaaaggatgccttacaatgcggacgcaacatcgtagcagctgggtatgcactgtacggcagcgcaactttggtggccctgtctactggacagggcgtcgacctatttatgctcgacccagctctaggagagttcgtacttgtggagaaagacgtgaaaatcaagaagaagggcaaaatttattctctaaatgaaggatacgcaaagtacttcgatgcagctactaccgaatatgtgcagaaaaagaaattcccagaggacggttctgctccttatggagcaaggtacgtgggctcaatggtggccgatgtgcaccgaaccttggtgtatggcggtatattcttatatcccgcaaatcagaagtcgccgaaaggcaaattacggctactgtacgaatgtaaccctgtagcatacattatcgagcaagccggtggcttggcgactacaggcactcagcccgttctcgatgtgaagccagaggctattcatcagcgtgttcctctgatcctgggatcccccgaagacgtacaggaatacctcacgtgcgtccaaaagaatcaagcagggtcctag

SEQ ID NO: 223714 - DNA, 837 bp, Artificial Sequence
  Description of Artificial Sequence: Synthetic coding sequence
atgggaaaaggcaatgaagattcagatctgcactgttctagcattcagtgctctaccgaccagccaccattccagcagatttctttcactgagaaaggaagcgacgagaagaaaccgtttaaagagaaagggaaaacagctttctcgcacagctcagagaagcacatccagcggcaggggtctgaacctaatccaaacaaagaaaatagcgaagaaactaaactcaaagcaggaaattctacagccggtagcgaaccagagtcgtcaagctatcgggagaactgccggaagcggaagatgagctcaaaggatagttgtcaggataccgcaggcaattgccccgagaaggaatgtagcctatccttgaacaaaaagagtcgctcgagtaccgccgtacataatagcgaaatccaagaaacctgcgatgcccatcataggggtcacagtagagcctgcaccggccactcaaagcgtcaccggtcaagggctctgggcgttcaaacacccagcatacgcaagagcctggtgacatccgtcagggccatgagcgaggctgtataccaggatctggcccaggtatgggcacagcagatccacagtcccctgacatgcgaacaactgaccctgttgacccgcttgagaggccctctctgcgcacaggtgcagacgctgtatagtatggcgacccaggcagcgtacgtgtttccagccgaaagttggctcgtgcctgctacgctgcccggtcccggtgagagtgctctcgacagggaagcacacccattccctgggcaagagataacggagacagtgtccggctccgatgaagcgaagctttag

SEQ ID NO: 223715 - DNA, 984 bp, Artificial Sequence
  Description of Artificial Sequence: Synthetic coding sequence
atgggaagaacgagcaaagacaaacgcgacgtttactaccggctggccaaggaaaatggttggcgggctcgttccgcatttaagttgctgcaattggacaaggagttccagctgttccagggcgttactcgcgctgttgatttatgtgccgcacccggaagctggagccaggttctgagtcagaaaatagggggtcagggctccgggcacgtggtggcagtggatcttcaggctatggcaccgctgcctggagtggttcagatccaaggggacatcacccagctttccacagccaaagagatcattcagcactttaagggttgtcccgctgacctagtggtatgtgacggagcaccagatgtgacgggcctccacgacgttgacgagtatatgcaggcccaactgttgcttgccgcactgaacatcgctacacatgtgttgaagcccggtggctgcttcgtcgccaagatcttcagggggagggatgtcacactcctatattctcaattgcaagtgtttttctctagcgtgttatgtgctaagccacgaagtagccgaaacagttcaatcgaggcatttgcagtgtgtcagggatatgaccccccagaagggttcatcccggatctgtctaagccccttcttgatcactcctacgatttcaaccagctggatggtcccacacgaataatcgtcccatttgtaacttgtggagacctgagctcatacgactctgaccggtcctatccactggatctagaaggagggagcgaatacaagtacacaccacctacgcagcctcctataagtcctccttatcaggaggcatgcactctgaaacggaaaggacaattagcgaaggagataagacctcaggactgtccaatttcacgcgtcgatacctttccccaaccactcgccgctccccagtgtcatacactgctcgcccctgagatggaggataacgagatgtcctgctctccctag

SEQ ID NO: 223716 - DNA, 990 bp, Artificial Sequence
  Description of Artificial Sequence: Synthetic coding sequence
atgggccgaacgtccaaggacaagcgggacgtttactaccggctggctaaagagaacggttggagagcacgcagtgcctttaagctgctccagctcgacaaggagtttcagctcttccagggcgttacgcgtgctgtggacctttgtgccgctcccggaagctggtcgcaagtcctgtcccagaaaataggtggacagggttctggccatgtggtggccgtggatctccaggcaatggctccattgccgggtgtggtccagattcaaggcgacattacccaactatccacggctaaggaaatcattcagcattttaaaggctgcccggctgacctggtggtgtgcgatggagccccagacgtgactggcctacacgatgtggacgagtacatgcaggcacaactactgctggcagcactgaacattgcaacacacgttttgaaacccggaggctgctttgttgcaaagattttccgtggccgtgacgtgacccttctgtatagccaactgcaggttttcttttccagcgtgctttgcgctaaacccagatcatcccgcaatagctctatcgaagcctttgcagtctgtcaaggatatgacccaccagaaggctttattcccgacttgagtaagcctctgctggaccattcatacgacccagatttcaatcagctagacggaccaactagaattattgttccattcgtaacgtgcggcgatctgtctagctatgattccgacagaagttatcctctagacctcgaagggggttctgaatataagtataccccccctacccagccgccaattagtccgccttatcaggaagcctgcactctgaagcgaaagggtcagttggcgaaagaaatacgtcctcaagactgccctatctccagagttgatacctttccgcagccactcgctgctcctcaatgccacaccttgctagctcctgagatggaggacaacgagatgagctgttccccctag

SEQ ID NO: 223717 - DNA, 579 bp, Artificial Sequence
  Description of Artificial Sequence: Synthetic coding sequence
atggccttgaatattgcaactcacgtactgaaacctgggggttgtttcgtcgcaaagatcttccgaggtcgcgacgttaccctgctatactcgcagctgcaggtattcttcagtagtgtactatgtgcgaagccccgtagctcacggaactcatcaattgaggctttcgctgtttgtcaggggtatgaccccccagagggtttcatacctgacctgtctaagcccctgctcgaccactcctatgaccccgatttcaatcaactggacggacctactagaataatcgtgcccttcgtgacatgcggcgatctgtcttcctacgacagtgacaggagctatccccttgacttggagggaggaagcgaatataagtatactcctcccacccaaccccctataagcccaccataccaagaagcatgcactctcaagcggaagggacaactggctaaagagatacggccacaggattgtccaattagccgcgtcgacacatttcctcaaccccttgcagctccccagtgtcataccctgttggcgcctgagatggaggataacgaaatgagttgcagcccttag

SEQ ID NO: 223718 - DNA, 984 bp, Artificial Sequence
  Description of Artificial Sequence: Synthetic coding sequence
atggggcgtacttcaaaggataagcgcgatgtgtactatagactcgccaaagagaacgggtggcgtgctcgaagcgcattcaaactgctacagctggacaaggagttccagctcttccagggagtgaccagggcagtggacctgtgtgccgcacctggatcctggtcgcaagtcctttcccagaaaattgggggacaaggatctgggcacgtggtggccgtggacctgcaagcaatggcccctcttccaggagtagtgcagatccagggcgatattactcaactttctaccgcaaaggaaatcatacaacacttcaaagggtgccctgccgaccttgtggtatgtgatggtgctcccgatgtaacggggttacatgacgttgacgagtatatgcaagcccagttactccttgccgctttgaatatcgccactcacgtccttaagcctgggggatgctttgttgcgaagattttccgaggcagggacgtaacccttttgtactcacagctccaggtgtttttctcaagcgtattatgtgccaaacctagaagctctaggaattcttcaatagaagccttcgcagtgtgccagggatacgatcctcctgagggtttcataccggacttgtctaaaccacttctggatcactcttatgattttaaccaactggacggccctacgaggatcattgtgcctttcgttacatgcggggacctatcgtcatacgattccgataggagctatccactcgacctcgagggcggatctgaatataagtatacacctcccacccagcctccaatatcccccccatatcaagaagcttgcacactgaagagaaagggtcagctggcgaaggagatccgaccacaagattgtcctatctcacgtgtggacaccttcccgcagcccttggcggcacctcaatgccatactctccttgccccagagatggaagataacgaaatgagttgttccccttag

SEQ ID NO: 223719 - DNA, 741 bp, Artificial Sequence
  Description of Artificial Sequence: Synthetic coding sequence
atggctgggtacctgaagctcgtgtgcgtgagcttccagcggcagggattccacacggtcggctcaaggtgtaaaaataggacaggtgcggaacacctctggttgaccaggcacctgagggacccatttgtgaaagcagccaaggtggaatcctaccgttgcaggtcagccttcaaactactggaagtcaacgagcgccatcagattttgcggccaggtttacgagtcctggactgcggcgctgctcctggcgcttggagccaggtggcggtgcaaaaagtaaatgccgctggcacagaccctagttcaccagtcggatttgtactcggcgtggacctcctccatattttccccctagagggcgctaccttcctctgccccgcagacgtgacagatcctaggacgagccagagaatcctcgaagtattgcccggtaggagagccgacgtgatcctctccgacatggccccaaatgcaacagggttccgcgacctggatcatgacagacttattagcctatgtcttacactgctctcagtgactcccgacatcctccagcccggagggaccttcctgtgcaaaacctgggctggatcccagagcaggagacttcagagacgccttacggaggagtttcaaaatgtaaggattattaagcccgaagcaagtagaaaggaatcatcagaagtttacttcttggctactcagtatcacggtcgaaagggcaccgtgaaacagtag

SEQ ID NO: 223720 - DNA, 438 bp, Artificial Sequence
  Description of Artificial Sequence: Synthetic coding sequence
atggccggatacttaaagctcgtgtgtgtgtccttccagcgccaaggatttcatacagtggggtcccggtgtaaaaacagaaccggcgcagagcacctatggctgaccaggcacttgagggatccctttgtaaaagctgccaaggtcgaatcttatcgctgccgatccgcatttaagctgctcgaagtcaacgagaggcatcagatcctgcggcctggcctgcgagttctggactgcggagccgcacctggcgcatggagtcaagttgccgtccaaaaggttaatgccgctggcactgacggtgtatccctgctgcctaggttgcaatgtaatggcgtgatttctgcccattgtaacctatgcttgcctggcagcagcgactcacccgctagtgcaagccaaattccggcacttctgctggcatcttgcctcgggtag

SEQ ID NO: 223721 - DNA, 768 bp, Artificial Sequence
  Description of Artificial Sequence: Synthetic coding sequence
atgcctgagctttacgatttggtgaacagttacaaacccgatcttatttggtctgacggagagtgggagtgtcccgatacgtactggaacagcacgaacttcctatcttggctgtataacgacagccccgttaaagatgaagtcgtggtcaacgatcggtggggacagaactgctcctgccatcacggtggttattataactgcgaagataaatttaaaccacagagtctgcccgatcacaagtgggagatgtgcacatcaatcgacaagttcagttgggggtaccgcagggacatggccctgtctgacgtaacggaggaatccgaaattatctccgagctggtgcagaccgtctctctaggtgggaattatctgctgaacatcggacccacaaaggacgggctgattgtgccaatttttcaggagcgcctactggccgtcggcaagtggcttagcattaacggcgaagctatttatgccagcaaaccgtggagggtgcagtgggaaaagaacacaacatcagtttggtacacctcgaaaggttcagccgtttacgccattttcctgcattggcctgaaaatggcgtgcttaacctggagagtccgatcacaaccagtacaactaagataaccatgctgggcatacaaggtgaccttaagtggagcacagaccctgataaagggctgttcatcagcctgccacagcttcctccaagtgctgttccggcagaatttgcttggacgataaaactgaccggagtcaagtag

SEQ ID NO: 223722 - DNA, 1401 bp, Artificial Sequence
  Description of Artificial Sequence: Synthetic coding sequence
atgagagcaccaggcatgaggtcccgccctgccggacccgctctgctgcttttattactgttcctcggggcagctgaaagcgttcgacgcgcacagcctccaaggagatatacacccgattggccttccctagatagccgacccttaccagcgtggttcgacgaagcgaaattcggcgtgttcattcactggggtgtgttctccgtgccagcttggggctctgagtggttttggtggcattggcaaggagagggacggcctcagtaccaaagatttatgcgcgataattacccacccggattttcttatgctgacttcggtcctcagtttacagcccgtttttttcatcccgaggaatgggccgatttgttccaggccgcaggcgctaaatatgtcgttctgacgaccaagcatcacgagggattcacaaactggccgtcccccgtatcttggaattggaattcgaaagatgttgggcctcaccgcgatctggtgggcgaattgggaactgccctgcgaaagcgaaatatacggtacgggctataccacagcttgctggaatggttccaccctttgtatctcttggacaagaagaacggcttcaagactcaacactttgtgtcggctaagacgatgcctgaactgtacgacctggtgaacagttacaagccggatcttatatggtcagatggcgagtgggagtgtcctgatacctactggaattcgacaaattttctttcctggttgtacaatgacagtccggttaaggacgaagtggttgtaaatgatcggtgggggcagaactgcagctgccatcatgggggttactacaattgcgaagataagtttaagccacagagtctcccagaccataagtgggagatgtgcacaagtattgataaattttcttggggataccgcagggatatggccctttctgatgtgactgaggaatcagagattatctccgagcttgttcagaccgtctctttaggtggaaactacctgctcaatattggaccgactaaagacggactgatcgtaccgatcttccaagagcgtctcctcgctgtgggtaaatggctgagtataaacggtgaggcaatttacgcatctaaaccttggcgcgtccagtgggagaagaacacaacatctgtgtggtatacatccaaggggagtgctgtgtacgctatcttccttcactggcctgagaacggcgtgctgaatcttgagagccctatcaccacatctacgacaaagattactatgctggggattcaaggcgacctgaaatggagtacggacccagataaagggttgttcataagcttgccacaactgcccccttctgcagtcccagctgagttcgcctggacaattaagctgaccggggtgaagtag

SEQ ID NO: 223723 - DNA, 1404 bp, Artificial Sequence
  Description of Artificial Sequence: Synthetic coding sequence
atgcggccacaggagctgccgcgactggcgttccccctgctgcttctcctgctgttgctcctgccacccccaccctgccccgcacactctgcgactcgatttgaccctacatgggaatcccttgacgccaggcaactgccagcatggttcgatcaggcgaagtttggcattttcatccactggggcgtgtttagtgttcctagcttcggatcggagtggttctggtggtactggcaaaaagaaaagatcccaaagtacgtagagtttatgaaggataactaccctccgagttttaaatacgaggacttcggcccacttttcaccgcgaaatttttcaatgcaaatcagtgggccgacatcttccaggcttcaggagcgaagtacatcgtgctgaccagcaaacatcatgaaggattcaccctgtgggggagcgagtattcctggaattggaatgcaatcgacgaaggccctaaacgcgacatcgtgaaggaactggaggtagccatcaggaataggactgatctgcggtttggcctgtactattcccttttcgagtggtttcaccccttgtttctggaggacgagtcctcttctttccataaacgacagttcccagtttctaaaactctgccagaactgtacgagctggtgaacaactaccagcccgaggtgctttggtccgatggagatgggggagctcctgatcagtattggaacagcaccggattcctggcctggctatacaatgaaagtcccgtgcggggaactgtggtaacaaatgataggtggggagctggctcaatttgcaaacacggtggtttctacacatgtagcgatcgatataaccccggacatctgttgccccacaaatgggagaattgtatgactatcgataaactctcttgggggtatagacgggaggccggtattagtgattacctgacgatcgaggaactggtaaagcagctcgtggaaaccgtttcctgtggcggaaatctccttatgaatatcgggcctacactggatggcacaattagcgtggtgttcgaggaaaggctccgccaaatgggcagttggctgaaggttaacggtgaagccatatatgaaacccatacatggaggtctcagaatgacaccgttacacccgatgtgtggtatacgagcaagcccaaggagaagctggtgtatgcaatctttctgaagtggcctacctcaggtcagttgtttctcggacacccaaaagctatcctgggtgccaccgaggtgaagctgcttggccatggacagccgttgaattggatcagcttggaacaaaacggaattatggttgagcttccacaattgacaatccaccagatgccctgcaagtggggctgggcccttgccctgactaatgtcatatag

SEQ ID NO: 223724 - DNA, 498 bp, Artificial Sequence
  Description of Artificial Sequence: Synthetic coding sequence
atgaggccccaggagctgccgagactggcctttccccttctgctgctgctgctgttgctgttgccacctccaccctgtcccgcacactccgctactcgctttgaccctacgtgggagtcactggatgccaggcagttgcccgcatggttcgaccaggccaagttcgggatcttcatccattggggcgtttttagcgtgccatcctttggatccgaatggttctggtggtattggcagaaggagaaaattccaaaatacgtggagtttatgaaggataattatcctccgtcctttaagtacgaagattttggcccattgttcaccgccaagtttttcaacgcaaaccaatgggccgacatatttcaggcctcaggagccaaatatatagtgctaacctccaagcaccacgaagcaacttgcagagattctttcatgtggcgaaaaagcttcgacgaatattgggcacacacaaggtggcatcatttctgttcgttctag

SEQ ID NO: 223725 - DNA, 498 bp, Artificial Sequence
  Description of Artificial Sequence: Synthetic coding sequence
atgcgcccacaggaactcccacgcctcgccttcccgttgctcctactgctgctgctgctattgccaccccctccgtgcccagctcacagcgctacccgtttcgacccgacttgggaatcactggacgcgagacagttacccgcatggttcgaccaggccaagttcggtatcttcattcactggggcgtcttcagcgtcccgtcttttgggagcgagtggttctggtggtattggcagaaggagaagatcccaaagtatgtagaatttatgaaagataattatccacccagctttaaatacgaggatttcggcccactgttcactgcaaagtttttcaacgcgaaccagtgggcagatatctttcaagcctctggggctaaatatattgttctaacttcgaaacatcacgaagccacctgcagagactcctttatgtggagaaaaagtttcgacgagtactgggcacatacaagatggcatcacttctgcagtttctag

SEQ ID NO: 223726 - DNA, 330 bp, Artificial Sequence
  Description of Artificial Sequence: Synthetic coding sequence
caactggttgaaactgtgtcttgcgggggaaatcttttgatgaatattggccctactctggatggaacaattagtgttgtcttcgaggagcgcctgaggcagatgggcagctggcttaaagtaaacggagaagccatctatgaaacccacacatggcgatctcaaaatgacaccgtgacaccagatgtctggtatacgtctaaaccaaaggagaagctggtgtatgccatcttcctgaaatggccaactagcggccagttatttcttggacatcccaaagccattctgggggcaaccgaagttagaggcaacttcacgcttttcttatag

SEQ ID NO: 223727 - DNA, 1098 bp, Artificial Sequence
  Description of Artificial Sequence: Synthetic coding sequence
atgtggctgcgatctcaccgccagctctgcctggcatttctcttagtttgcgtattgtccgttatctttttcctacatattcaccaggacagcttcccccatggattgggcctctcaatcttgtgtcctgacagacgactggtcacgccacccgttgccatattttgcttacccggtaccgccatgggccctaatgccagctcgagctgccctcaacaccctgcctcattgagtggcacctggaccgtctaccccaatgggaggtttggcaatcagatgggacagtacgccactctcttggcactggcccagctcaatggcagaagggcgtttattttaccggcaatgcacgccgctctcgccccagtgttcagaataactctgccagtgctggccccagaagtcgattcccggacgccgtggcgcgaactgcagctgcacgactggatgtccgaagaatatgctgacctcagagatccctttctgaagctgtccgggttcccctgttcctggactttcttccaccacctgagggaacagattagacgagagtttacgcttcacgaccatctccgagaggaggcccagagtgttctgggccagctccgactgggacggacaggagacaggccccgtacttttgttggggttcacgtgagacgcggtgattacctccaggtcatgcctcaacgctggaaaggtgtggtcggagattcggcctatctgaggcaggccatggattggtttcgggcaaggcacgaggctcccgtgtttgtggtcacatcaaacggtatggaatggtgcaaggaaaacatcgacacgtcccagggagacgtgacatttgcaggtgatggtcaggaggccaccccctggaaggatttcgctctgcttacgcaatgtaaccacacaatcatgaccattggtactttcggcttctgggctgcatacctggcaggcggtgacacggtctacctggccaactttaccctgcccgattcagaatttctcaaaatcttcaagcccgaagctgcttttctgcccgagtgggtcggaatcaacgctgatctgtctcccctgtggacactcgccaaaccatag

SEQ ID NO: 223728 - DNA, 1068 bp, Artificial Sequence
  Description of Artificial Sequence: Synthetic coding sequence
atgtggctgcgtagtcaccggcagctgtgcctggccttcctccttgtttgtgtgctgtctgttatattttttcttcacattcatcaggactcctttccacacgggctgggcctgagtatactttgtcccgatagacggctagtcactccccctgtggctatcttttgcctccctggtacggctatgggcccaaacgcctcttcaagctgcccccagcaccctgccagcttgagcgggacatggactgtgtatcccaatgggaggtttggaaaccagatgggacagtacgccaccttacttgcacttgcacaactgaacggcagacgagcttttatcctgccggctatgcatgctgccctggcaccccctgaggtggactcgcgaacgccttggcgtgaactgcagctccatgactggatgtcagaagagtatgccgacctgcgggacccatttctgaaattaagtggcttcccctgttcttggactttctttcaccatctgcgcgaacagatccgacgtgagtttacacttcacgaccacctgcgggaggaggcccagtcagttctgggacagctgcggctcgggagaaccggcgaccgcccaagaacctttgtcggggtccatgttaggcggggagactatctgcaggtgatgccccagaggtggaaaggggtggtgggcgattcagcctacctgaggcaagccatggattggtttcgtgcccgtcacgaagcacctgtcttcgtggtaacttccaacgggatggaatggtgcaaggagaacatcgacacatcacagggggatgtgactttcgctggcgacggacaggaagcgacaccctggaaagattttgcgttgctgacacaatgcaatcataccatcatgacaatcggcaccttcgggttttgggctgcttacctcgctggtggggataccgtgtatcttgccaactttacacttcccgactccgaatttctgaagatttttaaacctgaggccgcattcctgcctgagtgggtgggaatcaacgcagacctgtctcccctgtggacactcgccaaaccttag

SEQ ID NO: 223729 - DNA, 1032 bp, Artificial Sequence
  Description of Artificial Sequence: Synthetic coding sequence
atgctcgtagtgcagatgccttttagctttcccatggctcactttattctttttgtttttaccgtgagcacgatttttcacgttcagcaacgcttggcaaaaattcaggccatgtgggagctccctgtgcagattccagtcctggcctccacctcaaaagcactgggcccttcccagctgcgtgggatgtggacgatcaatgccatcgggcgactgggcaaccagatgggcgagtacgcaactttgtatgcactggccaagatgaacggccgaccagcctttatacctgcccagatgcattccactttagcccctatatttcggatcactctgccagtactacacagcgctaccgcgagccgtattccttggcaaaattaccacttgaacgactggatggaggaagagtacaggcacattccaggtgaatatgtcaggttcaccgggtatccctgtagctggactttttaccaccacctgcgtcaggagattctgcaggaattcaccctgcatgaccacgtgagagaggaggctcagaaattcttgcggggtttgcaggtaaacggctccaggccaggcaccttcgttggagtgcacgtccgcaggggcgactacgtgcacgttatgcctaaggtgtggaagggggtggttgccgatagaaggtacctccagcaggccctggactggttccgcgctagatactcttctctgatcttcgtcgtcacatccaatggaatggcgtggtgtcgcgagaacatagacactagccatggggatgttgtcttcgcgggagacggtatagagggcagtcccgctaaggattttgccctcctcacccagtgcaaccacacaatcatgactataggaactttcggcatttgggcagcatacttaacgggaggcgatacgatctacctggccaactatactctcccggactcccctttcctcaaaatcttcaagcctgaggctgcgttccttcccgagtggaccggtattgccgcagatttgtctccacttctaaaacactag

SEQ ID NO: 223730 - DNA, 1032 bp, Artificial Sequence
  Description of Artificial Sequence: Synthetic coding sequence
atgcttgtggtacaaatgcctttctcattccctatggcacactttatcctgtttgtgtttaccgtatccacaatatttcacgtgcagcagcggttggccaagatacaggccatgtgggagctgcccgtacaaattcctgtgctggcgagtacctcaaaagctctgggtccctcccagctccgaggcatgtggacaatcaatgcaataggtcgcctgggaaatcagatgggtgaatacgcgacactctacgctttagccaaaatgaacggaaggcctgcctttattccagctcagatgcattcaaccctggccccaattttcagaatcaccttaccagtgcttcattctgctactgcctcccgaatcccatggcagaactaccatctgaatgactggatggaggaggaatacagacacattccaggcgaatacgtgcggttcactgggtacccttgttcatggacattttaccatcacctcagacaagagatactgcaggaatttactctgcacgaccatgtgcgggaggaagcccagaagttcctcagaggacttcaggtcaatggatcaaggcccggtacattcgtgggtgttcacgtcaggcggggagactatgtgcacgtaatgccgaaagtttggaagggtgttgtggcggatcgtcgatatttgcagcaagcattggattggtttagggctcgatactcatcactgattttcgtagtaacatctaacggtatggcttggtgccgcgagaatatagacaccagtcacggcgacgttgtgtttgccggtgatggcatagaaggatcccctgccaaggatttcgccctcctgactcagtgcaatcataccataatgaccatcggaacttttgggatatgggccgcataccttactggaggcgatactatctaccttgcgaattacaccttgcctgatagccccttcctgaaaatattcaagcctgaggctgcatttctgcctgaatggactggaatcgctgcggatctgtctccgctcttgaagcactag

SEQ ID NO: 223731 - DNA, 663 bp, Artificial Sequence
  Description of Artificial Sequence: Synthetic coding sequence
atgttggtcgtgcagatgcccttctcttttccgatggcccactttatccttttcgtattcactgtgtccaccatttttcacgttcagcagcgccttgcgaagattcaggccatgtgggaattgccagttcagatccctgttcttgccagcacctctaaggcactgggaccatcacaactgaggggaatgtggactatcaatgcaattggaagactggggaaccagatgggtgagtacgcaactctttatgcattagcaaagatgaatggcaggcctgcttttatacctgcacaaatgcactctaccctggcacccatcttccggattaccctcccagtcctgcacagcgccacggcgtcgagaattccatggcagaactaccacctcaatgactggatggaggaggagtatagacatattccaggcgagtacgtgagatttactgggtatccatgtagctggactttctatcatcatctcagacaggaaatactccaagagttcaccctgcatgatcatgttcgtgaagaggcccagaagttccttagagggcttcaggtcaatggaagcagaccgggaacatttgtgggcgtgcacgtgcggagaggcgactatgtgcacgtgatgcccaaggtttggaaaggcgtggtggcagaccggtag

SEQ ID NO: 223732 - DNA, 1086 bp, Artificial Sequence
  Description of Artificial Sequence: Synthetic coding sequence
atggaccccctaggggctgccaagccacagtggccttggagaaggtgtctggccgcactcttattccaactactagtggccgtgtgtttcttttcttacttgagggtgagccgggatgatgcaaccggttctcccagggctcccagcggatcctctcggcaggacaccacgccaactagacctacactgttgattctattacgcacctggcctttccatattccagtggctctgtctcgctgctccgaaatggtcccgggaacagctgactgccacatcacagcggatagaaaggtttatccacaggcggatatggtgatcgtccatcactgggacataatgtccaatccaaaaagccgtctcccacccagtcccagaccccagggccagaggtggatctggtttaacttggaaccaccgccaaattgccagcacctggaagccctggaccgttacttcaatctcaccatgagctatcgaagcgattctgatattttcacaccgtacgggtggctggaaccatggagcggacagccggctcacccaccactcaacctgagtgctaaaactgaactggtagcttgggccgtgagcaattggaagccagacagcgccagagtacgatattaccaatccctgcaggcacacctcaaagtggatgtgtatggtagaagtcacaagccgttacccaagggaactatgatggaaaccctgtctagatacaagttctatcttgctttcgagaactcactccacccggactatatcacagaaaagctctggcggaacgccctcgaagcctgggcggtgccggtagtgctcggaccctcgcgctccaactatgagcgattcttgccacccgatgccttcatccacgtggatgacttccagtcccctaaggatctggcaaggtatctccaggaattggataaagaccacgctagatatttatcttacttccggtggcgtgaaaccctacgtccccgaagttttagctgggccctcgacttttgtaaggcttgctggaaattacagcaagagtctagatatcaaaccgtgcgctctatagccgcatggttcacttag

SEQ ID NO: 223733 - DNA, 1086 bp, Artificial Sequence
  Description of Artificial Sequence: Synthetic coding sequence
atggatcctctgggagctgctaagccacagtggccgtggcgacgttgtctagcggctttactgttccaactcctggtcgctgtctgtttctttagttatctgcgagtgtctcgagacgacgcaacaggaagccctcgggctccgtccgggagcagtcgacaggatacgacccccacaagacctaccctcctcattctcttacggacctggcccttccacatccccgttgctctgtcacggtgctccgagatggtgcctgggaccgccgattgtcatataaccgcagaccggaaggtgtaccctcaggcagatatggttatcgtacaccactgggatattatgtcaaatcctaagagcagattgccaccctcccctcgtccgcaagggcaaagatggatatggtttaacctggaaccaccaccgaattgccagcatctggaggctttagacaggtatttcaacttaactatgagctacaggtcagactctgacatctttaccccctacggatggcttgagccgtggtcaggccagcctgcgcaccccccactcaatctctcagcgaagacagagctggtcgcttgggctgtgtcaaactggaagcctgactccgcaagagtgcggtactaccagtccctgcaagcccatcttaaggtggatgtctatgggagatctcacaaaccactccccaagggaaccatgatggagacactctccagatataagttttatctcgcatttgagaatagtctgcaccctgattacatcacggagaaactgtggcgcaacgcactggaggcctgggccgtccccgtggtgttgggcccatctcgttctaactacgagcggttcctaccacctgacgccttcattcatgtggacgatttccagtctccgaaggaccttgcccgatatctgcaagaactcgataaggaccacgccagatacctcagttattttagatggcgcgaaactctgaggcccagatcatttagctgggccttagacttttgtaaggcgtgttggaaactgcaacaggagagtcgctaccagacggtgcggtcaattgccgcatggttcacctag

SEQ ID NO: 223734 - DNA, 1086 bp, Artificial Sequence
  Description of Artificial Sequence: Synthetic coding sequence
atggatcccctgggggctgcaaagccacagtggccatggcgccgatgcctagccgcactcctgttccagctgttagtagcggtgtgcttcttcagctacttaagagtgtctagagacgatgccaccggctctcctcgtgccccaagtggctcgtcccggcaggacacaacacccacccggccaacgcttttgattttactcagaacttggccattccacatcccagtggctttgagtagatgcagcgagatggtgcccggaaccgccgattgccatataactgcggataggaaggtatatccccaagccgacatggtgattgttcatcactgggacataatgtcaaaccctaaatctaggctgccgccaagcccccgaccacagggccaacgctggatatggttcaatctggaacccccacccaactgccaacatctggaagccctggacaggtactttaacttgacaatgtcgtaccgaagtgacagcgacattttcacaccatacgggtggctcgaaccttggtcaggtcaacctgcccacccccctctgaacctttctgcgaaaactgaactagtggcctgggccgtgtcaaattggaaacccgattccgcacgtgtgcggtactaccagtcacttcaggcgcatctcaaggttgatgtttacggcaggtcacataagccactccctaagggaactatgatggaaactctatcccgctacaaattttacctggcttttgaaaattccctccacccggactacataaccgagaaactttggcgcaacgctttggaggcatgggccgttcccgtggtgttgggtccctctcgcagcaactacgagaggtttctgcctccagacgcctttatacacgtcgatgactttcaatccccaaaagatctggcgaggtatttgcaggagttggacaaggaccacgctaggtatctgagttatttcagatggagggaaactcttagacctaggtcgttctcatgggccctggacttttgcaaagcttgctggaagttgcagcaggaatctaggtaccaaaccgtccggagtattgctgcatggttcacttag

SEQ ID NO: 223735 - DNA, 1086 bp, Artificial Sequence
  Description of Artificial Sequence: Synthetic coding sequence
atggatcccttaggtgctgccaaacctcagtggccatggagaagatgcctggcagccctgctcttccagttgctagtggctgtatgctttttttcttacctgcgagtgtcaagggatgacgcaacaggaagtcctagagcaccttctggctcgtcacgtcaagatactacaccaacccgccctactcttctgattctcctgcgcacgtggccgtttcacataccggttgctttatctagatgctccgaaatggttcccggaacagctgattgccatataacagctgataggaaagtctatccacaggccgatatggtcattgtccaccactgggatattatgtctaaccccaaatctcggctccccccttcaccaagacctcaagggcagcgctggatatggttcaaccttgaaccaccaccgaattgtcagcacctggaagctctagataggtacttcaacctcacaatgagttacagatctgattcagacattttcaccccgtatggttggctcgagccctggtcaggccagcccgcacatcctccgctgaatctgagcgcaaaaacggagctcgtggcttgggccgtttcaaattggaagccagacagtgcccgtgtcagatactatcaatcactgcaagcccacctgaaagtagacgtctacggcaggagtcataaacccctaccgaagggcactatgatggagaccctgtccaggtacaaattttatctggcgttcgaaaattcattgcaccccgactatatcactgaaaagttatggagaaacgccctcgaggcctgggctgttcccgttgtgctgggaccgtcacgctccaattacgagcgcttcctgcccccagatgcattcatccatgtcgatgattttcaatctcccaaggatctcgcaagatacctgcaggagctcgataaggaccacgccagatatctttcttattttcgctggagagaaaccctgcgtccaaggtcattctcctgggccctcgatttttgtaaggcatgctggaagttacagcaggaaagcaggtaccagacagtacggtcaattgcagcctggttcacctag

SEQ ID NO: 223736 - DNA, 1593 bp, Artificial Sequence
  Description of Artificial Sequence: Synthetic coding sequence
atgaggagactctggggggctgctagaaaaccctcaggtgccggatgggagaaggagtgggccgaagcacctcaagaagcgcctggcgcttggtctggaagactaggcccaggaagatcagggagaaaaggaagagctgtcccagggtgggcttcctggcccgctcacctcgctctggcagctcgtcccgctcgacacctcggaggggctggacaggggccaaggcccttgcactctggcacagctccattccactctcgggcaagcggcgagcgccagcgaagactggagccccaactgcagcatgagtcccggtgccgatcttccactccggcagacgcttggcgcgcagaagctgcgcttccggtcagagcgatgggggctccctggggtagccctactgctgcagcgggagggagacggggatggcggaggggccgtggtctcccatggactgtgtgtgtcctggctgctgctggcttaacatgcacagccctgataacatatgcttgttgggggcaacttcctcctctgccttgggcctctcccacaccctcgaggcctgtcggtgtcttgctatggtgggaacctttcggaggcagggacagcgcacctcgaccgcctcccgattgccgtctgaggttcaacatttccggatgtaggctgttgactgaccgtgcctcttacggagaggcccaggccgttttgtttcaccaccgggacctcgtgaaggggcctccagattggccacctccctgggggattcaggcgcacaccgcagaagaagtggacctgcgggtactcgattatgaagaagccgctgccgcagccgaggcactcgccacctcaagcccaaggccaccgggtcagcggtgggtttggatgaactttgagtctccctcccactcgccaggactacgctcactcgcctctaacctgtttaactggacgctgtcttatagagccgactccgacgtctttgtcccctacggctatctctacccgagatctcatccaggagaccccccatccggactggcacctcctttgtctcggaaacaggggttagtcgcctgggtggtgtctcattgggatgagagacaagcgagggtccgctactatcaccaactgtcgcagcatgtgacagtggacgtgtttggtcggggaggtccagggcaacctgtacccgagataggcctgctgcacacagttgccaggtacaaattctatctggcttttgagaattcacagcatctcgactacattaccgagaagttgtggcgcaatgccttgctggctggagctgtgcccgtggtcttaggtccagatagagcgaactacgaaagattcgtacctcgaggtgcctttattcacgtcgatgattttcctagtgcttcctcactggcgtcatacctattgtttctggaccgtaacccggctgtctataggcgctactttcactggcggcgtagctatgcagtccacataactagtttctgggacgagccatggtgtagagtgtgccaagcggtccagcgcgctggtgaccgcccaaaatccattaggaacctggccagctggtttgagcggtag

SEQ ID NO: 223737 - DNA, 1125 bp, Artificial Sequence
  Description of Artificial Sequence: Synthetic coding sequence
atggacccccttggacctgccaaaccccagtggctgtggcgtcggtgccttgcaggcctcttgttccagctgctagtcgctgtgtgcttcttcagctacctgagggtcagccgagacgacgccaccggcagtccccgaccagggctgatggctgtggaacccgtgaccggtgcacccaatgggtcaagatgtcaggattcaatggccactccagcacaccctacactgttgattctcctatggacatggccatttaacacgcccgtggccctaccccgatgtagtgagatggtgccaggggcagcagattgtaacattactgccgatagctccgtctatccccaagccgacgccgttattgtccaccactgggatatcatgtataaccctagcgcaaacttgccaccccctactaggccacaagggcagcggtggatttggttcagcatggaaagcccatcaaactgccgacacttagaggccctggacggctacttcaatctgactatgagttatagaagcgactcagatatatttactccttacgggtggctggaaccatggtcaggccaaccggctcatcccccattgaatcttagcgctaagacggagttagtagcctgggctgtgagcaactggaagccagactccgctagagtgaggtactaccaatcattacaggctcatctgaaggtggatgtgtatggacgcagtcacaagccacttccaaaggggactatgatggaaactttgtctagatacaagttctacctggcctttgaaaattctctgcatcctgactacatcaccgaaaaactctggcgaaatgcccttgaggcatgggccgtcccggtggtactaggtccatctcgatctaattatgaacggttcctgccgcctgacgctttcatccacgtggacgatttccaaagccccaaggatcttgccagatatctccaagagcttgataaagatcacgcacgctacttaagttacttccactggagggaaacactgagacctcgctcttttagctgggcgcttgcattctgcaaggcgtgttggaagctgcagcaagaatctcgctatcagactgttcgcagcatagcggcatggtttacctag

SEQ ID NO: 223738 - DNA, 1125 bp, Artificial Sequence
  Description of Artificial Sequence: Synthetic coding sequence
atggaccctcttgggccagctaaaccccagtggctgtggagaagatgcctcgcagggctcctgttccaattgctggtcgcggtttgttttttcagctacttgcgcgtcagccgggatgacgccactggtagcccaagacccggactaatggctgtagagcccgtgaccggcgcaccgaacggtagccggtgccaggacagtatggcaacacctgcacatccaaccctgctcatcttactgtggacctggccctttaatacccctgttgccctccccaggtgcagcgagatggtcccaggtgccgctgactgtaacataactgccgacagctccgtgtatcctcaggccgatgccgtcatcgtccaccactgggacataatgtataatccgtctgctaaccttcccccacccacacgcccacaagggcagcgctggatctggttcagtatggagagcccgagcaattgccggcacctggaagccctggacggctattttaatctaactatgtcataccgttctgatagcgacatctttaccccctacggctggctcgagccatggtctggccaacctgcccacccccctttgaacttgtccgcaaagacagaactggttgcatgggcagtttcaaattggaagcctgacagtgcacgcgttcggtattatcagtcactccaggctcacctcaaggttgacgtttacggaagatcacacaagcctcttccaaaggggacaatgatggagacgctttccagatataagttctatttggccttcgaaaacagccttcaccccgattacatcacggagaagttatggagaaatgccctggaggcttgggctgtgccggtggtcctcggtccttctcgtagtaactacgagcggttcctccctccagatgctttcatccatgtggacgactttcaaagccccaaagatctagctaggtacctacaggaactggacaaagaccacgcacgctatctctcctattttcactggagagaaactctgcggcctagatctttcagttgggccctcgcattttgtaaagcctgttggaaactgcagcaggagagccggtatcagaccgtgaggtccatcgccgcttggttcacatag

SEQ ID NO: 223739 - DNA, 1080 bp, Artificial Sequence
  Description of Artificial Sequence: Synthetic coding sequence
atggaccccctggggccagccaaaccccaatggtcctggagatgttgtctcacaacactgctgttccaactgctgatggccgtgtgttttttctcatatctccgtgtgtcacaagacgatcccacagtataccctaatggaagtcgtttcccagactccacaggtacccccgctcactcaatccccctgattttgctgtggacctggccattcaataagcccatcgcgctgccacgatgctctgagatggtgccaggcacggcagactgcaatatcacagctgacagaaaagtgtacccacaggccgacgcagtgatagtccatcacagggaggtgatgtacaacccctcagcacagctgcctagatccccccgacgccagggccagcgttggatctggttttccatggagtctccctcgcattgttggcagctgaaagcaatggatggctattttaacctaaccatgagttataggtctgattctgacatcttcacgccgtatggatggctggaaccttggtcaggacaaccagcacaccctccgttgaatctgagcgcgaaaaccgaattagtggcttgggccgtgtcgaactggggcccaaacagcgccagggtaagatattatcagtccctgcaggcccacctgaaggtcgatgtctatgggagatcccacaaacccctcccccagggtaccatgatggaaactttaagtaggtacaaattctatcttgcttttgagaactccctccatcccgactatattactgaaaagctgtggagaaacgcgctcgaagcctgggcggtgcctgtggtgctggggccaagtcggagcaattacgaacgttttctgcccccagacgcttttatccatgtcgacgactttcagtctccgaaggatctagcacggtacctccaggagctcgacaaggatcatgcgaggtacttatcctatttccgctggcgcgagactctcagaccccgaagtttttcctgggcattggcgttctgcaaggcctgctggaagctccaggaagagtctcgttaccagaccagaggcattgccgcatggttcacctag

SEQ ID NO: 223740 - DNA, 1080 bp, Artificial Sequence
  Description of Artificial Sequence: Synthetic coding sequence
atggatccccttgggcctgctaaaccccagtggagttggaggtgttgcttaacaacactgctttttcaactgctcatggctgtttgcttcttctcatacctgcgggtctctcaggacgaccctactgtttatccaaacggtagccgatttcccgactccacaggtacgcccgcacacagcattcccctgatactgctgtggacgtggccctttaacaaacctatagccctgcctaggtgtagtgaaatggtcccaggcaccgctgactgtaacatcacggcggatagaaaggtctatccgcaggccgatgcagtgatagttcaccaccgcgaggtaatgtacaatccatccgcccagctccccagatcaccacgaaggcagggccagagatggatttggtttagcatggaaagcccgtctcattgttggcagctaaaggctatggatggatactttaaccttactatgtcctaccggagcgactctgatatttttacaccctacggttggctggagccctggagtgggcagcctgcccacccaccactgaatttgagcgccaagacagaactagtggcctgggcggtctccaactgggggccaaattccgctagagttaggtactaccaatctctgcaggcacatctgaaagtcgatgtgtatggtcggtcacacaagccattgccacaagggaccatgatggagaccctgagccgatacaagttttatctggcttttgagaattctctgcacccggactatattaccgagaaattgtggaggaatgcactggaagcctgggctgtccctgtggtcctgggaccctcacggtccaattacgagcgcttcctccctccggatgcattcattcatgtggatgactttcagagtcccaaggatctcgccagatacttgcaagaactggacaaggatcacgctaggtacctatcatatttccgctggcgcgagacacttcggcctaggagtttctcttgggccttggccttctgtaaggcttgctggaaactgcaagaggagagcagatatcagactcgtgggattgccgcttggttcacatag

SEQ ID NO: 223741 - DNA, 1098 bp, Artificial Sequence
  Description of Artificial Sequence: Synthetic coding sequence
atggatccactgggcccagcaaagccacagtggtcttggcgctgttgccttacaactttgttatttcaacttctgatggccgtgtgtttctttagctatcttagagtgagccaggatgatccaaccgtatatccaaacggctctaggtttccagatagcacaggcacaccggctcacagcatccctttgattttgctgtggacatggcccttcaataagccaatagcgttaccacgctgtagtgaaatggtcccaggaaccgcggattgtaatatcacggccgatagaaaggtctatccccaggctgatgccgttatcgtgcaccatcgcgaggtcatgtacaatccctctgcccaactgccacgaagtccaagaagacagggtcagagatggatttggtttagcatggaatcacctagccactgctggcagctgaaagcaatggatggctactttaatcttactatgtcttatcggtcggacagcgacatattcactccgtacggatggctggagccatggagtggtcagccagcccaccctccactcaatctgtcagccaagacggaactcgtcgcctgggcagtgagcaattggggtccaaactcggctagggttcgctactatcaaagccttcaagctcacctgaaagtggatgtttacggcagatcacataagcctctgcctcaaggaaccatgatggagaccctgtccaggtacaagttctatctggcgtttgagaactcactccatcccgattacataactgagaaactttggcgaaacgcgttggaggcctgggccgtgcctgtagtccttgggccttcccgctctaattacgaacgctttctacctcccgacgcctttattcatgtagatgacttccagtcccctaaagatctggcacgctatctccaggagctggataaagatcacgcaagatatctaagttatttcagatggagagagaccctgagaccgaggagctttagctgggccctggctttctgtaaggcttgctggaaattgcaggaggagagtaggagtgggggacttatatatttgcgtaccaggttgcctgaagcaagcccagcatag

SEQ ID NO: 223742 - DNA, 1080 bp, Artificial Sequence
  Description of Artificial Sequence: Synthetic coding sequence
atggatcctttagggcctgccaaaccccaatggtcttggcgttgttgtctgaccaccctgctttttcaacttttgatggccgtgtgctttttttcgtacttacgcgtgagtcaagatgatccgacagtttaccccaacggttcgaggtttccagactctacagggacaccggcacacagcatacccttaattctgctctggacctggccctttaataagccaatcgcgctgcctcggtgcagtgagatggtgccaggcactgctgactgtaatataacagccgacaggaaagtttacccccaggccgatgctgtgatagtccatcaccgggaggtgatgtacaacccctccgctcagctccccagaagccctcgacgacagggtcagcgttggatatggttttccatggaatcaccttctcattgttggcagcttaaggccatggacggttactttaacctaacaatgtcctacaggagtgatagtgatatcttcaccccctacggatggctggagccatggagtgggcaacccgcacatccgcctctgaatctcagcgcaaaaactgagctggtggcatgggccgttagcaattggggacctaacagcgccagggtgaggtattaccaatccctccaggctcacctcaaagtggatgtttacggccgttcccataagcctctcccccaagggaccatgatggagactctaagccggtataagttttatctggcttttgagaattcgctgcacccggactacattacagagaagctgtggcggaacgccctggaagcttgggctgtgcctgtggtcctcggcccttctaggtcgaactatgagaggtttcttcccccagatgcattcatccatgtcgacgacttccaatcgcctaaggatctggccaggtacctgcaagagctagataaggaccacgctagatatttgtcctactttcggtggagggaaacactccggccacgctcattctcgtgggctctggctttttgtaaagcatgttggaaattacaggaagagtcccgataccaaactcggggaatagctgcatggttcacctag

SEQ ID NO: 223743 - DNA, 1080 bp, Artificial Sequence
  Description of Artificial Sequence: Synthetic coding sequence
atggaccccctcggtccggctaaaccacaatggtcgtggcgatgttgtctgactaccctcctctttcagctgcttatggcagtgtgtttcttttcttacctcagggtcagtcaggacgatcctacggtatacccaaatgggtcccgtttccctgactccactggtacccctgctcactcaatccctctgatcctgctctggacctggcctttcaacaaacctattgctttgccaaggtgctcggagatggtgcctgggaccgccgactgcaatatcacggccgatcggaaggtatatccacaggccgatgccgttattgtacaccacagagaggtgatgtacaacccatctgcacagctcccgcgtagccctcggcgacagggccagcgctggatctggttttcaatggaatctccctctcactgctggcaactgaaggcaatggatggatatttcaacttaacaatgagctatcgctctgattccgatatctttacaccttatggttggttggaaccgtggtctgggcagccagcgcaccctccccttaacctaagcgcaaagactgaactggtggcctgggcagtctcaaactggggcccaaactccgctcgcgtgaggtattatcagtctctgcaggcacatctcaaggtcgacgtgtacggcagatcacacaagccactgcctcagggcacaatgatggagactttatctcgttataaattctatctggcctttgaaaactccctgcatcctgattatattacagaaaaattgtggcgaaatgcattagaggcctgggcagtgcctgtcgtattaggcccatccaggagcaactatgaaaggttcttaccacccgacgccttcatccacgtagatgactttcagtcgccaaaagatctggcccgttacctccaagagttagataaggatcacgctcgctacctgtcctattttagatggcgagaaaccctcagacccagatcctttagttgggccttggcgttctgtaaagcatgttggaagctgcaggaggaaagtcggtaccagacccggggaatagcggcatggttcacttag

SEQ ID NO: 223744 - DNA, 93 bp, Artificial Sequence
  Description of Artificial Sequence: Synthetic coding sequence
atggatccgctcggacctgccaaacctcagtggtcttggcgctgctgtctgactactctgctatttcagctgctcatggctgtttgtttttag

SEQ ID NO: 223745 - DNA, 414 bp, Artificial Sequence
  Description of Artificial Sequence: Synthetic coding sequence
atggatcctctcgggccagccaaaccacagtggtcatggagatgctgtctcactactttactgtttcagttattaatggcagtgtgcttttttagttatcttcgcgtctctcaggacgatccgacagtatacccaaacggttcccgctttcccgacagcaccggtactccggcacactccatccccctaatccttctctggacgtggcccttcaataagcccattgcgctgcccaggtgctcagagatggtgcccggaaccgccgactgtaatatcactgcagataggaaagtatatccccaagctgatgctgtgattgtgcaccatagggaggtgatgtataatccttctgcgcagcttccgaggtctcccagaagacaggggcagaggtggatttggtttagcatggaatag

SEQ ID NO: 223746 - DNA, 210 bp, Artificial Sequence
  Description of Artificial Sequence: Synthetic coding sequence
atggatccgctcggaccagccaagccccaatggagttggaggtgctgtctcactacacttctgttccagctgctgatggccgtctgctttttctcctaccttagagtgtcccaggatgacccgaccgtatacccgaacgggtcgaggttccccgacagtacggggactcccgctcacagcattccactcatcctgctttggacatggtag

SEQ ID NO: 223747 - DNA, 201 bp, Artificial Sequence
  Description of Artificial Sequence: Synthetic coding sequence
atggatccgttaggaccagctaaaccacagtggagctggcgttgctgcctcaccactctactattccagttgcttatggccgtgtgcttcttttcctacctccgggtgtcacaggacgaccccactgtgtatcctaatgggtctcggtttccggactccacaggcacccccgctcattcaattccactaatcctgctttag

SEQ ID NO: 223748 - DNA, 138 bp, Artificial Sequence
  Description of Artificial Sequence: Synthetic coding sequence
atggatcccctaggtcctgcgaagccacaatggagttggaggtgctgtctaaccacactgctgttccagctgctgatggccgtatgttttttttcgtacttgagagtcagtcaggatgaccctaccgtgtatccttag

SEQ ID NO: 223749 - DNA, 1029 bp, Artificial Sequence
  Description of Artificial Sequence: Synthetic coding sequence
atgaataatgcaggtcacgggccaacccgtcgcttgagaggactcggggttctggccggagtcgccctgctggctgctctctggctgctgtggctgcttgggtcagcacctcgcggtacccctgcaccgcagcctacaatcactatcctcgtttggcattggcccttcactgatcagccccctgaactgcccagcgacacctgcacacgctatggaatagcacgatgccacctgtcagccaaccgttctttgttagcttccgctgatgccgtggtgttccaccacagagagttgcagacgagacgctcccatttgccgctcgctcagaggcctcggggacagccatgggtctgggccagtatggagtccccctctcacacacacggtctttctcacctgcgaggcatatttaactgggtgttatcttatcgacgtgactccgacatcttcgtgccatacggacgcctggaaccgcactggggaccgagtccccctttgccagcaaaatccagagtcgccgcatgggtcgtctcaaacttccaggagcgccaactacgggcacgcttgtaccgccaactcgccccacatctgcgcgtggacgtcttcggcagggctaatgggcgtcccctatgcgcctcttgcctagtgcccacagtagctcaataccgattctatctttccttcgaaaacagtcagcacagggactatattactgagaaattctggcggaacgccttggttgccggaaccgtgccagtggtgctgggtcctcccagggccacttatgaggccttcgtgcccgctgacgctttcgtgcatgtggatgatttcggcagcgccagggagctcgccgcattcctgacgggcatgaacgagtcgcgctaccaacgctttttcgcctggcgcgaccggctccgcgtgaggcttttcactgactggagggaaaggttttgcgcaatatgcgaccggtatccacacctgcctaggtctcaggtgtatgaggacctggaaggctggtttcaggcctag

SEQ ID NO: 223750 - DNA, 1728 bp, Artificial Sequence
  Description of Artificial Sequence: Synthetic coding sequence
atgaggccatggacaggcagttggcgctggatcatgttaattctatttgcatggggcaccctgttgttctatattggcggacacctcgttcgtgacaacgatcaccccgaccattccagtagggaactgagtaagatactggccaagctggaacgcctgaaacagcagaatgaggaccttcggagaatggcagagagtctgaggatccccgagggcccaattgatcagggtcctgccatagggcgagtccgtgtgctggaggagcaactggtgaaagctaaggagcagattgagaactacaagaagcaaaccagaaatggattagggaaggaccatgaaatccttagaagacgcatcgaaaatggggcaaaagagttatggtttttcttgcagtctgagttgaaaaaattaaagaatcttgaaggaaatgaacttcaaagacacgcagacgagtttctactggatttggggcatcacgaacggagcatcatgaccgacctgtattacctttctcagaccgatggcgctggcgattggcgggagaaggaggctaaggatctgacggaattggtgcagcggagaatcacgtatttacagaaccccaaggactgctctaaggccaagaagttagtttgtaacatcaataaagggtgcggatacggatgccagctacaccacgtcgtgtactgctttatgattgcatacggaacacagcgaacgctcatcctggagtcacagaactggcgatacgcgaccggagggtgggaaaccgtatttcggccagtcagcgagacttgcactgatcgctcaggtatttccactggacactggtcaggggaggttaaggacaaaaacgtccaggtcgtcgaactgcctatcgtcgacagcctgcatcctaggcccccatatctgccactcgccgttcccgaagacctggctgacaggttggtacgtgtgcacggagaccctgccgtctggtgggtaagccaattcgtcaagtatctgatcagacctcagccatggctcgagaaggagattgaagaggcaaccaaaaagttgggcttcaaacaccccgtaattggggtccatgtccgaaggaccgataaggtgggaacagaagccgcattccatccaattgaagagtacatggtgcacgtcgaagaacactttcagctgctggcccgtagaatgcaggtcgataagaaaagagtgtatctggctaccgacgatccctctttgctaaaggaggccaaaacaaaatatccgaactacgaattcatatccgacaattccatctcctggtccgctggtctgcacaatcgatatacagagaattcgctgcgtggagttattctggacatccactttctctcacaagccgatttcctcgtttgcacattctccagccaggtgtgtcgggtcgcatacgaaatcatgcagacgttgcatcccgacgcttccgctaacttccacagtttggatgacatctattattttggtgggcagaatgcccacaatcaaattgccatctacgcccaccagcctaggacagccgatgagattcccatggagcctggcgatatcattggcgtcgccggaaaccactgggatgggtatagcaaaggcgtgaaccgcaaactggggcgaacggggctctacccatcttataaagttagggagaagatcgagaccgtgaagtaccctacctatcccgaggcagagaagtag

SEQ ID NO: 223751 - DNA, 1728 bp, Artificial Sequence
  Description of Artificial Sequence: Synthetic coding sequence
atgcgcccttggacaggctcctggcggtggatcatgctaattctgtttgcatggggaaccttgctgttttacatcgggggtcacctcgtgagggataacgaccatcctgatcattccagccgcgaattatctaaaattctggccaaactggaaagacttaagcaacagaacgaggacctgcggagaatggccgaatccctgagaattccagagggccctattgaccaggggccagctattggcagagtgagagtgttagaggagcagctggtaaaagccaaagagcagatcgagaactataagaaacagacaaggaatggcctgggcaaggaccatgagatcttacgacggagaatagaaaatggagctaaagagttgtggtttttcctgcagagcgagctgaaaaagctgaaaaatcttgaaggcaacgaacttcaaaggcacgctgatgagtttttgttggatttgggccaccacgaacgaagtataatgaccgatctttactatctgtcacaaacggacggtgccggagactggagagaaaaggaggccaaggatctgaccgaactggtgcagagaaggatcacttatctccagaacccgaaggattgtagcaaagccaagaaactcgtatgtaatatcaataagggatgcggctacgggtgccagctccatcatgtggtatattgctttatgattgcctacgggactcagcgcaccctgattctagagagccaaaactggcgatacgcaacaggaggatgggaaaccgttttcagacctgtgtcagagacatgcactgacagatccgggatcagcaccgggcattggtccggcgaagtcaaggacaaaaacgtccaggtggtcgaactccccatcgtggatagcctccacccacgccctccttatctgcctttggccgttccagaggatcttgctgatcgactcgttcgggtgcatggagacccagcggtatggtgggtttctcagtttgtgaaatacttaataagaccgcagccgtggttagaaaaggagatcgaagaggctactaagaagctgggttttaagcaccctgtcatcggcgtgcatgtgcggcgtactgacaaagtgggaacagaagctgcttttcacccaatcgaagaatacatggtgcacgtcgaagaacacttccagctgctcgcgagaaggatgcaggtagataagaagcgcgtttatttggctacggacgatccatctctcttaaaggaagccaaaacgaagtacccaaattacgagttcatttctgataatagcattagctggtccgcaggcctccacaaccgttacaccgaaaactcgcttagaggcgtcatcctcgacattcactttctgagtcaagctgacttcctggtttgcacctttagtagccaggtatgtcgtgttgcatatgaaattatgcagaccttacacccggacgcctcggccaacttccactccttggatgacatttactacttcgggggacaaaacgctcacaaccaaatagcgatctatgctcatcagccaagaaccgccgacgaaatcccaatggagcctggagacatcatcggcgtcgcagggaatcattgggatggatattcaaaaggggtgaataggaagctgggccgtaccggcttgtatccgtcgtacaaagtaagagaaaaaatcgagaccgtgaagtacccgacgtaccccgaggcagagaaatag

SEQ ID NO: 223752 - DNA, 1728 bp, Artificial Sequence
  Description of Artificial Sequence: Synthetic coding sequence
atgcgaccttggactggtagttggcggtggattatgctgatcttgtttgcatggggcaccctcctcttttacattggaggccatctcgtgcgggacaacgatcatcccgaccattcctcccgcgagttgagcaagatcctcgctaaactggagaggctgaagcaacaaaacgaagaccttcggcgaatggctgagtcactgcgcattcccgagggcccaatagatcagggtcccgcaatcggcagggtacgggtccttgaagaacagctggtgaaggccaaagagcaaattgaaaactataaaaagcaaaccaggaacggtctgggtaaagaccatgagatcctgaggcggagaattgagaatggcgcaaaggagctgtggtttttcctgcagtcggagttaaagaagctgaaaaatcttgaagggaatgagttgcaacggcacgcagacgagtttctgctggaccttggccaccatgagcgttcaatcatgacagacctgtactatcttagccagaccgacggcgcaggagactggcgcgagaaggaagccaaggacctgacggagctagtgcagcggcgtatcacgtacctgcagaacccaaaggattgcagcaaggctaaaaaactggtgtgcaacatcaataaggggtgtgggtacggatgccagcttcaccacgtagtgtattgcttcatgatagcatatggcacacagagaaccctgatcctggagagccagaattggcgatatgcgaccggcggatgggagacagtgtttagacctgtgagtgaaacatgcacagataggagcgggatttcaaccggccactggagtggggaagtcaaagataaaaatgttcaagtggtggagcttccaattgtcgatagcttgcaccctcggccaccatacttaccacttgcagtcccggaagacttggccgatagactcgtccgggtgcacggggatcccgctgtgtggtgggtgtctcagtttgtcaaatatcttattcgtccacagccttggctggaaaaggagatcgaagaggccacaaaaaaactgggcttcaaacaccctgtgatcggagtgcacgttagacgtaccgacaaggtggggacggaggctgcattccacccaatcgaggaatatatggtgcacgttgaggaacattttcagttgttggctaggcggatgcaggtcgacaagaaacgcgtatatcttgcgactgatgatccctccctgcttaaagaagccaaaacgaagtatcccaattatgagtttattagtgacaattcgatttcttggtccgctggccttcacaacagatacaccgagaacagcctgcgcggtgtgatccttgatatccacttcctgagtcaggctgatttcttggtatgcacattttctagccaggtatgtagagtcgcttacgaaataatgcagacccttcaccctgacgcatctgctaatttccactcgctagatgatatttactacttcggcggacaaaatgcccataaccaaattgccatatacgctcaccaacctaggactgcggacgaaattcctatggaacccggagacattataggcgtcgcgggaaatcattgggatgggtattctaaaggcgttaacagaaaattggggcgaaccggcctatacccatcctacaaggttagagagaaaattgaaaccgtgaagtatcctacatatcccgaggccgaaaaatag

SEQ ID NO: 223753 - DNA, 510 bp, Artificial Sequence
  Description of Artificial Sequence: Synthetic coding sequence
atgcaccggcaaatctggcatttgcattggactctggtgagatacccaaattacgaatttataagcgataattctatttcttggtctgccggacttcacaatagatataccgagaactcactcagaggcgtcatccttgacattcacttcctctcacaggcagatttcctggtctgcactttctctagccaagtctgccgggtggcctacgagatcatgcagacattacatccagacgctagcgcaaactttcattctctagacgacatttactatttcggaggtcagaacgcccacaaccagatcgcgatttacgcccaccaaccacggaccgccgatgagatcccaatggaacccggtgacatcatcggggtggctggaaatcactgggatgggtactctaaaggtgtaaatcgcaaactgggaagaactggactgtaccctagttataaagtcagggagaagatcgagacggtcaagtacccgacataccctgaggcagagaaatag

SEQ ID NO: 223754 - DNA, 48 bp, Artificial Sequence
  Description of Artificial Sequence: Synthetic coding sequence
atgaggccctggacaggatcctggaggtggatcatgcttatcttgtag

SEQ ID NO: 223755 - DNA, 135 bp, Artificial Sequence
  Description of Artificial Sequence: Synthetic coding sequence
atgagaccatggacaggatcctggaggtggattatgctgattttattcgcctggggtaccctgctgttctatattggcggacacctggttcgcgacaatgaccaccctgatcactccagccgcgaactgtcctag

SEQ ID NO: 223756 - DNA, 141 bp, Artificial Sequence
  Description of Artificial Sequence: Synthetic coding sequence
atgaggccctggacgggttcatggaggtggatcatgcttattctgtttgcctggggtaccctgctattttacattggagggcacctagtgcgtgataatgaccaccccgaccattcttcccgtgagttatcaaaaatatag

SEQ ID NO: 223757 - DNA, 126 bp, Artificial Sequence
  Description of Artificial Sequence: Synthetic coding sequence
atgaggccttggacagggtcctggcgctggatcatgcttatcctgtttgcctggggcacactgctgttttacatcggtggtcatctagtacgggacaatgaccatccagatcattcctcccggtag

SEQ ID NO: 223758 - DNA, 93 bp, Artificial Sequence
  Description of Artificial Sequence: Synthetic coding sequence
atgagaccgtggaccggttcttggcggtggatcatgctgatcctgttcgcttggggcacccttctcttctacatcggagggcatttggtttag

SEQ ID NO: 223759 - DNA, 1239 bp, Artificial Sequence
  Description of Artificial Sequence: Synthetic coding sequence
atgacagatctgtactacctgagccagactgacggcgcaggggattggagggagaaagaggcaaaggacctgactgagttagtgcagcgccgtattacttaccttcagaatcccaaagactgctctaaagcgaagaagcttgtgtgtaacattaataaaggttgcggatacggatgtcaactgcaccatgtggtgtattgttttatgatcgcctacggaactcaaaggaccctgatcctcgagtcccaaaactggcgctatgcaactggaggatgggaaacggtgttcaggcctgtttcagagacttgtacagatcgctccggtattagcaccgggcactggtcaggggaagtgaaggataagaacgtacaagtggttgagttgccaatcgtcgatagcttgcaccctcgaccaccttaccttccattagcggtacctgaagacttggccgaccgattagttagggttcacggtgatccagcagtctggtgggtctcacagttcgtgaaatacctgattaggccccagccgtggctggagaaggaaattgaggaagcaacaaaaaaactgggttttaagcacccggtaattggtgtgcatgtgcgacggaccgataaagttggcacagaggctgcgtttcatcccatagaggaatacatggtgcacgtagaggaacacttccaacttttggccaggagaatgcaagtagataaaaagagggtctatctggctaccgacgatccctctctactcaaagaagccaagacaaaataccccaactatgaattcatctctgataattctatcagctggtccgcagggctgcacaacagatacactgaaaattcgctccggggagttattttggacatacatttcctgtcccaggctgactttctggtgtgtacgttcagctcacaagtttgtcgtgtagcatacgagatcatgcaaacactgcacccagatgcttccgcgaattttcacagtctggacgatatatactatttcggcggacagaacgcccacaatcagatagctatttacgcgcaccaacctagaacggctgatgagataccaatggagcccggagatatcatcggcgttgccggaaatcattgggacgggtatagcaagggagtcaataggaaacttggcagaaccggtctgtaccccagttataaagtaagggagaagattgaaactgtaaagtatcccacctatccagaggctgaaaagtag

SEQ ID NO: 223760 - DNA, 153 bp, Artificial Sequence
  Description of Artificial Sequence: Synthetic coding sequence
atgcgcccttggacgggctcctggagatggattatgctaattcttttcgcttggggtactttattgttctatatcgggggacatctggtccgagataatgaccaccccgatcactccagtagggaacttagtaaaattctggccaagctgtag

SEQ ID NO: 223761 - DNA, 1080 bp, Artificial Sequence
  Description of Artificial Sequence: Synthetic coding sequence
atgacttcaacttcaaaagggattttacgtccctttctgattgtctgtataatccttgggtgcttcatggcctgtttgttaatttatataaaaccgacgaattcgtggatattttcgccaatggagtccgcatcctcagtactgaagatgaaaaactttttttcgactaaaactgactacttcaatgagaccacaattctagtctgggtttggccctttggccagaccttcgacctaacctcttgccaagcaatgtttaatatacagggatgtcatttgaccacagatcgctctctgtataataagtcgcacgcagtcctcattcaccaccgggacatcagctgggatttaacaaacctgccacagcaggctaggccaccttttcagaaatggatctggatgaatttagagtcccctacacacacacctcaaaaaagtgggatcgagcacttgttcaatctcaccctgacatatagacgcgatagtgatatacaggtgccctacggctttctgaccgtctcgaccaatcctttcgtgtttgaagtgccatccaaagagaaactggtttgttgggtggtgtcaaattggaatcccgagcacgccagagtgaaatactacaacgagctaagcaagtccattgaaatccacacttacgggcaggcgtttggcgagtatgtcaacgataaaaaccttattcctacaattagcacttgcaaattctacttgtccttcgagaacagtatccacaaagactatattaccgaaaaactctacaacgcctttttggctggctcggtcccagtggtgcttggaccaagccgggaaaattatgagaactatatccctgccgactccttcattcacgtggaggactataactcaccctctgaacttgccaaatacctgaaggaggtggacaagaacaacaaactgtacctgagctattttaactggcgcaaagattttacagtgaacctccctaggttctgggaaagccacgcttgtctggcatgcgatcacgtcaaacggcaccaggagtataaatccgtgggtaacctggagaaatggttctggaattag

SEQ ID NO: 223762 - DNA, 660 bp, Artificial Sequence
  Description of Artificial Sequence: Synthetic coding sequence
atgaaccgtctgtttggtaaggctaagcctaaagcacctcccccaagcctgactgactgcatcgggaccgtcgattcaagggctgaatccatcgacaagaagatatcaaggctcgatgcggagttggttaaatataaggatcaaatcaaaaagatgagggagggaccagctaaaaacatggtaaagcagaaggctcttagagtgctgaaacagaagaggatgtatgagcaacagcgggacaacctggctcaacaatcttttaatatggaacaggcaaattacaccatccaatctcttaaagacactaagacgacagttgacgctatgaaattgggagtgaaagagatgaagaaggcctacaagcaggtgaaaatcgaccagatagaggacttacaggatcagctggaggatatgatggaggatgccaacgaaatccaggaggctctgtctcgaagctacggaacgcctgagctcgacgaagacgatttggaagctgaattggacgcccttggtgacgagcttttggccgatgaggattcaagctacttagacgaggctgcctccgcccctgccattcctgagggcgttccgaccgacaccaagaataaggacggagtattagtcgatgagtttggcctgcctcagatcccggcaagctag

SEQ ID NO: 223763 - DNA, 1293 bp, Artificial Sequence
  Description of Artificial Sequence: Synthetic coding sequence
atgagccggattaacaagaacgtggtcttagcactgttgacgcttacgtcctctgccttccttctgttccagctatactattacaagcactacctgagtaccaagaatggcgcaggactcagcaaaagtaaaggctcacgcattggctttgattcaacacagtggagggccgtaaagaaatttatcatgcttactagcaaccaaaatgtgccagtcttccttattgacccactgatcctcgagctcatcaataagaattttgagcaagtgaagaatacatctcacggctcaacatcacagtgcaagttcttttgtgtgcctcgagacttcacggcgtttgcacttcagtatcatctttggaagaatgaagagggctggttccggatcgctgagaatatgggcttccaatgcctgaaaatcgaaagcaaggacccacgcctcgatggaattgacagtctctctgggacagagatacctctgcattatatttgtaagcttgctacacatgcgatccatctggtcgtgttccacgaacgcagtggaaactatctgtggcatggccacctccggctgaaagagcacatcgatagaaagtttgtgccgttccgaaaactgcaattcgggagatatcccggagctttcgaccggccagaactccagcaggttacagtagacggactggaggtcttaatacctaaggacccaatgcatttcgtcgaagaggtgccacacagtcgctttatcgaatgcaggtataaagaagctcgggctttttttcagcaatacctggacgataatactgttgaagcggtcgcttttcggaagtctgccaaggaactgttgcagctcgccgctaagacactcaacaaattgggggtgcccttttggctatccagtggcacatgccttggctggtacaggcagtgtaacataattccctattccaaagacgtggacctgggcatctttatccaggactataagagcgacattatcctggcctttcaggatgccggtctgccactgaaacacaagttcggaaaagtggaagatagcctggagttgtcttttcagggaaaggacgacgttaaacttgacgtgttcttcttttatgaagagacagaccacatgtggaatggcggaactcaggccaagaccgggaagaaatttaagtacctgttcccaaagttcaccctgtgctggaccgagtttgttgacatgaaggtgcacgtgccctgcgagacactggaatatatcgaggccaactatggaaagaaccagcagggagcatag

SEQ ID NO: 223764 - DNA, 708 bp, Artificial Sequence
  Description of Artificial Sequence: Synthetic coding sequence
atgatcctggaggtgggcgagaataacggattttttagtaagagcctgctcccccgatatgcatccaagaagttgaaatcttcgctccctcatagccgtgccgtcaagaaattcatcatgttgacaagtaaccaaaacgtgcctgtgttcctgatcgaccctctcatcctggagctgatcaataaaaatttcgaacaggtcaaaaatacatcgcatggctcgacctcacagtgtaaattcttttgtgtgcctcgtgattttacagcctttgcattgcagtatcacctatggaagaacgaggaagggtggtttcgcatcgctgagaatatgggattccaatgcttgaaaattgagtcaaaggatccgagactggatgggatcgatagcctgtccggcactgaaataccactgcattatatctgcaaactcgcaacacacgctatccacctagtggttttccatgagcgttctggtaattacctctggcacggtcacctccgccttaaggaacacattgataggaagttcgtgccatttcgcaaacttcagttcgggagatacccgggagcatttgaccggccagaactccaacaggtgaccgtcgatgggctagaggtcctgatacccaaagacccgatgcacttcgtggaggaggtgccccactcaagattcatcgagtgtcggtataaagaagctcgcgcattctag

SEQ ID NO: 223765 - DNA, 552 bp, Artificial Sequence
  Description of Artificial Sequence: Synthetic coding sequence
atgtcccggattaacaagaacgtcgtgctggcccttttgacgcttacgtcatctgccttcctgctatttcagctatattactacaaacactatctgtcaaccaagaatggagctggactgtccaagtcgaaggggtctagaataggcttcgatagtacacagtggcgcgcagtgaagaagttcattatgctgacctctaaccaaaatgtgccagtgttccttatagaccccttaatactagagctaattaataagaatttcgagcaagtcaagaatacgagtcacggctctacgtcccagtgcaagtttttctgtgtaccgagagattttacagccttcgccctgcaataccacctgtggaaaaatgaggaggggtggtttagaatagctgagaacatgggttttcagtgcttgaaaatcgagtcaaaagatcccagactcgatggtattgactccctaagcggaactgaaattcctctgcattacatttgtaagttagccacacacgctatccacctagtggttttccatgagagaagtggcaattactag

SEQ ID NO: 223766 - DNA, 483 bp, Artificial Sequence
  Description of Artificial Sequence: Synthetic coding sequence
tgatggtataggcagtgtaatatcataccctattcaaaagatgtcgacctgggaatcttcatacaggactataagtcggacatcattctcgcattccaggacgccggacttccactgaagcataaattcggcaaggtggaagacagtctggaattgtcgtttcaggggaaagacgacgtgaaacttgacgtgtttttcttctatgaagagaccgaccatatgtggaacggcggaacacaggcgaaaacaggaaagaaattcaagtacctgtttcctaaatttactttgtgttggactgagtttgtggatatgaaagtacatgtcccttgcgagacactcgagtatattgaggcgaactacggcaaagaggctgaatcttatatcctttcaatgctcttcaggacaactttctggtccctcgccgactttccactgactccggaaaacaactcgagcttgaagaacggaaatctcaacgtgtag

SEQ ID NO: 223767 - DNA, 816 bp, Artificial Sequence
  Description of Artificial Sequence: Synthetic coding sequence
atgagtagaattaacaagaacgttgtactggccctgctgactcttacttcttccgcattcttgctctttcaactctattattataagcactatttaagcacaaagaacggcgcaggccttagcaagtcaaaaggctcaagaattggattcgactccacccaatggcgggctgtaaagaaattcatcatgcttaccagtaaccaaaatgtgcctgtcttcctgatagaccctcttatattggagctgataaataaaaacttcgagcaagtcaaaaacactagccacgggagcacctcacagtgcaagttcttctgcgtacccagagacttcaccgccttcgccctccaatatcatctgtggaagaatgaagaaggctggtttcgaattgccgaaaatatgggattccagtgcctgaagatcgaatccaaagaccctaggctcgacggcattgactcactttccgggacagaaataccactgcactacatttgcaaactggcaacccatgccatccacctggtggttttccatgagcggtccggaaattacctgtggcatggacacttgcggctgaaagaacacattgatcgtaagtttgtaccattcagaaagctgcaattcgggcgttaccctggggctttcgacagacctgagctccagcaggtgaccgtagatggcctggaagtcctgattccaaaagaccctatgcatttcgtggaagaggtccctcactcccggttcatagagtgtcgctataaagaggccagagctttttttcaaatcccagtgtcagaggtctatacagtgttggattag

SEQ ID NO: 223768 - DNA, 1488 bp, Artificial Sequence
  Description of Artificial Sequence: Synthetic coding sequence
atgcgcctcacccggtgtcaggccgcattggccgctgccattaccctgaacctgctcgttcttttttatgtgtcttggctccagcaccaacctcggaattcgagagcaagaggcccaagacgagccagcgccgcagggccaagagtgactgtgctcgttagagaattcgaggcattcgataatgctgtgccagaacttgtcgattctttcctgcaacaggatccagctcagcccgtggtcgtggcagcggacaccctgccgtatccaccactcgctctgcctagaataccgaatgtgaggttagctctcctgcagcctgcgctggatagacccgcagcagcctcaagaccggaaacatatgttgccaccgagttcgtcgcacttgtgccggatggtgcccgagcagaggctcctggtctcttagagcggatggttgaggccttgcgagctggctcagccaggttggtcgccgcacctgttgccaccgctaatcccgctcgatgccttgcactgaatgtcagcctgcgggaatggacagccaggtatggcgcagcccctgccgcaccaaggtgcgacgcgctggacggtgatgcagttgtgttgctgcgggctagggacttgtttaacctgtcggctcctctggcccgacccgtgggcacttccctgttcctgcagaccgccctaagaggctgggctgttcagctgctcgaccttactttcgccgcagccagacagccccctctggcaaccgcacacgcgagatggaaagcggagcgcgagggccgtgccagacgcgctgcgctgttgagggccttagggattcgcctggtatcatgggaggggggaaggctcgagtggttcggatgcaacaaagagaccaccaggtgtttcggaaccgtcgtcggcgacacacctgcctacttgtatgaggagaggtggaccccgccttgttgtctccgggcactcagagagacagctcggtacgtagtgggggtgctggaagcggctggggtgcgatattggcttgagggcggttcactcttgggggcagcaagacacggggacatcattccttgggattacgacgttgacttagggatctatttagaagacgtgggcaattgtgagcagctgaggggcgcagaagctggttctgtcgtcgacgaacggggttttgtgtgggagaaggcagtagagggcgatttcttcagagtacaatattcagagtcaaatcacttgcacgtggacctttggccattctaccctcgaaatggcgtcatgacgaaggacacctggttggatcaccgccaggatgtcgagttccccgagcactttctgcagcctctggtgcccttacctttcgccggatttgtggctcaagccccaaacaactaccgcagatttctcgaattaaaatttggacctggggtcatcgagaacccccagtaccccaaccctgccctgctttctctgaccggatccggatag

SEQ ID NO: 223769 - DNA, 1488 bp, Artificial Sequence
  Description of Artificial Sequence: Synthetic coding sequence
atgcgactgactcgatgtcaggcggctctggccgctgcaatcaccttgaacttacttgttttgttctatgtgtcatggttgcagcatcagcctagaaattcccgcgctagaggaccaagacgggcaagcgccgcagggccaagagttacagtactggtccgcgaatttgaagccttcgacaacgcagtccccgagctggtcgattcattcctgcagcaggaccccgctcaacctgtggttgtagccgcagataccttaccctacccaccactggcactgcccagaattccaaacgtgagactagctctcctccagccagcactggatagaccggcagcagcttcacggcctgagacgtacgtagccacggaatttgtcgcgctggtgcctgatggagctagagccgaagccccaggtcttcttgagcggatggtcgaagccctgcgggctgggagcgccaggctagttgccgctccggtggcaacagccaacccagccaggtgtttggcccttaatgtctccctgcgcgagtggactgcccgttacggagcagcccctgcggctccccgatgtgatgctcttgacggtgacgccgttgtgttactgagagccagggacttattcaacttgtctgctcccctggcaaggccggttgggacatcactctttttacaaactgctttaagaggatgggccgttcagctcctggatcttacctttgcagctgccagacagcctccactggccactgcacacgctcgctggaaagccgagcgggagggaagggctaggcgcgcagccttgctacgcgctttagggatacggctagtaagttgggaagggggacgcctggagtggttcgggtgcaacaaagagactacccgctgtttcggtactgtggtcggcgatacccccgcttacctctacgaagagcggtggacgcctccttgctgcctgagagcactgagagagacggcacggtacgtggtgggagtcctggaagctgccggagttcgctactggctcgagggaggatctttgttgggggcagcgaggcatggcgatattattccttgggactacgacgtcgacttggggatctacctggaggacgtgggcaactgcgaacagttgagaggcgcagaggcagggtctgtagtggatgagcggggattcgtgtgggaaaaggccgtcgagggagacttcttccgggtacagtactccgagtcgaaccacttacatgtggacctatggccattttacccaagaaacggggtaatgaccaaggatacctggctggatcaccggcaggacgtagagttccccgagcattttcttcagccgctcgttcccctccccttcgcaggctttgtcgcccaggcccctaacaactataggcgtttcctggaactgaaatttggtcccggagtcatcgagaacccccagtatcccaatccggcactacttagcttgaccggatctgggtag

SEQ ID NO: 223770 - DNA, 2385 bp, Artificial Sequence
  Description of Artificial Sequence: Synthetic coding sequence
atggagcttagaccctggctcctttgggtggttgccgctactgggactttagtgctgctggccgcagatgcgcagggccagaaagtcttcaccaatacctgggccgtgagaatccccggtggacctgccgtcgcaaattccgtcgccagaaaacatggatttcttaacctaggccagatctttggggattattaccatttctggcataggggagttactaagcgtagtctcagcccccatcgaccgcgacattcccgactgcaacgtgaaccacaggtccagtggctggaacaacaggtagctaagcgacgaacaaagagagacgtctatcaggaacctacagatccgaaatttccacagcaatggtacttatcgggagtgacccagagggatctgaatgtcaaagctgcctgggctcagggatacaccgggcacgggattgtagtatctatcctggacgacggcatcgagaaaaatcaccctgatttggctgggaactacgatccaggtgcatcctttgatgttaatgaccaagaccccgaccctcagcccagatacacccagatgaacgataaccgccatggtacgcgctgcgctggcgaagtggcagcagtcgctaataatggagtttgtggagtgggggtggcgtacaatgctaggattggtggagtgcgtatgctggacggagaagtcactgatgcagtggaagcaagatccctgggattaaaccctaatcatatccacatatactccgcatcttggggccctgaagacgacggcaagacagtggatggtcctgctcgtttggccgaagaggcatttttcaggggtgtgtcgcaggggaggggcggattaggcagtatattcgtgtgggcttcgggcaatggcggtagggagcatgacagttgtaactgtgacgggtacaccaattcgatttacacgctgagcattagcagcgctactcagttcggaaatgtcccatggtattccgaggcctgctccagtaccctcgcaaccacatactcttccggaaaccaaaacgaaaagcagatcgtgacaaccgacctgcgtcagaagtgcacagagagccatacggggacttcagccagcgccccattggcggcaggcatcatcgcactgacacttgaggccaacaaaaacttgacgtggagggatatgcagcatcttgtggtgcagacctctaaacccgcacatctcaacgccaacgactgggctaccaacggagtcggcaggaaagttagccacagttacggctacggtctactggatgctggagctatggttgcacttgcccaaaactggacaaccgttgctcctcagaggaagtgcattatcgatatactgacagaacccaaggacattggtaaacgtctggaagtccggaagaccgtcacagcatgtctgggcgagccaaaccacattactaggctggagcacgcacaagctaggctgaccctgtcctataaccgcagaggggacctggctatccacctcgtgtctcccatgggcaccaggtcgacgctgttagctgccaggcctcacgattactccgccgacggattcaatgattgggcgttcatgactacgcacagctgggacgaggacccttcaggcgagtgggttttagagatcgagaacaccagtgaggctaacaattacggcacccttacgaagtttactctggttttatatggaaccgccccagaaggtctgcccgtgccgcctgagtcatccggctgtaaaacgctgaccagtagtcaggcctgtgtggtttgcgaagaaggcttctccctccatcagaaaagctgcgtgcagcattgtccgccaggatttgcaccccaggtgctggatacccattattccactgaaaatgatgttgagactatcagagcgtctgtgtgcgcaccatgtcatgcatcctgcgccacttgccaggggccagcccttacagactgcttatcttgtccttcgcatgcttccctcgatccggtcgagcagacatgcagtcgtcaatcccaatctagtagggagtcccctccacagcagcagccccctagactgccacccgaggtggaagccggacagagactgcgcgctgggctgctgccttcacatctgccagaagtggtagccggtctttcttgtgcctttatagtgcttgttttcgtgactgtgtttttggtcttgcagctccgatcaggattctcctttaggggcgttaaggtttacaccatggacaggggactgatctcctataagggcctgcccccagaggcttggcaggaggagtgtcccagcgacagcgaagaagatgaaggccgtggggagagaacagcttttatcaaggatcagtctgctctttag

SEQ ID NO: 223771 - DNA, 210 bp, Artificial Sequence
  Description of Artificial Sequence: Synthetic coding sequence
aagcctgctcacctgaacgctaacgactgggctactaacggagtggggaggaaggtgtcccactcgtatggatatggattgtggacccaagcaccctggtggccctggccaaggatcggacctcagtggcccccttccgggtctgcctcttctacaagtagcccgagtccgaagaccagcggcaacggctcaagatgcggccgaccctag

SEQ ID NO: 223772 - DNA, 210 bp, Artificial Sequence
  Description of Artificial Sequence: Synthetic coding sequence
atggaactacgtccatggctcctttgggtggttgcggcaaccggtactttggttcttctggccgcagacgcccagggacaaaaggtgtttacgaacacgtgggctgtgagaatccccggaggccctgccgtcgccaactctgtcgccagaaaacatggatttctcaatctgggccagatttttggcgattattatcacttctggcattag

SEQ ID NO: 223773 - DNA, 1581 bp, Artificial Sequence
  Description of Artificial Sequence: Synthetic coding sequence
atggcttccaacgattacacgcaacaggccacacagtcatatggcgcatatcccacccagcccggtcaaggatacagccagcaatccagtcagccttacgggcagcagagttattctggctactcccagtctactgacacctccggctacggacagagttcctacagctcttacgggcagtctcagaataccgggtacggtacgcagtctacgccacagggctacggatctacggggggatacggctctagtcagtcaagccagtcttcctacggacaacagagctcataccctggctatggacagcagcccgctcctagtagcacttccggcagttatgggtccagcagccagtctagcagttatggacagccacagagtgggtcctactcacagcagccttcatacggtgggcagcagcagtcttatggtcagcagcagtcttacaaccctccccaggggtatggtcagcagaaccagtacaattcaagtagcgggggaggaggaggcggtgggggaggcggaaattacggccaggatcagtcttcgatgagctccggcggtggatccggaggaggttacggtaaccaggatcaaagcggaggcggtggatcaggtggatacggacaacaggatcggggtggacgcggacgagggggatcgggtgggggtggtggtggcggaggcggaggatacaacagatcctcaggtggctacgaacctagagggaggggtggagggagggggggacgcggtggaatgggtgggagtgaccggggtgggttcaacaagttcggcggtcccagggaccaggggtcaaggcacgactcagaacaggacaatagcgacaataatacgatctttgtgcagggcctaggtgaaaacgtgactatcgaatctgtggccgattattttaaacagattggtatcattaaaaccaacaagaagaccggacagccaatgattaacttatacacagaccgagagaccgggaaactgaagggggaagcaacagtgtcattcgacgatccaccttcagccaaagccgctattgattggtttgatggcaaggagttttcgggcaatcccatcaaggtgagcttcgcaaccaggcgggctgattttaaccgtggcggtggtaacggaagagggggacgcggacggggtggccctatgggcaggggtggatatgggggtggcggatctgggggtgggggaagaggtgggtttccgtctggcggaggaggtggtggcggacagcagcgtgccggtgattggaagtgcccaaatccgacatgcgaaaatatgaacttcagctggcgcaacgaatgtaaccagtgcaaggctccaaagcccgatgggcctgggggaggacccggaggcagtcacatgggcggaaactatggcgacgaccggagaggagggcgaggtggctatgacagaggaggttatcgcggacggggtggcgacagaggcggattcagagggggacgcggtggcggagataggggcggtttcggtccaggcaagatggactctcggggagaacacagacaggatagacgggaaaggccatattag

SEQ ID NO: 223774 - DNA, 456 bp, Artificial Sequence
  Description of Artificial Sequence: Synthetic coding sequence
atgaaccctgaagtggtggaggtggctgtcgaggcagaggttgcttgggcagaagtgaccgtggttgcctccattaacctcgtagccttaggcactaaggatcatgtcatgacacctacaaataagaagactggacagccaatgattaatctgtacaccgaccgcgagacgggaaaactgaagggggaagccacagtttcatttgatgacccccctagtgccaaggcagccattgattggtttgacggcaaggaattctcgggaaaccctataaaagtgtcctttgccacaaggagagctgactttaacaggggtggaggcaatggcagaggtggacggggacgtggtgggcctatggggcgaggcggatacggcggaggagggtctggtggcggaggccgaggcggttttccctccggcggtggaggcggtgggggtcagcagcgggcaggctag

SEQ ID NO: 223775 - DNA, 1290 bp, Artificial Sequence
  Description of Artificial Sequence: Synthetic coding sequence
atggctagtaatgactacactcaacaagctacccagtcctatggagcatatcctactcaaccgggacagggttatagccagcaaagtagtcaaccatacgggcagcagtcttatagtggctactcccagtctacggatacctccggctatggccagtcttcatactcctcttacggccagtctcaaaacacaggatacggtacccaatcgactccacagggttatgggagtacaggcggttatggttcgagtcaaagcagtcagtcatcctacggacagcagtccagctaccctggctacggacaacagccggcaccctcatctacatccgggtcctacggctccagtagccagtcttcctcttatggacaaccacagtccggtagctatagccagcaaccgagttacggaggacaacagcagtcctatggtcagcaacagtcttacaacccacctcaaggatacggtcaacagaaccagtacaacagttctagtggtggatacgagcccagagggaggggcggaggaaggggtggacggggtggaatgggcggatccgatcgcggtggattcaataaattcggcggacctagagaccaaggcagtagacacgactccgaacaggataacagcgacaacaacaccatttttgtgcagggactgggcgagaacgtgacgatagagtctgtcgctgactatttcaagcaaattggaataatcaagacaaacaaaaaaaccggacagccgatgataaacttatatactgatagggaaactggaaagctcaaaggcgaggcgaccgtgtcctttgacgatccccctagcgctaaggctgcaatagactggttcgatggtaaggaattcagcgggaatcccataaaagtgagttttgcaaccaggcgggctgattttaatcggggaggaggaaacgggcgaggcggacgcggaagaggaggccctatggggcgaggcggttatggcggtggaggatcaggagggggaggacgtggagggtttccctccggaggcggaggcggaggcggacagcagagggcgggagattggaagtgccccaatcccacatgcgaaaacatgaatttctcttggcggaacgaatgtaaccagtgtaaggcacccaaacctgacgggccagggggaggtcctggaggctcgcacatgggcggaaactacggagatgacagacggggaggagacagaggcggattcggacccggaaagatggatagccgaggtgagcatcgccaggatcgcagggagcgcccttactag

SEQ ID NO: 223776 - DNA, 1257 bp, Artificial Sequence
  Description of Artificial Sequence: Synthetic coding sequence
atgggagaggagggcacaggcggtactgtccatttgctgtgcttggctgccagctccggcgtgcctctgttctgccggtccagccggggaggagcaccagctcgtcagcaactgcccttttctgtcattgggtccctgaacggagtacatatgtttggacagaatcttgaggtgcaattatcctctgcacgtactgagaacactacagtggtgtggaagtcatttcacgactctatcacactgatcgtcttgtcaagtgaggtggggatctctgaactaagacttgagagactgttacagatggtatttggcgcaatggtgctacttgtcggcctggaggaactgactaatatccggaacgtcgagcggctgaagaaggacctgcgggcatcctactgtcttatcgattccttcctgggcgatagtgagttgatcggcgacttgacacagtgcgtggattgcgtgattccacctgaaggaagccttctacaagaggccctttctggctttgccgaggccgcaggcacaaccttcgtgtcactcgtggtttccggtcgggtggtagctgccactgagggctggtggcggctgggaaccccggaggcagttcttctgccttggttagtcgggagtctaccaccccaaacggccagggactaccccgtctacctgcctcatggatctccaaccgtgcctcatcgactgctcacgttgacactgttacctagtctggagttgtgtctgctgtgcggcccttctccacccttaagtcagctgtacccccaactgctggagcgttggtggcaaccacttctggacccgctccgggcttgtcttccattggggccacgggctctacccagcggttttccgctccacacagacattcttggactcttgctgctccacctcgagctcaagcggtgtctgttcactgtcgaacccttgggcgataaggagccctcacccgaacagagacgaaggttgctgaggaacttttatactctggttacctctacccacttcccgccagaacccggtccccctgagaagaccgaggatgaagtctatcaggcacagctccccagggcatgctacctggtgctggggaccgaggagcctggaaccggggtgagactcgtggcattgcagctggggttgcgaagactcctgctgctgttaagtccccagtcccccacgcatggattacgttcccttgccacacacaccctgcacgcccttactcctctcttgtag

SEQ ID NO: 223777 - DNA, 711 bp, Artificial Sequence
  Description of Artificial Sequence: Synthetic coding sequence
atgggcgaagagggcactggcggtacggtccatcttctctgtctcgccgcttcctctggagtgccattattttgtaggtcttcaaggggcggtgccccagccaggcagcagctgccattttctgtcatcggtagtctgaatggagtgcatatgttcgggcaaaacctggaagtacagctgtcctcagcgagaacagaaaacaccaccgtggtttggaagagtttccatgatagtataacattgatagtcctgagctccgaggttgggattagcgagcttaggctggagcgcctactgcagatggtgtttggcgctatggtgttactggtcggcttagaggaacttacaaacatccgaaacgtggagagactgaagaaagacctgcgcgctagttattgcctcattgattcttttttaggcgacagcgagctgattggggacctgacgcagtgcgttgactgtgtaattcccccagaggggtctttattgcaagttctgggaatgttgtggaaactgctgcacctgttctgctggccttggctgtcgcctcacccactgtcaagcggacctctgagccagcctccccctatattgtctgcctcaagcccgattcctacctggagtcagaagaatctattctcattcttcttttcattcctctctttgtctttcctgttctccttcctcagcctctttctgttcgagacttag

SEQ ID NO: 223778 - DNA, 1164 bp, Artificial Sequence
  Description of Artificial Sequence: Synthetic coding sequence
atgggggaggaaggaacaggcggaacagttcatctcctttgccttgcagcttctagtggtgttcccctcttctgccggagttcacgtgggggtgcaccagcgaggcagcaactacctttttctgtcatagggtccctaaacggagttcacatgtttggtcaaaacttagaggtgcagctctcctcagccaggaccgagaacacaaccgtcgtttggaaaagttttcacgactcgattacattgatcgtcttgtcttctgaggtgggaatatcagagctccggctagaacgcctcctccagatggtgtttggggctatggtgctgctcgtgggactggaagagctcacaaatattcgtaatgtcgaacggttgaagaaagatctgcgcgctagctactgtctcatcgactcgttcctgggggactccgaactgatcggagacctaacgcaatgtgtggattgcgttattcctcccgagggatccttactccaggaggccttgtccggttttgccgaggccgcagggaccacatttgtgtcacttgtggtaagcggcagagtggtagctgcgacagagggctggtggaggttaggcactccggaagcggttctacttccatggttggttggctcccttcctccacagactgcccgagattacccagtttatctgccccacggctcacctacagtgccccaccgcctcctcacactgaccttgctccctagcctcgaattgtgtcttttgtgtggaccctctccccctctctcgcagttgtatccccagcttctagagcgctggtggcagcccctattggacccgttgagagcctgtctgcccctgggaccgagagctctgcccagtggtttcccacttcacactgatatcctgggactactgcttctgcatttagaacttaagcgctgcctcttcaccgtggagcctctcggagataaggagcctagccctgagcagcggaggcgacttctgcgcaacttctataccttagtgactagtacccacttccccccagaaccgggacctccagagaaaactgaagacgaagtgtaccaggcccaattgccacgcgcatgctacctggtaatgggcgacggccaccggcacggggctgtgtccgttagccttttcattcgcagccagtag

SEQ ID NO: 223779 - DNA, 1149 bp, Artificial Sequence
  Description of Artificial Sequence: Synthetic coding sequence
atgggggaggagggtacgggcggaaccgtgcacctgctctgtctggcggctagttccggcgtgccccttttctgtagatctagcagagggggagccccagcccgacagcagttacccttcagtgttattggcagcctgaacggcgtccatatgtttggacagaacttggaggtgcagctatcatctgcaaggaccgagaacacaaccgtggtactattagtgggtctcgaggagctgacaaacatccgtaacgttgagcgcttaaaaaaggatctccgcgcttcctactgtcttatagactcatttctgggtgactctgagctgatcggagaccttacacagtgtgtcgactgcgttatacctccagaaggctcactgttacaggaagcactctccggcttcgccgaggctgctggtaccacctttgtgtcgctcgttgtttctggcagagttgtcgctgccactgaaggatggtggaggctcggtacgcctgaggccgtcttgctgccatggctcgtgggttccctccctccccagacagctcgcgattacccagtgtacctcccacacggctcccccaccgtccctcataggctgcttacactgacactcttgccatccctggaactctgcctgctgtgcgggcctagcccaccattgagccaactctatccgcaactcctggagaggtggtggcagccactgctcgaccccctgagggcatgcctgccacttggacctcgggcactgccatccggtttccctctgcatacggatatcctgggcctgctgcttctccacctggagttaaaaagatgcttatttactgtagaacctctgggagacaaagaaccaagccccgagcaacggcgtaggctcctgcggaacttctatactctcgtcacgagcacacactttccgcctgaacccggaccgccagagaaaacagaggatgaggtataccaggcgcaactaccaagagcgtgttacctggtgctgggcactgaagagccaggcacgggggtgaggttggtcgccctgcaattggggctcaggcggctcttgctgttgcttagtccccagagtccgacccatgggttacgctctctggccacccataccctgcacgcactgactccattgctgtag

SEQ ID NO: 223780 - DNA, 279 bp, Artificial Sequence
  Description of Artificial Sequence: Synthetic coding sequence
atggcctctctgggccacattctcgtgttttgtgtaggactcttaactatggcaaaggcggagagtccaaaagagcatgatccctttacctatgactaccagtcactccagattggcggactggtcatcgccggtattttattcattctcggtatcttgattgtcctgagcaggcggtgccgctgcaaattcaatcagcaacaacggacgggtgagcccgacgaagaggagggtacctttagaagctctattagaaggctgtccacccggcgtcggtag

SEQ ID NO: 223781 - DNA, 279 bp, Artificial Sequence
  Description of Artificial Sequence: Synthetic coding sequence
atggccagcttagggcatattctggtattctgtgtgggcctgctcactatggccaaggccgagtctccaaaagagcatgacccgttcacctatgattaccagagcctgcagatcggaggactggtcattgcaggcatacttttcattctgggtatcctcattgttctgtctaggaggtgccggtgcaagtttaatcagcaacagcgcacaggtgagcccgacgaggaagaggggacctttcgctcttccatacgacggctgtccacccggagacggtag

SEQ ID NO: 223782 - DNA, 195 bp, Artificial Sequence
  Description of Artificial Sequence: Synthetic coding sequence
atggatcgatggtacctgggaggttcaccaaagggggacgtggatcccttttattatgattatgagacggtccgtaatggtgggctgatctttgctggcctggcattcatcgtaggcctgctcatactgttgagtagaaggttccgatgcggaggaaataaaaaacgacggcagattaacgaagatgagccttag

SEQ ID NO: 223783 - DNA, 201 bp, Artificial Sequence
  Description of Artificial Sequence: Synthetic coding sequence
atgaccgggctgtcgatggatggcggagggtcacctaagggggatgtggaccctttctattacgattatgaaacagtgcgtaacggtggactgatctttgctgggctcgcatttatcgtggggctcctgatcttgctcagtcgcagattcaggtgtggaggtaacaagaagcgtagacagattaacgaggatgagccgtag

SEQ ID NO: 223784 - DNA, 195 bp, Artificial Sequence
  Description of Artificial Sequence: Synthetic coding sequence
atggacaggtggtatctgggaggtagtccaaagggagacgtggacccattctactacgattacgaaactgtacgtaatggcggattgatattcgctggactggcgttcatcgtagggttgctgattcttttgtctcgcaggtttaggtgcggaggcaacaagaaaaggaggcagataaacgaggatgagccatag

SEQ ID NO: 223785 - DNA, 264 bp, Artificial Sequence
  Description of Artificial Sequence: Synthetic coding sequence
atgcagaaggtgaccctgggcttgctggtgttcctggcagggttccctgtcttagatgcaaacgacttggaggacaagaactcccctttctactacgactggcactcgctccaagtgggaggacttatatgcgccggagttctctgcgctatgggaatcatcattgtaatgagcgcgaagtgtaagtgtaaatttggtcagaaatctggacatcatcctggcgagacacctccgctcatcacccctgggtcggctcagtcatag

SEQ ID NO: 223786 - DNA, 342 bp, Artificial Sequence
  Description of Artificial Sequence: Synthetic coding sequence
atgcagaaagttactctagggctgctcgtgttccttgccggattcccagtgctagacgctaacgatcttgaggacaagaatagcccattctattatgactggcacagcctgcaggttggtggattaatttgcgctggggtgctgtgcgccatgggcattattattgtaatgagcgaatggcgcagttccggggaacaggcagggaggggatggggatctccacctctgaccacgcaactgagccccacaggcgctaagtgcaaatgtaaattcgggcaaaagtcaggtcatcatcctggtgagactccaccattaataactcctggttccgcccaaagttag

SEQ ID NO: 223787 - DNA, 291 bp, Artificial Sequence
  Description of Artificial Sequence: Synthetic coding sequence
atgcagaaagtgacattgggtctattagtgtttctggccggatttcccgtcctagatgcaaatgacctggaggacaaaaacagcccattttattatgactggcacagtctccaggtagggggacttatttgtgcgggtgtactgtgtgctatggggattattatcgtcatgtccgagtggcgaagtagcggagaacaggcagggcgtggttggggatcacctccccttaccacacagctatccccgactggagcaaaatgcaaatgtaagtttggccaaaagtctggatag

SEQ ID NO: 223788 - DNA, 264 bp, Artificial Sequence
  Description of Artificial Sequence: Synthetic coding sequence
atgcagaaagtcaccctgggactgctggtttttctggcagggtttcctgtcctcgacgctaacgacctcgaggataaaaacagtccgttctactatgactggcactccctgcaggtaggcggtcttatctgtgccggtgtcttatgcgccatggggatcatcattgtaatgagcgcaaagtgcaagtgcaagttcggccaaaaatcagggcatcaccccggagagacccctcccttgattacacccggttcagcgcagtcctag

SEQ ID NO: 223789 - DNA, 435 bp, Artificial Sequence
  Description of Artificial Sequence: Synthetic coding sequence
atgggtagggggtattctggtgctctccaggctaggggaggcctcgaggagcccctggagcggggactgagaggtccatcattcacacagtcccctctgcatggcgcagccgctgcatatctgtccgcacagcgcgacgcatcattgccagtgcccggtcagagatctgacatgcagaaagtcacactgggactcctcgtgtttctggccggattcccagttctcgacgctaacgacttggaggataagaattcccctttctactacgattggcactccctgcaggtgggaggtctgatctgtgctggcgttttatgcgcgatgggtataataatagtgatgtctgctaaatgcaaatgtaaattcggccagaagtccggccaccatccgggtgagacacctcccctcatcacacctggctctgctcaatcctag

SEQ ID NO: 223790 - DNA, 186 bp, Artificial Sequence
  Description of Artificial Sequence: Synthetic coding sequence
atgcagaaggtcaccttggggctgttggtttttctggccggatttccagtgcttgacgctaacgacttggaggacaaaaacagcccgttctactacggtgaaagcccctgtcctctgagtcccccacataaccccacctattgtctggtgcctcgtgtgcctatacagggctggggcctgacatag

SEQ ID NO: 223791 - DNA, 435 bp, Artificial Sequence
  Description of Artificial Sequence: Synthetic coding sequence
atgggccgaggctattctggcgcactgcaggctcggggaggcctggaggaacccctcgaacggggattaagaggcccatcttttacccagtctcccctgcacggggctgcggctgcatacctctcagcgcaacgtgatgcatccctccctgtgcccggtcagcggtccgacatgcagaaggtaaccttgggactgctcgttttccttgccggtttcccagtgctggacgcaaacgacctggaagataaaaactcacccttctactacgattggcacagcctgcaggtgggcggtctgatctgcgcaggtgtgctctgcgccatgggtatcatcatagtaatgtcggccaagtgcaagtgcaagttcggccaaaaatccgggcaccatccaggagagactccgcctctgatcacaccaggttccgcccagagctag

SEQ ID NO: 223792 - DNA, 288 bp, Artificial Sequence
  Description of Artificial Sequence: Synthetic coding sequence
atggaactggtactggtgtttctatgttcccttttggcacccatggtactggccagtgctgcggagaaagagaaagagatggatccattccactacgactaccagaccctcagaatcggaggtcttgtgttcgcagttgtgctcttcagcgtgggcatcttgttgattctgtccagacgttgcaagtgtagtttcaatcagaaaccccgtgcgcctggtgacgaggaggcgcaggttgaaaatctcattacggcgaacgccacagagcctcagaaggcagagaactag

SEQ ID NO: 223793 - DNA, 288 bp, Artificial Sequence
  Description of Artificial Sequence: Synthetic coding sequence
atggagctcgtgcttgtgttcttatgttcccttctggctcctatggtcctcgcgtccgccgctgaaaaagaaaaagagatggatccgtttcattatgactatcaaactctgcgaataggtggcctagtgttcgccgtagtattgttcagtgtgggaattctgcttatcctgtcaagaaggtgcaagtgctccttcaatcagaaaccgcgagcccctggggatgaggaggctcaggtggaaaatctcataacagctaatgctacagaacctcagaaggctgagaattag

SEQ ID NO: 223794 - DNA, 288 bp, Artificial Sequence
  Description of Artificial Sequence: Synthetic coding sequence
atggagctcgtactagtgtttctttgcagtctactggcacccatggtcctggcaagcgccgctgagaaggaaaaggagatggacccgttccactatgactaccagactctccggattggcggtctggtgttcgccgtcgtcctgtttagcgtggggattctgctgatattgagtcgtcgctgtaagtgtagctttaaccagaagccgagagctcctggcgacgaggaggctcaggtagagaatttgataaccgctaatgctaccgagccacagaaggccgaaaattag

SEQ ID NO: 223795 - DNA, 288 bp, Artificial Sequence
  Description of Artificial Sequence: Synthetic coding sequence
atggagctggtgctcgtgttcctgtgttccctcttagcacctatggttttagccagcgccgcagaaaaggagaaagaaatggacccctttcattatgactaccaaacactccggataggagggctcgtgttcgcagtagtcctatttagcgtgggaattctgctgatcctatcacgcaggtgcaaatgctccttcaaccagaagccaagggcgccaggagatgaggaggcgcaggtcgaaaacctgatcaccgccaacgccaccgagccccagaaagcagagaattag

SEQ ID NO: 223796 - DNA, 288 bp, Artificial Sequence
  Description of Artificial Sequence: Synthetic coding sequence
atggagttagtcctggtctttctgtgctcactgcttgccccaatggtgctggcatcggcagccgaaaaggagaaagagatggatccttttcattatgattatcaaaccttaaggatcggtggcctggtgtttgcagtagtgctgttttctgtgggtatactcctgatcctctctcggagatgtaaatgcagtttcaaccagaagcccagggccccaggagatgaagaggctcaagtggaaaatttgattaccgcaaacgcaactgagcctcagaaagctgaaaattag

SEQ ID NO: 223797 - DNA, 288 bp, Artificial Sequence
  Description of Artificial Sequence: Synthetic coding sequence
atggagctggttctcgtgtttttgtgctctttactggccccaatggttctcgcaagtgccgcagagaaagagaaggagatggacccgttccactatgattaccagaccttgaggattggtggactggtattcgccgtggttctttttagtgtgggtattctgctgattctttcacggcgatgtaagtgttctttcaatcagaagccaagggctccaggagatgaggaagcgcaggtagagaacctgatcacagcaaacgccaccgagccacagaaagctgagaattag

SEQ ID NO: 223798 - DNA, 243 bp, Artificial Sequence
  Description of Artificial Sequence: Synthetic coding sequence
atggccacccctacacaaacccccacaaaagcccctgaagaacctgatcctttttattacgattataatacggtgcagaccgtagggatgacccttgctaccatcctcttcctgctggggattctgatagtgatctccaagaaggtgaaatgccgcaaggccgactcgaggagcgaaagcccgacgtgcaaaagctgtaagtccgagctgcctagttcggccccagggggtgggggagtgtag

SEQ ID NO: 223799 - DNA, 402 bp, Artificial Sequence
  Description of Artificial Sequence: Synthetic coding sequence
atggtgtcagttggattcggagacagagccggacttggaagttcctgcagatgttcccaaatcacacccgatatggctagtgcggtggccactagatacgtacttggccactggcctcgcgaccatatctgcggatgtggctctcatcaactctcctcatggcgagcagaaccagatggcggtgtgggcatgccccacacattgtctgagcccccttccggccttaccggcatctgggctggtgccttggtaagcccggaaaaacagatgaaggaaaacctccgatctaacgactcagaaccaaggcttcctggcttcgaatcatgcctaattcattctttagccgtctggccatgggcatccaattttgcaagtctgggcccttcggtaaacaagggatag

SEQ ID NO: 223800 - DNA, 882 bp, Artificial Sequence
  Description of Artificial Sequence: Synthetic coding sequence
atgtatttcctaacaccgatcttggtggcaattctttgtatcctggtcgtttggatattcaagaatgctgacagatccatggagaagaagaaaggagaacccagaacaagagctgaagctaggccatgggtggatgaggacctaaaagattcctctgaccttcaccaggcagaggaagatgccgatgaatggcaggagagcgaagaaaacgtggagcacattccgttttcccataaccactatccagagaaggaaatggttaaacgtagccaggagttctacgaactcctgaacaagcggagaagcgtaagattcatttctaatgagcaggtacccatggaggtgatcgacaacgtgatccgcacagcgggaactgctcccagcggcgctcacaccgaaccgtggacctttgttgtcgtgaaggatcctgatgttaagcacaaaatccgaaagattattgaggaggaggaagagatcaattacatgaagaggatgggtcacagatgggtgaccgacttaaaaaaactgagaacgaactggattaaggaatacctcgacacggctccaatcctgatcctcattttcaaacaggtgcatggattcgcagctaatgggaagaagaaagttcactattataatgagatatcggtgagtattgcatgcggcatcttgctggccgctctgcaggtgaataatggcattacaatgaggcaccagaccgctcgacacaggcatctgattgagggccctgggaggtcctccgaagcatgctctaagctctcctctcagggctgtccggaatgtagatccggtgactgccactaccattcttcacagttatggccaagtactgaaggcgctcccggaccaccaaggacctag

SEQ ID NO: 223801 - DNA, 1458 bp, Artificial Sequence
  Description of Artificial Sequence: Synthetic coding sequence
atgggctgcgtgcagtgcaaggacaaggaagcaaccaagctgaccgaagagcgggacggaagcctcaatcagagcagtggttacaggtacgggactgacccaactcctcagcattatccttcttttggcgtgacctccatcccaaactataataactttcatgcagccggagggcagggcttaactgtattcgggggtgtgaattccagcagtcacactggtaccctgcgaacgcggggtgggacaggagttactctctttgttgccctgtatgattatgaagcccgtactgaggagtggtatttcggtaagctgggacgcaaagatgctgaaaggcagctgctctccttcggtaatccacggggtacctttcttatccgggagtctgagaccaccaagggtgcctatagcttgtcgatccgcgactgggacgacatgaagggcgaccacgttaaacattacaaaataaggaagctggacaacgggggttactatattacgacaagagcccagtttgaaaccctccagcagttggtgcagcactattcggaaaaggctgacggcctgtgcttcaatctgacagtcatcgcttcatcctgcactccccagacctcaggcctcgcaaaggacgcatgggaagtcgccagaaggtccctgtgcctggagaagaagttgggtcaagggtgctttgcagaagtctggctcggtacatggaacggaaacaccaaggtcgccatcaaaaccctcaagcctggcaccatgagtccagaaagttttctggaggaggcccagattatgaagaagcttaagcatgacaagctcgtgcagctctatgcagttgtgtcagaagaaccaatttacatcgttaccgaatacatgaataaaggctcgcttctcgactttctcaaagacggagagggaagagctctcaaactgcctaacttagtcgatatggccgctcaggtggctgccggtatggcatatattgagcgaatgaattacatacatcgagatttgcgtagtgcaaatatccttgttggcaacgggctcatatgcaagatagccgatttcgggctcgcaaggctaatagaggataatgagtacaccgctcgccagggcgctaagttccccatcaagtggacagcacctgaagctgcattgtacggccgttttaccatcaagagtgatgtgtggtcatttggaatcctgttgaccgagctagtcactaaaggaagggtgccctatcctggaatgaataaccgcgaagtcctcgaacaggtcgaaaggggataccggatgccctgtccacaagattgccctatttctctccatgagcttatgattcactgttggaaaaaagacccggaggagcgtcctacatttgagtacctccagagctttctggaggactatttcaccgcaaccgagccacagtaccagcctggagagaacctgtag

SEQ ID NO: 223802 - DNA, 1614 bp, Artificial Sequence
  Description of Artificial Sequence: Synthetic coding sequence
atgggctgcgtgcagtgtaaagacaaggaggccactaaattgacagaagagcgggatggctcactaaatcagagttcaggatatcgttacgggaccgatcccacgccacagcactacccaagttttggcgtgacctccatccctaactacaacaactttcatgctgccggtgggcagggcctaaccgtctttggcggagtcaattcatcatcccatactgggacactgcgaacccgtggagggaccggcgtgaccctgtttgttgccttgtatgactatgaggctcgtaccgaggatgacctatcttttcacaaaggcgagaagtttcagattctgaacagctccgagggggactggtgggaagcccgatcactgaccaccggcgaaaccgggtacatccccagtaactatgtcgcgccagtcgactctatccaggctgaggaatggtacttcgggaagcttggaaggaaagatgcggagcgacagcttctctccttcggaaatccccgaggtacgttccttattcgtgagagcgagaccacgaaaggcgcatactcactgagcatccgcgactgggacgacatgaagggcgatcacgtaaaacactacaaaatcaggaagctggacaatggaggctattatatcaccacaagggcccagtttgaaacattacaacagttagttcaacactattccgaaagagccgcaggcctctgctgccggctcgttgtgccttgccacaagggcatgcccaggttgaccgacctgtcagtgaagaccaaggacgtctgggagattcccagggaatccttgcaactcattaagcgcctgggaaatgggcagtttggggaagtttggatgggtacttggaacggaaataccaaagtagcgatcaagactcttaaaccaggcacaatgtcccctgaatccttcctcgaggaggcccagatcatgaaaaagttaaagcacgataaattagttcaactttatgcggtggttagcgaagagcccatctatatagtgacggagtatatgaacaagggttcactgcttgacttccttaaggacggggaaggcagagctcttaaactcccgaacctggtggacatggctgcccaggtggcagccggaatggcctacatcgaacggatgaactacattcacagggatctgagatctgcaaacatcctggtcggaaacgggctgatctgcaaaattgctgacttcgggctggccagactgattgaagataatgagtatacagctaggcagggcgcaaaatttcctattaagtggacagctcccgaagccgctctctacggcaggttcacaatcaagtctgatgtttggagttttgggatcttgctgacagaactcgtgacgaagggaagagtgccctaccctgggatgaataaccgggaagtgctggagcaagttgagcgcggatatcgaatgccctgccctcaggactgccccataagccttcacgagctgatgattcattgctggaagaaagatcccgaggagcggccaacattcgaatatcttcaatccttccttgaggactacttcaccgcaaccgagccgcagtatcagcccggagaaaacctgtag

SEQ ID NO: 223803 - DNA, 1449 bp, Artificial Sequence
  Description of Artificial Sequence: Synthetic coding sequence
atgggttgcgtgcagtgtaaagacaaagaggccactaaactcacggaagaacgtgacggaagcctgaatcagtcatccggctatcgctatggtacagacccaaccccacaacattatccaagtttcggggtgaccagtatcccaaattacaacaacttccacgcagctggtggtcagggactgaccgtgttcggcggagttaactcaagcagtcacaccggtactctgcgtacacgcggtggaacgggcgtcacccttttcgttgcactttatgactatgaggctcgcacagaagacgacctctcattccacaaaggcgagaagttccaaattctgaattcttctgaaggggattggtgggaggctagaagccttactacaggcgaaactggttacatccccagtaattatgtggcgcctgtggatagcattcaagcggaagagtggtattttggcaaattggggagaaaagatgccgagagacagttactatctttcggaaacccacgagggactttcctgataagagagtccgagacaacgaagggggcttatagcttatccatcagggattgggatgacatgaaaggagatcacgtgaaacattacaagattcggaaactcgataatggcggatattacattactacccgcgcacagtttgagaccttgcagcagctggtccaacattactctggcacttggaacggcaacaccaaggtggccatcaaaaccctaaaacccggtactatgtccccagagtcattcctggaggaggctcagatcatgaagaaactcaaacacgataagctggtgcagctatatgccgtggtctcggaagaacccatctatattgtgaccgagtacatgaacaaagggtccctgctggatttcctgaaagatggagaaggccgagctctgaagctgcccaatctagtcgatatggcagcacaggtggctgcagggatggcctatatcgagcgaatgaattacattcatagggatttgcgatccgctaacatcctcgtaggtaacggcctgatttgcaaaattgcagattttggccttgctagactgattgaagataacgaatacaccgccaggcaaggagcaaaattcccaattaagtggacggctcctgaggccgcactatacgggcgtttcacaattaagtccgacgtgtggagctttggaattctgctcacagaactggtgacaaagggacgcgtgccctatcccggaatgaacaatagggaggttctcgagcaggtggaaaggggatacaggatgccatgccctcaggactgccccatctcactgcacgaactgatgatccattgttggaagaaagacccagaggagaggcccacttttgagtatctgcagagctttctggaagattactttactgctaccgaaccccagtatcagcctggcgaaaacctttag

SEQ ID NO: 223804 - DNA, 1614 bp, Artificial Sequence
  Description of Artificial Sequence: Synthetic coding sequence
atgggatgtgtgcagtgcaaagacaaggaagctaccaagcttacggaagagagggacgggagtcttaatcagagttcaggttatcgctacgggacagaccccacaccccagcattacccctcgtttggggtgacgagcataccaaactacaataacttccatgccgctggaggccagggcctgactgtgttcgggggagtcaactcttctagtcacaccggcactctcagaactcgtggcggaacgggcgtgacactttttgtcgccctctatgactatgaggcccgtaccgaggatgacctgtcctttcacaagggggagaaatttcagatccttaatagtagtgaaggtgactggtgggaggccaggtccctgaccaccggggagactggatacatccctagtaattatgtagctcctgtcgattctatccaggcggaggaatggtattttggtaagctagggcgaaaagatgcagaacgccagcttctctctttcggcaacccgaggggaacattcttgataagggagtctgaaaccacgaagggcgcatatagcttgagtattagagactgggacgacatgaagggcgaccacgtgaaacattataagatccggaaactggacaatggcggatactatattaccactagggcacaattcgagaccctgcagcaactcgttcagcattatagtgagcgcgctgcaggcctgtgttgtagacttgttgtcccttgtcataaaggaatgcctaggctcactgatctgtcagttaagacaaaggacgtatgggagataccgcgtgaatccctccagctgattaaaagactggggaacgggcagttcggcgaggtgtggatgggcacttggaacggaaatactaaggttgccatcaagaccctcaaaccaggaaccatgtctccagaatcgtttctcgaggaggctcaaatcatgaaaaagcttaagcatgacaagctggtgcagctatatgcagtggtcagcgaagagcccatttacattgtgacagaatacatgaataaagggtccctactggacttcctcaaggatggcgaaggccgagcactcaaactgcccaatctggtggacatggccgcacaagttgcagccggtatggcttacattgagagaatgaactatattcatagggatctgcggtctgccaacattcttgtcggcaacggccttatttgcaaaatcgcggacttcggtctcgctcggttgattgaggacaacgaatatacagctagacaaggcgcaaaatttcccatcaagtggaccgctcctgaagccgctttgtatggccgtttcaccataaaaagcgatgtgtggagtttcgggattcttctgaccgagctcgtaaccaagggacgtgtcccctatcctggcatgaacaacagggaggtgctggaacaggtggagcgcggttaccgaatgccatgccctcaggattgtccaatctccctgcatgaactcatgatccactgctggaagaaggatccggaggaaaggcctacttttgaatacctgcagtcttttctggaggattactttaccgctaccgagcctcaatatcagccaggagagaacctctag

SEQ ID NO: 223805 - DNA, 1605 bp, Artificial Sequence
  Description of Artificial Sequence: Synthetic coding sequence
atgggatgtgtgcaatgtaaggacaaggaggcgacgaagctgactgaggaacgggacgggagtctcaatcagagctctgggtacaggtacggtaccgatcctaccccccagcactatccgagtttcggggtgaccagcatcccaaattataacaacttccacgcagcgggaggacaagggctgactgtgtttggaggcgttaatagttcatcacataccgggactctgcggaccagagggggtacgggagtgaccttatttgtggccctctatgactatgaggccagaacagaagacgatctttctttccataagggcgagaagttccagattcttaactccagcgagggggattggtgggaagccagatctctgactaccggcgagactggctacattccatctaactacgtggcgccagtggactcaatacaggctgaagagtggtacttcgggaagcttggaaggaaggatgccgagagacagctgttatcgttcggaaaccctaggggaacatttctcatccgggagagtgagacaaccaagggcgcttattctctcagtatacgcgactgggatgacatgaagggggatcacgttaagcattataagattagaaagttggataatgggggttactatatcaccacaagggcccagtttgagacactgcagcagttggtccaacactattctgagaaagcagatggactatgtttcaacctaactgtaatcgcctcctcttgcactccacagactagcgggctggcaaaggatgcctgggaggtggcacgcagaagcctgtgtttggaaaagaagctcgggcaggggtgtttcgccgaggtgtggctaggcacgtggaatggcaatactaaggtggcaattaaaaccttaaagcccggaactatgagccccgagagctttctggaagaagcacagatcatgaagaaactgaagcacgacaaactggtccagctgtatgcagtggtgagtgaagagccaatatacatcgtgacagagtacatgaataaaggttcactactggacttcttgaaagatggcgaggggagagctctgaagctgcccaatctggtcgatatggccgcacaggttgctgctggaatggcttatattgagcgcatgaactatatccaccgggacctcagaagtgcaaatatcctcgttggaaacggcttgatctgcaaaattgctgatttcggtttagcaagacttatagaggataacgagtataccgccaggcagggggcaaagttccctattaaatggacagctccagaagcggcactgtacggccgattcactatcaaaagcgatgtctggagttttggaatcctccttacagagttagtgacaaaaggaagggtgccataccccggaatgaacaatagagaagtcctggaacaagttgagcgcggataccggatgccgtgtccccaggattgccccattagtttacatgagttgatgattcattgctggaaaaaagaccccgaggaaagacccacctttgaatacctccagtcttttctggaagactacttcacagcaactgaaccccagtatcaacctggtgaaaatttgtag

SEQ ID NO: 223806 - DNA, 1605 bp, Artificial Sequence
  Description of Artificial Sequence: Synthetic coding sequence
atgggctgtgtgcagtgtaaagataaggaggccacaaaactaactgaggagagagacgggtctctcaaccagtcctccggataccgatatggcactgatccaaccccccaacactatccctcattcggcgttacatccatccccaattataataacttccacgcggcaggaggtcagggccttacagtgtttggcggagtgaatagttcatcccacaccggaaccctgcgtaccaggggaggaaccggcgtgacgctattcgtcgctctgtacgattatgaagccaggaccgaggacgacctgtcattccacaaaggggaaaagttccaaatcctcaattcaagcgaaggggactggtgggaggcacggtcacttaccaccggcgaaacgggctacattccttcgaattacgtagcccctgtggacagtatacaggccgaagagtggtatttcggcaaattggggagaaaagacgccgagaggcagctgcttagttttggaaacccgcgaggcacttttctcattagggagtctgaaacaactaagggggcttattcactttctatccgggactgggatgacatgaagggagatcatgtaaaacactacaaaatcagaaaacttgataatggcggatactacataacgacccgtgcccagtttgagaccttacagcaactggtccagcattattctgaaaaagccgacggcttatgtttcaatctgaccgtcatcgccagctcttgtaccccccaaacttcaggactcgccaaggacgcctgggaagtcgcccgaagaagtctctgcctagagaaaaagctgggtcaagggtgtttcgcagaggtctggctaggcacgtggaacggcaacaccaaggttgcgatcaagaccctcaagccaggcaccatgtcaccagaaagttttctggaggaggctcaaatcatgaaaaaactgaaacatgataagctcgttcagctgtatgccgtggtatctgaggagccgatttatattgtcacagagtacatgaataaaggttctttactggattttctgaaggacggcgaaggaagggcattaaagctcccgaatctagtagacatggctgctcaggtcgcagctggcatggcctatattgagagaatgaattacatccaccgcgaccttcggagtgccaatatcctggttggaaacggccttatctgtaagatagcagacttcggtttggcaagactcatcgaggacaatgagtacactgcaaggcagggggcaaaatttcccataaaatggactgccccagaagccgctctgtatgggagatttacgatcaaatccgacgtttggtctttcggcattctcttgacagagcttgtgaccaagggcagggtgccgtaccctggaatgaacaatcgggaggttctagaacaagtggaacggggatatcgtatgccctgtcctcaagattgccccattagtctgcacgagttaatgatccactgctggaaaaaagatcccgaggagcgcccaaccttcgagtacttgcagtctttcttagaggactattttaccgcgactgaaccccagtaccagccaggagagaatctctag

SEQ ID NO: 223807 - DNA, 363 bp, Artificial Sequence
  Description of Artificial Sequence: Synthetic coding sequence
atggggtgcgtgcaatgtaaggataaagaggcgactaagctcactgaggaaagggacggatcattgaaccagagctcagggtatcgctacggaacagacccaacccctcaacactacccaagctttggagtcaccagcatcccaaactataataattttcacgccgctggagggcaaggcctaacagttttcggcggtgtgaactccagctcacataccggaactctccgtactcgagggggaacaggtgttacccttttcgtcgcgctgtatgactacgaggcccgaactgaggatgatctgagcttccataagggcgagaaatttcaaattctcaacagcagcgagggggattggtggtag

SEQ ID NO: 223808 - DNA, 699 bp, Artificial Sequence
  Description of Artificial Sequence: Synthetic coding sequence
atggggtgcgtgcagtgcaaagataaggaagcaaccaagctcactgaggaaagagacggttctctaaaccagtccagtggatatagatacggtacagatcccaccccccagcactaccctagcttcggagtcacttcaataccaaactataataacttccacgcagcaggtggacagggcctgactgtgttcgggggtgtcaactccagttctcatactggcaccctgagaacaaggggcggtacaggcgtaaccctattcgttgcactctatgactacgaggctaggactgaggacgacttgtcatttcacaaaggggaaaaattccagattcttaatagttcggagggagattggtgggaagcacgaagtctgactacgggagagacagggtacataccttcaaactatgtagcgcctgtggactctatccaggccgaggaatggtactttggaaaactgggacgtaaggacgccgaacgacaactgttaagtttcggtaacccacgcggaacctttctgattagggagagcgagacaactaagggcgcttattctttatccattcgcgattgggacgacatgaagggagaccacgtgaagcactacaaaattaggaagcttgacaacggaggttactacatcaccacaagagcccagtttgagacactgcagcagttggttcagcattattcctag

SEQ ID NO: 223809 - DNA, 321 bp, Artificial Sequence
  Description of Artificial Sequence: Synthetic coding sequence
atgggatgcgtccaatgcaaagacaaagaagctactaaactcactgaagaaagagatggctccctcaatcagagctccggttacagatacggaactgaccctaccccacagcactatccctcatttggcgtgacttccatccctaattacaacaactttcatgcagcaggtggacagggtctgaccgtgtttggcggagtgaatagctcttctcacactgggacactgagaacccggggaggaacaggagttacacttttcgtagccctctatgattatgaggccaggactgaggacgatttatcctttcacaaagggtag

SEQ ID NO: 223810 - DNA, 198 bp, Artificial Sequence
  Description of Artificial Sequence: Synthetic coding sequence
atgggctgtgtacagtgtaaagataaagaggccaccaagttaaccgaggagcgcgatggatcgctcaatcagagttctggctacagatacggcacagatccaaccccgcaacattacccctccttcggcgtgacttccatacccaattacaacaattttcatgccgcaggaggacagggcctgactgtcttcgggtag

SEQ ID NO: 223811 - DNA, 528 bp, Artificial Sequence
  Description of Artificial Sequence: Synthetic coding sequence
atgggttgtgtgcaatgtaaggataaagaggctaccaagctcacagaagagcgagatgggtcacttaatcaaagctctgggtatagatatggcaccgatcccacaccacagcactaccccagctttggtgtcacctccatcccaaactacaataactttcacgcggcaggagggcagggattgaccgtttttggcggtgtgaacagctcatctcacacgggaaccttgcggacccgaggtggaacgggagtaacactgttcgtagcgctctacgattatgaagccaggacagaggatgacctgtctttccataaaggtgaaaaatttcagatcctgaactcttctgagggggattggtgggaagccaggtctctgaccactggcgagacggggtatatccccagcaattacgttgcacctgtggatagcatccaagctgaggagtggtactttggaaagcttggtcgtaaggacgcggagcggcaattgctctcctttggtaacccacggggaacgtttctgatatag

SEQ ID NO: 223812 - DNA, 462 bp, Artificial Sequence
  Description of Artificial Sequence: Synthetic coding sequence
atgggctgcgtgcagtgtaaggataaagaggccactaagctgaccgaggaacgagacggaagcttaaaccagagctctgggtacaggtacggaactgatcctacgccccaacattaccctagctttggtgttacaagcatccctaattataacaatttccacgccgcagggggacaaggcctgacagtgtttggtggggtgaatagctccagccataccggtaccctaaggaccagggggggaaccggcgttacgctgttcgtcgccttgtacgactacgaagctaggacagaggatgacctgtcttttcacaagggtgagaaattccagatcctaaacagcagcgagggagattggtgggaggcgagaagcttaacaacaggggagactgggtatataccatcaaactatgtcgctccggttgacagcatccaagctgaagaatggtacttcgggaagtag

SEQ ID NO: 223813 - DNA, 357 bp, Artificial Sequence
  Description of Artificial Sequence: Synthetic coding sequence
atgggctgtgttcagtgtaaagacaaagaggccaccaagctgactgaagagcgggatgggtcactgaaccaatcttcagggtatagatatggaactgaccccactccccagcattatccttccttcggcgtcacatccatccccaactataacaactttcacgccgcaggcggtcagggcctgacagtgttcggaggggtgaattcctctagtcacaccggcacgctgcgcactcggggtggtacaggcgtcaccctctttgtggccctgtacgattacgaggctcgtacggaagatgatctgtcctttcacaagggggagaaatttcagatcctcaattcatccgaaggagattag

SEQ ID NO: 223814 - DNA, 561 bp, Artificial Sequence
  Description of Artificial Sequence: Synthetic coding sequence
atgggttgtgtgcagtgcaaggataaagaggccacaaagttgaccgaagagagggatggatctctaaaccagtctagtggatacagatatgggacggatccgactccccagcactatcccagttttggggtcactagcatccccaattacaacaactttcatgctgccggaggccaaggcttaactgtatttgggggagtcaattcctccagccacactgggacactccgcaccagggggggaaccggtgtgacactctttgtggcattgtacgactatgaagcgcgtaccgaggatgacttgagtttccacaaaggagagaaatttcagatcctgaatagtagcgaaggcgactggtgggaagcacgtagtctcaccaccggggaaactggatacataccctccaattatgtcgcgccagtcgactctattcaggctgaggagtggtactttggcaaactggggagaaaggacgcagaacgccagctgctctcattcggaaaccccagggggacgttcctgattcgcgagtccgagactaccaaaggcgcatactcttag

SEQ ID NO: 223815 - DNA, 312 bp, Artificial Sequence
  Description of Artificial Sequence: Synthetic coding sequence
atgggctgcgtgcagtgtaaagacaaggaggccacaaaactgactgaggagcgggatggaagcctgaatcagtcatctggatatagatacggcaccgacccgaccccacagcactatccctccttcggggttaccagcattcccaattacaacaattttcacgccgctggaggtcaggggctgacagtatttgggggagtcaatagcagctctcacacaggcactttgcggacaagaggaggtaccggggtaacgctctttgtggccctgtacgactacgaggcgcgaacagaggatgatctttcattctag

SEQ ID NO: 223816 - DNA, 459 bp, Artificial Sequence
  Description of Artificial Sequence: Synthetic coding sequence
atgggttgcgtgcagtgcaaggataaagaagctaccaaacttaccgaggagagggacggctcattgaatcagtcatccggatatcggtacgggacggacccgacaccacagcattacccaagtttcggcgtgacttctatacccaactacaataacttccatgccgctggcggtcagggactgactgtgtttggcggtgtcaatagttcctctcatacaggcactctgagaacccgtggtggaactggcgtgacacttttcgttgccctgtatgactatgaggccaggactgaggacgatctcagtttccacaagggagagaaatttcagatcctcaactcgagtgaaggcgactggtgggaagcacggtctctaaccaccggagagacagggtatatcccaagtaactatgtcgctcctgtggacagcattcaggcggaggaatggtatttcggatag

SEQ ID NO: 223817 - DNA, 351 bp, Artificial Sequence
  Description of Artificial Sequence: Synthetic coding sequence
atgggatgcgtgcagtgtaaagataaggaggcaaccaagctgacagaggagcgggatggctccttgaaccagagctcaggataccgctatgggactgacccaacgccccaacattaccctagttttggtgtgactagcatccctaattataataatttccatgctgcgggagggcaaggcctgaccgtgtttggtggggtgaattcatccagtcacacaggcactttgcgaacgagaggcggtacaggagttacactgttcgtcgccctctacgattatgaggccaggactgaggacgacctttcctttcataagggtgaaaagtttcaaattctcaattcttccgaatag

SEQ ID NO: 223818 - DNA, 423 bp, Artificial Sequence
  Description of Artificial Sequence: Synthetic coding sequence
atgggttgcgttcaatgcaaagataaggaagccacaaagctgacagaggaaagggacgggtctttgaatcaaagcagcggatacaggtacgggaccgatccaaccccacaacactacccaagcttcggggtcacatccatacctaactacaataactttcatgccgcaggcggacaaggcttgaccgtctttgggggagtaaattcttcttctcacaccggcactctgcggactaggggaggtacaggcgtcaccttatttgttgcattgtatgattatgaggctcggacggaagacgatctcagctttcacaagggcgagaaatttcagattctcaactctagcgagggtgactggtgggaagcaaggagcctgacaacaggcgagacaggctacataccgtccaattacgtcgccccttag

SEQ ID NO: 223819 - DNA, 438 bp, Artificial Sequence
  Description of Artificial Sequence: Synthetic coding sequence
atgggatgtgtgcagtgcaaggacaaagaggctactaagctcactgaagagcgggatggtagtctgaaccagtcaagcggttacaggtatggcacagacccaactcctcagcattatccttcttttggcgttacctctatcccaaactacaataactttcacgctgctgggggtcagggtctgacagtctttgggggagtcaattccagcagccataccggaaccctgagaacccgaggcggtactggcgttaccttgtttgtggccctgtatgactacgaggccagaacagaagatgacctgtccttccataaaggagagaagtttcagattcttaatagtagtgagggcgactggtgggaggcaaggagccttactacgggcgagacaggctacattccttcaaactacgtcgcccctgttgactcaatccagtag

SEQ ID NO: 223820 - DNA, 1605 bp, Artificial Sequence
  Description of Artificial Sequence: Synthetic coding sequence
atgggatgtgtgcagtgcaaggataaggaggctacgaaactgaccgaagagagggacgggagcctcaaccagtcatctggctaccgttacggcaccgaccccacaccccagcattacccctctttcggggtgactagcatccctaactataataattttcatgcggcaggcggacagggcctgacagtgtttggcggagtgaatagcagcagccacaccggcactctacgcactcggggagggacgggcgtaaccctttttgtcgccctgtacgactacgaggcccgaactgaagatgacctctctttccataagggagagaagtttcagatcctgaacagttccgagggtgactggtgggaagcccgatccctgacgactggagaaacagggtacatcccctccaactatgtggcaccggtagatagtatccaggctgaggaatggtatttcggcaagttggggagaaaggacgctgagaggcagctgctttcctttggcaatccccgtggaaccttcctgatccgcgagagtgaaactacaaaaggggcatacagtctgtcgattcgggactgggacgatatgaagggagaccacgttaaacattacaagatacgtaagctggataacggtggctattatattacgaccagagctcagtttgagacactccagcagctggtccagcactatagcgagaaggctgatggcctctgcttcaatctgacggttattgcctcaagctgtacaccccagaccagcggtctcgctaaggatgcatgggaggtggcacgcaggagtttgtgcttggagaaaaagttaggtcaggggtgcttcgccgaagtatggctgggcacctggaatgggaacactaaggttgccatcaagacgttaaagcccggaactatgtctcccgagtcattcctcgaagaagcccaaattatgaagaagctaaaacacgacaaattagtccagttatatgcagtggtctccgaggaacctatctacatcgtgaccgagtacatgaacaaaggatctctgctagacttcctcaaggatggggaaggcagggccctgaagttgccaaaccttgtggacatggccgctcaagtcgccgctgggatggcctacattgagcgcatgaattatatccaccgagacttaaggagtgcgaatatccttgtggggaacggtctaatttgcaagattgccgactttggcctggctcggctaatcgaagacaacgaatatacagcaagacagggggctaaatttccaattaagtggaccgcgcctgaagccgcactgtatggaagattcacaatcaagtccgatgtgtggtcctttggaatcctgctgacggaactggttaccaaaggacgcgtgccttaccccggtatgaataatcgcgaagtattagaacaagtggagcgtgggtatcggatgccttgtccacaggattgtcccatcagccttcacgaattaatgatacactgctggaaaaaggaccccgaagagagaccaacattcgagtacctgcagtccttcctggaggactatttcaccgcaaccgagccgcagtatcagcctggtgaaaatctgtag

SEQ ID NO: 223821 - DNA, 1458 bp, Artificial Sequence
  Description of Artificial Sequence: Synthetic coding sequence
atgggatgcgtccagtgcaaagacaaagaagccactaagctgaccgaagaaagagacggcagtttaaaccagtcctctggatacaggtatggcaccgaccccacaccacagcactatccctcgtttggagtgacctcgatccccaattataataatttccatgcagctgggggtcagggactgactgtgtttggaggggtcaattcaagcagccatacaggcacactgcggacgagaggtggtacgggtgtaacgttgtttgttgcattatatgattatgaagctcaagctgaggagtggtactttgggaaactgggccgaaaggatgcagaaagacagctgctgtcgtttggcaatccgagggggaccttcctgattcgtgaatcagagacaactaaaggggcttatagtctcagcattcgcgattgggacgatatgaagggggaccacgtgaagcattataagattcgcaaattagacaatggtggatattacatcactacccgagctcagttcgaaactttgcaacagcttgtgcagcactactcagaaaaagccgatgggctgtgtttcaatttgactgtgatagcctcttcgtgcaccccacagacaagcgggctcgcgaaagacgcttgggaggtggccagacggtccctttgtctggagaagaagttggggcagggctgtttcgccgaggtttggctgggtacttggaacgggaacacaaaagtagccatcaagactctcaagccaggtaccatgtccccagagagcttcctggaggaagcgcaaatcatgaagaagctgaaacacgacaagctagtgcaattatatgcagtggtatcagaggaaccaatatacatcgtcaccgaatacatgaacaaaggctctttactcgacttccttaaggatggcgaagggagggcacttaagcttcctaacctcgtagacatggcagcacaggtcgctgcaggcatggcatacatagaacggatgaactatatccatagggacctgagaagtgcgaacattctagttggaaacggactgatttgcaaaatcgctgatttcggattggcacgcctaattgaggacaacgagtacacagcccgtcagggagccaaattcccaattaaatggaccgccccagaggcagctctgtatggcaggtttaccataaagtccgatgtgtggagcttcgggatacttctgactgaactagtgaccaagggccgtgtcccatatccgggaatgaacaaccgggaagtgttggaacaggtcgaacgcggatatagaatgccgtgcccgcaggactgtcctataagcctgcacgaactgatgatacactgctggaagaaggaccctgaggagaggcctacttttgagtatctgcagtcattcctggaggactactttaccgcaactgagccacagtaccagccaggcgagaacctgtag

SEQ ID NO: 223822 - DNA, 4437 bp, Artificial Sequence
  Description of Artificial Sequence: Synthetic coding sequence
atggcatctacaaacgccgagtcccagttacagcgtataatacgcgacctccaggatgctgtcacggaactctcaaaagagttccaggaggcaggcgagcctattacggatgacagcacgagcctgcataagtttagctataaactggagtatctgctccagttcgaccaaaaagaaaaagccaccttactcggtaacaaaaaagattactgggattacttctgtgcgtgcttagctaaggttaagggtgcaaacgacggcatccggttcgtgaagtcaatttccgaactgcgcacgtcgcttggtaaagggagagcctttatccgatattccctggtgcaccagaggcttgccgatacactccaacagtgcttcatgaacacaaaggtcactagtgactggtattatgctcggagtcctttcctgcagcccaagctttcatctgacatcgtcgggcagctatatgaactgaccgaggtacaatttgatctcgcctcaagagggttcgaccttgatgccgcatggccaacgtttgccagacgcaccctgactacaggctcctcagcttatctttggaagccccctagccgatcatcttcgatgtcttctctggtaagttcttatttacagacccaggagatggtctctaacttcgacctgaacagtccgctgaataacgaagctctggaaggcttcgacgaaatgaggctggagctcgatcagctcgaagtgcgagagaaacaacttagggagcgcatgcagcagctggacagggagaaccaagagctgcgggctgctgtatctcagcagggcgaacagctgcagaccgagcgcgagaggggcagaaccgccgcagaagacaacgttagattaacttgcctcgtggccgaacttcagaagcagtgggaagtcacacaagccacgcagaacacagtgaaagaactacaaacctgcctgcaaggcctcgaactgggagcagccgaaaaggaagaagattaccacacggcacttaggagactcgagtccatgctgcaacccctcgctcaagaacttgaagctacgcgcgattcactcgacaaaaaaaaccagcacctggcgtccttcccgggatggcttgcgatggctcagcaaaaggccgataccgcttccgatactaaaggacgccaagagcccattccttccgatgcagcgcaggaaatgcaggagcttggagaaaagctccaggccctggaacgggagagaacgaaggttgaagaggtgaatcggcagcaatccgcacagctggagcagctggtcaaagaactccaactgaaggaggatgccagagccagtcttgagcgcctggtgaaggagatggcaccattacaagaggaactgtcaggaaaagggcaggaggcagaccagctgtggcggaggctgcaagaactactggcacatacttctagttgggaagaagaattggccgaactgcgacgtgagaaaaagcagcaacaggaagagaaggaacttcttgaacaggaagtgaggtcattaaccaggcaacttcaatttctggagacacagcttgcccaggtaagccagcacgttagcgacctcgaagagcagaagaagcagcttatacaagacaaggaccatctgtcccagcaggtggggatgttggaaagactggcaggtcccccagggcctgaattacccgtggcaggcgaaaagaatgaagccttagtccccgtgaactcaagtctccaggaggcctggggaaaacctgaggaggagcagcgtgggctccaggaggcccagctcgatgacaccaaggtgcaggaaggaagtcaagaggaggaattgaggcaggcaaaccgcgagttagagaaggaactccagaatgtcgtaggtagaaaccaacttctggagggaaaactacaggcactgcaggccgattatcaggctctccagcagcgagagagcgctattcagggcagtttggcctcactggaggccgaacaggcgagcattcgtcatctaggagaccagatggaggcttctctgctggcagtacgcaaagccaaagaggcgatgaaagcacagatggcagagaaggaagccattcttcagagcaaggagggtgagtgccagcagctgagagaggaggtggagcagtgtcagcagctggctgaagcgagacaccgagaactgcgcgctctggagtcacaatgccagcaacagacacaactcatcgaagtcctgactgctgagaagggccaacagggagtgggaccgcctacagataacgaggctcgcgagctggccgctcaactggccctcagccaggctcagcttgaagtgcaccagggggaggtgcagcggctacaagctcaggtggtggatctgcaggccaagatgcgcgcagccttggacgaccaggataaggtacagagccagctgtctatggcggaagcagtgctccgtgaacacaaaacccttgtgcagcagctgaaagaacagaacgaggccttaaaccgcgctcacgtacaggaactgctgcaatgttcagaacgcgagggagcactacaggaagagcgagcagacgaagcccagcaaagggaggaggaactcagagcgcttcaggaggaacttagtcaggctaagtgctctagcgaggaggcacagctggagcatgcggagctgcaagagcagttgcaccgggctaatactgataccgccgaacttggtatccaggtgtgcgcactgacagttgaaaaagaaagggtggaagaggccctggcctgtgccgtgcaggagttgcaagatgctaaagaagctgcgtctagggaaagagaaggcctcgaacggcaggtggcaggcctccagcaggagaaggagtctcttcaagaaaagctcaaggccgctaaagctgctgccggttcccttcctggtctacaggcccagcttgcccaggcagaacagcgagcccaatccttgcaggaggctgcccatcaagagctaaacactctcaagttccagctttcggccgaaatcatggactatcagtctcgactgaaaaacgcgggagaagagtgcaagtccctgcgagggcagttggaggaacaggggaggcagcttcaggccgctgaggaggctgtcgagaaactgaaggccactcaagccgacatgggggagaaactttcctgcacctccaatcacctggccgagtgtcaggcagccatgctgaggaaagacaaggagggtgctgcactaagagaggatctcgagcggactcagaaagagcttgagaaagccaccactaaaatccaggagtattacaataagctgtgccaggaggtgaccaaccgggagcgcaatgaccagaaaatgctggccgatctggatgacctgaatagaacaaaaaagtatcttgaagagaggttaattgaattactgcgggataaagatgccttatggcagaagtccgacgctttagagttccaacaaaagctaagcgccgaagagcgttggctgggcgataccgaggcaaaccattgtttagattgtaagcgggaattttcatggatggtgcgacggcatcattgccgaatctgcggtagaatcttctgttattattgctgtaacaactacgtcctcagtaagcacggcggtaagaaggaacggtgttgcagagcttgttttcaaaaactgtccgagggtccgggatcacctgactcctccggctcggggaccagtcagggtgagccatcccctgccctgtcccccgctagccctggaccacaagctaccggtggacaaggggcaaacaccgattataggccacctgacgatgcagtattcgatattatcaccgatgaagagctctgccaaatccaggagtctggatctagtttgcccgaaactcctactgaaaccgattcacttgatccaaatgccgcagagcaagacactacatctacaagcctgaccccagaggacacagaggatatgcccgttgggcaggacagtgagatttgcctcttaaaatccggtgagctcatgatcaaggtgcccttaacagttgacgagatcgcctcgttcggtgagggatctcgggagctcttcgtcaggtcaagcacctactcactgatccctatcacagttgcagaggctggtctcacaatcagttgggtgttctctagtgatcctaagtctatcagtttcagtgtggtgtttcaggaagcagaagacacacccctagatcaatgcaaggtgcttataccaacgactcggtgcaacagtcacaaagaaaacatccaggggcagttaaaggttcggactccaggcatttatatgctgatcttcgacaataccttcagccggtttgtttctaagaaggtcttctatcatcttacagtagatcgaccagttatctacgacggcagcgacttcctgtag

SEQ ID NO: 223823 - DNA, 804 bp, Artificial Sequence
  Description of Artificial Sequence: Synthetic coding sequence
tgatccaagcacggtggcaagaaggagcgttgttgtcgcgcttgttttcagaaactgtccgagggccctggatcacccgactcatctgggagtggcacatcccaaggagagccatctccggctttgagcccagcaagccccggacctcaggctaccgggggacaaggagcgaacaccgattatcggccaccagacgacgccgtttttgacatcatcacagacgaggagttgtgccaaattcaagaatccggctcctcattaccagagacacccactgaaacagattcgcttgacccgaacgccgcagagcaggacaccacatctacaagtctgacaccggaagacaccgaggatatgccggtgggtcaagattctgaaatttgtctccttaaaagtggtgagttgatgataaaggtacccttgactgtagacgagatcgctagctttggcgagggctcccgtgaactttttgttcggagctctacttattccctcattcctatcactgttgccgaagcaggccttaccatcagttgggtttttagcagtgaccctaagagcatttcctttagtgttgtcttccaagaggcagaggacacccccttggaccagtgtaaggttctgattcccacaacgcgttgtaactcacataaggaaaatatacagggccagctgaaggtaaggacacccggtatctatatgttaattttcgacaataccttctcccgcttcgtcagcaagaaggtcttctaccatctgaccgttgaccgcccagtgatctatgatggctcagacttcctgtag

SEQ ID NO: 223824 - DNA, 4497 bp, Artificial Sequence
  Description of Artificial Sequence: Synthetic coding sequence
atggccagtacaaacgctgagtcccagctacagcggattattcgcgaccttcaggacgccgttactgagctttcaaaagaatttcaggaggccggagaacccatcaccgatgattcaacctccttacacaagttttcctacaaactggagtatttactccagttcgaccagaaggagaaagccaccctattgggtaataagaaggactactgggactacttctgtgcctgcctagctaaagtgaagggagccaacgatggcatcagattcgtcaaaagcatttctgagcttaggacctccttggggaaaggaagggccttcataagatactctctagtgcaccagcgtctggcagacacgcttcaacagtgtttcatgaacaccaaggtgacttcagactggtactatgcgagatccccatttctccagccgaagctatcatccgacatcgtggggcaattgtacgagcttacagaggtgcaattcgacctggcctctcgcggattcgacctggacgctgcatggcctacttttgcccgaagaactttgaccacaggttcgtctgcatacttgtggaagccgccatcaagatcctccagcatgtcatctctggtgtcaagttatctgcagacacaggaaatggtgtcaaatttcgacttgaattcaccattgaataatgaagcgcttgagggctttgacgaaatgcgactggaacttgaccagctcgaggtcagggagaagcagttgcgggagagaatgcagcagcttgatagggaaaatcaagagctgagagccgctgtgagtcagcagggcgaacagctgcaaactgaacgcgaacgcggtcgaacagctgcagaggacaatgtacgacttacctgtttggtggcagagttacaaaagcagtgggaagtcacacaggccactcagaatactgtgaaagaactgcagacgtgcctccagggccttgagctgggagcagccgaaaaagaggaggactaccatactgccctgcgccgactggaatcaatgctgcagcccttggcacaagaacttgaagctacaagggattcactggataagaaaaaccagcacctggcttcatttcctggctggctcgctatggcccaacaaaaagccgacaccgcctcagatacgaagggtcgacaggaacccatcccttccgatgcagcccaagagatgcaggagttaggagaaaaactgcaagccctagagagagagcgaactaaggtcgaagaggtgaaccgccagcaatccgcacagttggagcaactggtaaaagaactgcagctcaaggaggacgccagagccagcctggagcgcttagttaaagagatggctcccctgcaggaggagcttagcggtaaggggcaagaagctgatcagctctggcgacggttgcaggagttgctggcccacactagctcctgggaggaagaacttgccgagctgcgtcgcgagaaaaagcagcagcaagaggagaaagaactgctcgagcaggaagtgcgcagcctgacacggcagctccagttccttgaaactcaacttgctcaggtgagtcagcacgtgagcgatctcgaggagcagaagaaacagctgattcaggacaaagaccacttatcccaacaggtaggcatgctggaacgcctggcgggacccccaggaccagaactccctgtggcaggagaaaaaaacgaagcgttagtgcccgtcaattcatccctgcaagaggcttggggtaaacccgaggaagaacaacgcggtctccaggaggcccagctggatgatacaaaggtccaagagggcagtcaggaagaagaactcagacaggcaaacagagagctcgaaaaggagctccaaaacgtggtgggtcgcaaccagctgctggagggcaaactccaggctctgcaggcagattaccaggccctccaacaacgcgaatccgccattcaaggtagcctggcaagcttggaggccgagcaggcctccatcaggcacttaggcgatcaaatggaagcatcactcttggcagttaggaaagcgaaagaggcaatgaaagctcaaatggcggaaaaagaagcgatcctgcaatcaaaagagggggaatgccagcagctgagggaagaggtcgagcagtgtcagcagctagctgaggcgaggcacagggagctgcgagcattggagagtcaatgtcaacaacaaacacaactcattgaagtcctgaccgccgagaaggggcagcaaggagtcggcccaccgacggataacgaagcgagagagcttgctgctcagctggccctgtcacaggcccagttggaggtgcatcagggcgaggttcagcgcctgcaggcacaagtagtggacttgcaggcaaagatgagggcagcgctggacgaccaggacaaagttcagtcccaactgagcatggctgaggcggttctgagagagcataaaacactcgttcagcagctcaaggagcagaacgaggccctcaaccgtgcccacgttcaggagcttttacagtgctccgagagggagggagcccttcaagaagagagggccgatgaggcccagcagagggaggaggagctgagagcactgcaggaggaactcagccaggccaaatgctcaagcgaagaagcccagttagaacacgccgaacttcaggaacagttacaccgcgctaatacagatacagccgagttaggaattcaggtgtgcgccctaactgttgaaaaggaaagggtggaagaggcactagcatgtgctgtccaggagttgcaggatgccaaagaggccgcttctagggagcgagaagggctggagcgacaggtggcagggctgcaacaggagaaagagtctttgcaagagaagctgaaggccgcaaaagctgctgcagggagcctgcctgggctccaggcacagctggctcaggctgaacaaagggcccagtctcttcaggaagcagcccatcaggaactgaataccttgaagttccagctctccgccgaaattatggactatcagagcaggttaaagaatgccggagaggagtgtaagtcattgagaggtcagttagaggaacagggcaggcagctccaggctgccgaagaagcggtcgaaaagctgaaggccacgcaggccgatatgggtgagaaactttcatgcacctctaaccacttggcggagtgccaagccgctatgctgaggaaggataaagaaggtgctgcgctgagggaagacctggagagaacacagaaggaactggagaaagcaacaacaaagattcaagagtattacaataaactatgtcaggaggtgaccaatagagagagaaacgaccagaagatgctagccgatttggatgatcttaacaggaccaagaagtacttagaagaaaggctaatcgagctgctacgcgacaaagacgctctctggcagaagtcagacgccctggaatttcagcagaagctaagcgccgaagaaaggtggctgggcgatactgaggctaaccattgccttgactgtaagcgtgaattcagttggatggtgcgcagacaccactgtcggatctgcggccgtatcttttgttactactgctgcaataactacgtgttgagtaaacacggaggaaagaaggaaaggtgttgccgcgcttgtttccagaagctgtcagaagggcctggctcccccgactctagcgggtccggcacttcccagggggagccaagccccgcactctcgcccgcttctccaggccctcaggccacaggagggcagggagcgaacaccgattatcgacccccagacgacgccgtcttcgatattataactgatgaagagctttgtcaaattcaggaaagcggttccagcctgccagagacccctacagagactgattcactcgatcctaatgctgctgaacaggcctccgtcggcgctagtaagggacttggaaacctactgtgcgaaagctcagcgtgccgagacaccacaagcacatccctaaccccagaggataccgaggatatgccggtgggccaagacagcgagatatgcctccttaagagcggggaattaatgattaaagtgccgctcaccgtggacgaaatcgcgagttttggagagggtagtagagagttgttcgttcgttcctctacttattccctcattcccattacagtcgccgaggcgggtctgaccatctcttgggttttttcaagcgatccaaagagcatttccttttccgttgtgttccaggaagcagaagacactcctcttgaccagtgtaaagtgctcattccaacaacgaggtgtaactcacataaagagaacattcagggtcaacttaaggttcggaccccaggaatatacatgcttatctttgacaatacatttagcagattcgttagcaagaaggtgttctatcacctcacggtggacagaccagtgatttatgacggctccgatttcctgtag

SEQ ID NO: 223825 - DNA, 2886 bp, Artificial Sequence
  Description of Artificial Sequence: Synthetic coding sequence
atgcatgggcatcgcgcacctgggggagctggcccaagcgaacctgagcaccctgcaaccaatccgccaggcgctgctcctcctgcatgtgccgatagcgatcccggtgctagtgaacccggactccttgcccgtcggggttctggctccgcactgggtggccctttagatccacaattcgtgggaccgtctgatactagcctaggggctgcacccggacatagggtgttgccttgcggcccttcccctcaacaccaccgtgctctccgctttagctaccatttagagggaagccagccgcgtcccggactgcatcagggcaaccgcatcctggtcaaatcgctgtcattggaccccggtcagtccctagaaccacatcccgaaggtccacagagactccggagcgaccccggacctccaacagaaacgccaagccagcgtcccagccctctgaaacgggctcccggacctaaaccccaagtcccaccgaaacccagttacctccagatgcccaggatgccaccacctctggagccaatcccccctcctccctcgcgacccctccccgctgatccgagggtggccaagggtttggcacccagggctgaagctagtccatcaagtgccgctgtttcttccctcattgagaagttcgagcgagagcccgtgattgtcgctagtgaccgtcctgtccctggcccatccccaggaccgcctgaacctgtgatgctgccacaaccgacaagccaaccccctgtaccccagctcccggaaggagaagcgagtagatgcctgtttcttctagcccctggccctcgagatggcgagaaagtgccaaatcgcgattcgggaatcgatagcatctcgagcccaagtaattctgaggaaacctgtttcgtgtcggatgacggcccacccagccattcattgtgcccaggacctcctgctctggcatctgttccggtcgctttagctgatccacatcgcccaggatcacaggaggtagactctgatcttgaggaggaggacgacgaggaggaggaggaggaaaaagatcgggaaatcccagtcccattaatggagcgtcaagaaagtgtcgagcttaccgtgcaacaaaaagtgtttcacatcgccaacgaactcttacaaacagagaaagcatacgtgagtaggctgcatcttctcgatcaggtgttctgcgctagactgctggaggaggccagaaaccgctcctctttcccagcagacgtggtgcatggaatattctccaatatctgttccatctattgtttccaccagcagttcctactgcccgaattggagaagaggatggaagaatgggacaggtatcctaggataggagatattctccagaagttagcacctttcctcaagatgtatggagagtacgtgaagaattttgatcgcgctgtcgagctcgtaaatacatggacagagcgctcgacgcaatttaaggtgataatccatgaagtccagaaagaggaggcgtgcggaaatttgacactacagcaccacatgctcgagccagtgcagcggatcccaagatatgagctcctgctcaaggattatctgctgaagttaccccatgggagccccgactccaaagacgcccaaaagtcattggaactgattgcgaccgcagcagagcactccaatgccgctattcggaagatggaacgaatgcataagttgcttaaggtttatgaactcttaggaggggaggaggacattgtctcccctacaaaagagttgattaaagaggggcatatcttgaaattgtcagccaagaacgggactacgcaggaccgctacctcatacttttcaacgatagacttctatattgcgtgcccaggttgcggcttctcggtcagaaattctccgtgcgagcgcgaattgacgtagatggtatggagttaaaggagagttcgaacctcaatctccctcgaacatttctcgtgagtggaaaacagcggtcactggaactgcaagcccgaaccgaggaagagaagaaggattgggtccaagctatcaattcgaccttattgaagcatgagcagacattggaaacctttaaactcttaaattctacaaatagagaagacgaagacacaccaccgaacagccctaatgtcgacttaggaaagagggccccaacaccgattagggaaaaagaggttacgatgtgcatgagatgccaagaaccctttaattccatcactaagcggaggcatcattgtaaagcctgtggtcacgtggtatgcggcaagtgtagcgaatttcgggcaaggctggtgtatgacaacaatcggtctaatagggtctgcacggactgttatgtagccctccatggggtgcccggaagcagcccagcctgttcgcagcatacccctcagagaaggaggtcaattcttgaaaagcaggcctctgtcgcagcagagaatagtgttatttgttcttttctccactatatggagaaaggaggaaagggatggcataaagcttggtttgtggtgcctgagaacgaacctcttgtgctatatatctacggagctcctcaggatgtgaaagctcagcggtctcttcccctcataggatttgaagttgggccacccgaggcgggagaacggccagataggcgacacgtcttcaagattacacagtcacacctgtcctggtatttctcacctgaaaccgaggaactccagagaagatggatggcagtactggggagagccggtcgaggcgacaccttttgccccggacccacactgagcgaagatcgtgagatggaggaggcccctgtggctgcacttggggctactgccgagccaccggagtcgccacagacacgtgataagacctag

SEQ ID NO: 223826 - DNA, 1968 bp, Artificial Sequence
  Description of Artificial Sequence: Synthetic coding sequence
atgaagggggcttctgaggagaaactcgcctcagtttctaacttggtcactgtcttcgagaattctaggaccccggaagccgctccaagaggtcaaagactggaagacgtccaccatcgaccagagtgtagacctccggagagcccaggccctcgggaaaagactaatgtgggagaagctgttgggtccgagccgaggaccgtgagcaggaggtatctgaattcattaaagaataagctgtcctccgaggcctggcgcaaatcctgccaacctgtcaccctctctggcagcggaacccaggagcccgagaaaaaaatagtacaggagctattggagactgagcaagcatacgtggccagattacaccttctggatcaggtgttttttcaggagctgctgaagactgccagatcatccaaggccttccccgaagatgtcgtccgggttatcttctctaacattagtagcatttatcaatttcacagtcagttctttctgcccgagctccaaaggagattagacgattggacagccaacccgagaattggtgacgtaatccaaaagctggccccattcctgaaaatgtacagtgagtacgtaaagaatttcgagagagcagctgagctgttggcaacctggacagacaagtcgccccttttccaggaagtgctcacaagaatacagtcatcagaagcatccggcagcctcactcttcagcaccacatgcttgaacccgtgcaacggatccctcgctacgagctgcttcttaaagaatacattcagaaactaccggctcaggcacctgaccaggccgatgcacagaaggcccttgatatgatatttagcgcagctcagcattccaatgcggcaattacagagatggagaggctgcaggatctatgggaggtgtatcagcgattaggcctggaggacgatatagtggatccgtctaatactttgctgagagagggaccagtgctgaagattagcttccgccgtaacgaccccatggagcgttatctattcctgtttaacaacatgttgctgtactgcgtgcctcgcgtgatacaggtgggagcccagttccaggtgcggactaggatcgatgtggccggtatgaaggtaagagaactcatggacgcagagttcccccactcatttcttgtaagcgggaagcaaagaactctggagctacaggcacgctcacaagaagagatgatttcatggatgcaagctttccaggccgctatcgatcaaatcgagaagcgcaatgagacattcaaagcagcagctcagggcccagagggcgatatccaagaacaggagctacagagcgaggagctgggcctcagggcacctcagtgggtgcgcgacaagatggtcacaatgtgtatgcggtgtcaagaaccattcaatgccctgacgcgccgtcggcaccactgccgggcatgcggttatgttgtctgcgcacggtgctccgactaccgggctgaactgaagtacgatgacaaccgcccaaacagggtctgcctgcattgttatgcctttttgaccgggaacgtgctcccagaggcaaaagaagacaaacgaagaggcatcctagaaaaggggtccagtgctactcctgaccaatcactcatgtgcagctttcttcagctgatcggggacaaatgggggaaatccggtcctcgcggatggtgcgtgatccccagggacgatcccctggtcttgtatgtttatgcagctccccaggacatgagagcacatacctctatccctctccttggatatcaggtcaccgtcgggccacagggcgaccctcgagtattccaattacagcagagtggacaactgtatactttcaaggccgagaccgaagaactcaagggtcgttgggtgaaagccatggagagggccgcttccggatggtcaccaagttggcccaatgacggtgacctgagcgactag

SEQ ID NO: 223827 - DNA, 852 bp, Artificial Sequence
  Description of Artificial Sequence: Synthetic coding sequence
atgaaagtccgagaactcatggatgctgaatttccccatagttttcttgtgagcgggaaacagaggactttagaattacaggcaaggagtcaggaggaaatgataagctggatgcaagccttccaagcagcaattgaccaaattgagaagcggaatgaaactttcaaagctgccgctcagggtcccgaaggggatatccaggagcaggaactccagtctgaggagcttggtttgcgcgcacctcaatgggtccgggataaaatggttactatgtgtatgcgctgccaggaaccctttaacgcgctgacaagacgtagacatcactgtagagcgtgtgggtacgtggtgtgcgcgcgttgttcggattaccgcgcagagctcaagtatgacgataatcggcctaaccgggtttgtctgcattgttatgccttcctcaccgggaacgtgctccctgaggcaaaagaagataaacggaggggaatcctggagaagggctctagtgccacccccgatcagagtttgatgtgcagcttcctgcagttaatcggcgataaatgggggaagagcggcccacgtggatggtgcgtcatacctagagacgaccccctggtgctctacgtgtatgccgcaccacaggacatgcgggctcacacttcaatccccttgttaggataccaggtgacagttggccctcaaggcgacccgagagtctttcagcttcaacagagtggccagctgtacacgttcaaagctgagacggaggagctgaaaggcaggtgggtaaaagccatggagcgcgctgcctctgggtggagtccatcatggccaaacgatggagatctttcagattag

SEQ ID NO: 223828 - DNA, 2178 bp, Artificial Sequence
  Description of Artificial Sequence: Synthetic coding sequence
atggagtccggccgaggaagctctactccacctggccctatcgccgcacttggaatgcccgacaccgggcctggtagcagcagcctgggtaagctgcaggcattgccagtgggccctagagctcattgtggcgatccagttagcctcgccgcagctggcgacgggtcccccgacatcggaccgactggcgaattgtcaggatctcttaaaatccctaacagggactctggaatcgatagtcctagtagcagtgtggccggtgaaaatttcccttgtgaggaagggcttgaagcgggtccaagtccaacagtgcttggggcacatgctgagatggctcttgactcccaggtgccgaaagtgacacctcaggaggaggcagactctgacgttggcgaggaacctgactccgagaataccccccaaaaggcagacaaagatgctgggctggctcagcattcaggccctcagaaactcttgcacattgcccaggagttgctccacacagaagagacctatgtcaagcgtctccatttgcttgatcaggttttttgcacccgcttgaccgatgcaggaatcccacccgaagtcattatgggcatcttctcaaatatctccagcatacatcgcttccacggccaattcttgctgccagaactgaagacacgaatcaccgaggaatgggacacgaaccccagacttggggatattctccagaaactggcacctttcctcaaaatgtatggagagtatgttaaaaacttcgatagggccgttgggctcgtctctacttggacccaacgctctcccctgttcaaggatgtggtccacagtatccaaaagcaagaggtgtgtgggaaccttactctgcaacatcacatgctggaacctgtgcaaagagtccctcgatatgaactcttactgaaggactacctgaagcggttaccccaagacgcaccagataggaaagatgccgaacggagtctggagttgatttccaccgctgccaaccacagtaacgcagcaatcagaaaggtggaaaagatgcacaagctgctagaagtgtatgaacagcttggcggtgaggaagacatagttaaccccgcaaacgaattaatcaaggagggacagatacaaaaactttctgctaaaaacggtactccccaagacagacatctgtttttatttaacagtatgatactgtactgcgtcccaaagctgaggcttatgggtcagaagttttcggtgcgagagaagatggatatttctggactgcaagtgcaggatattgtcaagcccaataccgcacacaccttcattattactggcaggaagcgctcattagagctgcagacccgcacagaagaagagaaaaaggaatggatccagataattcaagcgacaatcgagaagcacaagcagaactccgagacatttaaggctttcgggggtgccttttctcaggacgaggatccgtctctgtctcccgatatgcccatcacctctacctctccggtcgagcccgtcgtcactaccgaggggtccagcggggcagccggtctagagccacgcaagcttagcagcaagacccgcagagataaggaaaagcagtcgtgcaagagttgtggggagaccttcaacagcatcactaaaagaaggcatcactgcaagctgtgtggggctgtgatctgtggaaagtgcagcgagttcaaagccgagaactcacgtcaatcgcgggtttgtcgcgattgcttcctcacgcaaccagttgcccctgagagtaccgagaagacccctactgccgacccccaaccatcgctcctctgcggacccctgcgcttgtctgaaagcggtgaaacctggtcagaggtctgggccgctatcccaatgtctgacccacaggtcctccatttacaggggggtagccaagatggaaggctgccgaggactattccactgcccagttgcaaactgtccgtccctgacccggaggagcgcctcgactctgggcatgtgtggaagttgcaatgggctaagcaaagttggtatttgtctgcttcttcggccgaactgcagcaacagtggctggaaacgctaagtaccgctgctcacggggatacagcccaagatagcccaggggctttacagcttcaggtgccaatgggcgctgcggctccttag

SEQ ID NO: 223829 - DNA, 2178 bp, Artificial Sequence
  Description of Artificial Sequence: Synthetic coding sequence
atggagtccggcagagggtccagcactccacccggtcccatcgctgccctgggtatgccagatacggggcctggcagtagtagtctcggcaaactacaggccctcccagttggacccagagctcactgtggcgaccccgtgtccctcgcagctgccggagacgggagccccgacataggcccaacgggagaattgtcagggtctctgaagatcccaaacagggatagcggaatagatagtccctcttcctcagtggcgggagagaacttcccgtgcgaagagggcctcgaggcaggaccgtccccgaccgtgctgggcgcacatgctgagatggcactggactcccaagtgccaaaggtcacaccgcaggaggaagcagattcagatgtaggggaggaaccagattcagagaataccccacaaaaagccgacaaggacgccggtctggcccagcacagcggaccgcagaagttgctgcacattgcccaggagttacttcacactgaggagacttatgttaagcggttgcatctgttagaccaggtattttgtacacgcctgaccgacgctggcattcctccggaagtgattatggggatcttcagcaacatttcaagtatccaccggttccatggacagttcctccttcccgaactcaaaacaagaattaccgaggagtgggacactaacccgaggctaggcgatattctccagaagttggccccttttctcaaaatgtatggagaatatgttaagaatttcgaccgagctgtcggcctcgtcagcacttggacccaacggtcccctctgttcaaagatgtggtgcattctattcagaagcaggaggtatgcggcaatttgactctccagcatcatatgttggagcctgtacagagggttcccaggtatgagctcctgctgaaggactatctaaaacggctcccccaggatgctcccgataggaaggacgctgagcgatcactggagctgatctctaccgcggcaaatcactccaacgccgctatcagaaaagtggagaaaatgcataagctcctggaagtctatgaacagctgggtggagaagaggatatcgttaaccctgcaaacgaactcattaaggaaggccagatccagaaactgtctgctaaaaacggcacccctcaggaccgacacttatttcttttcaactccatgattttgtactgtgtgccaaaactgcggctgatggggcaaaagttctccgttagagagaagatggacatctccggcctgcaggtccaggacattgtgaaaccaaatactgctcatacttttatcattactggacgcaagcgctcgcttgaacttcagactagaactgaagaggagaagaaagagtggatccagatcattcaggccactattgaaaagcacaagcaaaacagcgaaacatttaaagcatttggtggcgctttcagccaggatgaggatccgagcctgagccctgatatgcccatcacttccacaagtcctgtagagcccgtggttaccaccgagggttcctccggagccgctggtctggagccacgtaagctgtcctcgaagaccagacgagacaaagagaaacagagttgtaagtcatgcggagagacttttaattcaattaccaagcgtagacaccactgcaagctgtgcggcgctgtaatttgcggcaagtgttcagagtttaaggcagaaaatagtcgccagtctagggtatgccgcgattgcttcctgacacagcccgtggccccagagtcgactgagaaaacccccactgccgatccccaaccgtcactgttgtgcggtccactgaggctctccgaatcaggtgagacatggtcggaagtctgggctgcgatcccaatgagtgatcctcaggtgctgcatctgcaaggcggtagtcaggatggcagactcccgagaactattccgctgccttcctgtaaacttagtgtgccggaccccgaggaacgacttgacagcggtcacgtttggaaacttcagtgggcgaaacaaagctggtatctctctgcctcctctgcagaattacagcagcagtggcttgaaacgttatcgaccgcagcccatggagatacggcacaggactctcctggcgcactacaactccaagttcctatgggtgctgctgcaccatag

SEQ ID NO: 223830 - DNA, 2175 bp, Artificial Sequence
  Description of Artificial Sequence: Synthetic coding sequence
atggaaagcgggagaggcagctccactcctcccggacctatagccgctttgggtatgccagacaccggacccggttcctccagcctggggaaattacaggcccttccagtggggccaagagctcactgtggggaccctgtctctctggcagccgctggcgatggcagccctgacatcggaccaacgggagaattaagcggttcactgaaaattcccaacagagacagtggtattgattctccgtcctcttccgtggctggagaaaacttcccctgtgaagagggtctggaggccggaccctctcccacagtgctcggcgctcatgccgagatggccttggacagtcaggtgccaaaagtgactccacaggaggaggctgacagcgacgtgggcgaggagcccgatagtgagaacacgccacagaaggctgataaggatgcaggtctggcccagcactctggccctcagaagttattgcatattgcgcaggagctgctgcacactgaagagacttacgttaagaggctccacctgctcgatcaggtgttttgcactcgcctgactgatgccggtataccccctgaggtgattatgggcatcttttctaacatctctagtatccaccgattccatggccagtttctgctgccagagttgaaaactcgtatcacggaggaatgggacactaacccgaggctcggagacatactgcaaaagttggccccattcctaaagatgtatggagaatatgtgaagaacttcgatcgcgcagtgggcctagtcagtacatggacacagcgaagccctttgttcaaagacgtggttcactcaatccaaaagcaagaggtgtgtgggaatctgactctgcagcaccatatgcttgagccggtgcagcgtgtgccaagatacgaactcctcctcaaagattacttgaaacgacttccccaggatgccccagatagaaaagatgcagaaaggtctctggaacttatcagcaccgcagccaaccattccaacgccgcaatccggaaagtggagaaaatgcacaaattattggaggtctatgagcagctgggaggagaggaggacattgtgaatccagccaatgagctgataaaagaggggcagatccagaagctgagcgctaaaaatggtacacctcaggatcgtcatctattcttgttcaattcgatgattctgtactgtgtgccgaaacttcggttaatgggccaaaagttcagcgttcgagaaaaaatggatatctccggtctgcaggtccaagatatcgtgaaacctaatacagcccatacctttattattacaggcaggaagcgttccctggagctgcaaacaaggacagaagaagagaagaaagaatggatccaaataatacaggccacaattgaaaaacataagcaaaattctgaaactttcaaagcttttggcggtgcctttagccaggacgaagatcctagtctgtcccctgacatgccaatcacatccacctctcccgtagagccagtcgtgactaccgaaggctccagtggcgctgccggtctggaacctcgcaagctgtcctcaaaaacccgcagggacaaagagaaacaatcctgtaagagttgcggcgaaacctttaacagcattacaaaaaggagacaccactgcaaactgtgtggagcagtgatctgcgggaaatgcagcgagttcaaagccgagaacagcaggcaatctcgcgtctgtcgagattgtttcttaacacagccggtggctcctgagtctacagagacccccaccgcagacccacagcccagcttactttgcgggccactcagacttagtgagagcggagaaacttggtccgaagtgtgggctgctatacctatgagcgatccacaggtgctccatttacaaggtggaagccaggacggcaggcttcccagaaccatccccctcccttcctgcaagctaagcgtgcctgatccagaggagagactagatagcggacatgtttggaagctgcagtgggccaagcagagctggtacctcagcgcaagctcggccgaactgcaacaacagtggttggaaacattgagcacagccgctcacggggatactgcccaggactccccaggcgctctgcagctgcaagtgcccatgggagctgcagcgccttag

SEQ ID NO: 223831 - DNA, 987 bp, Artificial Sequence
  Description of Artificial Sequence: Synthetic coding sequence
atgatcctgtactgtgtccccaagttacggctcatggggcagaaatttagcgtcagagagaagatggatatatccggcttacaggtgcaggacatcgtcaagcctaacaccgcccacacattcattataacaggaagaaagcggagcctcgagctccaaacgcgcaccgaagaggaaaaaaaggaatggatccaaatcattcaggccacgattgagaaacataaacagaatagcgagacattcaaagccttcgggggtgcattcagccaggacgaggacccctccctttcccctgatatgccgataacctcaacctctcctgtcgagcctgtcgttaccactgaaggcagttccggcgctgccggattggagccaaggaagttgtcgagcaaaaccagacgcgataaggaaaaacagagttgcaaaagttgcggagagacgtttaatagtatcaccaagcgcagacatcattgtaagctctgcggggctgtgatctgcgggaagtgcagtgagttcaaggccgaaaactcccggcaatcacgagtgtgcagggattgcttcttaacccagccagtagcgccagagtctaccgaaaaaacccctactgccgatcctcagccctccttgttgtgcggacccttacggttgtctgaaagcggcgagacttggagcgaggtctgggctgcgattccaatgtccgaccctcaggtcctgcacctgcaggggggatctcaagatggccgtctcccacggaccatccctctgccaagctgtaagctcagcgtgccggaccctgaagagcggttggactccgggcatgtgtggaaactgcagtgggctaagcagagctggtatctgtccgcctcctctgccgagctccagcagcaatggctcgagacactaagcactgcagcccacggagacaccgcacaggactcgcctggcgcacttcaattgcaggttccaatgggagccgctgccccttag

SEQ ID NO: 223832 - DNA, 1416 bp, Artificial Sequence
  Description of Artificial Sequence: Synthetic coding sequence
atggtgaataagatcttctcaaatatttctagtatcaatgccttccatagcaagttccttttgccagaactggagaagcggatgcaggagtgggagactacgccgaggatcggggacatccttcagaagctggcccctttcctgaaaatgtacggcgagtacgtgaaaggattcgacaacgctatggagcttgtaaagaacatgaccgaacgtattcctcagtttaaaagcgtggtcgaagaaatccagaaacagaaaatctgcggtagcctgacgctgcaacatcacatgttggaaccagtccagcggataccaaggtatgagatgctcctaaaagactacctccgaaaattgccacctgactccctagactggaacgacgccaaaaaatctctagaaattatcagcacggcggcttcccactcaaatagcgcgatacgcaaaatggagaatctcaaaaagctgctggagatctatgagatgctaggagaggaagaggatattgtgaatccatctaacgagctgattaaagagggacaaattcttaaactggctgcacgtaacacctctgcccaggaacggtacctatttctgttcaacaacatgttgttatattgcgtcccgaagtttagcctggtgggaagtaaatttactgttcggacacgcgtggggattgatgggatgaaaatcgtcgagacccagaacgaggagtacccacatacatttcaagtctccggtaaggagagaaccctggaactgcaggccagcagcgcacaggataaggaagagtggatcaaggctttgcaggaaactatcgacgcttttcaccaacggcacgagactttccgcaatgctatcgccaaagataatgacattcactcggaggtcagcacagccgagctgggaaagcgggcaccaaggtggattcgcgataatgaggtcacaatgtgtatgaagtgcaaagaaccgttcaacgccttgaccaggcgacgccaccactgcagagcctgcggttacgtggtctgttggaagtgcagcgattataaagcacagctagaatacgatggtgggaagctcagcaaggtatgtaaagactgttatcaaataataagcggcttcaccgacagcgaagaaaagaagaggaaggggatcttggagatcgaatccgccgaagtcagtggcaattcagtcgtctgcagtttcctgcagtatatggagaagtccaaaccgtggcagaaagcctggtgtgtgatcccaaaacaggacccactggtgttgtacatgtacggagcaccccaagtgtccaagccgcatctcagcgaagggaccgacgccctgggtggaaaaggaaagcgggtagatagcggcctgaaaatctgtcgcacacgggtacaagcagtctccctgtttcattag

SEQ ID NO: 223833 - DNA, 843 bp, Artificial Sequence
  Description of Artificial Sequence: Synthetic coding sequence
atggtgaacaaaattttcagcaacattagttcgattaacgcttttcactctaaatttctgctcccagagctcgagaaaagaatgcaggaatgggaaaccactcccaggattggcgatattttgcagaagctcgctcccttcttgaagatgtatggcgagtatgttaagggatttgacaacgccatggagttagtgaagaatatgacagagagaataccccagtttaagtcggtcgtggaggaaatccaaaaacagaagatatgcggctccctgacgttacaacatcacatgctggaacccgtgcagagaattccccgatacgagatgttgctcaaagactacctccgcaaattgccacctgattccctcgactggaatgacgccaagaagagtctggagattatttcaaccgccgcatctcacagcaatagcgccattcgaaaaatggagaatctcaaaaaactgcttgaaatctacgaaatgctgggcgaggaggaggacattgttaacccatccaatgaactgatcaaggagggtcaaatattaaaactcgccgctaggaacacgtcagcacaagagagatatttgtttctatttaataatatgttgttgtattgtgtgcccaagttcagcctcgtgggaagtaagtttaccgtgagaactagggttgggatagacggcatgaagattgtggaaactcaaaacgaagaatacccgcatacttttcaggtgtctggcaaggaaagaactcttgaacttcaggccagctcagcccaagataaggaggagtggatcaagagacgcggttttgctatgttaccgcgactgatctctaattcttag

SEQ ID NO: 223834 - DNA, 567 bp, Artificial Sequence
  Description of Artificial Sequence: Synthetic coding sequence
atgttcagctgcttcctttgcatcctgagcttttcctctctcagtaattattccgacctcaagaaggagagcgcagtcaatctgaacgcccctcgcactcctggccgacacggcttgacgacaacgccacaacagaaactcctcagccagcatttacctcaaaggcagggaaacgacaccgacaaaacccagggggctcaaacctgcgtggctaatggcgtgatggccgcacaaaaccagatggagtgtgaagaggagaaagcagccacactctcgagcgatacaagcatccaggccagcgagcctctcctggacacccacatcgtgaatggcgagcgggatgagacagctacagctcccgctagcccgacaacagactcttgtgatggaaacgcatctgattcttcctaccggacacccggtatcggacccgtgctgcccctggaagaacggggagcagagactgagacaaaggtgcaggagagagagaatggggagtcaccacttgaacttgaacagcttgaccagcaccacgagatgaaggtcgagcacgaaacatcctcctag

SEQ ID NO: 223835 - DNA, 2301 bp, Artificial Sequence
  Description of Artificial Sequence: Synthetic coding sequence
atggaagagatcaagcctgcatccgctagctgtgtctctaaagaaaaaccatcaaaggttagcgatctgatctctcggttcgaaggaggatccagcctatcgaattattctgacctgaagaaagagtcagcggttaacctcaacgctcctaggacccccggacgccatggcttaacaaccacaccccagcagaaactgctcagtcagcacctgccccaacgtcagggaaacgataccgacaagacacagggcgctcagacttgtgttgcgaacggcgtgatggctgcacagaaccagatggaatgtgaggaagagaaagcggcaacactgtcttctgacacttcaatccaagctagcgagcctctgctcgatacccatatcgttaatggggagagagacgagaccgcaaccgccccagctagtcccacaactgactcttgcgacgggaatgcaagcgacagtagctatcgaacccctggcatcggtcctgtgttacctctcgaagagcgcggagccgagaccgaaaccaaggtacaggaaagagaaaatggcgaaagtccactagagttagaacagttggatcagcatcatgagatgaaagagaccaatgagcagaaactgcacaaaattgcaaatgagttgctgcttacagagagggcatatgtgaacagactcgatctactagaccaagtattttactgtaagctacttgaggaggccaatagggggtctttcccggcagagatggtaaacaaaatattttcaaacatctccagtatcaacgccttccattcgaaattcctactgcccgagctggagaagcgcatgcaggagtgggagaccacgcccaggattggagacatcctccagaaactagcacccttcctcaaaatgtacggagaatacgttaaggggtttgataatgccatggaactggtaaagaacatgacagagcgtatccctcagtttaagagtgttgttgaggaaattcagaaacaaaaaatttgcggctccttgaccttacagcaccacatgctggaaccagtgcagaggattcccagatacgaaatgctcctgaaggactatcttagaaagctcccacccgactccctggactggaacgacgccaagaagtccttagaaatcatctccaccgctgcctcgcacagtaactccgcaatccggaagatggagaatctaaaaaagctactggaaatttatgagatgctcggggaagaagaagatattgtgaacccatcaaatgaacttatcaaggaaggtcagatcctgaagttggcagctaggaatacatccgctcaggagcgttatctgttcctgttcaataacatgttgctgtattgcgtgcccaaattctctcttgtcggttccaaattcaccgtcagaactagagtgggcatagacgggatgaagatcgtggaaacccagaacgaggaatatccacatacctttcaggtgtctggcaaagaaaggacactagagttacaggcctctagcgcccaagacaaagaagaatggattaaagccctgcaggagactatcgatgccttccatcagcgacacgaaacattcagaaacgcgatcgccaaggataacgacattcattcagaagtcagcacagcggaactcggcaagagagcccctcgctggatcagagacaacgaggtgacgatgtgcatgaagtgcaaggagccctttaacgccctgacccgtcgacggcaccactgtcgggcatgtggatatgtggtgtgttggaaatgttctgactataaggcccaactcgagtacgacggtggcaagctatccaaagtatgcaaggactgttaccagattatcagcggttttacggacagtgaggaaaaaaagcgcaagggcattctggagattgagagtgcagaagtgtccgggaattcagtggtgtgcagctttctacagtacatggaaaaatctaaaccatggcagaaggcttggtgtgtaatccccaagcaggaccccctggttctatatatgtatggggctccccaagacgtcagggcccaggctacaataccactccttggttacgtggtcgacgagatgcccaggtccgctgacctgccacactctttcaaactgacacagtctaaatctgtgcactcctttgccgcagacagcgaagagctcaaacagaaatggttaaaggttatcttgctggcagttactggtgagactccaggcggacccaacgagcaccctgctacgctggacgatcaccccgagcccaaaaagaagagcgagtgctag

SEQ ID NO: 223836 - DNA, 624 bp, Artificial Sequence
  Description of Artificial Sequence: Synthetic coding sequence
atggaagagattaaaccggcttccgcttcatgcgtttctaaggagaagccatccaaagtctccgaccttatttcaagattcgagggcggatccagtcttagtaattatagcgatctaaagaaggaaagcgccgttaatctcaacgcacctagaactccgggacgccacggcctgaccactacaccccaacaaaagctcctgagtcagcacttgcctcagcgacagggaaacgacacagacaagacacagggagctcagacatgcgtcgctaacggcgtcatggccgcacagaaccaaatggaatgtgaggaggaaaaggccgctactctcagctcagataccagcatacaggcttcagagcctctcctagatacacatattgtgaatggcgagagggatgagaccgctacagctccggctagcccaacaacggattcatgtgacgggaacgcttccgactccagttaccgtacgcctggtatcggccctgtcctgcctttagaggagaggggggctgagaccgaaacgaaggttcaggagagggagaatggtgagtcacctctggagctcgagcagctcgaccagcatcacgagatgaaggtggagcacgaaacttcgtcttag

SEQ ID NO: 223837 - DNA, 2637 bp, Artificial Sequence
  Description of Artificial Sequence: Synthetic coding sequence
atgaatttcaaacgcgtgaaaccgaacattttcttgctcaaccagtcgcgtctcataatatcaatctgtgagataatgtcaacagaccagggttcctccacctgccccaaaatcgcactcgttccgccttgtagcacatcctctaccacaactttggtcggggagaatgttagcgaagaggaagcacagggcataaatggtaaccgacctgcaaagcattccgctgccagccctaagccccaggtgcctccgaaacctctccacctgcagaacagcccttcatccaatatccaccaaactcctcgccacaaggccctgccttcagccaaacccaggatggaggaaataaagcctgcaagcgcgtcttgtgtgtctaaggagaaaccatcaaaggtgtctgacctgatatcccgctttgagggtgggtcctctctcagcaattactctgacctcaaaaaggagagcgccgttaacttgaacgccccaagaaccccaggcaggcacggcctgacgacgacacctcagcaaaaactgctgagtcagcacctgccacagcgtcagggaaacgacacagacaaaacgcagggagcacagacttgcgttgccaatggtgtgatggccgctcagaatcagatggagtgcgaagaagaaaaagccgctacattgagctctgatacatctatacaggcctcagaacctttattggatacccacattgtgaacggcgaaagggacgagacagctaccgctcccgcttcacccacaacagatagctgtgatggcaatgctagtgattcatcatacagaacaccaggtatcggacctgttttacctctggaagaaagaggagcagagaccgagactaaagtgcaggagcgtgaaaatggggagtctccactggagctggaacagctcgaccaacaccatgagatgaaagaaacgaatgagcaaaaattgcacaagatcgcgaatgagttgctgctgaccgaaagagcctacgtgaataggctcgatctactggaccaggtgttctattgcaagttactagaagaagccaaccggggttcttttcctgctgaaatggtgaacaaaatattctccaatatttcttctatcaatgcttttcactcaaagttcctgttgccagaactagaaaaacgcatgcaagagtgggagaccaccccgcgaattggcgatattctgcaaaaactcgctccatttctcaaaatgtatggagagtacgtcaaaggattcgacaacgccatggaactcgtaaaaaatatgactgagaggattccacagtttaagtcggtggtagaagagattcagaagcaaaagatttgcggcagtctgacactgcagcaccatatgctggagcccgtccagcgcattccccgttacgaaatgcttctgaaagactatctgagaaagctgcccccagatagtctggactggaatgatgcaaagaagtccttagaaatcatcagcactgctgcaagccacagcaactctgctatacggaagatggaaaacctgaagaagctgcttgaaatctacgaaatgctgggggaagaagaggatattgttaatcccagcaacgaactcatcaaagagggtcagatcctcaaacttgctgctcgcaatacatccgctcaggaacgctatctcttcctgttcaacaacatgctgctgtactgcgtcccaaagttcagcctggtcgggagcaaatttacagtccggacaagggtggggatcgacggcatgaaaatcgtcgagacccagaatgaagagtatccccacacgtttcaggttagtgggaaagagcggacgctggaactccaggcctcatcggcccaggataaggaggagtggatcaaagctttacaggagacaatagatgccttccaccaaaggcacgaaacctttagaaacgccattgccaaggacaacgatatacacagcgaggtgtctacggctgagctgggaaaacgcgctcctaggtggattagggataatgaagtaaccatgtgtatgaagtgtaaagagccattcaacgcgcttaccaggagaagacatcattgccgtgcctgcggatatgtggtgtgttggaagtgttctgattacaaagcgcagcttgaatatgacggaggcaagctgtctaaagtctgtaaggactgttaccagatcatatccgggtttacggactccgaagaaaagaagcgcaaaggcattctcgaaattgagtctgcagaggtcagcggcaacagcgtggtgtgtagttttttacaatacatggaaaagtctaagccctggcagaaggcctggtgtgtgattcccaagcaagaccctttagttctgtacatgtatggagctccccaagacgttagggcgcaagctaccattcctctactggggtacgtggttgacgagatgcctagatctgcagatttacctcatagcttcaaactcacacagtcgaaatctgttcattcctttgcagctgactcggaggaactgaagcagaaatggttgaaggtgattctgttggccgtcactggggaaacaccaggaggaccaaatgaacatcctgcgaccctggatgaccacccagagcccaaaaagaagtctgaatgctag

SEQ ID NO: 223838 - DNA, 2556 bp, Artificial Sequence
  Description of Artificial Sequence: Synthetic coding sequence
atgggaggatgcagtagcacctgcccgaaaatcgctctggtccctccctgttcaacatccagcactaccacgctggtcggcgagaatgtcagtgaagaagaggcccaggggatcaatggcaatcggccagcaaaacactctgcggcttcccccaagccacaggtgcctccaaaacccttgcacctccagaactccccttcaagtaatattcatcaaactcctagacataaggcgttgcccagtgcaaagcctagaatggaagagatcaaaccagcctcagcatcgtgtgtttcaaaagagaaaccatccaaggtaagcgatttaattagtcgatttgaagggggttcatccctgagcaattattccgatcttaaaaaggagagtgccgtgaatctgaacgcacctagaacccccggtcgccacgggctcacaacaaccccacaacaaaaattattgagtcagcatctgccacagcgccaaggaaatgacacagacaagacacagggtgctcaaacctgcgtggccaacggagtgatggcagctcagaaccaaatggagtgcgaggaagagaaagcagccaccctgtcaagcgacacaagcatccaggcctccgaacctcttctggatacacacattgtgaatggggaaagagacgaaacggcaaccgcccctgcttcgccaacaactgatagttgtgatgggaacgcaagcgactcatcctatcggacacccggaatcggcccagtattgcctctggaagaacgcggagcagaaacagagacaaaggtgcaggagagggagaacggcgaatccccactggagctcgagcagctggaccagcaccatgagatgaaggagacaaatgagcagaaactgcataaaatcgctaacgagctgctcctaaccgaacgggcttatgtcaaccgcctggatttgctggatcaggtcttttactgcaaactgcttgaggaagctaacagaggctcgttccctgcggaaatggtgaacaagatctttagcaacatttcctctatcaacgcgttccacagcaagttcctcctgccagaactggaaaaaaggatgcaggaatgggagaccactcccagaatcggtgatattctgcagaaactggcgccttttttaaaaatgtatggcgaatatgtcaaaggatttgataacgcaatggagttggtcaagaatatgaccgagcgtatccctcagtttaaatcagtggtagaagagatccagaagcagaaaatatgtggaagtctgaccctgcagcaccacatgctcgagcctgtccagcgcattcccagatacgagatgctcctgaaagattacctacggaagctgccgccagattccctagactggaatgacgccaaaaagagtctcgaaattatctctacagcagccagccattccaacagtgcaattagaaagatggaaaacctcaagaaactgctggaaatttatgagatgttgggtgaggaagaagacatagtgaacccctcaaatgagctaataaaagaggggcaaatactgaaactagcagcgagaaatacaagcgcacaagagcgatacctatttttattcaacaatatgcttctgtattgcgttccgaaattctcgctagtggggtcgaagtttactgtgaggacaagagtcggaatcgacggtatgaagattgtggagacccaaaatgaagaataccctcacaccttccaagtatcaggaaaggaacgaactcttgaactgcaggcttcatctgcacaagacaaggaagagtggattaaagcgctgcaggagaccatcgatgcattccaccagaggcatgaaaccttcaggaatgccatcgcaaaggataacgacatccacagcgaggtgtcgacagccgaactgggcaagagggctcccaggtggattcgcgacaacgaagtgacgatgtgtatgaagtgcaaagagccctttaatgccctcacccgacgtcgccatcattgtcgcgcttgcgggtacgtcgtgtgttggaagtgtagcgactacaaggcgcagctggaatatgatggtggcaaactcagcaaagtctgtaaagactgttaccaaataatttcaggatttaccgattccgaagagaaaaagaggaaggggatcctggaaatcgaatctgccgaggtctctgggaattccgtggtgtgcagcttcctgcagtacatggaaaaatctaagccttggcagaaggcgtggtgtgtgatccctaaacaagatccattggttctgtacatgtatggcgcaccacaagacgtccgagcccaagctacaatcccattattaggatacgttgtggacgagatgccacggagtgcagatttaccccattcgtttaagttgacccagagcaagagtgttcactcttttgcagctgactccgaagaactgaagcagaaatggctcaaagtgatcctgctggccgtgacaggggagacccctggcggacccaacgagcaccccgcaaccctggacgatcaccctgagccaaagaaaaagtctgaatgctag

SEQ ID NO: 223839 - DNA, 2712 bp, Artificial Sequence
  Description of Artificial Sequence: Synthetic coding sequence
atgtctgacgaaggcggatctaatttcagacgggtggcgattaggcggaaaagcaatccttcctacctgccgccaggcgtgcccaggccttggtctaggccggcttcgcatttgggtcgtgttggcactgccgcatttaaaggacaggtgccctccggcgcaaccggttccagcacttgtcccaagattgccctggttccaccttgttcgacgagtagtactactacgctggtgggagagaacgtgtccgaggaggaggcgcagggtatcaatggcaaccgtccagccaagcactctgccgcatcacctaagccgcaggtgcccccaaagcccctccatttacagaatagtccctcgagcaacatccaccagactcctagacataaggcacttcccagtgccaagcccaggatggaggagatcaagccagcttccgcctcctgtgtgagtaaggagaagccctccaaagtttctgacctgatcagccgcttcgagggtggctccagcctttctaactacagcgatctcaagaaagaaagcgcagtgaacctgaacgcaccccgaactccaggacgccacggactcaccaccacaccacaacagaagttactctcacagcatctgcctcagaggcaaggcaacgacacagacaaaacccagggggcacaaacctgcgtggccaatggggttatggcagctcagaaccaaatggagtgcgaggaggagaaggcggcaacgctctcgtctgatacttctatccaggcttctgagcctctccttgacacccatattgtaaatggagagcgtgatgagactgctaccgccccagcaagtcccactacagacagttgtgacgggaatgcaagcgattcctcctaccgtacgcctgggatcggccctgtgttgcccctcgaggaaagaggagcagaaacggagactaaggtacaggagcgagagaacggggagtccccactggagctggagcaactagaccagcaccacgagatgaaagagacaaatgaacagaaactgcacaaaatcgccaacgagctgcttttgactgagagagcctacgtcaatagactggacctccttgatcaagttttttattgtaaactccttgaagaagccaacaggggctcattccctgcagaaatggtcaacaagatttttagtaacatcagctccattaatgcttttcatagcaagttcctgctgcctgaacttgaaaaaagaatgcaagagtgggaaacaacccccagaatcggagatatcctgcagaaactggcaccttttctgaaaatgtacggggaatacgtcaaaggcttcgataatgctatggagctggtgaaaaatatgaccgagaggatcccacaattcaagtctgtagttgaggaaatccagaaacaaaagatatgcggctctctcactctccagcaccacatgctggaacctgtgcagaggataccccgttacgaaatgcttctgaaagactaccttcgcaaactgccccctgacagcctggattggaatgatgctaaaaaaagcctcgaaataatatccaccgcggcttcccatagcaacagcgcgatacgaaagatggagaatctaaaaaaactcctggagatctatgagatgctgggggaggaggaagatattgtaaaccctagcaacgagctaatcaaggagggccagattctgaagttggccgcaagaaatacctctgctcaggaaaggtacttattcttattcaacaatatgctgctgtactgcgtgcccaaattctccctggtcgggtccaaattcactgtgcggactagagtgggtattgatggaatgaagattgtggagacccaaaatgaagaataccctcataccttccaggtttcaggtaaggaaagaaccctggaacttcaggcatcatccgcccaggataaggaagagtggattaaagccctgcaggaaacgatcgacgctttccaccaacgccatgaaactttccgcaatgcaatcgcaaaagataacgatatccactcagaggtcagcaccgccgagctgggcaagcgcgctccacgctggatcagagacaacgaagtcaccatgtgtatgaagtgtaaggaaccattcaacgcactgactcggcgtcggcaccattgccgagcatgtgggtatgtcgtttgttggaagtgttccgactacaaagctcagctggaatacgacggcggtaagctttccaaagtttgcaaagactgctatcagatcatcagcgggtttactgacagcgaggagaagaaacgcaagggcattcttgaaattgagagtgcagaagtgtctgggaactccgtcgtgtgctctttccttcagtacatggaaaagtccaagccttggcagaaggcttggtgtgtcatcccaaaacaggaccccctcgtgctctacatgtatggagctccccaggacgtccgcgctcaggcaaccatcccacttctgggttatgtcgtagacgagatgccaaggtctgctgatctgccccattcctttaaacttacgcagtctaaaagcgtccatagctttgccgctgacagcgaggaattgaaacaaaaatggctcaaagttatcttgctggccgtcacaggggagaccccgggagggccaaatgaacacccggcaactctagatgaccatcctgaaccaaagaagaagtcagaatgctag

SEQ ID NO: 223840 - DNA, 420 bp, Artificial Sequence
  Description of Artificial Sequence: Synthetic coding sequence
atgtcatggaggggacgatctacctactactggcctcgtccgaggcgttacgttcagcccccagagatgattgggcctatgcggccagagcagttttcagatgaggtcgaaccagctacccccgaggagggcgaacctgcaacccaaaggcaggatcctgcagcggcacaggagggcgaagacgagggagcgtctgcaggacagggtcccaagcctgaagctgatagtcaggagcaagggcatccccagaccggctgcgaatgcgaagatggccctgacggccaagaaatggatccgcctaaccccgaggaggtgaaaacccccgaggaagagatgcgctctcactacgtagcacagactggcatactctggctgctcatgaataactgcttcctgaacctgagcccacgcaagccctag

SEQ ID NO: 223841 - DNA, 351 bp, Artificial Sequence
  Description of Artificial Sequence: Synthetic coding sequence
atgtcctggagaggtagatctacttatcggagcaggcctaggctttatgtggagccaccagaaatgatcggcccaatgctcccagagcagttcagcgacgaggtggagcctgccacacccgaggagggcgaacctgcaacccagaggcaggaccctgccgcagctcaagagggggaggatgaaggcgcatccgctggacaggggcctaaaccagaggccgattcgcaggagcaggtccaccctaaaaccggctgtgaatgtggagatgggccagatggtcaggagatgggtctgcccaaccccgaggaggtgaaaagaccagaggaaggcgaaaagcagagccagtgttag

SEQ ID NO: 223842 - DNA, 354 bp, Artificial Sequence
  Description of Artificial Sequence: Synthetic coding sequence
atgtcttggaggggtaggagcacctactactggcccaggccccgtagatatgtgcagcctcctgaaatgatcggcccaatgcgcccagaacagtttagcgatgaggtcgaacctgctacaccagaggaaggcgagccggcaactcaatgccaggatccggctgcagcacaggagggcgaggatgagggggcatccgctggccaggggccaaagcctgaggcccactcacaggaacaagggcacccacagaccggatgtgagtgtgaggatggccctgatggacaggaaatggatccccctaatcctgaagaagttaaaacacctgaagaaggcgagaaacagagtcagtgctag

SEQ ID NO: 223843 - DNA, 354 bp, Artificial Sequence
  Description of Artificial Sequence: Synthetic coding sequence
atgtcctggcgcggtaggagcacctactactggcctcgccctcgaagatatgtgcagccaccggaaatgattggacccatgcgccctgaacagttctcggatgaagtagagcccgctacacccgaagagggggaacctgctacacagtgtcaggaccccgcagccgcacaggaaggagaagacgagggagcctctgctggtcagggtcctaagccagaagcccattctcaggagcagggccaccctcagaccggatgtgaatgcgaggatggcccagacggtcaggagatggatcccccaaatcccgaggaagttaaaaccccagaagaaggagaaaaacagagtcagtgttag

SEQ ID NO: 223844 - DNA, 354 bp, Artificial Sequence
  Description of Artificial Sequence: Synthetic coding sequence
atgtcttggcggggaagaagtacatactactggcctaggccgaggagatacgtgcagccgcctgaaatgattggccctatgaggcccgaacagtttagcgatgaggtcgagcccgcaactcccgaagagggcgaaccagcaacccagtgtcaagatccagctgctgcccaggaaggcgaagatgagggggcatccgccggacagggccctaagcccgaggcccactcccaggaacagggccacccccagaccggctgcgagtgcgaagacggcccagatggccaggagatggaccctcctaatcctgaggaggtcaagacgccagaagagggtgaaaagcaatcacagtgctag

SEQ ID NO: 223845 - DNA, 354 bp, Artificial Sequence
  Description of Artificial Sequence: Synthetic coding sequence
atgtcctggagaggtcgctctacctactactggccccgacctcgccgatatgtccaaccacctgaaatgatcggaccaatgcgccctgagcagttctctgatgaggtggaaccagcaacgcctgaagagggagagcccgctacccaacgacaagatcccgcagccgctcaggaaggtgaggatgaaggtgcttctgctgggcagggcccaaagccagaggcacactctcaggagcaaggacatccacagaccggatgtgaatgcgaggacggcccagacggccaggaaatggatccacccaacccagaagaggtcaaaacccccgaggaaggagaaaagcagtcccagtgctag

SEQ ID NO: 223846 - DNA, 354 bp, Artificial Sequence
  Description of Artificial Sequence: Synthetic coding sequence
atgagttggcgcggacggtctacctattattggcccaggccacggaggtacgtccagccgcctgaaatgatcgggcctatgcgcccagagcagttcagtgacgaggtagaaccagctaccccggaggaaggcgagccagccactcaacggcaggaccctgctgccgctcaagagggcgaggatgaaggagccagtgctgggcagggccctaaacccgaggcccattctcaagagcaaggccatccacagacaggatgtgagtgcgaggatgggcctgacgggcaagagatggacccccctaacccagaggaagtcaaaacaccagaggagggcgagaaacagagccagtgttag

SEQ ID NO: 223847 - DNA, 354 bp, Artificial Sequence
  Description of Artificial Sequence: Synthetic coding sequence
atgtcttggagagggagatcgacatactattggcctcggccaagacgttacgtgcaaccgccagaaatgataggccctatgcgcccagaacagttttcagacgaagtggaacctgcaacccccgaagaaggcgagcccgcaactcagtgtcaggaccccgcagccgctcagaaaggtgaagatgagggtgcgtcagccggacagggccctaagccagaggcccacagtcaggagcaggggcatccccagaccgggtgtgaatgtgaagatggcccagatggccaggaaatggatccgcctaatcccgaagaggtgaagacacccgaagaaggcgagaagcaatcccagtgctag

SEQ ID NO: 223848 - DNA, 354 bp, Artificial Sequence
  Description of Artificial Sequence: Synthetic coding sequence
atgtcatggaggggcaggtctacttattactggccaagacccaggccttatgtccaaccccctgagatgatcggaccaatgcgcccagagcaattctctgatgaggtggaacctgccacccccgaggagggcgagccagccacccagcgacaggatcccgcagcagcccaagaaggtgaagacgagggggcaagtgcaggtcaaggcccaaagcccgaggccgatagccaggaacaaggacacccgcagacaggatgcgagtgtgaagacgggcctgacggtcaagaaatggatccaccaaaccctgaggaagtcaagacccctgaggaaggcaaaaaacagtctcagtgctag

SEQ ID NO: 223849 - DNA, 354 bp, Artificial Sequence
  Description of Artificial Sequence: Synthetic coding sequence
atgagctggcggggtaggtccacatactatcgccctagaccacgacggtatgtcgagcctcctgagatgatcggcccaatgaggcctgaacaattttcagacgaggtggaaccagccacacccgaagagggggagccagccactcagtgccaagatcccgctgcggctcaggagggtgaagatgaaggcgcttcggcgggacaaggcccaaaacctgaggccgatagtcaggagcagggccatccgcagacgggatgtgagtgcgaggatggcccagatggacaggaaatggatccacctaatcctgaagaagtgaaaacaccagaagagggaaaaaagcagtcacagtgttag

SEQ ID NO: 223850 - DNA, 351 bp, Artificial Sequence
  Description of Artificial Sequence: Synthetic coding sequence
atgtcttggagaggacgaagcacctaccggcctaggccccgacgttatgtggaaccgccagagatgatcgggcctatgaggccagaacagttctcggacgaggtcgaaccagccactcctgaagaaggagagcctgcaactcagagacaggaccccgcagccgctcaggaaggacaggacgaaggagcatctgccggtcagggtccaaaaccggaggctcacagtcaggaacagggacatccccagaccggctgtgagtgcgaagatgggcctgacggccaagaaatggatcccccaaatccagaagaggtgaagaccccagaagaaggagagaaacagagccagtgctag

SEQ ID NO: 223851 - DNA, 351 bp, Artificial Sequence
  Description of Artificial Sequence: Synthetic coding sequence
atgtcctggagaggccgtagcacatataggccacgcccacgtagatatgtcgaaccccctgagatgataggccctatgaggcccgagcagttttcggatgaggtcgaacccgcaactccagaggaaggcgagcctgccacacaacgtcaagatcctgccgctgctcaggagggtgaggatgaaggcgcttcagcaggccaagggcctaaacctgaggcacattcccaggaacagggacatcctcaaacgggctgtgaatgcgaagacgggccagacgggcaggagatggaccctcccaatcctgaggaggttaagacccccgaggaaggggaaaagcagtctcaatgctag

SEQ ID NO: 223852 - DNA, 351 bp, Artificial Sequence
  Description of Artificial Sequence: Synthetic coding sequence
atgtcctggagaggcagatccacttaccgtcccagacctcgtcgctacgtagaacctccagagatgatcgggccaatgcggcctgagcagttctcagacgaggtggaacctgctacacctgaggaaggagagccagctacacaaagacaggacccggctgcggcacaggagggggaggacgaaggtgcttcggccggacaaggtccgaagccggaagcacattcacaggaacaaggccacccccagacaggatgcgagtgtgaggacgggcctgatggacaagagatggacccaccaaatccggaggaagtgaagactcccgaagagggagagaaacagagtcagtgctag

SEQ ID NO: 223853 - DNA, 351 bp, Artificial Sequence
  Description of Artificial Sequence: Synthetic coding sequence
atgagctggcgaggaagatccacctaccgcccaagaccgaggagatacgttgagccaccggaaatgataggaccgatgcggcctgagcagttcagtgatgaagtggagcccgcaaccccggaggagggggagcctgccacccagaggcaagatcccgctgcagcacaggagggggaggatgagggtgcatctgccggtcaggggcctaagcccgaggccgatagtcaagagcagggccaccctcaaactggatgcgagtgcgaggacgggccagacggccaggaaatggatcctccaaacccggaagaggtcaagaccccggaggagggagagaagcagtcccagtgttag

SEQ ID NO: 223854 - DNA, 351 bp, Artificial Sequence
  Description of Artificial Sequence: Synthetic coding sequence
atgagttggcggggtcggagcacatacagaccaaggcccagacgttatgtggaaccacccgaaatgatcggaccaatgcggccagaacaattcagcgacgaagtggagcctgccacaccagaggagggagagcccgctacccagcgccaagacccagcagctgcgcaggaaggcgaagacgaaggtgcttcagcagggcaaggtccgaagcccgaagcagactcacaggaacaagggcatccccagaccgggtgtgagtgcgaagatggcccagacggacaagagatggacccacctaacccggaggaggtaaagacacccgaggagggaaaaaagcaatctcagtgctag

SEQ ID NO: 223855 - DNA, 435 bp, Artificial Sequence
  Description of Artificial Sequence: Synthetic coding sequence
atgttcctggaagagaagattccatctatttcagatcttaaactggccatcaggcgcgctacacttaagaggtctttcacacccgtgttcctggggtcagccctcaaaaataagggggtacagccattgctcgacgctgtgctcgaatacctgcccaacccatccgaggtgcagaattacgcaattctcaataaggaagacgactcaaaagagaagacaaaaatcctcatgaattctagtagggacaattctcatccattcgtaggactggcgttcaagctagaattcctcagtaggagtttttttcgactcactcgtcagaaagaccataggcggcctatccaaagaacaaccctctaccttatcgtgatgtcaccttacgatttactcggctgcaattccttcttggattttccatgcttttcaagagactag

SEQ ID NO: 223856 - DNA, 2256 bp, Artificial Sequence
  Description of Artificial Sequence: Synthetic coding sequence
atgcggctgcttggcgcagctgcagttgctgccttggggaggggccgtgcccctgcctctcttggctggcaacggaagcaagtcaactggaaagcctgtaggtggtcttctagcggggtgattcccaatgaaaaaatcagaaacatcggtatttctgcgcacatagatagtgggaagacaacattgacagagagagtcctctactacacaggcagaattgccaagatgcatgaagtaaaggggaaagatggagtcggggctgttatggactccatggagctcgaaaggcagcggggaataacaatacagagtgccgctacgtacactatgtggaaagatgtgaatatcaacatcattgatacccccggtcatgttgatttcacaattgaggtcgaaagggcattgcgcgttttggatggcgctgttctggtcctctgcgccgtggggggagtccagtgtcaaacaatgacagtcaatcgccagatgaaacgatataatgtgccatttcttacttttattaacaagttggatagaatgggaagcaatccggctcgggctctccagcagatgagaagtaaattgaaccataatgccgcatttatgcaaatacccatgggcctggaagggaacttcaagggcatcgtcgacttgattgaagagagagccatttacttcgacggtgattttggccaaattgtgcgttacggggagattcctgccgagctgcgggctgccgctactgatcacaggcaggaactcatagaatgtgtcgccaacagcgatgagcaactcggtgagatgttcctcgaagagaagattccctctatttccgatttgaagctggccatccgcagagccacactcaaacgttcctttacaccggtgtttctggggtccgcccttaaaaataagggggtccaacctttactggacgcggtgttagagtatctgcccaacccatccgaggtacagaactacgctatcctgaataaagaagacgactctaaagaaaagaccaagattctcatgaattctagcagggacaacagtcacccatttgtggggttggcttttaaactggaagtggggcgattcggccaactcacctacgtgcggtcctatcagggcgagctgaaaaagggcgacactatatataatacgcgcaccaggaagaaggtccggcttcagcgcttagcacggatgcacgccgacatgatggaggatgtggaagaagtgtatgcgggtgatatctgtgctttgttcggcattgactgtgcctcaggagacaccttcaccgataaggccaatagcgggctcagtatggaaagtattcacgtacctgatccagtcattagcatcgccatgaagccttctaacaagaacgacttggagaagttctcaaagggcatcggcaggtttacgagagaagacccgacgttcaaggtctacttcgacactgagaacaaggagacagtcatttccggtatgggggaactgcacctggagatctacgcacagcggctggaacgtgaatatggatgcccatgtataacggggaaaccgaaggttgcattccgggaaactattaccgccccagtgccctttgatttcacccacaaaaagcaatccggcggtgccggtcaatatggtaaggtgatcggcgtgctggagccactggatccagaggactatacaaaactggagttctccgatgagacatttggctcaaacattccaaaacagttcgtgcccgcagtggagaagggctttctggacgcctgcgagaagggcccactgagcgggcataagctgagtggtctgagattcgtccttcaagatggagctcaccatatggtggattccaacgaaatttcattcatcagggctggtgaaggcgcactgaagcaagccctcgctaacgctaccctgtgcatccttgaacccattatggccgtcgaagtggttgcccctaacgaatttcaaggccaggtgatcgcaggcattaaccgaagacacggggtgatcacaggtcaagatggggtcgaggactatttcacattatacgccgacgtacccctgaatgatatgttcggttattccacggaactcagaagttgcaccgaggggaagggcgagtacacgatggagtattctcggtaccagccctgtctcccaagcacacaggaggacgtgatcaataagtatctcgaagcgaccggccaactccctgtcaaaaaaggtaaggctaagaactag

SEQ ID NO: 223857 - DNA, 459 bp, Artificial Sequence
  Description of Artificial Sequence: Synthetic coding sequence
atgagtctggttatccctgaaaaattccagcacatcctccgagtcttgaataccaacatcgacgggcgacgtaaaatcgctttcgcaataaccgccattaaaggcgttgggaggaggtatgcccacgtagtgcttcgaaaggctgacatagatctgactaaaagggccggagagctcactgaagacgaggtggagagggtcatcacaatcatgcagaaccctcgacaatataaaatccctgactggttcctgaatcggcagaaagacgtgaaggacggaaaatactcccaggttttggccaatgggttggataataagttacgcgaagacctggaaagactgaagaagattcgtgcgcacaggggactccgccacttctggggtctgcgggtaagaggacagcacacaaagaccacaggcaggcggggacggaccgtcggtgtttccaagaaaaagtag

SEQ ID NO: 223858 - DNA, 1071 bp, Artificial Sequence
  Description of Artificial Sequence: Synthetic coding sequence
atgtctagacctctcctcatcacctttacgcccgctactgaccctagcgatctgtggaaggatgggcagcagcagccccaacccgaaaagcctgagtccacgctcgatggcgcagcagcccgagccttctatgaagcactgataggcgacgagagctctgcacccgactcacagaggtctcaaacagagcctgccagggagcgcaaaagaaagaagaggagaattatgaaagcccctgcagctgaagccgtcgccgaaggagcaagtggacggcacggccagggacggagtctggaagctgaggataagatgacacacagaatcctcagagccgctcaggagggagatctacccgagctccggcgactgcttgaaccccacgaggctggaggagccggagggaacatcaacgctcgggatgccttttggtggactccgctgatgtgcgctgcaagagcaggacagggcgctgccgtgtcttatctgctgggtaggggcgctgcttgggtgggcgtctgcgaattgtctggaagggacgccgcacaactcgccgaggaagcagggttccccgaggtggcacggatggtacgcgaatcgcacggggaaacccgtagcccagaaaatagatcccctaccccctccctacaatattgcgagaactgcgatacccactttcaggacagcaatcacaggacgagcacagcgcacttgttatctctgtctcagggaccgcagccacccaatctgccgctgggagtgcctatttcatctcctgggtttaaactcctgcttcgaggcggatgggagccgggtatgggactgggccctcgcggagaggggagagcaaatcccattccgaccgtgctgaagcgagatcaggaaggccttggttacaggagcgcgccacagcccagggtgactcatttccctgcttgggatacaagggccgtggccggtcgggaaaggccaccaagagttgctaccttgtcctggagggaagaacgccgtagggaggagaaagaccgagcctgggaaagagacctgcggacgtatatgaacctagaattctag

SEQ ID NO: 223859 - DNA, 1071 bp, Artificial Sequence
  Description of Artificial Sequence: Synthetic coding sequence
atgtcacgtcctctgttgataaccttcactcccgcaaccgatcccagcgacctgtggaaagatggccagcagcaacctcagccagagaagcccgagagcacactagacggcgctgcagctagggcattttacgaggctttgataggcgacgagagttcagctccagatagccagagatctcaaacagaacccgctagagagagaaaacgcaaaaagcgccgaattatgaaggctcccgctgcagaagctgtggctgagggagcctccggccgtcacggccaggggaggtccctggaggcagaggataagatgactcaccgcatactgcgcgcagcccaggaaggtgacttgcctgagctccgccgtctgctggaaccccacgaggccggaggggctggcggtaatatcaatgctagggacgccttttggtggacacctctgatgtgcgccgcaagggcaggtcaaggagctgcggtgtcctatttgttgggtcgcggagccgcttgggtgggggtgtgcgagctcagtggccgagatgccgcacagttagctgaagaagcgggttttccggaagtagccagaatggttcgagaaagccatggggagacgcgatcccctgagaaccgaagcccaacccctagccttcagtactgtgagaattgtgatacacactttcaggactctaaccacaggacatcaacggcacacctgctgtcgctctcacaaggtccacagcctccaaacctgcccctcggcgtccccatctccagcccaggtttcaaactccttctgcggggtggttgggaaccagggatgggattaggaccaagaggagagggacgggcaaacccaatacccacagttctgaaacgagaccaagaggggcttggctatcgtagcgcccctcagcccagggtgacacattttcctgcttgggacacgcgggcagtcgccggacgggaacggccacccagggtggctaccttatcttggcgggaggaaagaagacgcgaggaaaaggaccgtgcctgggaacgcgacctcaggacatacatgaacttagagttttag

SEQ ID NO: 223860 - DNA, 1071 bp, Artificial Sequence
  Description of Artificial Sequence: Synthetic coding sequence
atgtccaggccccttctgatcacctttacccctgcgaccgacccatctgacttgtggaaagacggtcaacagcagccacagcctgaaaaacctgaatccaccctggacggtgccgcagcaagagcattttatgaagccctcattggggacgagtcaagcgcgccagactcccagaggtcacagacagagcccgcaagagagagaaaacgtaaaaaacggaggatcatgaaggcccctgctgccgaagcggtggcggagggcgcttcaggtagacatggtcagggacgcagccttgaggctgaggacaagatgacacatcggattttgcgcgctgcccaggagggtgatctgcccgagctgcggcgactgcttgagccccacgaggctggcggagctggaggcaacatcaacgctcgggatgccttttggtggacacctcttatgtgcgccgctagagccggtcagggtgcagctgtatcttatttgctgggccgtggggcagcatgggttggtgtttgtgagttaagtggtagggatgccgctcagttagcggaggaagcaggatttcccgaggttgcgaggatggttagggaaagccacggcgaaacccgcagcccagagaacagatctcccacgcctagcctgcagtactgtgagaactgtgatacccacttccaagatagcaaccacagaacctctactgcccaccttctcagcttgtcacagggcccacaacctccaaacctcccgctaggagtgcccatttccagcccaggtttcaagctgttgctgcggggtggttgggaaccgggaatgggacttggacctcgcggagagggacgtgcgaatccgataccaaccgtcctgaagagggatcaggagggactcggttatcggagtgctccccagcctagagtgacacatttccctgcctgggatacacgggctgttgctgggagagaaagacctcctcgcgtggcaacgctgagttggagagaggaacgcaggcgagaagaaaaggaccgggcatgggaaagggatctgaggacgtacatgaacctggagttctag

SEQ ID NO: 223861 - DNA, 1071 bp, Artificial Sequence
  Description of Artificial Sequence: Synthetic coding sequence
atgagccgcccattgctgattacatttaccccggctacagacccctcggacctctggaaggacgggcagcagcaacctcagccagagaagcccgaatcaacattggacggggcagccgcacgagcgttctacgaggctctgatcggggatgagtcttctgcaccggatagccagcggtcgcaaaccgaacccgcaagggaaaggaagcggaagaagaggcggatcatgaaggcacccgcagccgaagccgtggccgagggggctagtggccgtcacggacaggggaggtcccttgaagccgaagataaaatgacccatagaatcctgcgggcagcccaggagggcgaccttcctgagctcaggcggcttctggagcctcacgaggccggaggcgcagggggaaatattaacgcgagggatgccttttggtggaccccattgatgtgcgctgcaagggccggacagggcgctgccgtgtcgtatttattagggcgtggcgcagcttgggtgggcgtctgtgaactgtccggcagggatgccgctcagcttgccgaggaggcgggtttccccgaggtcgccaggatggtcagggaaagtcacggggaaaccaggtcaccagagaacaggagccctacgccgtcacttcagtactgcgagaattgtgacactcattttcaagattctaatcaccggacctcaacggcccaccttctatccctttctcagggtccacagccccctaacctcccactgggtgttcctatttcctcgccgggtttcaaattgctactgagaggcggatgggagcccggaatgggtttaggccctcggggtgaaggcagggccaatccgattccgacagtccttaagagggaccaagagggcctcgggtatcgctccgcgcctcaacctcgggttactcacttccccgcttgggacacacgtgccgtggccggtagggagcggcctcctagagtggcaactctgagctggagggaagaacgtcgcagagaggagaaagacagggcatgggaacgggacctgcgaacttatatgaatttggaattttag

SEQ ID NO: 223862 - DNA, 1071 bp, Artificial Sequence
  Description of Artificial Sequence: Synthetic coding sequence
atgtcccggcctctcctgatcacctttacccctgcgaccgatcctagtgatctttggaaggacggtcaacaacagccgcaaccagagaaacctgaaagtacactggacggcgctgccgctcgggcattctatgaggcactgatcggagacgaaagttcagcacctgatagtcaaagatcccagaccgaacctgccagggaacgtaaaagaaagaaacgcaggataatgaaagcaccagctgctgaggcggtcgccgagggcgcatccggcaggcacgggcagggacgtagcctagaagccgaagacaagatgactcacaggatactacgggctgcgcaggagggcgacctgcctgaacttagaagactactcgaaccacacgaagccggaggggctgggggaaacattaacgctagagatgcgttttggtggacccccctgatgtgcgcggcacgggcaggccagggagcggctgtgtcctacttactaggccgaggggctgcttgggtgggcgtgtgcgagttaagtggacgcgatgctgctcagttagccgaggaggccggattcccagaagtggcaagaatggtgagggaatcacacggggaaacacgaagcccagagaaccgctctccgacgccatctctccaatactgcgaaaactgtgatactcattttcaggatagcaatcaccgcaccagcactgcccatcttcttagtctttctcaaggcccacagccccctaatttacctctcggtgtccccatatcatcaccagggtttaagcttctcttgcggggaggatgggagcctggcatgggactcgggccaagaggcgagggaagagcgaacccaataccaaccgtgttgaagagagatcaggaggggttgggatatagaagtgctccccagccccgagttacccatttcccagcttgggataccagagcggtcgccggacgcgagagaccaccaagagttgccacactgagttggagggaggaacgcaggcgggaggaaaaggaccgggcatgggagcgcgacctccgtacgtatatgaatctcgagttctag

SEQ ID NO: 223863 - DNA, 1071 bp, Artificial Sequence
  Description of Artificial Sequence: Synthetic coding sequence
atgtcacgtccactccttattacattcacccccgctacagacccctctgacttgtggaaagatgggcaacagcagccacagcccgagaagcccgaatcgaccctcgatggcgcagccgcactcgccttttatgaggcattgatcggcgacgagtcctccgctcccgactcacaacgttcccagactgaacccgcacgggaaagaaagcgaaaaaaacgcaggatcatgaaagcaccagccgcagaggctgttgccgagggagcctctggccgacacgggcaaggtcgaagcctcgaggcagaggataagatgacgcaccgaatcctgcgtgcggctcaagagggagacctgcccgagctgcggagactgctcgaaccccacgaggctggcggtgcaggtggaaacatcaacgcgagggatgctttctggtggacgcccctgatgtgtgccgcaagagcgggtcagggcgctgccgtgtcctacttgttgggccgaggagccgcttgggtcggtgtctgtgagctgtcgggccgtgacgctgcgcagttggcagaagaggctgggtttccagaggtcgctcggatggttcgggagtcccatggtgaaacacgctctcctgagaacaggtctcctactccaagcctccagtattgcgaaaattgcgatacccactttcaggacagcaatcacagaacatcgaccgcccatttactgagcttgagccaaggcccacagcctcccaacttgcctctgggtgtgccaatcagcagccccggttttaaactcctgctgcgcggaggttgggaacccggaatgggactgggccctcgcggagagggacgtgctaaccctatccccacagtcctaaagagggaccaggagggactgggatatcggagcgcccctcagcccagggtcacacacttcccggcttgggacacccgcgctgttgcaggcagagagaggccgccacgcgtggcaacactgagctggagggaagagcgcagaagggaagaaaaggaccgggcttgggagcgggaccttcgcacatacatgaacttggaattttag

SEQ ID NO: 223864 - DNA, 1071 bp, Artificial Sequence
  Description of Artificial Sequence: Synthetic coding sequence
atgtccagacctctgcttatcacattcactcccgctacagatcctagcgacttatggaaggatgggcagcagcaaccacagcctgaaaagcctgagtctaccttagacggcgcagccgctctggctttctacgaagcactgattggtgacgaaagctcagcaccggattcccaacgctcccagacggaaccagccagggaaaggaaaaggaagaagcggcgtatcatgaaggctcccgcagcggaggcggttgctgagggcgctagtgggagacatggccagggacgcagtctcgaagccgaggacaaaatgactcacaggatcctgcgggctgcccaggaaggggatcttcctgagttgaggcggctgttagagccgcacgaagctggtggagccggaggaaatatcaacgcacgagacgctttctggtggacacctttaatgtgcgccgcaagggcgggacagggagcggctgtctcttacttactgggacggggagctgcgtgggtcggtgtttgcgagttgagcggaagagacgcagctcagctggcagaagaagctgggtttccggaggtggcaaggatggttagagagtcccacggcgagacacgatcccccgagaaccggagcccaacacccagcctgcaatactgcgagaactgcgacacccattttcaggacagcaaccacaggacgtccactgcccatctgctttcgctttcccaggggcctcaacctcccaaccttccgttaggtgtgcctatatcctcacctgggttcaagctgcttctgagggggggatgggagcctggaatgggtttgggccctcgcggagaaggcagggccaacccaatccctacagtacttaaaagagaccaggaaggactgggctatcgcagtgcaccccagccgagagtaacacatttccctgcttgggacactcgcgcagtagctggccgtgagaggccaccacgtgttgccacgctttcttggcgggaagaaagacggcgagaagagaaggatcgggcatgggaacgcgacctgcgcacttatatgaacctcgaattttag

SEQ ID NO: 223865 - DNA, 1071 bp, Artificial Sequence
  Description of Artificial Sequence: Synthetic coding sequence
atgagccgccctctcttgattaccttcactccagccacggatccatcagacctgtggaaagacggacaacagcagcctcagcctgagaagcccgaatccactcttgacggcgctgcagccctcgccttctacgaggccctgattggagatgagagtagcgcccctgattctcagagatcgcagaccgaaccagcaagggagaggaaaaggaagaaaagaaggattatgaaggctccggctgccgaagctgtggccgagggcgcatctgggaggcacgggcagggcagaagcctagaggcggaagacaaaatgacgcatcggattctgcgtgctgctcaagaaggggacttgcccgagttgcgacgtctgcttgagccacacgaggctgggggtgcagggggaaacataaacgctagagatgccttctggtggacgccactgatgtgtgccgcacgggctggccagggcgctgcagtgtcatacctccttggacgaggcgcagcttgggtgggcgtgtgcgagttaagcggacgcgatgcagctcagctggccgaagaagccggtttcccagaagttgcaaggatggtgcgagagtcccatggagagacacgttctcccgagaataggagtccaaccccaagcctgcagtactgcgagaattgtgatacccattttcaggactcaaaccacaggacatcaacggcgcatcttctctccctgagtcagggaccccaaccccctaacctaccactaggcgtgcctattagctcaccaggattcaaactgctcttgagaggaggatgggagccagggatgggcctaggtcccagaggtgaaggtcgtgccaaccccatacctacagtcctgaagagggatcaagagggactgggatacagaagtgcccctcaaccacgagtgacccattttcccgcatgggatacaagagctgtggccggtcgggaaagacccccaagagtcgctacactgagttggagagaggagagacgccgagaggagaaggaccgggcatgggaaagggacctgcgcacctatatgaacttggaattctag

SEQ ID NO: 223866 - DNA, 1071 bp, Artificial Sequence
  Description of Artificial Sequence: Synthetic coding sequence
atgtcgcgaccccttctgatcacatttacccccgctactgacccgagcgatctttggaaagatggccagcaacagcctcagcctgaaaagccagaaagcactctggacggagcagctgccctcgccttctatgaggctctcattggcgatgagtcaagtgcgcctgacagccagaggagtcagacagaacctgcacgcgaaaggaagagaaaaaaacgcaggattatgaaggccccagctgccgaggccgtggctgagggcgctagcggtagacatgggcaaggcaggtccctagaagctgaagataaaatgacacatagaatactgagggcagcgcaggaaggcgacctgccagagctgcgtaggctgttggaaccccacgaggctggcggagccggaggaaatattaacgccagggacgcgttctggtggacgccgttgatgtgtgctgctcgggctggacaaggagccgcagtcagttaccttctgggaaggggcgctgcctgggtcggagtatgtgaattatcaggtcgcgacgcagcccaactggcagaagaagccggattcccagaggttgccaggatggttcgtgaatcccacggagaaacacggtcccctgaaaacaggtcccccactccttccctacagtactgcgagaactgcgacacgcactttcaggatagcaatcatcgcacatccaccgcccatctgctaagcctcagtcaggggcctcagccccctaatctccccctcggcgtgcctatctccagcccgggatttaaactccttctgcgtggcggatgggagcctggaatggggctcggccctcgcggagaggggcgtgcaaatccgatacccaccgtattgaagagggatcaggagggattggggtaccgttctgcacctcagccaagagttacccattttccagcctgggacacacgcgctgtcgccggaagggagcgaccacccagggtcgccacactttcatggcgagaggagcgaagaagagaggagaaagaccgcgcatgggagcgggacctcaggacttacatgaatctcgagttctag

SEQ ID NO: 223867 - DNA, 1071 bp, Artificial Sequence
  Description of Artificial Sequence: Synthetic coding sequence
atgtctcggccactcctgattacgtttacaccagctacggacccatcagacctgtggaaggacgggcagcagcagcctcaaccagagaaacccgagtcgaccctcgacggggctgctgcgctggcgttttacgaggcattaattggggatgagtccagcgctccagactcccagcgcagccagacggaacctgcgcgtgaaaggaagcggaaaaaaagacgcatcatgaaggcccctgccgctgaagcggtcgccgaaggggcaagtggacggcatgggcaggggcgttctctggaggccgaggataaaatgacacaccgcattcttcgggcagcacaggagggcgacctccctgagctgagacgcctcctggagccacacgaggccggaggcgcaggcggaaatatcaatgccagggacgctttctggtggacaccgcttatgtgtgcggcacgcgcaggtcagggagctgcagtttcgtacttgttggggagaggcgcagcctgggttggagtctgtgaactgtcgggccgagacgccgctcaacttgccgaggaggcagggttcccagaggtggccagaatggtgagggagtcacacggagagacgagatcccccgagaatagatccccaactccctctctgcaatactgcgagaattgtgatactcattttcaagattccaaccaccgcactagcaccgcccatctgctctcactgagtcaggggccacaacccccaaatctgccactgggagtgccgatttcaagcccaggcttcaaactgctgctccgaggcggatgggagcccggaatggggctgggtcctcgtggcgagggaagagccaaccccatccccacggtgctaaaacgtgatcaggagggattgggatatcgatccgcccctcaaccacgggttacccactttccggcatgggacacccgggctgtcgcagggagagaacgaccccctagggtcgccacactgtcctggcgcgaggagagacgtcgggaggagaaagaccgggcttgggagcgtgacctgagaacgtacatgaacctcgagttctag

SEQ ID NO: 223868 - DNA, 498 bp, Artificial Sequence
  Description of Artificial Sequence: Synthetic coding sequence
atgtctagaccgctgctcattacatttacaccagccaccgatccaagcgacctctggaaggacggacagcagcagcctcagcccgaaaaacccgaaagtaccctggacggagctgccgcacgggctttctatgaggccctgattggtgatgagtccagcgctccagactctcaaaggtcccaaaccgagccagcaagggaacgtaagagaaagaaaaggcgtatcatgaaggcaccagccgcagaggctgttgccgagggagccagcggaaggcatgggcagggccgttctctggaagctgaagataagatgacacacaggatccttcgggcagcacaggagggcgatttgcccgaattacggcgacttctcgagcctcacgaagccggaggggctggaggaaatatcaatgccagagacgctttttggtggacgcccctgatgtgcgcagccagggccggacagggcgctgccgtgagttatcttctgggtaggtag

SEQ ID NO: 223869 - DNA, 459 bp, Artificial Sequence
  Description of Artificial Sequence: Synthetic coding sequence
atgtcgcggcctcttttaattacgttcaccccagccacggaccctagcgacctgtggaaggacggccagcagcaaccccagcctgagaagcccgagagcaccctggacggcgcagcagccctggccttttacgaggccctcatcggggatgaaagctcggccccagatagtcaacgctcccagacagaacccgctcgggagcgcaagcgtaaaaagcgcagaattatgaaagctcctgctgctgaggctgtggcagagggggcttccggtcggcatggtcagggcagaagcctcgaagctgaggacaaaatgacccacaggattctccgggctgcacaggaaggcgatctcccagaactccgcagacttcttgaaccacatgaagccggaggtgctgggggtaacattaacgctagagatgcattttggtggaccccactgatgtgtgccgctcgctag

SEQ ID NO: 223870 - DNA, 1071 bp, Artificial Sequence
  Description of Artificial Sequence: Synthetic coding sequence
atgtctcgacctctgctaatcacctttaccccagccacggacccatccgatctttggaaggatggtcagcagcagccccagcctgagaagccagaatccacactggatggcgctgcagccctagccttctatgaagccctgattggagatgaaagctccgcccctgactctcagaggagtcagacagagccagctagggagcgtaagaggaagaagagaaggattatgaaggcgccagctgccgaagcggtcgccgaaggcgcatcaggccgacacgggcagggaaggtcgctggaggcagaggataagatgacacacaggatattacgggctgcccaggagggcgacctgccagaattgcgtcgattgctggagccccatgaggcaggtggagcaggcggaaatatcaatgccagggatgctttttggtggacaccacttatgtgtgcagcaagagcgggtcaaggcgcagctgttagctacctgttgggtaggggagccgcatgggtaggagtatgcgagctatccggcagggacgccgcacagctggcagaggaggccggatttccggaagtggccaggatggtacgcgaatcgcacggagagactaggtcccccgagaatcgctctcctactccctctctccagtattgtgagaattgcgatacgcacttccaggacagcaatcacaggacatcaacagcccacctcctctcactaagccagggaccacagccaccgaacctgcctctgggcgtgcccatcagttcacccggattcaagttgttgctgcggggtggctgggagccaggtatgggattgggtcccaggggcgaaggtcgcgctaaccccatcccgactgtgttgaagcgggatcaggagggtttaggctaccgctccgcccctcagcccagggtcacccacttccctgcatgggacacacgagccgtggcaggcagagaacgacccccaagggtcgccactctgtcatggcgcgaggaacgcagacgtgaagagaaggacagggcctgggagcgggatctgcgcacctacatgaatctggaattttag

SEQ ID NO: 223871 - DNA, 459 bp, Artificial Sequence
  Description of Artificial Sequence: Synthetic coding sequence
atgtcccggccactgttaatcacctttaccccagctactgacccctccgacctctggaaagatggtcagcagcagccacaaccagaaaagcctgaatctactttagacggagctgccgcacgggctttttacgaggctcttataggagacgaaagcagtgccccagactcccaacgttcccagacagaaccggctcgagagaggaagcgaaagaagcggcgaatcatgaaagcccctgctgcagaggccgtcgcggagggcgcatccggccgtcacgggcagggacggagcctggaagcagaagataaaatgacccatagaatcctccgcgcagcacaggagggagatctccccgagttaagaagacttctggagccccatgaggccggaggagcaggcggaaatatcaatgccagagacgccttctggtggacacctctcatgtgcgccgctcgttag

SEQ ID NO: 223872 - DNA, 498 bp, Artificial Sequence
  Description of Artificial Sequence: Synthetic coding sequence
atgtcccgacccctgttaatcacatttacaccagcaaccgatccaagcgatctctggaaggatggacaacagcaaccccagcccgaaaaaccggaaagtacgctggatggggcagctgctctggctttctatgaagcccttataggggacgagtcaagcgcgcctgacagccagcgtagccagacagagcccgcacgtgagcggaagaggaagaagcgccgaataatgaaagcccctgccgctgaagccgtggccgagggcgcttccggcagacatgggcaggggcgaagcttggaggctgaggacaagatgacccaccgcattttgcgagctgcacaggaaggcgacctacctgagttgcggcgactcttagaaccacacgaagccggaggagctggcggtaacattaatgcaagggacgccttctggtggactcccctgatgtgtgccgctcgcgcaggccagggtgcagcagtgagttacctattgggccgatag

SEQ ID NO: 223873 - DNA, 273 bp, Artificial Sequence
  Description of Artificial Sequence: Synthetic coding sequence
atgtctaggccgctattgattaccttcacccccgcaaccgatcctagtgacctctggaaagacggtcagcagcagccacagccggagaagccagagagcacgctggacggggctgccgcactggcattttatgaggcccttatcggggacgagtcgagcgcgcctgacagccaacgtagtcagacggagcctgcacgcgaaaggaaaaggaagaaaagacggattatgaaggccccagccgctgaggccgtggccgagggagctagcggatag

SEQ ID NO: 223874 - DNA, 1071 bp, Artificial Sequence
  Description of Artificial Sequence: Synthetic coding sequence
atgagccggccactgctgatcacatttacaccggctacagatccttccgatctatggaaagacgggcagcagcagccccagccagagaagccggaaagtacccttgacggcgctgccgctagggccttttacgaagccctgattggcgatgaaagtagcgcccctgattctcagcgctcccagactgagcccgctagggaacggaagcggaaaaaaagacggatcatgaaggctccagcggctgaggctgttgcagaaggggcaagcggacgtcacggtcaggggaggagtctggaagccgaggataaaatgacccaccggatcctgcgagccgctcaggagggtgacctgcctgagcttcggcgactgcttgaacctcacgaagctggtggcgcaggtggcaatattaatgccagggatgctttctggtggacgcctctgatgtgcgcagctagggctggccaaggtgcagcagtgtcctatctccttggacggggagcagcatgggtgggggtctgcgagctgagtggcagggatgcggctcagctggcggaggaagcgggattccctgaggtcgccaggatggttcgcgagtctcacggagagacgagatctcccgaaaaccgcagcccaacaccatcacttcagtactgtgaaaactgtgatactcactttcaggacagtaaccacagaaccagtacggcccaccttctcagcttgagccagggcccacagccacccaacctgccactcggcgtgccgatcagcagtcctggcttcaagctcctactgcgaggcggatgggagcccggtatgggcctgggacctcggggagagggcagggcgaaccctattcctacagtgctgaaaagggatcaggaaggtctgggctaccgctctgctccacaacctcgggtcacccacttcccagcttgggatactcgcgctgtggccggacgggaacgccctcctagagttgccacactcagttggcgggaggagcgaagaagagaagaaaaagatagggcttgggagagagatctgcgaacctacatgaatctcgagttctag

SEQ ID NO: 223875 - DNA, 1071 bp, Artificial Sequence
  Description of Artificial Sequence: Synthetic coding sequence
atgagtagacccctgctgatcactttcacaccagctaccgacccaagcgatctctggaaggatggacagcaacaaccccaaccggaaaagccagaatccaccctcgatggggcagctgcaagggctttctacgaagcccttatcggcgatgagtcctcagccccagatagtcagaggagccagaccgaacctgccagggagcgaaaacgcaaaaagcgcaggataatgaaggcaccggctgcagaggccgtcgctgagggtgcatccggtagacatggccagggaagaagcttggaagccgaagacaagatgacacatcgtatacttcgagcggcacaagaaggggatctacctgaattgcggaggctccttgagccccatgaagccggaggcgcaggcggaaatatcaatgctagagacgctttttggtggacccccttaatgtgtgccgctagggcaggccaaggggcagctgtcagctatctcttaggacgcggagcagcctgggtaggggtgtgcgagctgtccggaagagatgccgctcagctcgctgaggaggcgggttttcccgaggttgcaagaatggtgagagaaagtcatggcgaaactagatcgcctgaaaaccggagtcccacaccatcacttcagtactgcgagaattgcgacactcactttcaggattccaatcacagaaccagtaccgcccatctgctgtccttgtcgcagggccctcagcctcccaatttgccattgggagtgccaatctcttcaccaggattcaaactactgctgagaggcggatgggagccagggatggggctgggtccacggggagagggaagagctaaccccatccctacagtactgaagagggaccaggaggggttaggataccgttcagctccccaaccccgagtgacacattttccggcatgggatacccgggcagtggccggtcgcgaacgcccaccgagagtagccactctctcctggcgggaagagcgcaggagggaagaaaaagaccgcgcttgggaaagggacctgcggacgtatatgaacctggagttttag

SEQ ID NO: 223876 - DNA, 324 bp, Artificial Sequence
  Description of Artificial Sequence: Synthetic coding sequence
atgtccagaccactgctaatcacttttaccccagcaaccgatccttccgatctgtggaaggacggtcagcagcagccccagccggaaaagcccgagagcaccttagacggagctgccgcacgggctttctacgaggccctcatcggggatgagagttccgccccagattctcagcgatctcagaccgaacctgcccgtgagcggaaacggaagaagaggagaatcatgaaagccccagcagccgaagcggtcgccgagggagcctctggaaggcacggtcagggcagatcactggaagctgaagataaaatgacccaccgatag

SEQ ID NO: 223877 - DNA, 324 bp, Artificial Sequence
  Description of Artificial Sequence: Synthetic coding sequence
atgtcacgtcccttgctaattactttcactccagctactgatcctagtgatctctggaaagatggccagcagcagccccagcccgagaagccagagtccacactggacggggctgctgccctagccttctatgaggccttgatcggtgacgagtccagcgcacccgactctcagaggagccaaaccgagccagcccgtgagaggaaaaggaagaagcgcaggataatgaaagctccagcagcagaggccgtggcagaaggggctagtggacgccacggccagggccgtagcctggaagcagaagataaaatgacacacagatag

SEQ ID NO: 223878 - DNA, 1071 bp, Artificial Sequence
  Description of Artificial Sequence: Synthetic coding sequence
atgtcaaggccgcttctgatcactttcactccggctaccgatccctcggacctgtggaaggacggacagcagcagccacaaccagagaagccagagtcgacgttggacggagccgcagcccgtgcattctatgaagccctgatcggggacgaatcttctgcaccagactcgcagcgctcccagactgaacccgctagagagcgcaagcgtaaaaagcgacgtataatgaaggcaccagccgctgaggctgtggcagagggcgcatccggcaggcatggccaaggaagatccctggaagccgaagacaagatgacccacaggattctgagagccgcacaagagggagatttacccgagctccgtaggttgcttgaaccccacgaagcgggtggagctggcggtaacatcaacgctagggatgctttctggtggactcctttgatgtgcgccgctagggccggacaaggagcagccgtgagctatttgcttggcagaggagccgcttgggtgggggtatgtgagcttagtgggagagacgccgcacagttggccgaagaggcaggctttcccgaggtggccagaatggtccgcgagagccatggtgagacacgctcgccggaaaacaggtctccgaccccaagtttgcagtactgtgagaattgtgacacgcatttccaggactccaaccacagaacgtctacagctcaccttctgtcgctgtcccagggtcctcagcctcctaacctgcccttgggcgttcctatatcatctccaggatttaagctgctgctgcgaggtggttgggaacccggaatgggactaggccctagaggcgagggcagagccaatcccattccaaccgtactcaaacgggatcaggaaggcctgggttatcggtctgcacctcaacccagagtcacccacttcccggcttgggacacacgggctgtggccggtagggaaagaccaccacgggttgctactctgagttggagggaagaacgtcgcagagaggaaaaggacagggcgtgggagcgggacctgcggacgtatatgaacctagaattctag

SEQ ID NO: 223879 - DNA, 1071 bp, Artificial Sequence
  Description of Artificial Sequence: Synthetic coding sequence
atgtccagaccgctcctgataacatttacaccggcaaccgatccatccgacctgtggaaggatggtcagcaacagccccagcccgagaagccagagtcgacgcttgatggagcggctgccagagccttttacgaggctttaatcggagacgagtctagcgccccagactcacagcgttcccagaccgagcccgcacgggaaaggaagaggaagaaaaggagaatcatgaaggcacccgctgcagaggctgttgcggaaggcgcaagtggcagacatgggcagggccgttcactggaggccgaagacaagatgacacataggatattgcgggctgctcaggagggtgacctgccagaactgcggaggctgctcgaaccgcacgaagcgggtggcgctggcggtaacatcaatgctagggatgccttttggtggacccctctgatgtgtgccgctcgcgctggccagggtgccgcagtgtcctacctactgggcagaggagctgcatgggtcggtgtgtgcgagctaagtggtagggacgcggctcagctggcggaggaggctggcttcccagaggtagccaggatggtgcgagagagccacggggagacacgtagcccggaaaacagaagcccgacaccctcacttcagtactgcgagaactgcgatactcattttcaagactcaaaccatcggacgagcacggcccacttactgtcattatctcagggtccacagcccccaaatttgcctctgggagtacccattagtagtcctggtttcaagctgttactccggaggggatgggaacccggaatgggcttgggccctcgaggggaaggaagggctaacccaattcctaccgtcctaaagagagaccaagagggactgggataccgaagcgccccacagcctagggttacccactttcccgcatgggacacccgcgctgttgccggaagggagaggccgcctagagtggccactctttcctggcgcgaggaacggaggcgtgaggaaaaggaccgcgcttgggagcgggatctaaggacgtacatgaatctggaattctag

SEQ ID NO: 223880 - DNA, 1071 bp, Artificial Sequence
  Description of Artificial Sequence: Synthetic coding sequence
atgtctcgacctttgctgatcactttcacccccgcaaccgacccctcagatctttggaaggacggccagcagcagccacagcccgagaagcctgaaagtacccttgatggcgctgccgcacgcgctttctatgaagctctgattggggatgagtcaagcgccccagattcacagaggtcacaaacggaaccggcacgcgagcgaaaacgaaagaagagacggatcatgaaggctcctgcagccgaagcagtggccgagggggctagcgggaggcacgggcagggaagaagtctggaagccgaagataagatgactcatcgaattctgcgcgctgctcaggagggagacctgcccgaattgcggaggttactagaaccccatgaagccggaggcgcaggaggtaatattaatgcaagggacgctttttggtggacccctcttatgtgtgccgctcgcgctggacagggcgctgcggtgtcgtacctgcttggaagaggcgctgcttgggttggagtgtgcgaactgtccggtcgggacgcagcacagctggctgaagaagcgggttttcctgaggtggctcgtatggtgcgggagtcccacggagagacacggtctccggagaatcggtcacccactccatcattgcagtattgcgagaactgcgatacccactttcaggactctaatcatcgcactagcactgctcatctccttagcttgtcccaggggccacagcccccaaacctgcctttaggagtgccaatatcttctcccggattcaagttgctgttgcgcagaggttgggaaccaggtatgggccttggcccacgcggtgagggcagggcgaacccaattcctaccgtcctgaagagggaccaggagggcctggggtatcgctcagctccacagccccgagttacgcactttcccgcatgggacacacgcgctgttgccggtcgagagcggcctccacgggtagctactctgagttggcgtgaagagcgccgacgagaagagaaggaccgcgcttgggagcgcgatttaaggacctatatgaatctggaattctag

SEQ ID NO: 223881 - DNA, 498 bp, Artificial Sequence
  Description of Artificial Sequence: Synthetic coding sequence
atgtcaaggcctctcctgattactttcaccccagccaccgaccccagtgacctctggaaagacggacagcaacagccccagcccgagaagcctgagtccaccctcgacggcgctgcagccagagccttttacgaagcactgattggggatgagagttccgctcctgactcccagaggagtcaaacagagcctgcccgtgagcgtaagcggaagaaaagacggattatgaaggcccctgctgcggaggccgtcgcagagggggctagtgggaggcacggtcaggggaggagccttgaggcagaagataagatgactcacaggattctgcgcgcagctcaggagggtgaccttcctgaacttcggaggctgctggaacctcatgaagctggtggtgctgggggtaatatcaacgctagggacgccttttggtggacaccgttaatgtgtgcagccagggctggtcagggtgctgctgtttcctacctactgggcaggtag

SEQ ID NO: 223882 - DNA, 1071 bp, Artificial Sequence
  Description of Artificial Sequence: Synthetic coding sequence
atgtcacgacctcttctaattacctttactcccgcaaccgaccctagtgatctgtggaaggacggccagcagcagccccaaccagagaaaccagaatccaccttggacggagccgcagcccgagctttttacgaggccctgattggggatgagagcagcgccccagactcacagagatcacagactgaacccgctcgcgaaagaaagagaaagaagcgcagaattatgaaagctccggctgcggaggccgtcgccgaaggtgcaagcggacgtcatgggcaggggagatccttggaagcagaagataagatgactcacaggatactgagggctgcccaagaaggggatctgcccgaactgaggcgccttctagaaccgcacgaggcaggcggagcgggagggaatatcaacgccagggatgcattttggtggacccccctgatgtgcgcagcccgagctgggcagggggcagcagtgtcctacctcctgggcagaggagccgcatgggttggtgtctgtgagttgagcggacgtgacgccgcacagctggctgaagaagcagggttccccgaagtggccaggatggttcgtgagtcacacggtgaaacccgttcgccagaaaataggtccccaacgccatccctgcagtactgtgagaattgtgatactcatttccaagactctaaccacaggacgtctacggcccatctgctcagtctctcccaaggccctcagccgcctaacctacccttgggcgtgcctattagcagcccgggattcaaactcctgctgcgcggaggttgggagcctgggatggggctaggtcctcgtggggagggtcgggctaatcctatccccaccgtcctaaaaagggaccaggagggcttaggctaccgctcggcgcctcaacctagagtgacacatttccccgcttgggatactagggctgtggccggaagagaacgcccacctcgggtggctacgctttcctggagggaagagaggaggagggaagaaaaagatagagcctgggagagggatctccggacttacatgaatcttgaattttag

SEQ ID NO: 223883 - DNA, 597 bp, Artificial Sequence
  Description of Artificial Sequence: Synthetic coding sequence
atgtcaaggccgttgctgataacattcacccctgctacggatccatctgatttgtggaaagacggacagcaacaaccacagcctgagaagccagagtcgacattggacggagccgctgcgcgagcattctatgaggcccttatcggagatgaatcctccgcacctgatagccagagatcccagacagaaccggcacgcgagaggaaacgaaagaagcgaagaattatgaaagcaccggctgcagaggcagttgctgaaggagcttctggaagacatggacagggaagatcccttgaagccgaagataaaatgacccacagaattctgagggccgctcaggagggtgacttgcctgaactgcgaaggcttttggagcctcatgaggcagggggtgcaggcggaaatatcaatgccagagacgccttttggtggacgccactcatgtgtgctgcaagggccggtcagggcgctgcagtctcatacttactaggaaggggcgcagcgtgggtgggagtctgcgaattgagcgggagagacgctgcccagcttgccgaagaagctggctttccagaggtggctcggatggtccgcgagtag

SEQ ID NO: 223884 - DNA, 1071 bp, Artificial Sequence
  Description of Artificial Sequence: Synthetic coding sequence
atgagccggcctctccttatcacatttacacccgcaacggacccctcagatctatggaaggatggacaacagcagccccagcctgaaaagcccgagagtacgcttgatggtgctgccgcaagggccttctacgaggctctgataggagacgaatcttctgccccagacagtcaacggagtcagactgagccagctagggaacgcaaacgcaaaaaacggcgtatcatgaaggcacccgcagctgaagctgttgctgagggtgccagcggccgacacggccaggggaggtcgctggaggccgaggataagatgacacatagaatcctgcgtgcggctcaagaaggggacctgccagagctgcgtcggctgttagagcctcacgaagctggcggtgccggaggcaacattaacgcgagggacgcattctggtggacccctctgatgtgcgcggcaagagcgggacagggcgcagcagtatcttatctcctcgggcgaggggctgcttgggttggtgtgtgtgaactgagcggaagggatgccgcacagctggccgaagaagcagggtttcctgaggtggctagaatggtgagagagtctcatggagagactagaagccccgagaatcggtcgcctacacctagcctgcagtactgtgaaaattgcgacactcacttccaggactccaaccatcggacatcaacggcacacctcctgtcgctgagccagggccctcagcccccaaatcttcctctgggcgtgcccatttccagcccaggtttcaagctgctcctgaggcgcggttgggaaccagggatggggctcggtccacggggagaagggcgtgctaatccaattcctacagttctgaagcgggatcaggagggcttagggtaccggtcagcgccacagcccagagtaacgcattttcctgcatgggacacccgcgcagtcgcgggtcgggaacgtcctcccagggtggctacgctgagttggcgggaagaacgacggcgagaggaaaaggatcgagcctgggagcgggatctacgaacttacatgaacctggaattctag

SEQ ID NO: 223885 - DNA, 498 bp, Artificial Sequence
  Description of Artificial Sequence: Synthetic coding sequence
atgtcacggccactcctcattacattcacccctgccactgatccatctgatctctggaaagacggccagcaacagcctcaacctgaaaagcccgaaagtactctggacggggctgccgcactcgcattctacgaagctctgatcggcgatgagtctagtgctcctgacagccagcgctctcagactgagcccgctcgggagcgtaagaggaaaaagaggcggatcatgaaggcaccagctgctgaagccgtggccgaaggcgcttcggggcgtcacggccaggggaggtcccttgaagcagaagacaaaatgactcataggattctgagggcagcgcaggagggcgacctgccagaactacgacgcttgctggagccacacgaagctggaggagccggtggcaacatcaatgcaagggatgctttctggtggaccccactcatgtgcgccgctagagccggacagggggcagcagtttcctacctattgggcaggtag

SEQ ID NO: 223886 - DNA, 459 bp, Artificial Sequence
  Description of Artificial Sequence: Synthetic coding sequence
atgagtaggccgctgctcattacattcacccccgcaaccgacccaagcgacctttggaaggacggtcagcaacagccccagcctgagaagccagagagcaccctcgacggagccgcagcgctcgctttctacgaggccctgatcggagatgagtcctctgcacctgatagccaaagaagccaaaccgagcccgctagagagaggaagcggaaaaaacggagaattatgaaggcaccagcagccgaagccgtggctgagggcgcatccggccgacatgggcaagggcgtagtttggaagccgaggacaaaatgacgcacagaatcctccgagccgcacaggaaggcgacctacctgagctcaggagactgctggaacctcacgaagccggtggcgctggagggaatattaatgctcgggacgccttttggtggacgcccctaatgtgcgcagcgagatag

SEQ ID NO: 223887 - DNA, 459 bp, Artificial Sequence
  Description of Artificial Sequence: Synthetic coding sequence
atgagcagacctctcctaattaccttcactccagccaccgatcctagtgacctctggaaagacggccagcaacagccgcagcctgaaaagcccgagagcacattagacggtgcagcggctcttgctttttatgaggcactgattggagacgaatccagtgctccagactctcagcggtctcaaacggagccagcccgagagcggaaaaggaaaaagagacgcattatgaaagctcccgctgccgaggctgtggccgaaggcgcatctggaaggcacggacaggggcgttcactcgaagcagaggacaaaatgacacatagaatcttacgcgcagctcaggaaggagacctgcctgaactgcgcagactactggagccccacgaagccggaggagcgggtggaaacatcaatgcacgtgacgccttttggtggacccccctgatgtgcgcagccaggtag

SEQ ID NO: 223888 - DNA, 597 bp, Artificial Sequence
  Description of Artificial Sequence: Synthetic coding sequence
atgagcaggccactgctgattactttcacccctgccacagacccatcggatctctggaaggacgggcagcagcagccacagccagagaagccggagagcacactggatggggctgccgctctcgctttctatgaagctttaatcggagatgagagctccgctccagacagccagcggtctcagacagagcctgcgcgagaacgtaagaggaaaaagcgacgaataatgaaggcccctgccgctgaagcagttgcagagggcgcatctggcaggcatggtcaggggcgaagtctggaggcggaggataagatgacccacaggatactgcgggctgctcaggagggcgatctgcctgagctgcgaagactgcttgaacctcacgaggcaggcggagccggaggtaatattaacgcaagggacgctttttggtggaccccattgatgtgtgcagccagagcagggcagggagccgcagttagctatctgctgggcagaggcgctgcttgggtgggggtgtgtgaattgtcaggccgagacgccgcacagctagcggaggaggccggattccctgaagtcgccagaatggtaagggagtag

SEQ ID NO: 223889 - DNA, 597 bp, Artificial Sequence
  Description of Artificial Sequence: Synthetic coding sequence
atgagtcgtccactgcttattacatttactcccgcaaccgacccctccgacttatggaaggatgggcagcagcaaccacaaccagagaaaccagagtccactctggacggggctgctgctttagcattctacgaggctctgatcggagacgagtcttcggccccagacagtcagaggagccaaactgagccagctcgggagcgcaagcggaaaaagcgtcgcattatgaaggccccagccgcagaggcggtcgctgagggcgctagtgggaggcacgggcaaggtagatccctagaagcagaggataaaatgacgcataggattctaagagcagctcaggagggagatctgcccgagttgaggcggcttttggaacctcatgaagctggcggtgccggtggtaacatcaacgccagagatgccttctggtggacgcctctgatgtgcgccgctcgtgcgggacagggggcagcggtgagctatctgctgggtcgtggggctgcttgggtgggggtgtgcgagctgtccggaagggatgccgctcaactggccgaggaggccggatttccagaagtggcacgcatggttcgtgagtag

SEQ ID NO: 223890 - DNA, 1071 bp, Artificial Sequence
  Description of Artificial Sequence: Synthetic coding sequence
atgtcccgcccactcctcatcacttttacccccgctaccgaccctagtgatctctggaaagatgggcagcaacagccccaaccagagaagccggagtctactctcgatggcgcagccgctcgggcattttacgaagcgctgattggtgacgagagctcggccccagattcgcagcgaagtcagactgagcctgccagggagaggaagagaaaaaagaggagaatcatgaaggcacccgcagctgaggccgtagctgaaggcgcttcaggtcgtcacggacagggacggtcactggaagcggaggacaagatgacacacagaattctcagagcagcccaggagggagacttgcccgagctgcgtaggcttctcgagccacacgaagccggtggtgctggcggtaacattaacgcacgagatgccttttggtggacacccctgatgtgcgcagctcgtgccggacagggggctgcagtcagctacctgttgggcagaggagccgcatgggtgggagtgtgtgaactaagcggcagggatgcagcccagcttgctgaagaggccggttttccagaagtcgcacgcatggtgagggagtctcatggagaaaccagatctccggaaaaccggagccctactccctccctgcagtactgtgaaaactgcgacacgcatttccaagactctaatcacagaacctcgacagcccatctgctgtccctcagtcaggggcctcaaccccctaaccttcccctaggagtcccgatcagctctcccggatttaagctgctcctgaggcgcggttgggagcccggaatgggtctaggacctcgaggcgaggggcgtgccaatccaatccccactgtcctcaagcgggaccaggagggactgggttataggagcgccccacagcctagagttactcactttcctgcatgggacaccagagcagtggctgggagagagcggccaccccgtgtagctactcttagctggcgggaggagagaaggcgagaggaaaaggatcgtgcctgggagcgagatctccggacgtatatgaacctggagttctag

SEQ ID NO: 223891 - DNA, 1071 bp, Artificial Sequence
  Description of Artificial Sequence: Synthetic coding sequence
atgagtcgccctcttctgatcaccttcacccccgcaaccgacccgtcggacctctggaaggatggacaacagcagccgcagcctgagaaaccagagtcaaccctcgacggcgctgccgcactggccttctatgaggccctcataggcgacgaatcctccgctcccgactctcagcgcagccagaccgagcccgctagagagcggaaacgcaaaaaacgcagaataatgaaggcaccagccgcagaagctgtcgccgagggagcgagcggtcggcatggacagggacggtctctcgaggcggaagacaagatgactcatcggatactgagagccgcacaagaaggtgacctgccggaactgaggaggctcctggagcctcatgaggcaggaggtgccggagggaatattaacgctagagacgctttctggtggactcccctgatgtgcgccgctagggcgggacaaggggcagcagtgagctacctgctggggagaggggctgcctgggttggcgtgtgcgaactatctggaagggatgctgcccagctggcagaagaggcaggctttcccgaggtcgcacggatggtaagagaatctcacggtgaaacccgttcacctgaaaacaggtctccaactcccagtttgcagtactgcgagaattgcgacacacattttcaggactctaaccaccgcaccagtacggcccatctgttatccttaagccagggaccacaaccccctaacttaccgctgggcgttccgatctccagtccagggttcaagctcctgctgaggggtggctgggagcctgggatgggtctagggcctcggggtgagggccgagctaatccaatccccactgttctgaagagggatcaggagggcttaggatatcgatccgcccctcagcctagggtgacacactttcccgcatgggatacacgtgccgtcgccggaagagaacggcctccccgtgtggcgactctgtcctggcgggaggagcggaggcgcgaggaaaaagatagagcttgggagagggacctgagaacctatatgaatctcgagttttag

SEQ ID NO: 223892 - DNA, 597 bp, Artificial Sequence
  Description of Artificial Sequence: Synthetic coding sequence
atgtctaggccgctccttatcaccttcaccccagccactgacccaagtgatctctggaaagatggacagcagcagcctcagcctgagaagcccgaaagtactctcgatggcgcagcggctctggccttctatgaggcattaatcggagatgaatcatctgcgcctgactctcaacgtagtcaaaccgagcctgcccgtgagaggaagcggaaaaagaggcgaatcatgaaagcccctgccgcagaggctgtggcggagggtgcgtcagggcgacacgggcagggtaggtccttagaagcagaggacaaaatgacacacagaatactcagggccgctcaggagggggatctccctgaactccggcgactgctggagccccacgaggccggaggcgctggaggtaatattaacgcacgagatgccttctggtggactccactcatgtgcgctgcccgtgctggccaaggtgctgctgtgtcttacctactgggacgcggagccgcttgggttggcgtctgtgaattatctggccgagacgccgcacagttggccgaagaagctggatttccggaggtagctcgcatggtgagggagtag

SEQ ID NO: 223893 - DNA, 1071 bp, Artificial Sequence
  Description of Artificial Sequence: Synthetic coding sequence
atgtcgcgccctcttcttattacatttacccctgccacggatccctctgatctctggaaagatggacagcagcagcctcagcccgaaaagccagagagtaccctggacggggctgctgcccttgccttttacgaggcccttattggcgatgaatctagtgcccctgactcccagaggtcccaaacggaaccagcgagggaacgcaaacgcaaaaaacggagaatcatgaaggcgccagcggctgaagcagttgctgagggcgcaagtggtagacacggacagggacgctctttagaagcagaggataagatgacccatcgcatccttagagcagcacaggaaggcgatctgcctgagctccggaggttacttgaaccccacgaagcgggtggcgctggcggaaatattaacgctcgtgatgctttttggtggacccctctgatgtgcgctgccagggctggacagggcgctgccgtcagctatctgctcgggcgaggtgctgcctgggttggtgtgtgcgagttatccgggagggacgccgctcagctggcagaagaggccggattcccggaggtggcgagaatggtccgtgagtcccatggggaaacccgaagtccggaaaatcgtagcccaaccccttctctccagtactgcgagaattgcgacacgcacttccaggatagcaaccacaggacttctacagcgcacctgctctctttgtctcagggacctcagccccctaacttgcctctcggagtccctatctcttcaccaggatttaaactcctgttgcgtgggggatgggaaccgggtatgggcttgggccctagaggggaagggagagccaacccaataccaaccgtgctcaaacgggatcaagaggggctgggatatagatccgcaccgcagcctagggtgacccatttccccgcttgggatacaagagcagttgcgggacgcgagcggcctcccagagtggcaacactcagctggcgcgaggaaagacgcagagaagagaaggatcgtgcctgggaaagggatctgcgcacctatatgaaccttgaattttag

SEQ ID NO: 223894 - DNA, 597 bp, Artificial Sequence
  Description of Artificial Sequence: Synthetic coding sequence
atgagccggcctctgttaattacctttactccggctactgatccttctgatctttggaaggacggccaacagcagccccagcctgagaagcctgagtcgacactggacggcgctgccgcaagggccttttacgaagccctgataggcgacgagtcgtccgcaccagactcccaaaggtcacagacagaacctgccagggagcgcaaacggaagaagcggcgaattatgaaagcgccagccgctgaagccgttgcagagggggctagcggccgacatgggcagggacgaagtctcgaagcggaagacaaaatgacacatcgaatcctacgtgctgcccaagaaggtgacctaccagaacttaggaggctgttagagccacatgaggcgggtggagccggtggaaacattaatgcacgcgatgccttctggtggacccctctcatgtgcgctgccagagccggtcagggcgcagccgtgtcttacctcctggggcgtggtgcagcatgggtgggggtttgcgagttgagcgggagggacgcggcacagttggcagaggaagccggattccccgaagtggcacggatggtgagagaatag

SEQ ID NO: 223895 - DNA, 1071 bp, Artificial Sequence
  Description of Artificial Sequence: Synthetic coding sequence
atgtcccgccctctgctcatcactttcacacctgccacagacccatcagacctatggaaggatggtcagcagcagccgcagcctgagaaacccgagagcacacttgatggtgctgcagcaagagcgttttatgaagctttaatcggagatgagtcaagtgctccagattcgcagaggtcccagaccgaacctgccagagagcgcaagaggaagaagaggaggatcatgaaggccccagctgcggaggctgtagctgaaggtgcatccggcagacacgggcaaggtcgttccttggaggccgaagacaagatgactcataggattctcagggcagctcaggaaggcgatctgcccgagctcagaagactgttggaaccacacgaggccggaggtgcaggcggaaacatcaacgcccgtgatgcattttggtggacccccttgatgtgcgcagccagggcaggccagggagctgcggtgtcctacttgcttggcagaggtgctgcgtgggtcggtgtttgcgaacttagtggccgtgacgctgcacagttggctgaggaagcagggtttcctgaggtcgccaggatggtccgcgagtcccacggggaaaccaggagtcctgagaatcggtctccaacccctagtttacaatattgcgagaactgcgacactcatttccaagattccaaccatcgcacttccacggcccatctgctaagcctcagccagggaccgcagcccccaaacctgcctctgggagttccaatttctagccccggttttaaactactgcttagggggggatgggaaccaggaatgggtcttgggcctaggggcgaaggtagggccaaccccattcctacggttctgaagcgtgatcaggagggcctcggctataggtcagcacctcagcccagagttactcactttccagcctgggacacccgcgcagtggcgggacgggagcgaccacccagggtcgccacactttcatggcgggaagaacggcgacgggaggagaaagatagagcatgggaaagagatttgcgtacttatatgaacctggagttttag

SEQ ID NO: 223896 - DNA, 324 bp, Artificial Sequence
  Description of Artificial Sequence: Synthetic coding sequence
atgtcacggccactcctgatcaccttcactcccgctactgacccgtccgacttgtggaaagacggccaacagcagccgcaacccgagaagccggagagcacactggatggcgcagctgcaagggctttctatgaggcgctgatcggcgacgaatcgtccgccccagactctcagcgaagtcagactgaacctgctcgggagagaaagcgtaaaaaaaggcgaattatgaaagcacccgctgcagaagccgtagcagagggggctagcgggaggcacgggcagggcaggagcttggaggctgaagataagatgacacacagatag

SEQ ID NO: 223897 - DNA, 1071 bp, Artificial Sequence
  Description of Artificial Sequence: Synthetic coding sequence
atgagtaggcccctattgatcacattcaccccggctaccgatccatcggatctctggaaagatggccagcagcaacctcagccagaaaagccagagtcgaccctggatggcgctgcggctcgggcattttacgaagctctcatcggggatgaatcctctgctcccgatagccagcgctctcagacggagcctgctcgagaaagaaagcggaaaaagaggcggattatgaaggcacccgctgcagaagccgtcgccgagggcgcatctggccgacatggccaaggacggagtctggaggcagaggataagatgacccaccgcatcttgcgggcagcccaggaaggagacctgcccgagctccgacgcctattagaacctcacgaagccggaggagcaggaggtaatattaacgcaagagacgctttttggtggacacctctaatgtgtgccgcaagggcaggccaaggggcagcagtttcatacttgctgggacgtggcgctgcttgggtgggcgtgtgtgaacttagcggacgcgacgctgcccagctggcggaagaagcagggttccccgaagtggctaggatggttagagagagtcatggtgagactcggtcacccgaaaatagatctcccacgccgagtctgcagtattgcgagaattgtgatactcatttccaggactccaaccaccgtactagcacggcccacctgctttcgctctctcagggaccgcagccacccaaccttcctctcggtgttcctatctcctcgccagggttcaagctacttctcagaaggggatgggaaccaggcatgggcctcggccctagaggcgaagggagagccaaccccatcccgaccgtcctgaaacgcgaccaggaaggactcgggtatcggtcagcaccgcagccaagggtgacccatttcccagcatgggatactagagctgtggcagggagagagaggcctccacgtgtggctactctgagttggcgggaagagagacgcagggaagaaaaagaccgggcatgggagagggacctacggacgtacatgaatctggagttctag

SEQ ID NO: 223898 - DNA, 324 bp, Artificial Sequence
  Description of Artificial Sequence: Synthetic coding sequence
atgtccaggcccctattgataactttcacccccgcaaccgaccctagcgatctgtggaaggacggacagcagcaaccccagccagagaaacccgaatcgacacttgacggagctgccgcaagggcgttctacgaggccctgattggagacgaatcatctgctcccgacagccagcgctctcagaccgagcccgcacgagaacgcaaaaggaagaagagacgaattatgaaagctcccgctgccgaagccgttgcagagggtgcatcagggagacatggccaaggccgaagtctggaagccgaagataagatgacacatcggtag

SEQ ID NO: 223899 - DNA, 459 bp, Artificial Sequence
  Description of Artificial Sequence: Synthetic coding sequence
atgtccaggccactgctgataacttttactcccgcaacagacccctccgatctgtggaaagacggccaacaacagccgcaaccagagaagccagaaagcaccttggacggtgccgctgcacgggcattctatgaggcactgataggcgatgaaagcagcgccccagattcccaacggagtcagaccgaacctgcacgcgaacgtaagcgcaagaagcgtcggatcatgaaagcacctgctgcagaggccgtggccgaaggagcttccggaaggcatggccaggggaggtccttagaggccgaggacaagatgacacacaggattcttcgggctgcacaggagggcgatctccccgaattgaggcgactcctggaacctcatgaggctgggggagccggaggaaacataaatgcccgtgacgccttttggtggacgcccctgatgtgcgcagccagatag

SEQ ID NO: 223900 - DNA, 1071 bp, Artificial Sequence
  Description of Artificial Sequence: Synthetic coding sequence
atgagccgcccattactcatcaccttcactcccgctacagacccctcagatctgtggaaggatggtcagcagcagccacagcccgagaaacctgaaagtacactcgacggggctgccgctctggctttttacgaggctctgataggagatgagagtagcgcccctgattctcagcgatcacagactgaacccgcacgagagcgaaagaggaagaagcgtagaataatgaaggcacccgcagccgaggcagtagctgaaggcgcaagcgggaggcacggtcaaggccgttctctcgaggccgaggataagatgacacatcggatcttgcgcgctgctcaggaaggtgatcttcccgagctcagaaggttgctggaaccccacgaggccggaggcgctggaggaaatattaatgcacgcgacgccttctggtggacacctctcatgtgtgccgctcgggctggccagggcgctgccgttagctacttactgggacgaggcgctgcttgggtcggtgtgtgcgaactgtccgggcgtgacgcagcccagttggctgaagaggcgggatttccggaggtcgcccgaatggtccgggagagccatggagagacccgttcccccgaaaatcggagccccaccccttcactccagtattgtgagaactgtgacacccacttccaggatagcaatcacagaacctcaacagctcacctcctgagtctctctcagggtccccaaccacccaacctgcctttaggtgtccctattagttctccagggttcaagctcctgctgagagggggatgggaacccggaatgggtctgggcccaagaggcgaaggtcgagctaatccaatccctactgtgcttaagagagaccaggaggggcttggctatcggtccgcaccccagcctcgcgttacacacttccccgcttgggacactcgggcagtcgccggaagggaacgaccgcctcgtgtcgctacgctgagctggcgcgaagaaagacggagagaggagaaagatcgagcttgggagcgagatttgaggacatacatgaacctggaattctag

SEQ ID NO: 223901 - DNA, 1071 bp, Artificial Sequence
  Description of Artificial Sequence: Synthetic coding sequence
atgagtcgtcccctgctgatcactttcacgcccgcaacagacccatcagatttatggaaagatggccaacaacagccacagcctgaaaagcctgagtcaactctcgatggggctgccgcactcgctttttacgaggctctgattggcgacgaatcctccgcgccagacagccagagatctcagactgagcctgcacgagaacgcaagaggaagaagagacgaattatgaaggcacccgctgccgaggcggtggcggagggtgctagcggacggcatggacaaggacgctcactagaggctgaagataagatgacccacaggattctgcgggcagcccaggagggggacctcccagagcttcgtcgcctgttggagccgcacgaggcagggggagctggtgggaacatcaatgcaagagatgccttttggtggaccccgcttatgtgtgctgcccgagctggccaaggggctgcagtgtcttacctactggggagaggggcagcctgggttggggtctgcgagttatctggacgcgatgctgcacagctggcggaggaggccggattcccagaggtcgcgaggatggtgagagaatcccatggggaaacaagaagccctgagaatcgaagtcccacaccatccctgcagtattgtgaaaactgcgatactcactttcaggactccaatcacagaaccagcaccgctcatttactgtctctgtctcagggccctcaaccacccaatctcccacttggagtgcctatatcaagccccggatttaagttgctcttacgtggaggatgggagccaggtatgggcctggggccacgcggtgaagggcgtgcgaatccgatacctaccgtgctgaaaagggaccaggagggacttggctaccgctctgcacctcagccgagagtgacacactttcccgcttgggacacccgtgctgtcgctggcagagagcgtcctcccagggtggctactctctcttggcgggaggaacgaagaagagaggagaaagaccgtgcatgggagcgcgatctccgtacctacatgaacttggagttttag

SEQ ID NO: 223902 - DNA, 498 bp, Artificial Sequence
  Description of Artificial Sequence: Synthetic coding sequence
atgagcaggccactgttgattacattcacaccagctaccgatcccagcgacttatggaaggatggacagcagcagccacaacctgagaaacccgaaagtacgctcgacggcgctgccgcacgagcattctacgaagcactcattggcgatgagtcctccgctccggattcacagaggtcacagaccgaaccggcacgtgagcgcaaaaggaagaaacgcaggatcatgaaagcgcctgcagctgaggctgtggcagagggcgctagcgggaggcacggccaaggcaggagcctggaagcagaggacaaaatgacacacagaatcttgcgggcagcacaggaaggcgatctgcctgagttgagacgactcctagaaccccacgaggcgggaggagcaggcggaaatattaacgctcgtgatgcattctggtggaccccactcatgtgtgcagcccgagcagggcagggcgctgcagtgagctacctcctaggtagatag

SEQ ID NO: 223903 - DNA, 273 bp, Artificial Sequence
  Description of Artificial Sequence: Synthetic coding sequence
atgtcccggcctctgctcatcaccttcactcctgcaacagacccaagcgacttgtggaaggacggccagcagcagcctcagcctgagaagcccgagagcacactggatggcgctgccgcacttgctttttatgaagccctgatcggtgacgaaagctccgcaccagattcccagcggtctcagaccgaacctgcacgtgaacggaaacgtaaaaaaaggagaatcatgaaggccccagcggcagaagccgttgctgagggtgcctccggctag

SEQ ID NO: 223904 - DNA, 1071 bp, Artificial Sequence
  Description of Artificial Sequence: Synthetic coding sequence
atgagccgcccattactgatcacttttactccagctacagaccccagtgacctatggaaggatgggcaacagcagcctcaaccagagaagccagagtctactctcgacggagcagccgcacgtgcattttatgaagcattgataggcgatgaatcctctgcccctgacagtcagcgttcccagactgagcctgcaagagagcgcaagcgcaagaagaggcggatcatgaaggcacctgcagcagaagccgtcgcggagggtgccagcggcagacacgggcaaggcagatctcttgaagcggaggacaagatgacgcaccgaatattgagggctgcccaagaaggtgaccttcccgaactgcgaagactgctggagcctcacgaggctggaggggctggcggaaatattaatgctagggacgccttctggtggacccctctcatgtgtgccgctagagccggacagggagccgcagtgtcgtatctcttagggagaggggctgcgtgggtgggcgtctgtgaactgtcaggaagagacgctgcccagctcgctgaggaggcgggttttccagaagtagcccgtatggtaagggagagccatggagaaactcgctctccggaaaatcggagtcccacccctagcttgcaatactgcgagaattgcgacactcacttccaagactccaatcatagaacatccactgcccacctgttatcgctctcccaagggccacagcctccgaatcttcccctgggcgtgcctatcagcagcccaggcttcaagctgctcctgagaggagggtgggagccagggatggggctcggccctcggggagaaggcagggccaacccaattcccaccgtgttgaaacgggatcaggaagggttgggttaccgatcggcacctcagcctcgcgtgacccacttccctgcctgggatactcgagcagttgctggcagagagaggccgccacgtgtggccactttgtcttggagagaggaacgcaggcgggaagagaaggatcgcgcttgggaacgtgatctgaggacttatatgaatttggagttttag

SEQ ID NO: 223905 - DNA, 273 bp, Artificial Sequence
  Description of Artificial Sequence: Synthetic coding sequence
atgtcccgccctctgctcattacctttacgcctgctactgatccatccgacttgtggaaggatggacagcagcaaccccagcccgagaagcccgagagcacgctggatggcgctgcagcccttgccttctacgaagcactgatcggcgacgaatcttctgcccctgacagccagcgatctcaaaccgaacctgcacgcgagcggaaaaggaaaaaaaggcggataatgaaggctccggctgccgaggctgtggcagagggcgcatctggttag

SEQ ID NO: 223906 - DNA, 1071 bp, Artificial Sequence
  Description of Artificial Sequence: Synthetic coding sequence
atgtcaagacccctgctcatcacatttactcctgctacggacccgtcggacctgtggaaggatggccagcagcaaccccaacctgagaagcccgagagcactctggatggagcagccgctcgcgctttctacgaagcgctgattggcgatgaaagttcggctcctgacagccagagatcacagactgagcccgctagggagcgcaaaagaaagaagcggaggattatgaaagctccagcggcagaagctgtcgcagagggggcttcaggacggcatggccagggccgttccttagaagccgaagataagatgacccatagaatcttgcgggcagctcaggagggtgacctgccagaactccgcagactgcttgaaccccatgaggccggtggcgctgggggaaacatcaacgcccgtgacgctttttggtggaccccactgatgtgtgcagcacgtgccggacagggcgcagccgtgtcgtaccttctgggaagaggtgccgcatgggtcggcgtatgcgagctcagtggaagagacgcagcccagttggccgaagaagcgggattccccgaagtggccaggatggtgagagagtcgcacggggagactcgcagtccagagaatcgatccccgacaccttccttacaatattgtgagaattgtgacactcactttcaggacagcaatcaccgcaccagcacagctcacctgctcagcctgagccagggccctcagcctcctaacctgccgctcggcgtgcccatcagttccccaggctttaaactgctgctgcgcggtggatgggagccaggtatggggctcggtccaaggggggagggcagggcgaatcccataccgaccgtcctgaagcgcgaccaggagggcctaggataccgttcagccccacagcccagagtgacacactttcccgcatgggacacgcgtgctgtggccggtagagaacggccaccgagggtagccacactgtcttggcgtgaggagaggcgacgggaggaaaaagatcgcgcatgggaaagagacctgagaacttacatgaacttggaattttag

SEQ ID NO: 223907 - DNA, 597 bp, Artificial Sequence
  Description of Artificial Sequence: Synthetic coding sequence
atgtctaggccactgctcatcacctttacaccagccaccgatccatctgatctgtggaaagacgggcagcagcagccccagccggagaagcctgaaagcactctcgacggggctgctgccagggccttctatgaagcccttatcggggacgaatcctccgctcctgatagccaaagaagccaaacagagcctgctcgcgagagaaaacggaagaagagaagaatcatgaaagctcccgcagccgaggccgtggccgagggagcgagtggcagacatggacaggggcgatctctggaggcagaggataaaatgactcacaggatcctcagagccgctcaggagggggatctccccgagctgcgacggctgctggagcctcatgaggccggtggcgcaggaggcaacatcaacgccagggatgctttttggtggaccccgctgatgtgtgcagcccgtgccggacaaggcgctgccgtttcctatcttctgggacggggtgcagcttgggtaggcgtgtgtgagctgtccgggcgagacgcagcacaactggccgaggaagctggcttccccgaggtggccaggatggtccgggagtag

SEQ ID NO: 223908 - DNA, 324 bp, Artificial Sequence
  Description of Artificial Sequence: Synthetic coding sequence
atgtcaagacctttgctaatcactttcactccagcgactgatccgagcgacttatggaaggatggacagcaacagccacagccagagaagccggaatccaccctagacggggcagccgctctggcgttttacgaggccctgataggcgacgaaagctcagccccagatagtcagaggagtcagacggagcctgcgagagaacggaagcgcaagaagcgtagaattatgaaagcccctgcagccgaagccgtagccgagggcgcatctggacgacacggacaaggtcggtccctggaggcagaggacaagatgacacatcgatag

SEQ ID NO: 223909 - DNA, 324 bp, Artificial Sequence
  Description of Artificial Sequence: Synthetic coding sequence
atgtctcgcccactgttgatcaccttcacccctgccactgaccctagtgatctctggaaggatggccagcagcagccacagcctgagaaaccagagtctacactggacggtgccgctgccctggctttttacgaggcactcatcggagatgagtcgtccgcgcctgacagccaacgaagccagaccgagcctgctagggagcgcaagcgtaaaaagaggagaatcatgaaggcccctgcagccgaggctgtcgctgaaggcgctagcggcaggcacggacaagggagatcactcgaggctgaggataaaatgacccacagatag

SEQ ID NO: 223910 - DNA, 273 bp, Artificial Sequence
  Description of Artificial Sequence: Synthetic coding sequence
atgtctaggcctctcctcatcacttttacgccagctaccgacccaagcgatctctggaaagatgggcagcagcaaccccagcctgagaaacctgagtccactcttgacggagcagctgcccgagctttctatgaggccctaattggcgacgagtcaagtgctccagatagccagcggtcccaaactgaacccgctagggagagaaaacgaaagaagaggagaatcatgaaagcacccgctgcagaggcggttgctgagggggctagtgggtag

SEQ ID NO: 223911 - DNA, 273 bp, Artificial Sequence
  Description of Artificial Sequence: Synthetic coding sequence
atgagcagaccgttgttaattacgtttactcccgcaactgacccatcagacctctggaaggacggtcagcaacagccacagcctgagaagcccgaaagcacgctcgatggcgcagccgcacgggcattttacgaagcgctgatcggagacgaatcttctgcacccgactcacaaaggtcccaaaccgagcccgcaagagagcgcaagagaaaaaaacgtaggatcatgaaggcccctgccgctgaggcagtggctgagggcgcttccggctag

SEQ ID NO: 223912 - DNA, 459 bp, Artificial Sequence
  Description of Artificial Sequence: Synthetic coding sequence
atgagcagacccctgctgataacgttcacacctgctaccgaccccagcgacttgtggaaagacggacaacagcagcctcagccagagaagcccgaatcaactctcgacggcgctgcagcccgtgccttctacgaggcacttattggcgacgagagttcagcacccgacagtcagcggtcacaaaccgaacctgccagggagcggaagaggaaaaagcgaaggatcatgaaggctcccgctgccgaggccgtggctgagggagccagcggcaggcatggacaaggccgaagcctggaggctgaagacaaaatgacacataggatcctcagagctgcccaggaaggggacttgccagagttgcgtaggttgctcgaaccccatgaggcagggggagcaggcggtaacattaatgccagagacgctttctggtggacccctctcatgtgtgctgctcgctag

SEQ ID NO: 223913 - DNA, 597 bp, Artificial Sequence
  Description of Artificial Sequence: Synthetic coding sequence
atgtcccgtccactgctgattaccttcactccagccaccgatcctagtgacttatggaaagacgggcaacagcagccccagccagagaaacccgaaagcactctggacggcgcagcagccagggcattctacgaggcactcatcggagatgagagcagcgccccagattcacagcgctcccagactgaacccgctagggagcggaaaagaaaaaagaggcgaattatgaaggcaccagcggctgaagccgtcgcagaaggagcaagcggtcgccacggccagggacgaagcctggaggctgaagacaagatgacgcacagaatcctgagagcagcacaggagggcgacctccccgagttgagaaggttgctcgaacctcacgaggcaggtggtgcaggtggtaatataaacgccagagacgccttttggtggaccccactgatgtgtgccgctagagccggacagggcgctgctgtgtcttatctgctcggtaggggggctgcctgggtgggcgtgtgcgagctgagcggaagggatgccgcacagttagccgaggaggctggcttcccggaagtggctcggatggtacgggagtag

SEQ ID NO: 223914 - DNA, 1071 bp, Artificial Sequence
  Description of Artificial Sequence: Synthetic coding sequence
atgagtcgaccccttctgatcacatttacccctgccacagatccgtccgacttatggaaggacgggcagcagcagcctcagccagaaaaaccagagagcactctagatggggctgcagctctcgccttctacgaagctctcattggtgacgaaagttcagcaccggattcacaacgctcccaaactgagcctgccagggagcggaaaaggaagaagaggaggatcatgaaggcccctgctgcggaagcggtcgccgagggcgctagcggacgccatggtcagggaagaagtctggaggccgaggacaagatgacacataggatcctgcgggctgcacaagagggcgaccttccagagctgcgaagattactggaaccacacgaagccggaggcgctggaggaaacatcaatgcgagagacgctttttggtggacaccgctgatgtgtgccgctagggccggacaaggggcagctgtgtcgtacttattgggcagaggggcagcctgggtgggggtgtgcgagctgagcggtcgcgatgctgctcagttagcagaggaggccggatttccagaggttgcgcgaatggtaagggaatctcacggagagactagatctcccgagaaccgctctcctacccctagtctgcagtattgcgagaattgcgatacgcattttcaggactctaatcaccgaaccagcactgcacacctgctgtccttgtcccaaggcccacagccccctaatctccctttgggtgtacccataagctcccctgggtttaagttgttactgcgtggaggctgggagcctggaatgggcctagggcctcggggagaaggccgagcaaacccaattcctacggtcctaaagcgagaccaggagggactcggctatcgctccgctcctcaaccacgcgttacccatttcccagcgtgggataccagagccgtggcgggtcgcgagaggccccctcgagtggctacactgagctggcgtgaagagcgtcgaagagaagagaaggacagagcttgggagcgcgatctccgcacatacatgaatctggaattctag

SEQ ID NO: 223915 - DNA, 1071 bp, Artificial Sequence
  Description of Artificial Sequence: Synthetic coding sequence
atgagccgtcctctactcatcacctttacgcccgcaacagatccctccgatctgtggaaggacggccaacagcagccccagcccgagaagccagaaagtacacttgacggtgccgcagcaagggctttttacgaagccctgatcggcgatgagtcatccgcgcctgacagccagcgatctcagacagagcctgccagagagagaaagagaaaaaagagaagaatcatgaaagcccctgcggcagaggctgtggcggaaggagcctccgggagacacggccaggggcgatcattagaggctgaggataaaatgacccacaggatcttgagggcggcacaagaaggagacttacccgagctgcgaagactcctcgagccacacgaggccggtggcgcaggcggaaacatcaatgccagggacgccttctggtggacgccactcatgtgcgcggctagggctggccaaggcgctgccgtgtcatacctcctcggtcggggagccgcatgggttggagtgtgtgagcttagtgggagagacgctgcacagttggccgaggaggcaggctttccagaggtggcccgtatggttagggaaagccacggagagacccgatctccagagaatagatcccctacccctagcctgcaatattgtgagaactgtgacacccattttcaggattctaatcacagaactagcacagcacacctgctttctctgtctcagggccctcaacctcctaatcttcctcttggcgtacccatatcctctcctggattcaagctgctactgagggggggttgggagccaggaatggggctcgggccacggggagaaggcagagccaaccccattccaactgtgctcaaacgtgaccaggagggcctcgggtatcgaagcgctccgcaaccccgtgttacccacttccctgcttgggatacccgagctgtcgccggaagagagagaccccctagagtagccacactaagctggagagaggagaggcggagggaagaaaaagatcgagcctgggaacgggatcttcggacctacatgaatctggaattctag

SEQ ID NO: 223916 - DNA, 1071 bp, Artificial Sequence
  Description of Artificial Sequence: Synthetic coding sequence
atgtcccggcctctgcttatcacatttacccctgccacagacccatctgacctgtggaaagatggccagcagcaaccccagcccgaaaagccagaatcaacactcgacggtgccgcagccagggccttctatgaggctttaataggcgatgaaagctctgctccagattcccagcggtcccagaccgaaccagcaagggagcgcaagcgaaaaaagcgcaggattatgaaagcacccgcagctgaagcggtggctgaaggggcatcgggacggcatggccagggtagaagtcttgaggcggaggacaaaatgacccaccgcattctgagggcagctcaggaaggagatttgcccgaattaagaagattactggaacctcacgaggctggtggcgcaggtggaaatatcaacgccagagacgcattttggtggacgccgctgatgtgcgctgcgcgagccggtcagggcgcagccgttagctacctgctgggaagaggggcagcgtgggtcggtgtttgcgaactgtctgggagagacgcagcccagctcgctgaggaggcaggatttcctgaagttgcacggatggtgagggaatcacatggggagacgcggagccccgagaaccgcagtcccacacccagcctacaatactgcgagaactgcgatacccatttccaggattcaaaccacaggacatccactgcccatctcctttccctgtcccaagggccacaaccgccaaacctccctctgggggttcctatatcctcccccggattcaaattgttgctgaggggcggatgggaaccgggtatgggtctcggccctaggggagagggccgagcaaacccaatacccactgtcctcaagcgtgaccaggaaggacttggctacaggtctgcacctcaaccaagagtcacccactttccggcttgggatacgcgcgcagtggctggacgtgagcgaccgccaagagtagctaccctgtcttggcgagaggagcgacgaagagaagagaaggatcgtgcctgggaaagagacttgagaacctacatgaacctagagttttag

SEQ ID NO: 223917 - DNA, 498 bp, Artificial Sequence
  Description of Artificial Sequence: Synthetic coding sequence
atgtcgcggcctctcctcattactttcacgccggcaacggacccatcagacttatggaaagatggacagcagcagccgcagcctgaaaagcccgaaagcacactggacggggctgccgcattggctttctacgaggcactgattggggacgaaagtagcgctccagattctcaacggagccagacagaacctgctagagaacgcaaaagaaagaagaggagaattatgaaggcccctgcagcagaagcagtggctgagggcgctagcggcagacatgggcagggacgctcactggaggcggaggacaaaatgactcatcggattctcagggcggctcaggaaggagacctgcccgagctgaggagactgctggaaccacatgaggccggaggggctggtgggaacattaatgcacgagatgccttctggtggacaccactgatgtgtgccgcacgggcaggtcagggcgcagccgtatcgtacttactggggcgttag

SEQ ID NO: 223918 - DNA, 273 bp, Artificial Sequence
  Description of Artificial Sequence: Synthetic coding sequence
atgagccgcccactgcttataacttttacccctgcaacagacccttcagatctgtggaaggatggccaacagcaaccgcagccagagaaacccgagtccacacttgacggtgccgcagcgcgtgctttctatgaggctctgatcggagacgagagctcagccccagattctcagcgtagccagactgagcccgcacgagagcggaaacgtaagaagcggcgtataatgaaagctccggctgccgaggccgtggctgaaggcgcttctggatag

SEQ ID NO: 223919 - DNA, 324 bp, Artificial Sequence
  Description of Artificial Sequence: Synthetic coding sequence
atgtctaggccattgctgattaccttcactccagccaccgacccttccgacctctggaaagatggccagcaacagccccagccagagaagcccgaaagtaccctagacggcgcagcagctagggcgttttatgaggctctgattggtgacgagagtagtgcacctgattcccagcgctcccagactgagcccgctcgagaaaggaagcgcaagaaacggcgtattatgaaggcaccagccgctgaggccgttgcagagggagcatcagggcgacatggccaagggaggtccttggaagccgaggataaaatgacccacaggtag

SEQ ID NO: 223920 - DNA, 1071 bp, Artificial Sequence
  Description of Artificial Sequence: Synthetic coding sequence
atgtcacgtcctctgctcattacctttacgcccgctactgaccctagcgacctctggaaggacggacagcaacagccccagccagaaaagccagaaagcacgttagatggtgcagccgctcgcgctttttatgaagcactgatcggcgacgagtccagcgcacccgacagccagcggtcccaaaccgaaccagcacgcgagcgaaaacgcaaaaaaagacgcatcatgaaagccccagctgctgaggccgtagccgaaggcgcaagcggtagacacgggcagggccgttcactggaggccgaagataaaatgacacatcgcatactgcgggcagcgcaggagggagatttacctgagttgcgcaggcttctggagccacacgaggcaggcggagctggaggcaatattaacgcacgtgacgctttctggtggacccccctcatgtgtgccgctcgcgcaggccagggtgctgccgtgtcatacctgctcggacggggagctgcttgggttggagtttgtgagctgtcaggacgcgatgccgcacagctcgccgaggaagctggctttcctgaggtggcccgtatggtccgggaaagccatggggagacccgttcaccagaaaatcggtccccgaccccctctctgcagtactgcgagaactgcgatactcattttcaggactccaatcataggacatcaaccgcacacctcttgagtctgtcccaaggacctcagccacccaatctgcctctgggggtccctatttctagtcctggtttcaagctcctgttgagggggggttgggagcccggaatgggactggggccacgtggcgaggggagagcgaatccaatccccacggtactgaaaagagaccaggagggcctgggttataggtccgcaccacagcctcgcgtgacacatttccccgcttgggatacccgggcagtggccggacgcgagaggcccccacgcgtagccaccctgtcatggcgggaggaaaggagacgcgaagaaaaggatagggcctgggaacgcgatctgcgcacttacatgaatctggaattttag

SEQ ID NO: 223921 - DNA, 1071 bp, Artificial Sequence
  Description of Artificial Sequence: Synthetic coding sequence
atgtccagaccactgttgattaccttcaccccagctaccgaccctagcgatctgtggaaagatggacagcaacagcctcagccagaaaaaccggagagcacattggacggcgcagccgctctggcattttatgaagcactgattggggatgaaagcagtgctcccgattcgcaacgctctcagaccgaacccgctcgcgagaggaagagaaaaaagcggaggatcatgaaggcccctgccgcagaggctgtggccgaaggcgcaagcggcaggcatgggcaaggcaggtccctcgaagccgaggataaaatgacgcatagaatcttaagagctgcccaggagggagatctgccagaactgagacgactgctggagccacacgaagcaggaggggcagggggaaacattaacgctcgcgatgccttttggtggacaccgctgatgtgtgccgcacgcgcaggtcaaggtgccgctgtgagctacctgctgggcagaggtgctgcgtgggtgggcgtgtgtgagctcagcggacgagacgcggctcagctcgctgaagaggcaggctttcccgaggtggcccgtatggtccgggaatcgcacggggaaacccggtcccccgagaataggagtccgacacctagcttgcagtattgtgagaactgcgacactcacttccaagattctaatcaccgtacgtcaacagctcaccttttgagcctctctcagggtccccagcctcctaacctgcctctcggcgttcctatcagtagccctggcttcaaactgcttttaagggggggttgggaacctggaatgggacttggaccacgaggcgagggtcgagccaatccaatcccaaccgttctcaagagggatcaggagggtttgggatatagatccgcacctcagcctcgcgtgacccattttcccgcttgggacactcgcgcagttgccggacgggaaaggcccccacgagtcgcaaccttatcttggcgagaagaaaggaggcgagaggaaaaagatagggcgtgggaaagagacctccgtacctatatgaaccttgagttctag

SEQ ID NO: 223922 - DNA, 1071 bp, Artificial Sequence
  Description of Artificial Sequence: Synthetic coding sequence
atgagccggccactgttgatcacatttacacctgctactgacccctccgacctgtggaaggacggacagcaacagccccaaccagagaagccggagagtacccttgacggggctgcagcactggccttctacgaggctttaatcggcgatgagagttcagctcccgattctcagcgtagccaaactgagcctgccagggagcgaaagcggaagaagcgcaggattatgaaagcccctgccgctgaggcagtagctgagggcgctagtggtcgtcatggccagggtaggagtcttgaggccgaagacaaaatgacgcaccgcattttaagagccgcacaggaaggtgatctgcccgaattgagaaggttgttagaaccccacgaggccggaggcgctggaggtaatattaatgcaagggacgcgttctggtggacccctcttatgtgtgccgcaagagctggacagggggctgcagtttcctacttgctcggacgtggagctgcctgggtgggcgtgtgcgagctgtccggcagggacgccgctcagctcgccgaggaggcaggattccctgaggtagcaaggatggtgcgggaatcccatggagagaccaggtctcccgagaatcgtagccccactcccagtttacagtactgcgaaaactgtgatacccacttccaggactcgaaccaccgcacatctactgctcatttgcttagcttatcgcaagggcctcagcctcctaatctccctcttggggtccccataagcagcccgggattcaagttgctgctcagaggaggatgggaacctggaatgggcttgggcccaagaggtgaagggagggccaatcccatacccactgtcttgaagcgagatcaggaaggactcgggtataggagcgccccacagccgcgagtaacacatttccctgcttgggacactagagcagtcgccggacgcgaaaggcccccacgggtcgccaccctgtcctggcgggaagagagaagacgggaggaaaaggatcgggcatgggaaagagacctgcggacatacatgaatctggaattctag

SEQ ID NO: 223923 - DNA, 273 bp, Artificial Sequence
  Description of Artificial Sequence: Synthetic coding sequence
atgtcacggccactactcattacattcacccccgctacggatcctagtgacctgtggaaagacgggcagcagcagcctcaacctgagaaaccagagtcaaccctggacggggcagcagccagggcgttttacgaggccctcatcggggacgagtcctcagccccagacagtcagagaagtcagaccgagcccgcaagggagaggaaacgaaagaaaagaaggatcatgaaggcccctgcagctgaagctgtggccgaaggcgcttccgggtag

SEQ ID NO: 223924 - DNA, 1071 bp, Artificial Sequence
  Description of Artificial Sequence: Synthetic coding sequence
atgtcccgccctctcttgatcacattcacacctgctaccgacccctccgacctgtggaaagacggccagcagcagccacagccggagaagcctgaatcgactttggatggtgccgctgcattggccttctacgaggccctgatcggtgacgaaagttcggctccggactcacaaagatcccaaactgagcccgctcgggagaggaagcgtaagaaaagaagaatcatgaaggcgcctgccgcagaagccgttgccgagggtgccagcggaagacatgggcagggaagaagcctcgaagctgaagataagatgactcataggattctgcgggctgcacaggagggggatttaccagagcttagaagactactagagccccacgaggcaggcggagccggtggaaatataaacgcgcgtgacgctttttggtggactcctctgatgtgtgccgcacgcgcaggacaaggcgcagcagtatcttacctccttggtagaggagcagcctgggtgggcgtgtgcgagttatccggacgggatgctgcacaactggccgaggaagctggattccccgaggtcgctagaatggtcagagaaagtcacggggaaactaggtctccagaaaaccggtcccccactccttccctgcagtattgtgagaactgcgacactcacttccaggattctaatcacaggacaagtacagcccatctcctcagtctgtctcaaggcccacagccccctaacctgcccctcggagtccccatcagctctcctggattcaaattgctcctgagaggcggttgggaacccggaatggggctgggccctcgtggggagggccgtgccaatcccatacctaccgttctgaagagggatcaagagggcctgggttacaggagtgctccccaacctcgtgtgacccactttccagcctgggatacccgtgcagtggccggtagagagcggccaccgagggtggcgacactgagctggcgcgaggagcggagaagggaggaaaaagacagagcttgggaaagggatttgcggacctacatgaacctggaattctag

SEQ ID NO: 223925 - DNA, 498 bp, Artificial Sequence
  Description of Artificial Sequence: Synthetic coding sequence
atgtctcgtccactgctgatcaccttcaccccagccaccgacccttccgatttgtggaaggacggacaacaacagccccagcctgagaagccagagagcacactcgatggcgctgctgcccgagccttctatgaggccctcattggcgacgaatctagtgctcctgacagccagcgttcacagaccgaacccgctcgggaaaggaagaggaagaagcgcagaattatgaaggccccagcggctgaggctgtggcggagggggcttctggcagacatggacagggacgctccctggaagcagaggacaaaatgactcaccgcatcctgcgtgccgctcaagagggggatttgcctgagcttcgcaggctgcttgagcctcacgaagccggaggggctgggggaaacattaacgcacgggatgccttctggtggacccccctcatgtgcgccgcacgcgcaggccagggcgcagctgtcagttacctcttggggagatag

SEQ ID NO: 223926 - DNA, 459 bp, Artificial Sequence
  Description of Artificial Sequence: Synthetic coding sequence
atgagcaggcccctgctgattacttttacacctgccaccgacccttcagacctttggaaagacggccagcagcagcctcagcccgagaaaccagagagtacactcgatggagcagcagcgcgtgccttttacgaggcactgataggcgatgagagctctgcccctgatagtcagaggtcacagaccgaaccagccagagagaggaagagaaagaaacgtcgaattatgaaagcgccagcagctgaggctgtagcagaaggagcttccggacggcatggccaaggcaggtctctggaggcagaagacaaaatgacgcatcgcatcttacgggctgcccaggagggagatctgccggaactgaggcgccttctggagcctcacgaagccggaggggctgggggaaacatcaacgcaagggatgctttctggtggaccccattgatgtgtgcggctcggtag

SEQ ID NO: 223927 - DNA, 4509 bp, Artificial Sequence
  Description of Artificial Sequence: Synthetic coding sequence
atggctgaccggttttccaggttcaacgaagaccgggatttccaggggaaccatttcgatcaatatgaagagggacacctggagatcgagcaggcttcactggataaacccattgagtccgacaatatcggccatcgtctgcttcagaaacatgggtggaagctcgggcagggccttggtaaatcactccaagggagaactgaccccattcctattgtggtgaaatatgacgtgatgggaatgggcagaatggaaatggagcttgattacgctgaggatgccaccgaacgccgacgcgtccttgaagtggagaaggaagacaccgaggaactcaggcagaagtacaaggattatgtcgacaaggagaaagcaatcgctaaagcgctggaagacctgagagctaacttttactgcgaattgtgtgataaacagtatcaaaagcaccaggagttcgataaccacatcaattcatacgaccatgctcacaaacagcgcctgaaggacctgaaacagagagagttcgcacgcaatgtaagctctcgcagtaggaaagatgagaaaaagcaagagaaagccctgcgacggctccatgagctggccgaacaaaggaaacaagctgagtgcgctccaggctcaggcccaatgttcaaacctacaactgtggccgtggacgaggagggcggagaagatgacaaagatgaaagcgccaccaattctggaactggagccacagcctcatgtgggctcggttcagagtttagtaccgacaagggaggaccgttcactgctgttcagatcacaaacacaacggggttagcccaggcacctggcctagcctcccagggcatctcctttgggattaagaacaacctcggaacccctctgcagaaactaggcgtctcctttagctttgctaaaaaggcccctgtcaaactcgagagcattgcctctgtatttaaagatcatgccgaagagggcacatcagaggatgggaccaaaccggatgagaaaagttctgaccagggtctgcagaaggtgggggacagcgatggctcgtctaatcttgacggcaaaaaagaggatgaggacccacaagatggcggttcattggctagtacactgtccaaactcaagcgtatgaaaagagaggagggggctggcgcaaccgaacctgagtactaccactacattccacctgcccattgcaaggttaagccgaactttccttttctcttgttcatgcgggcttccgagcagatggatggtgataacacgactcatccaaagaacgctcccgaatcaaagaagggatcctcccctaagcccaaatcttgcatcaaggccgcagcaagccagggagccgagaaaaccgtgtcagaggtttcagagcaacctaaggaaacatccatgactgagccctcggaacccggatccaaagccgaggcaaagaaggccctgggtggcgatgtgagtgatcagagtttagaaagtcacagccagaaggtctctgagactcagatgtgcgaatcgaatagttcaaaggaaacctcattggctaccccagcaggtaaggagtcacaagagggccctaagcacccaactggtccgttttttcctgtcttgtccaaggacgagagcaccgctctccaatggccttccgagttgttgatttttacgaaagcagaaccttctatctcctactcatgtaaccctctgtatttcgatttcaagctaagtcgaaacaaggatgcccgaaccaagggcaccgagaagccaaaagacatcgggtcaagctctaaagaccaccttcaggggctggatcctggagaaccaaataagtccaaggaagtaggcggtgagaaaattgtcaggtcgtctggcggtcggatggacgctcctgctagcggctcagcgtgctcgggccttaataagcaggagcccggaggatcccacggctctgagacagaggatacagggagatccctgccttccaagaaggaacgttctggcaaaagccacaggcacaagaaaaagaagaagcataagaaatccagtaaacacaaacggaaacataaagccgatacagaggagaagtcctcaaaagccgaaagcggagagaaatcaaaaaagaggaaaaaaaggaagcgaaaaaagaataagagctcagcccctgccgattcagaaaggggacccaagcctgagcctcctggatcaggatcgcccgcaccccctaggcgcaggcgccgtgctcaggacgactctcagagacgctctcttccagcggaggagggatcatcggggaaaaaagatgaaggaggtgggggatccagttctcaggatcacgggggaagaaaacacaaaggggaactccctcccagttcctgccagcgtagagcaggaaccaaacgctcttccaggtcctcacatcggtcccagccttcttccggagatgaggatagtgatgatgccagtagtcaccgactccaccaaaaatctccaagtcagtattctgaggaagaagaggaggaggatagcgggtctgagcactcaaggtcacggagcaggagtggcaggaggcacagcagccatagaagctctaggcggagctactctagctcctccgacgcaagtagcgatcagagctgctacagccgccagcggagttactcagacgacagctatagcgattacagcgatagatcgcgtcggcattcaaagcgttcccatgattcggacgactccgactacgccagttccaagcacaggagtaaacggcacaagtactccagctccgacgatgattattcactatcatgcagtcagtccaggtcacgcagtcgctcacacacaagggagaggagtagatccagggggcgatctcgcagctccagctgttctcgcagccgaagtaagcgcagaagccgctccactaccgcacatagctggcagaggtctaggtcatattctcgggaccgctccaggagtacccgatcgcctagccagaggtcaggctcccgtaaaagaagctggggccatgagtctcctgaagagaggcactcaggcagaagagattttattagatctaagatctataggagccagagccctcactactttaggagtggtagaggcgagggacctggtaaaaaagatgatggcaggggagatgactctaaagccacagggccaccatctcagaactccaacatcggaaccgggagaggatcagaaggagattgttcaccagaagacaagaactctgtcacagccaagcttctcctcgaaaaaatacagtctagaaaggtggaacgcaagccctctgtcagtgaagaggtgcaagccactcctaacaaagcaggcccaaaattgaaagaccctccacaagggtatttcggacccaaactgccacctagcttgggaaacaaacctgttctccccctcatcgggaagctaccagccactcgaaagccaaacaaaaaatgtgaggagtccggcttggaacggggtgaggagcaggagcagtctgaaacagaagagggcccacccggaagctcagacgccctgttcggtcatcaattcccatctgaggaaaccactggcccattgttggacccccctcctgaggagtctaaatctggcgaagctacagctgatcatcctgtggccccactgggaaccccggctcacagcgactgctatcccggagatcccacaatttcccacaattacctcccagacccatctgatggggataccttagaaagtctggacagcagctcccaaccgggacccgtggagtcttccctgcttccaatcgctcctgatctggagcactttcccagctatgctcccccttcgggcgacccttcaattgaaagtaccgatggggcagaagatgcctctctggctcctcttgagtcccagcccataacgttcaccccagaggagatggagaagtacagtaagctgcaacaggctgcccagcagcatatacagcagcaacttttggcaaaacaggttaaagctttccctgccagcgccgcactcgccccagcgactccagccctgcaaccaatccacatccagcagcccgctaccgcgtctgcaaccagcattaccacagtacagcacgctatactgcagcaccacgcagccgctgcggctgccgcaatcggtatccacccacatccacaccctcagccactcgctcaggtgcatcacatcccccagccacacttaacgcccattagtttgtctcatttaacgcattcaatcattcccggacatcctgcaacttttctcgcctcacatcctatccatataattcccgcttcggccatccacccagggccatttaccttccaccccgttccccacgccgcattgtatcccactctgctcgctccccgaccagccgcagctgctgctaccgcgcttcatctgcatcctctgttgcaccccattttttctggccaggatctgcagcaccccccatcccacggcacgtag

SEQ ID NO: 223928 - DNA, 4275 bp, Artificial Sequence
  Description of Artificial Sequence: Synthetic coding sequence
atggggatgggacgaatggagatggagctggattacgctgaggatgcaactgagcgtaggagggttctggaagtggagaaggaagatactgaggagttgcggcaaaagtataaagactacgtggacaaagagaaagcaattgctaaagcacttgaagacttgcgcgcaaacttttactgtgagctatgcgacaaacagtaccaaaaacatcaagagtttgataaccacatcaattcctatgatcacgctcacaagcagcggcttaaagatctcaaacagcgagagtttgctagaaacgtgagcagcaggagtagaaaagatgaaaaaaagcaggaaaaagctttaaggaggctgcatgagctggccgaacagagaaagcaggcagaatgcgcccctggttctggtcccatgttcaaacctacaaccgtcgcggtagacgaggaaggtggcgaggacgacaaagatgagtcggccacaaattctggcactggtgcgaccgcctcatgtggcttgggcagtgaattttcgactgacaagggaggtcccttcactgcagtgcagatcaccaacaccacgggtctggcacaagcgcctgggctcgccagtcagggtataagttttggcattaaaaacaatctggggacaccgctccagaagttgggcgtgagttttagctttgccaagaaggcccctgttaagcttgagtccatcgcttcagtgttcaaagaccacgccgaggagggcacaagtgaagatggcacgaaaccggacgagaaatccagcgatcagggcctgcagaaagttggtgactccgatggctcttcaaacttggacggtaagaaagaggacgaggatccccaggacggagggtcccttgcgtctaccctatctaagctgaagagaatgaagcgagaggagggagcgggtgccaccgagccagaatactaccattatatccctccagcgcattgcaaagttaagccgaatttcccctttttactgttcatgagagcgtctgaacagatggacggggataatactacacaccctaaaaacgcccctgagtctaaaaagggcagcagtcctaaaccgaagagctgtatcaaggccgctgcatctcagggcgcagagaagaccgtatcagaggtgagcgagcagccgaaggaaacctccatgactgaacctagtgagcctggaagtaaggcagaagccaagaaagcactgggtggagacgtgtctgatcaaagcttggagtcacattcacagaaagtgagtgagacccagatgtgcgagtcaaacagctccaaggaaacttctctagcaactccagccggtaaggaaagccaggagggcccaaaacatcccacgggcccattcttccctgtgctgtcaaaagacgagtcgaccgcgttgcagtggccctctgaactcttgatctttaccaaagccgagccaagcatttcttattcatgtaatcctttgtatttcgactttaagctgagccgcaacaaggatgcccgtacaaaggggaccgagaagcctaaagatatcgggagcagttcgaaagaccatcttcaagggcttgaccccggtgaaccaaacaagagcaaggaagtgggcggagaaaaaatcgtgcgcagtagcggtggcagaatggacgccccagcttctggcagcgcatgctctggcctcaataagcaggagcctggcggaagccatggcagcgagaccgaggacacaggaaggtccctcccatccaagaaagaaaggtccggcaaatcgcacagacataagaagaagaaaaagcacaagaagagctccaaacacaagagaaaacataaagctgataccgaggaaaagagctctaaagcggagtctggagaaaaatctaagaaaaggaagaaaagaaaacggaagaaaaataagagctcagccccagccgatagcgagcgcggacctaaaccggaacctcccggttccgggagcccagctccacctaggagaagaagaagggcgcaggatgacagccagcggagaagcttgccggctgaagagggaagcagtggaaagaaggacgagggcggtggtggctcttccagccaggatcacggaggcaggaaacataaaggagagcttcccccatcttcatgccagagacgggctggaactaaaagatcaagccgctcatcccaccgctctcaaccaagtagcggcgacgaagacagcgacgatgcgtcctcccacagactgcaccagaagagtccaagccaatacagcgaggaagaagaggaagaggattctgggtccgagcactccaggagcagatcccgctctggccgacggcactcttcccatagaagtagccgcagatcttactcatcaagttcggacgcctcttctgatcaatcctgctattctagacaacgcagttatagcgacgacagctattccgattacagcgatagatcccgcagacattcgaagcgcagccacgacagtgacgattctgactacgcatcttccaaacatagatctaagcgtcataagtactccagttcagatgatgactactccctcagttgttctcagagtcgtagcaggagccgctcgcatacaagggagcggagccgttctcgcggacggagccggtcctcttcatgctccagatctcgctcgaaacggaggtctagatccaccactgctcactcctggcagcgcagccgctcttacagtagagacaggtcacgctcgacccgttctccaagccaaaggagcggctctagaaagcgcagctggggacatgagagccccgaagaaaggcatagcggtcgaagggacttcatcagatccaagatttacaggtcccaaagcccccactattttaggagtgggaggggggaggggcctggcaaaaaagacgatgggaggggagatgatagcaaggcaacaggccctcccagccagaactctaacattggaaccgggaggggatccgaaggagactgttcaccagaggacaagaactcagtcactgcaaagttgttgctcgagaagatccagagtcgaaaagtggaaaggaagcccagcgtgtctgaggaagtccaggcaaccccaaacaaagcagggccaaagctcaaggatccaccccagggatactttgggccaaagctcccgccatcccttgggaacaagcctgttctgccactcattggcaaactccccgctactagaaagcccaacaagaagtgcgaagagtctgggctcgaacgcggagaagagcaagagcagagcgagactgaagaaggcccacctggctcaagcgatgccctgttcggacatcaattcccgtccgaggagactaccggccctcttctcgaccccccacccgaagagtccaagtctggagaagccacagccgaccatcccgtcgctcctctgggcacgcccgcacacagtgattgctacccgggagaccctaccatctctcacaactacctaccagacccgagcgatggtgacacacttgagtcactggacagctcatcacagccaggcccagttgagagctcacttcttccaatcgcacccgatttggagcacttccctagttacgccccacctagtggggacccaagcatagaaagtacggacggcgcagaagatgcctcacttgcgccacttgagtctcagcccattaccttcacccctgaagagatggagaagtactcaaagctgcagcaggccgctcagcagcacattcagcagcagctcctggccaaacaggtgaaggcattccctgcctcagctgcactggccccagctacacccgctctgcagccaatccacatccagcagcccgcaacagctagcgctacaagcatcactacagtgcagcacgctatcctccagcatcacgcggcagccgcagccgctgcaattggaatccaccctcacccacatccacagccccttgcccaggtgcaccatatcccccagccacatctgactccaatttccctgtcacatctgacccacagcatcatccccggtcaccctgctaccttccttgcctcccacccgatccatattatcccagcctcggcaatccatcccggacccttcacattccatcccgtccctcacgccgcactttaccccacccttctggcaccgaggccagctgccgctgctgctactgctcttcacttacacccgctgctgcatcccattttctcaggtcaggatctgcaacatcccccttctcacggtacgtag

SEQ ID NO: 223929 - DNA, 132 bp, Artificial Sequence
  Description of Artificial Sequence: Synthetic coding sequence
atggccgatagatttagcagatttaatgaagatagggacttccaaggaaaccattttgatcagtatgaagaaggacacttagagatcgagcaggctagcttagacaagcccattgagtcctcttgcttctag

SEQ ID NO: 223930 - DNA, 4509 bp, Artificial Sequence
  Description of Artificial Sequence: Synthetic coding sequence
atggcagacagatttagtagattcaacgaagaccgagacttccagggcaatcatttcgaccaatatgaggaaggacacctcgaaatcgaacaggcttccctggataagcctattgaatcagacaacatcggacataggcttctgcaaaagcatggttggaagctcggacaaggtctgggcaagtccttgcagggccgtaccgatcctattcctatcgtggtcaagtatgacgtgatgggcatgggaaggatggagatggagcttgattacgctgaagatgccacagagcggaggcgggtgctggaagtggagaaagaggatacggaggagctgcggcagaaatataaagattatgtagataaggagaaagcaattgctaaggcacttgaggacctgcgggcaaacttttactgcgagctttgtgataagcagtaccagaagcaccaggagtttgataaccatatcaactcgtacgaccatgcccacaagcagcgcttaaaggacctgaagcagagggagttcgccagaaacgtaagtagtagatcaagaaaggacgagaaaaaacaggagaaagcacttcggagactgcacgagctggctgagcagcgtaaacaagccgaatgtgctcccggatcgggccctatgttcaagccaacaaccgtggccgtagatgaggagggaggcgaggacgacaaagatgaatccgcaactaacagcggcacaggtgctactgcctcctgcggacttgggtctgagttttccactgacaagggcggtccttttactgctgtgcagattaccaacaccacgggcctcgcccaggcgcctggattggcctcccagggaatttcattcggcattaaaaacaatctcggcaccccattgcagaaactcggggtctccttttcattcgctaagaaggctcccgtgaaactcgagagtatcgcaagcgtatttaaggatcatgctgaagaaggtacctccgaggacggcacgaaacctgatgaaaagtctagcgatcagggcctccagaaagtgggcgattctgacggctcttcaaatcttgatggcaagaaggaggatgaagacccgcaggatggtggcagtctcgcctcaaccctaagcaaactcaagcgcatgaagcgcgaggagggagccggtgccaccgagcctgaatactatcactatatcccacccgctcattgtaaggtgaaaccgaactttcccttcttgctcttcatgcgcgcttccgagcagatggatggcgataatacgacgcaccccaagaatgctcctgaatccaagaaggggtccagtcccaagccgaagtcgtgtatcaaggcagccgctagccagggggctgaaaaaactgtcagcgaggtgtccgagcaaccgaaagaaactagcatgaccgaacccagtgaaccaggcagcaaagccgaggctaagaaggctctgggcggtgatgtcagtgatcagagcttggaaagccacagtcagaaggtctccgagactcagatgtgtgagagcaactcatctaaagagacttcactcgccactcccgcaggtaaggagagtcaggagggccctaagcacccaactggcccattcttccccgtcctgagtaaagacgagagcacggccctccaatggccctccgagctgctaatctttacaaaggcagaacctagcatcagctattcctgtaacccgctgtattttgatttcaagctttcaagaaacaaagatgccagaactaaaggtaccgagaagcccaaggacatcggaagttcgtccaaggatcatctgcaaggcctggaccctggagagcctaacaagagtaaggaggtgggcggtgagaaaatagtaagatctagcggtggccgtatggacgcacctgcttctggctccgcttgctccggtttgaataagcaggagccgggtggaagccacggctcggagactgaagataccggacgctctctcccttccaagaaagaacgttctggcaagagccaccgtcacaagaagaagaagaagcacaaaaagtctagcaaacacaagcgaaagcataaagctgacacagaagaaaagagctctaaagccgaatctggcgagaaatctaagaagcgaaagaaacggaagcggaagaagaacaaatctagcgccccagccgattcagagcgcggtccgaagcccgaaccaccaggatctggaagtccagctccacctcgccgtagacggcgagcccaggacgattctcaacggaggtctctcccagctgaggaaggcagctctggcaagaaggatgaagggggaggcggtagttctagccaggatcatggagggagaaaacacaagggtgagctgccgcctagttcatgccagaggagagctgggaccaagagatctagtcggtcctcccacaggagccagccttcatcgggcgacgaagactcggatgacgcatcctcacatcgattgcatcagaaatcccccagtcagtatagcgaagaagaggaagaggaagactctggctccgagcatagcagatcacggagccgatccgggaggagacatagcagccaccgtagctccaggaggagttactcttcttctagcgacgcttcaagcgatcagagctgttattcacgtcagagatcatatagcgatgactcctattccgattacagcgaccggtctcgacgtcactctaaacggtctcacgatagcgacgattccgactatgccagcagtaaacaccggagcaagcgccataaatatagctcaagcgacgatgactattccctgagctgtagccaatcaagaagccgcagtcgttctcatacacgcgagagaagcaggtcccgtggaagatctcgctcatcctcctgctccagaagccggagtaagcggagatccaggagcaccaccgctcattcctggcaacggagccgcagctatagcagggatcgaagcaggtctaccaggtctccatcccaacgcagtggctctcgtaaaagatcatggggacacgagagtcccgaggagcggcattccggcagaagagacttcattcgctctaaaatttacaggtctcagtctccacattattttagatccggaagaggagagggtcctggcaagaaagacgatgggagaggtgacgacagcaaagctacaggcccaccaagccagaacagcaacatcgggaccgggaggggtagtgagggcgactgttcacccgaagacaaaaactcagtgacggcaaagttgctcctggagaaaattcagtcaagaaaggttgagagaaagcctagtgtgagtgaggaggtccaggcgacacccaacaaggctggacccaaactgaaagaccctccacaagggtatttcggcccaaagttgcccccttccttgggtaacaagccagttctgccattaatagggaagctgccagcaactcgcaaacccaacaagaaatgcgaggaatccggactggagagaggagaagagcaggagcagagcgaaaccgaggaaggtcctcctggcagctcagatgctctgtttggacatcagttcccgtcggaagaaactaccggtccactgttggatcccccaccggaggagtcaaagtcgggcgaagccaccgccgaccacccggtggctccactgggcactccagctcacagcgactgttaccccggagacccgactatttcccacaactacctgccggatccaagtgacggcgatacgctcgagagtctggactcaagctcacagcccggacccgttgagtcgagccttctgcctatagcacccgatctcgaacacttccccagctatgctccaccctctggcgatccctccattgagagcacagacggcgctgaggacgccagcctggctccacttgaaagccaacccattaccttcacaccagaggaaatggagaagtactccaagttacagcaagcggctcagcagcatatccagcagcagttgctagcaaagcaggttaaggctttcccagcttcagccgcactggcgccagcaactcccgctctgcaacctatccacatccagcagccagctaccgcaagtgccaccagtattacgacagtacagcacgccattctccagcaccacgcagccgctgccgcagctgccataggcattcaccctcacccacaccctcagccgctggcgcaggtacaccacatccctcagccgcatctgaccccaatcagcctgtcccacctgacccattccataatcccaggccaccccgctacttttctggcaagccatccaatacacatcatccccgctagcgcaatccatcctggcccatttactttccaccctgtgccacacgctgcactataccccactctgctggctccgcgtcccgctgctgccgcagcgactgcactgcatctacatcctctgctgcacccaatcttttctggccaagatctgcagcatcctccaagccacggcacctag

SEQ ID NO: 223931 - DNA, 1476 bp, Artificial Sequence
  Description of Artificial Sequence: Synthetic coding sequence
atgccacttcccgtgcaggttttcaacctccagggtgctgtcgaaccgatgcagatagacgtcgaccctcaggaagaccctcaaaatgccccagatgttaactatgttgtggagaacccttccctcgatctcgaacagtatgcggcttcctatagcggtcttatgcggatcgagaggctccaattcatcgcggaccactgccccaccctccgggtcgaggccctgaagatggcactgtcattcgtgcaaagaacatttaatgtcgacatgtacgaggagatccacaggaaactgagcgaggctacccgtagttccctccgggaactacagaatgcgccagatgctatccccgaaagtggagtagagccgcctgccctggataccgcgtgggtggaagcaacgaggaagaaggctcttttaaaattagagaaattggatacagatttaaaaaactacaaaggaaatagtattaaagaatccattcgcagaggccatgatgatttaggcgatcactatttggattgtggcgatctatccaacgccctgaagtgctatagccgagctagagactactgtacaagcgcaaagcatgtgataaatatgtgcttgaacgtcattaaagtttctgtatatttacagaattggtcccacgtgctttcatatgtatccaaagccgaaagcaccccagagatagccgaacagcgcggtgagcgcgattcacaaacccaggctattctgacgaagctaaagtgtgccgctggactggccgaactggccgctagaaagtataagcaggcagcaaagtgtttactccttgcaagctttgaccattgtgactttcctgagttgctttctcccagcaacgtcgcaatttatggcggactgtgcgccctggccacattcgatcggcaggaacttcagcggaatgtcattagcagctcttctttcaagctgttcctcgaattagagccacaggtgcgagatatcattttcaagttttatgagagtaaatacgcgagctgtctcaaaatgctcgacgagatgaaagataacttgctgttggatatgtacctcgcaccacacgtccgcactctttatacccagattcggaacagagccttgatccagtacttcagcccatatgtctctgccgatatgcaccggatggcggctgcatttaataccactgtcgcagctctggaggacgaacttacccagctgatcctggaaggattgattagcgctcgagtggactcacactctaagatcctgtacgccagggatgtcgatcagaggagcacaacgttcgaaaaatcactgttgatgggcaaggagttccagcggagagccaaggccatgatgctacgagcggctgttttacgcaaccaaatacacgtaaaatcaccaccgagagaaggttcccaaggagagttgacccctgctaactcccaaagccgcatgtctacgaacatgtag

SEQ ID NO: 223932 - DNA, 1653 bp, Artificial Sequence
  Description of Artificial Sequence: Synthetic coding sequence
atgccacttcctgtgcaggtcttcaatttacaacagcccgcatctagcgtgagtgggagcggcggagctgagagtcaggatcggatgcgcgactcgtccgctccatcaagcgctagctcttctgtgaccgatttgtactgcacccctcattcaagtcggagtgatctggtgctcccaggcaccgcaggcgacttttcactctccgcaagcttatcagcttgcactcttttatatgagggcgcagtggaacccatgcagatagacgtagatccacaggaggaccctcaaaatgctccggacgcaatcccagagagcggggttgagcccccagccctggatactgcatgggtggaagcgactaggaaaaaggccctcctgaaactggagaagctcgacacagacctcaagaactacaaaggcaacagtataaaggaatcaattcgcaggggccacgacgacctaggtgatcactacttagactgtggcgacctgtctaacgcccttaaatgttacagtcgcgcacgagattactgcacttccgcaaagcatgttattaacatgtgcctcaatgtgattaaggtgtctgtttaccttcaaaactggtcgcacgtgctgtcttacgttagcaaagctgaaagcactccagaaatcgctgaacagcggggagagagagatagccagacgcaggctattttaacaaagctgaagtgtgctgctggattagccgaattggccgcacgtaaatataagcaggccgctaaatgtttgttgctggctagcttcgaccattgtgacttccccgagctgttatctccctccaatgtcgccatttatgggggtctctgcgccctcgcaactttcgaccgtcaggaacttcagcgaaatgtgatcagcagctcttcttttaagctttttctggaattggaaccacaggtgagagacattatatttaaattttacgagagcaagtatgcctcttgcctaaagatgctagatgaaatgaaagacaatctccttctcgatatgtacctagcccctcacgtacgtacgctctacactcagatccgtaaccgagccctgattcaatacttttctccgtacgtatctgcagatatgcaccgaatggccgcagccttcaacaccaccgtggccgcattggaggacgagctgacgcagctgatcttagaagggttgatttccgctcgggttgattctcatagtaagatactgtatgccagagatgtcgaccagaggagtaccacttttgaaaaaagcctgctgatgggcaaagaatttcaaagaagagccaaggccatgatgctgcgggctgccgtgctgcgaaatcagatccacgtcaagcctctgcctacatcaactgacctgggaccccctggcggttccgtgctgcccgcagcccaactgcggggattggccacaggctgccatcccgcatgtgtgccctcattggggctccgcagacaagctgccgcttcttgtggcccaagttggaaggagagacccgctggactggatcctgtcggcttctgtccacagggggcagattgtgcagctcctaggccatccggcacaatttcgcagactccacccgtgccagccagtgtgaggtgccgccaagtcggaggtgtgcactag

SEQ ID NO: 223933 - DNA, 1584 bp, Artificial Sequence
  Description of Artificial Sequence: Synthetic coding sequence
atgagagacagtagcgcgccatccagcgccagtagcagtgtgacagatctatactgtaccccccattcatcccgatccgaccttgtgttgcccggaacagcgggtgactttagcctgtcagcatcattatcggcttgtacccttctgtacgagggggctgtcgaaccgatgcagatagatgttgatccccaagaggatccccaaaacgctcctgacgtgaactatgtggtggagaaccccagtctcgatttggagcaatatgctgcatcgtattcaggattgatgagaatagagcggctgcagtttattgcggatcattgtccaaccctgagggttgaagcacttaagatggcattgagctttgttcagaggacgtttaatgtggatatgtatgaagagattcacaggaaactctctgaggcgacgagagagttgcagaatgcccctgatgctattcccgagtctggagtggagccccctgctctagatacagcatgggtggaagcaacccgtaagaaggccctcctgaaactagagaaattagataccgacctaaagaattataagggaaactctataaaggagagcattcggcgtgggcatgacgacctgggggaccactatctggattgcggcgatctatcaaacgcgctcaaatgctattcccgggctcgcgattactgcacgagcgcaaagcacgttattaacatgtgtctcaacgtgatcaaggtgtctgtgtacctgcaaaactggagtcacgtgttgtcctatgtgtcaaaggcggagtctacaccagaaattgccgagcagcgcggtgagagggacagccagacccaagccatcttgaccaagctcaagtgcgccgcaggattagctgagctggccgctcgaaaatacaagcaggctgccaaatgtcttctgctggcctcttttgatcactgcgatttccccgagttgctgagtccaagtaatgtggccatatacggtggactgtgcgctcttgcaacattcgacagacaggaactgcaaaggaacgtaatatcctcatctagttttaagctgtttcttgagctggagccgcaggtgcgagatatcatctttaagttttacgagagcaagtacgcgtcctgtctgaagatgctggatgagatgaaggataacctgttgcttgatatgtatctggcgccacatgttagaactttgtacacgcagatacgtaatcgtgccctcattcagtacttctccccgtatgtttcagcggatatgcaccgcatggctgcagcatttaacactacagtcgccgcactggaggatgaactgactcagttaattctagaggggctgatcagtgccagggtggattctcatagtaagattttgtatgcacgcgacgtcgatcagaggagtaccactttcgaaaaatcactgctgatgggtaaggagttccaaagaagggccaaggccatgatgctccgggctgctgttctgaggaaccaaatccacgttaagtctccaccaagggagggcagtcagggagagttgacaccggctaatagtcagagtaggatgtcaacgaacatgtag

SEQ ID NO: 223934 - DNA, 855 bp, Artificial Sequence
  Description of Artificial Sequence: Synthetic coding sequence
ggccagcctgaaattggcggttttctccctagcagcttggcccctgtaaccgccgctattctgatggcaagatcaagtctgagagaactacaaaacgcgcctgacgctatacccgaaagtggagtggagccccctgccctggatacagcatgggtggaggctacccggaaaaaagctctgctgaagctggaaaagttggacaccgacctgaagaactataagggtaactccatcaaggaatctattagacggggacatgatgatctcggggaccactacctcgactgcggggacctgagcaacgcactcaagtgctatagtagagctcgtgattactgcacgagcgcaaagcacgttattaacatgtgtctcaatgtgatcaaggtgagcgtgtacctgcaaaattggagtcatgtcctatcatacgtcagcaaagctgaaagcacccccgaaattgccgaggtaagagccacctctagcgagacgttgccaccaggattccttacgacagccggacccagctgccctcctccccctcacagccctcccgaccttaacttgccttcgagccctttgtcgctgggcgctgggcatcgtgcgctgggtaacgtcgagcatggacctcacgcttgtggcttcttactgcagcagcgtggcgagcgcgattcacagacacaggccattctgacaaagctgaagtgtgcagcaggtgagggattgggccacgcccagctgacccccaggagccccgtggctaagagcagtcagcctcgtgccgtcggttggtccttaccgcagccgggtaagactagcctggcgggaagacggatgctgtgggcccacgtacaagtatag

SEQ ID NO: 223935 - DNA, 1584 bp, Artificial Sequence
  Description of Artificial Sequence: Synthetic coding sequence
atgcgagactcctctgcacctagttccgcgagtagctccgtgactgacctgtactgtacgccacacagtagccgctcggacctggtgctgcccggaacagctggcgacttcagcttatccgcctcactgtccgcctgtaccttgttatacgagggagctgtagagcctatgcagatcgacgtcgatccccaggaagaccctcaaaatgcacccgatgtgaattatgtggttgaaaaccccagcctggatttggaacagtacgccgcttcctattctggcctcatgagaatcgagcggctgcaatttattgccgatcattgtcccaccctacgggtggaagccctgaagatggctcttagctttgttcagaggacctttaacgtagacatgtatgaagagatccatcggaaactgtccgaagcaacaagagagctgcagaatgcccctgacgcaataccggagtcaggggtcgagccacccgctctcgatactgcctgggtggaggctacccgaaaaaaagccctgttaaaactagagaagctggataccgacctcaagaactacaagggcaacagcataaaggagagcatccgcaggggccatgatgacctcggcgatcattacctcgattgcggtgatctgagcaatgcccttaaatgctactcaagagcaagagactattgcacctctgctaaacacgtgatcaacatgtgcctcaatgtgattaaagtcagtgtgtacctgcagaattggagccacgtcctctcatatgtaagcaaagctgaaagcacgcctgaaattgccgagcagcggggagaacgagacagccagactcaggctatcctcactaagttgaagtgtgcagccggattagccgagctggctgctcgaaaatataaacaggccgcaaagtgtctgttactggctagttttgaccattgtgatttcccagaactgctgtccccttcaaacgttgctatctatggtggcctgtgtgcattggctacgtttgaccgccaagagcttcaacgcaatgtaatatcttcctcttccttcaaactgtttctggagctggaaccacaagtccgagatatcattttcaaattttacgaatctaaatacgcctcgtgtcttaaaatgttagatgaaatgaaggataacctgctgctggatatgtatttggcaccacacgtgcgtacgctgtatacacaaatccggaatagggcgttgatccagtacttttccccatacgtgagtgccgacatgcatagaatggcagcggctttcaatactactgtggcggctctagaggacgaactgactcagctgattctggagggtctaatttctgccagggtggattctcacagcaagatcctgtacgccagagacgtagaccagcgaagcacaacatttgaaaaatcgctactaatggggaaggagtttcagcgtcgagcaaaagcaatgatgctgcgcgcagccgtactacgcaaccagattcacgttaaatcgccaccgagggagggatctcagggagagcttacacccgctaacagtcagagcagaatgagtacgaacatgtag

SEQ ID NO: 223936 - DNA, 993 bp, Artificial Sequence
  Description of Artificial Sequence: Synthetic coding sequence
atgacacccaactcaaccggtgaggttccatctcctattcctaagggggctctcgggctaagtctggctctagcaagcttaatcatcacagcaaatctgctcctagccctggggatcgcttgggatcgccgtctgcggtccccacccgcaggatgtttttttctgtctctgcttttagctgggcttctcaccgggctggccctccccacacttccaggtctttggaaccagtccagaagaggttattggtcttgcctcttagtgtacctggccccaaatttttcttttttatccttgctcgctaatttactgctggtgcatggggagcgttatatggccgtgctgcgtccgttgcaaccccctggcagcattcgtcttgcgctactgctgacgtgggcaggccctttgctcttcgcctcactgcctgccctcgggtggaatcactggactcccggagctaattgtagttcccaggcaattttccctgctccttacctctacctagaggtttacggcctgttactccctgctgtgggagcggctgcgtttctgagcgttcgcgttttagcgaccgcccacagacaacttcaggacatctgcaggctggagagggctgtgtgtcgggatgagccgagtgctctggcgagagctttaacgtggagacaggcaagagcgcaagccggagcgatgctgctgttcgggctgtgttggggtccttatgtcgctaccttactcctgtctgtgctggcctacgagcagaggcctcctctcggtcccggaactttgctctcgttgttgtctttggggtctgccagtgccgctgccgttccagtcgccatgggtctaggtgaccagcgctataccgccccttggcgtgccgcagcacaacgttgtctgcaggggttatggggcagggcatctagagactcaccagggccatctattgcataccatcccagtagtcaatcgtccgtggacctggacctgaactag

SEQ ID NO: 223937 - DNA, 993 bp, Artificial Sequence
  Description of Artificial Sequence: Synthetic coding sequence
atgacacctaattccacaggggaggtgccatcaccaattccaaagggggctctgggactaagcctggctctggcttccctcatcataacagctaacttgctcttagccttagggattgcttgggaccgtcgccttagatctcccccagcgggttgctttttcctgagtctgctcttggccggactgttaacaggcctggcccttccaacccttccgggactatggaaccagtccagacgtggatattggagttgcctgctggtgtaccttgcacccaatttctcatttctatctctgctggctaacctgctcctggttcacggcgagcggtacatggccgtgctaaggcccttgcagccacctggcagtatacgcctggccctgctcttaacatgggcaggccctctgctctttgcatcattgcctgccctcggctggaatcactggactcccggagccaattgttcaagtcaggctatttttccagctccctacctgtacctggaggtgtatggactcctcctgccggcagttggggcagccgctttcctctcagtacgcgtactggcaaccgctcaccgccagctccaggacatatgtcgactcgagcgagccgtgtgtcgggacgagcccagcgccctggccagagctctgacatggcgccaggccagagcgcaggcgggagccatgctgttgttcggcctgtgttggggtccgtacgtcgctacactgctgctgtcagtcttagcctatgagcagagacctcctctcggacccggaactctcttgtctcttctgagcttggggagcgctagtgctgccgctgttccagttgccatgggactgggggaccagagatacaccgccccatggagagcagccgcacagaggtgcctgcaagggctgtggggccgagcctctagggacagccctggaccttcaatagcttatcatccatcttctcagtcctccgtcgatctggacctgaattag

SEQ ID NO: 223938 - DNA, 993 bp, Artificial Sequence
  Description of Artificial Sequence: Synthetic coding sequence
atgaccccaaactccactggagaagtgccaagcccgattcccaagggcgcactcgggctttctctcgctttagcctccctgatcatcacggccaacttgctgctggctctgggcatcgcctgggacaggcgcctgcgatctccgccagccggatgcttctttttgtcattgctcctcgctggcttgcttacaggcctcgcccttcccaccctccccggtctgtggaaccaaagtagacggggttattggagttgtctgctagtatatcttgcgccaaactttagcttcctgagtctgctggcaaatctgctattggtgcacggagagcggtacatggccgtccttagaccactgcagcctcccggttccattcgtcttgcattattgctgacatgggcagggcctttgttgttcgcatccctgcccgcattaggctggaatcactggactcccggagcaaactgcagctcacaagcaatcttccccgctccatacctctacttggaagtatacggcctgttgctcccagctgtcggggcagcagcatttttaagcgtccgggttttggccaccgctcaccggcagctgcaggacatttgccgactggagcgagcggtgtgtcgggacgagccctccgcgctcgcaagagccctgacttggaggcaggctagggcccaagctggagcaatgctgcttttcggactgtgctggggaccgtatgttgccaccctgctcctcagcgttctggcttatgaacagcgccctccactggggcctggtaccctcctgtcactgctgtcgctcggatccgccagtgctgccgcagtaccagtcgccatgggattaggggatcagagatatacagccccttggcgcgctgccgctcaacggtgccttcagggcctttgggggagagcctcgagggattcgcccggaccatcaatcgcttaccaccccagcagtcagagttccgttgatctggacctgaactag

SEQ ID NO: 223939 - DNA, 993 bp, Artificial Sequence
  Description of Artificial Sequence: Synthetic coding sequence
atgaccccgaattccaccggtgaagtcccatctcctatacctaaaggggctttgggcttgtccctggccctggcttccctcatcatcaccgctaatctgctcctcgcgctaggaattgcctgggacaggcgcttaagatcgccccctgctggctgcttctttctctcactgctgctggctgggttgctcaccggcctggctttgcctaccctgcctggactgtggaaccagtcacggagaggctattggtcttgtttactcgtttatctggccccaaatttctcttttctgagcctgttagccaacttactccttgttcacggcgagcgttacatggcagttctgcgcccacttcagcctcccggaagcattaggctcgccttgctgctgacctgggcaggacccctactattcgcctcactccctgctctggggtggaaccattggacgccaggggcaaactgcagctctcaggccatctttccggctccctacctgtacttagaggtctacggcttgctgcttcctgccgtgggcgcagccgcattcctctcggtaagagttctggcgaccgcccaccggcaactgcaggatatctgtaggctggagagagccgtctgccgggatgagccgtcagcccttgcgagagctctcacatggagacaggccagggcacaagcaggagctatgctgttgttcgggctgtgctggggtccttatgtggctaccctgttactgtcggtgctcgcctatgagcagaggcctcctctggggccaggaacattgctgagccttctgtctctgggctcggcaagcgcggctgcagtgcctgtagccatgggcctcggagatcagcgttacacggcgccttggagggcagctgctcagcgttgccttcagggtctgtggggaagggcctcacgagattccccgggacctagcatcgcgtatcatcctagtagccagagttcagttgatctcgacctgaattag

SEQ ID NO: 223940 - DNA, 1128 bp, Artificial Sequence
  Description of Artificial Sequence: Synthetic coding sequence
atggatgtgacatcacaggccagaggtgttggattggagatgtaccctggcacagctcaacccgctgccccaaatacaacgagtccggagctcaacctcagccacccattactgggcactgctctagctaatggcacgggggagctgagcgagcaccagcagtacgtaatcggccttttcctgtcatgcctgtatacgatctttctttttccaattggatttgtcggtaatattctcattctggttgttaacatctcttttagagagaagatgacaataccagatttatactttatcaacctggccgttgccgacttgattctcgtggcggactctctgattgaagtctttaacttgcacgaacgatattacgacatcgctgtgttgtgcacgtttatgtccctcttccttcaggtcaacatgtattcttccgtgttctttttgacatggatgtctttcgatcgctatattgctcttgccagagccatgcgctgcagtctgtttaggaccaaacatcatgccagactttcttgcggccttatatggatggcctccgtcagtgcgacactggtgcccttcaccgcggtccatctccagcacacagacgaagcttgcttctgcttcgccgacgtcagagaggtccagtggcttgaagtcaccctggggtttattgtaccctttgcaataattgggctgtgttattctcttatcgtgcgggtccttgtgagggcgcacagacatagggggctgagaccacgcagacagaaggctctgcggatgatccttgccgtggtcctggttttcttcgtctgctggctccccgagaatgtatttatctctgtgcacttgctgcagcgcactcagccaggtgccgcaccttgtaagcaaagcttcagacacgcccatcctctgactgggcacatcgttaaccttgcagctttcagcaactcttgccttaatcccttgatatacagtttcctaggtgaaactttcagggataaattgcggctatatatcgaacagaagactaatcttcccgcactgaatcgattttgccatgctgccctcaaagctgtgatcccagattcgactgaacagtccgacgtcagattctcttccgcggtgtag

SEQ ID NO: 223941 - DNA, 531 bp, Artificial Sequence
  Description of Artificial Sequence: Synthetic coding sequence
atgagcctaaactgtggccaaatgtggcttctggcccctcgcggtttggccagagtgaccttggcttggtctccctgggggtgcctggggaacttaacgacaggccatctcgccttattaacacaaaactgctacaatccgaaggcactcgcccctcaaggacccaaggcctccggggatcagcctgtcacacagctgctgcccgcaaatccggcatgccggtgcacatgcctcccactccaagaaacttttctgagcgtgctccacctcccagggtggcaacagtggaggtgtgccgctagccccggtcccaggggcgctgctgccttagggcctgagcaacaggaggggcctagcgtcgagaggccccctagcgcacccggttggttctcacactgcttattaacatccacatggcagctccacagctgcggcttgggtccatgtgagcttccctgcgggctagtgggttgccaggacaacgagatcctgcaacacctgtggctaactaatctgtttttacagaaatag

SEQ ID NO: 223942 - DNA, 1128 bp, Artificial Sequence
  Description of Artificial Sequence: Synthetic coding sequence
atggacgttacctctcaggcgaggggtgtaggactggagatgtaccccggtactgctcagcctgccgctcctaataccacttcccctgaacttaatttatcacatcccctcctgggaaccgctctagctaatggcacaggagagctctctgagcatcagcagtatgttattgggctgttcctgagttgtttgtacaccatctttttgtttcccattggatttgtggggaatatcctgattcttgtagtgaacattagctttcgcgaaaaaatgacgatcccagacttgtatttcataaacctggctgtggccgacctgatccttgtggccgactccctgatcgaggttttcaatctgcacgaacgttactacgatatcgctgtcctgtgtactttcatgagcctgttccttcaagtcaacatgtactcgtccgtgttttttttgacatggatgtctttcgaccggtatatcgccttggcaagggctatgcggtgttcactctttcggaccaagcatcacgccagactcagctgcggtttgatttggatggcctccgtctccgccacacttgttccgtttactgccgtccatctgcaacacaccgatgaggcttgtttctgttttgccgacgtcagggaagtccagtggctggaagttactctggggtttatagtgccatttgcaattattggcttatgctactctctaattgtaagagtgctagttagggcacacaggcacaggggcctgcgaccccgtcgccagaaagccctgaggatgattctggcagtggtactggtgttcttcgtatgctggctacctgaaaacgtattcatttctgtccacctgttacagcggactcagccaggggcagctccctgcaaacagagtttccgacatgctcatccattaaccggccacattgttaacctggccgcattctctaactcatgcctgaatcctctaatttacagcttcctgggcgaaacgtttcgtgacaaactgaggctatacatcgagcagaaaaccaatctgccagccttgaatcggttctgccatgcggcattaaaagcagttattcctgactccactgaacagagtgatgtcaggttcagcagcgccgtctag

SEQ ID NO: 223943 - DNA, 1128 bp, Artificial Sequence
  Description of Artificial Sequence: Synthetic coding sequence
atggacgtgacaagccaggcgagaggggtcggccttgagatgtatccaggcactgcccaacctgccgctcctaacactacgtcccctgagctaaacttatctcaccccctcctggggacagcattggccaacgggactggcgaactgagcgagcatcaacaatacgtaattggactctttctgtcctgcctctacaccatctttctctttccaattggttttgtgggaaatattcttatcttagtagtcaacatttcattccgagagaaaatgaccattcctgacctctacttcattaacttagctgtggcagacctcatcctggtggccgattccctcatagaggtgttcaatcttcatgagagatattatgacattgctgtgctatgtacctttatgtcactgttcctgcaggtcaacatgtacagcagcgtcttttttctgacatggatgtcgttcgataggtatatcgcattggccagagcgatgcgatgtagcttattccgaacgaaacaccacgccagactgagctgcgggcttatctggatggccagcgtgagcgctaccctggttccatttacagcagtgcaccttcagcacaccgacgaggcatgtttctgttttgcagacgtgcgcgaagtgcagtggttagaagtcacattaggattcattgtgcctttcgcgataattggtctgtgttactcgttgattgttcgggttctggtgcgggctcaccgacataggggtcttcgccctcgccgacagaaggccctacggatgatcttggcagtcgtactagtcttctttgtttgttggctcccagagaatgtgttcatctccgtgcatctgctccagagaacacagcctggcgcagctccttgcaagcagtctttccgacacgcccatcccttgaccggtcacatcgtaaacctggcagctttctcgaactcctgtctgaatccactcatatatagttttctcggagagacctttagggataaactgcgattgtacattgaacagaaaacaaatctgcccgcactgaaccggttttgccatgcagccctgaaagcagtcatcccagattctacggaacagtctgacgtgaggttctctagtgcagtttag

SEQ ID NO: 223944 - DNA, 1128 bp, Artificial Sequence
  Description of Artificial Sequence: Synthetic coding sequence
atggatgtaaccagccaggcacgtggcgtcggcctggagatgtaccctgggactgcccagccagccgcacccaacaccacaagtcccgagctgaatctgtctcaccccttgctgggcaccgctttagccaatgggacaggagaattgtctgaacatcagcagtatgtgatcggcctttttctctcatgtctctacaccattttcctgttccccataggatttgtcggcaatattcttattcttgtggtgaacattagtttccgcgaaaagatgacaatcccagatctctacttcatcaacttggctgtggctgacttgattttagtggcagactcacttatcgaggtctttaacctgcacgagagatactacgatatcgccgtattgtgcacttttatgagtttgtttctgcaggtgaacatgtacagctccgtgttctttctgacatggatgagcttcgacaggtacattgcgctggcgcgtgcaatgagatgctctctttttcgcaccaaacatcatgcgcgactgagctgcggactcatttggatggccagcgtgtcagcgaccttagtgcccttcacagctgtgcacctccagcacactgatgaggcttgcttctgtttcgccgacgtgagggaggtgcaatggctagaggtaacccttggattcattgttccatttgcaattatcggactttgctactccctgatcgttagagtcttagtccgagctcaccggcaccgaggcctgcggcctaggcgccagaaagccctgagaatgattcttgccgttgtattggtcttttttgtgtgttggctgccagagaacgtctttataagtgtgcatctgctgcagagaactcagcctggggcagcaccttgcaagcagtcatttagacacgcccatcctttaacgggacatatagtgaaccttgccgcattttcgaactcttgtctgaaccccctcatttactcttttctcggtgagacttttagagataagcttaggctgtacattgagcagaagacaaacctcccagctttaaacaggttttgtcatgcagcactgaaggctgtaattcccgatagcaccgagcagtctgacgttaggtttagcagtgctgtttag

SEQ ID NO: 223945 - DNA, 222 bp, Artificial Sequence
  Description of Artificial Sequence: Synthetic coding sequence
atggacgtgacgtcacaggctagaggcgtcggcctggagatgtatccgggaaccgcgcaaccagctgcccctaacacaacgagccccgaactgaatttatcacaccccctactcggtacagccctcgccaacggaaccggtgagctgagcgaacaccaacagtacgttattggtctattcctgtcctgcctgtatacaatatttctgttccccatcggatag

SEQ ID NO: 223946 - DNA, 1227 bp, Artificial Sequence
  Description of Artificial Sequence: Synthetic coding sequence
atggacgtcactagccaagctagaggtgtaggcctagagatgtatccaggtaccgcacagcctgcagccccaaataccacgagcccggagttgaatctcagtcacccgctgctaggtactgccctcgcaaacggcaccggggagctctcagagcatcaacaatacgtgattggactcttcctgagctgcctctacacaatttttctcttccccattggatttgtaggcaacattctcatactcgtggtgaatatctcattcagggagaagatgaccatccccgatctgtactttattaacctggcagttgcggacctgattttggttgccgattcactgatcgaagtgtttaatctgcatgaacgttattatgacattgctgtcctgtgtactttcatgagtctctttctgcaagtgaatatgtattccagcgtgttctttctgacttggatgtcgtttgatagatacatcgcattggcccgtgcaatgcgctgcagtctgtttcgtacaaagcaccacgctcgtctgtcttgcggactgatctggatggccagtgtgtcagcaactttagtgcccttcaccgcagtgcatctgcaacataccgacgaagcctgcttctgttttgccgacgttcgagaggtgcagtggctggaagtgaccttaggatttattgtccccttcgctataattggcctttgctactccctgattgttcgggttcttgttagggcacacaggcatcgtgggttacgaccaaggcgccagaaggccctgcgcatgattcttgctgtagtcctcgttttcttcgtctgttggctgcctgagaatgtatttatatccgtccacttgcttcagcggacccaacctggagccgctccctgcaagcagtccttccgacatgcacacccacttacacacggccacgtcatgagcctcaattgcggacagatgtggctgctggctcctcgtggcctcgcccgagttaccctagcttggtccccctgggggtgtctagggaatttaaccaccggtcacctggccctcctgacacaaaattgctacaacccaaaagcgttggctccacagggtcctaaagcttctggcgaccagcctgtcacacaactgttgcccgcaaatcccgcttgccgatgcacatgtctgccactgcaggagactttcctgacaccttctaccagaaaagctacgcgtcgaggccattgtgggtag

SEQ ID NO: 223947 - DNA, 1068 bp, Artificial Sequence
  Description of Artificial Sequence: Synthetic coding sequence
atggaggacctcgaagagacactgtttgaggaattcgagaattacagctacgacttagactactattcgctagagtcagacttagaagaaaaggtgcagctcggagtggtccactgggtgtcacttgtgctttactgtctggcatttgtcctaggcatacccggtaacgccatcgtgatctggttcacagggtttaaatggaaaaaaactgtcaccacactgtggtttctgaatcttgctatagctgactttatttttctcctctttctgcccctgtatatctcctatgtggcaatgaattttcattggccgtttggcatttggctttgtaaagccaattctttcacagcccaactgaacatgttcgcctcagtgtttttcctgacggtgatctcactggatcactatattcacctcatacatcctgtattatctcatagacatagaaccttaaagaactccttgattgtcataatttttatttggctactggcttcattaatcggagggccagccctctacttcagggatacagtagagtttaataaccacaccctttgctacaacaatttccagaagcacgaccctgacctcacccttatacgccatcatgttcttacatgggtgaagtttattataggttatctctttccactgttgacaatgtcaatttgttatctctgcctgatcttcaaagtcaagaaaaggagtatcctcatatcgtcccgtcatttttggacgattctggtagtggtggttgccttcgtggtttgttggacgccgtatcacctgttttctatttgggagctcacaatacaccataattcctatagtcatcacgttatgcaagccggaatccctttatcgaccggtctagcatttctaaatagttgcctgaaccccattctctacgtgcttataagtaagaagttccaggctaggttccgctctagcgtagccgaaatactgaaatacactctctgggaagtgagctgctcaggtacagtttctgagcagctcagaaactcagagaccaagaacctctgtctgctggagacagctcagtag

SEQ ID NO: 223948 - DNA, 225 bp, Artificial Sequence
  Description of Artificial Sequence: Synthetic coding sequence
atggaagatctggaggagaccctgttcgaggaattcgaaaattattcctacgatcttgattattactccctggagtcagatcttgaggagaaagtacaactgggcgtggtacactgggtcagtctggtgctttactgtttagctttcgtgcttggaatcccgggaaacgccatcgtgatttggttcactggatttaagtggaaaaagaccgtaaccacgctttag

SEQ ID NO: 223949 - DNA, 1068 bp, Artificial Sequence
  Description of Artificial Sequence: Synthetic coding sequence
atggaagacctcgaagaaacgctgttcgaagaattcgaaaattattcctatgatctcgactactactccctggagtcagacctagaggaaaaagtgcaactcggagtggtccactgggtgtcactagtcctttattgtttggcctttgttttgggcatcccgggaaatgccatcgtgatatggtttactgggttcaaatggaagaagactgtgaccacgctgtggttcctcaacttagccattgcggatttcatctttctgctgtttctccctctttatatctcatatgttgcaatgaacttccactggccattcggtatttggttgtgtaaagccaacagctttactgctcagctgaatatgttcgccagcgtattcttcctgacagtgatctcacttgatcactacatccatctcattcatcctgtcctcagccaccggcatcggactctgaagaactcactcatcgtgattatcttcatctggctgctggcatctctgattggcggaccggctctgtatttccgcgatactgtggaattcaataatcataccctctgttacaataactttcagaagcacgatccagacttgaccctaattcgtcatcacgtccttacttgggtgaagtttattatcggttatctgttcccactgttgactatgtccatttgctatctgtgcctcatttttaaggttaagaaacgcagcatacttataagtagtaggcatttttggactatcttggtggtggtggtggcatttgtggtatgctggacaccctaccacttgttttctatctgggagctgacaatccatcataacagctatagccatcacgtgatgcaggccggaattccactgtcaactggccttgcctttttgaactcatgccttaacccaatcttgtacgtccttatctccaaaaagtttcaggccagatttagatcatccgtcgctgaaattcttaaatacacactgtgggaggtttcctgtagcggtacagtgtcagagcagcttaggaacagtgagactaagaatttgtgcctgcttgagacggcccagtag

SEQ ID NO: 223950 - DNA, 249 bp, Artificial Sequence
  Description of Artificial Sequence: Synthetic coding sequence
atggaggacttggaagagaccctgttcgaagaattcgaaaattatagttatgacctcgactactattctctcgaatcggacctcgaggagaaagttcagctcggagtggtccactgggtgtccctggtcttatactgtctcgcctttgtgctaggcattcccggtaacgcaattgtgatctggtttacgggatttaaatggaaaaaaacagtgactaccctgtggtttctcaacctggctatagcttag

SEQ ID NO: 223951 - DNA, 684 bp, Artificial Sequence
  Description of Artificial Sequence: Synthetic coding sequence
atggaggaccttgaagagactctatttgaagagttcgagaactattcctatgacctcgactattactccctggagagcgatttggaagaaaaggtgcaactgggtgtggtacattgggtgtccttggtgctgtactgccttgcatttgtattggggatccccggaaatgccatcgttatttggttcacaggttttaaatggaaaaaaacagtgactactctgtggttcctgaacttggccatcgctgattttatctttcttcttttcctgcccctatatatatcctatgttgctatgaactttcattggccatttggcatttggctttgtaaggccaatagcttcacagctcagttgaacatgtttgcttcggtgttctttctgacagtgatctcgcttgatcactatatccatctgattcaccctgtgctgagtcaccggcatcgtaccttgaaaaatagtctgattgtgatcatatttatatggctcctggctagcctcatcgggggacctgcgctgtactttcgggatacagtagaatttaataatcacactctgtgctacaacaatttccagaaacatgaccccgacttaacccttataagacatcatgttctgacttgggtaaaattcatcatcggctacctcttccccctcctgactatgagtatctgctacctctag

SEQ ID NO: 223952 - DNA, 414 bp, Artificial Sequence
  Description of Artificial Sequence: Synthetic coding sequence
atggaggatctcgaggagacgctatttgaagagtttgagaactacagctacgacttagactactacagtctggaatcggatctggaggaaaaagtccagctcggggtggtacactgggtgtccttagtgctctattgtcttgctttcgtcctgggaattccaggcaatgcaatagtgatctggttcactggcttcaagtggaaaaagacagttaccacactttggtttctcaacttggccatcgctgattttatattcctcctgtttctacctctttatatcagctacgtggcaatgaacttccactggccatttgggatttggctgtgtaaagccaatagctttaccgcccagcttaacatgtttgcatctgtgttctttcttactgtgatttcgctggaccactacatctag

SEQ ID NO: 223953 - DNA, 537 bp, Artificial Sequence
  Description of Artificial Sequence: Synthetic coding sequence
atggaagatctggaagaaactctgttcgaggagttcgaaaactactcgtacgatttggattattactcgttagagtccgacctggaggaaaaggtccagttgggagtggtgcattgggttagtctggtcttatattgcctggcatttgtcctagggatacctgggaacgcaatagtcatttggtttacaggatttaagtggaagaagaccgtgacgactctctggttcctaaacctggctatcgcggacttcatatttctcctgttcctgccgctgtatatttcgtatgtggcgatgaacttccactggcctttcggcatctggttatgtaaggccaacagcttcactgcccagcttaacatgtttgcaagcgtgttctttttgacggttatatcgttggatcactacatccacctcatacatccagtgctgtcacacaggcacaggactcttaaaaactcacttatcgtcataatctttatctggctgttagcgagtttgattggcggaccagctctttacttcagagatacctag

SEQ ID NO: 223954 - DNA, 60 bp, Artificial Sequence
  Description of Artificial Sequence: Synthetic coding sequence
atggaggatcttgaggagactctattcgaagagtttgagaactattcttacgacctctag

SEQ ID NO: 223955 - DNA, 1527 bp, Artificial Sequence
  Description of Artificial Sequence: Synthetic coding sequence
atgacttctacttgcactaatagcactcgcgagagtaactcaagccatacctgcatgccgctgtctaagatgccgatttccctggcacacggcatcatcagaagtactgtgctggtaattttcttggccgcatcattcgtggggaacattgtgctggcactggtcctgcagcggaaaccacaactcttacaggtgactaatcgatttatcttcaacctgcttgtaacagaccttcttcagattagtttggtcgcaccatgggtagttgccacaagcgtgccactcttttggcccttgaacagtcatttctgcaccgccttggttagcctgacacacttgttcgcttttgcctcggttaacacaatcgtggtggtgagtgtcgaccgttatttatccattatccaccccttgagctacccatctaagatgacccagagacgaggatacttactgttatatggcacctggatcgttgcaatcctgcagagtacaccaccactttatgggtggggccaggctgcattcgatgaacgcaatgcactgtgtagcatgatctggggggcttcccccagttacaccattttaagcgtggtgtcttttatcgtgatacctctgatcgtcatgatcgcctgttacagcgtggtattttgtgcagccagacggcagcacgcactattgtacaatgtcaagagacactcgctggaagtgagggtgaaggactgtgtggagaacgaagacgaggagggtgcagaaaaaaaggaagaattccaggacgaaagcgagtttagaaggcagcacgagggcgaggttaaagccaaggaggggaggatggaggctaaagacgggtctctgaaggctaaggaaggcagcaccggcacctccgagagttctgtggaggctagaggctccgaagaggtgcgtgaatcatcgaccgtagcctctgatggatcaatggagggaaaggagggttccacaaaggtagaggagaactcaatgaaggctgacaaaggcagaaccgaagtgaatcagtgctctattgacctcggcgaggacgatatggagttcggggaggatgacattaacttctcagaggacgacgtggaagccgtgaacatccccgaatccctgccgccatccaggcgtaactctaactcaaatcccccactgcccaggtgctatcagtgtaaggcggcaaaagtaatttttatcatcatctttagttatgtgctctccttggggccatactgcttcctcgccgtgctggccgtttgggttgatgtggaaactcaggtgccacagtgggtgatcaccattatcatctggctgttcttcctgcagtgttgtattcacccttacgtttatgggtatatgcacaaaacaattaagaaggaaattcaggatatgctaaagaagtttttctgtaaagagaagccgccaaaagaagacagccatcccgatctgccaggaactgaaggcggaaccgagggcaagatcgttccatcttacgacagcgctacattcccctag

SEQ ID NO: 223956 - DNA, 2088 bp, Artificial Sequence
  Description of Artificial Sequence: Synthetic coding sequence
atgaagatgaagagtcaggccaccatgatttgctgcttggttttctttcttagcacagaatgttcccactaccgttctaaaattcacctgaaagccggagacaagttgcagagcccagaggggaagcccaaaacagggcgtatccaagagaagtgtgagggaccttgcatctcctcctcaaactgtagccagccttgcgccaaagactttcatggcgagatcggctttacgtgcaaccagaagaagtggcagaagtcggccgaaacttgtaccagtctctctgtggaaaaattgttcaaggatagcacaggcgcttcccggctgagcgtggctgctccgtcaatccctctgcatattctggattttcgcgcacccgagactattgaatcagtggcccaggggattcgaaagaactgcccctttgactatgcctgcatcaccgatatggtgaagtcttccgagactaccagtggcaacatagcctttattgtggagctgttgaagaatatcagcaccgatctgtcagataacgtgactcgggagaaaatgaagagctactccgaggtggctaatcatattctcgacaccgcagcgatcagtaactgggctttcatccctaataagaacgcaagtagcgatctgctgcagagcgtgaacctgtttgcacgccaactccatatccacaataattcagagaacatcgtcaatgagttatttatacaaactaagggattccatatcaatcacaacactagcgaaaagtccctgaacttctccatgtcgatgaataacactacagaagatatcttaggaatggtgcagatcccgaggcaagagctgcggaagctctggcccaacgcatctcaggccattagcatcgccttccctaccctgggggctattctgcgcgaagcacatctgcagaatgtctcactgcctcgccaggttaacgggcttgtcctctcagtcgttcttcccgaaaggctgcaggagatcatccttactttcgaaaaaatcaacaaaaccagaaacgcccgagcccagtgtgtaggctggcactcaaaaaagcgcagatgggatgagaaggcatgccagatgatgctcgatattcggaacgaagtaaagtgcagatgcaattatacgagtgtcgtcatgagtttctcgatcctcatgtcatcaaaatcaatgactgataaagtgttggactacattacgtgtatcgggcttagcgtgtctatactttccttggtgctctgcctgataatcgaagccaccgtgtggtctagagtggttgtgacagagatctcttacatgagacatgtgtgtatcgtaaatattgctgtgtccttactcacagccaatgtgtggtttataattggttcccacttcaatatcaaggcccaggattataatatgtgcgtcgctgtgacttttttcagtcattttttctatctcagcctcttcttttggatgctgtttaaggctttgctcattatctacgggatcctggtcatttttcgcaggatgatgaagtccaggatgatggtaatcggcttcgctatcggctacggctgcccattgattatcgcagtcaccactgtggcgattaccgagcccgagaagggatacatgcgcccagaagcctgttggttaaattgggacaatactaaggccctgctagcgtttgcaatacccgcttttgtgattgtcgccgtgaacctaatcgttgtgcttgttgttgcagtgaatacgcagcggccaagcatcggcagtagcaagagtcaagacgtcgtgatcattatgcgcatatcaaagaatgtggcgatactgaccccattgctcgggctgacttggggattcggaatcgccacacttatcgaaggcaccagtctcacttttcacattatcttcgccttgctgaatgcttttcagggatttttcatcttacttttcggcactattatggaccataagatccgcgacgctctgagaatgaggatgagtagtctaaagggaaagagtcgggctgcagaaaacgcgtccttgggcccaacaaatggctctaagttgatgaacagacagggatag

SEQ ID NO: 223957 - DNA, 2088 bp, Artificial Sequence
  Description of Artificial Sequence: Synthetic coding sequence
atgaagatgaagagccaggcaaccatgatctgttgccttgtctttttcctgtctacagaatgttcccattatcgctcgaaaatacatttgaaggccggagataagctgcagtcacctgagggaaagcccaagacaggaaggatacaggagaagtgcgaaggaccttgcatttccagcagcaactgttcacagccatgcgctaaagattttcacggagagattggctttacttgcaatcaaaaaaaatggcaaaaatccgctgagacttgcacttccttgtccgtggagaaactgtttaaggacagtaccggagcgagccgcctttctgtggccgctccgtctattcctttacacatcctcgactttcgggcaccagaaaccatcgaaagcgtagcccagggtattagaaaaaactgccccttcgattatgcgtgtataacagacatggtgaaatcatccgagacaacctcaggcaatatcgcgttcattgtggaactcctcaagaatatatccaccgacctgtctgacaatgtgacacgagagaagatgaagtcttatagtgaggtcgccaatcacattctcgatacggcagccatctccaactgggcattcattccgaataagaacgccagtagcgacctcctccagagtgttaacctcttcgctcgacagctacatatccacaacaactccgagaatattgtaaatgagctgtttatccagacaaaagggttccacattaatcataacaccagcgagaaaagcctgaattttagcatgtcgatgaacaatacaactgaggatattctcgggatggtgcaaatcccaagacaagagctacggaagctgtggcctaatgcatcacaggccattagtatcgcatttcccactctaggagccatactgagggaggcccacctgcagaacgtttccctccctaggcaggtgaatggtctggtgctgagtgtcgtgttgcccgagcggctgcaggagatcatcttgacattcgaaaagatcaacaaaacccgcaacgccagagcacagtgcgtcggatggcacagcaaaaaacgacgttgggatgagaaagcctgccagatgatgttagacatcaggaacgaggtcaaatgtagatgtaattatactagcgtcgtgatgtccttctcaatccttatgagctctaaatcaatgactgataaagtcctggattacattacatgtatcggattatccgtctctattctgagccttgtgctctgccttattatcgaagccactgtctggtctagagtcgtcgtgacagaaatatcgtatatgagacatgtgtgtattgtgaatatcgctgtctcgctcctgactgcaaacgtgtggttcatcatcgggtctcattttaatatcaaggctcaggactacaatatgtgcgttgccgttaccttcttttcccatttcttttacctgtcgttgttcttttggatgctattcaaggctttattaattatatatggtatcctggttatcttccgacgtatgatgaagtctcgcatgatggtgataggcttcgccattggctacggctgccctttaattatagccgtaacaacagttgcaatcaccgagccagagaaaggctatatgaggccagaagcctgctggcttaactgggataacacaaaagcactgttagcatttgccataccagcctttgtcatcgtggcagtgaatttgattgtagtgctggtagtggcggtcaatacacaaaggccgagcattgggagcagcaagtcccaggatgtcgtgatcattatgaggattagtaaaaatgtggccatactgacaccgctgctcggccttacatggggattcggcattgcgaccctgatcgaagggaccagtctgacattccacattatcttcgccctactgaacgcatttcaggggttttttatcttgctgttcggcaccatcatggaccataagatccgggacgctctaagaatgcgcatgtcatcattaaaaggcaaatcgagagcagccgagaacgcaagcttgggccctactaacggctccaagctcatgaatcggcaggggtag

SEQ ID NO: 223958 - DNA, 2259 bp, Artificial Sequence
  Description of Artificial Sequence: Synthetic coding sequence
atgtacaccggcccttgtaaggtattgcacctgtccagtggactcctcccgaattccggtcgctttggcattgtacttagcgatgaataccaagttgtgacaagtctctggtgccagctctatacaacccacgctccacagcaggcgtccggcatgctcctcctgaattacctcgtgattccaagcaaggctcaggtgaacaagcctggatatattccaaacctgggtgagtgcagccattacaggtctaaaattcacctgaaagctggcgacaagttacagtctcctgaggggaaacccaagaccggcaggatccaggaaaagtgcgagggaccctgcatctcaagcagtaactgttcacagccctgtgcaaaggatttccacggagagatcggcttcacttgtaaccagaaaaagtggcaaaaatctgcagagacatgtacctccctctctgtggaaaaattgttcaaagacagtacaggcgcatctcggttaagtgtagcagcaccttctattcccctgcacattttggatttcagggcaccagaaaccatcgagagcgttgcacagggaattcgtaaaaactgcccgttcgactacgcgtgtatcacagatatggtaaaatcatcagagacaacgagcggtaacatcgctttcattgtggagttgctgaaaaacatcagtactgacctttctgacaacgttacccgagaaaagatgaagtcctattctgaagtcgcgaatcacattctcgacacagccgctatctctaactgggccttcatcccaaacaaaaacgccagttcggatctcttacagtcggtcaacctgtttgccagacagctccacattcacaacaatagcgaaaacatcgtgaatgaactcttcatccagaccaagggtttccacatcaaccacaacacctcggaaaagtctttaaactttagcatgtctatgaataatactacagaagatattttgggcatggtccaaatccccagacaagagctgcgcaagctctggcccaacgctagtcaagcaataagcatcgcgttccccaccttgggtgccatcctcagagaggcgcatttacaaaatgtcagcctcccgaggcaagtgaatggcctggtgctgagcgttgtgctccccgagcggctgcaggagattatcctcacctttgagaaaatcaataaaacaaggaacgctagagctcagtgtgtaggatggcacagcaagaaacggagatgggatgaaaaagcgtgtcaaatgatgttagacatccggaacgaggtgaaatgtcggtgcaattacacttccgtcgtgatgtcatttagtatcctgatgagcagtaagagcatgaccgataaggttttggactacatcacttgtatcggtctatccgtctccatactctcccttgtactgtgcctgatcatcgaggccacagtttggagtagggtcgtcgttacagaaatctcatacatgcgtcacgtatgcattgtgaatattgcagtgtcactcctgaccgccaatgtctggttcatcattggatcccacttcaatataaaagctcaagattacaacatgtgtgtagcagtcacctttttctcccacttcttctacctgtccctgttcttttggatgctgttcaaagcccttctgataatctatggaattttggttatattcagacgcatgatgaaaagtagaatgatggttatcgggtttgcaataggttatggttgccctctaatcattgcggtgactacagtggctatcacagaacctgaaaaaggctatatgaggccagaagcgtgctggttgaactgggacaacacgaaggctctgttggccttcgcgatacccgcattcgtgatagtggccgtgaatctgattgtggttctcgtcgttgccgtcaacacacagagaccaagcatcgggagcagtaaaagtcaggatgtggttatcattatgaggatcagtaagaatgtggctatcctgacaccactgctcggccttacctgggggttcggcattgccacattaattgagggtaccagcctgacttttcacattatctttgccctgctgaacgcatttcagggatttttcatcctgctcttcggtacaattatggatcataaaatcagggacgccctgcgaatgcggatgagctctttaaagggcaagtcaagggccgctgaaaacgcaagcctgggcccaacaaacggctctaaactgatgaaccggcagggctag

SEQ ID NO: 223959 - DNA, 1005 bp, Artificial Sequence
  Description of Artificial Sequence: Synthetic coding sequence
atgaacgaggatctgaaagtgaatctgtctggcctcccacgcgactacctagacgccgcagccgcagaaaacatctcagcggctgtttcctctcgggtcccggctgtcgagcctgagccagaactggtggtgaatccctgggacatcgttctgtgcacttctggcacactcatctcctgtgagaatgccattgtcgtgctaatcatctttcacaatcctagcctgcgggctcctatgttcttgctgattgggtcgcttgctctcgctgacttacttgctgggatcgggttgataaccaatttcgtgtttgcttacttgctgcagagtgaagctactaaactggtcacaattggcttaattgtggccagcttctccgcatcagtctgttctttactcgcaattacggtagataggtatctgtctctctactatgctttgacctaccactccgagcgcactgtgacttttacctatgtgatgctggttatgttatggggaacaagtatctgcctgggtttgctgcccgtgatgggctggaattgcttgcgcgatgagagtacatgctctgtagtccgccctcttaccaaaaataacgcagcgattttgtcagtgtcatttttgtttatgttcgccttaatgctacagctctacattcagatctgtaagatcgttatgagacatgctcatcagatcgccttgcagcatcactttctggctacctcccattacgtcaccaccaggaagggggtttccaccttggctattatcctggggactttcgctgcctgctggatgccctttacattatactcccttatcgccgattacacttatcccagtatatatacttacgctaccctgctgccagccacatataatagcattattaatcctgtcatatacgcttttcggaaccaggagatccagaaggctttgtgcttgatctgttgtggatgtatcccttcatctttggcccagagagcgaggagcccatctgatgtgtag

SEQ ID NO: 223960 - DNA, 1005 bp, Artificial Sequence
  Description of Artificial Sequence: Synthetic coding sequence
atgaatgaggacttgaaggtgaacctcagcggacttcctagagattatctggacgcagctgcagccgagaatattagtgctgccgtgtcatcaagagttccagccgtggaaccagagcctgagctggtagtcaatccctgggatattgtcctctgcacctctggcaccctaatttcttgcgaaaacgcaattgtcgtgctcatcattttccacaacccatcactccgcgctccgatgttcttgctgataggcagcctcgcactggcggatcttctggccggtatcgggctgatcacgaactttgttttcgcctacctcctccaatcagaggcgactaagctcgtgacaatagggctgatcgtggcatccttttccgcaagcgtatgctccctcctggctatcaccgtggataggtacttgagtctgtactatgcactgacctaccattcagaacgcaccgttacattcacatacgttatgcttgtcatgctctggggcacctcgatttgcctgggccttcttcctgtgatggggtggaactgcctacgtgacgaatctacatgttccgtggtgcgaccgttaactaagaacaacgcggcaatcctgtctgtatcatttctgttcatgtttgccctgatgctgcaactctatattcagatctgcaagatcgtcatgagacatgcacatcaaatcgctttgcagcatcacttcctggccacatcccattacgtcaccactcgcaagggcgtgagcaccctcgccatcatcctgggcaccttcgccgcatgttggatgccttttaccctgtactccctcatagccgactatacctacccctccatctacacctacgctacattacttcctgccacctacaactctatcattaaccctgtgatttacgccttccgcaaccaagaaattcagaaagccctgtgtcttatttgctgtggctgcattccgtcgagcctcgcacagcgggctagaagtccttctgatgtatag

SEQ ID NO: 223961 - DNA, 3840 bp, Artificial Sequence
  Description of Artificial Sequence: Synthetic coding sequence
atgagaggccatggaaatcactcccgcctcaaaagccggtgtgcctcactgggcaacgtacaccaccatcaggcacaaatggcccacggtgcccattgtcggggaggaagaacccctcagtcgcccgattccaggggtcccacagctggcggtcacaccagaggaagatggacatacagacccatagaggctctgatcaacgtcagcttccctggcgcaaaaggcggacggactgccgagggggaaccatcttgggcttgggtgttccggtctggctatctccagcgacaggcgctgcctggcctgccggttagcacccgtgtggccgcatgctggtggcagcaccatccaggacgcgatagcggtttccttggacccggatttattgatctgcttcgcgaagaaccctctggtcgtgcagacggcaaggccgcagcccagaagaccggtaggctgtacttgtttccaacctttttgggtaataagctaccagaggccgcagacagcttcggggagatcgccagtgggaacagtgtgatatttactagcgtactccaatcctcccacccacctggaaccccaccccctagcgcgaggaagccttcacctggcgctgctatgctcgtgtgtgaggagaccctggagctcggggcacaaggctgttgggggtcaacctcccccagggggcaggcagtgtctttggtcggcggtccaacagctggaggcagcagactcggtggggctggatgtacaatgggattgttgatggctctccaggcaaggcggccacgggacggcacctgggctgaccctcgcaggtgtagccgggctgtggagggttctggcttgacccgcgcagctttagtctcccctggcccaagtggagtggaggaggatactagacgggaagggtgcgtactggtcggctcatggcggtcttcaacccaccggtcccgcgtgcttatcattaatacccctagcggacgtacgccttggagccaggggagtctggggagcaccggaaggtacaaccagacgagagctcccggtagccagcagcaggggctgtgctccgacgcagcacttcatgaagactttgtgccagagcctaccccagctttcttccaatacccaccccaggcattcagcaagactaaagtgcgggacctgggcaggggcggattgtacgccttttctaaggaggagaaagtcagtgaggcccagcgcgtcgaagcctacgagacccacggattaggactgtccaccggaagacaaaatcccgtgccctctccgtgtaagccaggttgcgtatgtcagggactagcgcttgacgccgaagcttggcccagacatcctggccgacggccttgcgcagccaaggaagcctgcctcgggcctccaggctgcagcggagagctctctctccccgaggaagaggggatcgcgcctggtgcagctactgctgctccagcatgggtgccgcacggcagagtctctaggttcttgactgtcaagctgttcacctacgtgaccatgtatcaatgtaaacaggaaaggattcttcgactctgcattagtggagagtcagggaggtacgtcaggcgcagcaggtttcgtaactttgccgctttgatggtgagcaccggtgtgccgggagttcttcagctcggcgcaagacctcttcgaggaggcggacacccttacggcgacagtcaagccggaaaagtggtggaatggcgagcaggagacagggctagtggactatcagcaggagagcggaggttcctgtctcagtctgagctgcagacatggcctaggactccccattgcgtcgggaagaaagtgccacagcccgtgggcgctgctgatctcgccccagataccagcttatgtaggaaggagggatctagcgcaagccggagctgcagaccagggcctgggcatctgactaggagggaggaagattcctttcggcagctcgcgttcccaaggttcgaggaggtgacttttccccctctgactgctgctgagcgggctccatccgttcacgggggacacagtcttgcgagccaagggctggtgcttgcgggacggactcgcagcgtggcatccggaggaaaacaagagctttccggcccactagctgcctgcatcccaacacaggatctgaagacagtgctgtcactccctcggtaccccggagaattccttcacccagttgtctatgcttgcactgcggtgatgctgctgtgtctgctggccagctttgtgacctatattgtgcatcagtcagctattagaatctctcgtaaaggcagacatactttgctcaacttctgttttcacgcagcactgacgttcaccgtgttcgccggagggatcaacagaacgaagtatccaatcttgtgccaggcagttggaattgtattacattatagtacattatctaccatgctctggattggcgtaacagccagaaatatatataagcaggtgaccaaaaaagctccgttgtgtcttgacacggatcagcccccatacccccgacagcctctcctgcggttctatctggtttctggaggcgtgccctttattatctgcggcgttaccgcagccaccaatatccgcaattacggtactgaggacgaggacacagcttgctggatggcatgggaaccctctctgggcgctttttacggccctgccgcaatcataacactcgtcacctgcgtatattttttgggaacctatgtgcaactacgcaggcaccccggaagacgctatgagttacgaacccagcctgaggagcaacggagactcgcaacacccgagggagggagaggaatcagacctggcactcccccagctcacgatgcccctggggcatccgtgctgcagaacgaacacagcttccaggcacagctgagggccgcagcattcacgctatttctgttcaccgctacatgggcatttggagccctggctgtcagtcagggtcatttcttagatatggtattttcctgtttgtacggagccttttgcgtcacactggggctgtttgtcctgatccatcactgcgctaaaagagaagatgtctggcaatgctggtgggcttgctgtccaccacggaaggatgcccatccagctctggacgcgaatggagccgctctgggaagagcagcgtgtctacacagtccgggactaggacagccacggggttttgcccaccctccgggaccctgtaaaatgactaatttgcaggcagcacagggccatgcctcttgcctgagtccagccacaccatgttgcgccaaaatgcattgtgaacccctcacagcagatgaggcccatgtacacctgcaagaagaaggggctttcggccacgacccacacttgcatggctgcctgcagggaaggaccaagcctccctatttctcgcgccacccggctgaggaacccgaatacgcctaccacatacccagctcactcgacggctctccgaggtcgagccgaactgattcacctccctccagtctggacgggcctgctgggacccatacgctcgcctgttgcacccaaggggatccttttcctatggtcacccagcccgagggctccgatggctccccggcactctactcctgcccgacgcagccaggaagggaggccgcactggggccagggcacctggaaatgctgagacggacacagtccctgccgtttggaggcccatctcagaacggactacctaaaggaaagttgcttgagggactcccattcgggacggatggcaccgggaacatccgcaccggaccatggaaaaatgaaaccaccgtgtag

SEQ ID NO: 223962 - DNA, 1395 bp, Artificial Sequence
  Description of Artificial Sequence: Synthetic coding sequence
atgctgtggataggggttaccgccaggaacatttacaagcaagtaacaaaaaaggctcctctgtgcctcgacaccgaccaacccccatatcccaggcagcctctgttgtccaggttctatctcgtgagcggcggagttcctttcatcatttgtggagtcaccgccgctactaacatccgtaactatggcacagaggacgaagataccgcgtattgctggatggcctgggaacccagtctcggggctttttacggacctgccgctatcataaccctcgttacctgcgtctatttcttaggtacctacgtgcagctgcgcaggcatcccggaagacggtatgagttacgaacccagcctgaggagcagaggagacttgcaacccccgaagggggaagggggatcaggcctgggacccctcccgctcatgatgccccaggcgcatcggtcctgcaaaatgagcatagctttcaggcccagctaagagctgccgctttcacattatttctcttcaccgcgacgtgggccttcggcgctctagctgtgagtcagggacacttccttgacatggtgtttagctgcctgtacggcgcattttgtgtgactctcggtctgttcgtgctgattcaccactgcgcaaaacgggaagacgtttggcagtgttggtgggcgtgctgcccacccaggaaggacgctcacccagccctggacgcaaatggcgctgcattgggacgcgctgcatgcctccactctcctggcctgggccaacccaggggattcgcacatccacccggaccctgtaagatgacaaacctgcaggccgcacagggacacgcgtcatgtctctcaccggcaacgccatgctgcgctaagatgcattgtgagcccctgacagcggacgaggctcacgttcatctgcaggaggaaggcgcttttgggcacgacccccatttacacggttgcctccaggggagaaccaagccaccatacttctcacggcatcccgctgaggagcctgaatacgcctatcatattccctccagtctggatggttccccgcgatcttctagaacagattcaccaccgagcagtctggacggccctgctggaacacataccctggcatgttgcacacagggcgatccatttcccatggtcacacagcccgagggcagtgatgggtcacccgcattatattcctgtcctacacagccagggagggaggccgctctggggccaggacacctggagatgctgagacgtactcaatctctcccgtttgggggacctagccaaaatggtctccccaaggggaaactcctcgagggattaccatttggaactgacgggactggtaacatacgtactggcccatggaagaacgagaccacagtgtag

SEQ ID NO: 223963 - DNA, 1683 bp, Artificial Sequence
  Description of Artificial Sequence: Synthetic coding sequence
atggatctgaaaacagttctgagcctgcccagatacccaggggagtttctccatcctgtggtctatgcctgcacagctgtgatgcttctctgtcttctcgccagtttcgttacctacattgtgcaccagtccgctatacgtatctcacggaaggggagacacaccttgctcaacttttgttttcatgccgcattgaccttcaccgtcttcgccggagggatcaacaggacaaagtacccaattttatgtcaagccgttggcattgtgttacattactctacactgagtaccatgttatggataggagtgacagctcggaatatctataaacaggtaacaaagaaggctcccttgtgtctggacaccgaccagccaccataccccagacaacccctgcttaggttttatttggtctctggaggtgtgccattcatcatttgcggagttaccgccgctacaaacatccgcaactacggaacggaagacgaggataccgcctactgttggatggcgtgggagccctcactgggagcattttacggacctgccgctattatcaccttggttacttgtgtttatttcctgggcacctacgtgcagctgaggaggcacccaggcaggaggtatgagctgcggacacagcccgaagagcaacgcagattggcaacacccgaggggggacggggtattcgcccaggcactcctccagcccatgatgcccctggggcttctgttctgcaaaacgaacacagctttcaagcccagctgcgcgctgccgcattcaccctcttcttattcacagctacgtgggcgtttggagcgttggccgtgagtcagggccatttcttggacatggtgtttagttgcctctatggagccttctgtgtaaccctgggcctgtttgtcctcattcatcactgcgctaaacgcgaggacgtctggcagtgctggtgggcctgttgtcccccaaggaaggacgcccaccctgcccttgacgcgaacggcgctgcacttggtcgggcagcctgtctgcactcccccggtctaggccagccgagagggtttgcccaccctccagggccatgcaaaatgaccaatctgcaagccgcacagggacatgcatcgtgtctttcacctgcgacgccatgttgcgcaaagatgcattgtgaaccactgacggctgacgaggcccacgttcatctgcaggaggagggagcctttggccatgatcctcatttacacggctgtctacagggcaggaccaagcctccttacttcagcaggcaccccgctgaggagcccgagtatgcataccatattccgtcatctctggacggctccccaagatcatctagaacagacagtccacctagcagcttggatggacctgctggcactcatactctggcttgctgtacacagggggatccatttccaatggtgacacagccagaaggctctgatggcagtcccgctttgtacagttgcccaactcagcctggccgagaagcagcgctgggcccaggacacttggagatgcttcgtcgcacacagtccctgcccttcggcggtcctagccagaatggacttcctaaaggtaaactcctggaagggctcccattcggaacagacggcacaggcaacattcgcaccggaccctggaagaacgagaccacggtgtag

SEQ ID NO: 223964 - DNA, 2562 bp, Artificial Sequence
  Description of Artificial Sequence: Synthetic coding sequence
atgcgcggtcatggcaaccacagcagactgaaaagcaggtgcgcctctttggggaacgtgcatcaccaccaagcgcaaatggcgcacggggctcactgtaggggcggaagaaccccgcagagccctgactcccgcggtcccactgccggaggccacacacggggtcgttggacatacagacccatagaggctctgataaatgtgtccttccccggtgcaaagggaggcagaactgctgagggagagccctcctgggcgtgggtctttcgaagcgggtatctgcagcggcaggcgctgcctggtctgcccgtgtcaacacgcgtggcagcatgctggtggcaacatcaccccggacgcgacagtggcttcctcggccctggcttcatcgacttactgcgcgaggagccctcaggaagggcagatggtaaagcagcggctcagaagacaggacgcctgtacctgtttcccacattcctcggtaataaattacctgaggccgctgactcttttggggaaatcgccagcggtaactcagttatctttaccagcgtcttgcagagctctcatcctcccggtactcctccaccttccgccaggaagccctcacctggtgccgctatgcttgtgtgtgaggagacactggagctgggtgcacagggctgttggggaagtacaagtcctagggggcaggcagtttctctggtggggggtcccaccgcaggtggatctaggttgggtggggctggctgcacaatgggcctcctaatggcgttgcaggctagaaggcctagagacggtacatgggccgatccccgaagatgcagcagagccgttgaggggagcgggttgacacgcgcagctctggtgagtcctggaccctctggtgtcgaagaggatacgcgcagagagggctgtgtgctcgtgggtagctggagatcgagcacacatagatcacgggtgttaattatcaatactccctctggtcggactccctggtcacagggctctctgggatctacaggcagatacaatcagacgcgcgctcccggatctcagcaacagggactctgtagcgacgcggctctacacgaggatttcgtgcccgaacccactccggctttcttccaataccctccccaagcgttttctaagaccaaagtgagagatctggggagaggaggattgtatgcctttagcaaagaggaaaaagtgagtgaggcacagcgtgtcgaagcctacgagactcacggccttgggctaagtactggcagacagaaccccgtaccctctccttgcaagcctggctgcgtctgtcaaggtctggccttggacgctgaagcatggccgaggcacccaggacgaagaccctgtgctgccaaggaagcctgcctcggcccaccgggttgctctggagaactcagtctcccagaagaggaaggcatcgcccctggagcagctactgccgctcctgcgtgggttccccacggacgagtgtcccgattcctgacagttaagctctttacttatgtgactatgtaccagtgcaaacaagaacgcatcctcaggctgtgcatctctggagaatcaggcagatacgtgcgcaggtctagattcaggaattttgcagcactcatggtcagcacgggagtgccaggcgttctgcagctgggggcaaggcctctgcgcggagggggtcacccatacggggactcacaagctgggaaagtagtggagtggcgcgcaggagaccgcgcttcggggctgagcgccggagagcgcagattcctctctcagagtgagctgcagacctggcctcgcactccgcactgtgtgggtaagaaggtgcctcaacccgtcggagctgcggacctggctccagacacttctctgtgccggaaggagggatccagcgcctcccgcagctgcaggccgggacctgggcacttgacccgacgagaggaggattcctttaggcagttagccttccccaggtttgaggaagtgacgttccctcccctgacagctgcagaaagggctccaagcgttcatggaggccactcgttggctagccaggggctggtcctagctggcagaactaggagcgtcgccagcgggggaaaacaggagctaagtggcccactcgcagcttgcatcccgacacaggatctgaagaccgtgctcagcctcccacggtaccccggtgagttcctgcaccctgtggtctacgcatgtaccgctgttatgctcctgtgtctccttgcaagctttgtcacctatattgtccaccagtctgccatccggatcagcaggaaaggccgacacactctgctgaacttctgttttcacgcagccgagcaccctggcgttactcctttaagaactagccctcccctgccttggtggacaccaattcaggtcgggattgtgctccattattctactctgtctactatgttatggattggcgttacagctaggaatatttacaaacaggtgactaaaaaggccccactgtgtctggatactgaccagcccccatatcctcggcagccattgttgtag

SEQ ID NO: 223965 - DNA, 3366 bp, Artificial Sequence
  Description of Artificial Sequence: Synthetic coding sequence
atgggggcaggtggcaggaggatgcggggagcccctgctcgacttctgttgccgctcctcccatggctcctcctgcttttggccccagaagccagaggagccccaggctgtcccttgtcaatccgatcctgcaagtgctcaggagagcgccctaaaggtttgagtggcggagttcccggacccgcacggaggcgcgtggtgtgttcggggggagacctgccagagccacctgagcccggtctgttgccaaatggaacagtgaccctcctattgtctaataacaaaataaccggcctgaggaacggaagttttctcggcttgagtctgctggaaaagttggatcttcgaaacaacatcatctccacggttcagcctggagcctttcttggtctgggggagctcaagcgtctggatctgtccaataaccggattggatgccttactagcgaaacttttcagggcctcccaagattgttgagactaaacatctcaggcaatattttctcttcgctgcaacctggggtgttcgacgagctgcctgctctgaaggtggtcgatctgggcactgagttcctcacgtgcgactgtcatttaaggtggttgctgccgtgggcccagaatcggagcctacagttgtctgagcacactctgtgcgcctatccatcagcactgcatgctcaagccctgggctcccttcaagaagcacagctgtgctgcgagggcgctctcgagctccatacccatcacctgatcccgtcattgcgacaggttgtatttcagggggatagattgcccttccagtgctccgctagttatctgggcaacgacaccaggatccgatggtatcacaatcgcgctcctgtggagggcgacgagcaggccggtatacttcttgccgaatccttgattcacgattgcacttttatcacctctgagctcacgttgagtcacataggagtgtgggctagcggcgagtgggaatgtaccgtttccatggcacaagggaatgccagcaagaaggtcgaaatagtcgtattagagacctcggccagctattgccccgctgaaagggtggccaataatagaggagattttcggtggcctcgaacactagcaggaattactgcctaccagagttgcctgcagtatcccttcacatccgtgcccctggggggtggggctcccggtactagggcttcaagacggtgcgatagagcaggtcgctgggagccaggggattactcacactgtctttatacaaacgatattacaagggtcctctataccttcgtcctgatgccgattaatgcgtcaaatgcccttactctggcacaccagcttagggtttacaccgccgaagctgcatcgttttcagatatgatggacgtagtgtatgttgcccagatgatccaaaagttcctcggctatgtcgaccaaatcaaagagctcgtggaagttatggttgacatggcttccaatctgatgctggtagacgagcacctgctatggctggcgcagcgagaggataaagcctgttcacgaattgtaggggctcttgaaagaattggcggtgccgctctcagtcctcacgcccaacacatttctgtggagctctcagcctttccaagagaagtgggcggagccggtgccggtctgcacccagtggtgtacccgtgcaccgccttattgctgctgtgcctgtttgctaccatcatcacctacattctcaaccactcatccattcgagtgagccggaagggatggcatatgctcctgaatctttgctttcatatcgctatgaccagtgccgtgttcgccggaggcataactctcactaactaccagatggtttgccaagccgtcggcatcaccctacactattcatctttaagcacattgctttggatgggtgtgaaggcccgagtcctgcataaagaactgacctggcgcgctccccctccccaggaaggagaccccgcactgccaacaccatcccccatgctcagattttacctcatcgcaggtgggatccccctgatcatctgcggtattaccgccgctgtaaacatccataactaccgggaccatagcccttactgctggctcgtctggaggccaagcttgggcgctttttatatccctgtcgccctgatcctgctgatcacctggatctactttctttgcgcagggttgcgtctcaggggccctctggctcagaatccgaaggcgggaaattccagggcatcactggaagctggagaagagctacgagggtccaccagactccgcggatcaggacctctgctcagcgacagcggcagcctgctggccaccgggtccgcccgagtgggcacaccgggaccacccgaggacggcgatagtttgtacagccctggcgttcagctcggcgctctggtgactacccacttcctctatttagctatgtgggcctgcggtgcattggctgtgtcccaaagatggctgccacgggtcgtgtgcagttgcttatatggagttgctgcttctgcactggggctgtttgtattcacacaccactgcgccagacgacgcgacgtccgtgcctcctggagagcctgctgtccacccgcttccccggcagcgccacatgcacctcctcgtgcccttccagctgccgctgaggatgggtcaccagtgttcggagaagggcctccaagcctgaaaagttctcctagcggaagctctggtcaccctctcgccctcgggccttgcaagctaactaatctccaactcgctcagagtcaggtttgcgaggctggcgctgctgcaggcggagaaggtgagcctgagcctgcaggcacccgagggaatctagcacatcgacacccgaataacgtacatcatggcagacgcgcacataagtcaagagctaaagggcaccgggctggggaggcctgtggtaagaatcgactcaaagccttgagaggcggagccgctggcgcactcgaactgctttcgtccgagagcgggtctcttcataactctcctacagattcatacttaggctcaagtaggaactccccaggggctggcctgcaattggaaggcgagccgatgcttactccttcagaaggaagtgatacatccgcagcccctctgagcgaggccggaagagcaggacaaagacgctcagcgtctagagactctcttaagggagggggtgctttggaaaaagagtctcacaggaggtcatacccactgaacgccgcatctctgaacggcgcacccaagggcggaaaatacgatgatgtcacactgatgggggctgaggtggcatctggtgggtgcatgaagacaggcctctggaagagcgagacaaccgtttag

SEQ ID NO: 223966 - DNA, 4017 bp, Artificial Sequence
  Description of Artificial Sequence: Synthetic coding sequence
atgggcgcaggaggtcgtagaatgcgcggagctccagctcgccttcttctccctctgttaccgtggctcctccttctgctcgcacccgaggccaggggtgcgccagggtgtcccctgtctatcagatcttgtaagtgcagcggggagagacccaaaggcttgtccggtggcgtaccagggcctgcacgaagaagagtagtgtgcagtgggggtgacttgccagagcctccagagcctgggctcctcccaaacggaacggtcaccctactactgagtaataacaaaatcacgggtctgcggaacgggagcttccttggcttaagcctcctcgaaaaactggatctgaggaataatataatctcaacagttcagccaggagcatttctaggtcttggtgagcttaaaaggctggacttgtccaataatcggatcggctgtctgacatccgagacatttcagggtctccccagactgttgcgactgaatataagcggaaacatcttctcctctctgcagccgggtgttttcgacgaactgcctgctctaaaagtagtggacctgggtacagagtttttaacttgcgactgccatctgaggtggctcctaccctgggcacaaaataggtccttgcaactgtctgagcacaccctgtgcgcctaccctagcgctctgcatgcccaggccttaggatcccttcaagaagctcagctttgttgtgagggagccctcgagctgcacacacatcacttgatcccctctttacggcaggtggtctttcagggggatcgcctgccgttccaatgctccgcctcatatcttggcaacgacacacggatacgctggtaccacaatagggcccctgtcgaaggtgacgaacaagctggcatactgctcgcagaatcattgattcacgactgtacctttatcacgtctgaactgaccctttcccacattggagtctgggcgtctggtgaatgggaatgtaccgtgagcatggcacaaggcaatgccagcaagaaagtggagatcgtagtcctagaaaccagcgctagctactgccctgccgagcgagtggctaataatcgcggagacttccggtggccaagaaccctggcaggcataacggcctatcagtcctgcctccagtacccttttaccagtgtccctctgggcggaggcgctccaggcactagagcttcccgcagatgtgacagggcaggccgttgggagccaggcgactatagccactgtttgtatacaaacgatatcacacgagtgctctatacatttgtgttgatgccaattaacgcgtccaacgccctcactctggcccaccagcttcgggtgtatacagcagaggctgcctctttctctgatatgatggatgtcgtatatgtggcacagatgatccagaaattcctcggctatgtggaccagatcaaagaactggtagaggtcatggttgacatggcttctaacttaatgcttgtagacgaacacctgctttggttggcccagcgagaggataaggcttgttctcggatcgtgggagctctggagaggatcggaggagccgcactgtccccccatgcccaacacattagcgtgaatgctcggaacgtggctctggaggcttacttgatcaaaccacactcctacgttggtctaacatgcactgcattccaacggagagaaggaggagtgccgggaacaaggcctggttctcccggacagaacccacccccagagccggaacctcccgcagaccagcagctgaggtttcggtgcaccaccggccgacctaacgtatcccttagctcttttcatattaagaacagtgtcgcgctggctagtatccagcttcctccaagtctgttttcaagtctccccgcagcccttgctcctcccgtccctcctgattgcacgctccaactgctggtcttcaggaatggtaggctgttccactctcactcaaacacctctcggcctggcgctgcgggacctggcaagcggagaggtgtggcaacccctgtcatttttgccggtacctccgggtgcggcgtgggtaatctgactgagcccgtagccgtttcccttcggcattgggctgaaggagccgaacctgtcgctgcttggtggagccaggaaggtccaggagaggccggaggctggacctccgagggatgccaactgcgcagctcccagcctaatgtgtccgccttgcactgtcagcacctgggtaatgtggcggtgctcatggaactttccgcctttcctcgcgaagtcgggggtgccggagctggccttcaccccgtggtgtatccctgtactgccctgttactgctgtgtctattcgccaccattatcacctatattctcaatcacagctctattagagtatcgaggaaagggtggcacatgctcctgaatttgtgttttcacatcgctatgacaagcgctgtatttgctggaggcattaccttaaccaattaccagatggtgtgccaggcagtgggtatcacactgcactattcgtcgctcagcacccttctctggatgggagtgaaagcccgagtactgcacaaagaacttacttggagggcccctccaccgcaagagggggatcctgcgctcccaacaccatcgcccatgctcaggttctacctgatcgcaggtgggatcccgctgataatatgcggcattacagccgcagttaatattcacaattatcgggaccactccccttactgctggctggtttggaggccttctctgggggctttctacatcccagttgctctgatcctgttgatcacatggatttactttctctgtgcagggttaaggctcagaggtcctctggcgcagaacccaaaagccggaaacagtcgggcttcgctggaagctggggaggagctgaggggtagtaccaggttgagaggctctggaccattattgtccgattccggctcccttcttgccaccggctccgctcgggtcggcacacccggaccgccagaagacggcgattctctatactccccaggggtgcagttgggagccctcgtgactacacactttctctatcttgccatgtgggcttgcggcgctcttgccgttagtcagcggtggcttcccagggtggtgtgttcctgcctatacggagtcgccgcaagtgctctgggcctcttcgtcttcacgcatcactgcgcaaggcgaagggatgtgagggccagttggagagcctgctgccctcccgcatctccggcagcaccacacgcccctcctagggcccttcctgctgctgcggaagatggctctccagtcttcggcgagggcccaccgtctctcaagtcctccccgagtggaagttccggccacccactggccctggggccttgtaagttgacaaatctccaactggcccaaagtcaggtttgtgaggctggtgcagctgccggtggcgagggtgagcccgagcccgcaggcacaagggggaacctggctcatcggcatcctaataacgtgcaccatgggaggagagcccacaaaagcagagctaagggtcaccgcgctggcgaagcctgtgggaagaatcgactgaaggctctgcggggaggagctgccggtgccctagagctgctgtccagcgaatccgggtcccttcacaactcccctaccgactcctatctagggagttcccggaacagccccggtgcaggattgcagctggagggggaacccatgctgactccatccgagggctcagacaccagcgccgcaccgttgtcagaggctggcagagccggacaaagaagaagcgcttctagagactcattgaagggaggcggagcgctggagaaggaaagccaccggaggtcctatccccttaacgccgctagcctgaacggggcaccaaaggggggaaaatacgatgatgtgaccctgatgggtgctgaggtggccagtggaggctgtatgaagaccggtttgtggaaaagcgagaccactgtgtag

SEQ ID NO: 223967 - DNA, 3771 bp, Artificial Sequence
  Description of Artificial Sequence: Synthetic coding sequence
atgagaggtgcccctgctcggctgctgctccccctgctgccttggctgttgctgctgctggccccagaagcgcgaggtgcccctggttgtccgctgagcatcagatcatgcaaatgttctggagaacggcctaaaggcctgagcggtggagtgcccggacccgctaggcggagagtcgtgtgctcaggcggtgacttgccagagccacccgaaccaggactcctgccgaacggtaccgttacacttctgctgagcaacaacaaaatcaccggtctgaggaatggctcctttctggggctgagccttcttgagaagctggacttgcgtaataatattataagtacagtccagccaggcgctttcctggggctgggagaactgaaaagactggatttgtccaacaacaggatcgggtgtctgacaagcgagacttttcagggcctaccccgacttttgaggcttaatatttcgggcaacattttttcttctctgcagcctggcgtgttcgatgagctccccgctctgaaggtggtggacctgggaaccgaattcctgacatgtgattgccatttgcgatggctgctgccctgggcccagaatcgttcgttgcagctgagtgagcacacactctgcgcctacccatccgcgcttcatgctcaggctctgggctcactgcaggaggcacagctttgctgcgaaggggctctggaactgcatacacatcatcttatcccaagtttgaggcaagtggtcttccagggtgataggctaccctttcagtgttcagcctcctacctcggcaacgacacccgcattcgctggtatcacaaccgcgcacccgtcgaaggggacgaacaggctggaattttgcttgccgaatcattaatccacgattgtacctttattaccagtgagctaaccctctctcacattggggtttgggcctcaggcgagtgggaatgcaccgttagcatggcccaaggaaacgcttctaaaaaggtggagattgttgtgctggagactagtgcctcctattgccctgccgagcgagtggctaataacaggggagacttcagatggccacggactttggccggtatcacggcctatcaaagttgccttcagtatcctttcacttccgttcctctgggtggtggcgctcccggaactcgggctagtcgtcgctgcgacagagccggaagatgggagcccggtgattacagccactgtctttacacaaacgacatcacccgcgttctgtacaccttcgtccttatgcccataaatgcttctaatgcgctcacactcgcccatcagcttagggtgtatactgccgaagcggctagcttcagcgacatgatggacgttgtgtatgtagcgcagatgatccaaaaatttctggggtacgttgatcagattaaagaattagtcgaggtcatggttgacatggctagcaacctgatgcttgtcgacgagcatctcctgtggctagcccaaagagaagataaggcttgtagtcggattgtgggggctctggagcgtattggaggcgctgctctgtcgccacacgcacaacatatttcagtgaacgcgcgaaatgtggctctggaggcctatctcattaagcctcatagctatgtgggactgacatgtaccgcattccaaaggcgggagggcggtgtgccagggacgcggccagggagccccggtcagaaccctcctcctgaaccagagccccctgcagatcagcagctccggtttcgttgcactactggaagacctaatgtgtcactgagctccttccatatcaagaattccgttgccctggcatccatccaactgcctccgtcactgttttcatctcttcctgccgcactggcccctcctgtgccaccagactgtacgctacagcttcttgtgtttcgcaatggcagactgtttcactctcatagcaacacttctagacctggggcagctgggcctggcaagagacgtggcgtggccacgccggtaatcttcgccggtacctctgggtgtggcgttggtaacctgaccgaaccagtagcagtgtcactgcggcactgggcagagggcgctgaaccggtggccgcttggtggagccaggaaggacccggagaggccggtgggtggacttcggaaggctgtcagttacgctcatcacagccaaatgttagtgcgctgcattgccagcaccttggaaacgtggcagtactgatggagttgtccgcgttcccacgcgaagtgggtggagccggagcgggactccaccccgtcgtgtacccctgcaccgcgcttcttcttctctgtctgtttgccacgattataacatacattcttaatcactctagtattagggtgagtagaaagggatggcacatgttgttaaatctctgttttcatatcgcaatgaccagtgcggtatttgcaggtgggatcaccctgactaactatcaaatggtttgtcaggcggtgggcattaccttacattattcctcactgtctactctgttgtggatgggggtgaaggctcgggtgctgcataaggagttaacatggagggcaccacctccacaagagggcgatcctgctctgcccacacccagccccatgctgagattctaccttatcgccggtgggatcccgctgatcatttgcggcatcacagccgctgtgaacatacataactatcgcgaccatagcccctattgctggctggtgtggcgaccatctctgggcgctttttatatccccgtggccctgattctgcttattacctggatctactttctgtgcgcagggttgagattgcgtggcccactggctcagaaccctaaagcaggtaatagccgcgcttccttggaagcgggagaggaactgcgtgggtctacaagattacgcggaagtggccctctgctttccgattcaggaagtttgctcgctaccggatccgccagggtaggaacccctggaccaccagaggacggcgatagcctgtatagccccggagtgcagaggggagcaggcgatcacgcccttccagtgcttggccacgtaggcctgagaggaagcggcagcgtccctgccctggctgcgccaggtggagtgcagctcctggttcggggaggcagcttgcgcccagggccactgcggttgcactcacctttgtgccaggcagaggggagagaatcactggtggcacggctcctcccaccttgtttgtcgagagggcctccatgccccgcaccaggtcccgctcggcgtagaagaggcagattcccgggagtgcggggaggccctccactgccccaggtactcccgaagcgccagcagagaccctccgccggttccgggcctctgcaagcccatcagcccgctgcaggacctgagtccggcgtgcgaggagggggaggcggtcgacgaggcagacgcgctggtgctgggggacatccgggaaaacctcggcctccaccccctcagcagagagcccctagagcctccggcgctcaagaacctggccagggtacccctcgcggaggcggactgcgacaggaacctgcgcaaggacctgctaggggaagggggggaggggcaggcgctgccgttcagcgggagcgacagtctgcacagcagccccacagacagcttccgggacagcagccccagcagccaggtagacgtcccgctgcaggcaggcgggcacacgcccacgcagtacggggtcagcgacaccaacgccgagccgctttctag

SEQ ID NO: 223968 - DNA, 3966 bp, Artificial Sequence
  Description of Artificial Sequence: Synthetic coding sequence
atggagcctcccggacgacggagaggcagggcacagcctcctctgctgctgccacttagcttgctggcgctgctggcccttctaggcggaggcggaggcggaggtgcagctgctctcccggctggttgtaagcacgatggcaggccacgtggcgctggcagggcagctggcgctgcagagggtaaggtggtgtgcagctccctggagctggctcaggttcttccaccagacacactccctaaccggaccgtcacactgatactatctaacaataaaatttcggagctgaagaacggcagttttagcggcctctccttgctcgagcgcctggatcttcgcaacaacctcatatcctcaatcgaccctggcgctttctggggactctccagcctgaagagactggatttaaccaacaaccggattggctgtcttaatgcggacatttttcggggtctaaccaatctcgtgcggttgaatctctctggcaatctgttcagttcactgtctcaggggactttcgattacctggcttcactgcggtcgctcgaatttcagacagaatacctgctgtgcgattgcaacatcctgtggatgcatcgctgggtaaaggagaaaaacatcaccgttcgcgatacaaggtgcgtctacccaaaaagcttgcaggctcagccggttacaggggtgaaacaggagcttctgacctgtgatccacccctggaactgcccagcttttatatgactcccagtcacaggcaagtggtcttcgaaggggacagcctaccattccaatgcatggcctcctatatcgatcaggatatgcaggtgctgtggtatcaggacggacgtatcgtcgaaacagatgaatctcaaggcatttttgtcgaaaagaatatgattcacaattgttccctgattgcaagcgctctcacaatcagcaatatccaggccggttccaccggtaactggggatgtcacgtacaaacgaagaggggcaacaatactcgcacggtagacatcgtggttttggaaagttcagcgcaatattgtccacctgagagggtggtcaacaacaagggcgattttcgctggccaagaaccctagcaggaataacagcctacctgcaatgtactcgaaatacccacggctccggaatctacccaggcaatcctcaggacgagaggaaagcgtggagaaggtgtgacagaggtggtttctgggccgatgatgactacagtcggtgccaatatgcaaatgacgttaccagggtattgtacatgttcaatcagatgccgttgaatctgaccaacgcggtcgcaactgctcggcagctactggcatacacagttgaggctgcaaacttctcagacaaaatggacgtaatatttgtggcagagatgatagagaaattcggcaggttcacaaaagaagaaaagtccaaagaactgggagacgtcatggtcgatattgcctctaacatcatgttggcagatgagcgggtgctgtggctcgcgcagagagaagccaaggcctgttcaagaattgtgcaatgcctgcagaggattgctacataccggctggcaggaggcgctcatgtctacagcacctacagcccaaacatcgccttggaagcttacgtgataaagtccacaggtttcactggcatgacctgcaccgtgtttcaaaaggtggccgcatctgatagaaccgggctttcagattacgggcgtagggaccctgaggggaacttagacaaacagctgtctttcaagtgtaacgtgagcaacaccttttcaagtctggcccttaaaaacactattgtggaagcaagcattcagctccctccatctctattctcgcctaagcagaaaagggagcttcgaccgactgatgattccctgtataaactgcagttgatagcctttcggaatgggaaattgttccctgctacaggaaactctacaaatcttgccgacgacggaaaacggaggacagtggtgactcctgtcattctaacaaagatcgacggtgttaatgttgatacccaccatattcccgtgaatgtaacgcttcgccgtatcgcgcacggcgctgacgccgtcgccgcaagatgggattttgaccttctcaacgggcagggtggttggaaaagcgatgggtgccatattctgtacagcgatgagaacatcaccaccattcagtgttacagcctcagtaattacgccgtccttatggacctgaccgggagcgagctgtatacccaggcagcctctctgctccaccctgtcgtatataccaccgctatcatcctattactgtgtttgctcgcggtgatcgtgtcatacatctatcatcactccctgatccgcatttcactgaagtcatggcacatgctcgttaatctgtgctttcacatcttcctcacatgtgttgtgttcgttgggggtattacgcaaacacgcaacgcatcaatctgccaggcggtgggaatcatactgcactacagcaccctggcaaccgtactttgggtgggagtgaccgctcgaaacatctacaagcaggttaccaagaaagcaaaacggtgccaggatcccgacgagccccctcccccaccacggcctatgctgcggttttacctgatcggcggaggcatccctattatcgtctgcggcattaccgctgcagcaaacatcaaaaattacgggtctagaccgaatgcgccttattgttggatggcatgggagccatctttgggggcattttacggtccagcttcgttcatcacatttgtgaattgcatgtactttcttagcatctttattcagcttaagagacatccggagcgtaagtatgagctgaaggagccaaccgaggaacagcagagactggcagctaatgagaatggcgagatcaaccatcaagattctatgtcgttatctttaatctcaacgtccgccctggagaatgagcacacttttcactctcagcttctgggagcctctctgaccctattgctgtacgtggccctgtggatgttcggggcactggccgtttccttgtattaccctctggacctggtgttctcttttgtgttcggggctacgtcccttagcttctccgctttcttcgtggtccaccattgcgtgaatagggaggatgttcggctggcgtggataatgacctgttgtccgggaagaagttcgtattctgtgcaggtgaatgtgcagccgccaaactccaacggtactaatggcgaggctccaaaatgcccaaattcaagcgccgagtctagctgtaccaacaagtcagcctcctctttcaaaaattcaagccagggctgcaaactgaccaatttgcaggccgctgccgctcagtgccatgccaattcactgccgcttaacagcactcctcagctggacaattcactgaccgaacacagcatggataacgatattaaaatgcatgttgcccctctcgaggtgcagttccgtactaatgtgcactcatcacgccatcataagaataggtcaaaaggacatcgcgcttctagactgacagtgctgcgtgaatacgcctacgacgttcctacatctgtggagggaagcgtgcaaaacggtctgcccaagagtcgcctgggtaataacgagggacatagtcgctcaagacgggcttatttagcgtacagagaacgccagtacaacccgccacaacaggattccagcgacgcttgttcaaccctgcctaagtcttctagaaactttgagaagccggtgtccacaaccagcaagaaggacgccttgcggaagcccgctgtcgttgaattggaaaaccaacagaaatcttatggccttaaccttgccattcagaatggccctatcaagtcaaatggacaggagggccctttattaggaaccgactctaccggtaacgttaggaccgggctctggaagcatgaaaccactgtttag

SEQ ID NO: 223969 - DNA, 1851 bp, Artificial Sequence
  Description of Artificial Sequence: Synthetic coding sequence
atggagccaccagggcgaaggagagggagggcgcaaccccctttgctcctccctctgagtctcttggctctgttagccttactgggcggagggggaggtggtggtgccgctgcactgcctgcgggttgtaagcacgatggcagacctaggggagccggacgtgctgctggggcagcagagggtaaagtagtatgttcctccctggagctcgcacaagtgctgccacccgatacactccctaacagaacggtgacgctgatcctcagtaataataagatttcagagctgaaaaacggaagcttcagcggactctccctgctggaacgcctggatctaagaaataatcttatctccagcatcgatcccggagctttttggggcctgtctagcttgaaaagattggacctgactaacaatagaattggctgcctgaatgctgacattttcaggggactgaccaatctcgtgaggctgaatctcagcggaaacctgtttagcagtttgtcccagggaaccttcgactacctggcctcattacgcagtcttgaattccagacggaatatctgctctgcgattgtaacattctctggatgcaccgatgggtgaaggaaaaaaatattactgtgagggatacccgctgtgtctatccaaagagtctccaggcgcaaccggtgaccggtgtaaaacaggagttactgacgtgtgaccctcctctcgagcttcccagcttctacatgacaccttcacatcgtcaggtggtgtttgagggcgattcactaccattccaatgcatggctagctacatcgatcaggacatgcaggttctatggtaccaagacgggaggatagtggagacggatgaatcacagggcatcttcgtcgagaagaatatgattcataactgcagcctgatcgcaagcgctctcacgatttccaatatccaggccggaagtaccggaaactggggttgtcacgtacagactaaaagggggaacaacacccggactgtggacattgtagtgctcgaatcaagcgcccagtattgccccccagaaagagtagttaacaacaagggcgacttccgctggccacggaccctggccggaattacagcctatctccagtgtactcggaacactcacggttcaggaatctatcccggaaatcctcaggacgagcgcaaagcttggagaagatgtgaccgcggagggttctgggccgacgacgattattctaggtgccaatatgcgaatgacgtgactagagtgctctatatgtttaatcagatgcctctgaatctcacgaacgcggtcgcaactgccaggcagttgttggcctacacggtcgaagccgcaaacttcagcgataaaatggacgtcatttttgtggcagagatgattgaaaaatttgggaggtttactaaagaggaaaagagcaaggaactgggagatgttatggtggacatagcctcaaatattatgctagccgacgagcgcgtactttggctggctcaacgtgaagccaaggcttgtagcaggattgttcaatgtttgcagagaattgctacctacaggctagcgggaggtgcacacgtgtattccacatattctcctaacattgccctggaggcgtacgtgatcaaaagtacaggatttactggaatgacctgcaccgtgtttcagaaagtggccgcatcagacaggacaggattatcagactacggccgacgggaccccgagggcaaccttgacaaacagttgagttttaaatgtaacgtgtcgaatacttttagctcactggccctcaaagtgtgttacatactgcagtccttcaagactatctatagctag

SEQ ID NO: 223970 - DNA, 1146 bp, Artificial Sequence
  Description of Artificial Sequence: Synthetic coding sequence
atgcccctgaagagaaacaatagtaaatacccgcctctggaactgccttccttttatatgactccctcccacagacaggtagtattcgaaggagactcactgcccttccagtgtatggccagttatattgaccaggacatgcaggtgttgtggtatcaggacggcagaatcgtggagactgacgagagtcagggcatttttgtggagaaaaacatgatacataactgcagcctgatcgctagtgctctcacaatttcaaacattcaagcaggctccacaggaaactggggctgtcacgtccagacaaagaggggtaataacactagaactgtcgatatagtggtcctggaatcttccgcccagtattgccccccagagcgggtagtgaacaacaagggtgattttcgatggccacgaacgttggccggtattacagcttatttgcagtgcactcgtaacactcatggcagcggaatataccccggaaacccccaggatgagagaaaggcctggcggcgatgcgacagggggggtttctgggccgacgacgattactctagatgccaatacgcgaacgatgtaaccagggttctatatatgtttaatcagatgcccctcaacctgaccaacgcagtcgcgactgccagacagctgctggcctacactgtcgaggctgctaacttctcggacaagatggacgttattttcgtcgcagagatgatagaaaagttcggcaggtttacaaaagaggaaaagagcaaagaacttggcgacgtgatggtagacattgcttccaacatcatgctggccgatgagagagtgttgtggcttgcgcaaagagaagccaaagcttgtagccgtattgtgcaatgcctgcaacggatagccacctaccgcttggccggtggggcacacgtgtattctacctacagtcccaatatagcccttgaagcatacgtgatcaaatccacagggtttaccgggatgacctgcactgtgttccaaaaggtggcagccagcgatagaacgggcctgtcagattacggtagacgcgatcccgagggaaaccttgataaacagctgagttttaaatgtaacgtgtccaatacattcagcagcctggcgcttaagggaaaatttcgatag

SEQ ID NO: 223971 - DNA, 2724 bp, Artificial Sequence
  Description of Artificial Sequence: Synthetic coding sequence
atgccaaccgcggcagccccaataatctcaagcgtgcagaaactggtactttacgagactcgcgctcgatactttttggtaggaagcaacaatgctgaaacaaagtacagagtgctgaagatcgacaggacagagcccaaagatctggtgataattgatgaccgccacgtgtacacccagcaggaagtgagggagctcctgggccgactggacctgggaaatagaacaaaaatgggacagaaaggcagttccggtctttttagagccgtctcagccttcggggtggttgggttcgtgagattcctggagggatactatatagtgttgatcaccaaaagacgcaagatggcggacatcggcggacacgccatctacaaagtggaggacacgaatatgatctacattccgaatgacagcgtcagggttacccatccagacgaagccaggtatctgcggatatttcagaatgtggatctctcatcaaacttttacttctcttattcatacgatctctcacacagcctgcagtataacctgacagtgcttaggatgcccttggaaatgctgaagtcagaaatgacacaaaaccgacaagagagctttgacattttcgaagacgagggactgatcacacaaggcggtagtggcgttttcggcatttgttcagaaccatacatgaaatacgtgtggaatggggagctgctggatatcataaagagtaccgtgcatcgagactggcttctttacattatacacgggttctgcgggcagtccaaacttctgatatacggcaggcccgtgtacgtcaccttaatcgccaggcggtcctccaaatttgctgggactcgctttctgaaaagaggagccaattgtgagggggacgtggctaacgaagtggaaacagaacagatcctgtgcgatgcctctgtgatgagctttacagcaggaagctatagttcttacgtccaagttcgtggttccgtccccctgtattggagtcaggacatctcgaccatgatgcccaaaccaccaattaccctcgaccaggctgacccctttgcgcacgtggctgctttacatttcgaccagatgtttcagaggttcgggtctcccattattatcctgaatctggtgaaggagcgggagaagaggaagcacgagagaatactttcggaagagctagtggccgcagtgacctatttaaatcaattcctccctcctgaacacaccatcgtgtatattccctgggacatggctaagtacacaaagagtaagctctgcaacgtcctcgatagacttaatgttatcgctgagtctgtggtgaaaaagacgggattctttgtgaacaggcccgacagttattgctccattttacgtccggatgagaaatggaatgaattggggggatgcgttattccaaccggtcgcctgcaaactggcatactccgcaccaattgcgtcgactgtttggacaggactaacactgctcagtttatggttggaaagtgtgcacttgcctatcagctgtattcactgggtcttatcgataaacctaatttgcaattcgacaccgacgccgttcgactgtttgaggaactctacgaggatcacggtgacaccctgtcgctgcagtatgggggaagtcagctggtccaccgggtgaagacctaccggaagatagcaccctggacgcagcactctaaagacattatgcaaactctgagcaggtattattccaacgcgttcagtgatgcggataggcaagatagcatcaacctctttctgggcgtgtttcaccctactgaaggcaaaccccacctgtgggagctgcctaccgatttctacctgcaccacaagaacactatgcggcttcttcccacacgacgctcctacacttactggtggactcccgaagtcattaaacacctgcctctgccatacgacgaagtgatttgcgccgtaaacctgaaaaagctcatagtcaagaaatttcataagtatgaagaggagatcgacatccataacgagttcttcaggccttacgaacttagtagctttgacgataccttttgcttggcaatgaccagcagtgcccgtgacttcatgccaaaaacagttggcatcgaccctagtccgttcaccgtgcgcaaaccagacgagacaggcaaatcggtgttgggaaacaagagtaaccgcgaggaggctgtactccagcgaaaaaccgcggcatccgcgccaccccctccttcagaagaagcggtgagctcatcaagcgaggatgattccggcacagatcgtgaggaggagggtagcgtgtcccaacggtcgacaccagttaagatgacagacgctggggattctgcaaaggtaaccgaaaacgttgttcagcctatgaaggagctgtatggaataaatctgagcgatggtctatccgaggaagatttcagcatttactctcggtttgtccagttgggacagtcccagcataaacaagataagaacagccagcagccttgttccaggtgctcagacggtgtgatcaagctgacacccatctctgcattttcccaagacaacatatatgaggtccagccgcctcgggtggatcgaaagtccactgaaattttccaggcccacatccaggcatcccaaggcatcatgcagccactgggcaaggaggatagctctatgtaccgagagtatatccgtaacagatatctttag

SEQ ID NO: 223972 - DNA, 3582 bp, Artificial Sequence
  Description of Artificial Sequence: Synthetic coding sequence
atgatgttcagatctgataggatgtggtcctgtcactggaagtggaaaccatctcctctgctttttctgtttgccctctacataatgtgcgtacctcacagtgtttggggatgcgccaattgtcgggtagtgctctcaaacccttccggcacattcacaagcccctgctacccaaatgattatcctaactcccaggcctgcatgtggacactgagggcgcctacaggctacatcattcagatcacgttcaacgattttgacatcgaagaggctcccaactgcatctatgacagtctctcgttagacaacggggaaagtcaaactaagttttgtggggctaccgcgaaaggactgagctttaatagctctgctaacgagatgcacgtcagtttcagtagcgatttctctatccagaagaaaggatttaacgccagctatattcgcgtagcggtaagtctgaggaaccagaaagtcattctcccccagacgagcgacgcttaccaggtaagtgtggctaaaagcattagtatcccagagctttcagcctttacgctatgctttgaggcgaccaaggtgggccatgaggactctgattggactgctttcagctactctaatgcaagtttcacccagttactgagcttcggaaaggccaagagcggttacttcctttccatctcggactcaaagtgcctattgaataacgccttacccgtcaaagaaaaagaggacatctttgcagagagctttgagcagttgtgcttagtctggaacaatagtctcggatccatcggcgtcaatttcaagaggaattatgaaacagtgccatgcgacagcaccatcagtaaagttatccctgggaacgggaagctgcttttgggctctaaccagaacgagatcgtaagcctgaagggggatatttacaactttcggctgtggaactttacaatgaatgccaaaattttgtctaatctgagctgtaatgtaaaaggaaacgtcgttgattggcagaatgacttttggaacataccaaacctggccttgaaagccgaatctaacctgtcgtgtggcagttatctaattcccctgcccgcagcagagttagcttcctgtgccgaccttggcacactgtgccaggatggtataatctacaggattagcgtagtcatccagaatatcttgcgccaccctgaggtgaaagtccagagtaaggtggctgagtggctgaactccacgttccagaattggaactacaccgtatacgtagttaacatctcattccatctgtccgccggtgaggacaagatcaaagtgaagaggtcactcgaggacgaacctagactagtgttatgggctttgctggtctataatgctacaaataacaccaatttggaagggaaaatcattcagcagaagctcctaaagaacaatgagtcactggacgagggcctcaggctccatacggtgaatgttaggcaactgggccactgcctggccatggaagagccaaagggttactactggcccagcattcagcccagcgagtatgtcttgccatgtcctgacaagcccggtttctccgcttcccggatttgtttttacaatgccacaaacccgctggttacttattggggtcctgttgatatcagcaattgcctgaaggaagccaacgaggttgccaaccagatcttgaatttgactgcggatggccagaatctcacttccgccaatattacaaatatagtggaacaagtgaagcgcattgtcaataaggaagagaacatcgacatcacacttggaagcaccctgatgaatatcttcagcaacattctaagcagttcagattccgatctcctggaaagctcgagcgaagcactgaagacaatcgatgagttagccttcaagattgatctcaactctacatcacacgtcaacatcaccactcgcaatctggccctgagtgtgagctccctgttgcctgggacaaacgcaatctcaaactttagtattggtctgccttccaataatgaatcctattttcagatggacttcgagagcggccaggttgatccccttgccagcgtgattcttccaccaaatttgcttgagaacctgtcaccagaggactctgtgcttgtgcgacgcgcacagttcacattctttaataaaacgggattatttcaggacgtgggcccacaaaggaaaactctggtttcctacgtgatggcgtgttctatcggaaatatcacgatccaaaacttgaaagatcccgtacaaataaagataaaacatactaggactcaggaagtgcaccacccgatttgcgcattttgggacttgaataaaaacaagtcctttggcggttggaatacctcaggttgtgtcgctcaccgagatagtgatgcatcagaaaccgtttgcctatgtaatcacttcacccatttcggtgttctgatggatctccccagaagtgcttcacagttagatgctcgcaacacgaaggtcttaacttttattagttacatcgggtgtggcatcagcgctatcttctccgctgcgacgctgcttacctacgtggcttttgaaaagctgcggagggattaccctagtaaaattctgatgaacctgtcaaccgcattgctgtttttgaatcttttgttcctattagatggctggatcacctcatttaacgtggacggcctctgtatcgcagttgccgtgctcctgcactttttccttctggctacttttacttggatgggtttagaagccatacatatgtatatagcgctcgtcaaagtcttcaatacatacatccggcgatacatcctgaaattctgtatcataggatggggtctacctgctttggtggtaagcgtcgtgctggcgtcgcggaacaataacgaggtgtacggaaaagagtcttatggcaaagagaagggtgatgagttctgttggatccaggatcccgttattttctacgtaacgtgcgccggatacttcggcgtaatgttcttcttgaatattgcgatgttcatcgttgttatggtgcagatttgtggcagaaatggaaaaaggagtaacagaactctgcgggaggaagtactccgaaacctccggtccgtggtgtcattgacgttcctgctcggcatgacctggggctttgccttctttgcctggggcccactcaacatccccttcatgtatctgttctcgatatttaattctctccaggggttattcatcttcattttccattgcgctatgaaagagaatgtgcagaagcagtggcggcagcacctgtgctgcggacgctttaggctcgctgacaactccgactggtccaagacagctactaacatcatcaaaaagagttccgacaatctaggaaaaagtttgagtagtagttcaataggcagcaactcaacatacctcacctctaagtcaaagtcgagctcgacaacctacttcaagcgcaactcccatacagacaacgtctcatacgagcattcctttaacaaatctggcagtttaaggcagtgtttccatggccaagtgctcgtaaaaaccggcccatgttag

SEQ ID NO: 223973 - DNA, 3669 bp, Artificial Sequence
  Description of Artificial Sequence: Synthetic coding sequence
atgatgttccgatccgacagaatgtggtcttgccactggaagtggaagccaagtccacttctgtttctgttcgctctatacatcatgtgcgtgccccattccgtgtggggctgcgccaactgccgcgttgttctttcaaaccctagcggcacgttcacctctccatgctacccaaatgactatccgaatagtcaagcctgcatgtggaccctgcgcgctcccacagggtatattattcagatcacttttaacgattttgacatagaggaagctcccaactgcatatacgactcactatcgttggacaacggagagtcacagactaagttctgtggagccaccgctaagggcctgtcattcaacagttcagccaacgaaatgcacgtgagtttctcctccgacttctccatacaaaagaagggcttcaacgccagctacatccgggttgctgtatccctgcgcaaccaaaaggttatccttcctcaaacctccgacgcctaccaagtatcagtagccaagagcatctcaatccctgaactctcggcatttaccctgtgcttcgaggctacaaaagtggggcatgaggacagtgactggacagcctttagttacagcaacgcatccttcactcagctgctgagtttcgggaaggcgaaatctgggtacttcctgtctatttctgactccaagtgcctcctgaataatgcgcttccggtgaaggagaaggaggacatctttgccgagagcttcgagcaactgtgtttggtgtggaacaactcacttggttcaattggcgtgaatttcaagcgaaactatgagacagtgccctgtgactcaacaatctcaaaggttatccctggcaatggcaagctgctgcttggaagtaatcagaacgagatagtctcgctcaagggagatatatataatttccgcctgtggaattttacaatgaacgctaagattctttcgaacctaagctgcaatgttaaaggaaatgtagtggattggcagaatgacttctggaatatccccaacttagccctgaaagctgagagcaacctgtcctgtggaagctacctgatcccacttccagctgccgaattggcgagttgtgcagatcttggaactctgtgtcaagacggaataatttaccgtattagcgtggtgatccagaacatactccgccaccccgaagtgaaggttcagtccaaggtagctgagtggctgaactctactttccaaaactggaattataccgtttatgtggtgaacatttctttccacctgagcgccggagaggataagatcaaggtgaagagatccctggaggacgagcctcgcctggtcctctgggccttgcttgtctacaatgcaacgaataacaccaacctggagggtaagattattcagcaaaaacttcttaagaacaacgaaagtcttgacgaaggtctgaggcttcatacagtaaacgttcgccagctggggcattgtcttgctatggaggaaccaaagggctactactggcccagcatccagccctctgagtacgtattaccatgtcccgataagcctggatttagcgctagtcggatttgcttctacaatgctaccaaccccttagttacctattggggtccagtcgacatatcaaattgtctcaaggaggcaaacgaagtggccaaccagattctgaaccttacggctgacggacagaaccttaccagtgccaacattactaacattgtcgagcaggtgaagaggatcgtgaacaaggaggagaacattgacatcaccctgggtagcactctgatgaatattttttctaacattctgtcctcctcagacagcgaccttctggagtctagctcagaggcccttaagacgatcgatgagcttgcttttaagattgatttgaacagcactagccacgtaaatattaccacacgcaacctggccctatccgtgtcctccctgctcccaggtacgaatgcaattagtaacttttctataggattgccttctaacaatgaatcatatttccagatggatttcgagtccggacaagtcgaccctctggcttctgttatcctgcctcctaacctcctcgagaatctctcccccgaagattctgttcttgtcagacgggctcagtttaccttctttaataaaactggcctgtttcaggacgtaggccctcagcggaaaaccctggtgagttacgttatggcttgctcgataggcaatatcaccatccaaaacctcaaagatccagtccagatcaagatcaaacacacacgcacccaggaggtccaccatccgatctgcgccttctgggacctaaacaaaaataagagcttcggtggttggaatactagcggttgcgtggcacatagggattcagacgcttcggaaaccgtgtgtttatgcaatcactttacccactttggcgtcttgatggacctgccgcgtagcgcctcacaactcgatgcacggaataccaaggtcctcacgttcatttcctatattggttgcggaatcagcgccatcttttcagcagcaaccctgcttacttatgtagcctttgagaagcttaggagagattatcccagtaagatcctcatgaatctttccaccgctctcctgttcctgaatttgcttttcctgctggatggttggatcacatccttcaacgtagatggcctttgtattgccgtcgccgttctcctgcacttctttcttcttgcaactttcacatggatggggctcgaggccatccatatgtatattgctctggtgaaagtgtttaatacctatattaggcgatatatcctcaagttctgtatcataggatggggactgccagccctggtggtctctgtcgttctggcaagcaggaataacaatgaggtgtacggaaaggaatcctacggaaaggaaaagggagacgaattctgctggatccaagaccctgtcatcttctatgtgacttgtgcaggatatttcggggtgatgttcttccttaacatcgcgatgtttatcgttgtcatggtgcagatctgtggacggaacgggaagaggtctaaccggaccctgcgggaagaagtgcttcggaacctaagaagcgttgtatctctcacattcctgctcggtatgacttggggcttcgcattcttcgcctgggggccattaaacattcccttcatgtacctctttagcatcttcaattcactgcagggactctttatattcatctttcattgtgccatgaaagagaacgttcaaaaacaatggcgtcagcatctatgctgtgggaggtttcgtctggccgataacagcgactggtcaaaaaccgctacgaatattatcaagaaatcctcagataatttggggaaatcactgtcgtcttcctccatcggtagcaacagcacataccttacttctaagtctaagtcttcctcaaccacgtattttaagaggaattcacacaccgattctgcctccatggacaagtctctctccaagctcgcccacgccgacggggaccaaacaagcattatacctgtacatcaggtgatcgataaagtgaagggatactgtaacgcacatagcgacaacttctacaaaaacatcattatgagcgacacgttcagccatagtacaaagttctag

SEQ ID NO: 223974 - DNA, 3753 bp, Artificial Sequence
  Description of Artificial Sequence: Synthetic coding sequence
atgatgtttcggtcagatcgtatgtggtcttgtcactggaagtggaaaccttcacctcttttgtttttgttcgcattgtacattatgtgcgtgcctcatagtgtttggggatgtgctaactgtagagtagtgctctctaatccgtcaggcactttcacttcaccctgctatccaaacgactacccaaacagtcaggcatgtatgtggaccttgagagcccctaccggatatattatccagattacctttaatgactttgatatcgaagaagcaccaaattgcatttatgattccctgagcttggacaatggcgaaagccagaccaagttctgcggggctaccgccaaggggctctccttcaactcatcagctaatgagatgcacgtcagtttctcttctgactttagcattcagaaaaaaggattcaatgcttcttatattcgcgtcgctgtgagcctgaggaaccagaaggtcattctccctcaaacctcggacgcttatcaggtgtccgtggccaaatcaatcagcataccagaattgtccgcatttacactgtgtttcgaagcgactaaggtcggtcacgaagatagtgactggactgccttcagttacagtaatgcatcttttacacagctacttagctttggcaaagccaagtcaggttacttcctaagcatttcggatagcaaatgcctcctgaacaatgctctgcctgtgaaggaaaaggaggacatcttcgccgaatcgtttgaacaactgtgcctcgtctggaataactcactcgggtccataggggttaacttcaaacgtaattacgagactgtaccctgtgattctaccatctccaaggtcataccaggcaatggcaagctactcctcggctcaaaccagaacgaaattgtgagtctgaagggagacatctacaactttagactatggaacttcacgatgaacgccaagatcctctctaacctctcctgcaatgtgaagggcaatgtggtcgactggcagaatgacttctggaacatcccaaacctggctctgaaagccgagtccaatttgagttgcggttcctacttgatcccattgccggcagccgagctggcatcatgtgccgacctgggaacgctttgccaggcaacagtgaatagtccatcaactacgccgcctaccgtgaccacaaacatgccagtgacaaatcgcatcgataaacagagaaatgacggcattatttatcggatttctgttgttatacagaatatcctccgccaccctgaggtgaaggtgcagtctaaggtcgctgagtggctcaactcgacttttcagaactggaattataccgtatacgtcgtaaatatctcattccatctgtccgccggagaggacaaaatcaaggtgaaacgatcgttggaggatgagcccaggctggtgctgtgggcgctgctagtatacaacgcaacaaacaatacaaacctcgaagggaaaatcattcaacagaagctccttaagaataatgagagcctcgacgagggcctgcggctacacacagtcaatgtacgccagctcggacattgccttgccatggaggaaccaaaggggtattactggcccagcattcaacccagcgagtatgtcttgccttgccccgacaagcctggatttagcgcctcacgtatctgcttctataatgcgacaaaccccttggttacctactggggccctgtcgacatttcaaactgcctcaaggaagcgaatgaggtggcgaaccagatcctgaacctgaccgcagacggccagaatctcacatcagcgaatattacaaatattgtggagcaggtgaagcggattgtcaacaaagaagaaaacattgacatcactttgggttccacacttatgaacattttcagcaatattttatcctcctctgacagtgacttgctggaatccagcagcgaggcactaaagacaatcgatgagctggcatttaaaatcgacctgaattcaaccagtcacgtcaacataacaactcgcaacctggcccttagcgtctcgagcttgctgccaggtacaaacgctatcagcaatttcagtatcggcctgccgtccaataatgaatcttacttccagatggactttgagtctgggcaggtagatccactagcttctgtgattctgccaccaaacctgctcgaaaatctctcccccgaggattccgtgctggttaggcgcgctcagttcacctttttcaacaaaaccggactcttccaggatgtgggcccacaaagaaaaacgcttgtttcgtatgtgatggcctgttctatcggtaacataaccatccagaacctcaaagatccggtgcagatcaaaatcaagcacaccaggacccaggaggtacaccatcccatctgcgccttttgggacctgaataagaataaatcattcgggggatggaatacttccggatgcgtcgcccaccgagattcagatgcctctgagaccgtatgcttgtgtaatcattttacccacttcggtgttctaatggatctgcccaggagcgcaagccagttggacgctcgaaatactaaagtcctcacttttatttcctacatcgggtgcgggatttccgccatattcagtgccgctactctcctgacatacgtggcttttgaaaagctgcgcagagactatccttctaaaattctgatgaacctgtctactgctctcctcttcttgaatctgcttttcttgctcgacggctggattacgtcatttaatgtggacgggctctgtattgcagtcgcagtactcttgcacttttttcttctcgccacattcacttggatggggcttgaagccatccatatgtacattgctctggtcaaggtgttcaacacgtatatcaggagatacatattgaagttctgtattattgggtggggcctccccgcacttgtcgtttcagtggtgctggcctcaaggaataataatgaggtatacggcaaggaaagctacggaaaagaaaagggtgacgagttctgttggattcaggatcctgttattttctacgtgacctgtgctggatacttcggcgttatgttcttcctaaacatcgccatgtttatcgtcgtcatggttcagatctgtggtagaaacgggaagagaagtaacagaaccctccgggaggaagtgctgcgcaacctgcgatccgttgtcagtctaacatttttattaggcatgacatgggggttcgccttcttcgcctggggccctctaaatattccttttatgtatctgttctccatttttaattctctgcagggcttgtttatctttatttttcactgtgcaatgaaagagaacgttcagaaacagtggagacagcatttgtgttgtggcaggttcaggctcgccgataatagtgactggtcaaagaccgccacgaacatcatcaagaaatcgtcagataacctgggcaagtcactgtccagcagtagtattggatctaattctacttatttgacctccaagagtaaaagttccagcactacctacttcaaacgcaattctcatacagattcagcaagcatggacaaaagcctgtctaaacttgcgcatgcagatggcgaccagacctcaattatccccgtgcatcaggtgatcgacaaagttaaaggatattgcaacgcacacagcgataacttctacaagaatattatcatgtctgataccttctcccactccactaaattttag

SEQ ID NO: 223975 - DNA, 2394 bp, Artificial Sequence
  Description of Artificial Sequence: Synthetic coding sequence
atggcgtcttgtcgcgcttggaacctcagagtgctggtggcagttgtttgtgggctgctgacgggaataattctggggctgggcatctggcggattgtcattaggatccagcgcggtaagagcacctctagtagttccacacccactgaattctgcagaaatggcggtacatgggagaacggacgctgtatatgcactgaggagtggaagggtctgagatgcacaatagcaaacttctgtgaaaatagtacctatatgggcttcacctttgctcggatccctgtcggcagatatggtcccagtctccaaacatgcggaaaggatactcctaacgcaggtaacccgatggctgtgcggttgtgctccctctcattgtacggcgaaatcgagctacagaaagttaccattggtaattgcaacgaaaaccttgagacattagaaaagcaggtgaaagacgtcacagcccctctgaacaacattagctccgaagtccagattctgacttccgatgccaataagctcaccgccgagaatattacctcagccaccagggtggttggacagatcttcaacacatccagaaatgcctcaccagaggcaaagaaggtcgctatagtgaccgtgtcacagctgctcgacgcaagcgaagacgccttccaacgggtggctgcaaccgcgaacgatgacgccctgacaacacttatagagcaaatggaaacatactctctgtccctcggcaatcagagtgtggtggagccaaacatagccatccagtctgccaacttcagctccgagaacgccgtgggaccttcaaatgtaaggttcagcgtccaaaagggcgcttccagtagcctggtgagcagctccacattcattcacaccaacgtggatggccttaacccagatgcccaaacagagctccaagttctgctgaacatgacaaagaattataccaagacttgtggcttcgtggtttaccaaaacgacaaacttttccagtctaaaactttcactgctaaatccgacttctcccaaaaaatcatctctagcaagactgacgaaaatgagcaggatcaatccgcatccgtggacatggtgttctctcccaagtataaccaaaaagaattccagctatattcttacgcctgcgtgtactggaatcttagcgcaaaggattgggacacttacggatgtcagaaggacaaggggaccgacggttttctgaggtgcaggtgtaatcacaccactaacttcgcggtcctaatgaccttcaagaaagattaccaatatcctaaatcactggatattctctccaatgtgggatgcgccttatccgttactgggctggccttgacagttatctttcagattgtgactagaaaagtgaggaaaacaagtgtgacctgggtgctggtgaacctgtgtatctcaatgctgatattcaatctattgtttgttttcgggatagagaattccaataaaaatcttcagacgtctgacggggatatcaataatatcgattttgacaataatgatataccacgtaccgacactatcaatatcccaaatcctatgtgcactgctatagcagcgctgctgcattattttctgctcgtgacctttacctggaacgctctctcagctgctcaactgtattatctgcttatcaggacaatgaaaccactcccgagacactttatccttttcatatctctgatcggctggggtgtgccagctatcgtcgtggccataacggtcggagtgatatactctcagaatgggaataatccacaatgggaactggattaccgtcaagaaaaaatctgctggctcgccattcctgagcctaacggcgtgatcaagagccccctactctggagtttcatagtcccagtaacaattattttgatttccaatgtggtcatgtttatcactataagtataaaggtcctgtggaagaataatcaaaacctgaccagcaccaaaaaggtgtcttcaatgaaaaaaattgtgtccacactttccgtggcggtggtattcggaatcacgtggatcctggcctacctcatgctggttaacgatgattcaattaggatcgtgttttcctacatcttttgcctgtttaataccactcagggactccaaattttcatcttgtataccgtacggacgaaggtcttccagagcgaagcatccaaggtgttgatgctcctttcgtcaatcgggaggcgcaaaagcctccctagtgttaccaggccaaggctgagagtgaagatgtacaacttccttaggagtttgccgaccctacatgagcggttccgtctattggagacaagtccgtcaacagaggaaattactctgagcgaaagcgacaatgcgaaggaatccatctag

SEQ ID NO: 223976 - DNA, 1509 bp, Artificial Sequence
  Description of Artificial Sequence: Synthetic coding sequence
atgccagtgaagatgctgtttaaagaactccttcttctcttgatgatgatgcctctgcaacactacacaaagacctgtgggtttgtggtgtaccagaatgataagctcttccaatcaaaaaccttcactgctaaatccgacttctctcagaaaatcatatcttcaaaaacggacgaaaatgaacaagaccagtctgcatcagtagatatggtgttctcaccgaagtacaatcagaaagaatttcagctctattcttacgcctgcgtctactggaacctgtcagccaaagactgggacacgtatggctgccagaaggataaaggaaccgacggctttctgagatgtcgctgtaaccatacaacaaatttcgcggtactcatgactttcaagaaggactaccagtatcccaagagcttagatatcctgtccaacgtgggctgcgccttaagcgtgaccggtcttgcactcactgtgatttttcaaatcgtgactagaaaggtccgcaagacgtctgttacctgggtgttagtgaacctgtgtatatccatgctgatcttcaacctccttttcgtcttcgggatcgagaacagtaacaaaaatttgcaaacctcggacggcgacattaataatattgacttcgataataatgacattccgaggaccgacactattaatattcctaatccaatgtgcacggcaatcgccgctctactacattattttctgctggtcacatttacttggaatgccctcagcgccgcacaattgtactatctactgatcaggactatgaaacccctgcctcggcactttatactattcattagcctcataggatggggggtccccgcaatagtcgtggccataacagtcggagtgatctacagccaaaatgggaacaatccccaatgggagctggactatcgccaggagaaaatatgttggctcgccattcccgagccaaacggggtgattaagtcccctctgctatggagttttatcgtccccgtaacaatcatcctgatttcaaatgtcgtaatgttcatcacaattagtattaaggttttgtggaagaataaccaaaatcttaccagcacgaagaaagtgtcctcaatgaaaaaaatcgtctccacattatctgtcgccgtggtttttggaattacatggattctggcatacctcatgttggtaaatgacgatagtattagaatcgtttttagttatattttttgtctgtttaacaccacccaaggtctacagattttcatactgtatactgtacggaccaaggtgtttcagtccgaggcttccaaagtgctcatgctgctcagctctatcggcagaagaaaaagtttgccttctgtgacaaggcctaggttgcgggtgaagatgtataactttctaagatccctaccaacattacacgagcgatttaggctgctcgagaccagcccgagcacagaggagattaccttgtcagagagcgacaatgcaaaggagagcatctag

SEQ ID NO: 223977 - DNA, 1143 bp, Artificial Sequence
  Description of Artificial Sequence: Synthetic coding sequence
atgtgtccaatgctgctgaaaaacggctataacgggaacgccacaccagtcaccaccaccgccccatgggcatctctgggcttgagcgctaagacctgtaacaatgtgagcttcgaagagagcagaatcgttttggtggttgtgtattctgcagtgtgtactctgggcgtgcccgctaactgccttaccgcatggctggccctactccaggttttgcagggaaatgtacttgccgtttacctgttgtgcctggccctatgcgagctgttgtacactggaaccctgcctctgtgggtgatttacattagaaaccagcatagatggactttaggactgctggcgtgtaaggtcacagcctacatttttttctgcaacatttacgtcagtatcctgttcctctgctgtatctcttgcgaccgcttcgtcgcagtggtgtatgctcttgaatctcggggtcgtagaagaaggagaactgccattctgatatcagcctgcatcttcattctggtaggcattgtgcactatccagtgttccagaccgaggacaaggaaacctgtttcgacatgctccagatggatagccgcatcgccggttattactatgcaaggttcaccgtgggatttgcaattcctctatcaatcatagcattcaccaaccacaggatctttcggtccataaagcagagcatgggtctgtcggccgcacaaaaggctaaggttaaacattctgctatcgccgtggttgtcatattcctcgtgtgttttgcaccataccacctggtgctgttagttaaggctgccgcattctcttactatagaggagacagaaatgcaatgtgtggtcttgaggaaaggctgtacaccgctagcgtggtattcctatgcctctccactgttaacggggtcgccgaccccattatctacgtactcgcaaccgatcacagcaggcaggaagtgagcaggatccacaaagggtggaaggagtggtccatgaagactgatgtgacgcggttaacacactcacgagacacagaggagcttcagtctcctgtggcactggcggatcactataccttttccagacctgttcaccctcctgggagcccctgccctgcgaaacgactcattgaggagagctgttag

SEQ ID NO: 223978 - DNA, 1116 bp, Artificial Sequence
  Description of Artificial Sequence: Synthetic coding sequence
atgcccggtaacgctacacccgtgacaaccactgccccatgggcttcattaggtctgtccgctaaaacgtgcaacaacgtatcgttcgaagagagtcggatcgtcctggtggtggtctattcggccgtctgcacgcttggagtgccggcaaattgtcttacagcctggctggcccttctccaggtgttacaggggaacgttctcgctgtatatctgctgtgcctcgccttatgcgaactcctatatacaggaaccttgccactgtgggttatttatattcggaaccaacaccggtggaccctgggccttttagcctgtaaagtgacagcatacatatttttttgtaacatttacgtgtcaatcttgttcctatgctgcatctcctgtgaccggttcgtggccgtggtttacgcccttgagagcagaggcagacgccgacgccgtacagccattttaatctctgcttgcatcttcatcctcgtaggtattgtgcactatccagtctttcagactgaggacaaagagacgtgttttgatatgttgcagatggacagcagaattgccggatattactacgcgcgtttcacagtggggtttgcaatccccctgagcatcatcgcctttacaaatcaccgcattttccgtagcattaaacagagcatggggctctcagctgcccagaaagctaaagtgaagcactcggcaatcgctgtcgtggtgatcttccttgtgtgtttcgcaccatatcacttggtccttttagtgaaagcagccgctttttcctactacagaggagaccgaaatgccatgtgtgggcttgaggaaagattatatacagcgagtgtcgtgttcctgtgcctgtccacggtgaatggggtcgcagatcctattatttacgtgttggccaccgaccatagtagacaagaagtgagtaggatccataaggggtggaaggagtggtcgatgaaaacagacgtcactcggctgacacacagccgggatacagaagaacttcagagcccagtggccttggccgatcactatacattttctcggcctgtacaccccccaggctccccttgtccagccaagagacttattgaggagagctgctag

SEQ ID NO: 223979 - DNA, 1143 bp, Artificial Sequence
  Description of Artificial Sequence: Synthetic coding sequence
atgtgtcctatgctgttgaagaacggatacaacggaaacgccaccccagtgacaacaacggctccgtgggcctctctggggctgagcgcgaagacctgtaacaatgttagctttgaagagagtcgcatcgtattagtggtggtttatagcgcggtatgcacgttgggagtgcctgctaactgcctgaccgcttggttagcactgctgcaggtgttgcagggaaacgtccttgccgtctatctcctgtgcctggcactttgcgaactgctgtacacaggaactctacctctgtgggtcatctatatccggaatcaacataggtggactctgggattgctggcttgtaaagttacagcttatatctttttctgcaatatttacgtcagtatactttttctctgttgtatcagctgcgacagattcgtagcagtggtctatgcccttgagagtcgaggaaggaggcggcgtaggactgccatactgattagcgcctgcatctttatactggtcggcatagtgcattatccagtcttccagacagaagacaaggaaacatgctttgatatgttacagatggattcacgtattgctgggtattattacgctcggttcacagtgggatttgccatccctctgtcaatcattgcatttaccaaccatagaatttttcgtagcatcaaacagtcaatgggcttgagcgccgcacagaaggccaaagtcaaacatagcgcaattgctgttgtagtgatctttcttgtgtgttttgctccctaccacctggtcttgctggttaaggccgcagcattttcatattatcggggtgataggaatgctatgtgcggtctggaggaacgcttatacacagcctcagtcgtttttctctgtcttagcactgtgaatggcgtcgcggatcctattatctacgtgctggcaaccgatcactctcgccaagaggtgtctcggatccataagggatggaaagagtggtcaatgaaaacagacgttactagactgacacactctcgagacactgaggagctgcaatctcctgtggccttggccgaccactatacattctcccgccctgtacaccccccaggttcaccatgtccagcaaagcggctgattgaggaatcctgctag

SEQ ID NO: 223980 - DNA, 33 bp, Artificial Sequence
  Description of Artificial Sequence: Synthetic coding sequence
atgtgtcccatgctgctcaagaacggctattag

SEQ ID NO: 223981 - DNA, 2625 bp, Artificial Sequence
  Description of Artificial Sequence: Synthetic coding sequence
atggagaagctgcttaggctgtgttgctggtattcctggctgctgcttttttactataatttccaagtgcggggagtgtatagccgctcacaggatcacccaggctttcaggttctcgcttccgcttctcactattggccactcgagaatgtggacggtattcacgagttacaggatacaacgggcgatattgtcgaggggaaggttaataagggtatttacctcaaagaagaaaagggggtgacactattgtattatggcaggtataactcttcgtgcatctccaaacccgagcaatgtggaccagagggcgtgacattttcttttttctggaaaacccagggggagcagagtagacccattcccagcgcttacggcggacaagtcattagtaatggattcaaggtatgcagttcaggcggacgaggtagcgtggagctgtatacccgcgacaactcaatgacttgggaagcgtccttttctccgccaggcccatactggacacacgtcctttttacatggaagagcaaggaggggctcaaggtgtatgtgaacggaaccctttctacatctgatccctcaggaaaggtgtcccgagattatggcgaatcgaatgtgaacttggtaatcggatccgagcaggatcaagcgaaatgttacgaaaacggagcgtttgatgagtttattatctgggaaagggctctcacaccagacgagatagcaatgtactttacagccgcaatcggaaaacacgccctcttgtcctcgacccttccatctctgttcatgacctctactgcttctccggtcatgcccactgatgcatatcacccaatcattacaaatttaaccgaagaacgaaaaactttccaatctcccggagtgatactcagttatctgcagaatgtgtcactgtcgttgccgtcaaagtcactgagcgaacagacggctttgaatcttaccaagacattcctaaaggctgtcggagaaatcctgctgctgccagggtggatagcacttagcgaggactctgccgtagtgttgtctctgatcgatactattgataccgttatggggcacgtgtcctctaatctccatggctccactcctcaggtgacagtggagggaagtagcgccatggcagaatttagcgtcgcgaagatattacctaagactgtgaattcaagccactatcggttccccgcacatgggcagtcctttatccagatcccccacgaagccttccaccgtcacgcctggtccactgttgtcggcctgttgtaccacagcatgcactattacctgaacaacatttggcctgctcacacgaagatcgctgaggctatgcaccaccaggactgcttgctgtttgcaacttctcacctgattagcctggaggtaagtcctccgcctacgctgtcccagaacttgagtggcagtccgctgatcactgtccacctcaagcacagactcacaaggaaacagcactccgaagccactaactcatcaaatagagtgtttgtctactgtgctttcctggactttagtagtggtgagggagtgtggtccaaccatgggtgcgcattgaccagaggtaacctcacgtattcagtctgccgttgtactcacttgacaaatttcgcaatcctgatgcaagttgtgcctttggaattagctcgcggacaccaagtcgcattaagttctattagctacgtcggctgtagcttaagcgtgctatgtctggtggctacactggtgactttcgctgtcctctcctctgtgtctacaattagaaaccagagataccatattcatgccaatttgtcctttgcggtactggtggctcaggttttgctgctcatcagctttaggctagagcctggaaccaccccctgtcaagtgatggctgtcctgctgcactactttttcctgtctgcttttgcctggatgctcgtcgagggcttgcacttatactcaatggtgatcaaagttttcggaagcgaagattctaagcatcgctactactatggtatgggttggggatttcctctgctaatctgtattatttctctgagcttcgcaatggatagttatggaacatccaacaattgttggctgtccctcgccagtggcgctatctgggctttcgttgcacccgctctgtttgtgattgtggtcaacatagggatactcatcgcggttacgcgcgtgatctctcagatctctgccgataattataaaatccacggagatcctagcgccttcaaactcacagccaaagctgtagcggtgttgcttccaattctggggacatcctgggtgttcggcgtcctggccgtcaacgggtgcgcagttgtttttcaatacatgtttgctacgctgaatagcctccaggggctctttatctttttgtttcattgcctactgaactcagaggtaagagctgcctttaaacacaagactaaagtctggtccttgacttcatcaagcgctagaacaagcaatgcaaaaccctttcacagcgacctgatgaacggcactcgccctggcatggcaagcaccaaactgtcaccatgggataaatcttcgcactcagcccatcgtgttgacttatcggccgtgtag

SEQ ID NO: 223982 - DNA, 687 bp, Artificial Sequence
  Description of Artificial Sequence: Synthetic coding sequence
taacacggagttagcgcacgcgatgtgctcgagtcaaggacccggaagcagcactccgaggcaacaaactctagtaatagggttttcgtttactgcgcgtttctcgacttttccagcggcgagggagtgtggtctaaccacgggtgtgcactcacgcggggaaatctcacatactcagtttgtaggtgcacccacttaacaaacttcgctatcctcatgcaggtggtacccctcgaggtgaacatcggaatcctcatcgctgtgactcgagtcatatcgcagatcagcgcagacaattataagatccatggcgacccaagtgcgttcaaactgaccgccaaagccgttgcagtcttgctgccaatcctgggtacttcctgggtattcggcgtacttgccgtcaacggttgcgccgtggtctttcaatatatgttcgccaccctgaactcactgcaaggtctctttatattcttatttcactgcttgctcaattctgaagtccgcgcagccttcaaacacaagaccaaagtatggagtctgacctccagctccgcgagaacgtccaatgccaaaccttttcattctgacctcatgaacgggactcgcccaggtatggctagcactaagctctcgccttgggacaagagtagtcactcagcccaccgcgttgacctttctgccgtgtag

SEQ ID NO: 223983 - DNA, 2721 bp, Artificial Sequence
  Description of Artificial Sequence: Synthetic coding sequence
atggagaaactgctgcgtctgtgctgctggtactcatggttgttgctcttttattataacttccaagtgaggggggtgtactcaaggtcccaggaccatccagggtttcaggttctcgcttctgccagtcactattggccactcgaaaacgtcgacggaatccacgagctccaggacacaaccggcgctagtaggacccataaactgacagtccttccttcccgaaacgccacttttgtgtactctaacgattcagcatactccaacctgtccgcaactgtcgatatcgtggaagggaaggtcaataaaggcatctatttgaaagaggagaagggtgtgaccctgctgtactacggaagatataatagctcttgtatttctaagcccgagcagtgcggacctgagggcgtaactttctctttcttctggaaaactcaaggcgaacagagcaggccaatcccttctgcctacggtggacaggtgatatctaatggcttcaaagtgtgtagctctggcggaagaggttctgtggagttatacacaagggataatagcatgacatgggaagcctccttcagccctccaggcccttactggactcacgtgctcttcacctggaagagtaaggaaggcctgaaagtttatgtgaatgggactttgtctacttccgacccatcaggcaaggtaagcagagactacggagaaagcaatgtcaacctggtgatcgggagtgaacaagaccaggcgaagtgctatgagaatggcgcattcgacgagttcatcatctgggagagagctctgacacccgatgagattgcaatgtactttaccgctgctataggcaaacacgccctgctgtcctctaccttgcccagcctattcatgacatctacagcaagtcctgttatgcccactgatgcttatcacccgataattacaaacctgaccgaggaacgaaaaacttttcagagccccggtgtgatactgtcgtacctccagaatgtgtcactaagtctgccgtccaaatccctcagcgaacaaaccgcactaaatctgactaaaacatttctgaaggccgttggcgaaattctgcttttacctggttggattgctttgagcgaagacagcgcagtcgttttgtctttgatagataccattgatactgttatgggtcacgtgagttctaacctgcacggtagtaccccacaggttaccgtggagggttcctcggcaatggcggagtttagtgtggcaaaaatactgccaaaaaccgtgaacagctcgcactaccgttttcctgctcacgggcagtcttttattcagattcctcatgaggcattccatagacacgcctggagtacggtggttggtttgctgtatcatagtatgcattactatctcaataacatctggcctgcacacaccaaaatagccgaggcaatgcatcaccaagattgccttttgtttgctacgtcccacctgatcagcctggaagtcagtccaccgcctaccctctctcagaacctgagtggtagccccctgatcaccgtccacctgaagcaccgtctcactaggaaacaacattctgaagcaaccaattcgagcaacagggttttcgtgtattgtgcattcttggactttagtagtggcgaaggggtgtggagcaatcatggttgtgccctaacgagaggcaatctcacctacagtgtctgtaggtgcacccacctcaccaacttcgccatcctgatgcaagtggtccctctggaattggcacggggtcaccaggtggcactatctagcatttcctacgtcggctgttccctgtcggtcctctgccttgtcgcaacacttgtcactttcgcagtgctgagctccgtgtcaaccatccggaaccagcgttaccacatccacgccaatctgagcttcgccgtcctggtggcacaggtgttgctgttgataagtttccgccttgagccgggtacaaccccttgccaggtgatggctgtgctactacattacttctttttaagcgcgttcgcctggatgctcgtggagggcctgcatctgtattcgatggtgattaaagtgtttgggagcgaggacagcaagcaccggtattattacgggatggggtggggctttccactgctgatttgtataatcagtctctcatttgccatggattcctatggtacttccaacaattgttggctctcgcttgcctccggtgccatttgggccttcgtggcccctgccctgttcgtgatcgtggtgaatatcggcatcttgatagctgtgaccagagtcataagtcagataagtgccgataactataagatacatggtgacccttccgcctttaaactgactgccaaggccgtcgcagtactgctgccaatactcggtactagctgggtattcggggtactggcagtaaacggatgtgcagtggtcttccagtatatgttcgctacattaaactcattacagggcctctttatcttcctttttcactgtctcctgaacagcgaggtccgcgcagcgtttaagcataagacgaaagtctggagcctgacctcgtcctccgcacgaacttccaatgccaaacctttccactccgacctcatgaatgggacccggccagggatggcttccactaaactgagtccatgggacaagtccagccactccgcccaccgggtggatctgtccgccgtgtag

SEQ ID NO: 223984 - DNA, 1275 bp, Artificial Sequence
  Description of Artificial Sequence: Synthetic coding sequence
atgacccaggcagggcgaaggggtcctggaactccggagcccaggcctcggacccaaccaatggcaagcccaaggctgggaaccttttgttgccctactcgcgatgccgcaacacagttggtcctctcgttccagccccgagcttttcatgcgctgtgcctgggatccggcggattacgcctggctctggggcttttacagcttcttcctggccgaaggcccgctggtccaggatctcccgcaactagtcccccagcatctgtgagaattttgagggctgctgcagcctgcgacctgcttggctgcctcggcatggtaataagatcgaccgtttggctcggctttcccaactttgtggattccgttagtgatatgaaccacactgagatctggccggctgccttttgtgtgggctcagctatgtggatccagcttctgtactcagcttgtttttggtggctgttctgctatgctgtggacgcatatctggtgataagaaggagtgctggtctctctactatactactgtaccacatcatggcctggggccttgccacactactatgtgtggaaggagcggctatgttgtactatccaagtgttagtcgatgtgaacgaggtcttgaccatgccatccctcactatgtgactatgtatcttcccctgctcctggttcttgtcgcaaaccccattttgttccagaagacagtgacagccgtggcctccctcctgaaaggccgtcaggggatctacacagaaaatgaacgaagaatgggcgcagtaatcaagatacgattctttaaaatcatgctcgtgctaatcatttgctggctctctaacatcattaatgaatcactgctgttctacttagagatgcagacagacatcaatggcggtagcctgaagcctgtgagaaccgctgctaagactacctggttcatcatggggattctaaatccagctcaagggtttctgctgtctctggcattttatgggtggaccggatgtagtctaggatttcagtccccgaggaaggaaattcagtgggagagcctgacgacaagcgctgccgagggcgctcaccccagccccttgatgcctcacgagaatccagcatccggtaaagtgtcacaggtcggcggtcagacaagtgatgaggcactgtcaatgttgagtgaaggttccgatgccagtacaattgagatacatacagctagcgagagctgtaacaagaacgagggggaccccgctctgccaacgcatggcgatctgtag

SEQ ID NO: 223985 - DNA, 516 bp, Artificial Sequence
  Description of Artificial Sequence: Synthetic coding sequence
atggtgatccggagcactgtgtggttagggtttcccaacttcgtggactcagttagtgatatgaaccatacggaaatatggcctgccgcattctgcgtaggctctgctatgtggatccaactcctttatagtgcttgtttctggtggcttttctgttatgctgtcgacgcctacctggtcataaggcggagcgcaggcctatccaccattctgctttatcatataatggcatggggtctggccactctattatgcgtggagggtgcagccatgctctactatccctccgtgtctcggtgcgaaagggggctcgaccacgctatcccccactacgtaacgatgtatctgcccctcttattggtcctggttgcgaatccgatcctgtttcagaagacagtgaccgccgtggcaagccttcttaaagggaggcaggggatctatactgaaaacgagcgacgaatgggcgcagtgattaaaatccggttcttcaagattatgctcgtgctaattatttag

SEQ ID NO: 223986 - DNA, 864 bp, Artificial Sequence
  Description of Artificial Sequence: Synthetic coding sequence
taaacagccggaccagttaccggctccgcatctaggggcccagctcgaggcccaaaagggatggtgatccgatccacggtgtggttgggcttccccaattttgtcgactccgtgtccgacatgaaccataccgagatatggccagctgccttctgtgtcgggagcgcaatgtggatccagttgctgtatagtgcttgcttttggtggctgttctgctatgccgttgatgcatatttagtaattcgccgttctgcagggctctctacaatcctgctttatcacattatggcctggggcttagccacactcttatgtgtggagggggctgccatgctgtattacccttctgtgtcacgatgcgagcgtgggctcgaccatgctatcccccactatgtgaccatgtatcttcctcttctgctggtgttagtggctaaccctattctttttcaaaaaacagtgactgctgtagcctccttactcaaaggcaggcagggcatctatactgaaaacgagaggcgcatgggggcagttatcaagatcagattctttaaaattatgctcgtcctgataatctgctggctcagcaatataattaatgagtcgttgctgttttacctggaaatgcagaccgatattaacgggggaagcctgaagcctgtccgaaccgccgcaaaaacaacttggtttatcatggggatcctgaatcccgcacaggggttcctgctgagcttagccttctacgggtggaccggatgctccttaggcttccagtcgcctagaaaggagatccagtgggagtcgctgactacgtctgcagccgaaggtgcccatccgtctccacttatgccccacgaaaacccatag

SEQ ID NO: 223987 - DNA, 1215 bp, Artificial Sequence
  Description of Artificial Sequence: Synthetic coding sequence
atggcatctccacggctcggaacattctgctgccctacacgcgacgcagctacacagctcgtcctctcttttcagccacgcgcttttcacgccctctgcctgggatctggcggacttagattggcccttggattgttacagctactgcctgggaggcgaccggcaggcccaggaagcccggcaacatcgcctcctgcctcggtccgaatcttgagagctgctgctgcgtgtgatctgctggggtgtctcggtatggtgatccggtctaccgtgtggctgggctttcccaatttcgtggactcggtttcagatatgaaccatacggaaatctggcctgccgctttctgcgtaggcagcgctatgtggatccagctgctttattcagcttgcttctggtggctcttttgttacgccgtggacgcctatctggtcatacgccgatccgccggattatccaccattctcctctatcacatcatggcgtgggggttggcaaccctcctctgtgtggaaggcgcagccatgctgtattacccatccgttagccggtgtgaacgtggactggaccatgccatcccgcattatgtgacaatgtaccttcccctgctgcttgtactggtcgccaatccgatactcttccagaagaccgtaacggccgtcgccagtctgctgaagggaaggcagggaatttatactgagaacgaacgcaggatgggcgcagtcatcaagattcggttttttaaaattatgttggttctaattatttgttggctcagcaatataatcaatgagtctttgctgttctacttagagatgcagacagatattaacggcggttcactgaagcccgtacgcacagccgctaagactacatggtttatcatggggatcctgaatcctgcccaggggtttctgctctcccttgccttttacggttggacaggttgctctctggggttccagtccccccgtaaggagatccagtgggaaagtctgacgacgagcgctgccgagggcgcacatccgagtccacttatgccgcacgagaaccccgcaagcgggaaagtcagtcaagttggcggtcagactagcgacgaggccctctcaatgctgtcagaggggagcgatgccagcacaattgagattcacaccgcttctgagagctgtaacaagaacgagggagaccctgccctgcccacacatggcgacctgtag

SEQ ID NO: 223988 - DNA, 1083 bp, Artificial Sequence
  Description of Artificial Sequence: Synthetic coding sequence
atggaccccgaggaaacaagtgtatatttggattattattatgccacctcccccaattccgacataagggagacgcactcccacgtgccctatacctccgtgtttttacccgtgttctatacagctgtgttcttgacgggtgtgctgggaaatctggtgctcatgggagccctgcactttaaaccgggatctcgcagacttattgatatttttatcatcaacctggccgcaagcgacttcatctttctggttacattaccactgtgggtagataaggaagctagtttaggcctgtggcgcactggtagtttcctctgtaaggggtccagctacatgattagtgttaatatgcattgcagtgtattgttacttacgtgcatgtccgtggatcggtatctcgcaattgtgtggccagtcgtttctcggaaattccggagaacagactgcgcctatgtcgtatgtgctagcatctggtttatctcctgcctgctgggacttcccaccctgctgtcaagagaactgacgctgattgatgataaaccttattgcgccgagaaaaaggctacccctatcaagcttatctggagcttagtggcactgatttttacattctttgtacccctgctaagtattgttacttgctattgttgcatcgccaggaaactgtgcgcgcactatcagcagagcggcaagcacaataaaaagctcaagaagtcaattaagattatcttcatagtcgttgctgccttcctggtgagttggctgccattcaatacattcaagtttctggccatagtgagtggtctacgacaggagcactacctgccaagcgccattctccagctggggatggaggtgtctggcccattagcttttgccaactcatgcgtaaatccctttatctactacattttcgattcctatatccgtagagcaatcgtgcactgcttgtgcccatgcctcaagaattacgattttgggtctagcacagagacaagcgattctcatttgaccaaagctctgagcacttttatacacgccgaagactttgccaggagaaggaaacggagcgtaagtctttag

SEQ ID NO: 223989 - DNA, 1830 bp, Artificial Sequence
  Description of Artificial Sequence: Synthetic coding sequence
atgtctgacgagcggagactaccaggcagtgccgtcggatggcttgtgtgcggtggtctcagccttctagctaacgcttgggggatcctatccgtgggagcaaaacagaaaaagtggaaaccactggaattcctcctctgcactctcgcagccactcacatgttaaacgtagcagtgcccattgcaacctactccgtcgtccagctgcgacgtcagcggcctgatttcgaatggaatgagggcctgtgtaaagtttttgtgtcgacattttataccctgactttagcaacctgcttctcagtgaccagcctgagttaccatcgaatgtggatggtctgctggcccgtcaactaccggctgtctaacgccaagaaacaagctgtgcatacagtgatgggaatttggatggtcagttttattttgtcggccctgcctgccgtgggctggcatgacacaagcgagagattctacacccatggatgccgattcattgttgccgaaattggactgggatttggtgtctgcttcctgctgctggtgggtggttctgtcgccatgggcgtgatttgtacagctatcgcgttgttccagactctggcagtccaggtgggcaggcaggctgacaggcgggcatttaccgtgccgacaatcgtggtggaggatgcacaggggaagcgacggtctagcatagacgggagcgagcctgccaaaactagtctccagactaccggcctggtgacaacaattgtcttcatctatgattgccttatggggttccccgttctggtggtcagcttctcctcccttagggctgatgcttctgctccatggatggcgctatgtgtgttatggtgctctgtcgcccaggcgttgctcttgcctgtctttttgtgggcctgtgaccggtaccgcgcagatttgaaggccgtgcgggaaaagtgtatggcacttatggcaaatgatgaagagagcgacgacgagactagtctcgagggtggcatcagtcccgacctagtgcttgagaggagtcttgactatggctacgggggagattttgttgccctcgatagaatggccaagtacgagatctccgctctggagggagggctgccccaactgtaccccttgcgaccattgcaggaagataagatgcagtacttgcaagtgcctcccactcgcagattttcccacgacgatgccgatgtgtgggccgctgtgccattaccagccttccttcccaggtggggttctggcgaggatctcgccgcattagcccatcttgtgctacctgccggacccgaacgaagacgcgctagccttctggcgttcgccgaggatgcccctccaagcagggcacggaggaggtccgcagagtccttgttaagtttgaggccttccgcccttgattctgggcctcgcggagcgcgagacagccctccaggtagccctaggaggcgtcctggacccggaccaagaagtgccagcgccagcctgctccccgatgctttcgcccttaccgccttcgaatgtgaaccccaggccctccgcagacctccaggcccattccccgcagcgcctgcagcccctgatggcgctgaccccggtgaggcaccaacgccacccagctccgcccaacggagcccagggcctcggccttcagcacacagccacgctggctcactgcggcctggcctgtctgcttcttggggtgaaccaggcggtctgcgcgcagccggagggggagggtccacatcttccttcctgtcttcaccatcagagtcctccgggtacgctactctacattccgattccttgggctccgcctcttag

SEQ ID NO: 223990 - DNA, 2445 bp, Artificial Sequence
  Description of Artificial Sequence: Synthetic coding sequence
atggagcctgagatcaactgctccgaactctgcgattcctttccaggccaagagctggacaggaggccattgcacgacctttgcaagactactatcacgagcagtcaccattcatcaaaaacaatatctagtctttcccctgttctgctcggaatcgtgtggaccttcttgagctgtgggctactccttatactgttcttcctagcgttcaccatccattgtcggaagaataggatagtgaaaatgtcaagccctaaccttaacatcgtgacactgctcgggtcctgcctgacttacagctcagcatatttgtttggtatccaggatgttctcgtcggtagcagcatggagaccttaatacaaacacgcctctccatgctctgtatcggcactagtctggtgttcgggccaattctgggcaaatcttggcgcctctataaagtgtttacacagcgagttccggataagagagtaatcatcaaggatctacagttacttgggctcgttgccgcactcctgatggcagatgtcattctgttgatgacttgggtcttgactgaccctattcagtgtctacaaatcctgagtgtgagcatgaccgtcaccgggaaggatgtgtcttgtacttctacgtctactcacttttgcgcaagccggtactccgacgtgtggattgcgttgatttggggctgtaaggggcttctgttactttatggcgcttacctagccggactgaccggacatgtgagtagccctccggtgaatcaatcactgacaatcatggtcggcgtgaacctcctcgtgctcgccgcaggccttttgtttgtggtcaccaggtacctacactcatggcccaacctagtcttcgggttgaccagcgggggtatatttgtgtgcacaacaaccattaattgtttcatttttatacctcagctcaagcagtggaaggcattcgaggaggaaaaccagaccatccgacggatggcgaagtacttcagcactccaaataagtcgtttcacacacagtacggggaggaggaaaactgtcacccaaggggagagaaaagcagtatggagaggttgctgacagagaagaatgccgtcatagagtccctgcaggagcaagtgaacaacgcgaaggagaagatcgtgaggcttatgagcgctgagtgcacctacgacctccccgagggggcagcccctcctgcgtctagccccaacaaggatgtccaggcagtggcctcggtgcacaccctggcagctgctcagggcccaagcggacatctatcagacttccagaacgacccaggtatggccgcacgagatagccagtgcacgtcagggccttccagttacgctcaatctctggagggacccggaaaagacagcagcttcagtcccggaaaagaagagaaaatatctgactccaaagacttctcggaccatcttgatagtggctgttctcagaagccatggactgagcagagtctgggtcccgagagaggcgatcaagttcccatgaacccatcccaaagtctgctaccggagagaggcggatctgatccacagaggcagcgacacctggagaactcagaggaaccacctgaacgtaggagcagggtatcttccgtgatacgggagaaactccaggaagtactgcaggacttaggacttggacctgaggcatccctgtcgacggcaccttcatgtcaccagcagacatggaaaaatagtgcagctttttccccccagaagatgcccctgagcaaagagttaggtttcagcccctacatggtgaggcgacggagagctgctcagagggcgcgaagccacttcccaggcagtgcaccctcaagcgtcggccaccgcgcaaacaggacagtgcccggtgcccatagccggctgcatgtgcaaaacggcgactcaccaagccttgcgccacaaactacagattcacgagtgaggcggccttcttccagaaagccctccctgcccagcgaccctcaggatcgccctggaacccttgaaggatcgaagcagtctcaaacggagccagaaggggctagggggtcaaaggctgcgtttttaagacagcccagcggaagtggcagagccccttcccccgcagccccatgcctcagtaaagcttcccctgatcttcctgaacagtggcagttatggcccccagttccctctggctgcgctagccttagctcacaacattcttacttcgacaccgagagcagctctagcgacgaatttttctgccgctgtcaccgcccttattgcgaaatttgcttccaatcctcctccgactcttcggatagtggcacctcggacacagatcctgaaccaaccggaggcctggctagctgggaaaagctgtgggccagaagcaagcccatcgtgaactttaaagacgatctcaagccaacccttgtgtag

SEQ ID NO: 223991 - DNA, 2445 bp, Artificial Sequence
  Description of Artificial Sequence: Synthetic coding sequence
atggaaccagagataaattgttccgaactgtgcgattcgtttcccggacaggaactcgatcgtcgccctcttcacgacttatgtaagaccacaatcacctcctctcaccactcttccaaaaccatcagcagtctttcacctgtactcctgggaatcgtctggacatttctgtcgtgcggactacttctgatactctttttcctggcatttacgatccactgtagaaaaaatagaatagtgaaaatgtcgtcgcctaacctgaatatcgtgaccctgctgggaagttgtcttacatactcgtctgcttacctgtttgggattcaggacgtcctggtgggctccagtatggagacactgattcaaactcggttgagtatgctgtgcatcgggacatctcttgtctttggccctattttgggaaagtcctggcgcctgtacaaagttttcacccagcgcgtgcctgataagagagtcatcattaaagacctgcagcttctgggccttgtggctgcattgctgatggctgatgtgattctgctgatgacctgggtgctcaccgatcccattcagtgtctccagatcctttctgtgagcatgactgttaccggaaaagacgtcagttgcactagcacctcgacccacttttgtgccagtcggtacagtgacgtctggatagcacttatttggggttgtaaaggactcctcttactgtacggagcatatcttgctggccttacaggacacgtcagtagcccgcctgtgaatcagtcacttactattatggtcggtgttaacctgctggtgcttgccgcaggattgctcttcgtggttacaaggtatctccatagctggccgaatctagtatttggattgacgagtggcggtatctttgtctgcaccaccaccatcaactgcttcatcttcatccctcagctgaagcagtggaaggcctttgaagaagaaaaccagacgattaggagaatggccaaatatttttcaactccgaacaagtcttttcatacacagtacggtgaggaggagaactgtcatccacggggagaaaagtcatctatggagcgtctgcttaccgagaaaaacgctgtcattgaaagcctgcaagagcaggtgaacaatgcaaaggagaagatcgtaagactcatgtctgccgaatgcacttatgacttgcctgagggcgcagcaccacccgcttctagtcccaacaaggacgtacaggcggtcgctagcgtgcacacgctggctgccgctcagggtccttcagggcatctatccgattttcagaacgatccaggaatggcggctcgagattcacagtgcacctccggccctagctcatacgcacagtcgctggagggccctgggaaagactccagtttctccccaggcaaggaggagaagatctccgattctaaggattttagtgatcatctcgactccggctgctcccagaaaccatggaccgaacaatccctaggtccggaaaggggggatcaggtccctatgaaccccagccagagcctgctccccgaacggggaggctcagacccgcagaggcagcgccatctggagaattccgaggagccaccagaaagaaggagtcgcgttagctccgtgattagagaaaagctgcaggaagttctccaggacctgggcttaggacccgaggcctcactcagcaccgcaccatcgtgtcatcagcagacttggaaaaatagcgcagctttttcacctcagaaaatgcccctctctaaagagttgggtttctccccttatatggttcgcagacggcgagccgcacaacgagcacggtcccatttcccgggttccgcacccagctccgttggccatagggctaaccggactgtgcctggtgctcactctcgcctgcatgtgcagaacggcgatagcccaagcctagctcctcagaccaccgatagccgggttcgcagacctagcagcaggaagccatccctgccctcggacccccaggatcgtccagggaccctagagggctcaaagcagtcccagaccgagcccgaaggcgcaagagggagtaaagccgctttcctgcgacagccttcaggcagcgggcgagctccatctccggcagcaccctgtctgtctaaagctagtcctgacctgcccgagcagtggcagctgtggcctccagtgccctccgggtgtgccagccttagcagtcagcacagctactttgacaccgaatcctcgtcgtctgacgagttcttctgtcggtgccaccgtccatattgtgaaatttgcttccagagtagtagcgactcttccgactcaggaacaagtgacacagatcccgagcctaccggaggcctggcctcttgggagaaactctgggcacgttccaagcccattgtgaattttaaggatgatttaaagcccacgctagtctag

SEQ ID NO: 223992 - DNA, 2433 bp, Artificial Sequence
  Description of Artificial Sequence: Synthetic coding sequence
atggagcccgagataaattgtagcgaactctgcgattcattccccggacaggaactggaccgtcgtcctctgcacgatctgtgtaaaactaccatcactagctcccatcattcatcaaagacaatctctagcctcagccccgtgttgctgggaatagtatggacttttttgtcatgcggtcttctgctcatcctgttctttttggcctttactattcattgccgcaaaaatcgaatagttaagatgtcgtctcccaatctaaacatcgtcaccttgctcggctcatgcctgacttatagtagtgcctacctctttggaatccaagatgtcctggtgggatcttccatggagacacttatccagacacgcctgagcatgctgtgtatcgggaccagccttgtgtttgggcctatcctcggcaaaagttggcgcttgtacaaagtctttactcagagagttccggacaagagagtaattatcaaagaccttcagcttctcgggctcgtggctgccttacttatggcagatgtgatcctccttatgacctgggtcttgaccgatcctatccagtgcctgcagattctcagcgtaaccggcaaggacgttagctgcacaagcacctctacacacttctgtgctagcaggtattcagacgtatggatcgccctgatctggggctgcaaaggtttgttactactttatggagcgtacctggctgggttaacaggacacgtctccagtcctccagtgaatcagagcctcaccatcatggtcggggtcaacctgcttgtcctcgctgccggactgctattcgtcgtaacaaggtacctccactcatggcccaacctcgttttcggactaacttcaggagggatcttcgtttgtacgaccaccatcaactgttttattttcatcccccagcttaaacagtggaaagctttcgaggaggagaaccagacaattcgacggatggcaaaatactttagcaccccaaacaagagttttcatacacagtacggcgaagaggagaattgtcaccctcgcggagaaaagagtagcatggaacgcctgctcactgaaaaaaacgcagtgatcgaatccttgcaagaacaagtgaataacgccaaggagaaaattgtgagacttatgtccgctgagtgcacgtatgacctgcctgaaggcgcagccccacctgccagctcaccaaacaaggacgttcaggctgtggcatccgtccacacgctcgccgcagcccaagggccttccggtcaccttagcgatttccagaatgatcctggtatggccgctagagactctcagtgtacgtccgggccttcctcttatgcccagagcctcgaggggcctggaaaagattcaagcttcagccctggaaaagaagagaaaattagtgatagcaaggacttctccgaccatctcgactccgggtgctcacaaaaaccgtggaccgagcagtcactgggacctgaaagaggagaccaggtaccaatgaatccttcacagagcctactccctgagaggggcggaagcgatcctcagcgccagaggcatctggagaacagtgaagagccacctgagcgacgtagccgggtgtcgagcgtcatccgcgagaagcttcaggaagttctgcaagacctagggctgggacctgaggcatcactctctacggccccttcgtgtcaccagcagacgtggaaaaattcagcggctttcagcccacagaagatgccactgtctaaagaactcgggtttagcccttatatggtccgcagacgcagggcagcacaaagggctcgctctcatttccctggctccgcaccaagcagcgtaggacatagagctaatcgaactgtgcccggagctcactctcggttgcacgtgcaaaacggagattcaccttctttagctccacagacaaccgacagccgcgtacgcaggcccagcagccgcaaacctagcctgcccagcgatcctcaggaccggcctgggaccttggaaggatccaagcagtcccagactgaaccagaaggcgctagagggtctaaggctgcgttcctgcggcaacccagcggcagcgggcgagccccatcacccgcagcaccatgtctctctaaggcttcgccagacttaccagagcaatggcagctgtggccaccagtcccgtcaggatgcgcctcattgtccagtcaacactcatactttgacaccgaaagctcaagtagtgacgaattcttctgtcgttgtcaccgcccttactgtgaaatttgtttccagtcttcaagcgactccagcgactccggcacatctgacaccgaccctgagcctaccggtggcctcgcctcttgggagaagctttgggctagatctaagcccatcgtgaattttaaagatgatctaaagcctactcttgtctag

SEQ ID NO: 223993 - DNA, 1590 bp, Artificial Sequence
  Description of Artificial Sequence: Synthetic coding sequence
atgtctctgaactccagtctcagttgtcgcaaggagctaagcaacctgacagaggaggagggaggggagggcggtgttatcatcactcagtttattgctatcatcgtgatcacaattttcgtgtgcttagggaatctagtaatcgtggtaactctgtacaaaaagtcttatctgctgaccctctcaaacaaatttgtcttctctttaaccctgagcaactttcttctcagtgttctggtgctgcccttcgttgtgacttctagtattcggagggaatggatattcggcgtggtttggtgcaacttctcggctctgctctacctgctcattagctcagcttctatgttgactctgggggtgattgccatagatagatactatgcagtgctctacccgatggtctaccccatgaagatcacaggtaatcgcgctgtgatggccttggtatacatctggttacactctcttatcgggtgcctgccccctctctttggctggtcctcagtggaattcgacgagtttaagtggatgtgcgtcgccgcttggcaccgggagccagggtataccgctttctggcagatctggtgtgccctgttcccttttttggttatgctggtatgctatggatttatcttccgggtcgccagggtaaaggccagaaaagttcactgtggtaccgtcgtgattgtggaggaggacgcacagcgtactggacgtaagaatagctcaaccagtaccagcagttcaggttcccgccgaaacgcattccagggcgtggtgtactcagccaaccagtgcaaggctctgattacaatcctggtggtgctgggcgcttttatggtgacatggggcccttacatggtagtgatcgcatcagaggctctatggggtaagtcatctgtctcaccttcactggagacatgggccacctggttgtctttcgcgagcgctgtctgccatccactgatctatggcctctggaataaaacagttcgcaaggagctgctaggcatgtgcttcggagaccgatactaccgagaaccctttgtgcagcgccaacgtacctccaggctctttagtatcagcaataggattactgaccttggactatccccccacctgactgccctgatggccggagggcagccactcggccactctagcagcacaggtgatacaggcttctcatgctcccaggactccgggaccgatatgatgctgttagaggattatacctctgatgacaacccgcctagtcactgcacatgtccccctaaaaggcgttcctctgtgaccttcgaggacgaggttgaacagattaaagaagctgctaagaactccattctccacgtgaaggctgaagtacacaaatcccttgacagctacgcagccagtctcgccaaagccatagaggcagaggcaaagatcaatctgttcggtgaggaggccctgccgggagtgcttgtgacagccaggacagtaccaggcggtggatttggcggtaggcggggtagccggaccttagtaagccagcgcttgcagctccagtctattgaggagggggacgtgctggctgctgagcaaagatag

SEQ ID NO: 223994 - DNA, 1590 bp, Artificial Sequence
  Description of Artificial Sequence: Synthetic coding sequence
atgtccctcaatagctctctgtcctgcaggaaagagttatccaatctgaccgaggaggaggggggagagggaggggtgatcattacgcagtttatagcaatcatcgtgataaccatatttgtctgtctgggtaacctggtgatagtggtgactctctataagaaatcgtatctcctgactttgtcaaacaagtttgtgttctctctgactctgtctaactttttactttcagtcttagtccttccttttgtggtcacaagcagcatcagacgcgagtggatcttcggggtggtgtggtgtaacttttcagcactattgtatctgctgatcagttctgcatcaatgctgactctcggcgtgattgcaatcgatcgatactatgcagtgctataccccatggtgtaccctatgaagatcacaggaaatcgagctgtcatggccctggtctacatttggctgcacagcctgatcggctgcctgccgcctttgttcggatggagctccgtcgaatttgacgagtttaaatggatgtgtgtcgccgcatggcatagagagcccggttataccgcattctggcagatctggtgcgcgctcttcccattcctggtaatgctcgtttgctacgggttcatcttccgtgtagccagggtgaaggccaggaaggtgcactgtgggaccgtggtgattgtggaagaggacgcgcagcggaccgggcgaaagaactctagcacctcaacaagctcaagtggtagccgcaggaacgcattccaaggggtggtttacagtgccaatcagtgtaaggcattaataacaatccttgtggttctcggggcattcatggtgacctggggcccttatatggtggtgatcgcctccgaggccctgtgggggaagagttcagtgagtccttccttagaaacgtgggcaacctggttatccttcgccagcgctgtgtgccatcctctgatatatggcctgtggaacaagactgtcaggaaagagcttttgggcatgtgtttcggcgaccgatattaccgcgagccatttgtccagaggcagcggacaagtagattattctcaatctccaatcgtatcacggacctcgggctctctcctcatcttaccgcactaatggccggaggacagcctctgggacatagctcttccaccggagatacgggcttctcctgtagtcaagattctggcacggacatgatgttgcttgaggactatacttcggacgacaacccaccgagccattgcacttgtcccccaaaaaggcgttcctccgtcacatttgaggatgaggttgaacagattaaagaggccgcaaaaaattccatcctccacgttaaggctgaggtgcacaaaagcctcgatagctacgcagctagcctcgctaaggccattgaggccgaggccaagattaacttgtttggcgaagaggcgctcccgggtgtgctcgtgaccgcgcgaacagtgccaggcggagggtttggaggaaggcgcggtagcaggaccttagtctcacagcggctgcaacttcagtccatcgaggagggtgatgtgctagcagcggagcagcggtag

SEQ ID NO: 223995 - DNA, 1590 bp, Artificial Sequence
  Description of Artificial Sequence: Synthetic coding sequence
atgtctttaaacagttcactgtcttgcagaaaagagcttagcaacctgacagaggaggaaggcggtgaaggcggagtgatcatcacacagttcatagctatcattgtgatcaccatctttgtgtgcctcggcaatctcgtgatcgtagtgacactgtataaaaagtcgtacctgctgactttatctaataaatttgtgttttccctgacactgagcaactttttgctgagtgtgcttgtgctgccttttgtggtgacatctagcatcagacgcgagtggatctttggcgtggtttggtgcaacttcagtgctctgttgtacctcctcatttcctccgccagcatgctcacactgggcgtgattgctattgaccggtattacgctgtgctgtatcctatggtgtacccaatgaagattacagggaatagagctgtaatggcactagtctacatttggcttcactcgctgattggctgtctgccaccattatttgggtggtcctccgtggagttcgatgaattcaagtggatgtgtgtggcagcttggcatcgtgaacccggatacacagctttttggcagatttggtgtgccctttttccatttctcgtgatgcttgtttgttacggcttcatctttagagtagccagagtcaaggctaggaaggttcactgcggaactgttgttattgttgaggaggatgctcagcgaacaggaagaaagaattcttcaacctcaacctccagtagtgggagtcggcgaaatgcattccagggagtggtgtacagtgcgaaccaatgtaaggcactgatcacgattctggtggtcctcggcgcattcatggtaacctggggcccttatatggtagtgatcgctagcgaagcactgtggggcaaatcgtccgtttctccaagtctggagacttgggctacctggctcagcttcgcatccgcagtgtgtcatccgctgatctacggcctctggaacaaaacggtcagaaaggaattgctgggcatgtgctttggagaccggtactacagagaaccctttgtacagcgacagaggacctcacgccttttttccatttctaaccggatcactgacctggggctctcgccacacctaacagctcttatggctggaggccaacccctaggtcattcatcgtccaccggagacacaggcttctcctgctctcaagatagcggcaccgatatgatgcttcttgaagactacacatctgatgacaacccaccatcccactgtacatgcccccctaagcgccgttccagcgtcacttttgaagacgaagttgagcagatcaaagaggccgcaaagaacagtatcctgcatgttaaggcggaggtgcacaaatccttggactcatacgcggcaagcctggcgaaagctattgaagctgaggccaagataaacctctttggagaagaagcactgcctggcgtgctcgtgacagctcgcacagtccctggcggtggcttcggtggacgaaggggttcccggacgctggtatctcagcgcctccagcttcagagcattgaggaaggagatgttctagccgctgagcagaggtag

SEQ ID NO: 223996 - DNA, 1590 bp, Artificial Sequence
  Description of Artificial Sequence: Synthetic coding sequence
atgtcacttaatagctccttgagctgccggaaggaactatccaatctcacggaagaggaagggggtgaggggggtgtcattattacacagttcatagctattattgttattacaatatttgtctgtttgggtaatctggtgatcgtagtaaccctgtacaaaaagtcttacctgctgacactcagtaacaagtttgttttttccttgactctgtccaatttccttctctccgtcctggtgctgccctttgtagttacttcgtctatccggagggaatggatctttggtgtggtttggtgcaacttttctgctcttttgtacctgctgatttcttctgcttcgatgttaactctcggcgtgatagctatcgatagatattatgcggtgctgtaccctatggtgtatcctatgaagatcaccggcaaccgtgcggtcatggccctggtgtatatatggttgcactccctcattgggtgcctaccccctttgtttggctggagtagtgtggagtttgacgagttcaagtggatgtgcgtcgccgcatggcacagagaaccaggttatacagctttctggcagatctggtgtgccttattcccttttctggtgatgctggtatgttatggatttattttccgcgtggccagggttaaggccagaaaagtgcactgtgggactgtggtgatagtcgaagaagatgcacagagaacagggaggaaaaatagcagtacaagtacatcaagttccggcagcaggcgcaacgctttccaaggagtcgtctattccgcaaaccagtgcaaagcgctcataacaattcttgtcgtgttaggcgcttttatggtgacctgggggccttacatggtggtcatcgccagcgaggcactgtggggaaaatcttcagtcagtcctagcctggagacttgggcaacatggctaagtttcgcctccgcagtatgtcatccactcatctacggactttggaataagacagttcgcaaagaactgttaggtatgtgcttcggggaccgatattacagagagccattcgtgcagcgccagcggacgtcaaggctgttctctattagtaaccgcatcacagatcttggcctgagtccgcacctgactgccctcatggcgggtggacagccgctaggacatagtagctccactggtgacaccggcttctcctgctctcaggactctggcactgatatgatgctgcttgaggattacacctccgacgacaatccaccctctcactgtacgtgccccccaaagcggcgatcctctgtgacttttgaggatgaggtcgagcagatcaaagaagccgctaagaacagcattctgcacgtgaaggctgaggtgcacaagtccctggatagctatgcagccagcctggcgaaagctattgaggctgaggccaagattaatttgtttggcgaggaggctctacctggggtgctggttacagcacgaacagtcccgggaggaggcttcgggggtagaagaggaagcagaacgctggtaagccagaggctgcagcttcaatctatagaggagggagacgtcttagccgctgagcagagatag

SEQ ID NO: 223997 - DNA, 1650 bp, Artificial Sequence
  Description of Artificial Sequence: Synthetic coding sequence
atgtccgcccgtggggtagtacagcatgcgttacccactcccaggaggggggctctgactatgagtctgaatagcagcctgtcctgtcggaaggaattgagtaacctgaccgaagaagagggcggtgaaggcggtgttattatcacacagttcattgcgatcatcgtaataaccattttcgtgtgtctaggcaatcttgttatcgtggttactctctacaaaaagagttatttgctcacactatctaataaatttgtgttctcccttacgttgtctaatttcctcctttccgtcttggttctgccctttgtggtgacctcttctatccgaagggagtggatctttggagtggtgtggtgcaattttagcgccctgctgtacctgctgatctcctccgcgtccatgttgaccctcggagtgattgccattgatagatactatgccgttctgtacccgatggtgtatccgatgaagattactggtaaccgggctgtaatggccctggtgtacatctggctgcactcccttatcggctgcctgccgccacttttcggctggtcatctgtggaatttgacgagttcaagtggatgtgcgtggctgcttggcatagggagcccggatatacagcgttctggcagatctggtgtgctctgtttcccttcttagtgatgctagtgtgctacggattcatattcagagtggccagggtgaaagccagaaaagttcattgtggtacagtggtgatagtggaggaggacgctcaaagaacaggacgcaagaatagtagtacgtctacaagctcctctggctctaggcggaacgcttttcagggagtagtgtattccgctaaccagtgcaaagccctgattaccatcctcgtcgtgctaggagcgtttatggtgacctggggcccatatatggtcgttatcgccagcgaggcgctgtggggaaagtccagcgtgtcacctagcctagagacctgggctacatggctttctttcgcatctgctgtctgccatccattaatttacggtttatggaacaaaaccgtgcggaaagagctcctggggatgtgttttggcgaccgttactatcgtgaaccctttgtccagcggcagaggacaagtcgcctcttctccatttctaatcgcatcactgacctcgggctctcacctcatctcacggcactgatggccggtggacagcccctgggccacagttctagtacaggggacacaggattcagttgctctcaggatagtggtactgatatgatgttgctggaagactacaccagtgatgataatcccccttcacactgtacatgcccccctaaaagacgtagctcagtcaccttcgaggacgaggtcgagcaaattaaggaggccgcaaagaactctattttgcacgtgaaagcagaagtgcacaaatccctggatagttatgccgcaagtcttgccaaggccattgaggccgaagccaagatcaatctgttcggggaagaagctctccctggcgttttagtgaccgctcggaccgtgccgggaggcggatttggtggacggagaggttcacggaccttagtgtctcaacgattgcagctgcagagcattgaagagggagacgtactggctgcagagcagcgctag

SEQ ID NO: 223998 - DNA, 1356 bp, Artificial Sequence
  Description of Artificial Sequence: Synthetic coding sequence
atgggaggcagacggtgtgtacctggcacgctccccatgcgggctgccccacccggagccaaaaggctgcacgtgccgcttcgggcaaagggcgtgggacgcagcggtcatgcccctcgcctggaatcagtccgcacctcttactacgctgtgctgtatccgatggtttaccctatgaaaatcactggcaacagagcggtaatggcactcgtttacatttggctacatagcctgatcggatgtctgcccccactctttgggtggtcatccgtggaattcgacgagtttaagtggatgtgcgtagcggcatggcaccgggaaccgggatatactgccttttggcagatttggtgtgcactgtttcccttccttgttatgcttgtgtgctatgggttcattttcagggtggcacgagtaaaggctcggaaagttcattgcggcaccgtggtgatagttgaagaagatgcccagaggaccggcagaaaaaattcatcaactagcacatctagtagcgggtcacggaggaacgcctttcagggtgtagtttacagcgccaaccagtgcaaggcactgataacgattctggtggttttgggcgctttcatggtcacatggggtccatatatggtggtgatcgcctctgaggcactctggggcaagagctcagtgagccctagcctggagacatgggccacctggttgtcctttgcctcggctgtgtgtcaccccttgatttacggtctgtggaacaaaacagttcgcaaagagctgctaggaatgtgtttcggggatcgctattaccgggagcccttcgttcagagacagcggacctccagactgttcagtattagtaacagaattactgatctcggactgtctcctcacttaacagccttgatggcaggtgggcagccactgggacactcatcatctactggggataccggcttttcatgctcacaggattcaggcacggatatgatgctcctggaggactacaccagcgacgacaatcccccaagccattgcacctgccccccaaagcgccgaagtagcgtcacttttgaggatgaagtggaacagattaaggaagctgctaagaatagcattttacacgttaaggcagaagtgcataagagcttggacagctatgccgctagcctggctaaggccattgaagccgaagcgaaaattaatctctttggagaggaagccttgccaggtgtgctggtaactgcaaggactgtaccaggaggtggtttcggcggtaggcgcggttcacggaccctggtgtcccagcgcctgcaactgcagagtattgaggaaggagatgtcctcgcagctgaacagcggtag

SEQ ID NO: 223999 - DNA, 1248 bp, Artificial Sequence
  Description of Artificial Sequence: Synthetic coding sequence
atgctggtacctgtgggatggatgaacgagtcatactacgccgtgctgtatcctatggtgtaccctatgaaaatcaccggcaaccgggctgtgatggccctggtgtacatatggctacatagcctgatagggtgtctcccacccctctttggctggtcatctgtcgaattcgatgaattcaagtggatgtgtgtcgctgcatggcatagggagcctggatacaccgcgttctggcagatatggtgcgccctcttcccctttttggtgatgctggtatgctacgggttcattttccgtgtggccagggtgaaggcaagaaaggtccattgtggtacagtcgtgatcgttgaggaagacgcccagcgtaccgggcgaaaaaactctagcactagcacttcaagcagcggcagtaggcggaacgcttttcagggagtggtgtacagtgcgaaccagtgcaaggcgttgatcaccatcctggtggtactgggcgcattcatggtgacatgggggccttacatggtcgtgatcgcttctgaagccctgtggggcaagtctagtgtgtcacctagcctggaaacctgggccacctggctcagcttcgccagtgccgtgtgtcatcccctaatctacgggctgtggaacaagacagtgcgcaaggagctgctgggaatgtgctttggggataggtactaccgcgagccgtttgtgcagaggcagagaacttcccgcctgttcagtatatccaacaggattactgacttagggctgagccctcacctgactgccctcatggccggtggtcagccgttaggtcattctagcagcacaggggatactggttttagttgtagtcaggacagtgggaccgacatgatgttgctcgaggactatacgtccgacgacaatcctccctctcattgtacatgtcccccaaaaagacgttcttctgtgacattcgaagatgaggtggagcagattaaggaagcggctaagaattctattctgcacgtcaaggcagaggtccacaaatcccttgactcctatgctgcatctctagccaaagccatcgaggccgaggccaagattaatctcttcggagaggaagctttgcccggtgtgctggtgacggcgagaaccgtcccgggaggtggcttcgggggacgcaggggttcccgaaccctggtgagccagcggttacagctccagtcaatcgaggagggtgacgttctggcagcagagcagagatag

SEQ ID NO: 224000 - DNA, 1104 bp, Artificial Sequence
  Description of Artificial Sequence: Synthetic coding sequence
atgtccaaacgcagttggtgggctgggagtaggaaacctccacgggagatgctgaagctttccgggtccgactcctcacagagcatgaatggcttggaagtggcacccccaggtctgatcaccaatttcagcctcgcgacagctgagcagtgtgggcaggagactccactggaaaatatgctgttcgcaagcttttatttactcgactttatactggcgctggtgggcaacaccctggctctgtggttgtttatccgtgaccacaaatcgggtacccccgctaacgtgttcctgatgcatctggctgtggccgacctgagctgtgtgctggtattgccaactcgacttgtgtaccattttagcggaaaccattggccattcggtgaaatcgcgtgccggttaaccgggtttttgttctacctgaatatgtacgcaagcatatattttttaacctgtatatcagcggaccggttcctcgccatcgtccatcctgtaaaatcgctaaagctgcgtcggcctctctacgctcatctggcctgtgcattcctgtgggtggtagtggccgtagctatggcccctctactggtgagcccgcagacagtgcagacgaatcataccgtagtgtgtctccagctgtaccgagagaaagcatctcaccacgcactggtctccctggccgtggcgttcacattccctttcatcactactgtcacctgttacctgttaatcattcgttccttgcgccagggcttgagagtcgaaaagagactgaagactaaggccgtgcgaatgatcgctattgtgctggccatattcctcgtgtgcttcgttccatatcacgttaatcgttctgtgtatgtgctccattatagaagccacggcgcaagttgtgcaacccagcggattctggctcttgctaaccgcatcacctcttgcctcactagcctgaatggtgctctggaccctattatgtactttttcgttgctgagaagtttcggcatgccctttgtaacttattgtgtggaaagcggttgaagggccctccccctagctttgagggaaagacaaatgagagttccttaagcgctaaaagcgaactgtag

SEQ ID NO: 224001 - DNA, 312 bp, Artificial Sequence
  Description of Artificial Sequence: Synthetic coding sequence
atgaacgggctggaagtggctcccccaggactcataacaaacttcagtcttgccacagccgagcagtgcgggcaggagacacctctcgagaacatgcttttcgcttcattttacctgccactgcctcgccagccgcgaatgtgtactgtgaccgggttgacagcaggttctaccgcccgatccaaacagcatctcgaagttgtgttcgcagtcctgcctgcctttaagctacagcggggacgtcgagagcggacaagcaaacccccaattattcctatgtcctcccctgggccatgctgggtccggacatag

SEQ ID NO: 224002 - DNA, 1104 bp, Artificial Sequence
  Description of Artificial Sequence: Synthetic coding sequence
atgagtaagaggagctggtgggccggatctcggaaaccaccaagagaaatgctaaaactgtccggtagcgacagcagtcagtcgatgaatggcttagaagtggctcctccgggactgattactaacttctcgctggctaccgccgagcagtgtggacaggagaccccactggaaaatatgctctttgccagcttctacctcctggactttattctggctctggtagggaacacactggcactgtggctgtttattcgcgaccacaagtctgggacccccgctaacgtgttccttatgcatctggccgtggccgatctatcctgtgtgctcgtgctgccaacgcgcctagtgtatcacttctcgggcaatcactggcctttcggagaaatagcctgtaggctaacaggcttcctgttttatctcaacatgtatgctagcatatacttcctgacttgtatttccgcggacagatttctggcgatcgtgcatcccgtcaaatccctcaagctgaggaggccactgtatgcccatctggcctgcgcctttttatgggtggtcgttgcagtggccatggccccactgctggtaagtccccaaacagtgcaaaccaaccacactgttgtatgcttgcagttatatagggaaaaagcctcccatcatgccctagtttcgctggcagtggcattcacatttccctttattaccactgtaacttgctatctgttgattattaggtccctgcgacagggcttacgcgtcgaaaagcgactgaaaacaaaagcagtccgtatgatcgcaattgtcctggcgatctttctcgtgtgtttcgtgccgtatcatgtcaatcgatctgtgtacgtgctacattaccgttcccacggcgcatcttgcgcaacgcagcggatcttggctctcgccaacagaatcactagctgtctgacatcgctgaacggggctctggaccctatcatgtacttttttgtcgccgagaagttccgacacgccctgtgcaacttgctgtgcggcaaaagactcaagggaccaccgccttcattcgaaggcaaaacaaacgagtcaagtctctctgctaagagcgaattgtag

SEQ ID NO: 224003 - DNA, 411 bp, Artificial Sequence
  Description of Artificial Sequence: Synthetic coding sequence
atgagtaagaggagctggtgggccggttccaggaagccgccaagagagatgctgaagctctcaggaagtgacagcagccagtccatgaatggactggaggttgctcccccaggtctcattactaacttctcattggcaactgctgagcagtgcggacaggagactccactggagaatatgttgtttgccagcttctatctgctggactttatcctagccctcgtgggcaatacccttgccctttggctgtttattagggatcataagagtggcaccccagcgaacgtcttcctgatgcacctggctgtggctgacttgtcctgcgtgctggtgcttcccactagattagtctatcactttagtggaaatcactggccattcggtgaaatcgcatgtaggctgacgggctag

SEQ ID NO: 224004 - DNA, 1104 bp, Artificial Sequence
  Description of Artificial Sequence: Synthetic coding sequence
atgtctaaacgttcatggtgggcaggttccagaaaacctcctcgcgagatgctaaaactctccggatctgattcaagtcaatccatgaacggcctggaagtggcccctccaggcttgattactaatttttctctggctaccgccgagcagtgcgggcaggagacaccactggagaacatgctcttcgcctcattctatctattggactttattcttgccctggtcgggaataccctcgcactgtggctgttcattcgggaccacaaaagcggtacgccagctaatgtgttcctaatgcacctcgctgtggcagacctgtcgtgtgtcttagtgctgcccacccggctcgtgtaccatttcagcggtaatcactggccattcggtgagattgcctgcagacttacagggttcctgttctatctcaacatgtacgcttccatttacttcttaacctgcatatcggccgatcgatttctggccatcgttcatcctgtgaagagtttgaagctgagacgtccgttgtatgcgcacttggcctgcgctttcttgtgggtggtagtggctgtcgctatggcccctctgctggtaagcccccaaaccgtgcagaccaatcacacagtggtgtgtttacagctatatcgcgagaaagcgtctcatcacgccctagtgtcgcttgccgtagccttcacttttcctttcatcactacggtgacgtgctacctccttattattcggagcctgaggcaagggctgcgcgtcgagaagcgcctaaaaaccaaggctgtgaggatgatcgccattgtcttggcaatattcctggtgtgtttcgtcccgtatcacgttaaccgatccgtttatgtcttgcattacagaagtcatggcgcatcctgtgctacacagagaattttagcattagcaaaccgaatcacgtcatgccttacatctctcaatggtgctctggaccctataatgtacttctttgtcgctgaaaagttccggcacgctctatgtaacctcttatgtggaaaacgcctgaagggaccacctccatcattcgagggcaagaccaatgagagctccctgagtgccaagtcagagctgtag

SEQ ID NO: 224005 - DNA, 1338 bp, Artificial Sequence
  Description of Artificial Sequence: Synthetic coding sequence
atggcagctccgacacccgctagaccagtgttgactcacttactcgtggcactgtttgggatggggtcttgggctgccgtgaatggcatatgggtggaactaccggttgtcgttaaagagttgcctgagggatggtctcttccgagctacgttagcgttcttgtggccctgggcaatctgggattacttgttgtgaccttatggcgaagactcgcgccaggcaaagacgaacaggttcctattagggtggtgcaagtgctaggtatggtcggaacagctcttcttgccagcctatggcatcatgtagccccagttgccggacagctgcactccgttgccttcctggcactggctttcgttttggcactggcgtgctgcgccagtaacgtaactttcctcccctttctgagtcacctgcccccacgcttcctgaggtctttcttcctgggacaagggctgagtgccttgttgccttgcgtactcgctctcgtgcagggggtggggaggctcgaatgccctccggctcctataaatggcacacccggaccaccccttgactttttggaacgattccctgcatccacctttttttgggcacttacagcgcttcttgttgccagtgctgcagccttccagggcctcctgctgctgctcccgccacctccttctgtgccaacaggcgagctgggttctggcctacaggtcggtgcccctggggctgaggaggaggttgaggagtcatctccactccaggagccaccaagccaggcggcaggtactactccgggtccagatccgaaagcttatcagcttctgtctgctcggtctgcttgcttgctgggtctactcgcagccacaaacgcccttacaaacggtgttctcccagcagttcagtcatttagttgtttgccgtacggaaggctggcataccatctggctgtagtcctgggctctgctgcaaacccactcgcctgtttcttggctatgggagtgttgtgccgcagtctggccggactcggagggctctccctgctgggtgttttctgcggcggatacttgatggcccttgctgtgctgagtccatgcccacctctggtgggtacatctgccggagtagtgcttgtcgtgctgtcctgggtgctgtgcctgggcgtgttttcatacgtgaaagtagccgcaagcagcctgctccacggcggaggaaggcctgctctgcttgcagcaggcgtcgccattcaggtcggcagcctgttaggggctgtggctatgttcccccctacctctatttatcacgtgtttcatagtcgtaaggactgtgccgacccctgtgattcctag

SEQ ID NO: 224006 - DNA, 1338 bp, Artificial Sequence
  Description of Artificial Sequence: Synthetic coding sequence
atggcagccccaacacccgcacgacccgtgcttacccacctgcttgtcgccctgtttggtatgggtagctgggccgctgtaaatggaatctgggtggaactgcccgtggtcgtaaaggaacttcctgaaggctggtcgcttcccagctacgtgtccgtgctcgtggcattgggtaatctcgggctcctagtggttactttgtggcggaggctagccccagggaaagatgagcaggtcccaatccgcgttgtgcaggttctggggatggttggtaccgccctgcttgcttcactctggcatcatgtggctccagtggcagggcagttgcattctgtagcctttctggccctcgctttcgttcttgccctggcctgctgcgcctctaatgttactttcctccccttcttgtcgcacctaccacctcgtttcctgcggagcttttttctgggccagggtttatcagccctgcttccgtgcgtgctcgccctagtccagggagtgggcaggttggagtgtccacccgctccaattaacggcacacccggacccccactggactttctggagaggttccctgcctctacttttttttgggcacttacagctctgctggtagcttcagctgcagcattccagggtctacttctcctgctgccccctccgccttcagtgcccactggtgagctgggatccggcctccaggtgggtgctccaggggcagaggaggaagtcgaagagtctagcccgctgcaagagccacccagccaggccgctggaacaacacccggtccagaccccaaagcataccagctcctctccgcacgctctgcttgccttctgggtctgcttgccgcaactaatgcgctgaccaatggtgtcctgccggctgtccaatctttctcctgtctgccctatggccgactcgcgtaccatcttgcggtggtgctgggcagcgctgcaaatccactggcatgctttttagcaatgggagtgctgtgtcgcagcctggcaggactcggtggcttaagtctcctcggcgtgttttgtggcggataccttatggccctagccgtactgagcccctgcccgccactggttggaacaagtgctggggtggttctggtcgtattgtcctgggtgctctgccttggagtgttttcttatgtgaaggtcgccgcttccagtctgctgcatggcggaggacgtcccgcactgctggcagccggagtggccattcaggtgggcagcttactgggggcagtggctatgttccctcctacctctatctaccacgtgtttcacagccgtaaggactgcgcagacccttgcgattcttag

SEQ ID NO: 224007 - DNA, 1338 bp, Artificial Sequence
  Description of Artificial Sequence: Synthetic coding sequence
atggctgccccaacacctgctcggccagtccttacacacctgttggtggcgctgtttggaatgggatcatgggcagcagttaatggcatatgggtcgagctccccgtagtggtgaaggagctgccagagggctggagtctgccttcttacgtgtcagtgctggttgcgctgggcaacctgggcctcctagtggtgaccttgtggcggaggctcgcccctggcaaagatgagcaggtaccaatcagagtggttcaggtgttaggtatggttggcacagccctcctcgcctcactgtggcaccacgtcgccccagtggcgggtcagcttcatagcgtagcttttctggctctggcattcgtgctcgccctggcctgctgtgcctcaaacgtgaccttcctgcctttcctgagccacctcccccctaggttcttgcgctccttctttcttggtcagggcctcagcgctttgcttccatgcgttctggccctggtccagggagtgggtcggcttgagtgcccccctgcccctattaatggcacacccggacctcccctggattttttggagaggtttcccgctagcacgtttttctgggccctgactgcgttactcgtcgcttcggcagctgcctttcagggactacttttgctgctgccccctccccctagtgtgccaaccggtgagctgggcagtgggttgcaggtgggagctcctggtgccgaggaagaggttgaagagagctctccactccaagaaccccctagtcaagccgctggcaccaccccaggacctgatcccaaggcttatcaactgctttcagcccgttcagcatgcttgctggggctgctggccgcaactaacgccttgaccaatggggttctaccggcagttcagagtttttcctgcctcccttatggacgcctagcttaccacctggccgtggtgctggggagtgctgccaatccactcgcgtgttttcttgccatgggagtcttgtgtcgatccctggctgggctcggcggactgagccttctcggggtgttctgtggtggctacctgatggctctcgctgtactaagcccgtgccccccattggtgggcacctccgctggggtggtgttggtcgtgctgtcctgggttctttgcctaggtgtgttcagctacgttaaagtcgctgctagctcgttactgcacggcggaggtcgaccagcactccttgctgctggcgtggctatccaagtggggtctctcctgggggcagtcgcgatgtttcctcctactagtatataccacgtgtttcatagccgcaaagactgtgccgatccttgcgattcttag

SEQ ID NO: 224008 - DNA, 1338 bp, Artificial Sequence
  Description of Artificial Sequence: Synthetic coding sequence
atggccgcaccgactcctgcaaggccagtacttactcatcttttggtcgctcttttcggaatgggctcttgggctgctgtgaacggtatctgggttgaactacctgtcgtggtcaaggagctccctgaggggtggagtctgccgtcctacgttagcgtgctggtagccctcggaaatctgggccttctggtggtcactctttggcgcagactggctcccggtaaagacgaacaagtaccaattcgggtggttcaggttttgggtatggtgggcactgccttgcttgccagcctatggcaccacgttgcgccagtggccggacagcttcactcagtagcgtttcttgctctcgcattcgtgctcgcccttgcgtgctgcgcttcgaacgtaactttcctgcctttcctgtcccaccttccaccacggtttcttcggagcttttttctgggccaaggactgagtgctctcctaccatgtgtgctggcccttgttcagggggtgggtcgcctggaatgcccccctgcccctataaatgggacccctggccctcccttagactttctggagaggttcccagctagcacttttttttgggctctgaccgcgctcctcgtggcctctgctgctgctttccagggcctgcttcttctgctcccaccccctcctagcgtgcccactggcgagctaggatcagggctgcaggtgggagcacctggagctgaagaagaagtcgaagagtcctccccccttcaggaacccccttctcaagcggctggaactacacccggacccgacccaaaagcttatcagctgctcagcgctcggagcgcttgcctcctcggattactagcggcaactaacgcccttaccaacggcgtgcttcccgctgtgcagtcttttagttgccttccatacggcagacttgcgtaccacctggccgtcgtgctgggctctgcagcaaatccactggcttgttttctggctatgggggtcctatgccggtctttggctggcctcggaggcctttctctgctgggggtgttttgcgggggatacctcatggccctcgcggtgttatctccctgtcctccgctcgtaggaactagcgctggggtggtgcttgtagttctctcttgggtcctgtgtctgggggtgttcagctacgtgaaagtggcagcatcatcactcttgcatgggggtggcagaccagctctgctggctgcaggcgtcgccatccaggtggggtccctgttaggggctgtagccatgttccctccaacttcaatctaccacgttttccattctcgcaaagactgcgccgatccctgcgatagctag

SEQ ID NO: 224009 - DNA, 1338 bp, Artificial Sequence
  Description of Artificial Sequence: Synthetic coding sequence
atggccgcacccacccctgccaggcccgtcctgacacacctgttggttgccctttttggaatggggtcttgggctgcagtcaacggcatctgggtcgagctgcctgtggtcgttaaagaactgccggaaggatggagcttgccgtcgtacgttagtgtgctggttgccctgggaaacctcggactcctcgtggtgacactctggcgcaggctcgcaccaggcaaagacgagcaagttccgattcgggtcgtgcaagtgttgggaatggtgggtaccgcactgctggcctctctgtggcatcatgtagcacccgtggcgggtcagctgcacagtgtggccttcttagctcttgccttcgtcctggctcttgcttgttgtgccagtaacgtgacttttttgcccttcttgagtcatttgcccccaagattccttcgctcttttttcctggggcaagggttatcagccctcctgccctgcgtgctggccctggtgcagggcgtggggagattagagtgccccccagcaccaattaacggtacgccgggtcctccactggattttctcgagagatttccagcttctacatttttttgggccctgactgctctgctggtggcgtccgctgccgcttttcaagggttgcttttgttacttcccccaccgccttccgtgcctacaggcgagcttggaagcggacttcaggtgggcgcacccggagctgaggaggaggtggaagagagcagcccgctacaggaacctccctcccaagcagcgggaaccacacctggacccgatcccaaggcttaccagcttctgtccgctcgatccgcttgccttttgggcctgctagctgccactaacgcgctgacgaacggggttcttccagctgtccagtcattctcttgcctcccttacggcagactcgcataccacctggccgtggtgctggggagcgcggcaaacccattagcgtgctttctcgccatgggcgtgctgtgcagatctctggctgggttgggcggacttagtctgttgggagtgttctgcggagggtaccttatggccctggccgttctgtccccatgtccaccattggtgggtacttccgccggagttgtgctagtggtactgtcctgggtgctctgtctgggcgtgttctcatatgtgaaagttgcagcttcatctctgctacacggagggggacgccctgccctgcttgcggcaggcgtagcgatacaagtgggcagcctccttggagccgtggctatgttccctcctacaagcatctatcacgtcttccactctcgcaaggattgtgctgacccctgcgactcctag

SEQ ID NO: 224010 - DNA, 1074 bp, Artificial Sequence
  Description of Artificial Sequence: Synthetic coding sequence
atggtcgggacagccctgctggcttcactttggcaccatgtggcacccgtagcgggtcaactccactccgtggcatttctggccttggccttcgttctggccctcgcttgttgtgcctccaacgtgacttttctgccgtttctttcccatttacctccacgtttcttaaggagctttttcctggggcaggggctctcagctctacttccatgtgtgcttgctctggtgcagggggtgggcaggctggagtgccccccagcaccgataaatggaacgccgggaccacccctcgactttctggagcgttttccggcaagcacatttttttgggcccttacagcactgctcgtggcctctgctgccgcatttcagggactccttttgctgctcccccctcctccatcggttccgaccggggaactggggtctggactgcaggtcggggcaccaggggctgaggaggaggtggaagagagttctccactgcaggaacccccaagccaggccgctggtacaacccctggtccagaccctaaagcttaccaattgctgagtgcacgatctgcatgcctgttgggcctgctggcagcaaccaatgctttaaccaacggcgtgctgccagctgttcagagcttcagttgtctgccctatggcaggttagcctaccacctggcagtggtgttagggtccgcggctaatccactggcgtgtttcctcgccatgggcgtgctttgtaggtcactggcgggtcttggaggcctgtcactgctgggggtcttctgtgggggttatcttatggccctagcggtgttgagtccctgtcccccactggtcggcacttccgctggagttgttctggtagttctgtcctgggtcttatgtctcggagtgttttcgtacgtgaaggtcgccgcatcatctctcctgcatggaggcggacgaccagctctgctggcggcaggagtggcgattcaagtggggagcttacttggcgctgtcgctatgtttcccccaacgagtatttatcatgtgttccattcacgaaaggattgcgcggacccgtgtgattcatag

SEQ ID NO: 224011 - DNA, 1347 bp, Artificial Sequence
  Description of Artificial Sequence: Synthetic coding sequence
atggcagccccaaccctcggcagattagtactcactcaccttttggtcgctctattcggaatggggagctgggctgcagtgaacggtatttgggttgaactgcccgtcgtggtcaaggacctccccgagggttggtccctgccatcctacctctccgtggttgtagcgttgggtaatctgggtctgctggtagttacgctgtggcgccaattggctcctgggaaaggagaacaggtaccaatccaggttgttcaagtgctgagtgtggtcgggacagctttgttggctccactctggcaccacgtggccccagtcgccggtcagctccactctgtcgctttcttgacgttggcactggtgctggccatggcctgctgcactagcaatgtcacattccttccctttctgtcacacctgccacctccatttctccggtccttctttctgggtcaaggcttgtcagcactgctcccttgcgtgttggccctggtgcagggagtgggcaggctagagtgccccccagcaccaactaatgggacctcgggcccacctctggacttcccagagcgttttcctgccagcactttcttctgggcactgaccgcccttctggttacctcagctgcagccttccggggactgctgttacttctgccctcgctgcccagcgtcactactggtggatccggacctgagctgcagctggggtcccccggagctgaggaagaggaaaaggaagaagaggaggccctgcctctgcaggaaccaccttcccaggccgcaggtaccatcccaggaccagatccggaggctcatcagctgttcagcgcacacggtgcattcttgttagggctgatggcgtttactagcgctgtgacaaatggtgtgctaccatctgtgcagagtttttcttgccttccttatggacggttggcctatcacctggccgtggttttggggagtgctgccaaccctctagcctgctttcttgccatgggagtgctttgccggtctctagctggactagtcgggctgtctcttctcgggatgctttttggggcttaccttatggctcttgcaatcttatccccttgtccccctctggttggtacaacagccggtgtcgtcctcgtagttttgtcttgggtactctgtctgtgtgtcttttcctatgtgaaggtggcagcctcttctctgcttcacggcggaggaagaccagctttgctggctgctggtgtggccatccaggttggcagtctgttaggtgccggtgccatgttccctcccacgagcatctaccacgtgttccaatcccgcaaagactgcgtggatccatgtggtccctag

SEQ ID NO: 224012 - DNA, 1347 bp, Artificial Sequence
  Description of Artificial Sequence: Synthetic coding sequence
atggccgctcctacactgggaaggctcgtgttgactcatctgctcgtcgcgctctttggaatggggagctgggcggcagtgaacgggatttgggtcgagctgcccgtggtcgtgaaagatctgccagaagggtggtccttgccttcctacctgtcagtggttgtggcactggggaatctgggactcttggtagttaccctctggcgccagctcgcacccggaaaaggagaacaggttccaatacaggtggttcaagtcttaagcgtagtgggcacagccttactcgcaccactgtggcaccacgtggctcctgtcgcgggtcagctgcattccgtagcattcttgacacttgctctggtgcttgccatggcctgttgcacaagtaatgtgacatttctgccatttttatcacatttacctcccccttttttacgctcgtttttcctgggacagggattgtctgcgctgttaccatgcgtgctggcactggtgcagggtgttggtcggctggagtgccctccagcccctaccaacggtacctcgggaccccctctagacttccctgaaaggtttcccgcatccactttcttctgggcccttactgccctgttggtaacctccgccgcagcgtttcgaggacttctgttgctcctcccctctctcccaagcgtaactaccggaggttctggaccagagttacagcttggcagcccaggagccgaggaggaagagaaggaggaagaggaagccctacccttacaggaacccccatcccaagctgccggaactatccccggtcccgaccctgaagctcaccagcttttctccgcccatggggcattcctgttgggattgatggcgtttacttcggctgtgacaaacggcgttctgccttcagtgcagagcttctcctgtctgccatacggtcgtttagcctatcacctggctgtggtgctcgggtctgcggcaaatccccttgcctgttttttagcaatgggggtactgtgccgaagtctggccggtttggtcggacttagcctgctgggaatgctattcggcgcatatttgatggctctggccatcttgtctccatgtccgccactcgtcggaaccaccgcaggagtggtccttgttgtgttatcctgggttctgtgcctgtgtgtgtttagttatgtcaaggtcgcagcatcctctctgttacacggcggaggtagacccgctcttctcgccgcaggagtcgctattcaggtgggcagtctgctgggcgctggcgctatgttccctccaacatcgatctatcacgtcttccagagccgtaaggattgcgtggatccctgtggaccctag

SEQ ID NO: 224013 - DNA, 1053 bp, Artificial Sequence
  Description of Artificial Sequence: Synthetic coding sequence
atggccgcacccactttggggcgactggttttaacacacttactggttgctctttttggcatgggctcttgggccgcagtcaacgggatatgggtcgagctccctgtcgtcgtgaaagacttgccagagggatggtcgttaccctcttacctgagcgtggtcgtggcactcggcaacctgggcctgctagtggtaactctttggcgacagctagcgcctggtaagggggaacaggtgcccatacaggtagtccaggtgctgagtgtcgtcggtacagctttgctcgctcctttgtggcatcacgtggctcccgtggcaggacagctgcacagcgtggccttcctaacacttgcactggtgttggctatggcttgttgcacatccaacgtaacgtttttgccgttcctctcacacctgcctccaccattcctgcgcagcttttttctcggtcagggcctcagcgcgcttttgccttgtgtcttagccctagtgcagggtgtgggcagacttgaatgtccacctgcaccaaccaatggcaccagcggtcccccacttgacttcccggaaaggttcccagcgtctacctttttttgggctctgaccgcacttctggtgacgagcgctgcggctttccggggactgctcttactgttgccttctctcccctcggtaactactggaggctctgggcctgagttgcagctcggcagcccaggtgcggaagaggaggagaaggaggaggaagaggccctccctctccaggaaccaccaagtcaggcagctggtactattcccggtcctgaccccgaggctcatcagctcttttcagcacacggcgcttttttgctgggattgatggctttcacatccgcagtcaccaatggggtattaccaagtgtgcagtcgttctcttgtttgccttatgggagacttgcctaccaccttgccgtggttctggggtcggccgctaacccactagcctgttttctcgcaatgggtgtgctgtgccgatgctgtcggggttgctgcgtctgcgtttgctctcacatgtag

SEQ ID NO: 224014 - DNA, 1413 bp, Artificial Sequence
  Description of Artificial Sequence: Synthetic coding sequence
atgcctgcgcctctcctgttaataagtcggactctagggaactttatggtgctgtggagtacctgtaggaccactgtgtttaaaagcgttactaaccggtttatcaaaaacctggcgtgctccggaatttgcgcctcactggtgtgtgttccttttgatatcatcctgagcacatccccacattgctgttggtggatttataccatgttgttttgtaaagtggtcaagttcttgcacaaagtgttctgttccgtcaccatactgagttttcctgcgatagccttggacagatactactcagttttgtatcccctggagcgcaagatttccgacgctaaatctcgggagctcgtgatgtatatctgggcgcacgccgtcgtcgcttctgtgcccgtcttcgcagtgaccaatgtggccgatatctacgccacatcaacctgtaccgaggtgtggtcaaattctctgggtcatctggtctacgttctggtgtataatataactacagtcatcgtaccagtcgtggtggttttcctcttcctcatcctgatacgtcgcgctctcagtgcctcgcaaaagaagaaagtgattatcgctgcattgcgtacaccgcagaacaccatttctatcccctacgcgtcccagcgcgaagctgaattgcacgccactcttctcagcatggtgatggtgtttatcctttgctctgtgccatacgccacacttgtagtgtaccagactgtgctcaatgtacctgatacgagcgtattcttgttgctgaccgctgtctggctgcccaaggtctctttactagcaaacccggtgctgttcttgacagttaataaaagtgtgaggaagtgtctgattggcacgctggttcagctacatcatcgatattcaagaaggaacgtggtatcgacggggtcggggatggcggaggcttctctagagccatccattcggagcgggagccagttgctggagatgtttcacatcggccagcagcaaatatttaagccgactgaggatgaagaggagtctgaggccaagtatatcggtagtgccgactttcaagctaaagagatattctctacttgcctcgaaggcgagcaggggccacagtttgctccctctgccccaccgctatcgaccgtagactccgtgtcacaggtagcaccagccgctcctgtcgaaccggagacgttcccagataaatacagcctgcaatttggcttcggaccttttgagctgccccctcagtggctgagtgaaacccggaatagcaagaagagactcctgccaccccttggcaatacccccgaagaattaatccaaacaaaagtgccaaaagtgggacgggtcgaacgcaagatgtccagaaacaataaggtaagcatcttccccaaggtggacagctag

SEQ ID NO: 224015 - DNA, 1548 bp, Artificial Sequence
  Description of Artificial Sequence: Synthetic coding sequence
atgggccataacggatcgtggatctcccccaatgccagtgagccccacaacgcttctggggctgaggctgctggcgtgaaccggtctgccctaggagagtttggcgaagctcagctgtatcgccagtttactactactgttcaagtggttattttcatcggcagtttattggggaatttcatggttctctggagtacctgccggacaacggttttcaaaagtgtgacgaatcgatttatcaagaaccttgcatgtagtggcatctgcgcctccctggtttgcgttccctttgacatcatcctgtcaacttcaccccactgttgctggtggatttatacaatgctgttttgcaaagtcgtgaagtttctgcacaaagtgttttgctcagtaaccatcctgagtttcccggcaatcgccctggaccggtactattccgtactgtatcccctggagcgaaaaatttctgatgccaaaagccgcgaactggttatgtatatatgggcccacgcggtcgttgcctcagtgcccgtttttgctgttaccaatgtagcagacatatacgccactagcacttgcaccgaagtgtggtccaactccctgggccatctggtctatgtgttggtgtataatattaccaccgttatagtgcctgtcgtcgtagtcttcctttttctcattctgatcagaagggctctgtccgcttcccagaaaaaaaaagtaatcatcgccgctctgcggacgccccagaatactatctccattccatacgcatcccagcgcgaagctgagttacacgccactctcctctcaatggttatggtttttattttatgttcagtgccctacgctacattagtcgtgtatcagacagtcctgaatgtgccagacacttctgttttcctgctcttaaccgcggtctggctgcccaaagtgtccctcctggctaatccagtgctctttttgacagttaataagagcgtgcgcaaatgtctgatcggaaccctggtgcagctccaccaccggtatagtcgaagaaatgttgtcagcactggctcaggtatggcggaagccagtctggaacccagtatccgatccggttcccagttgttagaaatgttccatataggacaacagcagatctttaagcccacagaggatgaagaagagtcagaggcgaagtacattggatccgccgactttcaggccaaggaaatcttcagcacctgcttggagggcgagcagggaccgcagttcgccccatctgcgccaccactgtcgaccgttgacagtgttagtcaggtggcacccgctgctcccgtagagcccgagacttttccagacaagtatagcctgcaatttggcttcgggccattcgagctcccaccacagtggctcagtgaaacacgcaatagtaaaaaacggcttcttccaccactgggaaatacgccagaggagctgatccagactaaagtgcccaaggtcggtcgggtggagcggaagatgtcaaggaacaataaggtttctatctttccaaaagttgactcatag

SEQ ID NO: 224016 - DNA, 1548 bp, Artificial Sequence
  Description of Artificial Sequence: Synthetic coding sequence
atggggcataatggctcatggatctcacccaacgcctccgaaccacataacgcttccggtgccgaagcagccggagtgaacagaagtgcactcggtgaattcggtgaggcgcagctataccgccagttcactactacggtgcaggtggtgatatttatcggtagtctgctcgggaatttcatggtactctggagtacttgccgcactacagtgttcaagagtgtgacaaatcgcttcatcaaaaatctggcctgttctggcatttgcgccagcttggtatgtgtgcctttcgatattattctgagcacgagtccacattgttgttggtggatttacacaatgctgttttgcaaggttgtaaaattcctacataaggtgttctgcagcgtgacaatcctgtcttttcccgctattgcactggacagatactattctgtcttgtatcccctggaaaggaaaatcagcgacgccaagagtcgggagcttgtcatgtatatctgggcccatgctgtcgtggcttcagtgcctgtgtttgcagtgactaatgtcgccgacatatacgcaacttctacttgcacagaggtttggagcaactcgctcggccatcttgtgtacgtactcgtgtataatataaccaccgtgattgtgccagtggtggtggtcttcctctttctgatcctgattcgcagggcactgagtgcatcccagaaaaaaaaagtgataattgccgctcttagaactcctcagaataccatcagcattccttatgcttcccaaagggaagcagaattacatgcaactctgctttcaatggttatggtgtttattttgtgctccgtgccatacgctactcttgtagtctatcagacagtgttgaatgtgcccgacacttcagtgttccttctgctcaccgctgtctggctacctaaggtctcactcctggcaaatcctgtgctcttcctcacagtgaataagtctgtacggaaatgtctgattggtaccctggtgcagctacaccatagatatagtagaagaaatgtggtgtccaccggatccggcatggccgaggcatctttggaaccatcaattcgctccgggagccagttgctggagatgttccacataggacagcaacaaatttttaagccaaccgaagacgaggaagaatccgaggcgaagtacattggctcggcggatttccaggcaaaggagatcttcagtacttgcctggaaggcgagcagggccctcaatttgcaccttccgcccctcccctatccacagtggatagtgtgtcacaggtggctcccgcagcccctgtcgagccagagacttttccagacaagtatagcctgcagtttggattcggccctttcgagctgcccccacagtggttgagcgaaaccagaaactcaaagaaacgtctgcttccccctctggggaatacccccgaggaactgatccagaccaaagtgccaaaggtcggcagggtggaaaggaaaatgagtcgcaataacaaggtgtctatcttccctaaggtggatagctag

SEQ ID NO: 224017 - DNA, 996 bp, Artificial Sequence
  Description of Artificial Sequence: Synthetic coding sequence
atgatcaccctgaataatcaagatcagcccgtccctttcaactcctcccatcccgatgagtacaagattgccgctctcgtgttttattcttgtattttcatcattgggctgttcgtaaacattacagcactctgggttttcagttgcacaactaagaaacggaccactgtcaccatctacatgatgaatgtcgccctagtggacctgatctttattatgaccctgcctttccgaatgttctactacgccaaggatgagtggccattcggcgagtacttttgtcagatactgggggctctgaccgtattctatccttctattgccctttggttgctggcttttataagcgccgaccgttatatggccattgtacagcctaagtatgccaaggaattgaagaatacctgcaaagctgttctggcctgcgtaggcgtctggatcatgaccttaaccacaaccaccccgctccttctgctctataaagaccctgataaggattcaacacctgcaacttgcttaaaaatctcggatatcatctatctgaaagcagttaacgttttgaacctgacccgtttaacgttctttttcctcattcccctgtttatcatgattggttgctacctggtaataatccataatctcctacatgggcgtaccagtaagctgaaaccaaaggtgaaggaaaagtcaatcagaattattattacgctcctggtacaggtcctggtttgttttatgccctttcacatttgtttcgcgttcttaatgctcggaactggagaaaactcatacaatccttggggggcatttacaacctttcttatgaatttgtccacctgcctggatgtgatcctgtattacatcgtgagcaagcagtttcaggctcgtgtgattagcgtcatgttgtaccgtaattatctgcgctccatgcgcagaaaatcattcagaagcggcagcctcaggagccttagcaatatcaactcagaaatgttgtag

SEQ ID NO: 224018 - DNA, 996 bp, Artificial Sequence
  Description of Artificial Sequence: Synthetic coding sequence
atgatcaccttgaataaccaggaccagcccgtgcctttcaatagtagccaccctgatgagtataaaattgcagcactagtgttctactcgtgtatttttataatcggtctcttcgtgaatatcaccgccctgtgggtgttttcatgcaccacgaaaaagaggaccacggtaaccatttacatgatgaatgtcgctctcgtggacctgatatttattatgactctgccttttaggatgttctactatgctaaggacgagtggccttttggtgaatacttctgccagatattgggagctttaaccgtgttttacccctcaatagccttgtggctgctggccttcatatcagccgatagatatatggccattgtgcagcccaaatacgcgaaagagctcaaaaatacatgcaaagcagtactagcttgtgtcggagtctggattatgaccctcaccactaccacaccactgcttcttctgtacaaggacccagacaaggactccactcccgcaacgtgtcttaaaatctcagatattatttacctgaaagccgtaaacgtgttaaaccttactcggctcaccttcttcttcttgatccccctgttcatcatgattggctgttacctggtgatcatccacaatcttctccatggccgaacctcaaagttgaaacctaaagtgaaagagaagagtattcgaatcatcattacactgctcgttcaagtccttgtctgtttcatgccattccatatctgtttcgcttttcttatgctgggaacaggtgagaactcttataacccctggggcgcttttacaacctttctgatgaacttatctacctgtctcgacgttatcttatattacatagtctccaaacagttccaggctagagtgatcagcgttatgctgtatcggaattacctgcgctctatgcggaggaaatcctttaggtctgggagcctacgcagcctcagtaacataaatagtgaaatgttatag

SEQ ID NO: 224019 - DNA, 996 bp, Artificial Sequence
  Description of Artificial Sequence: Synthetic coding sequence
atgataactctgaacaaccaggatcaacctgtgccatttaactcatcccaccctgatgagtacaaaattgcggctctcgtgttttattcctgcatatttataatcgggctttttgtgaacattaccgccctctgggtgttttcttgtacaacaaagaagcggacaaccgtaactatatatatgatgaatgtcgcccttgtagacctgatttttatcatgacactcccctttcgtatgttttattatgctaaggacgagtggccctttggcgagtacttctgtcaaatcctgggggctctgactgtgttctatccgtcaatcgccctgtggctgctcgcttttatctctgcagatcgctacatggcaatcgtccagcccaagtacgcgaaagagctgaagaacacctgtaaggccgtcttggcctgcgttggcgtgtggatcatgactcttactaccacaactccactcctgttgctctacaaggaccccgacaaggacagcacaccggctacctgccttaagatcagtgacattatatatttaaaggccgtgaatgtcctaaacctgacccggttaacttttttctttctcatcccactctttatcatgatcggttgttacctcgttattatacacaacctactgcatggaagaacatccaaactgaagccaaaggtgaaagaaaagtctatcagaatcattataaccctgctggtgcaggtgctggtctgcttcatgcccttccatatctgttttgcattcttgatgcttggtaccggggaaaattcctataacccctggggtgccttcactacattcctcatgaacctatccacctgtctggacgtgatcctgtactacatcgtgtcgaaacagtttcaggcaagggtgatcagcgtcatgctctataggaattatctgcggtcgatgcgccgaaaatctttccggagcgggagtctgcgttcactgagcaacataaatagcgaaatgctgtag

SEQ ID NO: 224020 - DNA, 297 bp, Artificial Sequence
  Description of Artificial Sequence: Synthetic coding sequence
atgattactcttaacaaccaggatcagccagttccgttcaattcctctcatcccgacgagtacaagatagccgcactggtcttttacagttgcatcttcatcattggcttatttgtgaacataactgccctctgggtgttctcgtgtacaactaagaagcgtaccacagtcacaatctacatgatgaatgttgccttggtggacctgattttcattatgacgctccccttccgcatgttctactatgcaaaggatgaatggccgttcggggagtatttttgtcaaatcctgggttag

SEQ ID NO: 224021 - DNA, 1086 bp, Artificial Sequence
  Description of Artificial Sequence: Synthetic coding sequence
atggacattcagatggccaacaacttcacaccaccttcagcaaccccacaaggtaacgactgcgatttgtacgcacatcattccaccgctcgcatcgtcatgccgctccactactctctggtgtttataattgggctggtgggcaacctcctggctttagtcgtgatcgtccagaatagaaaaaaaattaatagcaccacactgtattctacgaacctcgtgatctctgacatcctgttcactaccgcactgcccacaaggatcgcttactacgcaatggggtttgactggcggatcggcgatgccctgtgccgcatcactgcattagtgttctatataaatacttacgcaggagtgaattttatgacatgcttaagtatcgataggtttatcgcggtcgtccaccccctgagatacaataagatcaagagaatcgagcatgcaaagggagtctgtatcttcgtgtggatcctggtgtttgctcagacgctaccattactgatcaaccctatgtccaaacaggaagccgaacgcattacctgcatggagtaccctaactttgaggagactaagagcctaccttggatcttgctgggcgcttgttttataggatatgtgctgccactgattattattttaatctgttatagtcagatctgctgtaagcttttcaggactgccaagcaaaacccacttacagagaagtccggtgtgaacaagaaggcactaaataccatcatcctgatcatagtagtgtttgtgctgtgtttcaccccttatcatgtggctattatccagcacatgataaaaaagttgaggttctccaacttcctagaatgtagccagcgccatagtttccaaatttctttgcatttcactgtctgcctgatgaatttcaactgctgcatggatccctttatctatttttttgcttgtaagggctataagcggaaagtgatgaggatgctcaaacgccaggtcagcgtgtccataagctctgctgtcaaatccgcccctgaggaaaattcaagggaaatgacagaaacgcagatgatgatccacagcaagtcttccaacggtaagtag

SEQ ID NO: 224022 - DNA, 1248 bp, Artificial Sequence
  Description of Artificial Sequence: Synthetic coding sequence
atggtcttcgcacataggatggacaatagtaagcctcaccttatcatccccacgctcctggttccgttacaaaatcggtcgtgtaccgaaacagccacccctctgccttcccagtacctgatggagctttccgaagaacactcttggatgagcaaccaaacagaccttcactacgttttgaaaccaggggaggtggccacggcatctattttttttgggatcctgtggctcttctccattttcgggaattcattggtctgtctggtgattcaccggtcacgacggactcagagtacgacaaactatttcgtggtgtccatggcttgtgccgatttattaatctccgttgctagcacaccgttcgtcctactgcaattcacaacaggacggtggacactgggtagtgctacctgcaaagtggtccggtacttccagtatctaacccctggggttcagatttacgttttgctgtccatttgcatcgatcgcttttacaccatcgtgtaccccctctcattcaaggtgtctagagagaaggctaagaagatgattgcagcctcatgggtctttgacgccggtttcgtgacccctgtgctgtttttctatggctctaattgggatagccattgtaattactttttgcctagttcgtgggaagggaccgcctataccgttattcattttcttgtgggctttgtcatcccttccgttctgattattctgttttaccagaaagttatcaagtatatttggcgaattggtactgatggccgtacagtacggcgaaccatgaatattgttccgagaacaaaagtgaagacaatcaaaatgtttctgattttaaaccttctgtttctcctgtcttggttgcccttccacgtcgcacagctatggcacccccacgagcaggactacaagaagtcctccctcgtattcaccgccatcacttggataagcttctcgtcgagtgcctctaagcctacactttacagtatttataacgccaacttccgtagggggatgaaggaaactttttgcatgtcaagtatgaagtgttatcgcagcaacgcgtatacgataacaacttcctcacggatggctaagaagaattacgttggcatttctgagattccgagtatggctaaaacaatcacaaaagatagtatctacgattccttcgatagagaggcaaaagagaaaaaattagcttggccaattaatagcaatcccccaaacacattcgtatag

SEQ ID NO: 224023 - DNA, 1248 bp, Artificial Sequence
  Description of Artificial Sequence: Synthetic coding sequence
atggtgtttgcccaccgcatggacaactcaaaaccacacctgattatacctacactcttggtgcccctgcagaatagatcgtgcaccgaaaccgctactcccctgcccagccagtatctgatggagttgagcgaggaacattcctggatgtccaatcaaactgatctccactacgtgctcaagcccggtgaggtggccacagcttccatttttttcggcatcttatggctgttcagcatctttggaaatagcctggtctgccttgtcattcatagatcaagacggactcagtcgaccactaactacttcgttgtctctatggcatgcgccgacctgttgatcagtgtcgcctccacaccattcgtgctcttgcagttcacaacaggacgttggactctcggttcagccacctgtaaagttgtccggtacttccagtatttgactcctggcgttcagatatatgtgctgctaagtatttgtatcgatcggttctatactattgtctacccactgtcctttaaggtgagcagggaaaaagcgaaaaagatgattgccgcttcatgggtgtttgacgccggattcgtaacaccagtgctcttcttttacggatctaattgggactcccactgcaattacttcttgccttcaagttgggaggggaccgcttacacagttatccattttctagtgggatttgtcatcccctccgtgctgattatcctcttttaccagaaggtgattaagtacatatggagaataggcactgacgggagaactgtgaggcgaacaatgaatattgtcccccgaactaaggtcaaaaccattaaaatgttcttgattctgaatctcctgttcctgctctcatggctcccctttcacgtggcgcaactgtggcatccccacgagcaagactacaaaaaaagttcattagtgtttacagccattacatggattagcttctcaagcagcgcttcaaagccaactttgtatagcatttataatgctaatttccgtcgaggtatgaaagagactttctgtatgtcttcaatgaaatgttaccgctcgaatgcctacaccatcacaactagctctcgcatggcaaagaagaattatgtgggtattagcgaaattccttcaatggcgaagaccattactaaagactcaatatacgactcattcgacagagaggccaaagagaagaagctggcctggcctatcaactcaaatcctcctaatacatttgtgtag

SEQ ID NO: 224024 - DNA, 180 bp, Artificial Sequence
  Description of Artificial Sequence: Synthetic coding sequence
atggtatttgctcaccggatggacaattctaaacctcatctgattattcccacattgctagtcccattacagaatcgaagttgtactgagaccgcgacacccctcccatcccagtacttgatggagctgtcagaagaacactcctggatgtcgaatcagacggacttacactatgtgtag

SEQ ID NO: 224025 - DNA, 1077 bp, Artificial Sequence
  Description of Artificial Sequence: Synthetic coding sequence
atgccctccgtgtctcctgctgggccttctgcaggtgctgttccgaacgccactgccgtgaccaccgtgaggacaaacgcctctggactggaggttcctctgtttcatttgtttgcccgactggatgaggagctgcacggcacttttcccggactgtggctggcacttatggctgtgcacggggctatcttcctggcgggactggttctgaatggcctggccctgtacgtgttctgttgccgcactcgcgcaaaaaccccctcagttatttacaccatcaatcttgtggtgacagaccttcttgtcgggttgagcctcccaacaagatttgcagtatattacggagcacggggatgcctacgctgtgcatttccacacgtcctgggttacttcctcaacatgcattgcagcatcttgttcctcacctgcatttgcgtcgacagatacctggccattgtgcgccctgagggatcccgcaggtgcaggcagcccgcatgcgcacgggctgtatgcgccttcgtttggctcgcggcaggagcagtgacgctgagcgtactgggagtaacaggcagccggccttgttgccgtgtgtttgctttaactgtcctggagtttctcttgccactgttagttatttccgtgtttacaggcagaattatgtgcgctttatcccgcccaggtctgctccatcagggcagacaaaggagagtacgagccatgcagttactgctgacagtgctgatcattttcctggtgtgcttcaccccctttcacgcacgacaagtcgccgtagcactctggcccgacatgcctcaccacacctcactagtagtgtaccacgtggccgtcactctttccagtctgaattcctgtatggaccctatagtatattgttttgttacctctggatttcaagccacagtgagagggctcttcggccagcacggcgaaagggaaccctcctccggggatgttgtcagcatgcaccgctcatcaaaaggtagcggacgacaccatatcctttctgctggccctcacgctctaacacaggccctggctaacggccctgaggcctag

SEQ ID NO: 224026 - DNA, 1050 bp, Artificial Sequence
  Description of Artificial Sequence: Synthetic coding sequence
atgaactctaccctcgacgggaatcaaagcagtcaccccttctgtctgcttgcgtttggatacctggagaccgtgaacttttgcctgctggaggtgctcataatcgtcttcttgacagttctgatcatctcaggaaacatcatcgtcatattcgtgtttcattgcgcccctttattgaaccaccatacgacgtcttactttatacagaccatggcctacgccgacctctttgtcggggtcagctgcgtcgttcctagtctatcactactgcatcaccccctccctgtggaagagagtctaacctgccagatattcggattcgtggtaagcgtcctcaagtcagttagcatggcgtctcttgcttgtatttcaattgaccggtatatcgccattaccaagccattgacctacaacacattggttacaccttggcgattaaggctctgcattttcctcatttggttatattctacactcgtctttctgccttcattttttcattggggtaaaccagggtatcacggcgacgtcttccagtggtgcgcagaatcttggcacacagattcttactttaccctcttcattgtcatgatgctttacgcccctgccgctcttattgtgtgtttcacatatttcaatatcttccgcatttgccagcagcatactaaggacattagtgaaagacaagccagattttcctcacagtcgggggagacgggcgaggtacaggcctgccccgacaagagatacgctatggtattgttccggatcactagtgtattctacattttgtggttaccctatatcatctatttccttctggaatcgagcacgggccactcaaaccgatttgcttcgtttctaacaacctggctggctatttcgaattctttttgtaactgcgtaatttactccctatccaatagcgtattccaaaggggcctgaaaagactctctggggctatgtgtaccagttgtgcaagtcagactaccgccaacgacccatatacagtgcgttcaaagggaccgctaaatggttgtcacatctag

SEQ ID NO: 224027 - DNA, 753 bp, Artificial Sequence
  Description of Artificial Sequence: Synthetic coding sequence
atgaattccacgttggacggcaaccagtctagccacccgttctgtctcctggcctttgggtacctggaaacggtgaacttctgtttgctggaggtgttgataatcgtgtttctgaccgtcttgatcatttcaggcaacatcattgtaatatttgtgtttcactgcgccccattactgaatcatcataccacttcttattttatccagaccatggcctacgccgacctgttcgtgggagtgtcgtgcgtagttccgtctctatcactgctccatcacccgctgcctgtggaggagtccttgacgtgtcaaatttttgggttcgttgtaagtgtattaaagtccgtgagtatggcctcccttgcatgtatctctatcgaccgctacatagccataactaagccactgacctacaacactctcgtcacaccctggaggctgcgactgtgtatatttctcatctggctgtattccactttagttttcctgcccagtttctttcactgggggaaaccaggataccatggggacgtgttccagtggtgcgctgaaagttggcataccgacagctacttcactctctttatcgtcatgatgctatacgcgccagccgctcttattgtgtgtttcacctattttaacatcttccgaatctgtcagcagcatacaaaagatatctcagagaggcaggcacgcttcagttcacaaagtggagagacaggagaggtgcaggcctgccctgtaagcaaccactag

SEQ ID NO: 224028 - DNA, 1302 bp, Artificial Sequence
  Description of Artificial Sequence: Synthetic coding sequence
atgtgcttctccccaattctagagatcaatatgcagtctgaaagtaacatcacagttagggatgacattgacgacattaacacaaacatgtatcaacctctgtcataccccttgtcttttcaggtgtccctgaccggctttctgatgctggaaatcgttcttggtcttgggtctaaccttacagtactagtcctgtactgcatgaagtccaacctcatcaattctgtgtccaacattattaccatgaatttgcatgtgctggacgttataatctgtgtagggtgcatccctctaacgattgtcatcctcctgctcagcttagagtctaacaccgcactcatttgctgttttcacgaagcgtgtgtgagtttcgcatccgtatcgactgccattaacgtcttcgccatcaccttggatcgctacgatatctctgtgaagcctgcgaaccgtatcttgaccatggggcgagctgtgatgcttatgatctccatttggatattttcctttttctcgttcctgatcccctttatcgaggtcaacttcttcagtctgcagtctgggaacacctgggagaacaagacgctgctgtgtgtttctactaatgaatattatacggaactgggcatgtattatcacctgcttgtgcagatcccaatttttttcttcacggtggtagtgatgctcattacttacaccaagattttacaggcattgaatattagaattgggactcgattctccactggtcaaaagaaaaaagccagaaaaaaaaagacaatcagtttaactactcagcacgaggccaccgatatgtcacaatctagcgggggaagaaacgtggtctttggggtgcgcacgagcgtctccgttatcatagctctgcgacgagctgtaaaaagacatagggaacgacgagagcgtcagaagcgggtctttcgaatgtctctgctgataatttcaacatttctgctttgctggacccctatatccgtcttaaatacaaccattctgtgtctgggacccagtgacctcctcgtaaaactgcgactgtgctttctcgtaatggcatacggtactaccatcttccatccgctgttgtatgcttttactaggcaaaaattccagaaggtcctgaagagcaaaatgaagaagcgtgtcgtgagtatcgttgaggccgatccactgccgaataacgccgtcatccacaatagttggattgacccaaagagaaataaaaaaatcaccttcgaggatagcgagatccgggagaagtgcctggtgccacaagtcgtcacggactag

SEQ ID NO: 224029 - DNA, 1086 bp, Artificial Sequence
  Description of Artificial Sequence: Synthetic coding sequence
atggctcccactgagccctggtcgccctcccctggctctgccccttgggactacagcggacttgacggcctcgaggagctagaactctgcccagccggagaccttccgtacggatacgtgtatatccccgcattgtatctcgccgcattcgcggttggactgctgggcaacgcttttgtggtgtggttactggccggtaggagagggccacgtaggctcgtggacacgttcgtcctccacttggcagccgcagatttaggcttcgtgcttacactgccactgtgggccgctgccgcagctctgggaggaaggtggccattcggggatgggctatgtaaactaagctcgttcgctctagctggcaccaggtgtgctggagctttactccttgcaggaatgtccgtcgatcggtacttggcagttgttaagctgctggaagccagaccgttgcggactcctcgatgcgcattggcatcatgctgcggcgtctgggcagtggccctcctagccggtcttcccagcctcgtttatcggggtctgcagccgctcccagggggacaggattcacagtgtggtgaagagccctcccatgcctttcaggggctctctcttttgctacttctcctgacctttgtgttgcccctggtcgtgactctcttttgctactgcaggatcagtcgtaggctcaggagaccaccacacgtaggacgcgctcggaggaattctctcaggatcatattcgcgatcgaatcaacattcgtgggctcatggttgcctttttcagctctgagagctgtattccatctagctaggttgggagccctgcccctgccatgtccgctgctcctagcactgcgctggggcttgactatcgccacgtgcctggcatttgtcaatagttgcgccaaccctcttatctatttgttgttggaccgatcgttccgcgctagggctctcgatggagcctgtgggaggaccggtcggctagccagacgcatcagtagcgcttcatctctgagtagagatgattcttctgtatttaggtgtcgggctcaggcggcaaatacagctagcgccagctggtag

SEQ ID NO: 224030 - DNA, 1014 bp, Artificial Sequence
  Description of Artificial Sequence: Synthetic coding sequence
atgaactcatgggatgctggactggccggtctgctggtgggtaccatgggagtgtccttactgtccaatgcattggtcctgctctgtttgctccacagcgccgatattcgcaggcaagctccggcactctttaccttgaatttaacgtgcggcaatctcctctgcactgttgtgaacatgcccctcaccttggctggcgtcgtggcccagagacaacccgctggagataggctgtgtcggctggctgcctttctggacaccttccttgctgccaacagcatgctgtcaatggcagccctgtccatagatagatgggtggccgttgtcttccctttaagctaccgcgctaagatgcgccttagggacgctgcgctaatggtcgcctacacgtggttacatgctctgactttcccggcagcagcactcgcgctttcctggctaggcttccaccagctgtacgcttcctgtacgctgtgttcaagacgaccagatgagcgcctgagattcgcagtgttcaccggtgcgtttcacgcgttatctttcctgctgagcttcgtagtcctatgctgcacttacttgaaagtgttaaaagtggcccgtttccactgtaagcggatagatgtgattacaatgcagactttggtactgttagttgatttacacccctctgtgagggagcggtgcctggaggagcaaaagcggcgtaggcaaagggctacgaagaagattagcactttcattggtactttcctggtgtgcttcgccccatatgttatcaccagactggtggagctttttagcacagtgcccatagggtcccactggggagtgctgagcaagtgtctcgcatacagcaaggcagcatcagatcccttcgtgtacagtctgctgcgccatcagtataggaaatcttgcaaggaaatcttgaaccgcctgctgcaccgcaggtcaatacactcgagcggacttacaggggactcccactctcagaacatccttcccgtctctgaatag

SEQ ID NO: 224031 - DNA, 1128 bp, Artificial Sequence
  Description of Artificial Sequence: Synthetic coding sequence
atggcgaatgcttctgagcctggcggatccgggggaggcgaggcagctgctttggggctcaaattagccaccctgagcctgttgctttgtgtctcccttgctggtaacgtgctgttcgccctgctgatcgtacgcgagagatcactgcatcgggctccttattatcttctgctggacctctgcctggccgacggactgcgggctttggcctgtctgcccgctgtcatgctcgctgcacgccgtgcagctgctgcagcaggcgctccacctggggctcttggctgtaagttgctggcctttctggctgccctgttttgcttccacgcggctttcctgttactgggcgtgggcgtgacgcgctatttggccatagcacaccaccgtttctacgctgagcggctggccggttggccctgcgccgcaatgctggtgtgcgcagcttgggccctagcgctggccgctgctttcccacctgttttagatggaggcggagatgacgaagacgccccttgtgcacttgaacagcgcccagatggcgctcctggcgcactggggtttttacttctgctggccgtggtggtcggtgcgacccacctggtttacctccggctgctattcttcattcatgaccgtagaaagatgcgaccagccagactggtcccagccgtctcccacgattggacatttcacgggcctggggctacaggacaagccgctgctaattggactgccggattcggcagggggcctacaccaccagcactagtgggaatcaggccagccggtccaggtaggggcgctcgaaggcttttggtgctggaggagtttaaaaccgagaagaggctttgtaagatgttttatgcggtcacacttctgttcctgcttttatgggggccttacgtggtggccagctaccttcgagtcttagtcaggcctggagccgtaccccaagcttaccttactgcgagtgtgtggctgacttttgcacaggcaggtatcaatcctgtcgtctgcttcctgttcaatcgggaactgcgcgattgcttcagggcccagtttccctgttgtcaatcaccaaggaccacacaggctacccacccctgcgaccttaaggggatcggcctatag

SEQ ID NO: 224032 - DNA, 993 bp, Artificial Sequence
  Description of Artificial Sequence: Synthetic coding sequence
atgatgtggggtgcagggtcgcctctggcctggttgagcgccggatctggcaacgtgaacgtgtctagcgtgggtcctgcggagggacccaccgggccagctgcccctctgcccagccccaaggcgtgggacgtcgtgttatgcatttccggcacactggtgtcatgcgaaaacgcacttgtggtggcgattatcgtgggcacgcctgccttccgggctcccatgttcttgttggttggctctctggccgtggccgatctgttggctggactcggtcttgtgctccacttcgcagccgtgttctgcattggcagcgccgagatgtccctggtcctggtcggagtgctagccatggccttcactgcatcaataggaagcctcctcgcgataaccgtggatagatacctctctctctataacgcactcacctactatagcgagacaacggtcactaggacatatgtgatgctcgctcttgtttggggtggggctctgggcctcggattactgccagtcctggcctggaactgtctcgatggcctgacgacatgtggcgtggtttaccccttgtctaagaatcatttggttgtattggccatcgccttcttcatggtctttggaattatgctgcagctgtatgcgcagatctgcaggatcgtgtgtagacacgcacagcaaatagccctgcagaggcacctgcttcctgcctcacattatgttgctacaagaaaaggtatcgcgacccttgccgtggtccttggagccttcgcggcttgctggctaccatttactgtgtactgcctccttggagacgcgcacagcccccctctttatacgtatctcaccctactgcctgcaacttataatagcatgatcaaccccatcatttacgcgttccgaaatcaggacgtgcagaaagtcttatgggccgtttgttgttgttgtagcagtagtaagattccattcaggagcaggagcccttccgacgtgtag

SEQ ID NO: 224033 - DNA, 960 bp, Artificial Sequence
  Description of Artificial Sequence: Synthetic coding sequence
atgccttttcccaactgtagcgcaccttccactgtggtcgccaccgctgtgggagtgctgctgggactagaatgcggactgggcttattggggaacgcggtcgccctttggacctttttgtttcgggtaagggtgtggaagccatacgccgtctatctcttgaatctcgcgctggccgacctcctgctggctgcgtgtttgccgtttctcgctgcattctacttgagtctccaggcttggcacttggggagggttgggtgttgggcactacacttcttactggatcttagtcgatcggtagggatggcctttttggccgctgtggccctggatcggtatctgagggtggtgcacccccgactgaaggtgaatctcctttccccccaggcagccctgggtgtgtcaggtctcgtatggctcttaatggtggctctgacttgtccaggcctgctgatttccgaggcagcccagaacagcacccggtgccactccttttacagcagggccgatgggagtttctcgatcatctggcaggaggcgttgagttgcctacagttcgtcctgccctttggcttgatagttttctgtaatgccggaatcataagagcccttcaaaaacggctgagggaaccagagaaacagcctaagcttcagcgcgcacaggcactagtaacattagtggtggtgctgttcgccctctgcttcctaccctgtttcctggccagggtcctgatgcacattttccagaaccttggctcatgccgtgccctgtgcgcagttgcacatactagcgatgtcactggctccctgacatatctgcattcagtgctaaacccggttgtctattgtttttctagcccaaccttcaggtcaagctaccgcagggtatttcatacccttaggggtaaaggccaggcagccgagcctccagatttcaatccccgtgactcttattcctag

SEQ ID NO: 224034 - DNA, 1071 bp, Artificial Sequence
  Description of Artificial Sequence: Synthetic coding sequence
atgaatggcgtctccgagggaacaagaggctgctccgatcgtcagcccggagttctgacacgcgaccggtcctgttctaggaaaatgaatagcagcggctgtctctctgaggaggtgggatccctgcgcccactgactgtggttatactgtcagcttccattgtggtaggagtcttagggaatgggctcgtgctgtggatgacagtcttccgcatggccaggaccgtaagcaccgtttgtttctttcaccttgctcttgcagattttatgctctccctcagtttacctatcgctatgtactacattgtttcgcgccagtggctactaggcgaatgggcatgcaagctctatataactttcgtgtttttgtcttattttgcaagcaactgcttactcgtgttcatttccgtcgacaggtgcatcagtgtgctgtacccagtttgggcattgaaccataggaccgtgcaacgggcatcatggctggcattcggagtatggctgcttgctgctgctctgtgcagcgcgcatctaaagtttagaactactcgaaaatggaacggatgcacccattgttacctagccttcaattccgacaacgagacagctcagatctggattgaaggagtagtggagggacacatcatcggtacaatagggcatttcctgctaggattcctcggccctctcgcgataattggcacttgcgctcatctcatacgggctaagctgctcagggagggctgggttcatgccaataggcctaagagattactgctcgttttagtatccgccttctttatcttttggtcccccttcaatgtcgttctgctggtacacttatggagacgggttatgttgaaggagatctatcatccccgtatgctgctcatcctgcaggcgagcttcgctcttggctgtgtgaatagttcgctgaacccattcttgtacgtgttcgtggggcgagattttcaggaaaagtttttccagtccctgacgagcgctctcgccagagcctttggggaggaggaatttctctcctcatgcccaaggggtaacgccccacgggagtag

SEQ ID NO: 224035 - DNA, 1146 bp, Artificial Sequence
  Description of Artificial Sequence: Synthetic coding sequence
atgaggtcacacaccatcactatgactacgaccagtgtcagttcttggccctactcgtctcaccgtatgaggttcattacaaaccattccgaccaaccccctcagaacttcagcgcaacaccaaacgtaacgacttgtcctatggacgagaagctcctctcaaccgtcctgactacatcctactctgtgatctttatcgtcggacttgtggggaacattattgccttgtacgtgtttctgggtattcataggaaacgtaattctatccaaatctatctgctcaatgtcgctattgccgacctgctcctcatcttttgcctgccgtttcggataatgtaccacattaaccaaaataagtggacgttgggcgtcatactgtgtaaagtagtaggtacacttttctacatgaacatgtacattagtatcatcctccttggtttcatctctctagataggtacatcaagatcaaccgctcaatccagcaacggaaagccatcacaacaaagcagtctatatacgtctgctgcatcgtttggatgctcgccctcggcggtttcctgacaatgatcattcttaccctgaagaagggagggcacaattcaaccatgtgctttcactaccgggacaagcataacgccaagggcgaggcaattttcaattttatcctcgttgtaatgttctggctgatctttctgctaataattctatcgtacattaagatcgggaagaacctcctccggatttccaagaggcgctcaaaatttcctaattccgggaaatacgccacaactgctaggaatagtttcatcgtgcttatcattttcactatttgttttgtgccttatcacgcttttcggttcatttacataagcagccagctgaatgtgtcaagctgctattggaaggaaatcgtccacaagacaaatgaaatcatgctggttttaagctccttcaattcctgtttggaccccgttatgtatttcctgatgtcatctaatatcaggaagataatgtgccagcttctcttcaggcgatttcagggcgagccaagcaggagtgagagcactagcgagtttaagccgggatacagcctccatgacactagcgtggccgtgaagattcagtccagctctaagtccacttag

SEQ ID NO: 224036 - DNA, 1146 bp, Artificial Sequence
  Description of Artificial Sequence: Synthetic coding sequence
atgaggagccataccattactatgaccaccacctccgtgagctcctggccttactcttcccatagaatgcgcttcataactaatcactcagatcagccaccccagaatttctctgcgacccctaatgtgacgacctgtcctatggatgaaaagttgttgtcaaccgtgctcactacttcatatagtgtcatttttattgtcggattggtcggaaatataatagccttgtacgtttttctgggtatacaccgaaagaggaactccattcagatttatctgctgaacgtggctatcgctgacctgctgttgatcttttgtctgcccttccgaatcatgtaccatatcaatcaaaacaaatggaccctgggcgtgattctttgtaaagtggtgggcactctgttttacatgaacatgtatatttccatcatcctgctggggtttatcagtcttgacagatacatcaagatcaacagaagtatccagcagcggaaggccatcaccacaaagcaatccatctatgtgtgttgcatcgtttggatgctagccttagggggattcctgaccatgataatattaacactaaaaaaggggggacacaactctacaatgtgctttcactatagagacaaacacaacgctaagggagaagcgatattcaatttcatcctcgtggttatgttttggctgatcttcctgctaattatactgagttacatcaaaattggaaagaatctgctgcgcatctctaaacggagaagcaaatttcccaattctggtaagtatgcaaccacagccaggaactccttcatcgttttaattatttttaccatctgtttcgtcccttatcacgcatttcgatttatttacatcagttcccagctgaacgtgagctcatgctactggaaggagatcgtacataagaccaacgaaataatgctggtgcttagcagctttaattcctgccttgaccccgtgatgtattttctgatgtccagcaacattaggaaaatcatgtgtcagttgttatttcgcaggttccagggagaaccttcaagatccgagagcacctccgagtttaagccgggttactccctgcatgatactagcgtggctgttaagattcaaagctcctccaagtctacttag

SEQ ID NO: 224037 - DNA, 1005 bp, Artificial Sequence
  Description of Artificial Sequence: Synthetic coding sequence
atggatgaaaagctcctgtccacagtgctgacaacgagctatagcgtgatcttcatagttgggctcgtgggcaacatcatcgcgttatatgtattcctcggtattcataggaaacgcaattcaattcagatatacctcctgaatgtggctatcgcagatttgctgttgatcttttgtttaccttttcgaatcatgtatcacatcaaccaaaataagtggaccttgggagtcatcctgtgtaaagttgttggtactcttttctacatgaatatgtacattagcatcattctgctgggcttcatcagcctggacaggtatatcaagatcaaccggtctatacagcagcgtaaggctattaccaccaagcagtccatctacgtttgctgcatcgtgtggatgctcgccctgggcggattcctcactatgatcattctgacccttaagaaggggggtcacaactcaaccatgtgcttccattacagagataagcataacgccaaaggcgaagctattttcaactttatcctggtggttatgttctggttaatctttctgctcatcattctgagctatatcaagatcggaaaaaacctgctccgcatttcaaagagaagaagcaaatttccgaatagcgggaaatacgccactacggctcgaaacagtttcatcgtcctgatcatcttcactatatgttttgtgccttaccacgcgtttagatttatatacatatcttcacaattgaacgtcagctcttgctattggaaagagatagtacacaagacgaatgagatcatgctagtcctttcttcttttaacagttgcctagatccagtaatgtattttctcatgagcagcaatatacgcaaaattatgtgccaactcctctttaggcggttccagggtgaaccatcaagaagtgaatccacatcagaattcaaacctggctactcgctgcacgatacatcggtcgctgtgaaaatacagtcatcaagcaagagcacctag

SEQ ID NO: 224038 - DNA, 930 bp, Artificial Sequence
  Description of Artificial Sequence: Synthetic coding sequence
atgaatgggacatataatacctgcgggagttctgatctgacatggcccccagcaataaagctagggttctacgcttatctcggcgtacttctggtgttgggcctcctgctcaacagtctggccctctgggtgttctgttgcagaatgcagcaatggacagagacacgaatctacatgaccaacttggccgtagcagacctctgcctcctctgcacccttcctttcgttctccatagcttacgcgacacatccgacacacctttatgtcagctcagccaaggtatctacctgaccaaccgttacatgtctattagtctggtcacggccatcgccgttgaccggtatgtcgcagtgaggcatccgttgcgcgcaaggggattgaggagccccaggcaagcagcagctgtgtgtgcagtcctgtgggtgctagttataggatctctggtggccaggtggcttctcgggattcaggaaggagggttttgttttcgcagcacgagacataacttcaactccatggcttttcctttactaggcttctacctgcccctcgccgttgtggttttctgctccttgaaggtggttaccgcccttgctcagagaccgcctaccgatgttggacaggccgaagccacacgcaaggctgcacggatggtctgggccaatcttctggtatttgttgtctgtttcttgcccttgcacgtgggtttgaccgtgagactcgccgtgggttggaacgcttgcgccttgctcgagactatacgccgtgccttgtacatcacatccaagctttcagatgctaattgttgccttgacgccatttgctattactatatggccaaggaattccaggaagcgtccgcactggcggtggctccctcagcaaaagcacacaagagtcaggatagtttgtgtgtgacactggcatag

SEQ ID NO: 224039 - DNA, 930 bp, Artificial Sequence
  Description of Artificial Sequence: Synthetic coding sequence
atgaatggaacctataatacatgtggcagctccgacctgacttggccaccagcgattaaattaggtttctacgcctatcttggggtgctgctggtgttgggtctgctgcttaacagcctggccctgtgggttttctgctgtcgtatgcagcagtggaccgaaacccgaatttatatgaccaatctggccgtcgctgacctgtgcttactatgtacgctaccatttgtgctccacagccttcgggatacttcagataccccactctgtcagctctctcagggaatctatctgaccaaccgctacatgagcatatccctcgttacagcaattgctgtcgacaggtatgtggccgtgaggcaccctctcagggccaggggactacgtagccccagacaggctgcagctgtatgcgcagtactgtgggttcttgtcattggtagccttgtggccaggtggctcttaggcattcaagagggcggtttttgttttcggtctaccagacacaacttcaattcaatggcgttccccctgttgggattttacctgcctttggctgtcgtggtgttctgcagtctgaaggtcgtcaccgccctagcccagaggccacccaccgacgtggggcaagctgaagccactcggaaagcagccagaatggtctgggctaatctgctggtgttcgtagtgtgcttcctgccactgcacgtcggcctgacagtccgcttagccgtgggatggaacgcatgcgccctgctggagaccatcagacgcgctctgtatatcacaagcaaattatccgatgcgaattgttgtctcgacgcaatttgctactattacatggccaaggagttccaagaggcctccgccctcgcagtggcacctagcgcaaaggcacataagagtcaggactctctgtgcgtcacgttagcatag

SEQ ID NO: 224040 - DNA, 930 bp, Artificial Sequence
  Description of Artificial Sequence: Synthetic coding sequence
atgaacgggacatataacacatgtgggtcatctgacctgacatggcccccagccatcaaattagggttctatgcctacttgggtgtactgctcgtactgggcctgttgctgaattcactggccttgtgggtattttgttgtcggatgcagcaatggacagagacccgcatctatatgacaaacctagcagtcgccgacctctgcctgctgtgcacactgcccttcgttctccacagcctgagagatacatctgatactccgctgtgccagctatctcagggtatttacctcaccaaccggtacatgagtatctccctggtaaccgccatcgctgtagaccgttatgtggccgtgagacatcccttgcgagcccgaggactgaggtcccctcgccaagccgctgctgtgtgcgctgtcctgtgggtcttagtgattggctccctcgttgccagatggctgctaggaatccaagagggcggattctgtttccgctcaactcgccacaacttcaatagcatggctttccccctcttggggttctacttgcccctggctgtggtggtcttttgctccctaaaggtggtaacagcactggcacagcgcccacccaccgacgtgggacaggctgaggcaaccaggaaggccgcacgcatggtgtgggcaaatctcttggtattcgttgtgtgtttcctacctctgcacgtaggactaaccgtgcggttagcagtgggttggaatgcatgcgctttgctcgagaccataagacgggcactctatataactagcaagttgagcgacgctaattgctgtctggatgccatttgctactactacatggcaaaagaattccaggaggcctcagcattggcagtggccccatccgccaaagctcataagtcccaggattcactgtgtgttactctggcatag

SEQ ID NO: 224041 - DNA, 930 bp, Artificial Sequence
  Description of Artificial Sequence: Synthetic coding sequence
atgaacggaacttacaacacgtgtgggtccagcgacctgacgtggcccccagctatcaagctgggattttatgcctatctgggcgtgttattagtgttaggtcttctcttgaatagcctagccctgtgggtgttttgctgtcgcatgcagcagtggactgagacgcgcatttatatgacaaacctggctgtggccgacctttgcttgctgtgtactctcccattcgtgctgcactctctgagggacaccagtgacacacccctttgccagctgagtcaaggtatctatttaaccaatagatacatgagcatcagcctcgtaactgccatagccgtggatagatatgtcgcagtgcggcaccccctgagagctcgagggctcaggagccctcggcaagccgcagcagtgtgtgcggtgctctgggtcctggtaataggcagcctcgtcgctcggtggttgttaggcattcaggagggaggcttctgtttccgctcaacaaggcataactttaactcaatggccttccctcttctcggcttctaccttcctctcgctgtagtggtgttctgttcactgaaagttgtaaccgccctcgcacagcggccaccaacagatgtgggccaggcagaagcgacaaggaaggctgcgcgtatggtctgggccaacctactggtcttcgtagtgtgttttctaccccttcatgtaggactgactgtgcggttagccgtagggtggaacgcctgtgcactgcttgagacaatacgcagggccctctatatcacctcgaaactgtctgatgcaaactgctgcctcgatgccatttgctattattacatggccaaggaattccaggaggcaagcgcgctggcagtggcgcctagcgcaaaggctcataagagtcaggattccttgtgcgtgaccctcgcctag

SEQ ID NO: 224042 - DNA, 1023 bp, Artificial Sequence
  Description of Artificial Sequence: Synthetic coding sequence
atgctgtctgggtcccgtgcggtccctacaccacaccggggttccgaggaactgcttaagtatatgcttcattcaccttgtgtctctctaactatgaacggcacctataatacatgtggcagctcggacctgacgtggccccctgctattaagctgggcttctacgcttacctgggtgtgctactggttctagggttacttctgaactccctcgccctttgggttttttgttgtcggatgcagcagtggacagaaacccggatctatatgacaaacctcgcagtggctgatctctgtctgttatgtactctccccttcgtgctgcatagcttgcgggacacatccgacactcctctgtgccaactatcacaggggatctatctgacgaaccggtacatgtcaatctcccttgtcaccgccatcgcagtcgacaggtatgtagcagtgcgacacccactgagggctagggggctgcggtcccccagacaggcagcagctgtgtgcgcagtgttatgggtgctggtgattggtagtctcgtggccagatggctgctgggcatacaggaaggcggattctgtttccgcagcacccgccacaacttcaatagcatggctttccctctgctgggtttctacttgcccttggccgtggtagtgttctgctcactaaaggtggtcaccgccctggcccaaagacccccaacagacgtgggccaggcagaggctacaagaaaagctgcacgtatggtttgggccaacctcctcgtcttcgtcgtgtgtttcctgcccctccacgtgggactgaccgtgcggctggcggtcggatggaatgcctgcgcgctgcttgagaccatacgcagggccctgtatatcaccagtaagctctcagatgctaactgttgtcttgatgccatctgctactactacatggccaaagagttccaagaggccagtgctttagcggtagcaccctctgccaaggctcataaaagccaggactccctgtgcgttactctggcttag

SEQ ID NO: 224043 - DNA, 1842 bp, Artificial Sequence
  Description of Artificial Sequence: Synthetic coding sequence
atgagggccccaggggctctcctggccagaatgtctcgactgctgctgttgctgctgttgaaagtttcagccagtagtgccctcggagtggcccctgcatctcgcaacgagacatgccttggcgaatcttgcgccccaacagttattcaaagaaggggtagggatgcctggggccctggcaatagcgcccgagacgtcctgcgcgctcgggctccaagagaagaacagggagccgctttcttggctggcccaagctgggatctgcctgcggctccaggcagggatccagccgcaggacggggagccgaggccagtgctgcgggaccccctggcccaccaacacggccacccggaccgtggcggtggaagggagctaggggccaagaaccatctgagactctcggcagaggtaatcctaccgcactgcagctgttcctgcaaatctccgaggaagaggagaagggccctagaggcgcaggcataagcggcagaagccaggagcaatccgtgaaaacagtgcccggagcctcggaccttttttactggccaaggagggcgggtaagctgcagggatcgcaccacaaacctcttagtaagacagcgaacggactcgcagggcacgaggggtggaccatagcgctgcctggacgcgcacttgctcagaacggctcgttgggggaggggattcatgaacccggaggaccccgacggggtaattcaacaaacaggcgggtacggctcaagaaccccttctatccgctcacccaggagtcgtatggcgcatacgcagtgatgtgcctgtctgtcgttatcttcggaacaggcattatcggaaatttggcagttatgtgtattgtgtgccataactattatatgagatcaatctctaacagtttgctcgccaatctggccttttgggattttctcattatctttttttgccttcctctcgtcattttccacgagcttaccaagaagtggttactcgaagacttttcatgtaaaatcgttccttacattgaagtcgcctctttgggcgtgaccacgttcacactgtgcgctttatgtatcgaccggttccgagccgctactaatgtgcagatgtactatgagatgattgagaattgttcatctactactgccaaactcgccgtgatctgggtgggagctcttctcctcgctctgcccgaggtagtgctccgccagctcagcaaggaagacctcggcttcagcgggagggctcctgctgagcggtgcattataaagatcagtcccgatctgcctgacactatatacgtgctcgcgctaacatacgactctgctaggctttggtggtatttcggttgttacttttgtctgcccactctgtttacgatcacctgttctctggtgaccgctcgaaaaattcggaaagcggagaaggcctgcactcggggaaataaaaggcaaatacaactcgagtcgcagatgaattgtaccgtcgttgcactcacgatcctttacgggttctgtatcatccctgagaatatctgcaacattgtgactgcgtatatggctacaggggtcagtcaacagacaatggacttacttaacatcatcagtcagtttcttcttttctttaagtcatgcgtgacacccgttttgttgttttgcctttgtaagccttttagcagggcgtttatggaatgctgctgttgctgttgtgaggagtgtatccagaaatcctctaccgtgaccagtgatgataacgacaacgaatatactaccgaactggagcttagccccttctccaccattcgacgggaaatgtcgacttttgcatccgtgggaacacattgctag

SEQ ID NO: 224044 - DNA, 1362 bp, Artificial Sequence
  Description of Artificial Sequence: Synthetic coding sequence
atggctagcccatccctgcccggttcagattgttctcagataatcgaccattcccacgttccggaatttgaagtagccacgtggatcaaaatcactctgattctggtgtacctcataatcttcgtaatgggtcttttaggcaacagcgctacaattcgcgttacacaggttctacagaagaaggggtacctgcagaaggaggtcactgaccacatggtgtctttggcttgtagcgacatcctggtgtttcttattggtatgccaatggagttttactctatcatctggaatcccctaacgaccagctcttatacactttcttgtaagttacacacattcctgttcgaggcctgttcatatgcaacactccttcacgtcttgacactcagttttgagcgatacatcgccatttgccacccgtttcgatataaagctgtctccgggccttgtcaggtcaaacttctgatcgggttcgtgtgggttacgtctgcactggtcgcattaccccttctatttgctatggggaccgagtatccccttgtgaatgtgccttcacacagaggcttaacgtgcaacaggagcagtactaggcaccacgaacagcccgagaccagtaatatgagtatctgtactaatttgagctccagatggacagtgttccaatcttccatttttggagctttcgttgtctatctggttgtgctgttgtctgtggccttcatgtgttggaatatgatgcaggtgctgatgaagagccagaaaggcagcctcgccggaggaacgcgtcctcctcagctgaggaaatcagaatctgaagagtcccggaccgccaggaggcaaacaatcatcttcctgcggttgatcgtggtaactctggcggtttgttggatgcccaatcagattaggcggattatggccgcagcaaaaccgaagcacgactggacaaggtcgtattttcgggcttatatgatcctcctgcctttcagtgagacctttttctacctgtcctccgtgattaatcccctgctgtatactgtgagcagtcagcagttcagacgagtattcgtacaggtactttgttgtaggctgtcccttcagcacgctaaccatgagaaaaggctccgggtccatgcccatagtacaactgactctgctcgcttcgtacagcgacccctcttgtttgccagccgccgtcagagtagcgccagacggacagagaagattttcttaagtacttttcagagcgaggccgaacctcaaagtaaatcccagtcactcagtctggagagtttagaacctaactcaggggctaagcctgcgaattccgccgcagaaaatgggtttcaggaacatgaggtgtag

SEQ ID NO: 224045 - DNA, 1089 bp, Artificial Sequence
  Description of Artificial Sequence: Synthetic coding sequence
atgggcaaccatacctgggagggctgccacgttgactcaagggtggaccatctttttcccccttccttgtatatcttcgtaattggagtagggctgcctaccaactgcttggctctctgggccgcatatcggcaggtgcagcagcgaaacgagctcggcgtttaccttatgaatttgtccatagctgacctactgtatatatgcaccctccccttgtgggtcgattatttcctgcaccatgataactggatccatggtccaggcagttgtaagctgttcgggtttattttttatacaaacatctacatctccatcgcgttcctctgctgcataagtgtcgatcgctatctggctgtggcacatccactccgcttcgccagactgcggagagtaaagaccgcagtggcggtttctagcgttgtgtgggccactgagctcggggctaattcagctcctttgttccacgatgagctctttagggacagatacaaccacactttctgcttcgaaaagttcccaatggagggctgggtcgcctggatgaatctgtatagggttttcgtagggtttctgtttccttgggctctgatgctgctgtcctaccggggaatcctgcgggcagttcggggaagcgtttcaacggagagacaggagaaggcgaaaattaagagattggctctgtcactgattgcgatcgtattggtgtgttttgccccatatcacgtgttgctgctgagtaggtctgctatttatctgggccgtccatgggattgcggcttcgaagagcgggttttctctgcttaccacagtagcctagctttcacatccctgaactgtgtagctgaccctattctgtattgcttggtaaacgagggagcacgttccgacgttgcaaaagcccttcacaaccttctgcgttttttggcctccgataagccgcaggaaatggccaacgcctccctcaccctggaaacccccttgacctccaaacgcaatagcacagccaaggccatgaccgggagctgggcagccactccgccttctcagggggaccaggtccagcttaagatgcttcccccagcccaatag

SEQ ID NO: 224046 - DNA, 1041 bp, Artificial Sequence
  Description of Artificial Sequence: Synthetic coding sequence
atggataccggcccagaccaaagttacttctccggaaaccattggtttgtcttttctgtgtacctgttaacttttcttgttggcctgccactgaatctgttggcactagtggtgttcgttggcaagctccgctgtcggccagtcgccgtcgacgttctgctgctgaatcttacagcaagtgacttgttgttactgctgttcctgccgttcaggatggtggaggcagccaacggcatgcactggcccctgccttttatcctgtgtcctctgtccggattcatttttttcaccacaatttacctcacagcactgttcctggctgctgtcagcattgaacgctttctaagtgtggctcaccctctctggtataaaactagaccacgcctagggcaagcgggacttgtctcagtggcgtgctggctgttggcgtctgctcattgtagcgtggtgtatgtgatagagttctccggcgatatctcccactcccaggggaccaatgggacgtgttacctggaattttggaaagatcagctggccatcctcttaccagtccgcctggagatggctgtggttctgttcgtggttccgctgataatcacatcttattgttatagcaggctcgtgtggatactggggcgaggaggctcccaccgcaggcagcgcagggttgccggtctggtggcggcaactctgctgaattttctggtctgttttggaccttacaatgtaagtcatgtggtggggtacatttgtggagaatcaccagtgtggcggatatacgttacccttctgagcactctgaattcctgtgttgatccctttgtatactatttctcctcgtctggctttcaagccgactttcatgaactgctgagacgattgtgtggactgtggggtcaatggcaacaggaatcatctatggagctgaaggagcagaagggaggagaagaacagcgcgctgacagacccgctgaaaggaaaacatctgagcactcccaggggtgtggaacaggagggcaggtggcctgtgctgaaaattag

SEQ ID NO: 224047 - DNA, 1119 bp, Artificial Sequence
  Description of Artificial Sequence: Synthetic coding sequence
atggcctgcaattccacctctctcgaggcctatacttatttactgctaaatacctccaacgcgagtgattctggctctacacaactgccggcaccgctccgaatctcattagccatcgttatgttgctgatgacagtggttgggttcttgggcaataccgtcgtgtgcataatcgtgtatcagagacccgctatgcgatctgccattaatctcctactagccaccctcgctttttccgatattatgctgtctctttgctgtatgcccttcaccgcggtcactctcatcactgttcggtggcacttcggagaccacttctgtagattgagtgccaccctctactggttttttgtgctggagggcgtggcgattctcctgattatatccgtggatcggttcctcatcattgtccaacggcaagacaagttaaatccgagacgcgctaaagttattattgctgtgagctgggtgttgagcttctgcattgctgggccatccctgaccggatggactttggtggaggtgcctgctcgcgcacctcaatgcgttctcggttataccgagctgcccgctgacagggcgtacgtggtgactttggtcgtggctgtgttcttcgcgccattcggagtcatgttgtgcgcctatatgtgtattctcaatacagtgaggaagaacgctgtgcgtgtccacaaccagtccgattctctggatttgcgccagctcacccgggctggtctcaggcggcttcaaaggcagcagcaagtgtctgtcgacttatcgttcaagaccaaggcattcactaccattttgattctcttcgtgggattttcattatgctggctcccacatagcgtatactctctcctatccgtattctcacagcgattctactgtggctcatcgttttatgccacctctacctgtgtgctctggctttcttatctaaaatccgtgttcaatccgatcgtgtattgctggagaatcaagaaattccgcgaagcttgcatcgaactcctcccccagacatttcagattctccctaaggtgccagaacggattaggcgccgaatccaaccatccacagtttatgtgtgtaatgaaaatcagagcgccgtgtag

SEQ ID NO: 224048 - DNA, 837 bp, Artificial Sequence
  Description of Artificial Sequence: Synthetic coding sequence
atgtctgcaccaggctctccagatcaggcttacgattttctcctgaagttcctgctggttggcgaccgcgacgtgggcaaatcagagatcctggaatcattgcaggatggcacagccgagtctccctattcccacctgggagggattgactataaaaccaccactattctcctggatggccagagagtgaaactcaagctgtgggacacctccggccaaggaaggttttgtactatctttcggtcctattcccggggagcccagggagttatattagtctacgacattgccaatagatggtcctttgaaggcatggatcggtggattaagaagattgaagagcacgctccaggagttccaaaaatactcgtcggtaataggctccatctggcattcaagcggcaagtgccgagggagcaggcgcaggcctatgccgaaaggctgggagttactttttttgaggtttcacctttgtgtaattttaatattatagaatcattcaccgagttagccagaatcgttctgttacgccatagactcaactggttaggacgccctagtaaagtcctgtctcttcaagacctgtgttgtcggacaattgtctcttgtacgccagtgcacttagtggacaagctaccactccccatcgcgctgcgcagccatttgaaatcattcagcatggccaagggcctgaacgccaggatgatgcgcggtctgagctattccctcacgacttcaagcacacacaagaggtcaagcctgtgtaaagtgaaaatcgtttgcccaccacagtcaccacctaagaactgtacccgaaattcatgcaagatcagctag

SEQ ID NO: 224049 - DNA, 585 bp, Artificial Sequence
  Description of Artificial Sequence: Synthetic coding sequence
atggtcattcttgctgtcacaaaaaataagaaactgcggaattccggtaacatctttgtggtaagcctttcagtcgctgacatgttggtcgcaatttatccatatccattaatgctgcacgcgatgtccatcggcggttgggacttgtcccaactgcaatgtcaaatggtgggctttatcaccggactgagcgtggttgggtcaatttttaatatcgtggccatcgcgatcaatagatattgttacatctgccattcattgcagtacgagcgcattttctctgtgagaaacacatgcatctacttggttatcacttggatcatgaccgttttagccgtattaccgaacatgtatatcggaactatcgaatacgaccccagaacctacacttgtatctttaattacttgaacaaccctgtgttcacagtgaccattgtgtgtattcattttgttctgcccctgttgatcgtcgggttttgctatgtgcggatttggactaaagtgttggctgctcgggatcccgcagggcagaaccccgacaaccaactggccgagccaacgagcacagccgcttcaacactgtag

SEQ ID NO: 224050 - DNA, 1086 bp, Artificial Sequence
  Description of Artificial Sequence: Synthetic coding sequence
atgaacgagtcccgttggacggagtggaggatcctgaacatgagttcgggaatcgtcaatgtgtctgagcgtcatagctgcccactgggattcggacattattccgtggttgacgtgtgcatcttcgaaacggtggtcatagtgcttctgacgtttctgattatcgccggtaacctcacggtaattttcgtttttcactgcgcacccctgctccaccactatacaacctcctatttcatccagaccatggcctacgccgacctgtttgtgggggtgagttgtctcgtgccaactctcagtctgctgcactacagcaccggtgtgcacgaaagtcttacatgtcaagtgtttgggtacattatatccgttctcaagagtgtgtctatggcctgtcttgcttgtatttcggtggaccggtacctggccattactaagccgctttcttataatcaattagtcacaccatgcaggctacgcatatgtatcattcttatctggatctactcctgcctgatctttttaccgtccttcttcggttggggtaaaccgggataccatggagatatattcgagtggtgtgctacatcctggctgactagcgcatattttactgggttcattgtgtgtctcttgtatgccccagcagcgttcgtggtatgtttcacctacttccatatctttaagatctgtaggcaacacactaaagagatcaatgacagacgtgcgaggttcccatcccatgaggtggacagctcacgggagacaggccactcaccagatcgaaggtacgcaatggtactatttaggatcacaagcgtgttttatatgctttggcttccctacatcatttattttctgcttgagagctcaagggtgctcgataatccaactctgagcttcctgacgacctggctggctatttccaactctttctgcaattgtgttatttactcgctatctaacagtgttttcaggctgggccttaggcgtctgagtgagaccatgtgtaccagctgcatgtgcgtgaaggaccaggaggcccaggaaccaaaacctaggaagagagccaactcatgttccatttag

SEQ ID NO: 224051 - DNA, 960 bp, Artificial Sequence
  Description of Artificial Sequence: Synthetic coding sequence
atgtcccagcagaacacatccggcgactgcctctttgacggtgtcaacgaattaatgaaaactctacagtttgccgtacacatccccactttcgttcttggcctgctgctgaatctcctcgccattcacggcttcagcacttttcttaagaatagatggccagattacgccgctaccagcatttatatgatcaatctcgctgtatttgacctgctgctggtattaagccttcccttcaaaatggtcctctcccaagtgcagagcccctttccttctctgtgtactctcgtggaatgtttatatttcgtctccatgtacgggtcagtattcactatctgttttatttccatggacaggtttctcgccatcaggtatccactgttggtcagtcatttaaggtctcctaggaaaatcttcgggatctgctgcactatatgggtacttgtgtggacgggatcgatacccatatactcctttcacggaaaagtggagaagtacatgtgctttcataacatgtcggacgacacttggtccgctaaggtcttcttcccactggaggtgtttggctttctgctgccaatgggaatcatgggcttttgttgcagccgttccatccatatactcctaggacgtagagatcacacacaagactgggtccagcagaaggcttgtatttatagcatcgctgccagccttgccgttttcgtggtgagcttcttgccagtccatctcggattcttcctgcagttcctcgttagaaattctttcatagtggaatgccgggcaaaacaaagtatcagcttcttcttgcaactttcaatgtgttttagcaatgtgaactgctgcctggacgtattttgttactacttcgtgatcaaggaattcaggatgaatatccgcgcacacagacctagtcgtgtccagttagtactccaggacacgacaatctcgcgcggttag

SEQ ID NO: 224052 - DNA, 960 bp, Artificial Sequence
  Description of Artificial Sequence: Synthetic coding sequence
atgagccagcaaaacacttccggggactgcctgttcgacggggtgaacgagctgatgaaaactctgcagttcgcggtccatatccccacctttgtcttgggtctgttactgaacttactggcaattcacgggttctcaacatttctgaaaaatcgatggcctgactacgccgcaacctctatctatatgattaacctggctgtgtttgatcttttgctggtactctccctgccatttaagatggtgttgagtcaagtccaaagcccttttcccagcctctgtaccctggttgaatgtctctatttcgtaagtatgtatggttccgtgttcacaatctgcttcatcagcatggaccgcttcctggcaattaggtaccctctgctagtctctcacttgaggtctcctagaaagatttttggcatctgctgcaccatctgggtcctggtgtggactggctctattcctatctatagttttcatggaaaggtggaaaagtacatgtgttttcacaacatgagcgacgatacctggagcgctaaagttttttttcctcttgaggtctttggctttctgttacccatgggaataatgggcttttgctgttcaaggagtattcacattcttcttggcaggagagatcacacgcaggattgggtgcagcagaaggcctgtatctattccatagcagctagcttggccgtgtttgtggtgtcattccttcccgtgcacctcggatttttcttacaattcctggtacgaaattcctttatcgtggagtgccgagctaagcagagtatctcttttttcctgcaactgtccatgtgctttagtaacgttaactgttgtctggacgtgttttgttattacttcgttattaaagagttccggatgaatatccgcgcacatcgacccagcagagtgcagctggtcctgcaggacaccacgatcagtcggggttag

SEQ ID NO: 224053 - DNA, 729 bp, Artificial Sequence
  Description of Artificial Sequence: Synthetic coding sequence
atgtcccagcagaacaccagtggggattgcttattcgatggggtgaacgaactcatgaagacattgcaatttgcagtacatatccccacatttgtgctcggcttactgctcaacctgctggcaatccacggcttctctacttttctgaagaacaggtggcccgactacgccgcaacctcaatctatatgatcaacttagccgtcttcgaccttctcctcgtcctgagccttccttttaagatggtattgtcacaggtgcagagcccctttccctcgctctgcaccctcgtagagtgcctatacttcgtgtccatgtacggcagtgtctttacgatctgctttatcagtatggacaggtttttggctatacggtatcccctgctggtcagccacctgcgttcccccagaaagatttttggcatctgctgtaccatttgggtcctcgtctggaccggaagcatccctatttattctttccacggaaaggtcgaaaagtacatgtgctttcacaatatgtctgacgatacatggtcagccaaggtcttctttcctttggaggtcttcggtttcttgttgcccatgggaattatgggcttctgttgctcacggtcaatacacattctgttaggtcgcagggatcacacccaggactgggtgcaacagaaagcatgtatttatagcatcgctgcctcgttggccgtgttcgtcgtgtcatttctgcctgtatag

SEQ ID NO: 224054 - DNA, 960 bp, Artificial Sequence
  Description of Artificial Sequence: Synthetic coding sequence
atgtcccagcaaaacacatccggggattgtctgtttgacggtgttaacgaactaatgaagaccttgcagtttgcagttcacattcctaccttcgtgctgggcctgctgttaaatctattagccattcatggcttctccacctttctcaaaaacagatggccggactatgcggctacatcgatctatatgatcaacctggctgtgttcgaccttttgcttgtgctgtcactaccttttaaaatggtgttgtcccaggtgcagtcccctttccccagtctgtgtacattggtggaatgcctgtactttgtttccatgtatggctctgtgtttaccatctgttttatctcgatggacagatttctcgcaatcagatacccccttttggtgtcccacctacgatctccgcgaaagattttcggaatttgctgtactatctgggtgttggtgtggaccggttccatccccatttacagctttcacggaaaggtagaaaaatacatgtgcttccacaatatgagtgacgatacgtggtccgctaaagtgttttttcctctcgaagtgtttgggtttcttctcccgatgggcattatgggtttctgttgtagccgctctatccatatcttgctgggacgcagggaccacacacaagactgggtgcaacagaaagcatgtatctatagcattgccgcaagtctcgccgtcttcgttgtgagttttctcccagtacacctggggttctttctccagtttttagttcgcaactcctttattgtggagtgccgtgcaaagcaatccatctcattcttcttgcagttaagcatgtgtttctcaaacgtgaattgctgccttgacgtgttctgctattacttcgtgataaaagaatttcggatgaatattcgagcacatcggccaagccgggtgcaactggtgttacaagacaccactatctctcgaggctag

SEQ ID NO: 224055 - DNA, 1572 bp, Artificial Sequence
  Description of Artificial Sequence: Synthetic coding sequence
atgacaccgcagtctctcctgcagaccacacttttccttctgtccctgctctttcttgtgcagggggctcacgggagaggccaccgggaggacttccgcttttgcagccagcagctgcagagcttggaaagcaagctcacaagcgttcgcttcatgggcgacatggtgagttttgaagaggatcggattaacgctacagtgtggaagctgcagcctactgcaggactgcaggacctccacatccacagccgtcaggaagaagaacagagcgaaatcatggaatactcagtcctgctccctcgcaccctctttcagcgaactaaaggtaggtccggcgaagccgaaaagcgattgctcctcgtggacttttcttctcaggcccttttccaggacaaaaactcttcgcaggtgcttggtgaaaaggtcctgggcatcgtggtacagaatactaaggtagcgaatttgactgaacctgttgtactcacattccagcatcagctgcagccgaaaaatgtcaccctgcaatgcgtgttctgggtggaagatcctacattatcaagtccagggcattggtctagcgcgggttgtgagactgtgcggcgagagacacagaccagttgcttttgtaaccacttgacatatttcgccgtcctgatggtgagctcggttgaagtggatgccgtgcacaagcactacctatcactgctgtcttacgtcgggtgcgtcgtgagcgcattggcctgtctggtgacaatagctgcatacctctgttctagggtacccctgccttgccgccgaaaacctcgagactatactattaaggtccacatgaacctcctgcttgctgttttcctgcttgacacaagcttcctactcagtgaacccgttgcgttgaccgggagcgaggccggatgcagagccagcgccattttcctccacttcagtttactgacctgcttatcttggatggggttagaaggctataacctgtaccgacttgtggttgaggtattcgggacctatgtcccaggctacctcctgaagctatcagccatgggctgggggtttccgatttttttggtcaccctggtcgctctggtggacgtggacaattatggaccaattatccttgctgtgcaccgtaccccggagggggtgatttaccctagcatgtgctggatacgtgacagcttggtgtcctacataactaatttaggactgttctctctggtattcctgtttaacatggcaatgctcgctactatggtggtgcagattctgagattgaggccgcacactcagaaatggtcccacgttctgaccttgctaggtctttcactcgtgttgggcctcccatgggccctgatttttttctcatttgcaagcggtacttttcagcttgtggtgctctacctgttcagcatcataacatctttccaaggatttctgatctttatctggtactggagcatgaggctgcaggcgagagggggtccttcaccgctcaagtctaattcagactctgcaagactcccaatatcctcaggatctactagcagttctagaatctag

SEQ ID NO: 224056 - DNA, 2082 bp, Artificial Sequence
  Description of Artificial Sequence: Synthetic coding sequence
atgacaccccagtcattgctgcaaactactctgttcctgctgagcctcctgttcttagtccagggagctcacggccgaggccatagggaagatttcaggttttgttcacaacgcaaccagacccacaggagctctcttcactataaaccaacacccgacctgcgcatcagtatcgaaaacagcgaggaagctctgaccgtccacgcaccattccccgcagctcacccagcctctaggagcttcccggatcctagaggactctaccacttttgtctctactggaaccggcacgcgggaaggctgcacctgctctatggcaagcgtgactttctcctgtcggataaggcttcatcgcttttgtgcttccagcaccaagaggagtctttggctcaaggcccacccctattagccacctctgtgacttcttggtggagtcctcagaatatctccttaccatcagccgcatcatttacattctcattccacagccctccgcacacggcggctcacaatgcatctgtcgacatgtgtgagttgaaaagagaccttcagttgctgtcgcaattcctgaaacacccacagaaagcatcccgtaggccctcagccgctcccgctagccaacagctgcagagtctggaaagcaagcttacctcagtgagatttatgggcgacatggtctccttcgaagaggaccggatcaatgcgacagtttggaagctgcaacccactgccggactgcaggacctgcacatccatagccgacaggaggaggaacaatcagagatcatggagtatagcgtactcctcccccgaactctcttccagcgcaccaaaggacggagtggagaggctgaaaagcgtttgctgctggtggacttctcctctcaggcactattccaggacaaaaactctagccaggtcctgggagaaaaggtcctgggcatcgtggtccaaaataccaaggttgccaacctcaccgagcccgtggtattgacattccagcaccagctgcagcctaaaaacgtgacccttcagtgcgttttttgggtggaggatccaactcttagtagtcccggacattggtcaagtgctggatgcgagaccgtgcgcagggagacccagacgtcttgcttttgcaaccacctcacatacttcgccgtgctgatggtgtcatccgtggaggtcgacgctgtgcataagcactatctgtcccttctttcttacgtgggatgcgtggtgtctgccttggcatgtctggttacaatcgccgcttatctttgctctcgagttcctttgccatgtaggagaaagccacgcgactataccattaaagtccacatgaacttactgctggctgtcttcctgctcgacacaagcttcctcttgtcagagcctgtggctttgaccggttccgaagccggatgcagagccagcgctatcttcctgcattttagtctgttgacctgtcttagctggatgggcctcgagggttacaacttgtatcggctggtggtcgaggtgttcggcacctacgtgcccggatatctactgaaactctccgccatgggctgggggtttcctattttcctggtcaccctggtggcacttgtggacgtggacaactacggaccgataatactcgctgtgcatagaacccccgaaggagttatatatccatccatgtgctggatccgcgactccctggtgagctacatcaccaatttaggactgttttccctggtttttctttttaacatggccatgcttgccaccatggtcgtccaaatattgcgattgcgcccacacacccagaagtggtcccacgtgcttaccttattagggctgagcttagttctgggcttgccttgggcattgattttcttcagctttgcctcaggcaccttccagctggtggtcctctatctgtttagcatcatcacctcattccaggggtttctgatctttatttggtactggtccatgagattacaggcgagaggagggccttcaccgctgaagagcaatagcgactccgcacgactgcctatttccagcggtagcacaagcagctcaaggatctag

SEQ ID NO: 224057 - DNA, 2082 bp, Artificial Sequence
  Description of Artificial Sequence: Synthetic coding sequence
atgacaccacaaagccttctccagactacattgttcctgttatccctgctgttccttgtccagggtgcccacggacgaggtcacagggaggatttccggttctgctctcagagaaatcaaacgcatcgctccagtctccactacaaacctacgcctgacttgaggatctccattgaaaactcggaagaggccctgacagtgcacgcaccgttccctgccgcacatcccgcttcccgtagcttccccgaccctcgcggtctgtatcacttctgcttgtattggaataggcatgccggaagattgcacctgctgtacgggaagcgggactttctgctcagcgataaggcgtcttccttattgtgctttcagcaccaggaggagagtctggcacaaggtccacctctgctcgcaaccagtgtgacctcttggtggtctccgcagaacatttccttgcccagtgccgctagtttcaccttctcctttcactccccgccacatactgctgcacacaacgcctccgttgacatgtgtgaactgaaacgcgaccttcagcttctgagtcagtttctgaagcatcctcagaaggcttctagacgcccttctgctgccccagccagccagcagcttcagtcactggagagcaagctgacaagcgttcggttcatgggcgacatggtctcttttgaggaggaccgtattaacgccactgtttggaagctgcagcctaccgccggtctccaagacttgcatattcatagccgccaggaggaggagcaatcagagatcatggaatattcggtgctgctaccaaggacgctgtttcaaaggaccaaaggcaggtctggggaagctgagaaacggctcctgctggtcgacttttcgagccaggccctctttcaggacaagaattcgagccaggtgctcggggagaaggtgctgggaattgtcgtgcagaatactaaagtggctaacctgacagaaccggtggtcctgacgtttcaacaccagttacagcccaagaacgtgaccctgcagtgcgtattctgggtggaggaccccaccctgagctccccgggacactggagcagcgctggatgcgagactgtgagaagagagacacaaacgtcctgcttttgtaaccacttaacatatttcgcggtcctgatggtttcttctgtggaagttgacgctgtgcataaacattacttgagccttctgtcttacgtgggttgcgtcgtgtccgctctagcgtgcctggtgaccatcgctgcctacctgtgctcgagagtccctttaccttgcaggagaaagcccagagattacaccatcaaggtacacatgaacttgctgctggcagtatttctgcttgatacttctttcctgctgtccgaacctgtggctcttacagggtccgaggctggctgccgtgcctcagccatttttctacatttcagcctgcttacatgcctttcctggatgggtttagagggatataacctgtatagactcgtggtggaggtctttggtacctatgtccctggctacttattgaaacttagtgccatggggtggggctttcctatattccttgtgactctggtcgcactagttgacgttgacaactacgggccaatcatattagcagtgcacaggactccggaaggagtcatctacccgtcaatgtgctggatccgggactcacttgtttcatatatcacaaatctggggctattctcgcttgtgttcctctttaatatggcgatgcttgccacaatggtggtgcaaatattgcgcctgcgaccccatacgcagaagtggagccacgtactgaccttactcggcctatctctggtcttggggcttccatgggccttgattttcttctcttttgcctccggaacctttcaactggtcgtcctgtatctgttcagcatcattaccagtttccagggtttcttgatctttatttggtactggagcatgaggctgcaggcacgcggtggcccttccccactgaagagtaatagcgacagtgctcgactccctatttctagcggaagtacatcctcttccaggatatag

SEQ ID NO: 224058 - DNA, 2064 bp, Artificial Sequence
  Description of Artificial Sequence: Synthetic coding sequence
atgacgcctcagtctctgctgcagactacactgttcctcctcagcctgctgttcctggttcaaggcgcacacggcagaggccatagggaggatttccgtttctgctcacagaggaatcaaacgcacagaagctccttgcattataaacccactcctgacctacgcatatccatagaaaacagcgaggaggccctgaccgtgcatgcacccttccctgcggctcatcccgcttcaaggagtttccctgaccccagggggctgtaccacttttgcctctattggaaccgacacgctggcaggctccatttgctgtatggcaaaagagactttctgctgagcgacaaggcgtcttccctgctatgctttcagcaccaggaagaatctctagcacagggccctcctctgctggcaacaagcgtgacatcatggtggagcccccagaatatttctctgcctagcgccgcatcattcacattttcttttcatagcccaccccacaccgctgcacataatgcgtccgtggatatgtgcgaattgaagcgcgacttgcagctgctcagccaattcctcaaacatcctcagaaggcatctagacgaccatcagccgctccagcctcccagcagctgcagtccctggagtccaaactgaccagcgttcggttcatgggggacatggtctccttcgaggaggacagaataaacgctacagtgtggaaactccaaccaacagctgggctgcaggacctgcacattcattccagacaggaggaggagcaaagcgagatcatggaatatagtgttttgcttccacgaactctgttccagcgtacaaaaggtaggagcggcgaagccgagaaacgcctgctgcttgtcgatttctcttcgcaggctctctttcaggataagaactcatctcaagtgcttggggagaaagtacttggcatcgtggtgcagaacacaaaggtggctaatctgacagagccagtcgtattgacatttcaacatcagctacaacctaaaaacgtcacccttcagtgtgttttttgggtggaggacccgaccctgagtagccccggacattggagctcagctggctgcgaaactgtcaggagagaaacacagacttcttgtttttgtaaccacctgacctattttgctgtgctgatggttagttcagtcgaggtcgatgctgttcataaacactacctgtctcttctgtcttacgtgggctgtgtggtgtccgctctcgcctgcctggttaccattgcagcctacctctgctctcggaggaaaccaagagactacactatcaaggtacacatgaatctattgctggccgtttttttgttggatacaagctttctcctgagcgaacccgttgccctcaccggctcagaagccggatgtcgcgcaagcgccatctttctccacttttcgctccttacctgcctatcctggatgggcctggagggatataatttgtaccgcctggtggtcgaggtcttcggaacatacgtgcccggatacctcctcaagctttccgctatggggtggggtttcccaatatttctcgtcactttggttgcgctagtggatgtcgacaattacggtccaatcatcttggctgtacaccgaacacccgaaggagtgatctatccttccatgtgttggataagggattctctggtaagctatatcacaaacctcggcctgttctccctcgtttttctgtttaacatggcgatgctggccaccatggttgtccagattctgcgactgcgaccgcacacgcaaaagtggagccatgtgctaacgcttctagggctgtctctggtgctcggtttaccctgggcattgatcttcttctcctttgctagcggcacttttcagctggttgtgctgtatctgttcagcatcattacatcattccagggcttcctgatcttcatttggtactggagtatgcggctacaagctcggggtggcccaagtcctttgaagagcaattctgatagcgctcggctgccgatctcgagcggatctaccagcagcagtcgtatctag

SEQ ID NO: 224059 - DNA, 2082 bp, Artificial Sequence
  Description of Artificial Sequence: Synthetic coding sequence
atgacaccacagagtctgttgcagaccacactttttctactgtcactgttgttcttggtacagggcgctcatgggaggggccatcgggaggatttccgattctgcagtcagagaaaccagacccaccgttcaagcttgcattacaagcccacacctgacctcaggatttccatcgaaaattcagaagaggctctaacagtccatgcccctttcccggcagctcaccctgcttcccgttccttccccgacccacggggtctataccatttttgtttgtactggaacaggcatgcaggaaggcttcatctgctctatggtaaacgagacttcctcctgtctgacaaggcgtccagcctcttgtgcttccaacaccaggaagaatccctagcgcagggtcctcctttattggccaccagcgtgactagctggtggtctcctcagaacatctcactaccttctgctgcctccttcacttttagttttcattctccccctcataccgctgcgcacaacgcttctgttgatatgtgcgaattgaaacgcgatcttcaactgctctcccagtttctaaagcacccacagaaggcttcccgtaggccctcagctgctccggcttctcagcagttgcagtccctggagagcaaattgacttccgtgcgctttatgggagatatggtgagcttcgaggaagaccggattaatgcaactgtctggaaactccaacctacggcaggcctgcaagacctgcatattcacagccgccaggaggaagagcagtcagagattatggagtatagcgtgctcctccccagaacattattccagaggactaagggtaggtccggagaggcagagaagaggcttttgctagtggacttcagctcccaagccctctttcaggacaaaaacagcagccaggtgttgggtgagaaagtgttggggattgtcgttcagaataccaaagtggccaatctgacagagcctgtggttctcacgttccaacaccagttacagccaaaaaatgtgacgctgcagtgtgtcttttgggttgaagaccctacgttaagctcccctgggcattggtcatcagcgggatgtgagaccgtgcggagagaaactcagacaagttgtttttgtaaccacctgacatattttgcggtccttatggtctcctccgttgaggttgacgccgttcacaagcactacctgtcactcctgtcgtacgtgggctgcgttgtgagcgccttggcttgtctggttacaattgctgcctacctctgcagccgggttcctctcccctgtcgaaggaagcctcgtgactacacaattaaagttcatatgaatttactcctcgccgtgtttcttttggatacctcttttctgctctccgagccagtagccctcacgggttccgaggctggctgtcgcgcttccgcaattttcctacatttttccctgcttacttgcctgtcttggatgggcctggaaggatacaacctgtaccgactagtggtggaggtcttcggcacctacgttccaggctatctgcttaagctgagtgcgatggggtggggtttcccgatctttctcgtgaccctggtcgcgttagttgatgtggacaactatggacctattatcctggccgtccaccggactcctgaaggagtcatctatccctccatgtgctggatccgtgatagcctcgtgtcttacattacgaatctgggactgtttagtctggtttttctcttcaacatggctatgttggctacaatggtggtgcaaatcctgagactccgcccacacacccagaagtggtcgcatgtcttgactctgctgggcttgtccttggttcttggcctcccttgggccctgatctttttttctttcgctagtgggactttccagctggtagtcctgtatctctttagcattatcacgtcattccagggatttctgatcttcatttggtactggtcgatgcgtttgcaggccagaggtgggccatctcccttaaaaagtaacagcgatagtgctcgtctcccaattagctccggaagtacgagttcgagccgaatctag

SEQ ID NO: 224060 - DNA, 2064 bp, Artificial Sequence
  Description of Artificial Sequence: Synthetic coding sequence
atgactcctcagagcctgttacagacaacgctctttctcctgtcgttactgtttttggtgcagggcgctcacggcaggggccaccgagaagactttagattctgtagccaacgcaatcaaacccaccggagcagcctccattataagcccacccccgacctccggatctctattgaaaactcagaggaggccctcacagtgcatgcaccatttccagcagcacatccagcgtcacgaagcttcccggatccgagaggcttgtatcatttttgtctgtattggaatcggcacgcgggacgcttacacctgctctacggaaagcgggatttcctcttgtcagataaggctagcagcctactgtgctttcagcaccaagaggagtccctggcacagggaccccctctgttggctacgagtgtgacttcctggtggtcccctcagaacatcagcctcccaagcgctgcttcatttaccttttcttttcatagcccgccacacactgcagcgcataacgcttccgttgatatgtgtgaactaaagagggatctacagcttctcagccaatttttgaagcacccgcagaaggcttctagacgcccttccgctgcccctgcctctcagcagttgcaaagtttagagagcaagctaacttccgtccgattcatgggcgacatggtttctttcgaggaggacaggattaacgccactgtatggaagctgcagcccacagccggtctgcaggatttacacatacactctaggcaggaggaggagcagagcgaaattatggagtattctgttctgctcccaagaacattgttccagaggacaaaaggacggtcaggcgaggctgaaaagaggctacttcttgtcgacttcagctcccaagctcttttccaagacaaaaattcctcccaggtgctgggtgagaaggtattaggcatcgtcgttcagaatactaaggtagccaacttaaccgaacccgtggtgttaacctttcagcaccaactgcagcctaaaaatgtgactctacagtgtgtattctgggtcgaagatcctactctcagctcccctggccattggtctagcgccggttgcgagacggttcggagagagacccaaacttcctgcttttgtaatcacctaacatacttcgccgtcctgatggtcagcagcgttgaggtcgacgcggtgcataagcattatctgtcattactttcttatgttggatgcgtagtatccgcactggcgtgtctcgtgactatagcggcttacctgtgcagtaggagaaaacccagagactatactattaaggttcacatgaacctgttacttgccgtctttctgctggacacctcctttctactcagcgaacccgtcgcgttgaccggaagcgaggcgggatgcagggctagcgcaatattcctgcacttctccctacttacctgcttgagctggatgggactcgaggggtacaatctgtaccgactggtagttgaggtctttggaacgtacgtgccagggtatctgctgaaactgagtgcaatgggatgggggtttcctatcttccttgtgaccttggtcgctctggtggacgtggacaattacggaccaatcatcttggccgtacacagaacccctgagggcgttatctatccttcaatgtgttggatccgggattcgttggtgtcatacattacaaacctgggcctgttcagtctcgtcttcctgttcaacatggcaatgttagctactatggtcgttcagattctgcggctgagaccccatacccaaaagtggagccacgtgctgaccctgcttggactgagcctggtcctcggcctcccatgggcgcttatctttttctcatttgctagtggaacattccagttggttgtgctgtacctattttcaatcatcaccagctttcagggcttccttatcttcatttggtactggtctatgagactgcaggccaggggtggaccatccccactgaagtccaactccgattctgcgaggctcccgatctcttctggatccacgtcaagctctcgcatttag

SEQ ID NO: 224061 - DNA, 2064 bp, Artificial Sequence
  Description of Artificial Sequence: Synthetic coding sequence
atgactccacagtccttacttcagaccactctgttcctcctgtcattgctgtttctagtgcagggagcgcatggtcgcggacaccgggaagacttccgcttctgctcccagaggaatcaaacacacaggtccagcttgcattacaaacctacacctgaccttcggatctcaattgagaactctgaagaagctctcacagtgcatgccccatttcctgcggctcatccagccagtcggtctttccccgacccaaggggtctttatcatttctgtctgtattggaaccgacatgcagggagattgcaccttttatatggaaagagggactttttgttgtctgataaggccagttcccttctgtgctttcagcaccaagaggagagtctggcccagggcccaccacttctggcgactagtgtgaccagttggtggtctccacagaatatctcacttccctccgcggcatcattcacattctcctttcacagcccacctcacacagcagcccataacgcgagtgtggacatgtgcgagcttaaacgcgatctgcagctactctctcagttcttgaagcacccacagaaggcctcacgaaggccttccgcagcccctgcctcccagcaactgcaatcactggaatctaaactcacctcagtaaggttcatgggtgatatggtctcgttcgaggaggaccgcatcaacgcaacggtttggaaactccaacctacagccggactgcaggacctgcacatccactcaagacaggaggaggaacaatctgagatcatggagtacagcgttctcctccccagaacactcttccaacgcacgaaagggaggtctggagaagccgagaagcgcttactactggtggacttctcgtcccaggccctgttccaggataagaactcttctcaggttctaggtgagaaggtactcggcattgtcgttcagaatactaaagtggctaacctcacagagcccgtcgtgctcaccttccagcatcagctccaacctaagaacgttaccctgcaatgcgttttctgggtggaggaccccaccctctcttctcccggtcactggagctcggctggttgcgaaaccgtgaggagagaaactcagactagctgcttctgtaatcacctcacatatttcgccgttctcatggtgagctccgttgaagttgacgccgtccataagcattacttatcattgctgtcctacgtggggtgcgtggtgtccgccctggcgtgcttagtgaccattgctgcttacttatgcagccgtcggaaacccagagactatactattaaggtacacatgaacctgctgctcgccgtgttcctgttagatacatcattcctcctgtccgagccagtggccctcaccgggtctgaagctggatgccgggcaagcgccatctttctgcatttctcacttctgacgtgtttgtcatggatgggtctcgaagggtacaacctttaccgtctggtcgtggaagtcttcggaacttacgttccgggataccttttgaaactgtcagccatgggttggggctttcccatctttctggtgactctagtagcgttagtggatgtggataactacggtcccatcatcctggccgtgcataggacccctgaaggcgttatttacccctccatgtgttggatacgagatagtttggtatcctacattactaatttggggctgttcagtcttgttttccttttcaatatggccatgcttgccacgatggtggtccagatcctgcggttgcgccctcatacccagaagtggtctcacgtcctcactttgttggggctgagcctggtgctgggcctgccttgggcactcatattctttagctttgctagcggcacctttcaacttgtagttttgtatctgttttccattattacttcatttcagggattcctcattttcatctggtattggtcaatgcggcttcaagcccgaggcggaccatcacccctgaaatctaattccgactccgctcggttgccgatttcttccggatcgacctcctcctctcggatttag

SEQ ID NO: 224062 - DNA, 1539 bp, Artificial Sequence
  Description of Artificial Sequence: Synthetic coding sequence
atgtgtgaactgaagcgtgatttgcagctcttgagtcaatttctgaagcacccacagaaggcttcacgcaggcctagtgcagcccctgcgagccagcagttgcagtctttggagtccaaactgacgagtgttagatttatgggggatatggtgtcgttcgaagaggaccgtattaatgccaccgtgtggaagctgcagccaactgctggtttgcaggaccttcatatccatagtcgccaagaggaagaacagtccgagataatggaatactccgtgctgctgcctagaaccctgttccagcgcaccaagggcaggagtggcgaagctgagaagcgactgctgctagttgatttcagctcacaggccctgttccaggataagaacagttcccaggtgttaggagaaaaagtactgggcatcgtggtccagaataccaaggtcgcaaatctcaccgaacccgtcgtacttactttccagcaccagttgcagccgaagaacgtgacactgcaatgcgtattctgggtggaggatcctacccttagtagccctggacactggagtagtgcaggctgcgagaccgtccgacgggagactcagacatcctgtttctgtaaccacctcacttatttcgccgttctcatggtttccagtgtggaagtggatgccgttcataaacattacctgtctctgctgagttatgtcgggtgtgtggtgtccgccctagcctgcctggtgactatcgcggcttatctgtgttcacgaaggaagcctcgcgactatacaatcaaggtgcacatgaacctcctgttggccgtgttcctgctcgatacgtccttcctcttgagtgagcctgtggccttgaccggttcggaggccggatgcagagcatcagcaatcttcttgcatttttcactgttaacctgcttgtcatggatggggttggagggctacaacctctatcgactcgtggtcgaagtcttcgggacttatgtgccaggctacctgcttaagctgtctgcaatgggctggggttttcctatattcctggtaaccctggtcgccttggttgatgtcgacaattatggccctattattcttgctgtgcaccggacccccgagggggtcatttacccatctatgtgctggatcagagatagccttgtgtcttatatcactaatctcggtctattctccctggtattcctgttcaatatggcaatgcttgccaccatggtggttcagattctgcgactgcgccctcacactcagaagtggtctcacgttctgacactcctcggcctgagtcttgttctgggcctgccctgggctttgatctttttcagcttcgcctcaggtactttccagctcgtagtgctgtacctgttcagtatcatcacgtccttccagggctttctgatctttatatggtactggtccatgaggctccaagcccgaggcggaccctctcccctgaaatctaactctgactccgcgagactgcccatctcttccggctcgacctcaagcagccggatctag

SEQ ID NO: 224063 - DNA, 2064 bp, Artificial Sequence
  Description of Artificial Sequence: Synthetic coding sequence
atgacaccccagagtctgctccagactacattgttcttgctttctctcctgttcctggtgcagggagcacacggacgcggtcatcgtgaggacttccgattttgttcacagaggaatcagacacataggagctccttacactacaagcccactccagaccttcgtatctctatagaaaactccgaggaagctcttacggtccacgcgcctttcccagcggcacatccagcttcacgatccttcccagatccaagaggcctgtaccatttttgtctgtactggaacagacacgccggtagattacatctgctgtacgggaagagagacttcctgctgtcagataaggcaagctcattgctctgttttcaacatcaggaagagtccctagcccagggacctccccttcttgccacaagcgtgacctcttggtggagtccccagaatatcagcctcccaagcgcagcttcatttactttttcgtttcattctcctcctcataccgcggctcataacgccagcgttgacatgtgcgagctgaagcgcgacctgcagctgctgagccagttcctgaagcatccccaaaaggctagccgaagacctagtgctgcaccagcctctcagcagctgcagagcctggaatctaaacttactagtgtgagattcatgggagacatggtgtcatttgaggaggaccgtataaatgccaccgtttggaagctgcagcctaccgctggccttcaggatctccacattcatagtcggcaggaggaggagcagagtgagattatggaatactctgtgctgcttccgcgtactctatttcaacgcactaagggacggagcggagaggctgagaagcgtctcctgctggtggacttctcatcccaagcgttgtttcaagacaaaaattcatcacaggtgctgggcgagaaagtcttgggcatcgttgtgcagaacaccaaggttgccaacctcacggagcctgtggtgttaacctttcagcatcagctgcaacccaagaatgtcactctgcagtgcgtgttttgggtagaggatccaaccttatcttctcccggtcactggtcaagtgcaggttgcgaaacggtgcgcagagagacccagacgtcttgcttctgtaaccatctgacttatttcgcggtgctgatggtgtcaagcgtagaggtggacgccgtgcataagcattacctcagcttactttcatatgtgggctgtgtcgtctccgccctcgcatgccttgtgacaatcgctgcctatttatgcagccggcgaaaacctcgcgactatacaataaaagtgcacatgaatcttcttctggcggtgtttcttttagataccagcttcctgctctccgaaccagttgccctcactggaagcgaagctggatgccgcgcaagcgcaatatttctccacttctctctgctaacatgtctaagttggatggggttggaaggctacaacctctatcgactggttgtagaagtgtttggaacatatgttccgggatacttactgaagctttcggcgatgggttgggggttccccattttcctcgtgacccttgtcgcccttgtagatgtggataactacggacccataattctcgctgtgcaccggacgcctgagggtgttatctatccttctatgtgctggattagagatagcctggtgagttacataacaaaccttggacttttttcccttgtgtttttattcaacatggctatgctggctactatggtagtgcagatactgcggctgcgtcctcacactcaaaaatggagtcacgttctgactctcctcggtttaagcctggtgctcggtttaccatgggcactgattttcttcagcttcgcatcaggcacctttcagctggtggttctctatttattctcaatcattacatcttttcaaggatttctaatttttatttggtattggagcatgaggctgcaggcccgagggggaccttcccccctgaagagcaattccgatagcgccagactccctatcagctcaggtagcacatcatcctcacgaatttag

SEQ ID NO: 224064 - DNA, 2064 bp, Artificial Sequence
  Description of Artificial Sequence: Synthetic coding sequence
atgactccccagtccctgttgcagaccactctgttcctgctttcgctactcttcctggtgcagggagcccacggcagaggacacagggaggacttcagattttgtagccagagaaaccagactcatcgcagcagtctgcactataaacctacaccagacctacgcattagtatcgagaatagcgaggaggccttaaccgtccacgctccctttcctgcggcacacccagcttcaaggtcttttcctgacccacggggactgtatcacttctgtttgtactggaataggcatgctggccgacttcatttgctgtacggtaagcgcgacttccttttgagcgacaaggcttctagcctcctctgtttccagcaccaagaggaatcactcgcacagggaccgcctttgctagccacgtccgtgacatcatggtggtcaccacagaacatctctttaccaagcgctgcatcctttaccttctctttccatagcccacctcacacagccgctcacaatgcctctgttgatatgtgtgagctaaagcgggatctgcagctgctctctcaatttctcaagcacccacagaaggccagcaggaggcccagcgcagctcctgcctctcagcagctgcaatccttagaatccaagctgacatccgtacgatttatgggggacatggtgtcttttgaagaagaccgcattaatgcaacggtgtggaaactacagccgacagccggacttcaggacctacacatacactcccgacaggaggaggagcagtctgaaattatggagtatagcgttttgctcccaagaacactgtttcagcggacgaaaggtcgctcaggcgaggccgagaagcggctcctactggtcgacttttcctcacaagcactcttccaggacaaaaatagctctcaggtcttaggtgagaaggtgctgggcatcgtggtgcagaacaccaaagtggctaatctgaccgagccagtggtcctaacctttcagcaccaactgcagccaaagaatgttaccctgcagtgtgtattttgggttgaggatcctaccctcagcagccccggtcattggagtagtgccggttgcgagactgtgagacgggagactcaaaccagctgtttttgtaatcacttaacctatttcgcggtgttgatggtgtcttccgtcgaggtagatgccgtacacaaacactacctgagcctcctctcgtacgtgggatgtgtagtatctgccttagcctgcctcgtgaccatcgcagcgtatctctgtagtagaagaaaaccccgtgattacacaatcaaggtgcatatgaatctgctgctggccgtgtttctcctcgacacttctttcctcctttctgagcccgtcgccttaacagggtctgaagccggatgtcgagccagtgccatttttctgcattttagtctactaacttgcctctcctggatgggcttagaaggatataacctgtacagactggtagtcgaggtgttcggaacttatgtacccggatacctgctgaagctgtccgctatgggttggggtttccccatttttttagtgactctcgtggcccttgttgatgtcgacaattacgggcctattattctggccgtgcacagaactccagaaggggtaatttatccatccatgtgttggatccgggactctctagtcagttatatcacaaatctgggtttgttcagcctagtctttctttttaacatggctatgctagccacgatggtggtacaaatcctgcgtctccgaccgcacacccaaaagtggtctcatgttctgacgctattggggctctctctggtgctgggattgccatgggccttaattttctttagtttcgcctctggcacgtttcagctggtcgtgctctacctgttctctatcattaccagttttcagggcttccttatattcatatggtactggtcaatgcggctgcaggcaagagggggaccgtcgccactcaaatcgaacagtgactccgcccgactgcctatctcctccggtagtacatctagctctaggatctag

SEQ ID NO: 224065 - DNA, 1089 bp, Artificial Sequence
  Description of Artificial Sequence: Synthetic coding sequence
atgaacgcgtctgccgcttcattgaacgacagccaggtggtggtcgtggctgctgaaggcgctgcggcagcagccactgccgcaggaggtcccgacacgggtgagtggggccctcccgcagctgccgcactcggcgctgggggaggggcaaacggttccctggaactgagctctcagctgtccgcaggaccccctggactgctgcttccagcggtcaacccttgggacgtccttctgtgtgtgtcgggcactgtaatcgcgggagagaatgccctggtggtcgctctgatagcttccacacctgccctgagaaccccaatgttcgttctggtgggatctcttgcgaccgccgatctcttggccggatgcggcctcattctgcatttcgtatttcagtacctcgtaccaagcgaaacagtatcccttctgaccgtggggtttcttgtggcttccttcgccgcatctgtttccagcttactggccatcaccgttgacagatatttgtccctctacaatgctctaacgtattatagcaggcgaactcttctgggcgtgcatctcctgctcgcagccacctggactgtgtctttgggcttaggcttgttgccagtattgggctggaactgcttggcggaaagggccgcatgttccgtcgtgcggccattggccagaagccacgtggccctgctaagcgctgcattctttatggtctttggaatcatgcttcacctatacgtcaggatatgccaagtggtctggagacacgcccaccagatcgcactccaacagcattgtctcgcacctccccatttagccgcaactagaaaaggagtcggtactttggcagtggtcctgggaacatttggcgctagttggttacctttcgccatctactgcgtcgtgggctcacacgaggatccggcagtctatacttatgctacactgctccccgcaacgtacaactctatgataaaccccatcatctatgcatttagaaaccaggaaatccaacgtgcactctggctcttgctgtgtggatgttttcagtccaaagtccctttccgatcacgctcaccctccgaagtctag

SEQ ID NO: 224066 - DNA, 1134 bp, Artificial Sequence
  Description of Artificial Sequence: Synthetic coding sequence
atgactttgcttgcctggtgtaccaggggtgccaaccccgctgcaatgaacgcctcagccgcatctctgaatgattctcaggtggtggtggttgcagccgaaggcgcagcagcagctgctaccgcagccggaggccctgataccggcgaatggggccctcctgctgccgcagcccttggtgctggaggaggggctaatggtagcctggaactttccagccagctgtcagcaggccctccagggctgctgctccctgcggtgaacccttgggacgtactcttgtgcgtgtctggcaccgtaatcgcgggtgaaaacgcccttgtagttgccctgattgctagtacaccagcactgcgaacccctatgtttgttcttgtcggctccctggcaaccgccgacctcttggctggatgtgggttgattctgcactttgtcttccagtacctagtcccatccgagaccgttagcctgctcactgtgggctttcttgttgctagctttgctgcctcagtctcgtcacttctggccataaccgtcgatagatacctgagcctctataatgcacttacttactattcgagaaggaccctgctgggcgttcacttattactggcggcaacctggacagtaagccttggattgggtctcttgccggtcttaggatggaactgtctggccgaacgggcagcctgtagcgtggtgcgccctcttgctcgcagtcatgtggccctgctcagtgccgcattttttatggtgttcggaatcatgctccatctctatgttcgtatttgtcaggttgtctggcgccacgcacaccagatagctctccagcagcattgcttagctccgcctcacctcgcggctactcggaaaggggtcggaacactcgcggtggtactgggtaccttcggcgcatcctggctcccatttgcgatttactgcgtggtcggctctcacgaggatccagcagtttacacatacgcaacgctgctacctgcaacctataattctatgataaaccccataatctacgcttttcggaaccaagaaatccagcgagccctgtggttactactgtgtggttgcttccaatcaaaggtgccctttcgctctcggtcgccctctgaagtgtag

SEQ ID NO: 224067 - DNA, 1023 bp, Artificial Sequence
  Description of Artificial Sequence: Synthetic coding sequence
atgaacgcctctgcagcctctctcaatgactcccaagttgtggttgtggctgctgagggagccgcagccgctgcaacagcggcagggggtccagatacaggagaatggggccctcccgcagctgctgccctcggagcagggggtggtgcaaacgggagtctcgagctgtcatcacagctcagcgccggacctccaggcctgctgcttcccgcagtcaacccctgggacgtgctgctttgtgtcagcggaactgttatagccggagaaaatgcgctcgtagtagccctcatagcaagcacccccgcactgagaacccctatgttcgtcctggtcggatctctggctactgccgacctcctggctggttgcggactgatcctgcatttcgtatttcagtacctggtgccatctgagaccgtatcactgttgaccgtaggctttcttgtcgcaagcttcgcagcatccgtcagcagtctgctggcaataaccgtggaccgttacttgtccttgtataatgctctgacctactactctcggaggactttgttgggcgtgcacctcttattggccgctacgtggaccgtcagcctgggactcggactgctccccgtcctaggatggaactgtctcgctgagcgggctgcttgttctgtcgtgaggccgttggcgagatcacatgttgccttgcttagtgccgcattcttcatggtttttggtataatgctgcacttgtatgtgagaatctgccaggtagtgtggcgccacgcacatcagatagcactacagcagcattgcttggccccaccccatcttgcggcaacacggaagggagtggggactctcgcagtggtgctggggaccttcggggcttcgtggctgcctttcgcaacatataacagcatgattaaccccattatttacgctttcaggaaccaggaaattcaacgagctctttggctcctgctgtgtgggtgtttccaatccaaggttccattccgctcccggagccccagcgaggtgtag

SEQ ID NO: 224068 - DNA, 1740 bp, Artificial Sequence
  Description of Artificial Sequence: Synthetic coding sequence
aacccacggctgactgtgttggaaagggttgagggatacggcgagcaagaatggcagaaaggggatgggaaaggaagaggcgaaggccatagtgagagcggtgtgctctccggttcaggctcttgcacctcgcatgtgtcatgtttcctggcggtcactaaagccgatccggctgccacttcggggcaaaagggtgatgagttgctcatcctgcagctccctggcctggctctctgcacccaaaccaacctcccaaaacgcttacagtgggaggtgcctccaacaaagccaggaagtcttggcctgggctctccttcccagggacggtggactcgcatgggggatggccctcaggaagtgccatgggtacctagcttcgggcctatggaatcgagccctatcccccaatcttctggaaattcgagcaccttggggagggtgccccagactcccggtccttcaactgcaagtggcgtgccagaggtgggtctccgcgatgtggctagcgaatctgtggcgctgtttttcatgttgcttttggatctaactgcagtggctggaaatgctgccgtgatggcagtgatcgctaagactcccgcactgaggaagttcgtgttcgtgtttcacctctgcctggtagacctgttggccgctctcacacttatgcctcttgccatgctaagtagttcagcactgttcgatcacgccctgttcggtgaggtggcttgccgtttgtatttgtttctctccgtttgcttcgtctccctggctatcttaagtgtgagcgcaataaacgttgagagatattactacgtagtccatcctatgcggtacgaggtgcgcatgacgcttggcctggtggcgtcagttctggtcggtgtctgggtgaaggccctggcaatggcttcagtccccgtgctcgggagggtgtcctgggaggagggtgctccctctgtgccccctggctgtagcctgcaatggtctcattccgcatactgccagctttttgtggtagttttcgccgttctgtattttctactgcccctcttactgatcctggttgtgtactgctcaatgttccgtgttgcccgagtcgctgctatgcagcacggcccactcccaacctggatggagaccccccgacagcgctccgaaagcctcagctcccgcagtacaatggtgaccagctcgggtgcccctcaaacaacaccacaccgaacctttgggggaggcaaggccgcagtggttctgctagctgttggtggccagttcctcctgtgctggctcccttacttcagttttcacctctatgtggcccttagtgcccagcccatatccactggtcaggttgagtccgtggtaacctggatcgggtatttctgtttcacctctaatccatttttttacggatgcctgaatcgccaaataagaggagaactgagcaagcaatttgtgtgtttcttcaagcccgctccggaggaggagctccgcttgccctcaagagaggggtcaatcgaggaaaatttcctccagtttttgcagggcaccgggtgtccgagtgaaagttgggtatcacgaccactgccctcacccaaacaggaaccacctgcagtcgacttcagaattcctggccagatagccgaggaaacctctgaatttctggaacagcagcttaccagcgatataataatgtctgattcctacctacggcctgccgctagtcccaggcttgaaagttag

SEQ ID NO: 224069 - DNA, 1356 bp, Artificial Sequence
  Description of Artificial Sequence: Synthetic coding sequence
atggagtcatctcctatcccgcagtcctcgggcaactcaagtaccctaggacgggttccacagaccccgggacccagcacagccagcggagtgcctgaggtgggcctacgcgacgtggccagcgaaagcgtcgcacttttcttcatgctgctcctggatctgacagccgtggcaggcaatgcggcagtgatggcggtgattgccaaaaccccggctcttcgtaagtttgtgtttgtctttcacctatgtcttgtggaccttctggctgccctcacgttaatgcctctggctatgctgagctcctctgcactatttgaccacgccctcttcggcgaagtggcctgcagactataccttttcctgtccgtctgttttgtctcactcgcaatcctgtccgtctccgctatcaacgtggaaaggtactactacgtggtccacccgatgcgctacgaggtgcgaatgaccttgggcctggtagccagcgttttggtgggcgtgtgggtgaaagccctggcaatggcttccgttcccgtgttgggtcgagtatcttgggaagagggagccccatccgtcccaccaggctgtagcctccagtggagccactctgcctattgccaactgtttgttgttgtcttcgccgtgttatactttctgctacctctgttgttgattcttgtggtctactgttctatgttcagagttgctagagtggctgcgatgcagcatggacccctacctacatggatggagacgccacgccagcggtctgaatcactctcttcgagatccaccatggtcacctcaagtggagcacctcagactaccccacatcgaacttttgggggtggtaaagcagctgtcgtactccttgccgtgggtggacagttcttgctgtgctggttgccttacttctccttccacctctacgtcgccctcagcgcgcagcccatttctaccggccaggtcgagtcagtggtcacttggattgggtacttttgcttcacaagtaatccattcttctatggctgtctgaatcgacagataaggggcgaactgagcaaacaattcgtgtgctttttcaagcctgcacctgaagaggagctgcgccttccttctcgggagggctcaattgaggagaactttctgcaattcctacagggcactggctgtccttcggagagctgggtctcaaggcctttgcccagccccaaacaggagccgcctgcagtggatttccgtatccccggtcagatcgccgaagagacatcagagttccttgagcaacagctaaccagtgacatcataatgtccgattcctacttgcgccctgctgcctcgcctcgcctcgagtcatag

SEQ ID NO: 224070 - DNA, 1356 bp, Artificial Sequence
  Description of Artificial Sequence: Synthetic coding sequence
atggagtcctccccaatcccacagtcctcaggaaactcatccaccttaggacgggtgccacagacgcccggtccaagcacagcctctggcgtgccagaggttgggctccgagacgtggcctccgagagcgtggctttgtttttcatgctcttgcttgacctcaccgcagtcgccggtaacgccgcagtgatggccgtgatagcaaaaacacctgctttgcgcaagttcgttttcgtgtttcatctatgtctagtcgacctcctcgccgctctgacccttatgccactggccatgctgtcttcctccgccctgtttgaccacgccttgtttggggaagtggcctgtaggctctacttgttcctcagcgtatgtttcgtttctttggcaatcttgagcgtgagcgccatcaatgtagaaaggtactactacgtggtccatccgatgcgttacgaggtgaggatgacccttggactggtagcctcagtactggttggcgtttgggttaaggccttggccatggcttccgttcccgtcttggggagagtctcttgggaagagggggcaccttcggtccctcccggttgcagcctgcaatggtcccattccgcctattgccaactgttcgtggtggtctttgcggttctctattttttgctaccgttgctgctcattctggtcgtttattgcagcatgttccgagtggcacgcgtggcggctatgcaacacggccctttgcccacgtggatggaaactcctagacagcgaagcgaatcacttagctcccgtagcaccatggtcacatcaagtggagctcctcaaacaaccccacatagaaccttcggcggtggtaaggcagcagtagtactgctggctgtgggcggacaatttctcttgtgttggctgccctatttttcctttcatctctatgtggccctgagtgcccagcctatctccaccggacaagtggaaagcgtcgtcacttggatcgggtacttttgctttaccagcaatccattcttttacggctgcctgaaccgccagatccggggtgaactttccaaacagttcgtatgctttttcaaacccgcacctgaagaggagctccgtttgcctagccgggagggaagcatcgaggagaatttcctgcagttcctacaaggcactggatgtccttccgaaagctgggtctcaagaccgttgccttcccccaaacaggagccaccagctgtggacttccggattccagggcaaatcgccgaggagacatcagagttcttggaacagcagttgacttctgacattattatgtccgattcttacctgaggccggctgcttccccaaggctggaatcatag

SEQ ID NO: 224071 - DNA, 1356 bp, Artificial Sequence
  Description of Artificial Sequence: Synthetic coding sequence
atggaatccagccctataccgcagtcttctggaaactctagtactctgggacgcgtgcctcaaacccccggacccagtacagcctcgggagttccggaggtgggacttcgagatgtagcgtctgagtcggtagccttatttttcatgcttttattggatctgaccgcggttgcaggtaatgctgccgtcatggccgtaattgccaaaactcccgcactaagaaagttcgtctttgtattccacctctgtttggttgatctgctggccgctttaacccttatgccgctcgccatgctgagtagctccgccctgttcgatcatgccctgttcggagaagtcgcatgccgcctgtacctgttcctatccgtctgtttcgtttccctcgccatcctgtcagtgagtgcgattaacgttgagcggtattattatgtagtacaccccatgagatatgaggtgcggatgaccctcggtcttgttgcgtccgtgcttgtgggagtttgggtcaaggctttggcgatggccagcgttcctgtactggggagagtgtcctgggaagagggagccccatcagtcccgcctggttgttctctccaatggtctcacagcgcctattgccagctgtttgtcgtggtattcgccgtcctctacttcctgctgcctctgctgctgattctcgttgtctattgttcaatgttcagagttgccagggtagccgctatgcagcatggacctctgcccacttggatggagacgcctagacagcggtcagagtcactcagcagtaggtcgactatggttacctcatctggcgctccccaaacaacacctcatcgcactttcgggggaggcaaagcagccgttgttctgttagctgtaggcggtcagtttctgctctgctggctgccctacttctccttccacctttatgtggcgctgtccgcccagcccattagcactggtcaggtcgaatccgtggtgacttggattggctacttctgctttacctctaacccatttttctacggctgcctcaaccgacagatccgcggtgagctctccaagcagttcgtttgcttcttcaagcctgcacccgaagaggaactgcggctgccctctagagagggctccattgaagaaaatttcctgcaattcttgcaggggaccgggtgtccatccgaatcatgggtgtcccggcctctcccctcccctaagcaggaaccacccgctgtcgacttccggatccccggacagatagccgaggaaacaagtgagtttctggagcagcagctgacaagtgatattattatgtcggactcttacttgaggcccgcagcctctccgcgtttggagtcctag

SEQ ID NO: 224072 - DNA, 1107 bp, Artificial Sequence
  Description of Artificial Sequence: Synthetic coding sequence
atggctaattctacggggttgaacgcttctgaagtcgctgggtctctcggcttaatactggcggctgtggtcgaagtgggagctttgctcggtaatggcgctctgttggtggtggtgcttaggactcccggactccgagatgccctctacctcgcccacctgtgtgtagttgaccttctggctgccgcaagcattatgccactgggactgttagcagccccaccacccggactggggcgagtgcgactcggccctgcaccatgtagagcagcccgatttctcagtgcagccctgctgcccgcatgtaccctaggcgtggctgctctcggccttgcccgttaccgcctgatcgtgcaccccctgaggcctggtagtagaccccctccggttctcgtgctgaccgccgtttgggctgcagccggtcttctaggcgcactgtcacttcttggaaccccccctgcgcctccacctgctccagcaaggtgtagcgtgctcgcaggtggattgggcccttttcggccactgtgggctttgctggccttcgctctaccagccctgttgctgttgggggcttacggcggtatctttgtagtagccagacgggctgcactaagaccccctagaccagcccgaggatcgaggctccacagcgactctctcgactcgcgcctgagcatactgcctccacttcgtcctaggcttccaggcggtaaggccgctttggctcctgctctggctgtgggccaatttgccgcttgttggctaccctatggttgtgcctgtctagccccagctgctcgggcagcagaagcagaggccgcagtgacctgggtggcctactccgcatttgctgcccaccccttcctgtacggcctcttgcagaggcccgtgaggctggcactcggtcgactgagtcgtcgtgctctgcctggacccgtcagagcctgtactccccaggcttggcacccgcgagccctgctccagtgtctgcaaagaccacccgaggggccagccgtagggccaagcgaggccccagagcagacaccagagctagcaggaggcaggagtcccgcttatcagggcccacccgagtcttccctatcctag

SEQ ID NO: 224073 - DNA, 1434 bp, Artificial Sequence
  Description of Artificial Sequence: Synthetic coding sequence
atggccaatatgcagggcttagtagagagactggaacgcgctgttagtcgactcgagagccttagcgccgaatcccataggccacctgggaactgcggagaggttaacggggtcatcgccggtgtcgctccatcggtggaagcgttcgacaaactgatggattctatggtcgctgagtttcttaagaactcaagaatactcgctggagatgtagagactcatgcagagatggtccattccgcctttcaggcgcagagagccttcctgttgatggccagccagtatcagcagccacatgaaaatgacgtggccgcactgttaaagccgattagtgaaaagatccaagagattcagactttccgtgagagaaacagaggatctaacatgttcaatcatctatcggcagtttcagaatccattccagcattaggatggatcgccgtaagccccaaacctggcccttacgttaaggaaatgaacgatgcggctactttctacaccaaccgggtgttgaaggattacaaacacagcgacctccgccacgttgattgggtcaaatcatacctgaacatttggtctgagctgcaagcctatattaaagagcatcatacaacaggtctgacttggagtaaaacaggccctgtggcctcaaccgtctccgcatttagcgtgctgtcaagtggacctggcttgccgcctcccccacctccgctgcccccacctggacccccaccactgttcgagaacgaagggaagaaggaggaatctagccctagtcgtagtgctctctttgctcagcttaatcagggcgaagccataaccaaagggttgagacatgtgactgacgatcaaaaaacatataaaaacccgtccctacgcgcacaggggggacagacacagtcccctacaaagtcgcatactccgagcccgacatccccaaagtcgtaccccagccagaaacacgcacccgttctggagctggagggcaagaaatggagggtcgaatatcaggaggaccgaaacgatctcgtcatttctgagaccgagctcaaacaggtagcatacatttttaaatgtgaaaaatcaactatccagattaagggaaaagttaattcaatcatcattgacaactgtaaaaaattaggcctggtgtttgataacgtggtcgggattgttgaggtcattaatagtcaagacattcagattcaggtgatgggaagagtgccaacgattagcataaacaaaacagaggggtgccatatctatctgagcgaagacgcactggactgcgagattgtgtctgccaagagctcagaaatgaacattctcattcctcaggacggagattatagagagtttccgattccagaacagttcaagactgcgtgggacggatctaaattgattacagagccagctgaaattatggcgtag

SEQ ID NO: 224074 - DNA, 1260 bp, Artificial Sequence
  Description of Artificial Sequence: Synthetic coding sequence
atggttttctctgccgtgctgactgcctttcacaccggcacgtcaaacactaccttcgttgtctatgagaacacttacatgaatatcactctccctcctccatttcaacatccagacctgagccctcttctccggtatagtttcgaaaccatggctccaacaggactgtcgtccctgactgttaactcaacggcggtgccaacaactcctgcagcgtttaagagtctaaacctgcctctccagatcaccttgtccgccatcatgattttcatcctgttcgtttctttcctgggtaatctggtagtgtgtctgatggtctaccagaaggctgctatgcgcagcgcgattaatattctattagcttccttggcttttgcggacatgcttttggccgtgcttaatatgccattcgccctagtgactattttgaccacaaggtggatctttggcaaattcttctgtcgggtctccgccatgttcttctggctgttcgtcatcgagggagtggccatactgctgatcatatctatcgaccgattcctgataatagtgcagaggcaagataaacttaacccctatcgtgctaaggtactgatcgcagtatcctgggcaacttccttttgcgttgcgtttccgttggccgtcggcaatcctgacctgcagatcccaagcagggccccacagtgtgtgttcggctacacaaccaatcctggttatcaggcttatgtgattcttattagtttaataagcttcttcatacccttcttggttatcctgtattccttcatggggatactcaatactttgagacataacgccctgcgaatccatagctacccagagggcatctgtctttcacaggctagcaagctggggttgatgagcttgcagcggcctttccagatgtctattgacatgggtttcaagacacgggcttttacaaccatcctgattctcttcgccgtgttcatcgtttgctgggcccctttcacaacttacagcttggtggccacgtttagcaagcatttttactaccagcacaactttttcgagatctccacttggctcctgtggttgtgttacctgaaatctgcgctgaatccacttatctactattggaggattaaaaagttccacgatgcttgtctggacatgatgccaaagagtttcaaatttttaccccagctccctgggcatactaagcggagaatccggcctagtgccgtttacgtgtgtggggagcatcgtacagtcgtttag

SEQ ID NO: 224075 - DNA, 1260 bp, Artificial Sequence
  Description of Artificial Sequence: Synthetic coding sequence
atggttttctccgctgtgcttaccgccttccataccgggacttcgaatacgacttttgttgtatatgagaatacctacatgaatatcacgcttccacctccttttcaacaccctgatttgtctcccttactgagatactcattcgagacaatggcgcctaccgggctatcttctttaaccgttaattctacagccgtgcccacaaccccagctgcctttaaaagtctaaacttgcccttacaaatcacattgtctgctataatgatctttattctgtttgtgagtttcctggggaacctggtagtatgcttgatggtttaccagaaagccgctatgcgctcagctatcaatatactgctggcgtctttagccttcgccgatatgctcttagcagttctcaacatgccgttcgcattagtaactatactgaccacccgatggatcttcgggaaattcttctgtcgcgtgtcagcaatgttcttttggttgttcgttatagagggcgtcgcaatactgctaattatttcaatagacagattcctgatcatagtacagagacaggacaaactgaatccatatcgtgccaaggtgctgatcgcagtgagctgggcgacttccttctgcgtagccttccccctcgcagttggcaaccctgatctccaaattccttccagggccccacagtgcgtgttcggatacactaccaatcccggttaccaggcgtatgtgatcctgatttcactgatctcattttttataccattcctggtcatcttgtacagcttcatgggtatccttaatactcttaggcataatgctttacgcattcattcctaccccgaagggatctgtctgagccaggccagcaaacttggtctcatgtctctgcagcgcccttttcagatgtctattgacatggggtttaaaacccgcgcattcaccaccattcttatactatttgctgtttttatcgtgtgttgggcaccctttacgacctactcactggtcgccacttttagtaaacacttttattatcagcacaacttcttcgaaattagcacctggctgctctggttatgctatttgaaatcggctctgaatcccctcatctattattggaggatcaaaaaatttcacgatgcatgcctcgatatgatgccgaagtcgtttaagttcctaccacagctgcccggacacacaaagaggaggattcgaccatccgcagtgtacgtttgtggggagcacagaacagtggtatag

SEQ ID NO: 224076 - DNA, 1332 bp, Artificial Sequence
  Description of Artificial Sequence: Synthetic coding sequence
tactgctgttccgtactgaagtgtctgaaaaacagctgtataagcgcatgtatattccatcccacagaaactatggtcttcagtgcagtgcttaccgcgttccacaccgggacctccaatacgacctttgtggtctacgagaatacctatatgaacattacgttaccacccccattccagcatcctgatttgtcccccttattgcgctacagcttcgagactatggccccaactggactgagttccttaactgtgaacagcacagcagtccccactacgccagctgctttcaaatcactcaatctgccactgcagatcactttgagtgctattatgattttcattctattcgtgtcgttcctgggaaatctggtcgtttgcttaatggtgtaccagaaagcagccatgagatcggcgattaacatcctgctggcatcactggccttcgccgacatgctgttagctgtgctaaacatgccgtttgcccttgtgactatccttacaacccgctggatatttggcaagtttttttgcagagtgtctgccatgtttttttggctgttcgtgatagagggtgtcgcaatactgctgattatatccatcgaccggttcctcattatcgtgcaacggcaggacaaactcaatccttacagggccaaggtgctaatcgccgtgtcatgggccacctctttctgcgtggcctttcctctcgcagtgggtaatcctgaccttcagatccccagccgggcaccacagtgcgtgtttgggtatacgacaaaccctggataccaggcttatgttattctcatctccctgatcagcttttttatcccctttctggtgatactgtactcctttatgggaatcttaaacaccttgcgtcacaacgccctgcgcattcactcgtatccagaaggcatctgcctgtctcaggcgagtaagttgggcctgatgtcgctgcagcgaccttttcagatgtctattgatatgggatttaagactcgagctttcactactatcctgattctattcgctgtctttattgtgtgttgggccccatttactacctattccctggtagctacctttagtaagcatttttattatcaacacaatttcttcgagatatcaacttggttactttggctttgctacctcaaatctgccctgaatcccttaatatactattggcgaataaaaaaatttcacgatgcatgcctggacatgatgcccaaatcctttaagttcctgccacaacttcccggtcacactaaaaggagaatccgacctagcgcggtgtatgtgtgtggagaacacaggaccgttgtgtag

SEQ ID NO: 224077 - DNA, 2697 bp, Artificial Sequence
  Description of Artificial Sequence: Synthetic coding sequence
atggtattctccgtgcgacagtgtgggcatgttggccgaaccgaagaagttctccttaccttcaaaatatttctcgtaatcatttgtctgcatgtcgtcttagtaaccagcctggaagaggataccgacaatagtagcctctctcctcctcccgaagtagagacaacctcacttaatgacgttactttatcactgctgccctctaacgagaccggagtcaaacctcaacgcaatatttgcaacctgtcctctatctgtaacgattccgcatttttccgcggagagataatgtttcagtatgacaaagagagcaccgtgccccaaaaccaacacattacaaatggcaccctcacaggcgttctgtcactgtctgaattaaagcggtccgagctgaacaaaactctgcagaccctcagtgagacctacttcattatgtgcgccaccgctgaagcccaaagtaccctgaactgcactttcacaattaagctcaataacacaatgaacgcttgtgcggttattgcagccctggagcgcgtgaaaatacggccaatggagcattgctgctgctccgtgcgcattccttgcccctcaagccccgaggagctggagaaacttcagtgtgatctgcaggatcccatagtgtgcctcgccgaccatccacgtgggccaccctttagcagttcccagagtataccagtcgtgccacgcgcaacagtcttaagccaagtgcctaaggctacttcattcgccgagccacccgattattctccggtgacccacaacgttcctagccccattggggagatccaacccctcagcccgcagccctccgccccaattgcttcgtcacccgctatcgatatgccccctcagtctgagacaataagctctcccatgccccagacccacgtgtctggcacaccaccgcctgttaaggcctcctttagctctccaaccgtctctgcccctgccaacgtcaacactaccagcgctcctccggtccagaccgacatagttaatactagctctatatccgacctggagaaccaggtgctgcaaatggaaaaagccttgtccctcggctcgctcgaacccaatttagcaggcgagatgatcaaccaggtaagcagactgttacatagtcccccagatatgctagccccactggcccagcgcctactcaaagtcgttgatgatatcgggttgcagctgaatttttccaataccaccatctctttgaccagtccctccctcgccctggccgtaatcagagtgaatgcgagcagctttaataccaccacgtttgtggcacaggatcccgctaacctgcaggatgaactgactgtgcgctgcgtcttttgggaccttggtaggaatgggggtcgtggcggatggtccgacaacggatgctcagtaaaggaccgcaggttgaacgagacaatttgcacatgcagccatctcacaagtttcggagtgctgctggacttaagtcgcacgtccgttctccctgcccagatgatggctctgaccttcattacctatatcggatgtggtctcagcagtatctttttgagcgtgaccttggtgacctacatcgccttcgaaaaaatccgccgagactacccatcgaaaattcttatccaactgtgcgccgctctcctgttgctgaatctggtgtttctactggatagttggatagccctctacaaaatgcagggcctgtgtattagcgttgcagtgtttctccattatttccttcttgtgagttttacttggatgggtctagaagcctttcatatgtacttggcactggtcaaggtctttaatacctacattaggaagtatatcctgaagttctgcattgtggggtggggagttccagcggttgtggttacaatcattctgactattagcccggataactatggactggggagctatgggaagtttccaaacggctcacccgatgatttttgctggatcaacaataacgcagtattttatataactgtcgttgggtacttctgtgtgatctttctgctaaatgtatcaatgtttattgtggtgcttgtgcagctctgtcgaatcaagaagaaaaagcagttgggggctcagaggaagacatctatccaggacctgaggagcattgcaggtctcacatttcttctaggaattacctggggcttcgctttcttcgcctgggggcctgtcaatgtgacattcatgtaccttttcgccatttttaatacactgcaaggcttcttcatcttcatcttttactgtgttgccaaggagaacgtgagaaaacaatggcgccgttatctgtgttgcggcaaactgaggttggccgaaaattcagattggagcaaaacagccacgaatggcctcaaaaaacagacagtgaatcagggcgtatccagcagctcaaattccctgcagtcctctagcaatagcaccaacagtacaactctgctggtgaataatgattgctcagtgcacgcttcaggcaatggcaacgccagcaccgaaagaaacggcgtcagcttcagtgtccagaatggggacgtctgccttcatgacttcacaggcaagcagcacatgttcaatgaaaaggaagactcatgcaatgggaaaggtcgcatggccctgcgcaggacatcaaaacgtggttccctgcatttcatcgagcagatgtag

SEQ ID NO: 224078 - DNA, 3006 bp, Artificial Sequence
  Description of Artificial Sequence: Synthetic coding sequence
atggtattctcggtgaggcagtgcggccacgtaggccgtactgaggaagtgctgctaacatttaagattttcctggtgattatatgcctgcacgtggtgttggtcacgtccttggaggaagacacagacaacagttccctgtcgccccctcctgatgaagaaactggggcatgtagtgatgtgaccttaagtctgctgccttccaacgagacagaaaaaaccaaaattacgattgtgaagacgttcaatgcaagtggcgttaaaccccagcgcaatatttgcaacctaagtagtatttgcaacgacagtgcattctttaggggagagatcatgtttcagtacgacaaggaatcaaccgtcccacagaaccagcacattaccaatggaacccttactggcgtactgagcctgtccgaactgaaacgatccgaactgaacaagacgctccagaccctttctgaaacatattttattatgtgtgccacagcagaagcccagagtacactgaattgtacctttactatcaagttgaataatactatgaatgcgtgtgcggtcattgccgctctcgagcgggtcaaaattcggccaatggagcactgttgttgttcggtccgaatcccatgcccctcttctcccgaggagctcgaaaagctgcaatgcgatctgcaggaccctatcgtctgtcttgctgaccatcccaggggcccaccattttcttctagccagagtatcccagtggtacctagggccaccgtcctctcacaggttcccaaagcaacatcattcgccgaacctcccgattatagccctgtgactcacaatgtgccaagtcctatcggagagattcagccgttaagcccacagccaagcgctcccatcgcctcaagccccgcaatcgatatgccgcctcagtccgaaacaatcagcagtcccatgccgcagacacacgtaagtggcacccctcccccagttaaggctagcttttcctctcctacagtgtcagctccggcaaatgtcaatacgacatccgcccctccagtgcagactgatattgttaacactagttccatttcggacctggaaaaccaagtgttacaaatggaaaaagctctcagcctagggagcctggagcccaacttagccggagagatgataaaccaagtctcacgcctgctccacagccctcccgatatgctggccccactcgcccagaggttgcttaaagtagttgacgacataggactccaactcaatttctcaaatacgactatttccttgacctcgccctcccttgctctggccgtgattagagtgaacgcttcttcgttcaatacaaccaccttcgtggcccaggaccctgctaaccttcaagtctcactggagactcaggcgccagagaattctattggaacaatcactcttccatcttctctcatgaataacctgcccgctcatgatatggagttggcaagccgagtacagtttaattttttcgagacccccgctctcttccaggatccgagccttgagaacctgagccttatcagctacgtgatctcctctagcgttgccaacctgacagtgagaaatctcaccaggaacgtcaccgtgactctcaagcacattaacccttcccaggacgaactaaccgtacgctgtgtattctgggacctcggtcgcaacgggggaagaggcggatggtccgacaatggttgctcggtgaaggacagaagattaaacgagacgatttgtacatgttcgcatctcacttcttttggcgttctgctcgatctgtccaggacaagcgtgcttcccgctcagatgatggccttgacctttattacatacattggatgcgggctatcatccatcttcttgagcgtgacattagttacgtacatcgccttcgagaaaatcaggagagattatccttccaagatcttgatacagctttgcgcagccctcctgctgctcaatctggttttcctgctagactcgtggatagccctgtataagatgcagggtttatgcatctctgtcgctgtgtttctgcactactttctcctggtgagttttacctggatgggcctggaggcgtttcatatgtacctggcgctggttaaggtgtttaacacctacatccgaaagtacatactgaaattctgtatcgtggggtggggagtgcctgccgtggtggttacgatcatcctgactatcagccccgataattatggtctgggctcttacggcaagtttcctaacggcagtcccgacgatttttgctggattaacaataacgctgtgttttacatcactgtggtcggatatttttgtgtcattttcctcctcaacgtcagtatgttcattgtcgtgctggttcagctatgccgtattaaaaagaaaaagcaactgggggcacaacgcaagacgtctattcaggaccttcgctctatagctggccttacatttcttctaggcatcacatggggcttcgccttcttcgcctggggtcccgtcaacgtgacctttatgtacttgttcgcaatattcaacacactccagggattctttatttttatcttctattgcgtggcaaaagaaaacgttaggaagcagtggagacggtatctctgttgcgggaagctcagactggccgaaaatagcgattggagcaaaaccgctacaaatggtcttaaaaagcaaaccgtcaatcagggcgtatctagtagctcaaacagcctgcagtctagctccaatagtaccaacagcaccaccttgttggtcaacaatgattgttccgtacacgcgtccggaaatgggaacgcatctacggagagaaacggggtcagcttttctgtccagaacggagacgtttgtctgcacgactttactggaaaacagcacatgttcaacgagaaggaggactcatgtaacgggaaggggcgtatggctctacgccgaacatcaaagcgtgggtcccttcatttcattgagcagatgtag

SEQ ID NO: 224079 - DNA, 3012 bp, Artificial Sequence
  Description of Artificial Sequence: Synthetic coding sequence
atggtttttagcgtgcgtcaatgcggccatgtagggcgtacagaagaggtgcttctcaccttcaaaatttttctcgttatcatctgtctgcatgtagtccttgtgacaagtcttgaggaggatacggataattctagcctgtctccgcctcccgctaagctgtcagttgtctcatttgcacccagttcaaacggaactcctgaagtggaaacgactagtctcaacgatgtgacattaagtctcttaccttccaacgagacgggtgttaagccgcagcggaatatctgcaacctgagctctatttgcaatgatagtgccttttttagaggcgagatcatgtttcagtacgataaagaaagcactgtgccccagaatcaacacatcaccaatggcactctgaccggcgtgttgagcctctccgagctcaagagatcagagctcaataaaacccttcagacactctccgaaacgtatttcatcatgtgtgcaactgctgaggcccagagtacgctgaactgtacgtttactatcaaattgaataacaccatgaacgcgtgcgcggtgatcgccgcactggagagggtaaagatccgcccaatggaacattgttgctgctcagtgcgcattccatgtccgtcatccccagaggaacttgagaagttgcagtgcgatttgcaggaccccatcgtttgtctggctgatcacccaagggggcctccctttagttcttcgcagagcatccccgttgtgcccagggcaactgtgctttcccaagtcccgaaagctacatctttcgccgagcccccagattacagccccgtaacgcataatgttccttctccaattggcgaaatccagccattgtccccccaacccagtgccccaattgcatcgtcccccgctatcgacatgcctccacagagcgagaccattagcagtcctatgcctcaaacacatgtgagtggaactccgcctccagtgaaggcgtccttctcttcccccacagtgtccgcccctgccaatgtgaataccactagtgcccctccagtgcaaactgacatcgtgaacaccagctccatctccgatctcgagaatcaagttcttcaaatggaaaaggccctgagcttgggatccctcgagccaaacttagctggtgagatgatcaaccaagtctctagactacttcatagccctccagacatgcttgcgcctcttgctcagcggttactgaaggtggtcgatgacatcggcctgcagttaaactttagcaacaccaccattagtttgaccagtccttcactggccctggctgtaatcagggtcaatgcctcttcttttaataccaccacattcgtggcccaggacccagccaacctgcaggtatccttggaaacccaggccccagaaaacagcataggtactatcactctgcccagctctttgatgaataacttacctgcccatgatatggagctcgccagccgagtgcaatttaatttttttgagacaccagccctgttccaggaccccagcctcgagaatctaagcctgatatcatatgttattagttcttcagtagccaacctcaccgtgcggaacttgaccaggaacgtgacagttacactgaagcacataaatccctcccaggatgaactcaccgtgcgatgtgtgttctgggacctcggacggaacggcggtagagggggatggtctgataacggctgctccgtaaaagaccgacgcttgaacgagaccatctgtacctgcagtcacctgacttccttcggggttcttttagacctgagcaggacaagcgtgctgcccgctcagatgatggctctgaccttcatcacttatatcggttgcggcttgtcttcaatattccttagtgtcactcttgtgacttacatcgcctttgagaagatacgcagagattacccgtctaagattctaattcagttgtgcgccgctttgctcctgttgaacctggtgttcctgctggactcatggatcgccctgtataaaatgcaggggctgtgtatcagtgttgccgtttttctgcactactttctcctagtgtccttcacatggatgggtctggaagccttccacatgtacctggcgctggtcaaagttttcaatacttacatcaggaagtatatccttaaattctgtatcgtggggtggggcgtgcctgctgtcgtggttaccattatcctcactatttcacctgacaattacggtctcggatcctatgggaaatttccaaatggctcgcccgacgacttttgctggatcaataataatgccgtgttttatattactgtggttgggtacttctgcgtgatatttttgcttaacgtgagcatgttcatcgtggtcctggttcagctctgtcgtattaagaagaagaagcaactgggcgcacaacgtaagacatctatccaggatctcaggagcatcgccggtcttacttttctgttgggcataacgtggggtttcgccttctttgcatggggtccagtgaacgttacatttatgtacctttttgcgattttcaataccctccagggctttttcattttcattttttattgtgtggctaaggagaacgttagaaagcagtggagacgatacctgtgttgcggcaaactgaggctggctgagaatagtgattggagtaagaccgctacaaacggcttaaaaaaacaaacagttaaccaaggagtttcctccagcagcaattctctacagagttcctccaactcaactaatagcacgaccctcctagtgaacaatgactgtagtgtccacgcatcaggaaacggcaatgctagcacagagcgcaatggcgtgagcttcagtgtccaaaatggtgacgtgtgccttcatgacttcactggcaaacaacacatgtttaacgagaaagaggacagctgcaatggtaagggcagaatggccctcagacggacctctaagagaggatcactgcatttcatcgagcagatgtag

SEQ ID NO: 224080 - DNA, 2964 bp, Artificial Sequence
  Description of Artificial Sequence: Synthetic coding sequence
atggtgttcagcgtgcgtcagtgtggacacgtgggacgtacagaggaagtgctgttgacgttcaagatcttccttgtcatcatttgcctgcacgtggtgcttgtaacaagtttggaggaggatacggacaattcctctctctctccccctcctgaagtggagacgacctcacttaatgatgtgactctgtcgttactgccttccaacgaaaccggggtcaaaccccagcggaacatctgtaacctgtcgagcatctgcaacgattccgccttcttccggggagagattatgtttcagtacgataaagaatcaacagttccccagaatcagcacattaccaatggtacgcttactggggtgctcagcctcagcgaattgaagagaagtgagcttaacaagaccttacagacgttatcggagacatacttcatcatgtgtgccactgctgaggcccagtctactctgaattgcacatttacgataaagctgaacaatactatgaatgcctgtgctgtcatcgcagctttggagagggtcaagattaggccaatggaacattgctgttgtagcgtccgcatcccctgtccatcaagccccgaagagctggaaaagcttcagtgcgacctacaagatcctatagtgtgccttgcggaccatccacggggaccaccttttagttcatcccagagcattcccgtggttcccagagccactgtcctgagtcaggtacccaaagcaaccagcttcgccgaacctcctgactatagccctgtgacccataacgtaccctcccccattggggaaatacaacctttgagcccacaaccatcagccccaatcgccagttcccctgctatcgacatgccgccacagtccgaaaccatcagctctccaatgcctcaaacccacgtctccggaacaccccctcctgttaaggcgtctttcagtagcccaaccgtaagcgccccagcaaacgttaatacaacctcagcccctccagtgcagaccgatattgtgaataccagtagcatttccgatctcgagaaccaagttctgcagatggagaaggcactctcattgggcagtctcgagcctaacttggcgggtgaaatgattaaccaggtgtccaggcttctccattccccgcctgacatgctcgcccctcttgcacagagactcctcaaggtagtagacgatatcggcctgcagctgaatttctctaacactaccatctccttgactagcccttcactggctttagccgtaatacgagtgaatgcttcatccttcaacacgactacctttgtcgctcaagacccagcgaatcttcaggtctccctcgagacacaggcccctgagaattccattggcaccattacattgccttcctcgctgatgaataacctgcctgcgcatgatatggaactggcttctcgagtgcagttcaactttttcgagactccagccttgttccaagacccttccctggagaacctgtctcttatctcgtacgtgatttcctcaagcgtggcgaacttgactgtccgcaacctgacgagaaatgttactgtaaccttaaaacatatcaatcccagtcaggatgaactaacagtacgctgcgtgttttgggacttgggcagaaacggcggacgcggagggtggagcgacaatggctgctctgttaaagatcgcaggttaaatgagacaatctgtacctgcagccacttgacttctttcggcgtactgctcgatctttcgcggactagcgtgctgcctgcacagatgatggctttaaccttcataacatacattggctgcgggctgtcaagcatttttctctccgtcacactcgttacctacatcgcatttgaaaaaatccgcagagactatcccagcaaaattttgatccagctctgtgctgcgctcctcctattgaacttggtgtttctgcttgatagctggatcgctctctataaaatgcaaggcttgtgtatcagtgtagccgtatttctgcattacttcctgctggtgtcctttacctggatggggttggaagccttccacatgtacctggctcttgtgaaagtgtttaatacatacattcggaagtacatactcaagttttgcatagtaggatggggagtaccagcagttgtcgtgacaattattctcaccattagcccagataactacggcctgggctcatatggcaaatttcctaacgggagccctgacgacttctgctggatcaacaacaacgccgtcttttacatcaccgtagttggatacttttgtgtgatttttctgctgaatgtatctatgttcattgtcgtcttggtgcaattatgccgtatcaagaaaaagaagcagctgggcgcacagagaaaaacctccatccaggatctccgtagcattgcaggcctcaccttcctactggggatcacctggggattcgcttttttcgcctggggaccagtgaacgtgacgtttatgtatttatttgccatcttcaacacactgcaaggattttttatctttatcttctactgcgtcgctaaggagaatgtccgtaaacagtggagaagatatctctgttgcggtaaattacgcctggctgaaaactctgattggtccaaaactgcaactaacgggctgaagaaacagacagtgaaccagggcgtatcatccagctcaaattccctgcaatcatcatcgaattctaccaattctaccacactacttgtgaataacgactgttccgtacatgcaagtggcaatggaaacgccagcaccgagagaaacggcgtgagcttttccgttcagaacggtgatgtctgcctgcacgatttcaccggcaagcaacacatgttcaatgaaaaagaggactcatgcaacggcaaaggcaggatggctctgagacgcacgagtaagaggggcagtctgcactttatcgagcagatgtag

SEQ ID NO: 224081 - DNA, 3045 bp, Artificial Sequence
  Description of Artificial Sequence: Synthetic coding sequence
atggtgttctccgtcagacagtgtgggcacgtgggtcgaaccgaagaagttctgctcaccttcaaaatattccttgtcatcatatgtttgcacgtggtgctcgtgacctcactggaggaggataccgacaactcctcattatccccacctccagccaagctcagcgtggtgtccttcgccccttcatcgaacgaagtggagactacttcactaaatgacgtgactctgtccctgctgccgtctaatgagactgagaagaccaaaattaccattgtgaaaacattcaacgcatctggagtgaaacctcaacggaatatctgtaatctgagtagcatctgtaatgactccgcattttttagaggggaaatcatgtttcagtacgataaagaatctactgtaccacagaaccagcacatcaccaacggcacgctcacgggcgtactgtccctatccgagttaaaaaggagcgagctgaataagaccttgcaaacgctgtcggagacctactttattatgtgtgccacggccgaggcacagagtaccctgaattgtactttcaccatcaaacttaacaacactatgaatgcctgcgccgttatcgccgcattggagcgtgtcaaaattcggccaatggagcactgttgttgtagtgtcaggatcccctgccccagcagccccgaggaattggagaagctgcaatgtgatctgcaagatccaatcgtgtgtctcgctgaccaccccagggggccacctttcagttccagtcagtctattcccgttgttccacgggcaacagttctgtcccaagtccccaaggccacatccttcgctgaaccgccagattactccccagtgacccacaatgtgcctagtccaatcggtgagattcaacccctgtcaccccagccctcggcccctatcgccagcagccctgctatcgatatgcctccccaatcagagaccataagttcacctatgccacagactcatgtgagcggcaccccaccccctgttaaggccagtttttcgagcccaacggtgtctgcccctgccaatgtaaacactacaagtgcccctcccgttcagactgacattgtcaacacctcctctatttcagaccttgaaaatcaggttctacaaatggaaaaggcactctcgcttggttcgcttgagcccaacctggcgggagagatgatcaaccaggtgtctcgactcctgcactcaccccctgatatgctagcacccctggcacagcgactgctgaaagtagtggacgacataggcctacaactgaacttctctaatacaactatctccctaacttccccttctctggccctggcagtgattagagtcaatgcgtcaagcttcaataccaccactttcgtcgcccaggatccggcaaatctgcaggtgagtctagaaactcaggccccagaaaattccattggtaccatcacactcccctccagtttaatgaacaaccttccagcccatgacatggagttggccagtcgtgtgcaatttaatttctttgaaacacccgcattattccaagacccatctctggagaatttgagccttatctcatatgtcatttctagcagcgtggcgaatctgacagtgcgaaacttgaccagaaatgtgacagtgacgctgaaacacatcaatcccagtcaggatgagctgactgttcgatgtgtgttttgggacctcggtcgaaacggtggaaggggtggttggagcgataatggctgctcagtaaaggaccggagattgaacgaaacaatctgtacatgctcccatctgacctctttcggtgtcctgcttgatctgtcacgcacttcagtgttgcccgctcaaatgatggcgcttacctttatcacttacataggatgcggactgtcttcgatcttcttatctgtgactctggtcacatatatagcgttcgagaagataagaagagattacccatcaaagatcctgatccagttgtgcgctgcccttttgcttctcaatctggtgtttttgctggactcctggattgccctctacaagatgcaaggtctttgcataagcgtcgcagtgtttctccattacttcttgctggtttcatttacctggatgggcctggaggcctttcatatgtacctcgccctggtgaaagtcttcaacacatacatcagaaagtacatccttaaattttgcattgtcggatggggggtacccgcagtagttgtgactataatcctgactatttctccagataactacggtttgggcagctatggcaagtttcccaatgggagccccgacgatttctgttggattaataataatgccgtgttttacattacagtcgtcggctatttctgcgtgatttttctgctgaacgtttctatgttcattgtggtattagttcagctgtgccggattaaaaaaaaaaaacagctcggtgctcaacgaaagaccagtatccaagatctgaggtctattgcaggtctgacattcctgttaggaattacatggggttttgccttcttcgcatggggccctgtcaatgtgacctttatgtacctttttgcaatatttaatacactgcaaggtttctttatattcattttctactgtgtggctaaagagaacgtgcggaaacagtggcggaggtatctgtgctgtgggaagttgcgcctcgcggagaatagtgactggtcgaagaccgctacaaacggcctgaaaaagcagacagtgaaccagggtgtgtcctcttcttcaaactccctccagtcgtccagcaatagtacgaattcgacaacgctccttgttaacaatgattgcagcgtgcatgccagcggtaacggaaacgcgtccaccgaaaggaacggcgtatctttctcagtgcaaaatggagacgtgtgtctacacgatttcaccggcaagcagcacatgttcaacgagaaggaagattcctgcaacggcaagggcagaatggcattaagacgtacctccaagagaggctccctgcatttcatcgagcagatgtag

SEQ ID NO: 224082 - DNA, 2988 bp, Artificial Sequence
  Description of Artificial Sequence: Synthetic coding sequence
atggtgtttagtgtgcgacagtgtggacatgtaggcaggacagaggaggtcctgcttacttttaagatctttttagtcatcatctgcctgcatgtcgtcctagtgacttccttagaggaggacacggacaactcttcactttccccccctccggcaaagttatctgtcgtcagcttcgctccttccagcaatgggaccccagacgtgacgctcagtctgttacccagcaacgaaaccggggtcaaaccacagcggaatatatgcaatctctcttcaatttgtaacgacagtgccttcttcaggggcgagattatgtttcagtatgacaaggagagcaccgtcccgcagaatcagcacattaccaatggcacgctgactggcgtcctttccttaagtgaactgaaacgttcggagcttaacaagactctccagaccctgtctgaaacctatttcattatgtgcgctaccgccgaggcacagagtacgctcaactgtacttttactattaagctgaacaacaccatgaacgcttgcgccgtgatcgcagctctcgaacgtgtgaagatccgacctatggaacattgctgctgcagcgtccgcattccttgtccttcatcacccgaagaattggaaaaactgcaatgcgacctgcaggatccgattgtatgtctggccgaccaccccagaggtccaccattctcttcatctcagtccatccccgtggttccaagagccacagtcctcagccaagtgcccaaggctactagctttgcagaacccccagactatagtccagtgacacacaatgtgccgagccctattggcgagatccaacccctctctcctcaacccagcgccccaattgcgtccagtccagcaatagacatgcccccacagtccgaaaccatttcttcccccatgcctcagactcacgtttccggcaccccgcctccagtgaaagcttccttctcttcaccgacagttagcgcaccagctaacgtgaacaccactagcgcccctcccgtgcagactgatatcgtgaacacgtcatccatctcggacctggaaaatcaggtgctgcagatggagaaggcgctgtccttggggtccctggagcctaatctggcgggtgagatgatcaatcaagtgagtagattactgcacagcccccctgatatgcttgcccctctcgcccaacggctgctgaaggtggttgatgacatcggcctccaactcaattttagtaacacaactataagcctgacaagcccctctcttgcattagccgtaatacgggttaatgcatcttcgttcaacacgacaaccttcgttgctcaggaccctgcaaacttacaagtgtctcttgagacccaggctccagaaaacagtatcgggactatcactctgccgagttcgctgatgaacaacctgccagcccacgatatggagctcgccagcagggttcagttcaatttcttcgagaccccagccctgtttcaggatccaagcctggagaatctcagcctgatttcctacgtcatttcctcatctgtggccaatctcaccgtaaggaatctaacaagaaatgttaccgtgactctgaagcacatcaacccaagccaggacgaattaacagtgcgctgcgtgttctgggaccttggcagaaacggcggtaggggaggctggtctgataacggatgctctgtcaaagacagaagattgaacgaaactatttgcacctgtagccatctgaccagcttcggtgtgctcctggatcttagcaggacatcagtgctcccagcacaaatgatggctcttacttttataacgtatatcgggtgtgggctcagctccatcttcctcagcgtgacactggtaacatacatcgcattcgagaaaatcaggagggactacccttccaagatactgatccaactgtgtgcagcattacttctcctgaacctagtattcttgctggattcatggatagccttatataagatgcagggtctctgcatatccgtggccgtgtttctccactatttcctgctcgtgtccttcacttggatggggttggaggcttttcatatgtacttagcgctggtgaaagtctttaacacgtacattagaaagtacattctcaagttctgcatcgttggctggggtgtacccgctgttgtcgtaacaatcattctcacaatctctccagacaactacggactcggctcgtatggaaagttccccaatggctcccctgatgatttctgctggatcaacaataacgcagttttctatattacagtggtaggatacttttgtgttatttttttgcttaatgtttcgatgttcattgtagtgttagtccagttgtgtcgcatcaaaaagaagaaacagttgggagctcagcgaaaaacatctattcaggaccttcggtcaattgctggtctgacttttttgcttggtattacgtggggctttgccttcttcgcttggggtcctgtcaacgtaaccttcatgtacttgttcgcaatttttaataccctgcagggattcttcatctttatcttttattgtgtagccaaggaaaacgtcagaaaacagtggagaaggtacttgtgttgcggaaaactgaggctggccgagaactcagattggtctaaaacagctacgaacggtctgaaaaaacagaccgtgaatcaaggggtgagctcatcgtcaaattccctgcagtcatccagtaatagtaccaatagcacgacgctgctagtcaataacgattgctccgtacacgcctctggaaacggtaatgcctctacagaacggaacggtgtaagtttttctgttcagaacggggacgtgtgcctgcatgatttcacagggaagcagcacatgtttaatgaaaaggaagacagctgcaacgggaaaggtcgcatggcactccggcgaacctctaagcggggtagcctacactttattgaacagatgtag

SEQ ID NO: 224083 - DNA, 3054 bp, Artificial Sequence
  Description of Artificial Sequence: Synthetic coding sequence
atggtattttctgtccggcaatgtggacatgtgggacggactgaggaagttctcctgaccttcaagatttttctggtgatcatatgcctccatgtggtgctggtaacatccttggaggaggacaccgacaatagcagcctatcacctcctccggctaagctatccgttgtgtccttcgctccatccagcaatgggacgccagaggtagagacgacgtcgctgaatgacgtaacactcagcctgctgccgagcaatgaaacggagaagacaaagattacaattgtcaaaacatttaatgcctcgggagtgaagccccaaaggaatatctgtaatctgtcaagcatttgtaacgacagcgcattcttccgcggtgaaatcatgtttcagtatgataaggaaagcaccgtaccgcagaatcagcacattaccaacggcacacttaccggggttctcagtctctctgaactgaagcgctccgagcttaacaaaacactgcagacgcttagcgagacctattttattatgtgcgccacagccgaggcacagtcaactctgaactgcacctttactatcaagctgaacaacaccatgaatgcatgcgctgttattgcggcactcgagagggtgaagattaggcccatggagcactgctgttgttctgtgcggattccatgcccttcctctcctgaagagctggaaaagcttcagtgcgatctgcaagatcccattgtatgcttggctgatcaccccaggggacctcctttctccagcagtcagtccatccctgtggtgccacgggcaaccgtgctgtcccaggttcccaaggccacatcattcgcagaacctcctgactacagccccgtgactcacaatgtccccagcccaattggcgaaatccaaccactgagtccacagccctcagccccaattgcgagttcccccgctatcgacatgccgccacagtctgagaccatatctagtccgatgccacagacccatgtctctggaacacctccccctgtgaaagcctctttttccagccccactgtctccgcccctgccaatgtcaacaccacaagcgcgcctcctgtccagacagatatagtgaacaccagcagtatttctgatctggaaaatcaggtgctccaaatggagaaagctctgtcccttggctccctggagcccaaccttgctggagaaatgattaaccaggtgtcccgccttctgcattctccacccgatatgttggcccctctcgcccagcgattgcttaaagtcgtggacgacatagggctgcagctgaatttctcaaacaccaccatctctctgacatcccccagcttagctcttgccgtcattagagtgaacgccagcagctttaataccactacatttgtcgctcaagaccctgcaaacctgcaggtgtccctggagacccaggctcccgaaaactcaatcggaacgattacgctcccttcctcactgatgaataatctgccagcacacgacatggaactggcttcgcgagtccagtttaatttctttgaaactcctgccttgtttcaggatccaagtttagagaacttatcccttatttcttacgtgattagttccagcgtcgcaaatctgaccgttcgcaaccttactcgaaacgtcaccgttacactgaaacatatcaatccttctcaagacgagctgacagtgagatgtgtgttctgggatctggggaggaacggcggacgaggcggatggtccgacaatggctgtagcgtgaaagacaggaggcttaacgagacgatctgcacctgctcccacttaacaagttttggtgtattactggatttgtcgaggacctctgtcctccccgcacaaatgatggcactgacgtttataacgtatataggctgcggcctgtcctccatatttctttcagtcaccctggtgacctatatcgctttcgaaaagatcaggagggactatccttcgaagattctcatccagttatgcgctgccctgctcctcctcaacctggtgtttttactggacagttggatcgccctttataagatgcagggtctttgcatctcagtagcagttttcctccactacttcttattggtatccttcacatggatggggctggaagccttccacatgtacctcgccctggtgaaggtctttaatacttacattcggaaatacatcttgaaattctgtattgtgggctggggggtgcccgcagtagtggttacaatcattctgactataagtcccgacaactatggacttgggagctatggcaagtttcctaacggatccccggatgatttttgctggattaacaataacgctgtgttttacataactgttgtaggatacttttgcgtaatatttttgctgaatgtgtccatgttcattgtcgtgctggtacaactctgtaggataaagaaaaaaaagcagctgggagcccagaggaagacatccattcaggatttgcgatcgattgcgggactgacattcctcttgggaatcacctggggctttgctttcttcgcatgggggcctgtaaatgtcacatttatgtatctgtttgcaattttcaataccctgcagggcttttttattttcattttctactgcgtggccaaggagaatgtcaggaaacagtggcgcaggtacctatgttgcggcaaattgaggctcgccgaaaacagcgattggtcaaagactgctactaacggactcaaaaagcaaactgtcaaccagggcgtgtctagctcatccaattcccttcagagcagctcaaatagcacaaactcaacaacattactggtgaacaatgactgcagcgtacatgctagtggcaacgggaatgcttctactgagcgaaatggtgtgagcttttcagtgcaaaatggggatgtctgcttacacgatttcaccggcaagcaacacatgttcaacgaaaaggaggatagctgtaatggcaaagggagaatggctctgcgaagaacgtccaagaggggaagccttcatttcatcgagcaaatgtag

SEQ ID NO: 224084 - DNA, 2901 bp, Artificial Sequence
  Description of Artificial Sequence: Synthetic coding sequence
atggttttttcagtccgacagtgcggacacgtgggtagaacggaagaagtgcttttaacttttaagatttttctagtgattatctgccttcatgttgtgctggtaacaagtctggaggaggacactgataactcatctctcagccccccacctgcaaaactctcagtggtgagcttcgctccatcaagcaatgggacaccagaagttgaaaccacttctctgaatgatgtaacgctgagtttgcttccgagtaatgagacagagaaaacaaagatcacaatcgtgaaaactttcaacgccagtggggtaaagccacagagaaatatttgcaacctcagctcaatctgcaatgactcagcattttttaggggtgagattatgttccaatacgataaggagtctactgttcctcagaatcagcacatcaccaatggtaccctcacaggggtcctgtccctctcagagttaaaacgtagtgagctgaataaaacgcttcaaactctgagcgagacatatttcatcatgtgcgccacagcagaggcacagagcaccctcaactgcacattcaccatcaagctgaacaacacaatgaacgcctgcgctgtgattgccgctctggaacgagtgaaaatccggcctatggagcattgctgctgctccgttcggataccatgccctagctctcctgaagagctcgagaagttacagtgtgatctgcaggatcccatagtctgtctcgccgatcaccccagggggccacccttcagctcatcccagagcatcccagtggtgcccagagctaccgtgctctctcaagtgccgaaggctaccagctttgccgaaccacctgactactccccggttacacacaatgtcccttccccaatcggggaaatccagcctctgtcacctcagccttccgccccaattgcatcctcccctgctattgatatgcctcctcagtccgaaacaatctcaagtcccatgccccaaacccacgtcagcggtacccctcctccagtcaaggcctctttttcaagtcccactgtcagtgcgcctgccaacgtgaataccacatctgcgccacctgttcagaccgacatcgttaatacttctagtatctccgacctggaaaaccaggtgctccagatggaaaaggccctctcccttggaagtctggagcctaatttggccggagagatgatcaaccaggtcagtcgactgcttcattctcctcccgacatgctggcacccctcgcacagcggttgttaaaggtcgtcgatgatatagggctgcaactgaatttcagcaacactactatctcacttacgagtccgtcgctggccttggctgtgatccgcgtcaatgcatcttcgtttaacactactaccttcgtggcccaggatcccgctaatctccaagtgtcactggagacacaggccccagagaactcaatcggcacgatcacactgccctcgtcactgatgaacaacctgcccgctcacgacatggaactggcttcaagggtccaattcaacttcttcgagactccagccttgttccaagacccctctctggagaacctgagcctgatctcctatgtgatttcttcttcagtagccaatttaacagtgcgaaatttaacccggaatgttaccgtcacattgaaacatatcaatccctctcaggatgaactcaccgtgcgctgcgtgttctgggacctgggccgaaacggtggtcggggtggatggtccgataacggctgtagcgtgaaggatagacgccttaatgaaaccatttgcacttgctcgcacctgacttcctttggtgtgctgttggatttgagcagaacctcagtcctgcccgctcaaatgatggctctgacgttcataacttacataggttgtggactgtcatccattttcctatctgttaccctggtaacctacatagctttcgagaagatcaggcgagattacccaagcaagatcctcatccagctgtgcgcagcactgctcctgttaaatttagtattcctgctggatagctggatcgccctgtacaagatgcaagggctgtgtattagtgttgcagtctttctgcactactttttgcttgtttcctttacgtggatggggctcgaagctttccacatgtacctggcactggtgaaggtattcaatacttacatccggaaatacattcttaagttttgtatcgtaggctggggggtgccagccgtggtcgtcactatcatcctgaccatttccccagacaattatggtcttggaagctacggcaagtttcccaacgggtcgcccgatgatttctgctggattaacaataacgccgttttctacatcaccgttgtggggtatttctgtgtaatcttcctcctaaatgtgtccatgtttatcgtggtgttggtccagttatgtcgcattaaaaagaaaaagcagctgggggctcagcgtaagacctctattcaggacctcaggtctattgctggtctaacttttctgctaggaattacctggggattcgcattctttgcatggggccctgtgaatgttacttttatgtacctgtttgctatcttcaatacccttcagggatttttcatattcatattttactgtgttgcaaaagagaatgtcagaaaacaatggcggcgttatttgtgctgcgggaagttgagattggcggagaacagcgggaacgctagcactgagcgtaatggcgtcagcttttccgtgcagaatggggatgtctgcctccatgatttcaccgggaaacagcacatgttcaacgagaaggaagattcgtgcaacggtaaagggaggatggcactaagaagaacgtccaaacggggaagcctccacttcatcgagcagatgtag

SEQ ID NO: 224085 - DNA, 2982 bp, Artificial Sequence
  Description of Artificial Sequence: Synthetic coding sequence
atggtgttttcagtccgccagtgcggccatgtcgggaggacagaagaagtgcttctgacatttaaaatctttctggtgatcatctgccttcacgtggtgctggtgaccagtctcgaggaggacaccgataattcctctttgtccccccctcctgatgtcactctctccctgctgccctccaatgagaccgaaaagacaaaaataacaattgtgaaaaccttcaatgcttcaggagtgaagcctcagcgaaatatttgcaatttgtcttccatctgtaacgatagcgcgtttttccgcggagagatcatgtttcaatatgacaaggagtcgacagtgccccaaaaccagcatatcacaaatgggacactcaccggtgttttgagcttgtcagaactgaagaggtcagagctgaacaagacactgcagacgctcagcgaaacctactttattatgtgtgcaacagcagaggcacagtctacattaaactgtactttcactatcaaattaaacaacacgatgaacgcctgcgccgttatcgccgcactggagagggtaaagattcgcccaatggagcactgttgttgctctgtgcggatcccctgtccctccagcccagaggagctggaaaaacttcagtgcgatcttcaggaccccatagtgtgcctggctgatcatccccgtggacctcctttctcatcgagccagtctatcccagtggtacctcgtgcaaccgttctctcacaggtgccaaaagccacttccttcgctgaacctcccgactactccccagtgactcataacgtgccgtcacctatcggcgagatacagcctctgtctccacaaccctctgcccctattgcaagctcaccagcaattgatatgcctccacagagcgagactatttctagcccaatgcctcagacacacgtgtctggtacacctcctccggttaaagcttccttcagctcacctaccgtgtctgctcccgctaacgtcaacacaacgagcgctccccctgtacagactgacattgttaacacgtcctccatctccgacttggaaaaccaggtgcttcagatggaaaaagcactctccctgggctctctcgaaccgaacctggctggggaaatgattaatcaggtgtcaagactgctgcactcccccccagacatgctggccccactcgctcagagactcttgaaggtcgtggacgacatcggactgcagttgaacttcagtaacacaactatttctctgacatctccaagcctcgccctcgcagtaatccgtgtgaacgcatcctcgttcaacacaaccacatttgtggcccaggaccccgctaacctccaggtgtctctggagacgcaggcccctgaaaatagcatcggcacgatcacactgccatcaagtctgatgaacaacctgcctgcccatgatatggaacttgcatcccgcgtgcagttcaatttctttgaaacacctgcgctctttcaggatccatccctggaaaacctttcgctgatatcttatgtcattagtagtagcgtcgccaatctgactgtccgaaacctgacccgcaacgttaccgttacgctcaagcacattaatccatcccaggatgagctcaccgtgcgctgcgttttttgggacctggggcgaaatgggggtcgcggagggtggagcgacaacggctgcagcgtgaaagacagaaggcttaacgagaccatatgtacatgctcacaccttactagcttcggggtgctgctcgatttgagccgaacatccgtgcttccggctcaaatgatggccctgacattcattacctatatcggatgtgggcttagctccatttttctctccgtgactctggttacctacatcgcttttgagaagatccgcagagactacccctccaaaatcctcattcagctgtgtgccgctctgctgcttctcaatcttgtgtttctactcgatagttggattgccctttataaaatgcaggggctctgtatatccgtggccgtcttcctgcattatttcctccttgtgagtttcacttggatgggactcgaggcctttcacatgtacctcgccctagtaaaagtatttaacacctatatacgaaagtatatcctgaaattctgtatcgtgggctggggtgtccccgcagtcgtagtgaccatcatcttgacgatctctcctgataattatgggctcgggagctatggcaaatttcccaacgggtccccagacgacttctgttggattaacaacaatgccgtgttctatatcaccgtcgtgggttatttttgcgtcatttttctcttgaacgtaagtatgttcatcgtggtcctcgtccaactctgccgcattaagaaaaaaaagcagctcggagctcagagaaaaacctctatacaagacctacggtccatcgctggcctcactttcctgctagggataacatgggggttcgctttcttcgcttggggcccagtcaacgtgacttttatgtacctgttcgccatattcaataccctacagggtttctttattttcatattttactgtgtggccaaggagaacgtgagaaagcagtggaggagatacttgtgctgcggtaagctgagactcgctgagaattccgactggtctaagaccgccacgaacggtttaaagaaacagacagtgaatcagggagtgtcgagctcatctaattctctgcagtcctcctccaatagcacaaactctaccacgctgctggttaataatgattgttctgttcacgcctcaggcaacggaaacgctagtaccgaaagaaacggagtgtccttctctgtgcagaacggcgacgtatgtttacatgattttaccggaaaacagcatatgttcaacgaaaaggaggattcttgtaatggtaaaggtaggatggctctgcggcgaacctcaaaacgaggcagccttcactttatagagcagatgtag

SEQ ID NO: 224086 - DNA, 3006 bp, Artificial Sequence
  Description of Artificial Sequence: Synthetic coding sequence
atggtatttagcgtgaggcagtgcggccatgtgggtcggacagaagaggtccttctaacattcaagatctttctggtgataatctgtctccacgttgtccttgtgacatcgctggaggaagatactgacaattctagccttagtccacctccagaagttgagaccacctcactgaatgacgtgacactcagtctcttgccatccaatgagaccgagaagaccaagatcacaatcgtgaagaccttcaacgcatctggagtcaagccccagcggaatatttgtaatctatccagtatctgcaatgactccgcattctttaggggggagattatgttccagtacgataaagagagtacggtgccccagaatcaacacattacaaatggcactctcactggagtgttgagcctgtcagagctaaaaaggagcgaactgaataaaacactccagactctgagcgaaacatacttcatcatgtgcgccacagcagaggctcagtctacactcaattgcactttcactattaagttaaacaatacaatgaatgcctgtgcagtgatcgcggctttagaacgcgtgaaaattaggcctatggaacactgctgctgctccgtgagaatcccgtgtccctcttcccccgaagaactggaaaaacttcagtgtgacttacaggatccgattgtctgcctggccgaccaccccagaggcccacctttctccagtagccaaagtatacctgtggtgccgagggccactgtgctatcccaggtccccaaggccacatctttcgcggaaccaccggattactcgcctgttacacacaatgtcccaagcccgatcggggaaatccagcccctgagccctcaacccagcgcccctatagcttctagccccgcaattgacatgccgcctcaaagtgaaaccataagctcaccaatgccacagacccacgtaagcgggaccccaccaccagtgaaggcgtccttctcatccccaactgtctctgcacccgctaatgtcaatactacttctgcacccccagtacagactgacatcgtcaatacttcatcaatttcggatctggaaaatcaggtgctccagatggagaaggctctgtctctcggatctctggagcctaatctcgccggagagatgattaaccaggtatcacggctcctgcattctccacctgacatgttagcccctttggcccagcgcctgctgaaagtggtggacgatattggcttacagctgaacttctctaatactacgatctctctgacctcaccttcacttgccctagcggtgatcagagtgaatgcttctagcttcaacactacaaccttcgtagcacaagacccagccaacttgcaagtgtcactggaaacccaggcccctgaaaattccatcggaaccatcactttgcctagctccctcatgaacaatctgccggcacatgatatggagctcgccagtcgggttcagttcaattttttcgagacgccggcactctttcaggatccctcactggagaacctgtctctgatctcatacgtaatcagttcctccgttgccaaccttaccgtgcgcaatctgacaagaaatgttaccgttacactaaagcacatcaatcccagccaagacgagctgaccgtgcgttgcgtcttttgggaccttggtagaaacggtgggaggggcggatggtccgataatggttgtagtgtgaaagacaggcggctgaatgagaccatatgtacctgcagccatctcactagttttggagtcctactggatctcagccgaacatccgtgctgccggctcagatgatggcactgaccttcatcacctacatcggatgtggtctttccagtatctttctgagcgtgactcttgtgacttatattgcatttgagaagatcaggcgagactatccgagcaaaatcctgatccagctgtgcgcagctcttctcctgctaaatttagtgttcctgcttgattcctggattgctttatacaaaatgcagggtctgtgcatctcggtggcagtgttccttcactactttcttctcgtgagcttcacatggatgggccttgaagcgtttcatatgtatcttgctctggtcaaggtatttaatacatacataaggaaatacatcttgaaattttgcatcgtgggctggggagttcctgcggtggtcgttaccatcatcttaaccatttcacctgataactatggcctaggcagctacggcaagtttcctaacgggagccctgatgatttttgttggattaacaataatgcggttttttacatcaccgtggtcggctatttctgtgtcatttttctcctaaacgtgtctatgtttattgtggttctcgtgcagctttgccgcatcaaaaagaagaagcagctgggcgctcagcgtaagacctctatccaggacctgaggagtattgcgggactgacctttctccttggaatcacttggggtttcgcctttttcgcctggggtcctgtcaacgtcaccttcatgtatctttttgccatctttaacacactgcaaggattttttatcttcattttttactgcgtggcaaaggagaatgtgagaaaacagtggagacgatacctgtgttgtggaaaactgcggctagccgaaaactcggactggtccaagaccgccaccaatgggctgaagaaacagacagtcaatcaaggagtgtccagcagcagtaattctcttcagtcgagcagcaattccaccaattcgactacactgctggtcaacaatgactgttccgttcacgcttcggggaacgggaacgcatcaaccgagaggaatggggtgtcattttccgtgcagaatggcgatgtgtgtctgcacgatttcaccgggaagcagcacatgttcaatgaaaaagaggattcttgcaacggcaagggacgcatggccctgcgcaggaccagtaagagaggctctcttcacttcattgaacagatgtag

SEQ ID NO: 224087 - DNA, 354 bp, Artificial Sequence
  Description of Artificial Sequence: Synthetic coding sequence
atcttactgacgatgcagcatatcaacactgggatagatatgcttaatcaactgggatgcgtgtttttcgctggagttaaaccgcagcggaatatttgtaatctgtcaagcatttgcaacgattcagctttcttccggggagagataatgtttcagtacgataaggagtcaacagtcccccagaaccagcatatcacgaatggcaccctgaccggcgtcctgagcttgtcggaactcaaaaggagcgaattaaacaaaactctgcagacactttcagaaacctactttattatgtgtgctacagccgaagcccaaaggcacattaagttgtacatccacaataagaccgagtag

SEQ ID NO: 224088 - DNA, 1014 bp, Artificial Sequence
  Description of Artificial Sequence: Synthetic coding sequence
atgaactccacatgcatcgaggaacaacatgacctggaccactatctgtttccgatcgtatacattttcgtgatcatcgtctctatccctgccaatatcgggtccctttgtgtgagctttttacaggcaaagaaggagtcagagttagggatttacctgttctcactgtctctatccgacctgctgtacgctcttactctgccattatggatagactacacctggaataaggacaattggactttcagcccggcattatgtaaggggtcggccttcttgatgtacatgaatttttatagcagcaccgcttttctgacctgcatcgcagtggaccgttatttggccgtggtatacccacttaagttttttttcctgcggacccggagatttgccctcatggtgagcttgtccatttggatccttgaaacaattttcaatgcagtgatgctgtgggaagacgaaacagtcgtggagtactgcgacgctgagaaatctaattttaccctgtgctatgataaatacccactggagaaatggcagattaatttaaaccttttccgcacctgcacaggctatgctattcctctcgtgaccatactaatctgcaacagaaaggtctaccaagcagtccggcacaacaaggctacagagaacaaagagaaaaagaggatcattaaactgctggtttcaatcacggtcacctttgttctatgcttcacgccttttcacgtgatgttactgatccgttgcatactggaacacgctgtgaatttcgaagaccattcgaatagtggcaagaggacctataccatgtatagaattacagttgccctgacttcacttaactgtgtggccgaccctattctctattgctttgtcacggaaactggtagatacgacatgtggaacatcctgaagttctgtacgggacggtgcaatacatctcagagacagagaaaaaggatcttatcagtgtctacgaaagacactatggaattagaggtgctcgaatag

SEQ ID NO: 224089 - DNA, 1623 bp, Artificial Sequence
  Description of Artificial Sequence: Synthetic coding sequence
atgaatagtactggacatttgcaagacgcaccaaatgctacctcgctccatgtgccgcattctcaggaagggaattcaacatctctgcaggaaggtttgcaggacttgatccataccgccacgctggtcacatgtaccttcctgctggccgtcatattttgcctcggatcttacggtaactttatcgttttcttgagcttttttgaccctgcttttcgcaagttccgcacaaacttcgactttatgatcctgaatctttctttctgtgacctgttcatctgcggcgtcaccgcgccaatgttcacctttgtcctcttcttttcttcggcttcctcaatccctgacgcattctgtttcacttttcacctcacctcatccggctttattattatgtccctcaaaactgtggccgtaatagctctgcaccggctgagaatggtgctcggcaaacaaccaaatcgaaccgcctcctttccatgcactgtcctactcacgctgcttctttgggcaacgagtttcaccctggcgacattggccactctaaagactagtaagtctcacctatgcttgcccatgagctcacttatcgcgggtaagggcaaagctatcctgtctctttatgtcgtagacttcaccttttgcgtggccgtggtgtcagtctcttatataatgatcgctcagactctaagaaaaaatgctcaggtgagaaaatgtccacccgtgatcacagtggatgccagccgccctcagccattcatgggtgtgcccgtgcagggcggaggagatcccattcagtgcgctatgccagccctgtaccgaaaccagaactataacaagctgcaacacgtgcagactagggggtataccaagagcccaaatcagctggtaacaccagcggcttcaaggctccagctggtatcagccattaacctatcaactgctaaagactctaaggcggttgtgacttgtgtgataattgtgttgagcgttttggtctgttgcttacctttgggcatctccctcgtccaagttgtgttaagctccaacggttccttcattttgtaccagtttgagctgtttgggttcactctgatcttcttcaaaagcggacttaatccgtttatttactcgcgcaacagcgcgggactgagaaggaaagtactgtggtgcctccagtacatcggcctgggatttttctgttgtaaacaaaaaactcgcctgcgtgccatgggaaagggtaaccttgaggtgaaccgtaataagagtagccaccacgagacaaactccgcgtatatgctgtccccaaaaccgcagaaaaaattcgtggaccaggcatgcggaccgagccacagtaaagagtcgatggtgagtccaaagatatctgctggacaccaacactgtggtcaatcgagctctacaccaatcaacacacggattgaaccgtattatagcatctacaattcatctccttctcaggaggagagctctccatgtaacctgcaaccggtgaattcttttggttttgccaactcatatatcgctatgcattatcacacaactaacgaccttgttcaagaatatgatagtacctctgctaagcagatcccagttcccagtgtgtag

SEQ ID NO: 224090 - DNA, 1092 bp, Artificial Sequence
  Description of Artificial Sequence: Synthetic coding sequence
atgggacctggcgaggcactcctggctggcctcctcgttatggttctggcagtcgccctcctgtccaacgctctcgtcctgttgtgttgcgcttattccgccgagctccggacacgagccagcggcgtgctcctggtgaacctctccctcgggcatctattgctggccgctctcgacatgccttttactctgctgggcgtgatgagaggcaggacacccagcgcccctggggcatgccaggtcatagggtttcttgataccttcctcgcgagcaatgctgccttgtcagtagcagctctgagcgcggaccagtggttggcagttggattccctctgcgctatgcaggtcgcttacggccaagatatgccggtctccttttggggtgtgcgtggggtcagagtttggcattctctggagcagctctgggctgtagttggttggggtattccagcgcttttgcctcatgctctctccgattgccacctgagcccgagcgcccacggttcgccgcttttactgcaacgctgcatgctgtcggatttgtactgcctctagcggtgctgtgcttgacctcactgcaggtccaccgcgtggccagaaggcactgtcaacggatggacaccgtcactatgaaagcgctggctcttctcgctgacctgcacccctcagttagacagcgatgtctgattcagcaaaaacggaggcgccacagggccacgcggaagatcggcattgccattgctacattcttaatttgtttcgccccttatgtcatgacccgactggctgagctagtacccttcgtgacagtgaacgctcagtgggggatcctgtctaaatgcctgacctatagcaaagccgtggctgatcccttcacatatagcctgcttcggcgacccttcagacaggtactcgctggcatggtgcacaggctcctgaaaagaacaccacgacctgcctccacccatgatagctcattagacgtggctgggatggtgcaccagctgcttaagcggacaccccgtcctgccagtacccataacggaagcgttgatactgagaatgatagttgtttacaacaaacccattag

SEQ ID NO: 224091 - DNA, 1011 bp, Artificial Sequence
  Description of Artificial Sequence: Synthetic coding sequence
atgaataacaacacaacatgcatccagccttctatgatatccagcatggctctgcctattatttatattcttctgtgtatagttggggtgtttggaaatactctgtcacaatggatttttctcacaaaaattggaaagaagactagcacacatatatacctgtctcaccttgtgacggctaacttattggtctgttcagcgatgcccttcatgtcaatatatttccttaagggattccagtgggagtaccaatccgcgcagtgtagggttgtgaactttctcggaactttatctatgcatgccagtatgtttgttagtttgttgatactctcttggattgctatcagtcgctacgccacactgatgcagaaagactcctcacaggagacaacttcatgttatgaaaagattttctatggacacctccttaaaaagtttcgtcaacctaactttgccaggaagttgtgcatttatatttggggagttgttttaggaatcatcatccctgtgaccgtctattattcagtgattgaggccaccgagggggaggagtctctatgctacaatcgacagatggaactaggagccatgatatcccagatcgcaggtctaattgggacaacatttatcggattcagcttcttggtggtattgacctcatattatagtttcgtgtctcaccttcgaaaaattcgtacctgtacaagcatcatggaaaaagatttaacttactctagcgtgaagcggcacctcttagtgatccagatcctgctgatagtctgcttcctgccatactcaatctttaagcccatattctatgtgcttcatcagagggacaattgccagcaactcaactacctgatcgagacaaaaaacatcctcacatgcctggcttccgccaggagcagcaccgatcccattatcttcctgctcctggataaaacttttaagaagacactgtacaacctctttactaagtcaaatagcgcacacatgcagtcctacgggtag

SEQ ID NO: 224092 - DNA, 1272 bp, Artificial Sequence
  Description of Artificial Sequence: Synthetic coding sequence
atggtcccccacttactgcttttatgcttgctccctttggtaagggcaacggagccacacgagggtagagcagatgagcagtctgcggaggccgctctggctgtaccgaatgccagtcatttcttttcatggaacaactacacgttttctgattggcaaaactttgtcggccgacgtcggtatggagcagagtctcagaatcccacggttaaagccttactgattgtggcttatagcttcataatagtgttcagtctgttcggcaatgtactcgtgtgtcatgtaatttttaagaaccaacgcatgcattctgcaactagcttattcatcgtcaacctcgctgtcgccgacataatgatcacattactgaacacgccatttacactggtgcgcttcgtcaatagcacctggatcttcggaaaaggaatgtgccacgtgtctcggttcgctcagtactgctcactgcatgtgtctgctcttacactgacagcaatcgccgtcgatcggcaccaggtcatcatgcaccccttgaagccaagaattagcataacaaagggcgtgatctacattgcagttatctggactatggcaacattcttcagcctgcctcatgccatctgccagaagctgttcacattcaaatacagcgaggacatcgttcgctcactctgcctgcctgacttcccagaacccgctgatctcttttggaagtatttggatcttgcaacgtttattctactgtatattctacccctgctgattatttccgttgcatacgctagggtggcaaaaaagttgtggctgtgtaatatgatcggagatgttactaccgagcaatatttcgcgctgagacggaaaaaaaagaaaacaatcaaaatgttaatgctcgtggtggtgctgttcgcactctgttggttccccttgaattgctacgtattactgctgtcttccaaagttatacggactaataacgccctgtactttgccttccattggttcgctatgtcttcaacctgctacaacccttttatttactgttggctgaacgaaaatttccgcattgagctaaaagccctcctttccatgtgccaaagacctccaaagccccaggaagatcgacctccgtcaccggtcccgagcttccgtgtcgcgtggactgaaaagaacgacggtcagagagctcctctcgcgaacaacctgctgcccacttctcagcttcagagtgggaaaactgatctctcaagcgtggagccaattgtgacaatgtcttag

SEQ ID NO: 224093 - DNA, 1191 bp, Artificial Sequence
  Description of Artificial Sequence: Synthetic coding sequence
atgtggaacagtagcgatgctaatttttcgtgttaccatgaatccgtgttggggtatcggtacgtggccgtaagctggggggtcgtcgtcgccgtgacagggaccgttggaaatgttctgactctgttagcactcgccattcaaccgaagctccggacccggtttaacctacttattgccaacctgacattggccgacctgctttactgcactctgcttcagccattcagcgttgacacatacttgcaccttcattggagaacaggtgctaccttctgcagagtctttggcctgcttttgtttgcgtctaactccgtgagcattttaacattgtgcctgattgctctcgggcgttacctactaatcgcccatcccaaactttttccgcaggtgttctcagctaaagggatcgtgctcgccctggtaagcacatgggtagtgggagtggccagtttcgcgcctttatggccaatctacattctggtgcccgtcgtgtgtacatgttctttcgatcggattagagggagaccctataccaccatcctcatggggatttatttcgtgctcggattgagctccgtaggaattttctactgcctcatccatcgacaagtcaaacgcgcagcccaggctttagatcagtataaactgcgccaggccagcattcatagcaatcacgtcgcacgcactgacgaggccatgcctggcaggttccaggagctggatagccggctggcctccggaggtccatccgaaggtattagcagcgagccagtctccgctgccaccacccagacactggagggcgattccagcgaggttggggatcagataaacagcaagcgcgcaaagcagatggccgaaaagtcaccccctgaagcttctgctaaagcccagcctataaaaggcgcacgtcgcgctcccgactcctcttcagaattcggaaaggtgacgcggatgtgctttgcagtcttcctgtgcttcgccctatcgtatattcctttcttgcttctaaatattttagacgccagggtgcaggcgcctagagtcgtgcatatgctcgccgctaacctaacctggctgaacggctgtatcaacccagtcctctacgccgctatgaatagacagtttagacaggcatatggttccattctgaaacgcggaccacgcagtttccaccgattacactag

SEQ ID NO: 224094 - DNA, 1191 bp, Artificial Sequence
  Description of Artificial Sequence: Synthetic coding sequence
atgtggaactcctccgatgcaaacttcagctgctatcatgaatctgtcctcggataccggtacgttgcagtttcatggggtgtcgtggtagcggtcactggaaccgtaggtaacgtattgaccctcctcgccttggctatccagccaaaactcagaacgcgcttcaatctgttaattgctaatttaacactggccgatcttctgtattgtaccctgctgcaacctttcagtgtggatacgtatctgcaccttcattggaggaccggggctacattctgccgcgtattcggtttgctgctctttgcctcaaatagtgtgtcaattctgaccctgtgcctgatcgcactgggcagatatttacttatcgcccaccctaagctatttccacaggtcttttcagccaagggaatcgtcctagcgctggtatctacgtgggtagtaggggtggcttcttttgccccactgtggcccatctacattctggtgccagttgtttgtacttgctcgtttgataggatacgcggtagaccctataccactattctaatgggaatctactttgttcttgggctgtcttccgtgggcattttctactgcttaatccatcgccaagtgaagagagccgcacaagcactcgaccaatacaaactccgccaagcttcaatccactcaaatcacgtggcccgaactgacgaagccatgccaggcaggtttcaggaacttgactctaggctcgccagcgggggtccatcggaaggcatctcttctgaaccagtgtcagctgccaccacccaaaccttggaaggcgacagttcggaggtcggcgaccagattaactccaagcgtgccaagcaaatggccgaaaagtccccccctgaggccagcgccaaagctcagcccataaagggggcacggagagccccagattcatcttcagagtttggcaaggtgacgaggatgtgttttgcagttttcctgtgctttgccctgtcctacattccgtttctgttgctgaatattctggatgcgcgtgttcaggcccctcgcgtggttcatatgctggcagctaacctgacttggctgaatggctgcattaacccagtgttgtatgccgcaatgaatagacaattccgccaggcttatggttccattctgaaaagagggccacggagttttcatcgcctccattag

SEQ ID NO: 224095 - DNA, 1113 bp, Artificial Sequence
  Description of Artificial Sequence: Synthetic coding sequence
atggccaactactctcatgcggcagacaacatcctgcaaaatctgtcacccctgacggccttcctgaaacttactagtctgggctttatcatcggagtcagcgtagtggggaacctcctgatcagcattctcctggtgaaggacaaaaccctgcaccgcgctccctattacttcctcctcgatctatgttgtagtgacatcctgcggagcgcaatttgttttccattcgtgtttaactccgtgaaaaacggctcaacctggacatacgggactctcacatgtaaggtgatcgccttcctaggggttttatcctgttttcacaccgccttcatgctgttctgcatctctgtcaccaggtatctcgcaattgcacatcacagattctatacaaagcgcttgacattctggacctgtctggctgtcatttgcatggtctggaccctgtctgttgcaatggcattcccaccagtacttgacgttggaacttactccttcatcagagaggaggaccagtgcactttccaacaccggtccttccgcgctaatgatagcctgggattcatgcttctgcttgctttaatactgctcgctacacagctcgtctatctcaagttgatttttttcgtccacgacagaaggaaaatgaagccggtccagtttgttgccgctgtgtctcagaattggaccttccacgggccaggcgcatcgggacaggcagcagcaaattggttagcagggttcggcaggggcccaacacccccaacactgctggggatccgccagaatgccaacacgaccggacgcaggcgtcttttggtcctagatgagtttaagatggaaaagcgcatcagtcgcatgttctacattatgaccttcctgtttctgaccctgtggggcccatacctggtggcttgttattggagggtgttcgctagaggtccagttgttcctggtggcttcctgacagccgctgtatggatgtcttttgcccaagccggaataaaccccttcgtctgcatcttctccaaccgcgagctgaggcgttgtttctccacaactctcctttactgccgtaagagcagactcccgagggaaccctattgcgtaatatag

SEQ ID NO: 224096 - DNA, 1113 bp, Artificial Sequence
  Description of Artificial Sequence: Synthetic coding sequence
atggccaattactcgcacgccgcagacaatatcttgcagaacttaagccccttgacagcattcttaaagcttacatcattgggctttatcataggcgtgagcgtggtggggaatctgctgatctccatcttgctggtcaaggataagacccttcaccgagccccttactactttctcctcgacctatgctgcagtgatattcttcggagcgcaatttgcttcccattcgttttcaacagtgttaagaacgggtcgacctggacctacggcaccttgacttgcaaagttatcgcattcctgggagtgctgagctgcttccacacggcgtttatgcttttttgcatatccgtcaccaggtacctcgctattgctcatcaccgcttttacacgaaaaggctaacgttttggacctgcctggctgtgatctgcatggtctggactcttagtgtggccatggcctttcctcctgttttggacgtgggcacctatagctttatacgggaggaggatcagtgcacctttcagcaccggtcgtttcgggctaacgatagtcttggatttatgctgctgctggccctgatcctgctggccacccagttggtgtacttgaaactcatcttcttcgttcacgacagaagaaagatgaaacctgtgcagtttgtggccgctgtgagccaaaattggacctttcatggtccgggtgcctctggtcaggcggctgctaactggctggctgggtttggccgtgggcctaccccacctaccctattgggcattagacagaacgccaacaccaccgggaggcgacgtctgctggtgctggacgaattcaaaatggagaaacgaatatcccgcatgttttatatcatgacattcctctttctgaccctgtggggcccttatctggtcgcatgttattggcgcgtgtttgctcgaggcccagtggtgccaggcggtttccttactgcggctgtctggatgtcctttgctcaagccggtatcaatccttttgtgtgtattttttcgaacagagagctgcgcaggtgtttcagtaccacccttctatattgccgcaagtctcgcttgcctagagaaccctactgtgtcatttag

SEQ ID NO: 224097 - DNA, 216 bp, Artificial Sequence
  Description of Artificial Sequence: Synthetic coding sequence
atggctaactacagccatgcagctgataatatcttgcagaacctctcaccattaactgcattcttgaagcttacctccctgggttttattattggggtgtctgtggttggcaatctgctgatctctatcctgctggttaaagataaaactctccatcgagctccctactacttcctcctcgatctgtgctgtagcgacatcctgaggagcgcttag

SEQ ID NO: 224098 - DNA, 1113 bp, Artificial Sequence
  Description of Artificial Sequence: Synthetic coding sequence
atggcaaattactcacatgctgcagataacatcctgcaaaatctcagtcctctaacagccttcctgaagctgactagcctaggcttcatcattggcgtgtccgtcgtcggcaacctgctgatctccatactccttgttaaagacaagactttacaccgggctccctactattttctgcttgatctgtgctgtagcgatattctccggtcagcaatctgctttcctttcgtgtttaattctgtgaaaaacggatcaacgtggacttacggaacgctgacatgcaaggtgattgcatttctgggcgttcttagctgttttcatacagccttcatgctgttctgtatttccgtcacacggtatttggcgattgcacaccaccgcttctacacaaagcgcctgaccttctggacttgcctggctgttatttgcatggtatggaccctgtcagtcgccatggcttttccgccagtgctggacgtcggtacctattccttcattagggaggaagaccagtgtactttccagcacaggagcttcagggctaatgactccttgggattcatgctgcttctcgctcttatcttactcgccacccagctggtgtatttgaaacttattttttttgtgcacgaccgccgtaagatgaagccagtgcagttcgtggctgcagtaagccaaaattggacattccacggcccaggcgcttccggacaggcagctgcaaactggcttgcagggtttgggaggggccctacccccccaacattgctcggcataagacagaacgctaacactaccggcaggcgcaggttactggttttggatgaattcaagatggagaagcggatcagtcggatgttttatataatgactttcctgtttctgacactgtgggggccttatcttgtggcctgctattggagggtcttcgccagaggcccagttgtgcctggaggattccttaccgcggcagtgtggatgagcttcgcccaagcaggaataaatcctttcgtgtgtatcttcagcaatcgagagttgcgcaggtgtttctccaccactctgctttattgtaggaaaagccgccttcctagggaaccctattgcgtgatttag

SEQ ID NO: 224099 - DNA, 366 bp, Artificial Sequence
  Description of Artificial Sequence: Synthetic coding sequence
atggccaattattcgcacgccgctgataatatcctgcagaatctctcccccctgacggccttcctgaaactgacaagtcttggtttcatcataggcgtgagcgtggtcggcaacttactgatttccatcctgctcgtaaaagacaagaccttgcaccgagcgccttactactttcttctcgatttgtgttgctcagacattctgcgaagcgccatctgcttcccattcgtctttaacagtgtgaagaacgggagtacgtggacatatggaaccctgacatgtaaagtaattgctttcttaggcgtattgagctgcttccataccgcctttatgctgttttgcatctctgtcacgcgttatctctag

SEQ ID NO: 224100 - DNA, 1113 bp, Artificial Sequence
  Description of Artificial Sequence: Synthetic coding sequence
atggcgaactacagccacgccgcagacaatatcctgcagaacctaagtccccttacggcatttctgaagctgacaagtctgggatttattatcggcgtgagcgtcgttggaaacctgctcatctccatcctgttggtcaaagacaaaacactgcaccgggcaccatactatttcctgttagacttgtgttgctcagatattctcagatccgctatctgttttccctttgtttttaatagtgtcaaaaatggcagcacctggacctacggaactctaacgtgcaaggttattgcttttctaggcgtgttgtcttgttttcacacagcgtttatgctgttttgtataagtgtgactagatatctcgccatcgcacatcaccggttctatacaaagcggttaacgttctggacgtgtcttgctgtcatatgtatggtttggacactgtcggtggcaatggccttcccaccagtcttggatgtcggtacatattcctttattagggaggaggatcagtgcaccttccaacatagatcctttagggctaatgattctctgggtttcatgctcctgctggcattgatcctgcttgctactcagcttgtgtaccttaaattgatattttttgttcatgatcgacgcaaaatgaagcctgtgcagttcgtggctgctgtctctcagaattggactttccacgggcctggcgcaagtgggcaagctgctgccaactggcttgccggatttgggcgaggacccactcccccaacgctgcttggcatccggcagaacgcaaatactactgggagacgcagattgctggtactcgacgaattcaaaatggaaaaacgtatttccagaatgttctatatcatgactttcttattcttgacactgtggggaccctatctggtagcctgttattggcgagtctttgcccgtggccctgtcgttccaggcggttttctgaccgcagcagtctggatgtctttcgcacaggccggaattaacccctttgtttgcatcttctccaaccgggaacttaggagatgcttcagtacaactctgctatactgccgtaagtcccggctcccacgtgagccctactgcgtgatatag

SEQ ID NO: 224101 - DNA, 1077 bp, Artificial Sequence
  Description of Artificial Sequence: Synthetic coding sequence
atgggtttcaaccttaccctggcaaagctccctaacaacgaactgcatgggcaagagagccacaatagcgggaatcggagcgacggcccaggcaaaaatacaacactgcataacgagttcgataccatcgtgctcccagtgctgtacctgattatattcgtggcttcaatcctcttaaatggacttgcagtttggattttcttccatatccggaataagactagcttcatattttacctgaagaacatcgtggtggctgacctgattatgacactcaccttcccgtttcgaattgtgcacgacgccggatttggcccttggtatttcaagtttattctttgccggtatacctccgtccttttttacgcgaatatgtatacgtcgatcgtgtttctcggcctcatttcaatcgaccggtatttgaaagttgtgaagccattcggtgattctagaatgtatagcattacatttacaaaggtgctgtctgtgtgcgtgtgggtgattatggcggtactgtccctgcccaacatcattctgaccaatgggcaaccaacagaagataacattcacgattgtagcaagctgaagtcccccctcggtgtgaagtggcacactgctgtaacttatgtgaacagctgtctgtttgtagcggtgctcgttatattaatcggctgctatattgcaattagtcgttacatccataagtcctcacggcagttcatatcccaatcaagtcggaaacgtaagcacaatcaatctataagagtggtcgtggctgtgttttttacctgcttcttgccctaccatctgtgccgaataccttttacgtttagccacctcgatcgacttctggacgaaagcgcccagaagatcctgtattattgtaaagagatcaccctgtttctgtccgcctgtaatgtctgtctggatcccattatttacttttttatgtgccgcagctttagccggaggctgtttaagaaatcaaacattaggacccgatcggagagcattcggtctctgcagtctgtgcggaggtccgaggtgcgaatctactacgattatacagatgtgtag

SEQ ID NO: 224102 - DNA, 1368 bp, Artificial Sequence
  Description of Artificial Sequence: Synthetic coding sequence
atgtccttccttatcgattcatctataatgattacctcacagatcctattctttggcttcggctggctgtttttcatgcgacaactgtttaaggattatgagatccggcaatacgtagtgcaggtgatcttcagcgttaccttcgcatttagctgcactatgttcgaactcatcatcttcgagattctcggtgtcctgaactcttccagtcggtatttccactggaagatgaacctgtgcgtcatactgctcatcttggttttcatggtgcccttttacatcggttacttcattgtgtctaatattagactgctacacaagcagcggctgcttttttcttgtctgctctggcttacgtttatgtacttcttctggaagctgggtgatccattccctatcttatcccctaagcatgggatcctctctattgaacagcttatctcacgggtgggagttatcggagtaaccctcatggccttgctttcgggttttggggctgtcaactgcccctacacgtacatgtcatatttcttacggaacgtaacagatacagacatcctggctttggagaggaggctattgcagaccatggacatgattattagcaagaaaaaaaggatggctatggcgagaagaaccatgtttcagaaaggagaggtccataataaacctagcggcttttggggcatgatcaaaagcgtgaccacatcagcatccggttctgaaaaccttacgttgattcagcaagaggtggacgctcttgaggaattgagtagacagttatttctggagactgctgatctgtacgccaccaaggaaagaattgagtattccaagacgttcaaaggtaagtactttaattttctgggctacttcttttctatctactgtgtttggaaaattttcatggccaccattaacatcgtcttcgatcgagtcgggaaaactgacccagtgacaaggggtatagagataacagtaaattatctgggaattcagtttgatgtcaaattttggagtcagcacatatcgttcatcctggtcggaattatcattgtgacaagcatccggggtctgctgatcacattgactaagttcttctatgcgatttccagctcgaaaagcagcaacgttatcgtactcctgcttgcccaaattatgggtatgtactttgtctcctccgtactactgatacggatgtcaatgcctctcgagtatcgtactattatcacggaagtgttaggagaactgcagtttaacttctaccaccggtggttcgatgtcatctttctcgtgagtgcactgtctagtatattattcttgtacctggctcacaagcaggctcccgagaaacaaatggcaccatag

SEQ ID NO: 224103 - DNA, 1008 bp, Artificial Sequence
  Description of Artificial Sequence: Synthetic coding sequence
atgtattttttttggaagctaggcgatcccttccctatcttgagccccaagcatggtattttgtctatcgagcagttaataagtagggtgggagtgatcggtgtgactctgatggctctactctcggggttcggggcagttaattgcccttacacatacatgagctacttccttcggaacgtaacagacactgacatactggccctggaacgccgactgctccaaactatggatatgatcatatcgaaaaaaaagagaatggccatggccagacgcacgatgttccagaagggcgaagtacacaacaaaccttccggtttttggggaatgatcaaaagtgtaactactagcgcaagcggatctgagaacttaacgctcatccagcaggaggtggacgctttagaagagctaagtcggcaactcttcctggaaacagcagacctttacgctacaaaggaaagaattgagtacagtaaaacctttaagggcaagtacttcaacttcttggggtacttcttttccatatattgcgtgtggaagatattcatggctaccatcaacattgtctttgatcgtgttggcaagacagatcctgtgacacgcggaatagagatcactgtgaactatcttggaatccagttcgacgtcaagttttggtctcaacacatctcatttatcctggtcggcattatcattgtcacttcaattcgcggtctgctaattaccctgactaagttcttctacgccattagttcgtcaaagagcagcaatgttatcgttctccttctggctcaaattatggggatgtatttcgtgagcagcgtgttgctgattcgtatgtctatgccattggagtataggactattatcacggaggtgcttggggagttacagttcaacttctaccataggtggttcgatgtaatcttcttggttagtgctttgtcgtccatcttatttctgtacttagcacacaagcaagcccctgagaaacagatggctccatag

SEQ ID NO: 224104 - DNA, 1368 bp, Artificial Sequence
  Description of Artificial Sequence: Synthetic coding sequence
atgtcgtttctgattgactcatccataatgatcacctctcagattctgttcttcggattcggctggctgttcttcatgcggcagctattcaaggactacgagatccggcaatacgtggtgcaggtcatctttagcgttactttcgcattcagctgcaccatgtttgaactgattattttcgagattttgggcgtcttgaacagttcatcaaggtatttccactggaaaatgaacttgtgcgtgattttgctcatcctagtgttcatggttccattctacattggctatttcatcgtgtctaacattcgtctgttgcacaaacagcgcctgctcttttcatgtctactgtggctaacattcatgtatttcttctggaagcttggcgaccccttcccaatcctttcccccaagcacggcatcctgagtatcgagcagctcatcagcagggtaggcgttatcggcgtaacactgatggctctgttatcggggttcggagccgtgaattgtccttacacatatatgtcatactttttaaggaacgtgacagataccgacattttagctctggagaggcgcctactgcagacaatggacatgatcatctcaaaaaagaaacggatggctatggccaggcgaacaatgtttcagaaaggcgaagtgcacaataaacctagtgggttctgggggatgattaagagtgtaacgaccagtgcctccggaagcgagaacttgactctcattcaacaggaagtggacgcactcgaggagctctctcggcagcttttcttggagactgcggacctgtatgccacgaaagaaagaattgagtactcgaagacctttaaggggaagtattttaacttccttggctacttctttagtatctactgtgtctggaaaatttttatggccactatcaacattgtgttcgatcgtgtcggaaagacagaccctgtgactcgaggaattgagatcaccgtgaactacctgggcatccagttcgatgtgaaattttggtcacagcacatttcatttatcctggtgggtataattatcgtgactagtatcagggggctgctcatcacattgactaaatttttttatgccatctcatctagcaaatcctcaaatgtaatcgtgctgctccttgcccagatcatggggatgtacttcgtgtcctccgtattgttgatccggatgagtatgccactggagtaccgcacgatcatcacagaggtgttgggagagttacagttcaatttttatcaccgctggtttgatgtgatctttttggttagtgccttgtcctcaatactctttctctatcttgcccacaaacaggccccagagaaacaaatggctccctag

SEQ ID NO: 224105 - DNA, 18920 bp, Artificial Sequence
  Description of Artificial Sequence: Synthetic coding sequence
atggatatcttcttggtcctgggcatgcccagcgcctctttgcttgtgaatcttctgagcgccctccttatcctgttcgtgtttggagagaccgagattcgattcaccggccagactgagttcgtggtaaacgagacctctactacggtcattcggttaataattgagcggatcggtgagccagctaatgtgactgccatagtgtcactgtacggagaggatgctggcgattttttcgatacatacgccgctgcttttattcccgctggcgaaacaaaccgaaccgtgtatatcgccgtgtgtgatgacgatctccctgagccagatgagactttcattttccacctgacactccagaagcctagtgctaatgtcaagctcgggtggccgagaaccgtgaccgtgacaattctgagtaacgataacgcattcgggattatttctttcaacatgctgccctccatagctgtctccgaaccaaaaggacgaaacgaatctatgccactgacattgatccgagagaagggcacgtatggaatggtgatggtgacatttgaagtggagggcggaccaaaccctcccgacgaggatttatccccagttaagggaaatattacattccccccaggcagggccacagtgatttacaacctcacagtactggatgacgaagtaccagagaacgacgaaatctttctgattcagctgaaatctgtggagggaggcgcagagatcaacactagccgtaatagtattgagattattattaagaagaatgacagccccgttaggttccttcagagcatctatctggtcccggaggaagatcacatacttatcataccggtcgtgagaggaaaagacaataatggtaatctcatcgggtccgatgagtacgaggtgtcaatatcttatgccgtcaccacaggtaactcaaccgctcatgctcagcagaatctagatttcattgacctccagcctaacacaacagtggtcttccctccattcatacatgagtcgcacctgaaatttcagatcgtcgatgacactatccctgagattgccgagtcgtttcacatcatgttattaaaagacacgctgcagggtgacgccgtgctcatctctccgtccgtggtccaggtcacaatcaaaccaaatgacaaaccgtacggggtgctatctttcaacagcgttctcttcgagcgaacggtcataatcgatgaggatagaatcagtcggtacgaggagatcacggtcgtgcggaacgggggaacccacggcaatgtctctgccaactgggtgctgaccaggaatagcaccgacccgtctcctgttactgctgacatcaggcccagtagcggagtcctgcattttgcacaaggccagatgctggcgacaatcccacttacagtcgtggatgatgatctcccagaagaagcagaagcctacttgctgcaaattcttccgcatacaatccgcggtggagcagaagtgtcggagcccgctgagctgcttttctacattcaagatagcgacgatgtgtacgggttgatcactttcttcccaatggagaaccagaaaattgaaagctcacccggtgagagatacctgtcactgtcattcacgaggctgggcggaacaaagggggatgtccggcttctttattccgttctgtacatcccagctggcgctgtcgatccattacaagccaaagaaggtatcctcaacatctcacgaagaaacgatctgatcttccccgaacagaagacacaagtgaccaccaaattaccaatcaggaacgacgcgtttctgcagaatggggcacattttctggtgcagttagagacggtggaattactcaatatcattcctcttattccccctatttcacctagatttggagaaatttgtaacatttcactcctggttacaccggcaattgccaatggtgagatcggtttcctgtcaaatctccccattatattgcacgagccagaagatttcgctgcagaggtcgtgtacatcccgttgcacagagatggcacagacggccaagctaccgtatattggtccctcaaaccgtcggggttcaacagtaaagctgttactcctgatgacattggcccattcaacggcagcgtgctgttcctgagcggccagtccgacactacaattaacattacaataaaaggcgacgatattcctgagatgaatgagacagtgacattaagcctcgaccgtgtcaacgtagagaatcaagtgctgaaaagcggatacacctccagagatcttattatcctcgaaaacgacgacccgggaggtgtgttcgagttctccccggcatcaagaggtccttatgtgattaaagagggcgagagcgtcgaattgcacattatccggtcccgaggctcacttgtaaagcagtttctccactaccgcgtcgagccgagagacagcaacgaattctatggaaacactggagtcctggagtttaaacctggagaacgggagatcgtgatcactctattagcacggctcgatgggatccctgagcttgatgaacattattgggtggtgctgagctcgcacggtgaacgggagagcaagctcggaagcgcaacaattgtcaacatcaccatcttaaagaacgacgatccacacggcatcattgaattcgtttccgatggactcattgtcatgatcaacgaaagtaagggtgacgccatctacagtgcagtctatgacgtggtgcggaacaggggaaatttcggtgatgtaagcgtgtcttgggtggtctctcccgacttcacccaagatgtgttccccgttcagggcacagttgtattcggcgaccaggaattcagcaagaatatcacgatttacagtcttccggatgaaatccctgaggagatggaagagttcactgtcatcctgctcaacggcacgggaggggctaaagtgggcaatcgtaccaccgccacacttaggattcgaaggaacgacgacccaatttattttgccgaaccaagagttgttagagtccaagagggagagaccgcaaatttcactgtccttcgaaacgggtcggtagacgtgacatgcatggtacaatacgctacaaaggacgggaaagccaccgccagagaaagggattttataccggtcgagaaaggagagaccttgatcttcgaggtcggctcccgccagcagtcaatcagcatattcgtgaatgaggacggcattccagaaacagatgaacccttttatatcattctactgaactccactggcgatactgttgtataccaatacggcgtcgctacagtgatcatcgaagccaatgacgatccaaatgggatcttctcactcgagcctattgacaaagcggtcgaagagggcaagaccaacgctttttggatactcaggcatagaggctacttcggaagcgtctccgtgagctggcagctgtttcagaatgactcagctctgcagcctgggcaggagttttacgagaccagcggcacagttaatttcatggatggcgaggaggcaaagcctattattttgcatgcattcccagataagatcccagaattcaacgaattctatttcttaaaactggtgaacatttcaggcggatccccaggacctggaggccaactggctgagactaatctccaggtaaccgttatggtgccttttaacgacgatccgttcggtgtgttcatcttggatcccgaatgcctggaaagggaagtggccgaggacgtgctctctgaagacgatatgtcctacattaccaatttcacgatccttcgccagcagggtgtcttcggagatgttcaattgggctgggaaatcctcagttccgagtttcctgctgggctccctccaatgatcgacttcctgctggtggggattttcccaaccactgtgcatctgcagcagcacatgcggagacatcattccgggaccgacgcactgtacttcacagggttggaaggagctttcggaacggtgaatccaaagtatcacccgtccagaaataatactatcgccaacttcaccttcagcgcttgggttatgcctaatgccaacactaatggcttcatcattgcgaaggatgatggaaatggttctatctattacggagtgaaaattcagacaaacgaaagtcatgtgacactcagcctgcactacaagacactggggagcaatgccacctacattgctaaaacgaccgtgatgaagtatctggaggagtcagtctggctgcacctcctgattatattggaagatggcataattgagttctacctggatgggaatgccatgcctcggggtatcaaatctctcaagggtgaagccatcactgacggcccaggcatacttcgcatcggcgcagggatcaatgggaatgatcggttcaccggactgatgcaagacgtgcgcagctatgagcggaagctcactctagaagagatatatgaactgcacgctatgcctgcgaaaagcgacctgcacccgatctcagggtatctcgagttccgccagggcgagactaacaagtcgtttatcatttccgcccgagacgataatgatgaggagggcgaagagctgtttattttgaaacttgtaagtgtctacggaggagctaggatttcagaagagaacaccactgcccgactgactatccaaaagagcgacaacgcgaacggattgttcggatttactggcgcttgtatacccgaaatcgccgaagaggggtcaaccatcagttgcgtagtggaaaggaccagaggggcactagattatgtgcatgtgttctacaccatttcgcagatagaaactgacgggattaattacttggttgatgatttcgccaacgcgagcggcactatcacgtttctcccttggcagagaagcgaggtgctgaacatctacgtgctggacgatgacattcccgaactgaacgaatattttcgggtgacgcttgtttctgcgatccctggcgacggaaagctcggatcgacccccaccagtggtgctagtattgacccagaaaaagagacaactgatattacaattaaggcaagtgatcatccctatgggctactccagttttctacagggttaccccctcagcctaaagacgctatgacgctccccgcttcttcggtgccacacataactgtggaggaagaggacggcgagatccggctcttagtgattcgggctcagggactgttgggcagagtcaccgctgaattcaggactgtgtccctgacagctttctcccctgaggattaccagaatgtggctggaactcttgagttccagcccggtgagcgttataagtatattttcatcaatatcaccgataatagtattcccgagcttgagaaaagctttaaggtggagcttctcaacctggaaggcggagtggccgaactttttagagtcgacgggagtggctccggagacggggatatggagttcttccttcccaccattcataagcgcgctagtttaggcgtcgccagccaaatattggtcactatcgccgcaagcgaccacgcacacggcgtctttgaattcagtccggagtccctttttgtgtctggaactgaaccagaggacgggtattctacagtcactctgaacgtgatccgtcatcatggcacactgagcccagtcactctgcactggaatatagattctgacccagatggggatctcgccttcacctctggaaacatcacgtttgaaatcggccagacgtctgccaacatcaccgtcgaaattctccccgatgaggatcccgagcttgataaggcttttagcgtgtctgtgctgtcggtttcatcagggtccctgggggcacatatcaacgccacattgaccgtgttagcttcagacgacccctacgggattttcatattctccgagaagaaccggcctgttaaggtggaggaagctacacagaatattacactctccatcatccggctaaaggggttgatgggcaaggttctcgtaagctatgccacgctggatgacatggagaagccaccatattttccccctaatttggcacgggctactcagggaagggattacattccagcctctggatttgcattgttcggtgccaaccagagtgaggctacaatcgccataagtatcctggacgatgacgaaccagagcgttctgagtctgttttcatcgagctgctgaactctacccttgtggctaaggttcagagccggtctattcccaatagccctagactcggtcctaaagtggagaccattgcccaactgataatcatcgctaatgacgatgcatttgggacactgcagctgagcgcgccaatcgtccgggttgccgaaaaccatgtcgggccaatcataaacgtgacaaggaccggaggcgcttttgcagatgtatcggtgaaatttaaagctgtaccaataactgccatcgcaggggaggattacagcattgcctccagtgatgttgtacttttggagggagaaacgagtaaagcagtccctatctatgtcatcaacgacatctatcctgagcttgaagagtccttcttagttcagttaatgaacgagacaaccggtggcgcacgtctgggggcactcaccgaagcggtgattattattgaagcttctgatgatccttatgggttgttcgggttccagatcaccaaactgattgtcgaagaacccgaattcaactccgttaaagtaaacctgccaatcataagaaacagcggcacgcttgggaatgtaaccgtccagtgggtggccaccattaatggccagcttgcaaccggtgacctgagggtggtgtctgggaacgtgactttcgcccctggcgagactattcagaccttactgctcgaagtcctggctgacgacgtgcctgaaattgaagaagtgattcaggttcagctcacagatgcttcagggggaggtacgatcggcttagatcgaatcgccaatataatcatcccagctaacgacgacccgtacggcactgtggcattcgcccagatggtgtatagggtgcaggagcctttagagcggtcatcctgtgcaaacatcactgtgagaagatctggcggtcacttcggccgtctactgcttttctacagcacgtcagatattgatgtggtcgccctcgccatggaagaggggcaggacctgctgtcctactatgagagtccaatccagggtgttccagatccactctggcgcacttggatgaacgtctcagcagttggagaacctctctatacgtgtgcgaccctgtgccttaaggagcaagcctgttctgctttctcgttcttttccgccagcgagggtcctcaatgtttttggatgacttcatggatctcgccggcagtgaacaattccgacttctggacctacaggaagaatatgacacgggtggcatcgttgttttccgggcaagcagtggccggttctgactatgaacccgtgacccgccagtgggcgatcatgcaagaaggagacgagtttgccaacctcactgtgagcatactgccagatgactttcccgagatggacgaaagcttcctgatatctctgctggaggtccatttaatgaacattagcgctagcctgaagaaccagccgacgatcgggcagcctaacatctcaaccgtcgttatcgcccttaatggagatgcttttggggtgttcgtcatttacaacatttccccaaatacttctgaggacggtctattcgtcgaggtacaagagcaacctcagacactggtcgagttgatgattcaccgcaccggcggatcgttggggcaggtggccgtggaatggcgtgtcgtaggaggaaccgccactgaaggactagactttattggagccggagaaatcctcactttcgcagaaggcgaaacaaaaaagacagtaatcctcacaatcctggacgatagtgaacctgaggacgatgaaagcatcatcgtttccctcgtctatactgaggggggatcccgcattcttcccagctctgacactgtgcgcgttaacatcctggcaaatgacaatgtggctgggattgtcagcttccaaactgcttcccggtcagtgatcggccacgaaggcgagatcctgcaattccatgtgatccgcacattccccggacgcggaaacgtaactgtaaactggaaaatcattggccaaaacttggagctaaacttcgcgaatttttcaggccagcttttttttcctgaagggtctcttaacactacactgttcgtgcacctattggatgacaatatccccgaagagaaagaggtttatcaagtgatcctgtacgatgtacggacccagggcgtgcccccagccggaatcgctctgctggacgcacaagggtatgccgcagtgctgactgtcgaggcttctgacgaaccccacggcgtcttgaacttcgcactgtcaagccggtttgtgttgctccaggaagctaacattacaatccaactgtttatcaatcgcgagtttggatccctgggagcaatcaatgtcacatatactacagtccctggcatgctgtctcttaagaaccagaccgtgggcaatcttgcagaacctgaagtcgacttcgtcccgatcatcggatttctgatcctggaggagggcgagaccgccgcagccataaacattacgatcctcgaagacgatgttcccgaactggaggaatatttcctggtgaacctgacatacgtgggcctgacgatggccgcatctactagtttcccacctcgtctggacagtgaaggactcacagcccaggtgataattgatgccaacgatggcgctagaggggtgattgaatggcagcagagcaggtttgaagtgaacgaaacacacggctctctgactctggttgctcaaaggtcccgcgaaccgctaggccatgtcagtctgttcgtgtatgcacaaaatctcgaagcacaggtggggctggattacatcttcacacctatgatcctccatttcgcagatggtgaaaggtataagaatgttaacattatgattctcgacgatgatattccagagggtgacgagaaatttcagttaattttgacaaatcctagtcccggtcttgagctgggtaagaatacaatcgcactgatcatcgtgctggctaacgatgacggaccaggcgtgctctcgttcaacaatagcgagcatttcttcttgagggaaccaacggccctatatgttcaagaatctgtggcagtgctgtacatcgtgagggaacccgctcagggcctgttcgggaccgtgacagtgcaattcattgttaccgaagtcaactcaagcaatgaatccaaagacctcacaccatctaagggatacattgtgctggaagaaggggtgcggttcaaagctctccaaatctctgccatcctcgacacagaacctgaaatggacgagtactttgtctgcaccctctttaacccaactgggggagcccgactgggagtgcacgtgcagaccctcataactgttctccaaaatcaggcccctttaggcctattttcgatttctgcggtcgaaaatcgagccacaagcatcgacattgaagaagcaaatcgcactgtctatttgaacgtgtccagaaccaacggtatagatttggcagtttccgttcagtgggagaccgtgtctgagactgcattcggaatgcggggtatggacgtggtttttagcgtattccagtctttcctcgacgaatctgccagtgggtggtgcttctttaccttggagaacctcatctatggcattatgctccggaaatcatcggttactgtgtaccgatggcaggggatattcatcccagttgaggaccttaacattgaaaacccgaaaacctgtgaagcctttaatattggattcagcccttatttcgtaattacacatgaagagcgaaacgaggaaaaacctagtctgaattccgtttttacatttacctcaggatttaaattgttcctagtgcagaccataatcattctagagtcaagccaggtcagatactttacttctgactctcaggactaccttataattgctagccagcgcgatgattcagaactgacgcaggtctttcgatggaatgggggatcattcgttttgcaccaaaagttgcccgtgcggggagtcctcaccgtggcgcttttcaataagggaggatcagtgttcttagctattagccaggctaatgctcgactgaattcactactgttcagatggagcggcagtgggtttatcaacttccaagaagtgcctgtaagcggaaccactgaagtcgaagctctcagctcagcaaacgacatttacctgattttcgccgagaatgttttcctaggcgaccagaacagcatcgacatttttatctgggaaatgggacaaagctcttttaggtactttcagagtgttgactttgctgccgtcaacagaatacacagtttcacaccagccagcggtatcgctcatatcttgctgataggtcaggacatgagcgccctgtactgttggaattctgagcgtaaccagtttagttttgtgctcgaggttccctccgcatacgacgtcgcctcagtaaccgtgaaaagcctgaattcgtccaagaacctgatagcacttgtaggagcccactcccacatctacgaactggcctacatttcctctcattcagactttataccatcatccggagagttgatctttgaaccaggtgagagggaggccaccatagcggttaatatccttgatgatacagtgcccgagaaggaggagagtttcaaggtccagttgaagaatcctaaaggaggtgccgaaatcggaattaacgactctgtcactattaccatcttatccaatgatgatgcctatggtattgttgcttttgcacagaactcattgtacaagcaggtggaggagatggaacaggacagcctggtgaccttgaacgtcgagcgtttaaaagggacttatggacgaataacaatcgcctgggaagccgatgggtcgataagcgacatattcccaacttctggggtaatcctgttcactgaaggacaggtgctgagcactattacactaacaattttggcagacaacattcctgaactctcagaggtggtcatcgttactctcacaaggatcactaccgagggagtggaagacagctacaagggagccactattgatcaggaccggagtaagagtgtcataaccaccctgcctaacgatagcccctttggcctggtgggatggcgggctgcctcggttttcatccgggtggctgagcctaaagaaaatactaccacgttacagcttcagatcgccagggacaaggggctgctgggggatatcgctatccatttacgggcacaacccaattttcttctgcatgttgataatcaagcgacagaaaacgaagattatgtgctgcaggagaccatcataattatgaaggagaacatcaaggaggctcacgcagaagtgagcatccttccagatgacctgccagagctggaagaggggttcatagtcaccattaccgaggtcaatctggtgaacagtgatttctctactggacagccctcagtgcggagaccgggaatggagatcgccgaaataatgattgaggagaacgatgacccaagggggatcttcatgttccacgttacgaggggtgcaggcgaggtcattaccgcatatgaggtgccgcctcccctcaacgtcctccaggtgccagtagtccggttggcaggctcttttggggctgtcaacgtgtattggaaagcatcaccagactcagccggactcgaggactttaaaccttctcatgggatcctggaattcgcagacaaacaggttacagctatgattgaaatcactataatcgatgacgcagaattcgaacttactgagaccttcaacatttccctgatcagcgtagccggaggcggacggctcggcgacgatgttgtggtcacagtcgtcatccctcaaaatgacagtcctttcggagtgttcggatttgaggaaaaaacggtaatgatcgacgaatctctgagctctgacgacccggactcatatgtgacattgactgtggtcagatcccccggtggcaagggcacagttagactggaatggactatcgacgaaaaggccaagcacaatctatctcccctgaatgggactctgcatttcgatgaaaccgaatctcagaagactatcgttctgcacaccttacaggataccgttttggaagaggacaggcgctttacgattcaacttatctctatagatgaggtcgagatttcaccagtcaagggttcagctagcatcatcataagaggcgacaaaagggcatccggggaggtcggcatagccccaagttccagacatatcctgattggtgagccctctgccaagtataatggtacagccattatcagcttggtgcgtgggccaggcatcttgggagaggttacagttttttggaggatattccccccatccgtcggcgaattcgccgaaacatccggtaagttgacaatgagagacgaacaaagcgccgtgattgtcgtaatacaggccctgaacgacgatattcctgaagagaagtccttctacgaatttcaacttaccgccgtgtccgaaggaggggtactaagcgaaagctccagtactgctaacatcactgtggtggctagtgacagcccatacggcagattcgcctttagtcacgaacagttgagggtttccgaagcccagagagtgaatattacaatcatcagaagctcgggcgacttcggccatgtgcgcctttggtataagaccatgtccggcaccgccgaggccggactggactttgttccggcagccggtgaactgctctttgaggcaggtgagatgaggaagagtttgcatgtcgagattctggacgacgattaccctgagggccctgaggaattctcattgactattacaaaagtggagttgcagggaagaggttacgattttacaattcaggagaatggccttcagatcgaccagcctccagagatcggcaacatctcaatagtgagaatcatcatcatgaagaacgataatgcagaagggatcatcgagttcgacccgaagtacaccgcctttgaggttgaggaagacgttggcctgattatgatcccggtggttcgattgcacggcacatacgggtatgtgacggctgattttatttctcaaagctcctcagcgtcccctggtggcgtggactacatcttgcacggaagcaccgtgacatttcaacacggtcaaaacttatccttcatcaatataagtatcatagacgacaatgaaagcgagttcgaggaacctattgaaatcctgttgactggcgctaccggaggggcagtgcttggcaggcacctggtatccagaatcatcattgccaaaagtgattctcccttcggggtgatacgctttctgaaccagtcaaaaatcagtatagcaaaccccaactcaactatgatactctcactcgttctggagcgcaccggcggactcctaggagagatccaagttaattgggagacagttggacctaactcccaggaggcactgctgccgcagaacagggacattgcagatccagtgagcggactcttttattttggagagggggagggcggtgtccgaacaattatcttaacaatttaccctcacgaagagatcgaagtcgaggaaacatttatcattaagctgcacctggtaaagggagaggcaaaattggactctcgagccaaggatgtgacccttacgatccaggaattcggtgatcctaacggggtggtgcagtttgcccctgagactttgtcaaaaaaaacgtactcagaacctctggccctggaagggcctcttctaataactttctttgtacgcagagtaaagggtacattcggggaaattatggtctattgggaactgagcagcgaattcgatataacggaagatttcctgtcaaccagcggattctttacaatcgccgatggggaaagtgaggccagttttgatgtacatctcctgcctgatgaggtgcccgaaatcgaagaagactacgtgattcagctcgtaagcgtcgagggtggggctgaactcgacctcgagaagtctataacatggttcagtgtatacgctaatgacgacccgcacggtgtgtttgccctgtactctgacaggcagagcatactcatcggccagaatctcatcaggtcaattcaaattaacattacaagactggccggaaccttcggcgacgtggccgtgggactccggatctcatcggaccataaagagcagcctatcgttaccgagaatgccgaacggcagctcgtggtgaaagacggtgcaacttacaaagtggatgttgtgcccattaagaatcaagtgtttcttagccttggctcaaattttacactccaactggtgaccgtcatgttggtcggagggcgtttctatggtatgcctacaatcctacaggaggccaaatccgccgtgttgccagtgagcgaaaaggcagctaattctcaagtaggcttcgaatccacagctttccagctgatgaatataacagccggaacgtcacacgtgatgatttcacgtcggggaacatacggcgcactgagcgttgcttggaccacgggctatgccccaggtctggagatccctgaattcattgtggtagggaacatgacccccaccctgggctccctgagcttcagtcacggcgagcagcgaaagggagtgttcctgtggactttccctagcccaggctggccagaggcttttgtacttcacctctccggtgttcagtcgtccgctcctgggggagcacaactcagaagcggttttattgtggccgagattgaacccatgggagtgtttcagttcagtacatcctcacgaaatatcatagtgtccgaagatacgcagatgatacggctgcacgtgcagagactatttggcttccactccgaccttatcaaagtttcttatcagaccacggctggctccgccaagccgctggaggacttcgaacccgtccaaaatggcgagcttttctttcagaagtttcagaccgaagtggacttcgagattactataatcaacgatcagctcagtgagatagaggagttcttctatatcaacctgacctctgtggaaatcagaggcctgcagaaattcgatgtcaactggagtccacgtcttaaccttgattttagtgtcgctgtaatcacaattctcgataatgatgacctggctgggatggacatttcttttcctgagaccaccgtcgcggtggccgtggacaccactttgatcccagtggaaacagaatcaaccacataccttagcacaagcaagaccacaactatcttgcaacccacgaacgtggtggccatcgtgacagaagcaacgggcgtatccgcaatccctgaaaagttggtgacgctacacggaacacccgctgtttccgagaagcctgatgtcgcaaccgtgacagccaacgtgagtatccacggcactttcagccttggtccatccatagtttacatcgaggaagagatgaaaaatgggacgtttaataccgctgaggttctcatacgacgcacaggaggattcacgggcaacgtctccataacagtgaaaacctttggggagcgctgcgcccagatggagccaaacgcacttcccttcagagggatatacgggatttcaaatctgacgtgggcggttgaggaagaggacttcgaagagcagacacttaccctgatttttttggacggagagagggagaggaaagtgtcggtccagatattggatgatgacgagccggagggtcaagaatttttttatgtctttttaaccaacccacaggggggtgcccagatcgtcgaggaaaaagacgacacagggtttgccgcattcgcgatggtgatcatcacagggagtgacctccacaacggcataattgggttttctgaagagtctcagtctggattagagcttcgtgagggagccgtcatgaggaggcttcatctgatcgtgacacgccaacctaatagggctttcgaagacgttaaagtgttctggagagtcaccttaaacaagacagttgtggtgctgcagaaagatggcgtgaacttagtcgaggaactgcagagcgtgagcggcacaacaacgtgcaccatggggcagacaaagtgcttcatttcaattgaactgaagccagagaaagtgccccaagttgaggtgtatttctttgtggagctctatgaggcaactgctggtgccgcaattaataattcagcgcgattcgcccagatcaagatcctcgagagcgatgagtcccagtcactggtctattttagcgtagggtccagattggcagttgcgcataagaaggcaacgttaatctctctgcaggtggctcgcgatagcggaactggcctgatgatgagcgtaaacttctccacacaggagctacggtccgccgaaactattgggaggaccatcatttcgccagcaataagcggcaaggactttgtcatcacagaaggcacgttggtttttgagcctggtcagagatccaccgtactcgacgttatcctcacccccgagaccgggtccttaaatagtttccccaagcgcttccagatagtattattcgatccaaaaggcggagccagaatcgataaagtctacggaactgccaacattacactcgtgagcgatgctgacagtcaggctatctggggtctggcagaccagttacatcagccagttaacgatgacattctgaaccgggtcttgcacacgatttccatgaaagtcgcgactgagaacaccgatgaacagctgagcgcaatgatgcacctcatagagaaaatcacaacagaaggaaaaatacaggcattttctgtcgcttcccgcacactgttttacgaaattctgtgcagcttaatcaacccaaagagaaaagacacgcggggattttcacatttcgctgaggtaacagagaatttcgctttctccctcttgacaaatgttacatgtgggtcgcctggagagaagagcaagacgattttagattcttgtccttacctttccattctggctctacactggtaccctcagcaaataaatggacataagtttgaggggaaggagggggattatatccgaattccagagcgccttctcgatgtacaggatgctgagatcatggcagggaagtccacctgtaagcttgtgcagtttacagaatactcctctcaacagtggtttataagtggcaataaccttcctactctgaagaataaagtcctctctctctccgtaaaaggccaatcaagccaactgctgactaacgataatgaagtgctgtatagaatttacgcagccgaaccccgaattatcccacagacgagtttgtgtcttttgtggaaccaggctgccgcttcatggctgtctgatagtcagttctgcaaggtggttgaggagacggcagattacgtagagtgcgcctgttcccacatgtctgtctatgctgtgtacgctagaaccgataatttgtcttcctataatgaagcctttttcacgtcgggatttatctgtatttccggtctgtgtttggccgtgctgagtcacatcttttgcgcgcgatactccatgttcgccgctaagctgctgacccacatgatggctgcatccctcggaacccagatcctcttcctggcttcagcgtacgccagcccccaactggctgaagagtcctgctcggctatggccgctgtgacccactacttatacctttgtcagttctcctggatgctcatccagtctgtgaatttctggtatgtgctcgtaatgaacgacgaacacactgagagacgctatctactcttctttctgctgtcctgggggctgcctgccttcgtggtgatcctactcatcgtcatacttaaggggatctatcatcagtccatgtcccagatctatgggctcatccacggagacctatgtttcatcccgaacgtgtacgcagccctctttaccgcagctctcgtcccgttaacttgcttggtcgtcgtgtttgtggtgttcatccacgcatatcaggtgaagccacagtggaaagcctacgacgatgtctttaggggaagaactaacgccgctgaaattcctctcatcctgtacttatttgccctgatctccgttacttggctatgggggggtttacatatggcatatcgacatttctggatgctggtcctttttgtgatatttaactctctgcagggcctatacgtgtttatggtgtattttatattacataaccagatgtgttgccccatgaaggcctcctacaccgtggaaatgaacggtcaccctggaccgagcacagccttcttcacacccggttccgggatgcctcccgctggtggggagatctcgaaatctactcagaatttaatcggagcgatggaagaagtgcctcccgattgggaacgggcttcgttccagcagggaagccaagctagtcccgacctgaaaccatcgccccagaacggagccaccttcccatctagcggagggtacggccaaggaagtttaatagccgacgaagagtcacaagaattcgatgatctaatttttgctctaaaaacgggagccggactgtcagtctccgacaatgagagtggccagggaagccaggaaggcggtacactgacggatagccagattgtggagcttaggaggattccaattgctgatactcatttgta

SEQ ID NO: 224106 - DNA, 6920 bp, Artificial Sequence
  Description of Artificial Sequence: Synthetic coding sequence
gtcgatgtgttcatgtttctcggtatgccatcggcatcccttcttgtaaaccttctgtcggcactgttaattttattcgtgtttggcgagaccgagatccggtttaccggtcaaactgagttcgtggtgaacgagacttccactaccgtcatacgactaattattgagagaattggagagccagccaacgtgacagcgatagtctccctttatggggaagacgcaggcgacttttttgatacctacgcggcagctttcattcctgcgggagagactaaccggaccgtgtatatagcagtatgtgacgacgaccttccagagcccgatgagactttcatctttcacctgaccttgcaaaagccgtcagctaatgtgaaactgggctggccccgtaccgttactgtgactattctaagcaacgacaatgcatttggaataatttctttcaacatgctcccctcaatcgctgtgtcggaacccaagggcaggaacgaaagcatgcccctgaccctcatccgggaaaaggggacgtacgggatggttatggtcacctttgaagtggagggcggtccaaacccacctgacgaagacctctcccctgtgaagggcaatattacatttccgccaggaagggcgaccgttatatacaacttaacagttctggacgacgaagtccctgaaaacgacgagatttttcttatccagctgaagtcagtggagggaggtgctgaaatcaatactagtcgcaactcaatagagattattattaagaagaatgacagtccagttcggtttttacagtcaatctacctggtccccgaggaggatcatatcttgatcatcccagtggtgcggggtaaagacaacaacggcaacctgatagggagcgacgagtacgaagtgagtatttcgtatgccgtcactacagggaatagtacagcacacgctcagcaaaacctggacttcatagacttacagccaaacacaacggtcgtttttcctccattcatccacgagtcccacctgaaattccagattgtggacgacaccatccctgaaattgccgaatccttccacatcatgctcctaaaggacactctacaaggcgatgccgtcttgatctccccaagtgtagttcaggtgacaatcaaaccaaacgataagccatacggcgttcttagctttaactctgtgctgttcgaacgtacagtgataattgatgaagataggattagccgatacgaggaaattactgtagtgcgaaatggcggaacgcacggaaatgtttcagccaactgggtgcttacacgcaattctaccgatccatcacccgtgacggctgacatccgcccatcatcaggtgtgttgcacttcgcccagggccagatgttagccacaatccccttgaccgtggttgatgatgatttgcccgaggaggcagaagcatatcttctgcagatcctaccccacaccattagagggggtgccgaagtgtccgagcctgccgagctgctcttttacatccaggactcagatgacgtttatggcctgattaccttcttccccatggaaaatcagaagattgagagctcacccggtgagcggtatctgtctttaagtttcacccgattaggcggaaccaaaggcgatgtgcggctgttatactcagtgctctatataccagccggtgccgtggatccacttcaggcgaaggaggggatcttaaatatctcccgacgtaacgacctgatctttcctgaacagaagactcaagtgaccacaaagcttccaattcgcaacgacgcttttctgcaaaacggggctcacttcctcgttcagctcgaaactgtggaactgctgaatatcatccctctgattccccctatctctccaagattcggagagatctgcaacatctccttactggtgacccctgctatagctaatggcgaaattgggtttctctcaaatctgcctatcattctccatgagcccgaagacttcgctgcagaagtggtctatattcctttgcaccgcgatgggaccgacggccaagccactgtgtattggtcacttaaaccaagtggatttaattctaaagccgtgacccccgacgatattggccctttcaatggctcagtgctgtttttaagcggccagagcgacacgaccattaatatcacaattaagggtgatgacatacctgagatgaacgagaccgtgacccttagcctggacagggttaacgtcgagaatcaggtgttaaagtcaggctacacttctagggatcttattatccttgagaatgacgaccctggtggagtgtttgagttttcacccgctagccgcggaccctacgtcattaaggaaggagagtcagtggaattgcacattatcagaagcagaggctctctggttaaacagtttttgcactacagggttgaacctagagattccaacgagttctacggaaatactggcgtactggagttcaaaccaggcgagcgcgagatcgtgatcacacttctggccaggcttgacgggatcccggagctggacgagcactattgggtggtcctatcctcacacggggagcgtgaatcaaaactgggctctgctacaatcgtgaacatcacaattcttaaaaatgatgatccacatgggattattgaatttgtgtctgacggtctgatcgtgatgattaacgagagtaaaggggacgcgatctactccgcagtgtacgatgtcgtacgcaatagaggcaatttcggtgacgtctccgttagctgggtcgtcagtccagattttacccaggacgtgttcccagttcagggcaccgtggtattcggggatcaggagttctccaagaatattaccatctatagcctgccagacgaaataccagaggagatggaggagtttaccgtgatactactgaacggaacaggtggcgcaaaggttggcaacagaactacggctacgctgcgcatccggaggaatgatgaccctatatattttgccgagcctcgcgtggtcagggttcaggaaggcgaaactgccaatttcacggtgctgaggaatgggtccgtggacgtaacttgtatggtgcaatacgctactaaggatggaaaagctaccgcgcgtgagagagacttcatccctgtcgagaaaggtgaaacactgatctttgaggtgggctctcgccaacaatcgatctccattttcgttaatgaggatggaatccctgaaaccgacgagcccttttacatcatcctattgaactctactggtgatacggtggtgtaccagtacggggtggccaccgtaataattgaagccaatgatgaccccaatgggatcttctccctggagcctatcgataaggctgtcgaggagggaaagaccaacgcattctggatcttgcggcaccggggatactttggatcagttagtgtttcttggcaattattccagaacgactctgctctgcagcctggacaggaattctatgaaacttctggcaccgtgaatttcatggacggggaagaggccaagccgatcatcctgcatgcattcccggacaagatcccagagttcaacgaattctacttcctcaagttggttaacatatccggcggaagtcctggcccaggcggacagctggccgaaaccaatctgcaggttacggtgatggtgcctttcaatgacgatccttttggcgtctttatccttgaccccgaatgccttgagcgagaggtagctgaggatgttttgtcagaggacgatatgagttatattactaacttcactatccttcgtcagcagggcgtgtttggtgacgtgcaactcggatgggaaatcctgtctagcgagttccctgcaggcctaccgccaatgatcgatttcttgttagtgggaatttttccaactaccgtccatcttcagcaacatatgcggcgacaccactcaggtactgacgccctatactttacaggcctggaaggagcttttggaacggttaatccaaagtaccaccccagccgtaacaatacaattgccaatttcaccttttctgcttgggtaatgccaaatgccaacactaatggtttcattattgccaaggacgacggcaacgggagtatttattatggcgtgaaaatccagacaaatgagagccacgtgacactcagcctccactataaaacgttaggcagtaatgccacctacattgcgaaaaccacggtgatgaaatatctggaagagagcgtgtggctgcacctcctgatcattctggaagatggcattatcgagttctacctggatggcaacgctatgccgagaggcattaagtccctgaagggggaagccatcaccgacggcccaggcatcctaagaattggagccggaatcaatggaaacgaccgcttcactgggctcatgcaagacgtacggagttacgagcgcaagctgacactcgaggaaatctacgagctgcatgccatgccagcaaaaagcgacctgcatcccatttcaggatacctcgaattcagacagggtgaaaccaataagtcattcattatcagcgcccgagacgacaacgacgaggagggagaagaactcttcatcctgaagctggtatcagtgtatggcggtgcacggatcagtgaggagaatactaccgcacggctgacaatccagaagtctgacaatgctaacgggctcttcggttttacaggggcatgcatacctgaaatcgcagaagaagggtcgactatcagctgcgtagtggagcgcacgcggggtgccctggactatgtccatgtgttttatacaatttcgcagatcgagacagatgggatcaactacctcgtagatgactttgcaaacgccagtgggactatcacctttctgccctggcaacgttcagaagtgctgaacatctacgtgctcgatgatgatatccctgagctgaacgaatattttagagtgactctggtgtcagccattcccggagatggcaagctgggctccacgcccacttctggggcaagcattgacccagaaaaagaaaccaccgatattaccatcaaagcatccgaccacccttatgggcttctgcagttctccaccggactccccccacaaccaaaggacgctatgactctgccggcaagtagcgtgccccacattactgtagaggaagaagatggagaaatccgcctgctcgtgatcagagcccaaggactgcttggcagagtaaccgccgagtttagaactgttagcttaacggcattcagccctgaagactaccagaacgtggccggtaccttggagttccaaccaggcgagaggtataaatacatctttatcaatattaccgataattcgatccccgaattagagaagagcttcaaggtggagttactcaacctagagggaggggtggccgagctgttccgagttgatggctccggctcaggagatggggatatggagttcttcctccctacaattcacaaacgggcttcactaggagtggctagccagattctggtgacgattgcagctagcgaccatgcacatggggtgttcgagttcagccccgagtccctgttcgtcagtggcacggaacctgaggacggctactctactgtgaccctgaacgtcatccggcatcacggaaccctgtcccctgtcaccctgcattggaacatcgactcagatcctgatggggacctcgctttcacgtccggtaacatcaccttcgagatcggtcaaacttccgccaacataactgttgagatcctcccggacgaagatccagaactcgataaagccttcagcgtttctgtgctgtcagtctctagcggcagtctcggagcccatataaatgccacgctcactgtgttagcttcagacgatccttacggaatcttcattttcagcgaaaagaataggcctgtgaaggtggaagaggccacccagaacattaccctgtcgataatcaggcttaaaggcctgatgggcaaagtgttggtttcttacgccacccttgacgacatggaaaaaccgccatacttcccaccaaacctcgcacgcgcaacccagggtcgagattacatcccggcttctggatttgccctgtttggcgctaaccagtccgaagccaccatagcaatatcgattctggacgacgacgagccggagaggagtgagagcgtcttcatcgagctgttgaattctactttggtagccaaggtgcagtcccgaagtatccccaattcacctagattggggccaaaggtcgaaactatagcccagcttatcatcattgctaatgacgacgccttcgggacccttcagctctcggcacctattgtcagggtcgccgaaaatcacgtgggcccaatcatcaatgtgacgcggactggaggggcttttgccgacgtgagcgtgaaatttaaggctgtgcccatcaccgctattgctggagaggattattctattgcatcctcggatgtcgtgctgctagagggtgagacaagtaaggctgtcccaatctacgtcataaacgatatctaccccgagctggaagaatcgttcctcgtccagctgatgaatgaaactaccggaggggctaggttgggggcactcacagaggcagtgattatcatcgaagcctccgacgacccttatgggctgtttggtttccaaattaccaagctgatcgttgaagagccagaatttaactccgtgaaggtgaacttacctatcatcagaaattctggaacacttggtaatgtgaccgtgcagtgggtggccaccatcaatgggcagctggcgaccggggaccttcgtgtcgtctccggaaacgtcactttcgctccagggatgagctcatatccctcggcaaccaatta

SEQ ID NO: 224107 - DNA, 18920 bp, Artificial Sequence
  Description of Artificial Sequence: Synthetic coding sequence
atgagcgtttttctcgggccaggcatgccctctgcctctctgctggtaaacctgctgtcagctctcctgatcttgttcgtgttcggtgagactgagatccgatttaccgggcagacagagttcgtggtcaatgagacaagcaccactgtcattagattaattatcgaacgaattggcgagccagctaacgtaaccgctatagtgagcttgtatggcgaggacgccggtgattttttcgatacatatgccgcagcctttatacctgctggcgagactaatagaaccgtgtacattgctgtgtgtgacgacgatttgccggaacctgacgagacgttcattttccacctcaccctacagaaaccttctgcaaacgttaagctgggctggcccagaaccgtgactgtgactatcttgtctaatgacaacgcatttgggatcatctcattcaacatgctgccttctatcgcggtttcagaacccaaggggagaaacgaaagcatgcctctgactctgatccgagaaaagggtacctacggcatggtgatggtgacattcgaagtggaaggagggccaaatccgcctgatgaggacctctctccggttaagggcaatattacctttcctcctggccgtgctacagtaatctacaatcttacggttctggatgatgaggtaccagaaaacgacgagatctttcttatccaactgaagtccgtagagggcggtgccgagattaacaccagtagaaacagcatagaaataataatcaagaagaacgatagcccagttcgatttttacagagcatctaccttgtgcccgaggaggaccacatattgatcattccagttgtccgcggaaaggacaacaatgggaacctgataggctctgacgagtacgaggtgagtatctcatatgctgtgaccacaggtaactccactgcgcatgcccaacagaatctcgactttatagatcttcagcccaataccactgtcgtcttcccgccatttattcacgaaagtcatctgaagttccagatagtggacgacaccattcctgaaattgcagagagttttcacatcatgctgctcaaagacactcttcagggcgacgccgtgctgatctcgccaagtgtagtacaggtcactattaagcccaacgacaagccttacggagtcctctctttcaacagtgtactctttgaaaggacagtaatcatcgacgaggacagaatttctaggtatgaagaaatcacagtggtcaggaacggaggcactcatggtaacgtcagcgccaattgggtgttgacaagaaacagtacagatccatcccccgtgacagccgacattaggcccagttcgggagtcttacactttgcccagggtcagatgcttgctacaattccactgactgtagtcgatgacgacctaccagaggaggccgaagcctacttgctacagatactgccacacacaatcaggggaggagccgaggtgagcgagcccgcagagctgctcttttacattcaggacagtgatgacgtttacgggctcattaccttctttcctatggagaatcaaaagattgagagttccccgggtgagaggtacttatcactgtctttcacccgtttggggggaactaaaggcgatgtcaggctcctctatagtgtcctctatattcctgccggtgcggtcgaccccctacaggccaaggagggtattctcaacatcagccggcgtaacgatctgatctttccagaacaaaaaacacaggtcacaaccaagctgccaattcggaatgacgctttcctccagaatggcgctcacttcctggttcagttggagacagtggagctgttaaacatcattccactgatcccccctatttcgcctcgatttggcgaaatctgcaacatctccctgctcgtgacaccagccatagccaacggtgaaattggattcctgagcaatctgccaatcattcttcacgaacctgaagactttgctgcagaggttgtctacattcccctccaccgggacgggacggatggccaagcgactgtgtactggagccttaaaccatcgggcttcaattcaaaagccgtgacccccgatgacattgggccattcaacggctccgtgctgttcctgagtggccagagcgacaccacaatcaacattaccatcaaaggagacgacataccggaaatgaacgagaccgtgaccttgagtctcgaccgggtgaacgtggaaaaccaggtgttaaagagcgggtacacgagcagggacttgatcatcttggaaaatgatgatccgggaggggtttttgaattctcgccagcctccagggggccttacgttatcaaagagggcgagagtgtcgaattgcacatcatccgctcccggggatctctagtcaagcagttcctgcattatcgcgttgaacccagagactctaatgaattctatggcaataccggcgtgctggaatttaaaccaggggagcgagagatcgtgattactctgctcgctcgcctggacggcatcccagagcttgacgaacactactgggtcgtcctcagcagtcatggagaacgtgagagtaaactggggagtgcgaccattgtgaatatcaccattctgaagaacgacgacccgcacggaattatcgagtttgtgtcagatgggctgatcgtgatgattaatgaatccaaaggggatgcaatttattcggccgtgtatgacgtggtcaggaatagagggaatttcggagacgtgtcagtatcctgggtggtatcaccagattttacccaggatgtgttccccgttcagggtaccgtggtcttcggcgaccaggaattcagcaagaacataacaatttatagcctgccagacgaaattcccgaggaaatggaagagttcaccgtgatcctactaaacgggaccggcggtgcaaaggtgggcaatagaacaacagccaccctgaggatcaggcgaaatgatgatcccatctacttcgccgagccaagagtggtgagagtacaggagggagagacagccaacttcaccgtgctgcggaacggatccgtcgacgtcacctgtatggtccagtatgcgaccaaggatggtaaggctacagcacgggagcgcgattttattcctgtcgagaagggcgaaaccctgattttcgaggtagggagtcggcagcagtcaattagcatcttcgtcaacgaagacggcatcccggaaactgatgagccattttatattattctgctgaactccaccggcgataccgtcgtgtaccaatatggtgttgctacagttatcatagaggcaaacgacgacccgaatggcatcttctccttagaacctatcgacaaagcagtcgaagagggcaagacgaacgccttttggattctgaggcacagaggctacttcggtagcgtcagcgtgtcctggcagttgttccagaatgacagtgcgctgcagccgggtcaggagttctacgagacatctggcactgtgaatttcatggacggcgaggaggctaaacctatcatattgcacgctttccctgataagattcctgagttcaatgaattctatttcctgaagttggtcaacatttctggcggaagccccggaccaggtggacagctggccgaaaccaatcttcaggtaaccgtgatggtccccttcaacgacgatccattcggggttttcatcctggatccagagtgcttggagagagaggtggcagaagacgttctgagcgaggatgacatgagctacattacgaacttcacgattctgcgccagcagggcgtgtttggcgacgttcagctcggatgggagatcctatccagtgagtttcccgctggtcttcccccaatgatcgattttctgctggtgggaatcttcccaactactgttcacctccaacagcacatgcgcaggcaccactctggcaccgacgctctctactttacagggttagagggggcatttgggaccgttaatcctaaataccacccttctcgaaacaataccattgccaactttacattctctgcctgggtaatgcctaacgctaacacaaacgggtttatcatagccaaggacgatggaaacggatccatttattatggcgtcaaaattcagactaacgagtctcatgtcactctgagcctgcactataaaaccctgggcagtaatgccacctatatagctaaaactacagtaatgaagtacctagaggaaagtgtctggctgcatttactgataattctcgaagatggtatcatagaattctatctggacgggaacgccatgccacgcggaattaagagtctgaagggagaggctattactgatgggcctgggattctgagaatcggcgctggcataaacggaaatgaccgatttactgggctgatgcaggatgtccgatcttatgaacgtaaactgactctggaggagatttatgagcttcacgctatgcctgccaagtctgacctacacccaattagtggatatctggaattccgacagggggagacaaataaatctttcatcatctcagcaagggacgataacgatgaggaaggggaagaactgtttatcctcaagctcgtttctgtgtacggcggtgccaggatctcagaagaaaatactaccgctcgactgacgatacaaaagtctgacaacgcaaacggtctctttgggttcacaggcgcttgcattcctgaaatagccgaggagggatctaccattagctgtgttgttgaacgtaccaggggggctcttgattacgtccacgtgttttataccataagtcagattgagaccgatgggattaactatcttgtggatgacttcgccaatgcaagtggcaccattacctttctcccatggcagaggtctgaagtgctcaacatatacgtgttagacgatgatattccggagttgaacgagtattttcgggtgacactggttagtgcaatacccggagacggcaagctaggatctacacccactagcggggcatccatagaccctgaaaaggaaaccaccgacatcactattaaagctagtgaccacccgtacggactgctgcagttcagtaccggcctgcctccgcagcctaaggatgccatgactctgccagcttccagtgtgccccacattacagtggaggaggaggatggtgaaataaggctcctagtgatccgggcacagggccttttgggccgagtgactgccgaatttcgaaccgttagcctcacagcattctcgccggaagactatcagaacgtggcaggtactctggaattccagcccggagaacgatacaaatacattttcatcaatatcactgacaatagtatccccgaactggaaaagtctttcaaggtggagctcctgaatctggaagggggagtagccgaactgttcagggtcgatggcagcggatctggcgacggcgacatggagttctttctcccaacaatccataaaagggcatctctcggagtcgcttcccagattcttgtgacaatcgccgcttccgaccacgcccatggcgttttcgaattcagtccagagagcctgttcgtcagtgggactgagccagaagacgggtactcaacagtaactttaaatgtgattcggcaccacgggaccctttctcctgtgacattgcattggaatattgattctgatcccgacggtgacttggcattcacaagcggcaatattacattcgaaattgggcagacttcagctaatattactgttgaaatcctgccagatgaagatcctgagttagacaaggcattcagtgtatcagtgttatctgtttcttcggggtcccttggcgctcacattaatgctaccttgacagtgctcgcctccgatgatccctacggcatcttcatattctctgagaagaatcgcccagtcaaagtcgaggaggccacccaaaacattaccttgtctatcatccgacttaaaggacttatgggtaaagtgttggtcagctatgccacactggatgacatggagaaacccccatatttcccaccaaacctagctagggcaacccaaggacgcgattacatcccggctagcgggttcgcattgttcggcgctaaccagtctgaggctactatcgctatctccatacttgacgatgatgagcccgagaggtctgaaagcgttttcattgaactgctgaatagtactctggtggctaaggtgcaatcacgttctattcccaacagtcccagactgggcccaaaagtcgaaaccattgctcagctcatcataattgccaatgacgatgccttcggtacattgcaactgtctgctcccatcgtcagggtcgctgagaaccatgttggacccattatcaatgtgaccaggactgggggtgcctttgccgacgtcagcgtcaagttcaaggcggtgcctattaccgcgatcgccggtgaggattattccattgccagtagcgatgtcgtcctgctcgaaggcgaaacctcaaaggcagtccctatctatgtcatcaatgatatataccctgagctggaagaatcttttctggtccagctgatgaacgaaaccacgggaggggctcgtctcggggcactgacggaggccgtgattatcatagaggccagtgacgatccttatgggctttttggtttccagattactaaacttatcgtagaagagcccgaatttaactccgtgaaggtgaatctgcccattatccgcaactctgggactctcggtaatgtgaccgtacagtgggtggctacgattaatgggcagctggctacaggggatctgagagtggtgtcgggcaatgtcactttcgctccaggagaaacaatccaaaccttgcttctggaagtgctggcagatgacgtgcccgaaatcgaagaagtcatccaggtacagcttactgatgcctctgggggaggcactattggactcgaccggatcgctaacataatcatccctgcgaacgacgacccgtatggaacagtcgccttcgctcagatggtttaccgagtccaggagccactggagcgatccagctgcgccaacattacagttcggagatccggaggccactttgggaggctcctcttgttctattcaacctcagacatcgatgtggtggccttggctatggaggagggacaggacctgctctcatattacgaatctcctattcaaggggtcccggacccgttatggcggacctggatgaatgtgagcgccgtgggcgagcccttgtacacgtgtgccaccttatgtctgaaagagcaggcatgtagcgcatttagcttcttttccgccagtgaaggaccccagtgcttctggatgactagttggattagccccgcagtgaataacagcgacttctggacatatagaaagaatatgacacgggtggcctcgctattcagcggacaggccgtggccggttctgattacgaaccagttacccgccagtgggctatcatgcaggaaggagatgaatttgccaatttgacagttagcattctccccgacgattttcctgaaatggatgagtcctttctgatatctctgctagaagttcaccttatgaacatcagcgcaagcctcaagaatcagccaactataggccagccaaatatctcgacagtggtgattgccctcaatggggacgccttcggagtattcgtgatctacaacatttccccaaacaccagcgaggatggactgtttgtcgaagtgcaggagcagccacagacacttgttgagctgatgatccacagaaccgggggatccctggggcaagtggccgtggaatggagggtggtgggtgggactgctaccgaggggctcgatttcatcggcgctggggagattctcacctttgccgagggagagacaaagaagaccgtcatcttaactatcctggatgactccgagcctgaagatgatgaatctatcatagtgtccctagtgtataccgaaggcggttctcgtatcctcccatcaagtgacacagtcagagtcaatattcttgccaatgacaatgtggccggtattgtgagcttccagactgcaagtcgaagcgtgatcggccatgaaggcgaaatactgcagttccacgtgattaggacttttcccggaagagggaacgtgacagtgaactggaagattattggccaaaatctggaactgaactttgccaacttttcgggtcaactattttttccagaagggtccctcaacaccacactttttgtccacttactcgacgacaatatcccggaggagaaggaggtgtatcaggttatcctttatgacgtacgcacccagggggtgcctcccgcaggaatcgctctgcttgatgctcaggggtacgctgctgtcttgactgtcgaggccagcgacgagccacacggtgtgctgaacttcgcattaagttcaaggttcgtgttattgcaggaggctaacatcactatacagctgttcatcaatcgcgaatttggtagcctgggggcaataaacgtgacatacacaaccgtcccaggcatgctgagcctgaaaaatcagaccgttggtaacctggcggaaccagaagttgactttgtgcccatcattggttttctgatccttgaggagggagagactgccgcagctattaacattactatccttgaggatgacgtgccagagctggaagagtactttttggtcaatctcacatatgttggtctcaccatggccgcaagcacctctttccctcctaggctggactcggagggtctcaccgcacaagtcataattgatgcaaatgacggcgctcgtggcgtaattgaatggcagcagtcacggttcgaggtcaatgaaacccacggtagcctgaccctggtcgctcagcggtctcgcgagccattgggacacgtttcattattcgtgtatgcacagaacctggaggctcaggtgggcctcgattacatcttcactccaatgatcctacatttcgcggatggcgagcgctacaagaatgtgaacattatgatactcgacgatgacattccagagggcgatgagaagttccagttgatcttgaccaacccctctcccggactggagctgggcaagaatacaattgctctgatcatagtattagctaacgacgacgggcctggcgtgctgagcttcaataattccgagcatttctttctcagagaaccaacagccctgtatgtgcaagaaagcgtggccgtcctatacatcgttagagagccagcccaagggctgtttggcacagtgacagtacaatttatagttacggaggtgaactcatccaatgagagtaaggacctcacacccagcaaagggtatatagtgcttgaggagggggtgcgcttcaaggcgctccaaatttccgccatcctggatacagagcccgagatggacgaatactttgtctgcactctattcaatccaacaggcggagccagactgggagtgcatgtgcagacactgatcactgtgctgcagaaccaggcacccctgggcctcttctccatttctgcagtagaaaatagagcaacatccatcgacatagaggaggcaaatagaacagtctacctgaatgtgagccgcacaaatggcatcgatctggctgtgagtgtgcaatgggaaacagtgagcgaaactgccttcggtatgcggggaatggacgtggtgttttccgtgtttcagtccttcctggatgagtctgcaagcggttggtgctttttcacactggagaatctgatttatggaatcatgctgcgaaagagcagcgtgacagtgtatcggtggcagggaatctttatccccgtcgaggatctgaacatcgagaacccaaagacttgtgaagccttcaacatagggttcagtccctattttgtaatcacacatgaagagaggaacgaggagaagccgtcgcttaactctgtgtttacattcacctcagggttcaagctcttcctagttcagacaatcattatcctggagtcatcccaggtgcgatattttacttccgactcccaggactatctcattatcgcatctcagcgcgatgactccgaattgacccaggtgtttagatggaatggcggttcatttgtgctccaccagaagttaccagtacgcggagtacttacagtcgccttgtttaacaagggcggaagcgtgtttctggccattagtcaggccaacgcaagactaaattcactgctgttcaggtggagtggtagcggatttattaattttcaagaagtacccgtgagtggaacaactgaagtagaagctttaagctccgctaatgatatctacctgatattcgccgaaaatgtgttcctcggagatcagaacagtattgatatattcatctgggaaatgggtcagtcatcgttccgctattttcagtccgtcgatttcgccgctgtcaatagaatccactcgttcacccctgcgtccggaatcgcccacattcttctgatcggacaggatatgtcagccctctactgctggaattccgaaaggaaccagttctcgtttgtgcttgaggtcccctcagcatatgatgtcgccagcgtgacagttaaatcactaaatagttctaaaaacctgattgcccttgttggtgcacatagccatatctacgagctagcttacatttccagtcactcagatttcatcccttctagtggagagttgattttcgaacctggagaaagggaagccactatcgctgtgaatatcctcgacgataccgtccccgagaaggaagagtctttcaaagtgcagctcaaaaatcctaagggtggggcagaaatcggcataaacgatagtgtgaccatcacaatcctgtccaatgatgatgcttacgggattgtggcctttgcccagaactcactatataagcaggtcgaggaaatggagcaagattccctggtgactctaaacgtggagcgactgaaagggacttatggcaggatcacgatagcgtgggaggcagacggttccatttcagatatcttcccaactagtggcgtgattctgtttacggaaggccaggtgttaagtacgattaccttaacaattcttgccgacaatatccccgaactgagcgaggtcgttattgtgacattgacacggattacgactgagggcgtggaagacagttataagggagccacaatcgaccaggacaggtctaagtctgtcataaccactctgccgaacgatagtccttttggactcgtggggtggagagcagctagcgtgtttatcagggtcgccgagcctaaggaaaacacaaccactctacagcttcagatagctcgtgacaaagggcttttaggggacattgcgattcacttgcgggcacagccgaacttcctgttgcacgttgataatcaggccaccgagaacgaggactatgtgctgcaggaaacaatcatcatcatgaaggagaacattaaagaggcccacgccgaggtgtctatactgccagacgatctcccagagctcgaggaggggtttattgtcactatcactgaagtgaatctagtcaatagtgacttttccacaggccaaccttcagtacgcaggcctggcatggaaatcgccgagatcatgatcgaagaaaatgatgacccaagaggtatctttatgtttcacgtcactagaggggctggagaagtcatcactgcctacgaggtacctcccccactaaacgtactgcaggttccagtcgttaggctcgccggaagtttcggagctgttaacgtttactggaaagcaagcccggacagtgcagggctggaggattttaagccatcacatggtatcttagaatttgctgataagcaagtcacagccatgatagagattaccatcattgatgatgcggagtttgaacttacagagacctttaacatttcactcatatcagtggcgggtgggggacgcttgggagatgacgtggtcgtgacggtggtgatcccccagaacgactcacctttcggcgtttttggcttcgaggaaaaaacagtgatgatcgatgagtccctcagctccgatgatcccgattcctatgtgaccctgacagttgtcaggtcccccggaggaaaaggtacagttcgattggaatggacaattgatgagaaagccaaacacaatctgagtcccctaaacgggactttgcactttgacgagactgaaagtcagaagaccatcgtgctgcacaccctacaggataccgtgttagaagaggatcgacgatttaccattcagctgattagtatcgatgaggtcgagatttccccagttaaggggtcagccagcattatcatccgcggagacaaaagagcctctggagaagttgggattgctccatccagtcgccacattctcattggcgagccaagcgccaagtataacggcactgcgattatatccctggtaagagggccaggtatattgggtgaggtaacagtgttttggagaatcttccctccttctgtcggtgagtttgcggaaacctccggtaaactgaccatgagagatgagcaatctgccgtgattgtagttatccaggccctcaacgacgatattcctgaagaaaagtcattctatgagtttcagctgactgctgtgagcgaaggtggcgtcctttccgaaagctcaagtaccgccaatatcacagtggtggcatccgactcgccgtatgggcgattcgccttcagtcacgagcagctgcgcgtaagtgaagctcagagagtcaatataactataatacgcagttctggggactttgggcacgtccgtttatggtacaagactatgtccggtactgcagaagcgggtctggacttcgtacccgctgccggagagctacttttcgaggccggtgagatgaggaaaagcctgcatgtcgagattttagatgatgactatcctgagggccctgaggagttttcgctgacaattaccaaggttgagttgcagggacggggatatgatttcacaattcaggaaaacggactgcagattgaccaaccccctgaaattggtaacatctccatcgtgcgaatcattataatgaagaacgacaatgctgaaggaatcattgagttcgacccgaagtacacagccttcgaagtggaggaagatgtggggttgatcatgattcccgttgtacgactgcacgggacttacggctatgtcactgccgattttatttcacaaagctccagtgcctcacctggaggcgtggactatatactccatggttctacagtgactttccagcacggacagaatctgtcctttataaatattagcattatcgacgataacgagagcgagtttgaagagcccatcgaaattctgctgaccggggcaaccggcggagccgtccttgggagacatctcgtgtcacgcatcatcatcgccaagagcgatagtccctttggggtgatcaggtttctaaatcagtccaaaattagtattgctaatccaaactctacgatgattctatcgctcgtgctggaacggacaggcggtctgctgggcgaaatccaagttaattgggagaccgtgggccctaactcccaagaggcactgctgccccagaatagggacatcgctgatcccgtgagtggtcttttttactttggtgagggggagggaggggtgcgaaccatcatcttaacaatatacccccacgaggaaatcgaggttgaggaaacgttcataataaaattacacctcgtgaaaggcgaagcaaagctggattcgcgcgcaaaggatgttactctcaccattcaggagttcggggaccccaatggcgttgtccaattcgcccctgaaactctttctaaaaagacttattctgagcccctggcactcgagggtcccttattaattacctttttcgtgaggcgcgtgaaaggcaccttcggggagattatggtctactgggaattgagcagcgagttcgacattactgaggacttcctgagcaccagcggattcttcaccatcgctgacggtgagtcggaagcctccttcgatgttcacttgttgcccgacgaggtgcctgaaattgaagaggactatgtcatccaactggtgtctgtggaggggggagcagaactagacctggagaagagtatcacttggttctctgtttacgccaacgatgaccctcacggcgtgtttgcactctactctgatcgccagtcgatactaataggacagaacctgatccggagcattcagattaacataacccgcctggcagggacattcggggatgtggcggtgggcctgcggatttcttctgatcacaaagaacaacctatagtgactgagaacgcggagcggcagcttgtggtgaaagacggagccacatacaaggtagatgtcgtacctatcaagaaccaggtgtttttgtctctgggctctaattttacgctacaattagtgactgtgatgcttgtcggcggtcgcttttacggcatgccaacaattctgcaggaagccaagagtgccgtgcttcctgtgtctgagaaggcagcaaactctcaggtcggattcgaaagtactgcatttcagctgatgaatatcaccgccggaacctcccatgtcatgatttcacgccgtggaacctatggcgcactgtccgtggcctggacgactggctatgctcctgggctggaaatccctgaatttatcgtcgtgggtaacatgacccccaccctgggatccttgagtttttcacacggtgagcaaagaaaaggcgtctttttatggacctttccatctccaggatggcccgaggcatttgttctgcacctgagcggcgttcagagctctgctccagggggtgcgcagctgaggtccggtttcatcgtggcggagattgagccaatgggggtttttcagttctcaacctcctcaaggaatatcattgttagcgaagacactcagatgatccgactccatgtacagcggctgtttggattccattcagacctgatcaaagtaagctatcagactacagcaggcagtgccaagccattggaggattttgaaccagttcaaaatggggaactctttttccagaagtttcagacggaggtggatttcgaaatcactatcattaacgaccagctgtccgagatagaagaatttttttatatcaatctgactagtgttgaaatccgtggactccagaagttcgatgttaactggtctcctcgattgaacctggattttagtgtggccgtgatcacaatcctcgacaacgacgatctggcgggtatggacatatccttccccgaaacaacagtagctgttgccgtcgataccaccctcattccagtggaaacggagagtactacatacctgagcacctcaaaaaccactactatattacagcctaccaatgtcgtagccattgtgacagaagcaaccggggtgtccgccatccctgaaaagctggtgacattgcacggaactccagcggtcagcgagaagcccgacgttgctacagtgacagcaaatgtatctatccatgggaccttctcgttgggcccttctattgtttatatcgaagaagagatgaagaacggaacattcaataccgccgaggtcctgattaggaggacagggggatttaccggcaatgtgtccattactgtgaagacgttcggggagcgctgtgcccagatggaacctaacgctctgcccttccgtggcatctacgggatttcaaatctaacttgggcagttgaggaagaggacttcgaggagcagactctgaccctgatcttcctggacggggaaagggagcggaaagtgagcgtgcagatactagatgacgatgagccagaaggccaggagtttttttatgtgttcctgacgaacccgcagggaggggctcagatagtcgaagagaaggatgataccggatttgccgcttttgcgatggtgatcataaccggctcagatttgcataatggcatcatcgggttcagcgaagagtctcagtctggactggaactcagagagggggcagtgatgaggcggttgcacctgatcgtgacacgacagcccaacagggctttcgaggacgtcaaagtgttctggagagtcacactaaacaaaactgtggtcgtgctgcagaaagacggtgtcaatctcgtggaagagttgcagtcagtcagtggaaccaccacctgtactatgggccagacaaaatgctttatcagtattgagctgaaacctgaaaaagtcccccaggtagaggtatatttcttcgtggaactgtacgaggcaacagccggtgcagcaatcaataattctgccagatttgcccagattaagatcctggagtccgatgaatcacagagtctggtgtacttctctgtgggcagccggctggctgtggcgcataaaaaagctactctgataagtcttcaagtggctagggactccgggaccggcttaatgatgtccgtcaatttctcaactcaagagttgaggtctgccgagacaatcggtcggacaatcatttcacctgccatttcagggaaagattttgtgataactgaaggaaccctggtctttgagcctggccagcggtccactgtgctcgacgtgatactgacacctgaaaccggcagcctgaactcatttccaaagcgatttcagatcgtgctcttcgaccccaagggcggagccaggattgacaaggtgtatggaactgctaatattactttagtgtctgatgcggactctcaagccatttggggcctggccgaccagctgcaccaacctgtgaatgacgacatcttaaacagggtcctgcatacgattagcatgaaggttgcaaccgaaaataccgacgagcaattgtctgccatgatgcacctcatcgagaaaattactacagagggcaaaattcaggccttttctgtggcaagccgaaccctgttctacgagattctgtgcagtctgataaacccaaaacggaaggacacaaggggattcagccactttgcagaggtaaccgagaattttgcattctctttgctgacgaatgtcacttgcggtagtccgggagagaagtcaaaaacaatattagacagctgcccttacttaagtatattggcactgcattggtatccccagcagattaacgggcacaagttcgaaggcaaggagggggactatatacgcattcctgagagactcttggatgtacaggatgccgagattatggctggcaagtccacatgtaaactcgttcagttcacagagtatagtagccaacagtggttcatttctggtaacaacttacccacccttaagaataaggttctctccctctcagtgaaagggcagagctcccagttgctgaccaacgacaacgaagtcctgtatcggatatacgctgcggaacctcggatcataccccaaacatctctgtgccttttatggaaccaggcagctgcttcatggctgagcgatagtcagttttgcaaggtggtggaggagaccgcagactatgttgagtgcgcttgctcccacatgtccgtgtacgccgtttacgcccgtaccgacaatttgtctagttacaatgaagcgttctttacttccggctttatatgcatatctggattatgtctagccgtcctctcccacatcttttgtgctcgctacagcatgtttgcggcaaaactgctcactcacatgatggccgcatctctcggtacccagattctgtttctggcaagcgcctatgcctcgccacaattagctgaggagagctgctcagccatggccgcagtaacacactatctgtacctgtgccaattctcttggatgctgattcagtccgtgaatttttggtatgtgctcgtgatgaatgacgaacatacagaaaggagatacctcttatttttcctgctgtcctggggtttgcctgcgttcgtcgttatcctgctcatcgtcattttgaaaggcatctatcatcagagcatgtcccagatctatggtttaatacacggcgatttatgttttatcccgaacgtttatgccgctttgttcacagccgcactggttcccctgacttgcctcgtggtggtgtttgtcgtttttatccacgcataccaggttaagccacagtggaaggcttacgacgacgttttccggggacgcactaatgcagcggaaatcccgctgatcctgtacctctttgccttaataagcgtcacctggttgtggggtgggctccatatggcctaccggcacttttggatgctggtcctcttcgttatctttaacagcttgcagggactatatgtcttcatggtctactttattctgcacaatcagatgtgctgccctatgaaggctagctacacagttgaaatgaacggccacccaggaccgagcactgcattctttactccgggatcgggcatgcctcctgccggaggggagatttccaagtcgacgcagaacttgatcggagctatggaagaggttcccccagactgggagagagcctccttccaacagggctcacaagcctccccagatttgaaacctagcccccaaaacggggcaacatttccaagctcaggcggatatggtcagggtagcctgattgccgacgaagaatcccaggaatttgacgaccttattttcgccctcaagaccggtgcaggactctccgtgtctgacaacgagtcaggacagggttcccaggaggggggaacactgaccgacagccagatcgttgaactgcggagaataccgatcgctgatacccatctgta

SEQ ID NO: 224108 - DNA, 4188 bp, Artificial Sequence
  Description of Artificial Sequence: Synthetic coding sequence
atgactggagctgagatcgagtcgggcgctcaggtgaagcctgaaaagaagcctggggaagaagtagtgggcggtgccgagatcgagaacgacgtcccccttgtcgtccgccctaaggtgaggactcaagcacagataatgcctggagctagacctaaaaacaagagcaaggtgatgcccggagcttcaactaaagtggaaactagcgctgtaggcggtgctcgaccgaaatctaaagctaaggcgattcctgtgtcaaggttcaaggaagaagctcaaatgtgggcacagccccgatttggcgctgagcgcctcagcaaaacggagaggaatagccaaacgaacatcattgcctcacccctggtatccactgatagtgtgttggtggcgaagactaaatatctgtctgaggatagggagctggtcaatacagacacagaatcttttcctcgccgaaaggctcactatcaggccggtttccagccctcctttcgcagcaaagaggagaccaacatgggttcctggtgctgtcccaggcccactagtaagcaggaggcatctcccaatagcgacttcaaatgggttgataagtcagtttcctcccttttctggtccggtgacgaagtaactgccaaatttcaccccggtaaccgcgtaaaggactccaacagatcaatgcacatggcaaaccaggaggccaatacaatgtcgaggagtcagacaaatcaggagctttacatcgcctccagctcgggatcagaagatgaaagtgtgaagactccatggttttgggctagggacaagactaatacatggtctgggcctcgagaggaccctaatagccgatcacgattccgcagtaagaaggaggtgtacgttgagagttcctcaggctccgagcacgaagaccacctcgagagctggttcggtgccggaaaggaggcaaagtttagatccaagatgagagctggaaaggaggccaacaatcgtgcacggcaccgggcaaagcgcgaagcctgtattgatttcatgccgggatctatcgacgtcatcaaaaaggagagttgcttctggccagaggagaacgctaacaccttcagcaggccgatgataaagaaggaggccagagccagggcaatgactaaggaggaagctaaaactaaggcacgggcaagggccaaacaagaggccagatccgaagaagaggcgcttataggtacttggttctgggcgacagacgagtcctcaatggccgatgaagcttccattgagagctccctgcaggttgaggacgaatccataatcgggagctggttctggaccgaagaagaggcaagtatgggtacaggagcctcaagtaaatcaaggccaaggactgatggggaaagaataggagacagcctgtttggcgctagagagaagactagcatgaagacaggcgctgaggccacttcggaaagtatcttagccgcagacgatgaacaggtgattatcggctcttggttctgggctggagaggaggtgaaccaggaagcagaggaggaaaccattttcggcagctggttctgggtcatcgacgctgctagtgtggagtccggtgtgggcgtctcctgtgaatcccgcacacgctcagaggaagaagaagtcatcggtccttggttctggtcaggcgaacaggtagatatcgaggcagggataggtgaagaagcaaggcccggagctgaggaagaaactattttcggctcctggttctgggccgagaaccagacttatatggactgtcgtgcggagacttcgtgcgatactatgcagggcgcagaggaggaagagcccattattgggtcttggttttggacacgggttgaagcttgtgtggaaggcgacgtcaattccaagagttctctcgaggacaaggaggaggccatgattccatgcttcggcgcaaaggaggaggtgtcaatgaaacacggcacaggagtgaggtgtcgctttatggccggtgctgaggagactaataacaaaagctgcttttgggcagaaaaagagccatgtatgtatcctgcaggtggcggttcttggaaatccagacctgaggaagaggaagacattgtgaatagttggttctggtccaggaaatacacaaaacctgaagccataatcgggtcatggttgtgggccaccgaggaatcaaatattgacggtacgggggaaaaagccaagctgcttacagaggaagagaccataataaatagctggttttggaaggaggatgaggcaatctcagaggctacggaccgagaggagtcacggccagaagccgaggagggggatatcattggcagctggttttgggcgggagaagaggacaggcttgagcccgcagccgaaactcgggaagaggatcggcttgccgcagaaaaggaaggtatagtcggctcttggtttggagcgcgtgaagagaccatccggagggaggcagggagttgttctaagagtagtcccaaggcggaggaagaagaagtcattataggcagttggttttgggaggaggaagcttcacctgaagccgtcgcaggcgtagggtttgaaagtaaacccggaactgaggaagaagagatcacagttggaagttggttttggccggaagaggaagccagtatacaagccggtagtcaagcagtggaggaaatggagtccgaaaccgaggaggagaccatctttggcagctggttctgggacggcaaggaagtgagtgaagaggcgggaccgtgctgtgtgtctaagccagaagatgatgaggagatgatagttgaaagttggttttggtccagggataaagcaattaaagaaacaggcacagtcgccacctgtgagtctaaaccagaaaacgaagaaggcgctatcgttggatcttggttcgaggcagaagacgaagttgataaccgaacagataacggatctaattgcggctcccggacactggccgacgaagacgaggcaatagtgggctcatggttctgggccggtgacgaggcacactttgaatccaaccccagccccgttttcagagctatttgtaggtccacttgctctgttgagcaggagcctgatccaagtcggcgaccccagagctgggaggaggtcaccgtccagtttaaaccaggaccatggggcagggtgggctttccctccatctcgccgttcaggtttcctaaggaagccgcatcactgttctgcgagatgttcggtgggaagccaaggaatatggtgctctccccggagggtgaagaccaggagagcttgttgcaacctgaccaaccctcacctgaatttccctttcaatacgatcctagctacaggtcagtgcaggaaatcagggagcacttgcgggctaaggaatcaactgagcctgaatcatctagttgcaactgtatccaatgcgaactcaagattgggtcagaagagtttgaggaacttctgctgcttatggaaaaaatccgcgatccttttatccacgagatctcaaaaatcgccatgggcatgcgtagcgcgagccagttcacaagagatttcatccgagatagtggtgtagtgagtctcattgaaactctattgaactatccatcgtctcgggtgcgaacctctttcctggagaatatgatccgtatggctcccccataccccaaccttaacatcatccagacgtacatttgcaaggtgtgtgaggagaccctcgcttattcagtggattctcctgagcaattgtctggaatcagaatgattagacacttgaccacaaccacggactaccacactctggtcgctaactatatgtcagggttcctttctctgctggctactggcaatgcaaaaacgaggttccacgtgttgaaaatgctgctgaaccttagcgagaacctgttcatgaccaaggagttgctgtcggctgaagccgtatccgaatttataggactgtttaatagggaggagactaatgataatatccagatcgtgctggcgatctttgagaacatcggaaacaatattaaaaaagaaaccgtttttagtgacgacgactttaacatcgagcctctgatctctgcttttcacaaggttgagaaattcgctaaggaactgcaagggaaaaccgataaccagaatgaccccgaaggcgatcaagagaactag

SEQ ID NO: 224109 - DNA, 4188 bp, Artificial Sequence
  Description of Artificial Sequence: Synthetic coding sequence
atgaccggggcagagattgaatcaggggcacaggtgaaaccggaaaagaagcccggagaggaggtagtgggaggcgctgagattgaaaacgacgtgccactggtcgtgagacctaaggtacgtacgcaggcccaaatcatgccgggtgcaagaccaaagaacaagtcaaaagtcatgcccggagcgtctaccaaagtagaaacttctgctgtgggcggtgctaggcccaaaagcaaggctaaggcgataccagtcagccggttcaaggaggaagcacagatgtgggcgcaaccaagatttggtgcagagcgcctgtcaaaaactgagcgtaattcccagacaaatattatagcctcacccctagtcagtactgacagcgtattggtggctaagactaagtacttatcggaggatcgggagctggtgaacacagatacagagtccttccctagacgaaaggcgcactaccaggctggattccagccgtccttccgctctaaagaagaaactaacatgggcagctggtgctgtccacggccaacttccaaacaggaagcctccccgaactctgatttcaagtgggttgacaaatcggtctcatcgttattctggtccggtgacgaagtcacagccaaattccacccaggcaatagagtaaaggattccaataggagcatgcacatggccaaccaggaggccaatactatgtctagatcacagacaaatcaggagctgtatatcgcatccagctctggcagtgaggatgaaagcgttaagacaccctggttttgggccagggacaagaccaatacatggagcgggcctcgcgaggatccaaactctcgctcaaggtttcgctctaagaaagaggtctatgtggaaagctcctcgggaagtgaacatgaggaccacctggaatcctggtttggggctggcaaggaagccaaatttaggtcaaagatgcgcgcaggaaaagaagctaataaccgagctcgccaccgtgcaaagcgagaggcatgcatcgactttatgcccggaagtattgatgtgatcaagaaagagagctgcttctggccagaggagaatgctaacaccttcagccggcctatgattaagaaagaggcgagagctcgcgctatgaccaaagaagaagctaaaacaaaagccagagcaagggccaagcaggaggccagatccgaagaagaggctttgatcgggacatggttctgggcaaccgacgaatcctctatggccgatgaggcatcaatcgaaagctctcttcaggtcgaggacgagtcaataatcggaagctggttctggacagaagaggaagcctctatgggcacaggggcttccagcaagtcaaggcccagaacggatggcgagaggatcggtgatagcctgtttggcgctagggagaagacttcaatgaagactggcgcagaggcaaccagcgaaagcatcttggccgctgacgatgagcaagtcatcataggctcatggttctgggccggagaggaggtgaatcaggaagctgaggaagagaccatctttggttcttggttctgggtaattgatgccgcttcggtagagtcaggcgtcggcgtgagttgcgagtcacgaacccgtagcgaagaggaagaggtgattggaccctggttctggagtggcgagcaagtggacatcgaggctggcataggagaggaagcccgacccggtgcggaagaagagaccatctttgggtcatggttctgggcagaaaaccaaacgtacatggactgccgcgcagaaacatcttgcgacactatgcagggggctgaagaggaggaacccattattgggagctggttctggaccagggtggaagcctgcgttgagggggatgtgaattctaaatcttcattagaagataaggaagaggccatgatcccctgcttcggagcaaaggaagaagtctctatgaagcacggtacgggcgtgaggtgccggttcatggccggagcagaagagactaacaacaagagttgcttctgggccgagaaggaaccttgcatgtaccctgcaggtgggggaagctggaagtctaggcctgaagaggaggaggatattgtgaacagttggttctggtctcgcaagtatactaaaccggaggcaatcattggatcttggctttgggccactgaagagagcaacattgacggaacgggcgaaaaggccaagctgcttaccgaggaggagaccattataaattcatggttttggaaggaagacgaggcaatctctgaagcaacagatcgtgaggaatcccgcccagaagccgaggagggagatatcattggtagctggttctgggccggtgaagaagataggcttgaacctgcagcagagactagggaggaagatagacttgctgccgaaaaagagggaattgtcggctcatggtttggggcacgcgaagagactattcgacgcgaggcaggttcatgctctaaatcaagtcccaaggcggaagaggaggaagttattattggtagctggttttgggaggaggaggcctcccctgaggccgtcgctggcgtggggttcgagagcaagccaggcactgaggaggaggaaattacagtgggcagttggttttggcccgaagaagaggcttcaatccaggccggatctcaggccgtggaggagatggagtccgagacagaggaagaaacaatctttggatcatggttctgggacggcaaggaagtttcggaggaggcaggaccgtgttgcgtgagcaagcctgaggatgacgaggagatgatcgttgagagctggttttggtccagagataaggcgatcaaggaaaccggaactgtggcgacctgcgagtccaagccagagaacgaagagggcgcaatcgtcgggagctggttcgaggctgaggatgaggtcgacaaccgcactgacaacggctccaactgtggttccaggaccctggccgacgaagatgaagcaattgtggggtcatggttctgggctggagacgaggcacactttgagtccaaccctagccccgttttcagggctatttgtcggagtacatgctcggtggaacaagagcccgacccgagcagaaggccacagtcttgggaggaagtcacggttcagttcaagcccggtccgtgggggagggtgggcttcccctccatcagcccctttagatttccgaaggaggccgcatcattgttttgcgagatgttcgggggtaaaccacgcaacatggtgttgtctcctgagggtgaggaccaggagtctctcctgcagcccgaccaaccctctccagaattccccttccaatacgacccatcttatcgctcagtgcaagaaatccgggagcacttgcgggcaaaagaaagtaccgaacccgagtcttcttcttgtaactgtatacagtgtgaactcaaaataggatccgaagaatttgaggagttgctcctgctgatggaaaaaattcgcgaccctttcatacatgaaatatctaaaatcgccatgggaatgcgcagcgcctcgcagttcactagggatttcattcgggacagtggcgtggtatccttaatcgagactctactaaactatccatcctctagagtgcggactagctttctcgagaacatgatacgaatggcccctccgtaccccaacctaaacatcatacagacctacatatgcaaggtgtgtgaagagacccttgcctacagtgtagatagccctgaacagttgtcagggatccgcatgattcggcacctcaccaccacaaccgattatcacacgctggtggccaattacatgagtggcttcctatcccttcttgccaccggaaatgcaaaaacacgctttcacgtgttgaaaatgttactgaatctgagcgagaatttattcatgactaaggagcttcttagcgcagaggcagtgagtgagttcatagggctgtttaatagggaagaaacaaacgataatattcagatagtgttggccatatttgagaacatcggaaataatataaaaaaagagactgtattctctgacgacgacttcaacattgaacccctgatctccgccttccacaaagtcgaaaagtttgcaaaagagctgcaggggaaaacagacaaccagaacgatcccgagggcgatcaagagaattag

SEQ ID NO: 224110 - DNA, 4188 bp, Artificial Sequence
  Description of Artificial Sequence: Synthetic coding sequence
atgacaggcgctgaaattgaatctggtgctcaggtcaagcccgaaaaaaaaccaggagaggaggttgtgggaggagcagaaatcgagaatgacgtccctttagtcgtgcggcctaaggtcaggacacaggcccagatcatgcccggagcacgacccaagaacaagagcaaggttatgcccggtgctagcaccaaggtggagacatctgccgtgggtggtgcaagacccaagtctaaagccaaagccattccagtgagcaggttcaaggaggaagcccagatgtgggcacaacctagattcggggcagagcgcctctctaagactgagcgcaactctcagaccaatataattgcatctcctttggttagcacagacagtgtactggtcgctaagacgaagtatttgtcggaggatagagagctggtaaatactgatactgaaagtttccctaggaggaaggcgcattaccaggcgggtttccaaccatccttccgttccaaggaagagaccaatatggggagctggtgctgtccaagacccacaagcaaacaggaagccagtcctaatagcgatttcaagtgggtggataaatccgtcagctctctcttctggagtggtgacgaagttacagctaaattccacccagggaatagggtgaaagacagcaacaggtccatgcatatggctaatcaggaagccaatacaatgtctagatcccagactaaccaggagctctacatagcttcatcaagcgggagtgaggatgaatctgtgaaaacaccttggttctgggcaagggacaagaccaacacatggtctgggcctcgcgaagatcctaacagtagatcacgttttaggagtaagaaggaggtatacgtggaatcctccagcgggtctgaacatgaagatcaccttgagagctggtttggcgctggtaaagaggccaaatttagaagcaagatgagggcgggtaaagaggccaacaaccgtgcccgacacagagccaagcgcgaggcctgcatcgatttcatgcctggttctattgacgtgatcaaaaaagaatcctgtttctggcccgaggaaaacgccaatactttcagtcgccctatgatcaaaaaagaagcgagggcccgagcaatgactaaagaagaggccaagaccaaagcgagggctcgagcgaagcaagaagcccgttctgaggaggaggcgttgatcggaacatggttttgggccactgacgagtcttcaatggccgacgaggccagcatagagtcttccttgcaggtggaggatgagtctataatcggctcatggttctggaccgaagaagaagcctccatgggaactggcgcttcatccaagagccggccacgcactgacggagagaggattggggactctctgttcggcgctagagaaaagacaagcatgaaaactggggctgaagcaacatcagagtcaatcttagcggctgacgatgagcaggtgatcatcggcagctggttctgggcaggggaagaagtcaaccaggaagccgaagaagagactatttttggatcatggttctgggtgattgacgccgctagtgtcgaaagcggagtaggcgtttcttgcgagagcaggaccagatccgaggaggaggaagtgatcggcccatggttctggtctggggaacaggtggacattgaagcaggcatcggagaagaggcccgaccaggggctgaggaggagaccatttttggtagttggttctgggcggagaatcagacctacatggactgccgcgcagagacctcatgtgatactatgcaaggggctgaggaagaagaaccaatcattggatcctggttttggacccgggtggaagcttgtgtggaaggcgacgttaattcgaagtcaagtctcgaagataaggaggaagccatgatcccttgctttggtgcaaaggaagaggtctctatgaaacatggaactggagtcagatgcaggttcatggccggtgcggaggagacgaacaacaaaagttgtttctgggcagagaaggagccctgcatgtacccagccggaggcggttcatggaaaagcaggcctgaagaggaagaggatatagttaattcttggttttggagcagaaaatacaccaaacccgaggctatcatcggcagctggctttgggccacagaagagagtaacattgacggcaccggcgaaaaagccaagctcctcactgaggaagagaccattataaatagctggttctggaaagaggacgaggccatcagtgaagctaccgatagggaagaaagcagaccagaagccgaagagggagacataataggttcctggttctgggccggtgaggaagacaggttagagcccgcagccgagacaagggaagaggatagactggcagctgaaaaggaaggaattgtcggatcatggttcggcgcaagagaagaaactattcgccgtgaagctggtagttgcagcaaaagttcccctaaggctgaagaggaagaggtgattatcggctcatggttttgggaggaagaggctagcccagaggcagtggccggagtcgggttcgaatcaaagccaggtacagaggaggaagagattaccgttggctcctggttttggcccgaagaggaagcgtcgattcaagccggatcccaggctgttgaggagatggaaagtgaaacggaggaggagacgatattcggctcatggttttgggatggaaaagaagttagcgaagaggcaggaccgtgctgcgtgtcaaagcctgaagatgatgaggagatgattgttgagagttggttctggtcccgggataaggcaattaaggagaccggaactgtggctacttgcgaaagcaaacccgagaacgaggagggagccattgtgggatcatggttcgaggcagaggatgaggtcgacaaccgtacagacaacggcagtaattgcggcagtcgtaccctggcagacgaggatgaagctatcgtaggctcctggttctgggcgggtgatgaagcccatttcgaatctaatccaagtcccgtgtttagagccatttgtcgcagcacctgtagtgtcgaacaggagccagacccttctcgacgaccacagagctgggaagaggtgacggtgcaattcaaaccaggtccatggggacgcgtaggatttcctagcatctctccattccgtttcccaaaggaagctgcgtccctcttttgcgagatgtttggcggaaaaccgcgaaacatggtcttgtccccagagggcgaagaccaggaatcattactgcagcctgatcaaccgtcacccgagttccccttccagtatgatccctcctacaggtcggtccaggaaattagagaacacctgcgagcaaaagagtccactgagcccgagtccagctcctgtaattgcattcagtgtgaattgaagattggatctgaagagtttgaggagctactcctgcttatggagaagattagggacccatttatccatgagatttccaaaatcgcgatggggatgcgatcagcaagtcaatttacccgcgacttcataagggatagcggtgtggtctcactgatcgaaactctgttgaactacccctcgtcgcgcgtgcgtacgtctttcctcgagaacatgattagaatggcccctccctatcccaatcttaacattatccagacctacatttgcaaagtgtgcgaggaaacactcgcatactcagtcgactctccagagcagctgtccggcattcgtatgatccggcacctaactaccactactgattatcacactttagtggctaattatatgtcgggcttcttatcactgttagctactgggaacgctaagacgaggttccacgtattaaagatgctgcttaatctgagtgaaaacctttttatgaccaaagaattactgtccgctgaagcagttagtgaatttattgggttatttaacagagaggagacaaacgataatatccaaatcgtccttgccatctttgagaatatcggaaacaacataaaaaaggagactgtattttctgacgacgattttaatatcgaacccctgatcagtgcatttcataaagtggagaaatttgcaaaggaactgcagggcaagaccgataatcaaaatgatcccgaaggagaccaggaaaactag

SEQ ID NO: 224111 - DNA, 4188 bp, Artificial Sequence
  Description of Artificial Sequence: Synthetic coding sequence
atgacgggcgcagaaattgagtcaggggctcaggtgaagccggagaagaaacccggtgaagaggtcgtgggtggggctgagatcgagaacgacgtgccattagtggtgcgcccaaaggttaggacacaggcccagatcatgcctggagctaggccgaaaaacaaatcgaaggtgatgccaggagcctccaccaaggtagagaccagtgccgtcggcggtgcccgtcccaaatctaaagctaaggcaatccccgtgtccaggtttaaggaagaagcccaaatgtgggcccagccaagatttggagctgagagactgagtaaaacggagagaaacagccagaccaacatcattgcctctcctctggtcagtacagactccgtgttggtcgctaagactaagtacttaagcgaggacagagaattggtgaatacagacacagaaagctttcccaggcgtaaggcccattatcaggccggtttccagcctagttttcgctctaaggaggagaccaacatgggtagctggtgctgtcccaggcctacctccaaacaagaggccagtcccaattccgactttaaatgggtggacaagtctgtgtccagcctcttctggtctggggacgaggtgactgccaagttccaccctggcaacagggtgaaggattctaaccgctccatgcatatggctaatcaagaggccaacaccatgtctcgcagccagactaatcaagagctctacatcgccagtagctcaggatccgaggacgaatccgttaaaactccgtggttctgggccagagacaagactaatacatggagcgggccacgggaggacccaaattcccgaagccgctttcggagtaagaaggaggtgtacgttgagtcctcttcaggaagtgaacacgaggaccacttggagtcttggttcggtgccggaaaagaagccaagttccgctcaaagatgcgagcgggaaaagaggctaataatcgggctagacacagagctaaacgcgaggcatgtatagattttatgccaggtagtatcgatgtcataaaaaaagagtcatgtttttggccggaggagaatgccaacacgtttagccggcctatgatcaaaaaagaggccagagcgagggcaatgacaaaagaagaggccaaaaccaaagcccgtgccagggcaaagcaggaggcacgctctgaggaggaggccctgatcggcacctggttctgggcaacagacgaaagcagcatggcagacgaagcctcaattgagtcttccctgcaggtggaggacgagtctatcattggatcttggttctggaccgaggaagaggccagtatggggacaggcgcttcaagcaagagccggccaagaacagatggggaacgcatcggagatagcctgttcggtgcaagggagaagacctcgatgaagaccggtgcagaggcgacttcagaatctatcctggctgctgacgacgaacaggtgatcattgggagttggttttgggccggagaggaagtgaatcaggaagctgaggaggagaccatctttggatcttggttttgggtgattgatgctgcttctgtggaaagcggtgtgggagtaagttgcgagtcgagaacccgaagtgaggaggaggaggtcataggaccctggttctggtcaggggaacaagttgacatagaggcaggaataggtgaagaggcccgtccaggtgccgaagaggagaccatctttggctcctggttttgggccgaaaaccagacctatatggactgtagggcggaaacgtcttgcgacaccatgcagggagccgaggaggaagagcccattatcggatcttggttctggacccgcgtggaggcttgtgttgaaggagatgtaaactccaagtctagcttggaggataaggaggaggcgatgatcccttgttttggcgcaaaggaggaagtttccatgaaacatggaaccggcgttaggtgccgattcatggctggcgcagaagaaaccaacaacaagtcttgtttctgggccgaaaaggagccctgtatgtacccagcaggcggaggatcttggaaatcaagacccgaggaagaggaggacatagtgaacagctggttctggagccgaaagtataccaagcctgaggccattatcggcagctggctctgggccaccgaggaatcaaatatcgacggcacgggagaaaaagccaagctcttaactgaggaggaaactatcattaattcgtggttctggaaagaagacgaggccatatcggaggccacagacagggaggaatcccggccagaggcagaagagggggacatcatcggtagttggttctgggctggtgaagaggacagactcgagcctgctgctgaaaccagggaggaagaccgattggcagctgagaaggaaggtatcgttgggagctggttcggtgcccgagaagagactataaggagagaggccggatcctgttccaagtcaagccccaaagcagaggaggaggaggttatcatcggttcttggttttgggaggaggaagccagtcctgaggccgtcgcaggcgttggcttcgagtctaagcccggtacggaagaggaagaaattaccgtggggtcttggttttggccagaagaggaggcttccattcaggccggatcacaggcagtcgaggaaatggaatcagagaccgaagaagagactattttcggatcctggttctgggacgggaaggaggtctcggaagaggctggcccatgttgtgtgagtaaacctgaagatgacgaagaaatgatcgtcgaatcctggttttggtcacgtgataaggcgatcaaggagaccgggacagtggccacttgcgagtccaagccggaaaacgaagaaggtgcgattgtggggtcctggttcgaggcagaggatgaagtggacaatcggactgacaatggttctaactgtggtagcagaactttggcggacgaggacgaagctattgtgggttcctggttttgggccggagatgaggcacactttgagagcaacccaagtccagtcttcagggcaatctgccgttccacctgttcagtggagcaggagcctgatcctagtcggcgaccccagagttgggaagaagtaacggtgcagttcaagccaggcccatggggaagggtcgggtttccatcaatctcacctttccggttccccaaggaagcagcctctctcttttgtgagatgtttggcggaaagcccagaaacatggttctgagccctgagggcgaggaccaggagagcttacttcaacctgatcagcctagcccagagttcccttttcagtacgatcctagttatcgatctgtccaggaaatcagggagcatttaagagccaaggaatccacggaacctgaatcctcctcatgcaattgcatacaatgtgaacttaagatcggttccgaagaattcgaagagttattgcttctgatggaaaagatcagagaccctttcatccacgagataagtaagatcgcaatgggcatgcgctctgccagccagttcacacgcgattttataagagattccggagtcgtctcccttatagagaccttgttgaattacccatcctccagggttcggacgagctttctggagaacatgatcagaatggctccaccctaccctaacctaaatattatacagacttacatttgcaaggtgtgcgaagagacactggcctactctgtggactcccccgaacagctgtccggaattcggatgatccgccatctgacaacaactacggattaccatacgttagtggcaaactacatgtccggctttctcagtctgctcgctacgggaaatgctaaaaccagattccacgttcttaaaatgctgcttaacctctccgagaatctgttcatgacaaaggagttactgagcgccgaggccgtttctgagtttattggtctctttaacagagaggagactaatgacaatatacagattgtgctggcaatattcgaaaatatcggaaacaatattaaaaaggagaccgtgttcagtgatgacgacttcaatattgaaccactcatatctgctttccacaaggtggagaagtttgcgaaagagcttcagggcaaaaccgataaccagaatgacccagagggcgatcaggagaattag

SEQ ID NO: 224112 - DNA, 1692 bp, Artificial Sequence
  Description of Artificial Sequence: Synthetic coding sequence
atggacttcggttctctggagacggtagtggcaaattcggcattcatcgcagcccgtggcagtttcgacggctcatcttctcagccttccagagacaagaagtatttggctaagttgaaacttcctcctctgtccaagtgtgagagcctgcgggacagcctgtctcttgagtttgagtctgtttgtcttgagcagccaatcggtaagaagttgttccagcagtttctacaatctgcagagaagcatttgccagcactcgagctatggaaagatattgaggattacgacacggccgataatgacctgcagccgcagaaagcccaaacgatacttgcccaatatctggatcctcaggccaagttattctgttcctttctcgacgagggaatcgtcgcgaagtttaaggagggaccagtggaaatccaggatggccttttccagcctttacttcaagcgaccctggcacacctcggccaagctcccttccaggagtacctagggagtctgtactttctgcgctttctgcagtggaagtggcttgaggcacagcctatgggggaagactggtttctggactttcgggtgctgggaaagggaggctttggcgaggtgtcagcgtgtcaaatgaaagctacaggaaaattatacgcctgtaaaaagttgaataaaaaaaggcttaagaagcgtaaagggtatcagggcgcaatggtggaaaaaaaaatcctcatgaaagtgcacagcaggttcatcgtatccctcgcatacgctttcgagaccaaagctgacctttgtttggtaatgacgattatgaacggaggggacatcagataccatatttacaacgttaatgaagagaaccctggctttcctgaaccgagagctcttttttatacagcacagataatttgcgggctagaacacttgcaccaacgtcgcattgtttatcgcgacctcaagccagaaaatgtgctcctcgacaatgacgggaacgtaagaatctcggacttaggcctcgccgtggaactgctggacgggcagtccaaaactaagggatacgccggaaccccaggatttatggcgccagaacttcttcagggggaagagtatgatttcagtgtagactactttgcacttggtgtcactctctatgagatgatcgccgctaggggtccctttcgtgccagaggcgaaaaggtcgagaataaagagctaaagcaccgcattatttccgagccagtgaagtatccagacaaattttcccaggcaagcaaggatttctgcgaggctctcttagagaaagatcccgagaagaggctgggatttagagacgagacctgtgataagttgagagctcacccactgttcaaagatctgaattggagacagctcgaggcgggtatgctgatgcccccttttatacccgattctaagacggtgtacgccaaggatatccaggatgtgggggctttttctactgtgaagggggtcgcctttgataagacagacaccgaattcttccaggaattcgcaaccgggaattgtcccattccttggcaggaggagatgatcgagacaggcatttttggcgagctgaatgtttggagatctgacggccaaatgcccgatgacatgaaaggtatatccggcggttcgtcaagctccagtaagtctggtatgtgtcttgtgagctag

SEQ ID NO: 224113 - DNA, 285 bp, Artificial Sequence
  Description of Artificial Sequence: Synthetic coding sequence
atgatagccgctcgtggcccatttagagcacgcggagagaaagttgaaaataaggagctgaaacataggattatctcagagccggtgaaataccctgacaaattctctcaagcctctaaggatttttgcgaggctcttttagagaaagaccccgaaaagaggctcggctttcgcgatgagacttgtgacaaactgcgggctcacccactgttcaaggacctgaactggcgccagctggaagccggaatgctcatgcctcctttcatacccgattctaagacctag

SEQ ID NO: 224114 - DNA, 228 bp, Artificial Sequence
  Description of Artificial Sequence: Synthetic coding sequence
atggaactcgaaaacattgtcgctaataccgtgctgttaaaagcacgagaaggtggaggaggaaaaaggaaaggtaagtccaagaagtggaaggaaattctaaaatttccgcacatctctcagtgtgaggatctgaggaggacaattggagagctttcaggaagcttgatctcttggtcctcgtcaaccaaggaacacgggaggccgactgaaataaagatgagatag

SEQ ID NO: 224115 - DNA, 1458 bp, Artificial Sequence
  Description of Artificial Sequence: Synthetic coding sequence
atgacgaaatatttgacacccaagtcccctgtatttattgcacaagtgggccaggatttggtttcccagactgaggagaaattgcttcaaaaaccatgcaaagaattgttttcagcctgcgctcagagtgtgcatgagtatctgcgcggagaaccgttccatgagtatttggactccatgtttttcgacagattcttacagtggaagtggttggagcgacagccagtgactaagaacaccttccgccaatatagagtgctcggcaaaggcggtttcggagaagtgtgtgcctgtcaggtaagagctacaggcaaaatgtacgcatgtaaacggttggagaagaagagaataaaaaaaaggaaaggagagagcatggcgctgaacgagaagcagatccttgaaaaggtgaatagccaattcgtcgttaacttggcatacgcctatgagaccaaggacgccctgtgtttagtgctgactatcatgaacggaggggaccttaagttccacatatacaatatgggcaatccgggatttgaggaggaaagggccctcttttatgccgctgagattctctgcgggctagaggatctgcaccgtgaaaataccgtttaccgagatcttaagcctgagaatattctgttagatgattacggtcatatccggatcagcgacttgggcctggcagttaaaatacctgagggagatctgatcagaggtcgagtcggaacagtgggttacatggctcccgaagtccttaataaccaacgatacggactaagtcctgattactggggcttgggttgtctcatatacgagatgatcgaagggcagtcccccttccgcggtagaaaagagaaagtcaagagggaggaggttgaccgtcgcgttctcgagactgaagaggtctatagccataagttctcagaggaggcaaagtccatctgtaagatgctgttgacaaaagatgccaagcagagactgggttgccaggaagagggggctgccgaggtgaaacgtcaccctttttttagaaacatgaacttcaaacggctggaggccggaatgctcgaccctccctttgtgcctgacccgagggccgtatactgcaaggatgtgctcgatattgagcagttctccacagtcaagggcgtgaatctggaccacaccgatgacgacttctacagcaagttcagcactgggtcggtgagcatcccctggcagaatgagatgatcgagaccgagtgtttcaaagaacttaatgtgtttggccctaacggcacgctcccccctgatctcaataggaaccatcctcctgagcctccaaaaaaaggtcttctgcagcgactcttcaagcgacagcaccagaacaactccaagtctagccccagttctaagacctcatttaaccaccacatcaattcgaatcatgtgagcagcaacagtactggcagtagttag

SEQ ID NO: 224116 - DNA, 1773 bp, Artificial Sequence
  Description of Artificial Sequence: Synthetic coding sequence
atggagttagaaaacatcgtggccaatacagtactcctgaaggcacgggaggggggaggaggaaaacgaaagggaaagtcgaaaaagtggaaagagatcctgaaattcccgcacatttcacagtgtgaagaccttcgacgtactatagaccgagactattgtagcctgtgcgataaacagccaatcggcaggcttctgtttaggcagttttgcgaaacaaggcccggtctggagtgctatatacagttccttgatagcgtggccgagtatgaagttactcctgatgaaaagttgggcgagaaaggtaaggagattatgacgaaatatctcacgccgaagtcacctgtgttcatcgcccaagtggggcaagacctggtgtcacagactgaagagaagctgctgcagaagccttgcaaggaactttttagcgcttgtgcccaatccgttcacgagtatctgagaggcgagccttttcatgaatacctggactcaatgttcttcgacagatttttacaatggaagtggctcgagagacagcccgtgactaaaaatacatttcggcaatatcgggtgcttgggaagggaggttttggggaagtctgcgcatgtcaggtcagagcaacaggaaagatgtatgcttgcaagcgtctcgaaaagaagaggatcaagaagcggaagggcgaaagcatggctctaaatgagaagcagatcctagagaaggttaactctcagttcgtggtaaacttggcctatgcttatgaaactaaggacgcactgtgcctggtgctcaccatcatgaacggcggtgacctaaaattccacatctataacatggggaatccaggcttcgaggaggaacgcgcactcttttacgctgcggagatactatgtgggctggaggaccttcatcgagagaacaccgtgtatcgggatttgaaacctgaaaatattctcctcgatgactatgggcatattcgcataagcgatctgggcttagcagtgaaaatccctgagggggacctgattagaggccgagtgggtactgtgggatatatggccccagaagtgctcaacaaccaacgctacggtttaagcccggactattgggggctcgggtgtctcatttatgaaatgatcgagggccagtctcctttcagggggcgtaaagagaaagttaagcgagaagaggtggatcgacgcgttcttgagacagaggaagtatactcgcacaagttttccgaagaggctaagtcgatttgcaagatgctgctcacaaaagacgcaaaacagcggctgggctgccaggaagaaggggctgccgaggtgaaacggcatcccttctttcggaacatgaattttaaacggctggaggctgggatgctcgacccaccatttgtccctgaccctagggcagtgtattgcaaggatgtactcgatatagagcagttctccaccgtaaagggcgtgaatctggatcataccgatgacgacttctactcaaagttttctacaggaagcgtctccattccctggcagaatgagatgatcgagacagagtgttttaaagaacttaatgtctttggcccaaacggaaccttgcccccagacctgaaccgtaatcatccacctgaaccaccgaagaagggcctgttgcagaggctgtttaagcggcagcatcagaacaatagtaagtctagcccctcctccaaaacctctttcaaccatcatataaactccaaccacgtctccagtaactctacagggagtagttag

SEQ ID NO: 224117 - DNA, 1200 bp, Artificial Sequence
  Description of Artificial Sequence: Synthetic coding sequence
atgacgaagtacctgacaccgaagtcaccggtcttcatagcccaggtgggccaggatctggtcagtcagactgaggaaaagctccttcagaagccttgtaaagagttgttcagcgcttgcgcccagtccgtgcacgaatatctgaggggcgaaccctttcacgaatatctagatagcatgttcttcgacagatttctgcagtggaagtggttggagcggcaacccgtgactaaaaatacttttcgccagtaccgagttctgggcaagggtggttttggcgaagtgtgtgcttgccaagtaagagccaccgggaagatgtacgcatgcaagaggcttgagaagaaaagaattaagaaacggaaaggagaatctatggcgctgaatgaaaaacaaatcctcgaaaaggtgaactcacagttcgtggtgaaccttgcctatgcttacgagacgaaggatgcgctgtgcttagttctgaccattatgaacggaggagacctgaagtttcatatttataacatggggaacccaggctttgaggagggggctgccgaagtcaaacgccacccgttcttccgaaacatgaactttaagaggctcgaagccggaatgctggaccctcctttcgtgccagaccccagagctgtttattgcaaggatgtgctggacattgaacagttttccacagtaaagggggtcaacctagaccacactgacgatgatttctattcgaagttttctaccggtagcgtctcgattccgtggcagaacgagatgatagagaccgaatgcttcaaggaactgaacgttttcggaccaaatgggactcttcccccagacctcaacagaaaccacccaccggaacctcctaaaaagggcctacttcagaggctgtttaagcgtcagcaccagaataattctaagtcttctccctctagcaagtccacggtggaacctgcgcagacactcttgctgcgatctggatcttctggcgcacccgcactagtggggttgcctggagagacgccgggagctggcgaagggggacggccttcccggagaaggaggacctcccgattccttaaggaaatctcgactcaggtgtgctttccaaggaggcctaggcctggctggatcggctttgtattcggcgagcattgcaatcggaaccctattggctacgacaacctccatgtgttttag

SEQ ID NO: 224118 - DNA, 1731 bp, Artificial Sequence
  Description of Artificial Sequence: Synthetic coding sequence
atggaactggaaaacatagtcgccaatacagtcctgttaaaggcgagggaaggcggaggcggtaacagaaaggggaagtctaagaagtggcgacagatgcttcagttcccacatatttcccaatgtgaggagttacgactaagcttagagcgagactatcatagcctctgtgagcggcaacctatcggacgcttgctgtttagagaattctgcgcaacccggccagaactgtccaggtgtgtggcattcctcgatggcgtagctgaatacgaagtaacgcctgacgataaacgtaaagcctgcgggagacaactgacccagaactttctcagccacaccggaccagacctgatcccagaagtgcccagacagctggtgactaactgtacccagaggttggagcaggggccatgtaaagacctgttccaggaactcacccggcttacccacgaatatctctcggtagctccatttgccgattacttggattccatctacttcaaccggttcctccagtggaagtggctggaacggcaaccggtaacgaaaaacacattccgccagtaccgtgtactgggcaagggtggcttcggtgaggtatgtgcctgccaggtgcgcgctaccggaaagatgtacgcctgcaaaaagctcgaaaaaaaacgcatcaaaaaacggaagggcgaagcgatggccttgaatgagaaacagattctcgagaaagtgaattctaggtttgtcgtgagcctcgcatacgcttatgagactaaagacgccctgtgcctggtactgaccctcatgaacgggggagatttaaagtttcatatttaccacatgggccaggcgggttttcctgaggcccgagcagtgttctacgccgcagaaatctgctgcggcctggaagatctccatagagaacggatcgtatacagagatctgaagccagagaatattcttctggacgaccatggtcatattcgaattagcgatttaggtctggctgtgcacgtgccggaaggccagacgattaaaggtagagtgggcaccgtcgggtatatggcccctgaggttgtgaaaaacgaacggtacacattctctcccgattggtgggccttgggctgtctattatatgaaatgattgcaggtcagtctcccttccaacagcggaaaaagaaaatcaaaagagaggaagtggagcggctagtgaaggaagtgcctgaagagtattcagaaagattctccccccaggcacgttcactctgtagccagctgctttgcaaggatcctgccgaacggctgggttgtcgtggagggtccgccagagaggttaaagagcaccctctgttcaaaaagttgaatttcaaacggctaggcgcaggaatgctggagcctccattcaagccagacccccaagctatatactgcaaggacgtgctcgatatagaacagtttagtactgtaaaaggcgtagagctggagccaaccgatcaggacttttaccagaaattcgccaccggatctgtgcctatcccttggcagaatgaaatggttgaaaccgagtgctttcaggagctgaatgtgtttggcttagacggctctgttcctcctgacctggactggaaaggccaaccgccagcgcctccaaaaaagggcctcctgcagcgtctcttctccaggcaagattgttgcggcaattgcagtgacagcgaagaggaactgccaacgcgcttgtag

SEQ ID NO: 224119 - DNA, 1683 bp, Artificial Sequence
  Description of Artificial Sequence: Synthetic coding sequence
atggagctcgagaatatcgtagccaataccgttctgttaaaggcaagagagggcggaggaggcaatcgtaaaggcaagagtaagaagtggcgacagatgctccagttccctcatatatcacaatgtgaggagctgagactgtctttagagcgcgactatcacagtctgtgcgagcgtcagccaatcggcagactactttttcgcgaattttgtgccacaaggccagaactttcccgctgtgtcgcctttctggatggagtggccgaatatgaggtgacccccgacgacaaacgaaaggcatgcgggcgtcagcttactcagaatttcctttcccatacagggccagacttgatccccgaggtccctaggcaactggtgacgaactgtacccagaggcttgagcagggcccttgcaaggacctattccaggagttgacgcggctcactcacgagtatctgagcgttgcccctttcgccgactatctcgatagcatatatttcaataggtttctgcagtggaaatggctcgagcgccagccggtaactaagaacacgttcagacagtaccgcgtcctcggtaagggcggattcggcgaggtctgtgcctgccaggtaagggcaaccggaaagatgtatgcgtgtaaaaagctcgaaaagaagagaatcaaaaaaaggaaaggggaggcaatggctctgaacgagaagcagatcctggaaaaggtaaactcacggttcgtggtgagtctggcctacgcatatgaaactaaggatgccctctgtctcgttctcactcttatgaacgggggagatcttaaatttcacatttatcacatgggacaggcgggattcccagaagctcgggcagtcttttacgctgccgagatctgctgcggtctggaggacttgcatagagagagaatcgtttacagagacctaaaaccagagaacattctgctggatgaccacggtcacattagaatctccgacttaggtcttgccgtgcacgtccccgaggggcagaccatcaaaggccgagttggcactgttggatacatggcacctgaggtggtgaagaatgagcgatacacatttagtcctgactggtgggcccttggatgtctcctgtacgaaatgattgctgggcaatcacctttccaacagcgaaaaaagaaaatcaagagagaggaggtcgagaggcttgtaaaggaggtgcctgaagaatactccgaaaggttttccccgcaggccaggagcctttgctcgcaacttttatgtaaggatcctgcagagcgattgggatgtcgcggtggatcagccagggaagtgaaggaacatcccctattcaagaagttaaactttaaaagacttggtgccggtatgctggagccacccttcaaaccagacccccaagcgatttactgtaaagatgtgctggatatcgagcaattttcaactgtgaaaggtgtggaactggaaccaaccgatcaggacttctatcaaaagttcgcaactgggtcagtgccaattccgtggcagaacgagatggttgagactgaatgttttcaagagttaaacgtatttggcctggacgggagtgtgccacccgatttggactggaaaggccagccacccgctccccctaagaaaggactgttgcaaagactgtttagtcgacagaggtag

SEQ ID NO: 224120 - DNA, 1770 bp, Artificial Sequence
  Description of Artificial Sequence: Synthetic coding sequence
atggagttagagaatattgtagccaataccgtgctgctgaaggcaagggagggagggggtggcaaccgaaagggtaagagcaagaaatggaggcagatgttacaatttccacacatatcccagtgtgaggagctgcgcctgagcttagagcgcgattatcactcgctctgtgaaaggcagcccattggaagattgctcttccgggagttctgcgcaacaaggccagaactgagcaggtgtgtggcttttttggacggcgtggccgaatatgaggtgacgccagatgataagcggaaggcatgtgggagacaactcacgcaaaactttttaagccacacagggccagacctcattcccgaagtgccccgtcaattagtcaccaactgtactcagagactggagcagggaccgtgcaaggatctgtttcaagagctaacaagactgacccatgagtacctcagcgtggctccttttgcagattacctggattccatctacttcaatcggttcctgcagtggaagtggttggaaagacagcccgttaccaagaataccttccgacagtaccgggtgcttgggaaaggaggttttggcgaagtgtgtgcttgccaggtgcgcgctacaggtaagatgtatgcatgcaaaaagttggaaaagaagcggattaagaagagaaagggcgaggctatggctttgaatgaaaagcaaattctggaaaaggtcaactctcggttcgtagtgtctttggcatatgcctacgagacgaaggatgctttgtgcttggtccttactctgatgaacggcggtgatttgaaatttcatatctaccatatgggccaggctggctttcccgaagcccgagctgtattttacgcggctgagatctgttgcggcctcgaggacctgcatcgcgagcggattgtctatagggatctgaagcctgagaacatcttgctcgacgaccatggccacatacgcatatctgacctggggctggctgtgcatgtaccggaagggcaaacaattaaagggagagtgggaacagtgggctatatggcacccgaggtcgtgaaaaacgaacgctacaccttctcgccagactggtgggcgctgggatgtctcctctacgagatgatcgcaggccaatccccattccagcagaggaaaaagaagattaaaagggaggaggtagagcgactggtcaaagaagtgcctgaagagtattctgaacgatttagcccacaggccaggtccttgtgcagtcagctattgtgtaaagacccagccgaacgtctgggatgtcggggagggagcgcaagagaagtcaaggaacatccacttttcaagaagcttaatttcaaacgactcggggctggaatgctggagcctccttttaagcccgaccctcaggcaatttattgcaaagacgtactggacattgagcagttctcaacagttaagggagtggaattggaaccgactgatcaggatttctaccaaaagttcgctactgggagcgtgcccattccctggcagaacgagatggtcgagacagaatgttttcaggagctgaacgtgtttgggcttgacgggtctgtgccacctgacctcgattggaagggccaacctcctgctcctcccaagaaaggtctgttgcagcggttattcagccggcagagaatcgccgtagagaccgcagccacagcaaggaagtcctcgccgccagccagctcaccccagcccgaagcccctacctcctcctggagatag

SEQ ID NO: 224121 - DNA, 1662 bp, Artificial Sequence
  Description of Artificial Sequence: Synthetic coding sequence
atggtggatatgggagcgctagataatttgatagccaacaccgcatacctccaggcaaggaaaccaagcgattgtgactccaaagaactccagcgcaggcggcgttccctggcactacctggtttgcagggatgcgcagaactacgccagaaactgtccctgaactttcactccttgtgtgaacagcagcctatcggcagaaggttgtttcgagatttcctagcaactgttcctacttttcgtaaggcagccaccttccttgaggatgtgcagaactgggagctggcggaggagggcccaacgaaggatagcgccttacaaggtctagtggccacatgtgctagcgcccctgctcctggcaacccccagccatttttgagccaggccgtagcgaccaagtgccaggcagccacaactgaggaggaacgagtggctgccgtgactttagcgaaggcagaagccatggccttcttacaggagcagccttttaaggacttcgtgacctctgctttttacgataaattcctgcaatggaaactatttgagatgcaacccgtctctgataaatactttacagagtttagagtcctgggaaagggcggttttggcgaagtttgcgccgtccaggtgaagaacacaggaaagatgtatgcatgcaaaaagctggataaaaaacgcctgaaaaagaaggggggagagaagatggcgctgctggaaaaggagatactcgagaaagtgtcctccccattcatcgttagcctcgcatacgcttttgagagcaaaacgcacctgtgtctcgtcatgagtctaatgaatggcggagacctgaaatttcatatttacaatgttggaacccgagggctggacatgagccgcgtcattttctattctgcccaaatcgcttgcggaatgcttcatttgcacgaattgggaatcgtctatagggatatgaaacccgagaatgtgctcctggacgacctgggaaactgcagactcagcgatttggggctggcagtcgagatgaagggcggaaagcccatcacgcagcgagccggaaccaacggttacatggctccagagattctgatggagaaggtgagctattcatatcccgtcgattggttcgccatgggctgttccatttacgagatggtggctgggcgaacacctttcaaagattacaaagagaaagtctctaaggaggatttgaagcagagaaccttgcaagatgaggtcaaattccagcatgacaacttcaccgaagaggctaaggacatctgtcgcctctttctggcaaagaaacctgagcagcgcttaggaagtcgcgagaagtctgacgacccacgcaagcatcatttcttcaagactataaacttcccacgattggaggcaggcctcattgagccccctttcgtgcctgatccttccgtggtatacgctaaagacattgctgagatcgacgatttcagcgaggtaaggggggtagagttcgacgataaagacaaacagttctttaaaaatttcgcaacaggagcagtgccaatcgcctggcaagaggaaatcatagaaaccggactattcgaagaattaaacgatccaaaccggcctactggatgtgaggaaggaaattccagcaagtcaggggtgtgccttctgctgtag

SEQ ID NO: 224122 - DNA, 2088 bp, Artificial Sequence
  Description of Artificial Sequence: Synthetic coding sequence
atggaggagaaaccaggccagccccagccacaacatcatcactcacaccatcacccccaccaccatccccaacagcaacagcagcaaccccaccaccaccaccactactacttctacaatcatagccataatcaccatcatcatcaccatcaccagcaaccgcaccaatacctgcagcatggggctgagggtagtccaaaagcgcagcccaagccactcaagcatgagcagaagcacaccctccagcagcatcaggagacccccaagaaaaaaacgggttacggtgaattaaacgggaacgctggagaaagggaaatcagcttaaagaacctgtcttccgacgaggctaccaatccaatcagcagggtgcttaacgggaatcaacaggtcgtggacaccagtctgaagcagaccgtgaaggcgaacaccttcggcaaggccggtatcaaaacaaaaaatttcatacagaaaaactccatggacaagaagaacggcaaatcctacgaaaacaagtcaggggaaaatcaaagtgtagacaaatccgatactatccccatccctaacggagtggtcacgaacaacagcggatatattaccaatgggtatatgggaaagggggcagataatgacgggtctggaagtgaatccggttatactacccctaaaaagagaaaggcaaggcgcaacagcgccaaaggttgtgaaaacttaaatattgtccaagataaaatcatgcagcaggagactagtgtgcccactctgaagcagggccttgaaacatttaagccggattatagcgagcagaagggtaacagagtagatggctcaaagcccatatggaagtatgaaaccgggccagggggaacttcaaggggaaagcccgcagtgggagatatgctccgtaagtctagcgatagcaagcctggcgtatcaagtaagaaattcgatgaccgtcccaaaggcaagcacgctagcgcagttgccagcaaagaagactcttggacactgtttaagcctcctcctgtctttcctgtggacaacagcagcgcgaaaattgttccgaagatttcctacgcatccaaggtcaaagaaaatctgaataaaactatccagaatagtagtgtgagccctacatctagctcctcctctagcagcagcaccggggagacacagacacaatcctcatctagactcagtcaggtgccaatgtctgcgttgaagagcgtaacgtcggccaatttctcgaacggtccagtgctcgccggaaccgatggcaacgtctaccctccaggcggacagccgctcctgacaacggctgcaaataccctgacacctatctcttccggaactgattccgttctacaggacatgtctctgacatccgcagctgtcgagcagattaaaacttccctgtttatatatcccagcaacatgcaaacaatgctgctgagtactgctcaagtagacctgccctctcagacagaccagcagaatctgggcgacatcttccagaatcagtggggtctaagctttattaatgagccctccgctgggcctgagacagtgaccgggaagtcaagcgagcacaaagtcatggaagtcactttccaaggcgaatatccggcaactcttgtcagccagggggctgaaatcatcccttcaggaaccgagcaccctgtctttcccaaagcttacgaactcgagaagaggacaagtccccaggtattaggcagcatccttaagagcggtaccacgagtgagtctggcgctctgagtctggaaccgtcacatatcggggatctgcagaaggctgacaccagcagtcagggtgccctggtgttcctttctaaagattacgagatagaaagtcagaaccctctagcctcgcccacgaatactctgcttggatcggctaaagaacagcgctatcagagaggactggaaaggaatgatagttggggatcattcgatctccgggcagccattgtgtaccatacaaaggaaatggaatcaatctggaacttgcagaagcaggacccaaagcgaattattacttacaatgaggcgatggactcccccgatcaatag

SEQ ID NO: 224123 - DNA, 534 bp, Artificial Sequence
  Description of Artificial Sequence: Synthetic coding sequence
atgtcgcgaaagggtccccgtgccgaggtgtgtgctgattgttcagctccagaccccggttgggcctctatctcaagaggtgtgcttgtctgcgacgagtgttgctccgtccataggtcactgggcaggcatatcagcatcgtcaagcacctcagacactcggcttggcccccaacgcttttacagatggttcatacacttgcctcaaatggcgctaatagtatttgggagcactctttactggatcctgcacaggtccagtcagggaggaggaaggcgaacccccaggataaggtacatcctatcaagtctgagtttatccgggcaaaataccagatgttagctttcgtccacaagcttccctgcagagacgatgacggcgtaactgccaaagacgatctgaccggtcaccggagctgggctacacccgatattaatccacatccaaatcgggctaccggcacgtcagcactatccgccgctaccctccccggttcacaggttccttggtgtccgcctctaagcagtccctag

SEQ ID NO: 224124 - DNA, 2313 bp, Artificial Sequence
  Description of Artificial Sequence: Synthetic coding sequence
atgagccgaaaaggacctcgcgctgaagtgtgcgccgactgcagcgcacccgacccgggatgggccagtatctcgcggggagtgctcgtgtgcgacgagtgttgttctgtgcaccggagcttgggcagacatatcagcatcgtgaagcatttacgtcatagcgcctggccacccaccctccttcagatggttcatactcttgcctctaatggggctaacagcatctgggagcactccttactggatccagcacaggtgcaaagcggcaggaggaaagcgaacccacaagataaggtacaccccattaaatccgaattcatcagagcgaaatatcagatgctggcgttcgtgcataaactcccttgtcgcgacgatgatggagtgaccgcgaaggacctgtctaaacagttgcactcaagtgtgagaacagggaaccttgagacctgcctcagactgctgagcctcggtgcccaagccaatttcttccatcctgaaaagggcacaacccctctccacgtcgctgccaaggctggccaaacccttcaggctgagctcctcgtcgtgtatggggctgaccccggatctcccgacgtgaacggtcgaacccccattgactacgccagacaagcaggtcaccacgaactggctgaacgcctggtcgagtgtcagtatgaacttacagacaggcttgccttctatctctgtggcagaaagcccgaccataaaaatggccattacataatcccccagatggccgataggagccgccagaaatgcatgtcccaaagcctggatctaagcgaactggcgaaggcagccaaaaaaaaattacaggccctgtccaatagactgtttgaggagcttgctatggatgtgtatgatgaagtcgaccggcgagagaatgatgccgtgtggcttgctacacaaaaccattctaccctggtaacagagaggtcagcggtgccattcctacctgttaaccccgagtatagcgccacccgtaatcaaggtagacagaaattagccagatttaatgcccgagaattcgccactctgattatcgacattctgagcgaagccaaacgtcggcaacagggtaaatctctgtcaagccctacagacaacctcgagctgtctttacgatctcagtctgacctcgatgatcagcacgattatgactctgtggcttcagatgaggataccgatcaggagcctcttcgctccaccggtgccaccagatccaacagagcacggagcatggactctagtgacctgagtgatggagccgtgactttgcaagagtacctggagcttaagaaagcactcgcgacttctgaagccaaggtgcagcagctgatgaaagtgaatagctctttaagcgacgagctccggcgtcttcagcgcgagatccataagctgcaggccgagaacctgcagttgcggcagcctccgggacctgtgcccaccccccctctgcccagtgaaagggccgaacatacccccatggcccctggcggaagcacacaccgcagagaccgccaagctttctccatgtatgagccaggcagcgccctaaagcccttcggcggacctcctggagacgagttgactaccaggctgcagcctttccactccacagagcttgaggatgatgcaatctattctgtccatgtgcctgctggcctgtacaggatcaggaaaggcgtgagcgccagcgctgtacccttcacacccagtagtcccctcctttcctgtagtcaggagggctccagacacacttctaagctgtctcgccatggttctggtgccgacagcgattacgagaatactcagagcggtgacccactccttgggctcgaaggaaaacgcttccttgaattgggcaaggaggaagatttccacccggaactggaatcactggatggcgacctggatccaggactgccaagtacagaggatgtgatcctgaaaaccgaacaagtgaccaagaatatccaggagctgctgcgtgccgcacaagagtttaagcatgactcctttgtcccctgctctgaaaagattcacctcgctgtgactgaaatggcctcactgtttcccaaaagacccgcattggaaccagtgagatccagtttgagactgctgaacgctagcgcctaccggcttcagtcggagtgtcgtaagaccgtgccgccagagccaggcgctcccgtggacttccagctactgacgcagcaggtgatccagtgtgcctacgacatcgctaaggccgctaaacagcttgtgaccattacaaccagggagaagaagcagtag

SEQ ID NO: 224125 - DNA, 1212 bp, Artificial Sequence
  Description of Artificial Sequence: Synthetic coding sequence
atgttcgtggcatctgagaggaagatgcgcgctcaccaggtgttgaccttcctcctgctctttgtgatcacatccgtagcgagtgaaaatgcttctacatcgcggggatgcggtttagacctgctgccgcagtacgtgagtctgtgcgacttagacgcaatatggggcatagtggtggaagcagtggcgggagctggcgcactgatcacactgctacttatgctgatattgttagtgaggcttccctttattaaagagaaggaaaagaagtccccggtaggactgcacttcctgtttctattaggcactctggggctgttcgggctgaccttcgctttcatcatccaggaggacgagacgatttgtagcgtacgacgcttcctctggggcgtcctgtttgccctttgctttagctgcctgttaagtcaggcctggagggtgaggaggctggtgcgccatgggacaggaccagctggatggcagttggtgggactggccttgtgcctgatgcttgtgcaggtgatcattgcagtagaatggttagtgttaacagtcttgcgagacacacggccagcatgcgcctacgagccgatggacttcgtgatggccctgatctacgacatggtgctgttggtggtcactcttggactggcactctttaccctgtgcgggaagtttaaaagatggaagctgaatggtgctttcctcttgatcacggcctttcttagtgttctgatctgggttgcttggatgactatgtacctcttcggtaatgttaagcttcagcaaggcgacgcatggaatgacccgactctcgctattaccctcgcagccagcggctgggtttttgtcatattccacgccatacctgagatacattgcacattgctgcctgcgctccaggaaaacacccccaattactttgatacatcccagccaaggatgagggaaaccgccttcgaagaggacgttcaactgcccagagcatatatggagaataaggccttttcgatggacgaacataatgctgccttgcgtaccgcaggcttcccaaacggctcgctgggtaagagaccctccggatcactcgggaaacggccaagcgctccttttcggtccaatgtgtaccagccaacggagatggccgttgtgctcaacggaggtactatccccacagcacctccatctcacactggaaggcacctgtggtag

SEQ ID NO: 224126 - DNA, 1215 bp, Artificial Sequence
  Description of Artificial Sequence: Synthetic coding sequence
atgtttgtggcctccgagaggaaaatgcgagcccaccaggtcttgacctttctgcttttattcgttataacctccgtagctagcgagaatgctagcacctcgagaggttgcggcttggatctgttgcctcagtatgtgtcactatgtgatctcgacgcgatttggggaatagtggtggaagccgtggcaggagcgggtgccttgatcaccctgctgctgatgcttatcctgttagtgcgactgccttttatcaaggaaaaggaaaagaagagccctgtgggtttgcacttcctcttcttgctgggcacgctcggtcttttcggcttgactttcgcttttatcatacaagaggatgaaactatctgttcagtgcggcgtttcctctggggcgtgctatttgctttgtgtttttcctgcctcctttcgcaggcttggcgcgtgcggaggctcgtcaggcacggaaccgggccagcaggctggcaactcgtgggactggctctgtgtcttatgctggtgcaggttattatagctgtagaatggctagtgttgaccgtcctgagggacacaaggccggcttgcgcttacgagcccatggactttgttatggccctaatttacgatatggttctgctggtcgttacgctcggtctggctctgttcacactctgcgggaagttcaaaagatggaaattgaatggagcatttctgctgataaccgcatttttgtcagtcctcatctgggttgcctggatgaccatgtaccttttcgggaacgttaagctgcagcaaggcgacgcttggaatgacccaactctagccatcaccctggctgctagcgggtgggtgtttgtgatttttcatgccatccccgaaatccattgtacactgctaccagcccttcaggagaataccccgaattacttcgacacatcccagccacgaatgcgtgaaaccgcctttgaagaggacgtgcagctgccacgagcctacatggagaataaagcgttcagtatggatgaacataacgccgcactccgcacagccggattcccaaacgggagccttgggaaaaggccttcaggcagcctcggcaaaagacccagcgcccctttcaggtccaacgtgtaccagccaaccgagatggccgttgttcttaacggaggcactgagatggtgactcacccaagatctttagagagctttggcgcattttag

SEQ ID NO: 224127 - DNA, 1290 bp, Artificial Sequence
  Description of Artificial Sequence: Synthetic coding sequence
atgaaccctccctggagcgtcgcctgggggcaagaaggttttcgggctgggacccccggatctcgctacctgcctcgcatgtttgtcgcgagcgaacgcaagatgagagctcaccaagtgctgacattcctcctgctcttcgtgattacgagcgtggcatcagaaaatgcctcaaccagtagaggctgcggcttagatctgttgcctcaatatgtgtctctttgcgacttggacgccatctggggcattgttgttgaggcggtagctggcgctggggctctgatcacactgctgttgatgctcatcctgctggtccggctaccttttattaaggagaaagagaagaaaagccctgtagggcttcactttctcttcttactcggcacattgggtctgtttggcctcactttcgcattcattattcaggaggatgaaacgatttgtagtgtgcgaagattcctgtggggagttctatttgccctgtgtttctcttgtttgctctctcaggcctggcgggtgcggagattggtgaggcatggtacgggaccagccggatggcaattggtaggcctcgccctgtgtttaatgcttgtgcaagttatcatcgcagtagagtggctcgtgctgactgtgctgcgcgatacaaggcctgcatgcgcatacgagccaatggatttcgttatggccttgatttacgacatggtgctgctggttgtgacattgggcctggcgttgtttacactctgtgggaagttcaagcgctggaagctgaatggagcttttctgctgatcactgccttcctctccgtgctgatttgggtggcctggatgactatgtacctctttggcaatgtgaagctccaacagggtgatgcatggaacgacccaaccttggccatcaccctcgcagcttccgggtgggtcttcgtgattttccacgccatacccgaaatccattgcaccctgctccctgcactgcaagaaaacaccccgaattatttcgacacctcacagcccaggatgcgcgaaactgctttcgaagaggacgtgcaattgcccagggcatacatggagaacaaggcattcagcatggacgaacataacgccgcactacggactgcaggattcccgaatggcagtctgggcaagcggccttccggttcacttggaaagagaccatcagctcctttccgctcaaatgtatatcaacctactgagatggccgtggtgctgaatggcggtactatacctaccgcaccccctagccatactgggcgacatttgtggtag

SEQ ID NO: 224128 - DNA, 759 bp, Artificial Sequence
  Description of Artificial Sequence: Synthetic coding sequence
atgttcgtggcaagcgaaagaaaaatgcgggctcaccaagtccttacctttcttctgctcttcgtcatcacttccgtggcatccgagaacgcctcaacatctaggggctgcggattggacctgctcccgcagtacgtgagtctgtgcgacctggacgccatctggggtattgtagtggaagctgttgcaggagccggtgcactgatcaccctgctgctcatgctaatcctcctagttcgattgccctttttcctgctcattaccgccttcctgtctgttttaatttgggttgcgtggatgacaatgtacctgtttggaaatgttaaactgcagcaaggtgatgcctggaatgaccccaccctcgcaatcaccctggccgctagcgggtgggtgtttgttatctttcatgccatcccagagatacactgcactctgctaccggctctccaggaaaacacacccaattactttgatacaagtcagccgcgtatgcgggaaactgccttcgaagaggacgtccagttaccaagggcttacatggagaacaaggccttttcaatggatgaacacaacgcagctctgaggactgcaggatttcccaatggatctctgggcaaaaggccaagcgggtctctcggtaagcgccctagcgctccatttcgctccaacgtttaccagccaactgagatggctgtggttctcaatggtggcaccattccgactgctcccccttcccatacgggccgtcacctgtggtag

SEQ ID NO: 224129 - DNA, 489 bp, Artificial Sequence
  Description of Artificial Sequence: Synthetic coding sequence
atggccatccacaaggcattggtgatgtgtcttggtctccctctgttcctgttccccgaacagtcataccaaggtgatatgtatcctacgcgcggagtgggttacgaaacgatattaaaggagcagaagggacaatccatgttcgtcgagaacaaggccttttcgatggatgaacctgtcgcggcaaagaggcccgtctccccatactcgggctacaatggtcagctgttgactagcgtgtaccagcccacggagatggcactcatgcacaaggtgccgtcagaaggggcatatgacatcattctgcccagggcgactgctaactcgcaagtaatgggctccgctaattccaccttgcgcgcagaagatatgtacagcgctcagtctcaccaggctgccactcccccaaaagacggtaagaacagccaagtgtcagaactcacccagaggggacaggccaacaccaaccaggtgtttctccggttgtag

SEQ ID NO: 224130 - DNA, 1461 bp, Artificial Sequence
  Description of Artificial Sequence: Synthetic coding sequence
atgcgcggacgaggatcccaacagcagcagcccacacggagacagggtcagaaactcccttctccatcacccgctgggaagtacgagtccgcgcagcccggagggacgcagccagaacccggactgggggctcgcatggctattcacaaagccctggtgatgtgtcttggactgccactatttctcttccccggagcttgggcccaaggccatgtccccccaggatgctcccaaggactaaaccccctatactataacctgtgtgatagatccggtgcctggggcatcgtgctggaggctgtggccggtgccggtatcgtgacaacctttgttctgactatcatcctggtcgcttctctgcctttcgtgcaagatacaaaaaagcgcagtcttcttggcacccaggtgttctttttgttagggactctcggactgttctgtttagtgtttgcctgtgttgtcaagcccgacttttccacatgcgccagtcggagattcctgtttggtgtgctcttcgccatctgtttctcctgcctggcagcccacgtgttcgccctcaactttctggctcgaaaaaaccatgggcctcgaggttgggtcatattcactgtggccctcctcctgactttagtggaagtcattatcaatactgagtggctgattatcacattagtgcggggatccggagagggaggccctcagggcaacagtagcgctgggtgggcagttgccagtccctgcgcaatagccaacatggatttcgttatggctctgatatacgtgatgctactgttattgggagcttttctgggcgcttggcccgcactgtgtggcaggtacaagcgctggcggaaacatggagtctttgtcctgcttacaacagcaacatcagtggccatctgggttgtgtggatcgttatgtatacatacggcaataagcagcacaacagccctacatgggatgaccccactctcgctattgctctcgcagcgaacgcatgggctttcgttctgttttatgtgattccagaagtgagccaagtgactaagagcagcccagagcaaagttatcaaggtgatatgtatcctacacgaggtgtggggtatgaaaccatactaaaggaacagaagggccagagcatgttcgttgagaacaaagcatttagtatggatgagccggtggccgctaagcggccagtcagcccgtatagcggatataacgggcagctgctgacctccgtctaccaaccaacagagatggcattaatgcacaaagttccatccgagggagcttatgatattatcctccctcgggctaccgcaaactcccaggtgatggggtccgccaactcaactctgcgcgctgaagacatgtattcagctcagtctcaccaggctgccacccctcctaaggacggcaagaacagccaagtgtttcggaacccctacgtgtgggactag

SEQ ID NO: 224131 - DNA, 1326 bp, Artificial Sequence
  Description of Artificial Sequence: Synthetic coding sequence
atggccatacacaaagccttagttatgtgtctaggattgcccttatttctgtttcctggggcttgggcacagggccatgtccctccaggctgtagccagggcttaaatcctctctattacaacctctgtgatcgctctggggcttggggcattgtgcttgaggctgtggctggcgcaggcatagtaacaacattcgtcctcacgattatccttgttgcatccctgccgttcgttcaagacaccaagaagagaagtctgttaggaacccaggtttttttcctgctgggcacccttgggctgttttgtctagtgtttgcctgcgtggtgaagcctgacttctctacctgtgcctcccgccgattcctgttcggggtcctctttgcaatctgttttagttgtctcgcagcccacgttttcgctctgaacttcctcgcccgaaagaaccacggcccaaggggttgggttatttttacagtggctctgttgctaaccctggtggaggtcatcattaatacagagtggttaattatcaccctggtgagaggttccggcgagggagggcctcaaggtaattcttccgcaggctgggccgtcgcatcaccttgcgccatcgccaatatggatttcgtaatggctctgatctacgttatgctgctcctcctcggcgctttcctgggagcttggcctgccctgtgtggacgttataaacggtggcgtaaacatggagtattcgtgcttttaacgaccgcaacgtctgtggctatctgggtggtctggatcgtcatgtatacttacggcaacaagcagcataacagtcctacctgggatgatcccactctggctattgcgcttgcagcgaacgcctgggcatttgtgctgttttacgtgatccccgaggtatcacaagtcaccaaatcttcgcccgagcagagttaccagggagatatgtaccccaccagaggcgtgggatacgagactatactgaaagagcaaaaaggacagtctatgttcgtggagaataaagcctttagcatggatgaaccagtggccgcaaagcggccagtgagtccttattctggatacaacgggcagttgttgacaagcgtttaccagccaacagaaatggccctgatgcataaggtgccctccgagggagcctacgacatcatcttgcccagagcgaccgccaattcacaggtgatggggtcagcaaactccaccctgagggctgaggatatgtactcagcccaatcccaccaagccgcaactcctccaaaagacgggaagaactctcaagtgttccgaaacccatacgtttgggactag

SEQ ID NO: 224132 - DNA, 1329 bp, Artificial Sequence
  Description of Artificial Sequence: Synthetic coding sequence
atggccatccacaaggcactcgtaatgtgcctcggactccccttgttcctatttcctggggcatgggctcaagggcacgtccctcccggttgctctcagggtctgaatcctctctactacaatttatgcgataggtccggagcctggggtattgtcctggaagctgttgcaggagccggaatcgtaactaccttcgtcctaactatcattctggtcgcttctttaccatttgtgcaagatactaagaagcgaagtctgttgggtacacaagttttcttcctccttggtactctcggcctcttctgccttgttttcgcgtgtgtcgtgaaacccgatttcagtacatgtgccagccgcagattcctatttggggtacttttcgccatttgttttagctgtctggccgctcacgtctttgcgctaaattttctggctcggaagaaccatggcccacgcggatgggtgattttcactgttgccctgttgctgactctcgtcgaagttatcattaataccgagtggcttataatcacgctggtccgtggtagtggcgagggaggacctcaaggaaattcgtccgccggttgggcagtggctagtccatgtgccattgcaaacatggatttcgtgatggccctcatttatgtcatgctgttgctgttgggtgcatttctgggagcttggcccgcattatgtggtcggtataagcggtggcggaagcatggtgttttcgtgcttcttactaccgcaacgtctgtggcaatctgggtggtttggatagtcatgtacacctatggaaataaacaacacaactcccctacctgggacgatccaactctggccattgctctggccgctaacgcatgggcattcgtactattttatgtgattcccgaagtgtcccaggtgacaaaatcatctcctgagcagtcatatcagggtgacatgtacccaactaggggagtggggtatgaaacaatactaaaagaacagaaggggcagtctatgtttgtggaaaataaggctttcagcatggatgagccggttgctgcaaaacgcccagtttccccctactctggctataatggacaactgcttacgagcgtgtatcaacccaccgaaatggcacttatgcacaaggttccaagcgagggtgcttacgatattattctgccacgagcgacagccaacagccaggttatgggatcagctaattccacccttcgtgctgaagatatgtactcagcgcagtcacaccaggcagccacacctccgaaggatggcaaaaactcccaagcccaaagtccccagtccaaaactagatggtag

SEQ ID NO: 224133 - DNA, 1362 bp, Artificial Sequence
  Description of Artificial Sequence: Synthetic coding sequence
atgggcacacagcccgagcctggtctgggggctcggatggcgatacataaggcactggttatgtgtctcggattgcctctatttctattccctggtgcatgggcccagggtcatgtgccgccagggtgttctcagggcttgaaccccctgtactacaacctgtgcgaccgctccggcgcatggggcatagtgcttgaggccgtggctggggcaggcatcgttacaacctttgtgctaactatcattcttgtcgcatcccttcctttcgtccaagacaccaagaagagaagccttctggggacacaggttttcttccttctcgggaccctgggccttttttgtttggtgtttgcctgtgtcgtgaaacctgatttctctacttgtgcatccagacgcttcctgttcggggtgttgtttgcgatttgtttcagttgcctggcagcccatgtgtttgcgctgaacttcctggcacggaaaaaccacggtccacggggttgggttatctttacggtggccctccttctgacattggtcgaagtgatcatcaatactgagtggctgataatcacactggtgcgagggagtggcgaaggtggtcctcaggggaacagcagtgccggttgggcagtggctagtccctgcgccatagcgaatatggactttgtcatggctctcatctatgtcatgcttctgctgctcggcgcattcttaggggcttggcccgcactgtgcggtaggtacaaacgatggagaaagcatggagtctttgtgcttcttacaaccgcaacctcggttgccatatgggtggtttggatcgtgatgtacacctatggtaacaagcagcataactccccaacatgggacgatcccacattggccattgccctggccgctaacgcctgggcttttgtgctgttttacgtaattcctgaagttagccaggttaccaagagcagccctgagcaatcctatcaaggtgatatgtaccccaccagaggcgtgggatatgagacgatccttaaagagcaaaaagggcagtccatgtttgtggaaaacaaagccttttcaatggacgagccagttgctgctaaaagacccgtctctccctatagtggctacaacggccagctgcttacaagcgtataccagcctactgagatggccttaatgcataaagtgccctcggagggggcatacgacatcatactgccacgggctacggcgaattcacaggttatgggatctgcgaattccacactccgggctgaggatatgtacagcgcacagagccaccaggccgctaccccgccaaaagatggcaagaactcccaagtattccggaatccatacgtgtgggactag

SEQ ID NO: 224134 - DNA, 597 bp, Artificial Sequence
  Description of Artificial Sequence: Synthetic coding sequence
atgtctaatgtacgcgtgagtaacggaagcccgagccttgagcgaatggatgccaggcaggccgagcacccgaagccaagtgcatgtaggaacctgttcggcccagttgatcacgaggaattgacacgggatctcgagaagcactgcagagacatggaggaagcaagccagaggaagtggaactttgactttcagaatcataagccccttgaaggtaaatatgagtggcaggaggtggaaaaggggtctctgcccgagttctactatagacctccaagaccacccaagggcgcttgtaaagttcccgcacaggagagccaggacgtctcagggtctagacccgctgctcccctcattggcgcacctgccaattctgaggacacacaccttgtagaccccaaaaccgacccgtccgactctcaaacaggtctggccgagcaatgtgccggtattcggaagcgtcctgccaccgatgatagctccacacaaaacaaaagagccaacagaacagaggagaatgtgtcggatggttccccaaatgccggttccgttgaacagacaccaaaaaagccaggactgcgacggaggcagacttag

SEQ ID NO: 224135 - DNA, 903 bp, Artificial Sequence
  Description of Artificial Sequence: Synthetic coding sequence
atgtacaaggattgcattgagtccaccggagactatttcctgctgtgcgacgcagagggaccttggggcattatacttgaatctttggccatactgggtattgtcgtcaccattttactcctcctggcgttcctgttcctcatgagaaaaatccaggattgctctcagtggaatgtactgccaactcagctgctctttctgctaagcgtgttgggactgttcggccttgctttcgcattcatcatagagttaaaccagcagacggcaccagttcgatatttcctattcggcgtcctctttgccctatgcttttcatgcctgcttgcccatgcctcgaatctggtaaaactggttaggggatgcgtgtcctttagctggactactatactgtgtattgcaattggttgttctctgctgcaaatcatcattgctacggaatacgtgacactaataatgaccagggggatgatgtttgttaatatgacaccttgccagcttaacgtcgactttgtggtcctgctggtttacgtgctgtttctgatggcactgacgttcttcgtttccaaagccaccttctgtggcccttgtgagaactggaaacagcatggccgtctcatctttatcactgtgctctttagtatcattatctgggttgtctggatctctatgcttttacgcggtaacccacaattccagcggcagccacaatgggatgacccagtggtctgcattgctctcgtcactaacgcttgggtgttcctgctactctatatcgtccccgagctgtgcattttatatcgatcctgcagacaggagtgccccctccagggtaacgcttgcccagtaactgcgtaccagcattcgtttcaggtcgagaaccaggaactcagccgggattgctag

SEQ ID NO: 224136 - DNA, 363 bp, Artificial Sequence
  Description of Artificial Sequence: Synthetic coding sequence
atgtacaaagactgcatagagtccactggtgactattttctgttatgtgacgctgaaggtccatggggcataatcctcgaatctctcgctatcctgggaatcgtggtcaccatcctgttgcttttagcatttctatttttgatgaggaagatccaggactgttctcagtggaatgtgctgccaactcaactgttgttcctgttgagtgtgctgggtctgttcggtctagccttcgcatttatcatcgagttaaatcagcagactgcccctgtacgttatttcctattcggagtgctctttgccctctgcttttcttgcctgctggcccatgcctcaaacctagttaagcttgttaggggctag

SEQ ID NO: 224137 - DNA, 312 bp, Artificial Sequence
  Description of Artificial Sequence: Synthetic coding sequence
atggagaccgttcaggaactgatcccattggctaaggaaatgatggcacagaaacggaagggaaagatggttaagctgtacgtgctgggatcagtgctcgccttatttggagttgtgctgggcctgatggaaactgtctgttcacccttcacagctgcccgtcggctgcgggaccaggaagcggctgttgcggagttgcaggcagccttagagcgccaagccttgcagaagcaggccctgcaggaaaagggcaaacagcaggacaccgtcctgggcggaagggcactatctaatcgccaacatgcaagctag

SEQ ID NO: 224138 - DNA, 1500 bp, Artificial Sequence
  Description of Artificial Sequence: Synthetic coding sequence
atggagctcagtgagcccatcgtggaaaatggggagaccgaaatgagtccagaagagtcatgggagcataaggaggagatttctgaagctgagccaggcggtggaagtctgggcgacgggaggccacctgaggagtccgcccacgagatgatggaggaagaagaggaaatccctaaaccaaaatctgttgtcgcccctcccggtgcacccaagaaggaacacgtaaacgttgtgttcatcggacatgtggatgccggaaaatcgacaattggtggccagatcatgtatctcactggaatggtcgataagcggacgctcgagaagtatgaaagagaagcgaaagaaaagaaccgtgagacttggtatctcagctgggctctcgacacgaaccaggaagaaagagacaaaggcaaaacagtcgaagtaggacgggcatacttcgagacagagaaaaaacatttcaccatccttgacgcccctgggcataagtctttcgttccaaatatgatcggtggcgcaagccaggcagacttggctgtcctagtgatcagcgccaggaaaggggaattcgagacaggatttgagaaaggcggacagacacgcgaacacgccatgctcgccaaaaccgccggtgtgaaacatctgatcgtcttgatcaataagatggacgacccaactgtgaattggtcgaatgagcggtacgaagagtgtaaagagaagctggtgccttttttgaaaaaagtaggctttaatcccaaaaaagatattcattttatgccatgcagtgggcttactggagccaacctgaaggaacagtctgatttttgtccatggtatattgggctaccattcataccctacctcgataacctcccaaattttaaccggtcagtggacggaccaataagactgcctatcgttgataagtataaagacatgggcaccgttgtcctgggcaaactcgagtcagggtcaatttgtaaggggcaacaactcgtgatgatgcctaacaagcacaatgtggaagtcttgggtatcctatccgacgatgtagagaccgatactgtcgcccctggcgagaacctcaaaatccgcctcaaaggtatcgaggaagaagaaattctcccgggattcatcctgtgcgacccgaacaatctatgtcattcgggtaggacatttgatgcccagatagtcatcatcgagcataagagcataatctgccccggatataacgccgttcttcacatccatacctgcattgaggaggtggaaatcacagccctaatctgcctggtagataaaaagtccggggagaagagcaagacacggccacgattcgtgaagcaagatcaagtttgcatcgccagacttaggactgctggcactatttgccttgagacgttcaaagacttccctcagatgggccgatttacactcagggacgagggcaagacgattgctataggcaaagtgctcaagctcgttcctgagaaggattag

SEQ ID NO: 224139 - DNA, 1914 bp, Artificial Sequence
  Description of Artificial Sequence: Synthetic coding sequence
atggatccagggtccggcggtggaggcggaggtggcggaggaggtggttccagtagcggtagttcttctagtgattccgctcctgattgctgggaccaggcagacatggaggcacctggccctggcccttgcgggggtgggggttctctcgcagccgcagccgaagcacagcgcgagaacctctctgcagcctttagtagacaactgaatgttaatgcgaaaccatttgtgcctaacgtgcacgctgccgagttcgtcccgtcctttttaagggggcctgctgcccctccacccccagttgggggtgcagcaaacaaccacggcgctgggagcggtgctggagggcgagctgccccagtggagtccagtcaggaggagcagagcctgtgtgaaggcagcaactctgctgtgtccatggaactgtctgaaccgatcgtggagaatggtgaaacagagatgagcccggaggagtcctgggaacataaggaggagattagcgaggctgagccagggggtggctctctgggggatggtcggccaccagaggaatccgcccacgaaatgatggaagaggaggaggaaatcccaaaacctaagagtgtagtggccccacctggagcgccaaaaaaggaacacgtcaacgtagtgtttataggtcacgtcgacgccggaaagagtacaatcgggggtcagattatgtacttgacagggatggtggataaacgaactctcgagaaatatgaaagagaggcaaaagagaaaaatcgggagacatggtatctgtcgtgggccctcgacactaatcaggaggagcgcgacaagggaaaaactgtcgaggtgggcagggcatattttgagaccgaaaaaaagcacttcacaatcctggatgctccagggcataagtccttcgtcccaaacatgatcggcggtgcatcacaggctgatctggctgtgttggtgatttcagctcgcaagggggaatttgagactggctttgagaagggaggacagactagagagcacgctatgctggccaagaccgctggtgtgaaacaccttattgtgctgataaataagatggacgacccaaccgtaaattggtcaaatgagcggtacgaggaatgcaaagagaaactggttccatttctgaaaaaagtagggtttaacccaaagaaagacatccacttcatgccttgttctgggcttacaggggcaaatctgaaagagcaaagcgatttctgcccatggtatatcggcctgccattcatcccatatttggataatctccctaacttcaatcgttctgtggacggcccaatccgactgccaatagtggataagtacaaagacatggggaccgtggtgctaggcaaactggaatctggtagtatttgtaagggtcagcagctcgtaatgatgcccaacaagcacaatgtggaggtgctgggtatcctttctgatgatgtggaaacagacaccgtggctcccggagaaaacctgaagatccgactgaagggcattgaggaagaggagatattgcctgggttcattctctgcgaccccaacaatctgtgccatagcggcagaactttcgacgcacagattgttatcatcgaacacaaatccataatctgccccggttacaatgccgtgctgcatattcacacatgtatcgaggaggtagagatcacagcattgatctgtttagtagataaaaaatccggagaaaaatccaagaccaggccaaggtttgtgaagcaagaccaggtgtgcatagctcggttacgaacagctggtaccatctgtttggagacattcaaggacttcccccagatgggcaggtttaccttgcgggatgagggcaaaaccatcgccatcggcaaagtgcttaagctggtgcctgagaaagactag

SEQ ID NO: 224140 - DNA, 1911 bp, Artificial Sequence
  Description of Artificial Sequence: Synthetic coding sequence
atggaccctgggtctggtggcggtggcggaggtggcggaggcggtggctcctcctccggttcatccagcagtgactcggcgccagattgctgggatcaggccgacatggaagcccctggtcctggaccatgtggtggtggaggatctttggcggctgccgctgaggctcaacgggaaaatctttccgctgcattcagccgtcagttgaacgtgaatgctaaaccgttcgtgcctaacgttcacgccgctgagtttgtgccatctttcctgcgcggtcccgcagctcccccacccccagtgggcggtgccgctaataatcacggcgcagggtccggagctggaggaagggctgcacccgtggagtcctcccaagaagagcagtctctgtgcgaaggcagtaattcagctgtgagcatggagctcagtgagccgatcgaaaacggagaaacggagatgagcccagaggagagctgggaacacaaggaggagattagcgaagctgaacccggtggaggcagtctgggagacggacgacctcccgaagagtctgctcatgaaatgatggaggaagaagaggagattcctaaaccaaaaagcgttgtggccccacctggagccccaaagaaagaacacgttaacgtcgtgttcataggacacgtggacgccggtaaatccactatcggagggcaaattatgtacctaacaggcatggtcgacaaaaggacattagaaaaatatgagcgtgaggcaaaagaaaagaaccgcgaaacatggtacctgagctgggcattggatactaaccaggaggaaagggacaaaggcaagacagtcgaggtgggccgtgcttacttcgaaacggagaagaagcacttcactattctcgatgcccctggacacaagtctttcgtcccaaatatgatcggcggagcatcacaagcagacctggctgttctggtgatctcggccagaaagggcgaatttgaaacaggatttgagaaaggaggacagacaagagaacatgccatgctcgccaagacggccggagtaaaacacttaatagtccttataaacaagatggacgatcccaccgtgaattggtcgaatgagcgctatgaggagtgcaaggagaagttggtcccatttctcaaaaaggtggggtttaatcctaaaaaagatattcatttcatgccgtgtagcggtctcaccggagcaaacctaaaggaacagtctgatttttgtccgtggtacatcgggctcccatttattccctatctggataaccttcccaattttaaccggtccgtggacggcccaatcaggctacccattgtggataaatacaaagatatgggaaccgtggttctgggtaaactggaaagcggaagtatttgtaaaggccaacagctggtgatgatgcccaataaacataatgtggaggttctgggcattctctccgatgatgttgaaaccgacacagtcgcacctggcgagaatttgaaaatccggctgaaaggcatcgaggaagaagagattctgcctggtttcattctctgcgaccctaataatttgtgtcacagtggaagaacattcgatgcccagatagtgattatcgagcacaaaagcattatatgccctggatacaacgccgtccttcatattcacacctgcattgaggaggtcgagattaccgctctgatctgtctggtagataagaaatccggtgagaagagcaaaactaggcccaggtttgttaagcaggaccaagtctgtatcgctaggctgcggaccgcaggcaccatctgtctcgaaaccttcaaagattttccacagatggggcgattcaccctgcgggacgagggtaagaccatcgcaattggtaaagtgttgaagcttgtccctgagaaggactag

SEQ ID NO: 224141 - DNA, 1887 bp, Artificial Sequence
  Description of Artificial Sequence: Synthetic coding sequence
atggactccggctcttcctcatccgatagcgcgccagattgttgggatcaagttgacatggagtcacccggatctgccccttcgggcgacggggtgtcatccgcggtggctgaggcacagcgggagcctctgagttctgcattttcccgcaagctaaatgtcaatgcgaaaccgttcgtacccaatgtgcacgccgcagaattcgtgccttcatttcttagaggcccaactcaaccacccacattgcccgcaggcagcggctctaatgatgagacctgtactggagccggttacccacaaggcaaaagaatggggaggggggcaccggtggaaccaagcagggaggagcctttagtgagcttggagggctctaactctgccgtcactatggaactgagcgagccagtggtggagaacggcgaagtagagatggccctggaagagagttgggagcatagcaaagaagtaagtgaggcagagccaggtgggggatcatctggagatagcggtcctcctgaggagtctgggcaagaaatgatggaggagaaggaagaaattcgcaagagcaaatctgtcatcgtgccttctggcgctccaaagaaagagcacgttaacgttgtctttattggacacgtggacgcagggaaaagtactatcgggggacagatcatgttcctgacaggcatggtcgacaaaagaacactggaaaagtacgagagggaggcgaaggagaagaacagggagacttggtatcttagctgggccctggatacaaaccaggaagaacgggacaagggcaaaaccgtagaggtgggccgagcctattttgagacggaacgcaagcacttcaccattctggacgcacccggacataaatcatttgtgcctaatatgataggaggcgctagccaggccgacctggctgtgttggtgatttccgctcgcaagggagaatttgaaaccgggtttgagaagggcggtcagacaagagaacatgccatgctcgccaagacagcaggcgtgaagcacctgattgtactgatcaacaagatggacgacccaaccgtaaattggtcaatcgagaggtacgaggaatgtaaggagaagcttgtcccttttctcaaaaaagtcggtttcagcccaaaaaaagacatccacttcatgccctgttctgggctgactggcgcaaatatcaaagagcagtccgatttctgcccctggtacaccggactgccattcatcccttatctggataacctgcctaatttcaatcgtagcatcgacggtcccattaggttgcctatcgtggataagtataaggatatggggacagtagtcttaggtaagctcgagtccggatccatttttaagggccagcagttagtgatgatgcccaataaacacaacgtcgaggtgctgggcatcctgtctgacgatactgagactgatttcgtagcgccaggagagaatctaaagatcaggctgaaaggcattgaagaggaggaaattctccccggatttatcctctgcgatcctagcaatctgtgccactccggacgtactttcgacgtgcaaattgtgattattgaacataagtcaattatatgccccggatataacgccgtgctgcacatccacacttgtatagaggaagtcgagataacagcactcataagccttgtagataaaaagagtggtgagaaatccaagaccagaccgcgattcgtgaaacaggatcaagtgtgcatcgcccgtctccgtactgccggaaccatctgcctcgagacgtttaaagactttccgcaaatgggcaggttcactttaagagacgagggcaagactattgccatcggaaaggtgttgaagctcgtcccagagaaggattag

SEQ ID NO: 224142 - DNA, 1638 bp, Artificial Sequence
  Description of Artificial Sequence: Synthetic coding sequence
atggactctgggagcaacgacgagacctgtaccggagcaggttacccacagggcaaacgcatggggaggggggctccggtggagcctagccgcgaggaaccccttgtctcgttggagggctccaactccgccgtcaccatggaactgagcgaacccgtggtggagaatggggaggttgagatggccctcgaggagagttgggagcatagcaaagaagtctctgaggcagaacctggcggaggttccagcggtgactcagggcctccagaggaaagcggccaagagatgatggaagagaaagaggagatacgcaagagcaaaagtgttatcgtgccgtccggcgctcctaagaaggagcacgtgaacgtggtttttatcggtcacgttgacgctggtaagagcaccatcggtggtcagatcatgtttctcacggggatggttgacaagaggactctggagaaatatgaacgggaagctaaagagaaaaatcgcgagacgtggtacctgtcttgggcccttgacacaaatcaggaggagagggataagggcaagacagtggaggtcggtagggcctacttcgaaactgagaggaagcacttcacgatcctggatgcccctgggcacaagtcttttgtgccaaacatgataggcggtgctagccaagctgatctggctgtcttggtgatcagcgcccgtaagggcgagttcgagaccggctttgagaaggggggacagacccgggaacacgctatgctggccaagacagccggagtcaagcatctgattgttctgattaataaaatggatgaccctacagttaattggagcatcgaaaggtacgaggagtgcaaggaaaagctggtcccattccttaaaaaagtgggcttttcacccaagaaagacatccattttatgccctgttctggcctgacaggagcaaatatcaaggagcagagcgacttctgtccttggtatactggccttccttttattccatacctggataatttaccaaattttaaccgtagtattgatggaccaattaggctgcctattgtggataaatacaaagacatgggcaccgtagtcctgggtaagttagaatcgggcagtattttcaaaggacagcaactcgtaatgatgcctaacaaacacaatgtagaggtgttgggcatcttgagtgacgatacagagaccgacttcgttgctcccggagagaacctgaaaattcggctcaaggggatcgaggaggaggagatactgcccggatttattctgtgtgacccctccaacctatgtcactccgggcgtacgttcgacgttcagattgtgataatcgagcacaaatccataatctgtcctggatataacgcagtgctgcacatccatacctgcatcgaggaagtagagatcacagccctcataagcttagtagataagaagagcggcgagaaatcgaagacaagacccagatttgtgaaacaggatcaagtgtgcatcgctcggctcagaaccgccggtactatctgccttgaaactttcaaggatttccctcagatgggcaggtttactctacgtgacgagggcaagaccatcgcaatcgggaaagttctgaaactggtaccggaaaaggactag

SEQ ID NO: 224143 - DNA, 1365 bp, Artificial Sequence
  Description of Artificial Sequence: Synthetic coding sequence
atgacgaagagggaggctgaagagctcatcgaaatcgaaatcgatggaaccgagaaggctgaatgtaccgaagaaagtatcgttgagcagacatatgctcctgccgagtgtgtgtcacaggccatcgacatcaatgagccaatcggcaacctgaagaaactgctagagcctagactgcagtgctctctggatgcacatgagatctgcctgcaagacatacagcttgaccccgaacggtctctgtttgaccaaggcgtcaaaaccgatgggaccgttcagcttagtgtccaggttatctcgtaccaggggatcgagcccaagttgaacatcctcgaaatcgtgaaaccagctgacacagtcgaggtggtgatcgaccccgatgcccatcatgctgagagcgaggctcaccttgtggaggaggctcaggtaatcacactggacggcaccaaacatatcaccactattagtgacgagacctccgagcaagtgacgcgctgggccgctgctttagagggctaccgaaaggaacaggaacgactgggcattccctatgatcccatccagtggagcaccgatcaagtcttgcattgggtcgtttgggtgatgaaagagtttagcatgactgacattgatctgactacattgaatatcagcggaagagagctctgttcccttaatcaggaggacttttttcaacgggtgcctaggggcgaaattttatggtcccatctggaactgcttcggaagtatgttttggcttcccaagaacagcagatgaacgagatcgtaacaattgatcagcccgttcagatcattcctgcttccgtgcagtctgctacccctacaacaataaaggttattaatagttcggctaaggccgctaaggtccagcgggctcctaggatcagcggggaggatcggtcatcccccggaaatcggacaggcaacaacgggcaaatccagctttggcagttcttgttagagcttctaacagataaagatgcaagggactgtattagctgggtaggagatgaaggggaatttaaactgaaccagcccgagctggtggcgcagaaatgggggcagaggaagaacaaacctaccatgaactatgagaagcttagccgcgctctgcgctactattacgatggggatatgatttgtaaagtacagggcaagcgcttcgtgtacaaattcgtgtgcgatctcaagacgctgatcgggtattctgcagcggagctcaaccggcttgttaccgagtgcgaacagaagaagcttgcaaaaatgcaactgcacggcatagctcaaccagtgacggctgtggctctggccaccgctagtctgcaaacagagaaggacaactag

SEQ ID NO: 224144 - DNA, 1365 bp, Artificial Sequence
  Description of Artificial Sequence: Synthetic coding sequence
atgacgaagagagaagctgaggaacttatagaaatcgagatcgatggaacggagaaggctgagtgcacagaagaatccatcgtagagcagacctatgcaccagccgaatgtgtcagccaggccatagatatcaatgagccgatcgggaacctgaagaagctgctggagcccaggctccagtgctctctggacgcacatgaaatctgtctgcaggacattcaactggacccagagaggtctctgtttgaccagggggttaagaccgatggcactgtacaactgagtgtacaggtaatttcttatcaaggcattgagcccaagttgaatattttggagattgtcaagcccgctgacaccgttgaggttgtaattgaccccgacgcgcaccacgcagagtcagaggcacatctagttgaagaggcccaggtcattacactcgacggtaccaagcacattaccacgatcagcgatgaaacaagcgaacaggtgactcggtgggccgctgctttggagggctacagaaaagagcaggaacgattaggtataccctatgaccctattcagtggagtaccgatcaggtcctgcactgggttgtgtgggtcatgaaagagttcagcatgaccgatattgatctgaccaccctcaacatcagcggcagagagctgtgctccctgaatcaggaagattttttccagcgggtgccgagaggcgagatcctatggagccatctggagctgcttaggaaatatgttctggcctctcaggagcagcaaatgaatgaaatcgtgaccatcgaccaacccgtgcagatcatcccggcttccgtacaaagtgccacacctaccacaattaaggtcatcaactccagcgccaaggctgccaaggttcagagggctcccaggattagtggcgaagacaggtcaagcccgggaaaccgcacaggtaacaacggacagatccaactatggcagttcttactggagctccttaccgacaaagatgcaagagactgtattagttgggtgggcgacgagggcgaattcaagttgaatcagcccgagctcgtagctcagaaatggggccaaagaaagaataaacccactatgaactacgagaagctctccagggcactcagatactactacgacggcgacatgatttgcaaggtgcaggggaagcggttcgtgtacaagttcgtgtgtgatctgaagacactgattggctatagcgctgcagagctaaacagactcgttacagaatgcgaacaaaaaaagttggcaaaaatgcaactgcatgggatagcccagccagtcaccgcagttgccctggcaacagctagtctacaaaccgaaaaggacaactag

SEQ ID NO: 224145 - DNA, 2163 bp, Artificial Sequence
  Description of Artificial Sequence: Synthetic coding sequence
atggctcagggcctggaggtggcacttactgacctgcaatctagccgcaacaacgtgcgccatcacacagaggaaataacagtggaccacttactggttcggaggggacaagcgttcaacttgaccctatatttccggaataggtccttccagcccggtctggataacatcattttcgtggtggagactggcccactacctgacctggcattgggcacaagagccgtcttcagcctggctagacatcacagtccaagtccgtggatcgcgtggctggaaactaacggtgccacctctacagaagtttctctgtgtgcccctcctacggcagccgtgggacggtacctcctgaagatccatatcgattcgttccagggttcagtgaccgcttaccagttaggagagttcatactgttgttcaatccctggtgcccagaggatgctgtttatctggactccgagccgcagcgccaggaatacgttatgaatgactacggtttcatttatcaaggctctaaaaactggataaggccgtgcccttggaattacggtcagttcgaggataaaatcatcgatatctgtctaaagttgctcgacaagtcgctccacttccagaccgaccctgcaactgattgcgccttacggggtagtcccgtctatgtgtctagagtcgtatgcgccatgatcaattcgaatgacgacaacggagtgctgaacggcaattggagtgaaaattatacagatggggctaacccggcagagtggaccggctcggttgccattctcaagcaatggaacgccacaggttgccagccagtgcgttacgggcaatgttgggttttcgcagccgtgatgtgtaccgtcatgcgctgtttagggatccccacccgcgtaataactaacttcgacagcggccacgataccgatggcaacctgatcatcgacgagtattatgacaacacgggcaggatcctgggcaacaagaaaaaggacaccatatggaatttccacgtttggaacgagtgttggatggctcgcaaggacctgccaccagcttacgggggatggcaggttctggacgccactccccaggagatgagtaatggggtgtactgctgtggccctgcctcagtgagggccattaaagagggcgaggtcgacctgaactatgacacaccattcgtcttctcaatggttaatgcagattgcatgtcttggttggtccagggcggaaaagaacagaagctccatcaagacacttcatcagttgggaattttataagtactaaatcaattcagagtgatgaaagagatgacattaccgagaactacaagtacgaggaaggctcactgcaggagagacaggtgttcctcaaagctctccagaaattaaaagcacggtccttccacgggtcccagagaggagcagagctgcaaccaagcaggcccaccagtctctcacaggatagcccaagatccttgcatacaccatcactcaggccaagtgacgttgttcaagtctctctgaagtttaaactcttagaccccccaaacatgggacaggatatctgcttcgtgctcctggccctgaatatgagtagccaatttaaggacctcaaggtgaatctgagtgcacagagtttactacatgatggctctcccttgtcacctttttggcaagatactgctttcatcactttatcacctaaagaggccaagacatacccatgcaaaattagctatagccagtatagccagtacctctcgaccgacaaacttatacggatttctgcattgggtgaggagaagagcagccccgaaaagattctggtgaacaagattatcaccctctcctacccctcaattactatcaacgttcttggagcagctgttgtcaaccagcccttgagcatccaggttatcttcagtaacccactgtctgaacaggttgaggattgtgtgctgacagtagaagggtctggcctctttaagaagcagcagaaggttttcctgggcgttcttaagcctcagcatcaggcatcaatcattctcgagaccgtgcccttcaaatctggccagagacagatccaggccaatatgaggtccaataaattcaaggacatcaagggttatcggaatgtctatgttgacttcgcactttag

SEQ ID NO: 224146 - DNA, 1047 bp, Artificial Sequence
  Description of Artificial Sequence: Synthetic coding sequence
atgtctcttgtcgacctcgggaagaagttgctcgaggccgctcgggctggtcaggatgacgaagtgagaattttgatggctaatggggcacccttcacaaccgattggctgggaacttccccattgcacctagccgcacaatatgggcattactcgactactgaggtgctgctgagggcaggagtatcgcgggatgcccgaactaaagtggaccggactccactccacatggcggcaagcgagggccacgctagcattgtggaagtcttgctgaagcatggggcagatgtgaacgcaaaggatatgctgaaaatgactgcgctccattgggctactgagcataatcaccaggaggtagttgagctcctgatcaagtatggagccgatgtgcacacccagtccaagttttgcaaaactgctttcgacatttccattgataacggcaacgaggatctggcagaaattctccagattgcaatgcagaatcaaataaatacaaacccggagtcccctgacacagttaccattcacgctgccaccccccagttcatcatcgggccaggcggagtcgtgaacctgaccgacgagacaggcgtgagtgccgtgcagtttggcaactcctcaacttccgtactggccacattagctgccttggccgaggcttcggcaccgctcagcaactctagcgagacaccggttgtggccacggaagaggtggtcactgcggaatcagttgatggagcaatacaacaggttgtttcctcaggcggacagcaggtgattaccattgttaccgacggaatccagctgggcaacttacatagcatccctaccagcggaattggccaaccaatcattgtgacaatgcctgatggacagcaggtgcttacggtgccggcaactgatatcgcggaagagactgttataagcgaggaaccccctgcaaagcgtcagtgcatagaaatcatagagaacagagttgaatccgctgagattgaggttaggagcctcctcccaggcgtcttgtgcaggagccacccaaaatag

SEQ ID NO: 224147 - DNA, 1152 bp, Artificial Sequence
  Description of Artificial Sequence: Synthetic coding sequence
atgtctcttgtggacctgggaaagaagctactagaagcggctagggctggccaggatgacgaggtacgcattctgatggccaacggggctccgttcacaacggactggttggggacgtcaccgcttcacctggcagctcagtatgggcactattccaccactgaagttctgttgcgcgctggagtttctagggatgccagaacaaaggtcgatcggacccctttacacatggccgcatctgaggggcatgcgtccatcgtcgaagtgctactcaagcatggcgctgacgtcaatgcgaaggacatgctgaaaatgactgcccttcattgggccactgagcacaaccaccaggaggtggtagaattactgatcaagtacggcgctgatgtacatacccagtcaaagttttgtaagacagctttcgacatttctatcgataatggcaacgaagacctggctgagatactccagattgcaatgcagaaccagatcaatacaaaccctgagagtcctgatactgttacaattcacgccgcaactcctcagttcatcatcggccctggcggtgtcgtaaacttaaccgacgagaccggagtatccgcggtacagtttggcaacagctctacctccgtcttggccacgctggctgcgctagcggaggcatctgccccactgtccaactcttctgaaacaccagtagttgcaacagaagaggtggtgacggccgagtcagtggatggtgccatccagcaggtggtatcctctgggggacaacaggtaattactattgtgaccgatggcatccaactggggaacctgcatagcatcccaacaagcggaataggccagccgatcatagtcacaatgccggacggccaacaagttctgacagtgcccgcaaccgatatcgccgaggaaaccgttataagcgaagaaccccctgcaaagcggcagtgcattgagataattgagaacagggtggaatccgcggaaattgaagagcgcgaggctctacagaagcagctcgatgaagctaatcgcgaggcccagaaatacaggcagcagctgctgaaaaaggagcaggaagctgaagcatatagacagaaacttgaggccatgacacggctccaaactaataaggaagctgtatag

SEQ ID NO: 224148 - DNA, 1047 bp, Artificial Sequence
  Description of Artificial Sequence: Synthetic coding sequence
atgtcattagtggacttgggaaagaagctgctcgaagccgcacgggctggccaggacgatgaagtgcgtatcctcatggctaacggcgcaccgtttaccactgactggctcgggacgagtccactgcatctcgccgcacagtatgggcactactccaccaccgaggtgctgctccgggcaggagtatcgagggacgctcgaacaaaggtcgacagaacccctcttcatatggctgccagcgaaggccacgcaagcattgtggaagttctcctcaaacacggagcagacgtcaatgccaaggatatgctgaagatgaccgcactccattgggcgactgagcacaaccaccaggaagttgtggagttactgatcaaatacggggctgatgtacacacacaatccaaattctgcaaaacagcctttgacatctcgattgacaatggaaacgaggatctcgcagaaatcctacagatagcaatgcagaaccagatcaataccaacccagagtctcccgatactgtgactattcacgccgctactccccagtttattattggcccagggggagtagtgaatctaacagatgaaacaggagtgtcagcggtccaatttggcaatagcagcacctcagtcttagctaccctggctgccttggccgaggcgtcggcccctctttcaaacagctccgagacaccagtggttgcaaccgaggaggtggtgaccgccgagagtgtggacggtgccatacagcaagtggtctccagcgggggacagcaagtgattacaatcgtaaccgatgggatccagttggggaatctccactccatcccgacgagtggtatcgggcagccaattatcgtgactatgcccgacggacagcaagtattaacggtgcctgcgacagatatagccgaggaaaccgtaattagcgaggagccaccagctaaaagacagtgcattgagataatcgaaaatagggtggagagtgctgaaattgaagtgcggagcctgcttccaggagtcttgtgtcgcagccatccaaaatag

SEQ ID NO: 224149 - DNA, 1083 bp, Artificial Sequence
  Description of Artificial Sequence: Synthetic coding sequence
atgagcttggtggacctgggcaagaagctcctggaagccgcaagggccggacaggacgacgaggtgcggatcttgatggccaacggcgctccatttactacagactggctggggaccagtcctttgcacctggctgcacaatacggacattacagtactacagaggtgctgttgagagccggagtatctcgagatgccagaacaaaagtggatagaactcccctgcacatggccgctagcgaagggcacgcctctatcgtcgaggtgctcctaaaacacggagctgatgtgaacgcaaaggatatgcttaagatgacagctctgcattgggccaccgagcacaaccaccaggaggtagtggaactcctaatcaaatatggagctgatgtgcacactcagtccaaattctgcaaaacggcctttgacatatcaatagataacggtaacgaagaccttgccgagattctgcagatcgccatgcagaaccagattaataccaatcctgagtctccagataccgtgactattcatgctgccacacctcagtttattataggtcccggtggcgtcgtgaatctcaccggcctggtgtcttcggagaatagcagtaaggccaccgatgaaactggggtttctgctgtacaattcggtaattcgtctacctctgtgctggcaaccttagctgcactagccgaagccagtgccccactgtcaaattccagcgaaacaccggtagtggcgacagaggaggtagtaaccgctgaatctgtcgatggcgctatccagcaggttgtctcgtctggtggccagcaagtgatcaccatcgtgacagacggtattcagctgggcaatctacatagcatcccaacttccggtatcggtcagcctatcatcgtgaccatgcccgatgggcagcaagtgcttacggtacccgcaacagacatcgccgaggagaccgtaattagcgaagagcctccagctaagagacagtgcattgaaattatcgagaatagggtggagagcgccgagatcgaggttaggtccctgctgccaggagtcctctgtcgttctcatcctaaatag

SEQ ID NO: 224150 - DNA, 270 bp, Artificial Sequence
  Description of Artificial Sequence: Synthetic coding sequence
atgtccctggtggacttaggcaagaagctgctggaagccgctcgcgctggccaagacgacgaagtgagaattttaatggcaaatggtgctcctttcaccaccgactggctcggcacgagtccactccatctggccgcacagtatggccactattccaccacagaggtcttgctgcgtgctggagtgagtcgagacgcaaggactaaggtcgaccgcaccccacttcacatggccgcttcagaaggccatgctagcatcgtggaagtatag

SEQ ID NO: 224151 - DNA, 270 bp, Artificial Sequence
  Description of Artificial Sequence: Synthetic coding sequence
atgtccctagtcgacctgggtaaaaaactgctggaagctgcacgagcgggacaggacgatgaagtgcgcattctgatggctaacggcgctccttttactacagactggctcggaacaagtcctctgcatctggccgctcagtacggacattacagcaccacagaagtcctcctgagggctggagtgtctagagacgccagaaccaaagtagataggacaccattgcacatggcggcttccgagggacacgcctccattgtggaagtctag

SEQ ID NO: 224152 - DNA, 354 bp, Artificial Sequence
  Description of Artificial Sequence: Synthetic coding sequence
atgaaattcgtgtacaaggaggagcacccatttgagaagcgacgctctgagggcgaaaaaattcgcaagaaatacccggaccgggtgcctgtgatagtggagaaggctcccaaggcccgaatcggcgatctggacaaaaaaaagtacttggtacccagcgaccttacagtgggacaattttacttcctcattcggaagcggattcacctacgtgcagaggatgctctgtttttcttcgttaataacgttatacctccgacctctgccactatgggtcagttgtatcaggaacatcatgaagaagactttttcctatacatcgcttacagtgatgagtctgtttatggcctgtag

SEQ ID NO: 224153 - DNA, 354 bp, Artificial Sequence
  Description of Artificial Sequence: Synthetic coding sequence
atgaaatttcagtataaggaggatcacccgttcgaatatcggaagaaggaaggagagaaaatccgcaagaaatatcctgatagagtgcctgtaatcgtggaaaaagcccctaaggccagggtcccggatcttgataagaggaagtatttggttcctagcgacctgaccgttggccagttctactttttgattaggaaaaggatacacctcaggcccgaggatgcactgtttttcttcgtcaataatacaataccacctaccagtgctacaatggggcagctttacgaggacaatcacgaagaggactatttcctgtatgtcgcgtacagcgatgagagcgtatatgggaagtag

SEQ ID NO: 224154 - DNA, 441 bp, Artificial Sequence
  Description of Artificial Sequence: Synthetic coding sequence
atgaaattccagtacaaagaagaccaccccttcgaataccggaagaaggaaggtgaaaaaattaggaagaagtatcccgaccgagtgccagttattgttgaaaaagccccaaaagctagggttccagatttggataagcgcaaataccttgtgccaagtgacctcaccgtgggtcagttttactttcttatccggaaacgcatccatcttaggcccgaagacgctctcttcttctttgtgaataacacgatcccccctacgtcggccacaatggggcagctgtacgaggtaatggtgctagtggcccaatactggatgcctagctctgctgtgtggcatcctctggccctcgtgctcgacgcattgatcacccacctccgctcgggcgctgagggcgtgatttaccctgaccctcttacttatggcagtgtgcgcctgtag

SEQ ID NO: 224155 - DNA, 441 bp, Artificial Sequence
  Description of Artificial Sequence: Synthetic coding sequence
atgaagttccagtacaaagaggatcatccttttgagtatcgcaagaaagaaggagaaaaaatccgcaagaagtatcctgatagggtcccagttattgtggaaaaggccccaaaggccagagtgcctgacctcgacaaacggaagtaccttgtgccaagcgaccttacggtgggtcagttctatttcctgatacgaaagaggatccacttgcgaccagaggacgctctctttttctttgtgaacaatacaattccacccacatctgctactatgggccagttgtatgaggtgatggtcctcgtcgctcaatattggatgccctcttcggcggtgtggcatcctctggctctggttttagatgccttgattacccacttaagatccggcgctgagggggtcatctatccagatcctctcacatatggcagtgttcgcctgtag

SEQ ID NO: 224156 - DNA, 213 bp, Artificial Sequence
  Description of Artificial Sequence: Synthetic coding sequence
atgaaatttcagtacaaggaagatcacccatttgaatatcgcaaaaaggagggggagaagattcgaaagaaatatccagaccgggtccctgtcatcgttgagaaagcccctaaagcgagggtgcccgatcttgacaaaaggaaataccttgttccatccgaccttacagtgggacagttttattttctcataaggaagaggatccacctctag

SEQ ID NO: 224157 - DNA, 354 bp, Artificial Sequence
  Description of Artificial Sequence: Synthetic coding sequence
atgaagttccagtacaaggaggatcacccttttgagtatcgaaagaaggagggggaaaagattcgcaaaaaatacccggatagagtgccagtcatcgtcgaaaaggctcccaaagctagagtgcctgacctcgacaaaaggaaatacctcgtgccctctgacctgaccgtggggcaattttatttcctgattaggaaacggattcacctccgcccagaagacgcactgttcttctttgtgaacaacacgattccccctacctccgccaccatgggacagctgtacgaagacaatcatgaggaggactactttctctacgttgcctactctgacgagagcgtctacggcaaatag

SEQ ID NO: 224158 - DNA, 354 bp, Artificial Sequence
  Description of Artificial Sequence: Synthetic coding sequence
atgaaatggatgttcaaagaagaccattctctggaacaccggtgtgtagaaagcgccaagatccgcgctaagtatccagatagggtgcccgtcatagttgaaaaggtgagtgggtcccagatcgtcgacatcgacaagagaaaatacctggttccatccgacatcactgtcgcccagtttatgtggatcattagaaaaaggattcagctgccatcagaaaaagcgattttcttgttcgtggacaagacagtaccacagtccagcctcacgatgggtcagctgtatgagaaagagaaagatgaggatgggttcctgtacgtagcctattccggggaaaacacattcggattctag

SEQ ID NO: 224159 - DNA, 1344 bp, Artificial Sequence
  Description of Artificial Sequence: Synthetic coding sequence
atgcccgtcctatatgacagattgctgaaactcaaagaaatgttcaattcgaagttcggcagcatcccgaagttttatgtgcgcgcacccggtagggtgaacataatcggggagcatatcgattactgtgggtacagcgtgttgccaatggctgtggagcaggatgtgttaatcgccgtggagcccgtaaagacttatgcccttcagttagcaaacactaacccactgtaccctgacttctccacaagcgccaacaacatccagatcgacaagacgaaacccctctggcacaattacttcctatgtggcctgaagggaatccaggagcatttcggtttgagtaatctgaccggaatgaactgtttagtcgacggcaatatccctccctccagtggacttagctcttctagcgcactcgtgtgctgcgccggacttgtcacactgaccgtcctcgggaggaacctgagtaaggtagagctagctgagatatgtgccaagagcgagcggtacatcggcactgagggcggagggatggatcagtctatttcatttctcgccgaagaggggacagcgaagctcatagaatttagcccgctgcgagccaccgacgttaagctgccttcaggtgccgtcttcgtcatcgccaacagctgcgtggagatgaacaaagccgcaacttcacattttaacatccgagtgatggaatgtagactcgccgcaaagctgctggccaagtataaatccctgcaatgggataaggtgctgagactggaggaggtgcaggcaaaattaggaatcagcctcgaagagatgctattggtaactgaggatgcactccatccagagccctacaatcccgaggagatctgccgatgcctcgggatttcactagaagagctgcgaactcagatactcagccccaatacccaggacgtgttaattttcaagttgtaccagcgggctaaacacgtctattccgaggcagcccgtgtgttgcaattcaagaaaatttgtgaggaggccccagaaaatatggtgcagctcttgggagagctcatgaaccagagccacatgtcttgcagagatatgtacgagtgttcatgccccgagctggaccaactagtcgacatttgccggaagtttggcgctcaggggtctaggctcaccggggctggatggggtggttgtaccgtcagtatggttcccgctgataagctgccgtccttcttggccaacgttcacaaagcctactatcagcggagcgatggctcactcgctccggagaaacagtccctgttcgctactaagcccggaggtggcgctctagtcctcctggaagcctag

SEQ ID NO: 224160 - DNA, 1305 bp, Artificial Sequence
  Description of Artificial Sequence: Synthetic coding sequence
atgttcaatagcaaattcggatctatccccaagttttacgtgcgcgcacctgggagggtcaatattattggtgagcacatagattactgcggatatagcgtgctgcccatggccgtcgaacaagacgtgctgatcgctgtggagcccgtgaagacgtacgccctccagctggccaacacaaatcccctttatcccgacttcagcacgtcagccaacaatatacaaattgacaagacaaagccactgtggcacaattattttctctgtggcctgaaaggcatccaagaacattttggcctgtccaatcttacaggcatgaactgcctcgtggacggaaacatcccaccgagtagtggattgagttccagtagcgccctagtgtgctgtgcaggattggttaccttaactgtcctggggagaaacttgtcaaaagtagaacttgcagaaatctgtgccaaatcggaaaggtacatagggactgaaggtgggggaatggatcagtcaatctctttcctggccgaggagggcacagctaagctgatcgagttcagtccgctgagagccactgatgtgaaactgcccagcggagcagtgttcgtgattgctaactcatgtgtggagatgaataaagctgctactagtcattttaatatacgggtgatggagtgcagactggccgcaaagctgctggccaagtacaagtccctccagtgggacaaggtcctgagattagaggaggtccaggcaaagctgggaatttctctagaagagatgctgctagtaaccgaagacgctttgcacccggaaccctacaatcctgaggagatctgtcgatgcttgggcatttccctggaggaactaagaacccagatcctctccccaaacacacaggatgtcctgattttcaaattatatcagcgtgccaaacacgtttacagcgaggctgcgagagttcttcagttcaaaaaaatttgtgaagaggcccctgagaatatggtacaactcctgggagagctgatgaaccaaagccacatgagctgtagagacatgtatgaatgcagttgtcctgaactcgaccaactcgtggacatttgtcgtaaattcggagcgcagggctcacggcttaccggtgccggttggggcggatgtaccgtcagcatggtccccgctgataaactgccgtccttccttgccaacgtgcacaaagcctactatcagagatctgatgggtctcttgcaccagaaaaacaatcactgttcgccacaaaacccggagggggtgccctggtgttgctcgaggcctag

SEQ ID NO: 224161 - DNA, 624 bp, Artificial Sequence
  Description of Artificial Sequence: Synthetic coding sequence
atgaactgtctggtggacggaaacattccaccctcttctggcctgtccagctcatccgcactggtgtgttgcgcaggattagtcacattaacagtgctggggaggaacctttctaaagtagagctagcagagatttgcgctaaatctgaacgctatattggcacggagggcggtggaatggaccagtctatcagcttcttagctgaggaggggacggctaagctcatcgaattctctccacttagagccaccgatgttaaacttccctctggcgctgtttttgtgatcgccaattcgtgcgttgagatgaacaaagccgctacctcccattttaatatcagagtgatggagtgcagactcgccgctaaattacttgccaagtataaaagtctgcaatgggataaagtcctgaggctggaggaagttcaggccaaactggggatcagcttagaggaaatgttgctcgtcacagaggacgccttacacccggagccttacaatcctgaggaaatatgccgatgcctgggtatttctctggaggaactgaggacacaaattctgtcccccaacacccaggacgacggggtggtgctctatcgccctgggtggtcagcaaccgcctag

SEQ ID NO: 224162 - DNA, 1305 bp, Artificial Sequence
  Description of Artificial Sequence: Synthetic coding sequence
atgtttaactccaaatttggatccatccctaagttttatgtgcgggctccagggagagtgaacatcataggcgagcacatcgactactgtgggtattccgtactcccaatggcggtggaacaggacgttttaatagccgtcgagcccgttaaaacctatgccctgcaactggccaatacaaaccccctttatcctgacttttccaccagcgcgaacaacatacagatcgacaaaacaaaacctttatggcataattatttcctttgtggcctaaagggtattcaggaacactttggactgtccaacctgacagggatgaattgtcttgtcgacggtaatataccaccatcatcaggtctgtcatcttccagcgcacttgtgtgctgtgcaggtctagtgactctcaccgtgctgggacgcaacttgtctaaagtcgagctggcggaaatctgcgctaagtcagagcgttatataggcacagaggggggtggaatggatcagtccatcagcttccttgcagaggaaggaacagctaagttgatcgagttctctcctctacgggctacagatgttaagctcccatccggagctgtctttgtaattgccaattcatgcgtcgaaatgaataaagccgctacatcgcactttaacataagagtgatggaatgccgcctggcagccaagttgctcgcaaagtacaaatccctgcagtgggataaggtgcttagacttgaagaggtgcaggctaaactaggcatcagcctggaagagatgctactggtcaccgaagacgcactccaccccgagccatacaatccagaagagatctgtcggtgcctaggcatcagtctggaagaactccgaacgcagatcctgagccccaatacacaggacgtcttgatcttcaagctgtaccaacgggcaaagcatgtatactccgaagcagcgcgtgtgcttcagtttaaaaaaatttgtgaagaggccccagaaaacatggtgcagctgttgggagaactgatgaaccaatcccatatgtcgtgtagggatatgtatgagtgcagctgcccagaactggatcagctggtggatatctgcagaaagttcggagcccagggatctaggctgactggcgcaggttggggcggatgcactgtgagcatggtccccgcagataaactcccgtctttcttggcaaacgttcacaaggcttattatcagaggtccgacggttcactcgcacctgagaagcagtccttattcgcaacaaaaccgggagggggtgcactggtgctgctggaagcttag

SEQ ID NO: 224163 - DNA, 1305 bp, Artificial Sequence
  Description of Artificial Sequence: Synthetic coding sequence
atgtttaattcaaaattcggatccatccccaaattctacgtcagagctccaggaagggtcaacatcataggtgagcacattgactattgcggctattcagtgttgcctatggcggtggagcaggatgtgcttatcgccgtcgagcccgtgaagacttacgccctgcaactcgcgaataccaatcctctatatcctgactttagcacatctgccaacaatatccagatcgataaaacaaaacctttatggcacaattatttcttgtgtggcctgaagggcatccaggaacacttcggactctccaaccttacaggaatgaattgcttggtggatggtaatattccaccgagctccggtctgtcatcttcaagcgcattagtgtgctgcgccggactggtgacgctgaccgttctaggcagaaacttgtctaaggtggagctcgccgaaatatgtgctaaatccgaacgttacattggaaccgaagggggagggatggatcagtctatttctttccttgcggaagagggcaccgccaagctgattgaattctcccctctgcgcgctacagacgtcaagttaccatccggcgctgtgtttgttatcgccaactcctgcgtagagatgaacaaggcagctacttcccacttcaacattagggtgatggaatgtcgcttagcagctaagttgctcgccaagtacaagagcctgcaatgggataaagtgctgaggcttgaggaagttcaggcaaaactggggatttccttagaggaaatgttgcttgtgaccgaagacgctctgcacccagaaccatataaccccgaagagatctgccgttgcctggggatctcgttagaagaacttcgcacacagatcctgtcaccaaacacacaagatgtgttgatctttaaactgtaccagagagcgaagcacgtctacagcgaagccgctagagtgctgcagttcaagaaaatttgtgaagaagcccctgagaacatggtccagcttctgggtgagctcatgaaccagagccacatgtcttgcagggacatgtatgaatgttcgtgcccggagttggatcagttggtggatatttgtcgaaaattcggcgcacaaggcagtagactgacgggtgcaggctggggaggctgtacagtaagtatggtccccgctgacaaattgccctcattcctggcgaacgtgcacaaggcatactatcaacgaagtgacggtagcctggccccagagaaacagtcactgttcgccaccaagcctggcggaggggctttagtgttgctggaggcatag

SEQ ID NO: 224164 - DNA, 1377 bp, Artificial Sequence
  Description of Artificial Sequence: Synthetic coding sequence
atggccacagagagtcccgcaactcgcagggtgcaggtggcagagcaccccagactgctaaaattgaaggagatgttcaacagcaaattcggctccattccaaagttttatgttagggctcccggtagagtgaacatcatcggggagcacatcgactattgtggatatagtgtgttacccatggcagtggagcaagatgtactgattgcagttgagccagttaagacctacgctttgcagctggccaatacgaaccctctgtatccggacttctctaccagtgctaacaacatccagattgacaaaacaaaaccattgtggcacaactatttcctgtgtggtctcaaaggcattcaggaacactttgggctgagcaacttgaccggcatgaactgcctggtcgatggtaacattccccctagctcaggcctttctagctcaagcgccctggtctgttgcgcaggactcgtcaccttaacagttctggggagaaacctgagcaaggttgagctggcagagatttgtgccaaatccgagaggtatatcggcacggaagggggaggaatggaccagtctatctcttttctggctgaggaaggaaccgccaagctgatcgaattttccccacttagggccacagatgtgaaattgccatcaggcgctgtctttgtgattgccaacagttgcgtggaaatgaataaggccgcaacctctcattttaatattcgagttatggagtgtcgactggctgctaaactgctcgccaagtataaaagtcttcaatgggacaaagtgcttagactggaggaagtccaagcaaaactaggcatatccttagaagagatgctcttggtgactgaagatgcactgcatcctgaaccgtacaaccccgaagaaatatgccgatgtctgggcatctccttagaggaactgaggactcagattttatctccaaatacacaggacgtcttgatttttaaactgtatcagcgggctaaacacgtttactccgaagctgcgagggtcctccagtttaaaaaaatttgcgaggaggcacctgaaaatatggtccagctgctcggtgagctaatgaatcagtcacatatgagttgtcgagatatgtatgagtgcagctgtcccgagctggaccaacttgttgatatttgccgcaaattcggcgcacagggtagccgcttgacaggcgctggatggggtggctgtactgtgtcgatggttcctgcggataaactgccttcatttctcgcaaatgtgcacaaagcctactaccaaagatcagatgggagcctagccccagagaagcagagcctgttcgccacaaagcctggagggggtgcactggtattgctggaggcatag

SEQ ID NO: 224165 - DNA, 1272 bp, Artificial Sequence
  Description of Artificial Sequence: Synthetic coding sequence
atgctacctccccagaagaagccttgggagagtatggcaaagggactggtcctgggagccctatttacaagcttccttctcttagtctactcttacgcagtaccccctctgcacgctgggctggcctccaccacccccgaggcggctgccagctgctctcccccagctctcgagcctgaagcagtgatccgggcaaatggctctgcaggtgagtgccagccacgaagaaacatcgtgtttctcaaaactcataagacagcaagctccacattgttgaatattctcttccggttcggccagaaacacagactgaagttcgcattccccaacgggaggaacgattttgactatcctacattttttgctagatctcttgtccaggactacaggcctggcgcttgctttaacattatatgcaaccatatgcgattccactacgacgaggtcaggggcttagtcccaaccaatgctatcttcattactgtgttgcgggatccagcgagacttttcgaaagttcattccattactttggcccagttgtcccactgacttggaaactgagcgctggagataagcttactgagtttcttcaggaccccgaccgatactacgaccccaatggctttaatgcccactaccttaggaatctgctgttcttcgatctcggatatgacaatagcctcgacccttcttcgcctcaggtacaggagcacattctggaagtagaacggaggttccacctagttctgctgcaagagtattttgacgaatcattggttcttctaaaagacctgctgtgttgggaacttgaggacgtcctgtactttaagttaaacgcaaggcgcgatagtcccgtcccacgcttgtccggcgagttatacgggagggccaccgcctggaacatgctggactcccatttgtaccggcacttcaacgcctcattttggcgaaaagttgaagcctttggacgggaaagaatggccagagaggttgccgctctgagacacgccaatgagcggatgaggactatttgcattgacggaggacacgccgtcgacgccgctgctatccaggatgaagcaatgcagccatggcaacctttgggaaccaagtctatcctgggatacaatttaaagaaatctattggccaaaggcatgcacagctgtgccggagaatgcttacgcccgaaatccaatacctgatggacctcggggcaaatctttgggtgaccaaattgtggaaatttatccgcgacttcctcagatggtag

SEQ ID NO: 224166 - DNA, 1272 bp, Artificial Sequence
  Description of Artificial Sequence: Synthetic coding sequence
atgttgccgcctcaaaaaaagccatgggaatccatggcaaaggggcttgtgctgggggcactgttcacatctttccttctgcttgtttattcctatgctgtccccccacttcacgcgggactggcgtcaacgacccccgaggccgctgccagctgcagccctcccgctctggaacctgaagctgtgatcagggcgaatggctccgccggtgaatgtcagccacggcgaaatatagtgtttctgaagactcataaaacggcttcatctacccttctgaacatactgttcaggtttgggcaaaagcatagactcaaatttgcattcccgaatggtaggaatgattttgactaccccaccttctttgcgcgatcattagtccaagactaccgccctggggcatgttttaatataatctgtaatcatatgaggtttcattacgacgaggtcaggggcctagtccccacaaacgctatctttataactgtattgcgcgacccggcacgcctcttcgagagcagctttcattactttggacctgtggtcccactcacctggaagctgtctgcgggtgataaactcacagagttcctgcaggatcctgaccgctattatgaccctaatgggtttaacgcccactatctcaggaatctgctgttcttcgacctgggttatgataatagcctggatcccagtagcccgcaggtgcaggagcatatcctcgaggtagaacgcagattccacctggtgttactgcaggagtattttgatgaaagcctggtgctgctgaaagatctgttgtgctgggaactggaggatgtgctgtactttaaactgaacgctcggcgagattcgcctgtaccaagattaagcggagagctgtacgggcgtgcaactgcatggaacatgctggattcacatctgtaccggcactttaatgcaagtttctggagaaaagtagaagccttcggcagggaacggatggccagggaggttgccgctttgagacatgcgaacgagcgcatgcgtacaatatgcatcgacggagggcatgccgttgacgcagctgctatccaagacgaagcaatgcagccttggcaacccctgggtactaagtccattctgggatataatctgaaaaaatccataggacaacggcatgcccagctttgcaggcgtatgctcacccccgagattcagtacttgatggatctgggggcaaatctatgggtgacgaaactgtggaagttcatacgcgatttcctgcgatggtag

SEQ ID NO: 224167 - DNA, 1272 bp, Artificial Sequence
  Description of Artificial Sequence: Synthetic coding sequence
atgcttccccctcagaagaagccttgggagtctatggctaagggattagtgctgggtgcactgtttacaagctttcttctgctagtgtattcctacgcagtgccccctctgcacgcaggccttgcctctactactcctgaagccgcagcaagctgcagcccccctgcgctggagcccgaggccgtaatccgagccaacggaagcgcaggcgagtgccagcccagaagaaatattgtgtttttgaagacccacaaaaccgcatcctcaacgctgctcaatatcctctttcggtttgggcagaagcatcgcctcaagtttgctttccccaacggacgtaacgattttgattatcctacattcttcgcacgttccttagtacaggactatcggccaggcgcttgtttcaacataatctgcaatcatatgaggttccattatgacgaggtgcggggactcgtccccacgaacgctatcttcatcacagttctccgtgatccagcgaggttgttcgagtcaagcttccattacttcggccctgtggtgccactgacatggaagctatccgccggagataaactgaccgagttcctgcaagatcctgacaggtattacgaccctaacggcttcaatgcccattatcttagaaaccttctgttcttcgatcttggatacgacaattctttggaccccagtagcccacaggtgcaggaacacatcctggaagtggagcggcgattccacctggtactgctccaagaatatttcgacgaaagtctggttctgctgaaagatctgctgtgttgggagcttgaggacgtgctgtatttcaaactgaacgcccgacgggattcccctgtccctcgcctctccggggagttatacgggcgagccacggcttggaacatgcttgattcccacttgtacagacacttcaacgcatccttttggaggaaggttgaggcattcggtcgtgaacgcatggctcgcgaggtcgcagctttgaggcacgcaaacgagcgcatgaggacgatctgtatcgatggcggacatgctgtggacgccgcagccattcaggatgaagccatgcagccatggcagcccctgggcaccaagtccatcctggggtacaatctgaagaagtccatcggccagagacacgcccagctgtgccgccgaatgctcactcccgagattcagtatttgatggacctgggagctaacttgtgggttaccaaattgtggaagtttattcgggacttcttgcgctggtag

SEQ ID NO: 224168 - DNA, 1272 bp, Artificial Sequence
  Description of Artificial Sequence: Synthetic coding sequence
atgctgcctccacaaaagaagccctgggaaagtatggctaaagggcttgtgctgggagcactgttcactagtttcctacttctcgtatacagttacgcagttcctcctttacacgcaggacttgcttccaccacccccgaagccgctgcctcttgttcgcctcctgccctcgagcccgaagcggtcattagagccaatggctctgctggggagtgccagcccaggcgaaatatcgtgtttttgaagactcacaagaccgcaagctccaccctgctgaatattctatttcggttcggccagaaacacaggttgaaattcgcgtttcccaacggcaggaatgactttgactatcctacattcttcgcacgctctttggttcaggattaccgtccaggtgcatgtttcaacatcatttgtaaccacatgagattccattacgacgaggttcgcggactcgtccccactaatgcaatcttcattaccgtcctgagggaccccgctcgcctctttgaatcatcattccactactttgggccagtggttcctctcacctggaagctgagcgctggcgataagctcacggagttcttacaagaccccgaccgatattacgatcctaacggctttaatgctcattacctccgtaacttactgttctttgacctcggctatgataactccctagatcctagttctcctcaggtgcaagagcacattctcgaggtcgaaagacggtttcaccttgtgctgctgcaggagtactttgacgagtccctcgtgctgctgaaggacctgctgtgttgggaactagaagacgttctatatttcaaattaaatgctagacgcgacagccctgtccccaggctgtctggcgaactgtatggaagggctaccgcctggaacatgttagacagtcacctttaccgtcattttaatgctagcttttggagaaaagttgaggcctttggtagggagagaatggctagggaggtcgcagcactcagacatgcaaatgagcggatgcgtaccatctgtatcgacggcggtcatgcagtggacgcggcagctatccaggatgaagccatgcagccatggcagcctctcgggacaaagagtatcctgggctataacctgaaaaagtctatcggccagagacacgcccagctctgccgtcggatgcttacccctgagatacagtacctgatggacctcggagctaacctgtgggtgaccaagctgtggaagttcatccgtgacttcctgagatggtag

SEQ ID NO: 224169 - DNA, 1272 bp, Artificial Sequence
  Description of Artificial Sequence: Synthetic coding sequence
atgctgccgcctcagaaaaaaccatgggagtctatggctaagggcttggtgttgggagccctgttcacaagttttcttctgctggtgtactcatatgcagtgcccccacttcacgccggattggcctcaacaacccctgaggccgcagcaagttgctcccccccagcactggagcccgaggccgtcatccgggcaaacggatctgcgggagagtgtcagcccaggcgtaacatcgtgttcctgaaaacccataaaactgcgtcttctactcttctgaatattctgttcagattcggacagaaacacaggctgaaatttgcctttccgaatggcaggaacgatttcgattatcccacttttttcgccagatccctcgtacaggattatcggccaggcgcatgtttcaatatcatctgtaaccatatgaggttccactacgacgaagtgcggggtttagtcccgacaaacgccatcttcatcaccgtgttgcgggatccggctaggctgtttgagagtagcttccactatttcgggccagttgtgccgttgacatggaaactgtcagcaggtgacaaattgaccgagttcctccaggacccggataggtactatgatcctaatgggtttaatgcccactatttaagaaatctgctgttcttcgacctgggctacgacaattccctggatccctccagtccacaagtacaagaacacatattagaggtcgaaaggagatttcacctggtgctgctgcaagaatacttcgatgagtccctcgtgctgttgaaagacttgctttgctgggagctggaggacgtcctgtacttcaagctgaatgccagaagagatagcccggttccacgcctgtccggagagttatacgggcgagccacagcttggaatatgcttgactcccatctttatcggcacttcaacgcttctttttggcggaaggtcgaagccttcggtagggagaggatggcgagagaggtcgcagcactgaggcacgctaatgagagaatgcgcactatatgcatcgacggtgggcatgcggtggacgctgcagcaatccaggacgaagccatgcagccgtggcaacccctgggaacaaagtctattctgggctacaacctcaagaaatccatagggcagcgtcacgctcagctgtgccgccgaatgcttactccagagattcaatatctaatggacctgggcgctaacttgtgggtaacgaagttgtggaagttcatcagggacttccttagatggtag

SEQ ID NO: 224170 - DNA, 1272 bp, Artificial Sequence
  Description of Artificial Sequence: Synthetic coding sequence
atgcttcccccacagaaaaaaccgtgggagtccatggctaagggcctggtgctgggggctcttttcacatcgtttttgctactggtgtactcctacgcggtccctcccttgcacgccggacttgcctccacgacccccgaagcggcagccagttgttcacctcccgctttggaacccgaggccgtgattcgggcaaatggctccgccggtgaatgccagcctcggaggaacatcgtgttcctgaagacccataaaacggcctctagtacccttctgaacattctgtttcgctttgggcagaagcacaggctgaaattcgcctttcccaatggaaggaacgattttgactatccaacatttttcgcgagatctctggtccaggattaccgccctggcgcttgcttcaacattatctgcaaccacatgcgcttccattacgatgaagtgcggggactggtaccaaccaacgcgatcttcatcacagtgctacgcgaccccgctcggttattcgaatccagcttccattattttggcccagtcgtcccactgacttggaagctctctgccggtgacaaacttacagagtttctccaggacccggaccggtactacgatccgaatgggtttaacgcccactacctccgcaacctactcttctttgacctggggtatgacaattctctggacccctcctcccctcaggtccaggaacatattcttgaagtggaaaggcgcttccatttggttttgctccaggagtatttcgatgaatctctggtcttgcttaaggatctgttatgttgggagctggaagacgttctttactttaagctgaatgcccgacgcgactccccggttcccaggctctctggggaactctatgggcgagcaaccgcgtggaatatgctggatagccatctttaccgacactttaatgcttctttttggcggaaagtggaggcgttcgggcgagagcgtatggcgagggaggtcgcagccttgcgccatgccaatgagcggatgcggacaatctgcatagatgggggacacgccgtagatgccgcagcgatccaggacgaggcaatgcaaccttggcagcctttaggtacaaagtctattttggggtacaacctgaaaaaaagtatcgggcagcggcacgctcagctgtgccgaagaatgctgactccagagatccagtacttgatggatctcggcgctaatctgtgggtgaccaagctctggaagttcattcgcgatttcctcagatggtag

SEQ ID NO: 224171 - DNA, 258 bp, Artificial Sequence
  Description of Artificial Sequence: Synthetic coding sequence
atgttaccacctcaaaagaaaccgtgggaatctatggcaaagggccttgtgcttggtgctctctttacatcttttcttctgctcgtgtacagctatgctgtgcctcctctccatgccggactggccagtactaccccagaggcagctgcttcctgtagtcctcccgctctcgagccagaagcagtgattagagcaaacgggagcgccggtgaatgccagcctcggaggaacatcgtttttctgaagacccataagtag

SEQ ID NO: 224172 - DNA, 513 bp, Artificial Sequence
  Description of Artificial Sequence: Synthetic coding sequence
atgcttcctccccagaagaagccttgggagagtatggccaaaggcttggtcctaggtgccctatttacatcattccttttacttgtttattcgtacgccgtgcctcctctgcacgctggactcgcttctacaacgcccgaggctgccgcatcctgttcaccccctgctctcgagcccgaagcagtgatcagagctaacggcagcgccggtgaatgccagcctcgtaggaacatcgtctttttgaaaactcataaaacagcctccagtactctcctgaacatactattcagattcggccagaagcaccggctgaagttcgcttttcctaacggacgtaatgacttcgactacccaacgttcttcgcgcgttcacttgtccaagattatagacccggtgcctgctttaacatcatctgtaaccacatgaggttccattacgatgaagtgcgtggtctcgtgccaactaacgccatttttatcacagtgttgagagatcctgcaagactgttctag

SEQ ID NO: 224173 - DNA, 450 bp, Artificial Sequence
  Description of Artificial Sequence: Synthetic coding sequence
atgctgcctccacagaaaaagccttgggagtcaatggccaaaggcctagtgttaggcgcattgttcacctccttcctactgctggtctattcctacgctgtgccaccactccatgccggtctcgcttcaacaacacccgaagcagctgccagctgctcgcctccggcactggaacctgaagctgtgatccgcgctaatggcagtgctggtgagtgccagccgaggcgcaatatcgtctttttaaagactcataagacagctagctcaacacttttgaacatcctgtttcgcttcgggcaaaaacaccgtctaaagttcgctttccccaacgggagaaacgatttcgactaccccactttctttgctcgttcgttggtacaggactacaggcctggtgcctgctttaacattatctgtaatcacatgaggttccactacgatgaggtgtag

SEQ ID NO: 224174 - DNA, 300 bp, Artificial Sequence
  Description of Artificial Sequence: Synthetic coding sequence
atgctgccacctcaaaagaagccctgggaatctatggccaagggcctagtgctgggcgctctctttacctcctttctgttgctcgtgtactcatatgccgtgccacccctacatgcaggcttagctagtacgacccctgaggcagctgcctcgtgttcacctcctgctctggaacctgaagctgtcatccgcgcaaatggatctgctggcgaatgtcagccgagacggaacattgtgttcctgaaaacccacaagacagcatcttccacacttctgaatatcctgtttaggttcggatag

SEQ ID NO: 224175 - DNA, 312 bp, Artificial Sequence
  Description of Artificial Sequence: Synthetic coding sequence
atgctgccaccccagaaaaaaccctgggaatccatggctaagggcctggttcttggcgctctgttcaccagttttttgttgctcgtctattcatacgcagttccccctctgcacgccggactggcctccaccactcccgaagccgctgcttcctgtagccccccagcccttgaaccagaagctgtgattagggcgaatgggagcgcgggtgaatgccagcctagacgaaacatcgtgttcttgaaaacgcacaagacggcctcgagtacgttgctgaatattttattcagatttggacaaaagcaccggtag

SEQ ID NO: 224176 - DNA, 600 bp, Artificial Sequence
  Description of Artificial Sequence: Synthetic coding sequence
atgttgccaccccagaagaagccatgggagtctatggcgaaaggtctcgttctgggtgccctcttcacaagcttcctgctgctcgtatactcttacgccgtgccgcctctccacgctggtctggctagcaccacacctgaagcagcagcatcttgctctccaccagccctcgaaccggaagcagttatccgcgctaatgggagtgccggagagtgtcagcccagaaggaatatagtcttcctgaagactcataagaccgcctccagtacgctgctgaacatcttgttccgatttggccagaagcatcggttgaaattcgcctttcctaacggccgaaacgattttgattatccaacgtttttcgctaggagtttggtccaggactatcgtccaggagcctgtttcaatatcatttgtaatcacatgcgcttccattacgacgaagtgcggggacttgtgccaacaaatgccatatttataactgttcttagggaccctgccagactgttcgagtcctctttccactattttggccctgtagtaccccttacttggaaactgtctgccggagataaattaacggagttcttgcaggattag

SEQ ID NO: 224177 - DNA, 840 bp, Artificial Sequence
  Description of Artificial Sequence: Synthetic coding sequence
atgctgccacctcagaagaagccctgggagagcatggctaaaggccttgttttgggagctctatttacctcatttctgctgctagtctatagttatgctgtgcctccactacatgctgggcttgccagcactacacccgaggccgcagcttcctgtagccccccagcgcttgagccagaggctgtgatcagggctaatggcagcgcaggggaatgccagcccagaaggaacatagtgtttttgaaaacgcacaaaactgcttcgtctacactcctgaatatactgttccgattcggacagaaacatcgtctcaagttcgcgtttcccaatggcaggaacgactttgactatcctacatttttcgctcggtctctggtgcaggactacaggccaggagcctgtttcaacatcatctgtaaccacatgcgattccactacgacgaggtcagaggcctcgttcccactaacgctatctttatcacagttctccgggacccagccagactgtttgaatcgtctttccactacttcggccctgtcgtaccgcttacgtggaagttgtccgccggagacaagttgacggagttcctccaggacccggatcggtattacgatcccaacgggttcaatgcacactacttgcgaaaccttctcttcttcgatctgggctatgacaatagccttgacccatcgagcccacaggtgcaggaacatatcctagaagtggaaaggagatttcacctggtcctactgcaggaatacttcgacgaaagcttggtcctgcttaaagatctcttgtgttgggagttggaggacgtgctgtacttcaaactcaactag

SEQ ID NO: 224178 - DNA, 1272 bp, Artificial Sequence
  Description of Artificial Sequence: Synthetic coding sequence
atgctgccaccccaaaaaaagccatgggagtctatggccaagggactggtcctcggggctctatttacctctttcttgctgctagtctactcttacgcagtgcctccactgcacgctgggctcgcatctactacaccggaagcggcagcctcctgtagtcctccagctcttgagccggaggcggttatccgggcaaacggcagtgccggagagtgccagcccagacggaatatagtgttcttgaagacacacaagactgccagcagtactctgctgaacatcctttttaggtttggccagaaacataggctcaaattcgcctttcccaatggaagaaatgacttcgattaccccacattctttgcacgatccctggtgcaggattatcgcccaggagcatgttttaatattatttgcaaccacatgaggttccactacgatgaggtgcgcggtttagtgcctaccaacgcaatctttatcaccgttctgagggacccagcgaggctcttcgagtcttccttccactactttggtccggtggtgcctcttacatggaaactgagtgccggtgataaactgaccgagtttctgcaggaccccgataggtactatgaccctaacggcttcaatgctcactacctgcgcaacttactcttttttgatctcggatacgataatagcctggacccatcaagtccacaggtccaggaacacatacttgaagtagagcgtagatttcacctggtccttctgcaggagtacttcgatgagagtctcgtcctgctgaaagatctcctgtgttgggaacttgaggacgtgctgtatttcaagctcaacgcaaggcgcgatagccccgttcccagactctcgggggaactgtacggcagagcaaccgcttggaacatgctggatagccacctgtaccggcatttcaatgctagtttttggcgaaaagtggaggcatttggacgagaacgcatggcccgagaagtagccgctttgagacacgctaatgaaaggatgcgcaccatctgtattgatgggggtcacgccgtggacgccgctgcgattcaggacgaggccatgcaaccctggcagcctctggggaccaagagcatactgggatacaatctcaagaaaagcatcgggcagcgccacgcccagttgtgcaggcggatgcttaccccagaaattcagtacctcatggacctgggtgccaacctgtgggtcacaaagctctggaagttcatcagggacttccttagatggtag

SEQ ID NO: 224179 - DNA, 432 bp, Artificial Sequence
  Description of Artificial Sequence: Synthetic coding sequence
atgctaccacctcagaagaagccctgggaaagtatggctaagggattggtgctcggcgctttgttcactagttttctgctactagtgtattcatacgcggtcccacccctccatgctgggctcgcctctaccactcctgaagcagccgcaagttgcagtccgccagctctagagcccgaagcagtgattagggctaatgggagtgccggagagtgtcagccccgaaggaacattgtgtttctgaagacccacaaaacagccagctcaactctgctgaacatcctctttcgattcggccagaagcaccgactgaaattcgctttccctaatggcaggaacgatttcgactacccgacttttttcgcacggtccttagttcaagattataggccaggggcttgttttaatattatctgcaaccatatgcgatag

SEQ ID NO: 224180 - DNA, 231 bp, Artificial Sequence
  Description of Artificial Sequence: Synthetic coding sequence
atgttaccccctcagaagaagccatgggaaagcatggcgaagggactggttctaggtgctctgtttacatccttcctcctgctggtatatagttatgctgttcccccactgcatgctgggttagccagtaccacccctgaggccgctgcgagctgtagtcctcctgctctcgagcctgaggctgtgatacgggcaaatggcagtgctggcgaatgccaaccaaggagatag

SEQ ID NO: 224181 - DNA, 288 bp, Artificial Sequence
  Description of Artificial Sequence: Synthetic coding sequence
atgttaccgcctcagaaaaagccgtgggagtctatggctaaaggcctggtgctgggcgcattattcacctcgtttcttttattggtctattcgtatgccgtgccacccctgcacgctggtcttgccagcaccacgccagaagctgctgctagttgcagcccccctgctctggagcccgaggctgtgattcgagcgaacggtagtgccggagagtgtcagccacgcaggaacatcgtctttttaaagacacataaaacagcaagcagtacactgttgaacattctgtag

SEQ ID NO: 224182 - DNA, 216 bp, Artificial Sequence
  Description of Artificial Sequence: Synthetic coding sequence
atgcttccacctcaaaaaaagccgtgggaatcaatggccaaaggcctggtcttgggagccctgttcacctcattcctattgctagtctacagctacgcagtgccacctttgcacgcaggcctcgcgagcacgacccccgaggccgctgccagttgttctccacccgctctcgagcctgaagccgtgatacgcgctaacggctctgcgggagagtag

SEQ ID NO: 224183 - DNA, 729 bp, Artificial Sequence
  Description of Artificial Sequence: Synthetic coding sequence
atgctcccccctcagaaaaagccgtgggaaagcatggctaagggactggtgctgggagctctattcacatcatttctgctattggtctacagttacgcggtgccaccactccacgcgggactggcgagcactacaccagaggccgctgcaagctgttctccaccagcgctagagcccgaggctgtgatcagagcgaacggaagtgccggagaatgtcagccccgtcgaaacattgtgttcttaaaaacgcataaaacagccagttctaccttattgaatatcctctttcgctttggtcaaaaacatcggctcaaatttgcatttcccaacggcagaaatgattttgattatccgacttttttcgccagatcgctcgtccaggactaccgccctggggcttgtttcaatatcatctgcaaccatatgcggtttcactacgacgaagtgagagggctggttccaaccaatgcaatcttcattacagtgcttagagatccagcccgactctttgagtcctccttccactattttgggccagtggtcccgttaacttggaagctctctgcaggtgataaactgactgaattcctccaggacccagatcggtattacgaccccaatggcttcaacgcacactatttgcgtaatctactgtttttcgacctgggctacgataattcactcgacccctcatccccccaggtccaagaacatatactagaagtttag

SEQ ID NO: 224184 - DNA, 303 bp, Artificial Sequence
  Description of Artificial Sequence: Synthetic coding sequence
atgctcccacctcagaaaaaaccttgggaaagtatggcgaaaggactggtccttggggcattgttcacctccttcctacttctggtttattcttatgctgtccctccactgcacgctggcctagcatccacaactcccgaggctgccgcaagctgctcacctcctgctctggagccagaggccgttatcagggcaaacggatcagccggtgaatgtcagcccagaaggaacatcgtattcctgaagacccataagacggccagctcgactctactgaatattttgttccgatttggccagtag

SEQ ID NO: 224185 - DNA, 1197 bp, Artificial Sequence
  Description of Artificial Sequence: Synthetic coding sequence
atgatgtcaatgctcggcggattacagcgatattttagggtgatcctcctattgcttctggccctcaccctcttactactggcgggattcctccacagcgatctggagctggacacgcccctctttgggggtcaggccgaggggccacccgtcacgaatatcatgttccttaaaacacataagacagctagctcgaccgttctgaatattctgtaccggttcgccgagacacacaatttaagcgtggcactgcctgctggcagccgggtgcatctggggtacccctggttatttctcgcacggtacgtggaaggcgtggggtctcagcaacgctttaacattatgtgcaatcatcttcggttcaacctgccgcaggtccagaaggtgatgccaaatgatactttttacttctccatcctgcgcaatccagtatttcagcttgaaagctccttcatttattacaagacatacgccccagctttccgcggagcaccctctctggacgcctttcttgcaagccctaggacattctacaatgatagccgccaccttcgcaatgtatacgcgaaaaataacatgtggtttgatttcggcttcgacccaaatgcccagtgcgaggaagggtacgtgcgtgcacggatagccgaagtggaaagacgattcagactcgtcctgattgctgaacacctggatgagtcacttgtgctgctgcgacggaggctgaggtgggcgcttgatgacgttgttgcatttagactgaactcccggagtgcccgaagtgtcgctcggttgtcacccgaaacacgagagcgagccagatcctggtgtgctctcgattggcgcctatacgaacacttcaaccggaccctctgggctcagctgagggcagaacttgggcctcgacgcctcagaggcgaagtagagcgtttacgtgccaggcgcagagaactggcgtctctgtgccttcaggacggcggtgccttaaaaaaccacacacaaattcgcgatccgagactgcgcccataccagtcagggaaagccgacattctaggctataacctgaggcccggactggacaaccaaacattgggcgtgtgccagcgcctggttatgcctgagttgcagtacatggccaggctgtacgcactccaattccctgaaaagcctctgaaaaatataccattcctaggcgcatag

SEQ ID NO: 224186 - DNA, 1296 bp, Artificial Sequence
  Description of Artificial Sequence: Synthetic coding sequence
atgcctcccatcctgcagagacttcagcaagccacaaagatgatgagccgccgaaaaatcctcctcttggtgctgggctgcagcacagtgtcacttttgatccatcagggtgctcagctctcttggtaccccaaattgttccctctcagttgtcctcccctgcgcaattctcctcccagaccaaaacacatgacagtcgcgtttctgaagacccataagaccgctggcacaacggttcagaacatcttattccgcttcgccgaaaggcataatctgactgtggccttgcctcacccatcttgcgagcaccaattctgttaccctcgtaacttctccgcacatttcgtacatcctgccaccagacctccgcacgttttagcctcacacctgaggttcgaccgagccgagctagaacgtctgatgcctcccagcaccgtctatgttacaatcctgagggagccggctgctatgttcgaaagcttgttcagttattacaatcaatactgccctgcatttcggagggttcctaatgcttcgctggaagcatttcttcgcgcaccagaggcctattatagggcaggcgaacacttcgcaatgtttgcacataatacactggcctatgatcttggaggagacaacgagcgctcccccagggacgacgctgcatatctagctggactgattcggcaagtggaagaagtgttttcacttgtgatgatcgccgagtacttcgacgagtccctggtgctgcttagaaggcttttggcctgggatctagacgacgtactttatgccaaactgaatgcgagagctgccagcagcaggctggccgctatcccggcagctctggcccgagcagcacggacctggaacgctttggacgcaggactgtacgatcattttaatgccacattctggaggcacgtcgcaagggctgggagggcgtgcgttgagagagaagcaagagagctgcgggaggcgagacagcgtctcttacgcagatgcttcggcgacgaacctttgctgcgtccagcagcccagattcggacaaagcagttacagccatggcagccctcacggaaggtagatataatgggatatgacctgccgggtggcggagccggaccagccaccgaggcgtgtctcaaactggctatgcctgaggtgcagtatagtaactatctgcttcggaaacaaaagaggcggggtggagctagagctcggcctgaacctgtgctggacaatccaccacccagacccatcagagtcctccccagaggacctcaaggcccatag

SEQ ID NO: 224187 - DNA, 1296 bp, Artificial Sequence
  Description of Artificial Sequence: Synthetic coding sequence
atgcccccaatcctgcaacgcttgcagcaggctacaaaaatgatgtcaaggagaaaaattctgttactcgtgctggggtgcagtaccgtgagtctcctgatacaccaaggagcccagctctcttggtacccaaaactgtttcccctgtcctgtccacctttacgtaacagcccaccacgcccaaaacatatgacggtagctttcctcaaaacccataagacagctggaaccacagtccaaaacattctgttcaggtttgccgaaaggcataacctaacggtggcactgccccatccatcgtgtgaacaccaattttgttaccctcgcaacttttctgcgcacttcgtgcatccagctaccagacctccacatgtgctggcctcccatctgcgctttgatagggctgagctcgagaggctcatgccaccctccactgtctacgtgaccatcctacgggaacccgcagcgatgttcgagagtctgttctcttactacaatcagtactgtcctgcgtttcggagagttcctaacgccagccttgaggcttttctgcgcgctccagaagcatactatcgggcaggagagcatttcgcaatgtttgcgcacaatacactcgcttacgatttggggggtgataacgagaggtcacctcgggacgatgcagcctatctggcaggcctcattaggcaggtggaggaagtgtttagcctggtaatgatagcagagtatttcgatgaaagtctggtcctgttacgcagactcctggcatgggaccttgacgacgtgctttacgccaaactgaacgcacgggctgcatcctccaggctagcagcgatacctgcagccctggcgagggccgcaaggacttggaacgctctcgatgctgggctgtatgaccatttcaacgccaccttctggcgccatgtggcccgtgcgggtagggcctgtgtggaaagagaagccagagaactgagagaggccaggcaacgactgctgcggcgatgttttggcgacgagcctctcttaagacccgctgcacagattcggaccaagcaattgcagccatggcaaccttcccgcaaagtcgatatcatgggctatgatttgcccggtggcggagctggtcctgcaaccgaagcctgcctgaagttggcaatgccagaagttcagtacagcaactacctgctccgaaagcagaaacggcgaggcggtgctcgggctagacctgagccagtgctggacaatccccctcctcgtcctatcagggtgctgccgcgtggaccccaaggcccttag

SEQ ID NO: 224188 - DNA, 1461 bp, Artificial Sequence
  Description of Artificial Sequence: Synthetic coding sequence
atgggccctctctccccagcacgcaccctgaggctgtggggccctcgcagcttgggcgtggccctgggcgtgtttatgacgataggctttgctctccaattactgggaggaccttttcagaggcggctccctgggctccagctgaggcagcccagcgccccaagcctgcgccctgctctcccatcttgtcctccaaggcagaggctagtgtttttgaaaacccataagtccggcagctcctcagtgctttctctgctccatagatacggtgatcagcatgggctgcggtttgcccttcccgctcgctaccagttcggctatcccaaacttttccaggcttctagggtcaagggataccgcccacaaggaggtggcacccagctcccttttcacatcttgtgccaccacatgcgatttaacctgaaagaggtcttacaggtgatgccctcagacagctttttcttctctatcgtgcgggaccctgcagcccttgctcggagcgctttttcgtattacaagtccacaagtagtgctttccgtaaaagtccttcactcgccgctttcctggcaaacccccgaggcttttatcgacccggagcccgaggagaccactatgctcggaacctgctgtggtttgattttggcttaccatttcctccggagaagagagcaaaacgcggaaatatccatccaccgagagatccgaacccacctcagcttcaggtgctgccgtcaggcgcaggcccacgcgctcaaactttaaatcctaacgccctgattcacccagtcagtaccgtgactgatcaccgctctcagatcagctcgccggctagctttgatttagggtctagctcgtttatccagtggggtctggcttggctggactccgtttttgatctcgtgatggtcgccgagtactttgacgagagcctcgttctgttagctgacgctctgtgttgggggctggatgacgtagttggtttcatgcacaatgctcaggccggtcacaagcagggactctccactgttagcaattctggactaactgcagaagaccgccagctgaccgctagggcaagagcctggaacaacctggattgggccctgtacgtgcatttcaacaggtctctctgggctcgcattgagaagtacgggcagggaagactacagactgctgtggcagagcttcgggcacggagggaagctctcgctaagcattgtctggtggggggtgaagcatccgatccaaagtatatcacggataggcgcttccgacccttccagttcgggagcgctaaagtactaggatacatccttcgatcagggctatcgccccaggatcaagaggagtgtgaacgactggctacaccagaactgcagtacaaagacaaactcgatgcgaaacaatttccccctactgtatcccttccattgaagacgagtagaccactctctccttag

SEQ ID NO: 224189 - DNA, 1461 bp, Artificial Sequence
  Description of Artificial Sequence: Synthetic coding sequence
atgggaccattgtcaccggcacgaacactcagactctggggacctagaagcttaggggttgcgttgggggtctttatgacaatagggtttgccctccagttactagggggtcccttccagagaaggctcccaggtctgcagctgagacagccaagcgctcccagcctcaggcccgctctcccttcctgccccccacgccagcgcctcgtgtttctgaagacccacaaaagcggctcatccagtgttctgagcctgctacatcggtatggcgaccagcacggccttcggttcgcccttcctgcacgctatcaatttggatatcctaagctgttccaggcctctcgggtaaaggggtatcgacctcagggaggcggaactcaacttcctttccacatcttgtgccaccatatgcggttcaaccttaaagaagtcctacaggttatgccctctgactcttttttctttagtatcgtcagggatcccgcagccttagccagatccgcattttcatattacaagagcacctcttctgcttttcgaaaaagcccttcgctggctgctttccttgcaaatccccgtggcttttataggcccggagcacggggtgatcactatgcacgcaatctgctgtggttcgatttcggcttaccctttcctcccgaaaagagagctaagcgcggaaatatccatcccccaagagatcccaacccaccccagttacaagtgctcccctcgggcgcaggccctagagcccagactctcaatcctaatgctctgatccaccccgtgtcaacggtgacagaccatcgaagccagatttcttcccctgctagcttcgacctgggatccagttcgttcatccagtgggggctcgcatggctagactcagtctttgacctggtaatggtggctgaatactttgatgagagtctcgtgctcctggccgatgctctatgttgggggttagacgatgtagtaggattcatgcacaacgctcaggccggtcataagcagggtctctctactgtgtccaacagcggacttaccgctgaggatcgccagctaaccgctcgtgccagggcctggaacaacctggactgggcactctacgtgcatttcaaccgctcactctgggccagaatagagaaatatggccaaggcagattgcagactgctgtcgctgagttacgcgcacgcagagaagccctggcaaaacactgcctggtgggcggtgaggctagcgatcccaaatacataactgatcgacgattccggccatttcagtttggttccgcaaaggttctgggctatatcctgaggagtggcctgtcgccccaggaccaggaagagtgcgaacggctggccacccccgagctccagtataaggacaagttggacgcaaagcagttcccccctactgtgagtctgcctctgaagacctcgaggccacttagcccatag

SEQ ID NO: 224190 - DNA, 1275 bp, Artificial Sequence
  Description of Artificial Sequence: Synthetic coding sequence
atgacacctcggagccctacatccgcctttaggagctgcacagctgtgtcatcctgcttgtgcccctcctcatggccttggctccacctctcagtcacgtcaccatttcccgtcccccacgggcctagtctcagttgtcaggacgctgccgctctgggcacaagtgaacccggagggggaagcggaagccttcacgaccactggttgtgcactcccgctttagggagagcactgcccgaggaagtcctacaggtcatgccgtccgatagctttttcttcagcatagtgagggaccccgcagcattggctaggagcgcgttcagctactacaaatccacgtccagcgcatttagaaagtccccgtcactcgccgcttttctggctaatccaagagggttctacagaccgggtgcccgtggagatcattatgccaggaacctgctgtggttcgactttggcctgccctttccacccgagaaacgtgccaagcggggtaatatccatccacctagagaccccaatccaccgcagcttcaggttctgcccagtggcgctggccctagggcccagacactcaacccgaacgcactgattcatcctgtctctaccgtcacagaccacaggagtcaaatctcctcccctgcctcttttgacctggggtcctccagctttattcaatgggggctcgcgtggctcgactcagttttcgaccttgtcatggtggcagaatatttcgacgagagtctagtgttactggcagatgctctttgttggggcttggacgacgttgtcggttttatgcacaatgcccaagccggtcacaagcaggggctgtccaccgtgtccaacagcggacttaccgccgaagacagacagctgacagcccgtgccagggcctggaacaatctggactgggctttgtacgtacacttcaatcgatcactttgggctagaattgagaaatatggccagggcagactgcagaccgctgtcgccgaattacgggcacgcagggaagccctagccaaacattgtctggttggtggcgaagctagcgacccgaagtatatcacagataggcgttttcgcccattccagtttgggagcgccaaagttctgggttacatactgaggagtggcctgtctccccaagatcaggaagaatgcgagagactggccactcccgagctccaatacaaggataaactggacgcaaagcagttcccgccaaccgtgtcattgcccctgaagacaagcaggcctctgagcccctag

SEQ ID NO: 224191 - DNA, 1641 bp, Artificial Sequence
  Description of Artificial Sequence: Synthetic coding sequence
atgccgggattccttgtccggatactaccgctgctcctagtgcttctacttcttggaccaactagaggcctcagaaacgccacgcaacgaatgttcgagatcgactactccagagacagtttcctgaaggacggtcagcccttcaggtatatcagcgggtctattcactacagccgcgttcctaggttctactggaaggatcgtctactgaagatgaaaatggccggactgaatgcaatccaaaccctgcctggctcttgtgggcaggtagtggggtctccatcagctcaggatgaggcgtctcctctgtcggagtggagagcatcttataattccgctggaagtaacattaccgatgcgtttttgtcccagcgcaagtgcgaacccaaaggccctctaattaatagcgaattctacactggatggctcgaccactggggccagcctcattctactattaaaaccgaagctgtggcctcctccctatacgacatccttgccaggggcgcatctgtcaacctgtatatgttcatagggggaacgaactttgcctattggaatggggctaattcgccctacgccgcacagcccacctcctacgattacgatgccccactgagcgaggccggagacctgacggaaaaatacttcgcactgagaaacatcatccagaagttcgagaaggtgccagagggaccaatccctcccagcacaccaaaatttgcctacggaaaagttactttggaaaagctgaagactgttggtgctgcactggacatcctgtgcccatccgggccaatcaagagtctatacccattaaccttcatccaggtgaagcagcactatgggtttgtcctatacaggaccacgctccctcaggattgttcaaaccccgcaccactctcgtcacccctgaacggtgtccatgaccgagcttatgtggctgtggacggcatcccccaaggcgtcctggagcgaaacaatgtgattacactcaacattaccggcaaggccggagccacattggatctcctggtcgagaacatgggcagggtgaattacggagcatatatcaacgactttaagggtttggtgtcaaacctgaccctgtcttctaatatcctgactgactggactatcttccctttggataccgaggacgcagtctgctcccatcttgggggatggggacatcgagattctggccaccacgatgaggcatgggctcataatagttctaattatacccttccggcattctatatgggaaattttagtatcccatcgggcatacccgatcttccacaggatacatttattcagttccccggttggactaaaggccaggtgtggatcaatggatttaatctgggacggtactggcccgcaaggggcccacaactgacgctgttcgtgccccagcatatccttatgacatctgcaccgaatacaattacagtattggaactggagtgggctccttgcagtagcgatgatcctgagctgtgtgccgtgacttttgttgataggcccgtaatagggtcctcagtgacctacgatcatcctagtaagccagttgaaaaaaggcttatgccacccccaccacagaagaacaaggattcctggctagaccacgtgtag

SEQ ID NO: 224192 - DNA, 1944 bp, Artificial Sequence
  Description of Artificial Sequence: Synthetic coding sequence
atgttcgagatagattattcccgagattcattcctgaaggacggacaaccttttcggtacatcagtggcagcatccactattctcgggtgccccgtttctactggaaagatagactcttaaaaatgaaaatggcgggtctcaacgccatccagacctacgttccctggaatttccacgaaccttggccaggtcagtatcagttctctgaggatcatgacgtagaatacttcctgagactggcccatgaactggggctcctcgtaattctgcgccctggaccctatatttgtgccgagtgggagatgggaggtctcccagcctggctgttagaaaaggagtcaatcttattgaggtcatccgaccccgattatctggccgctgtagataaatggctgggcgtgctgctccccaaaatgaaacctctgctctaccagaatgggggacccgtgatcaccgtgcaggtggaaaatgaatacggatcttacttcgcctgcgacttcgactatcttcggtttctgcaaaaacggttccggcatcatctgggcgacgatgtcgtgttgttcactacagatggagctcacaaaacattcctaaagtgtggagccctacaggggctatacactacagttgacttcggaactggttcgaacatcaccgatgcctttctttcccaaaggaaatgtgaaccaaaggggccactcataaactccgaattttacaccggctggctggaccactgggggcagccccattccactattaaaacagaagctgtcgcctcatcgctatacgatatcctggcgcgtggggctagcgtcaatttgtacatgttcatcggcggtaccaactttgcgtactggaatggcgctaattctccatatgctgcacagccaacctcctacgactatgacgccccactctccgaagcgggagatctgactgagaaatatttcgccctgcgcaacattatccagaaatttgaaaaggtccctgaagggccaatccccccttcaaccccaaaatttgcttatggcaaggttactttggaaaaactgaagactgtgggagccgctctggacatactctgcccttctggaccaattaaaagcttgtatcccctcacattcattcaggtcaaacagcactacggattcgtcctgtatcgaaccaccctgccccaggattgttcaaaccccgctcccttgagtagtccgttgaatggagtgcacgaccgagcatatgtggctgtggacggaatcccccagggagtcctggaaaggaacaacgtgatcacattgaacatcacaggcaaggccggtgccacactagacctccttgtggaaaatatggggagggtgaactacggggcttacatcaatgactttaagggtctggtgagtaatctgaccctgtcaagcaacatcttgactgactggactatcttccccctcgatacagaagatgccgtctgtagccatcttggtggatggggacatcgggatagtgggcaccatgatgaagcttgggcacataattcctccaactacaccctgcccgcattctatatgggcaacttcagcatacccagcggcataccggacttgcctcaggacaccttcatacagttccctggctggaccaagggccaggtgtggatcaacggttttaatctgggacgctactggcccgctcgtggaccacagctgacgctgtttgtacctcagcatattttaatgacctctgcgccaaatacaataactgttctcgagctggagtgggctccctgttcctccgatgaccctgagctttgtgctgtaacattcgtggaccggcctgttattggttcttccgtgacgtacgatcacccgtcaaaacctgtggaaaaaagacttatgcccccaccaccacagaaaaataaagattcctggcttgaccatgtctag

SEQ ID NO: 224193 - DNA, 2034 bp, Artificial Sequence
  Description of Artificial Sequence: Synthetic coding sequence
atgccgggttttttggttaggatcctgccgctgctgctcgttcttctattattaggacccaccagaggactccggaacgcaacccagcgcatgtttgagatagactatagtagagactcctttcttaaggacgggcagccatttagatacatctcaggctctattcattactcccgggtccctcggttttattggaaagataggcttttgaagatgaaaatggctgggctgaacgccatccaaacatacgtcccctggaacttccacgaaccctggcctggacagtaccagttttccgaagaccacgatgtagaatacttcctccggctggcccacgagcttggcctgttggtgatcttacgcccaggaccatatatttgtgcagagtgggaaatgggtggactacccgcttggttgctagaaaaagaatccatcttgttgaggagttccgacccagactacttggctgcagtagataagtggctgggcgtcctgctgcccaaaatgaagccgcttctgtaccaaaatggcggacccgtcatcaccgtccaagtcgagaacgaatatggatcatatttcgcgtgcgatttcgactaccttcgattcttacagaagaggtttcgccaccacctgggagacgatgtggtgttgttcacgacagatggggctcacaagaccttcctcaagtgtggcgctctacaaggattgtacaccaccgtcgattttggcacaggaagtaatatcacagacgcctttctgagtcagagaaagtgtgaaccaaagggacctctgatcaacagtgaattttacacagggtggctcgatcattgggggcagcctcactcaaccatcaagaccgaagcagtggcctctagcctctatgacatcttggctcgcggagcgagcgtgaatctgtatatgtttattgggggaacgaacttcgcatactggaacggggcaaactccccctatgctgcccagcccacgtcttatgactacgacgcaccactcagcgaggcgggagatttgactgagaagtatttcgctctgagaaacatcatccaaaagttcgaaaaagtgcccgaaggaccaatacccccatctaccccaaaatttgcatacggaaaggtcacactggaaaagctgaaaaccgtcggggcagctttggatattctgtgtccttctggtccgataaagtctttgtatccgctgactttcattcaggtgaagcagcattacggcttcgtgctgtaccggacaacgctgccgcaagattgttcaaatcccgcaccactgtcttctcctcttaatggagtccatgacagggcatatgtcgccgttgatggaattccccagggggtattggagcgaaataatgtcattacgttgaatatcactggtaaggcaggagccactctggacctcctggtggagaacatgggacgcgtgaactacggagcttacattaatgactttaaggggttagtaagcaatctgacgctctcttccaacatcctgacagattggacaatcttcccattggacacagaggatgcagtatgttcacatttgggtggctggggtcatcgcgacagcgggcatcatgacgaagcctgggcccataactctagcaactacacacttcccgctttctatatgggtaatttctctatacccagcggaatccctgatttgccccaggacacctttatccagttccctggctggacgaagggacaggtttggatcaatggattcaatctggggaggtactggcctgctaggggtccacagctgactctgttcgtgccacaacatattctgatgacctcagcccctaacacaattacagtgctggaattggagtgggctccctgttcatccgacgatccggagctgtgtgctgtcacctttgtcgatcgaccggtgatcggctcgtcagtgacgtacgatcacccttccaagcctgtagagaaacggctgatgccccctcctccccagaaaaataaggattcctggttggatcacgtgtag

SEQ ID NO: 224194 - DNA, 2178 bp, Artificial Sequence
  Description of Artificial Sequence: Synthetic coding sequence
atgcctggttttctggtgaggatcctgccactgctgttggtgttactcctccttggtcccacaaggggtctgcgcagcagatttctgccctgggcattccatttgcccagacaggcgcctaagtcccagctgccgctgcacaagcgcggaacaaagaccgcgcctaacgagcacgcttcctccaaccgctccggccgtcgacgcagaagacagcagtggaacgcaacacagagaatgttcgagatagattacagcagagattccttcctgaaagacggacagcctttcagatatatcagcggctctattcattactcaagagtgccgagattctattggaaagaccgactgttgaagatgaaaatggccggattgaacgctatccaaacttatgtcccgtggaactttcatgaaccctggcctggacagtatcaattctcggaagaccacgatgtggagtactttctgcggctggcacatgaactaggattgctcgtaatcctacggcctggcccatatatatgtgccgagtgggaaatgggagggcttccagcctggctccttgaaaaagagtcaatcttgcttcgctccagtgaccccgattacttggccgcagtcgacaaatggctaggcgtactactgccgaagatgaagcctcttctgtaccagaacggaggccctgttataactgtgcaagtggaaaacgagtatggatcctattttgcttgcgactttgattacttgaggtttctgcagaagagatttagacaccatctaggagatgacgttgttctcttcacaaccgacggcgctcataagacattcctgaagtgcggtgcccttcaagggttatataccacagtcgacttcggtactggcagtaacatcactgacgcctttctcagtcagcgcaagtgtgagcctaaagggccactcatcaactccgagttttatacaggctggttggaccattgggggcagccacacagtacaatcaagaccgaggctgtggcttccagcctgtacgatatcttggccagaggagcttccgtcaacttgtacatgttcatcggaggcacaaattttgcatattggaacggcgcaaattcgccctacgctgcacaaccaacctcttatgattatgatgccccattatcagaggccggagatctgactgaaaaatacttcgccctgcgaaatattatacagaagtttgaaaaggttcccgaagggccaataccaccatcaacacctaagtttgcctacgggaaagttacgttggagaaattgaaaacagttggcgcagcgctggacatcctgtgtccttctggacccattaagtctctgtaccctctgacctttatacaggttaaacagcattacggattcgtgttgtatcggaccactttgccccaagattgttctaatccagcccctctttccagcccgcttaatggagtgcatgaccgcgcatatgtggctgtagacgggattccacagggggttctggagagaaataacgtcatcactctcaacataacgggtaaggctggcgctactcttgatcttctcgttgaaaacatggggcgtgtgaattatggagcttatatcaatgattttaagggcctggtgagcaacctcacactgtcctctaatatcctcaccgactggaccatctttcctttggacactgaagacgctgtgtgttcccatttaggagggtggggccatagagactcagggcaccatgatgaagcctgggctcacaacagtagcaattacactctacctgccttctatatggggaatttttcgatccccagcggaattcctgacctccctcaggatacctttatccagtttccaggctggacaaaaggccaagtctggatcaatggatttaacctgggaagatattggccagcccgaggaccacagctcaccctctttgttccacagcatatcctgatgacaagcgccccaaataccattacagtgctggagctggaatgggcgccttgctctagcgacgatccggagctatgcgccgtcacgttcgtggacagaccagtcattgggtcctctgtgacttatgaccatccaagcaaacctgtcgaaaaacgactcatgccaccccctccacagaagaacaaagactcctggctggaccacgtgtag

SEQ ID NO: 224195 - DNA, 2058 bp, Artificial Sequence
  Description of Artificial Sequence: Synthetic coding sequence
atggctgagtggctgttgtcagcaagttggcagcggcgtgcgaaagccatgacggccgctgccggaagcgccggtagggccgctgtgccactactcctttgtgcactgctagctcctgggggtgcctacgtgctagacgactcagatggactgggacgggaatttgacggaattggagcggtgagtggtggtggtgcaacgagcaggctgctggtcaactacccagaaccctatcggagccagattcttgattatctgttcaaacccaatttcggagccagcctgcacattttgaaggtggaaatcggcggtgatggccagacaacagatggaaccgagccctcccacatgcactacgctctggacgaaaactatttccggggatatgagtggtggctgatgaaagaagcaaagaaacggaatccaaacattacactaataggcctgccctggtccttcccagggtggcttggtaagggtttcgactggccatacgtgaatcttcagctgaccgcctactatgtggtgacttggatagtgggcgctaagcggtaccacgacctcgatatcgattatatcggaatttggaacgaaagatcttataacgcaaattacattaaaatcttaaggaagatgttaaattaccagggcctgcaaagagttaagatcattgcttctgacaacctgtgggaatctatcagtgcaagtatgctcctcgatgccgagctcttcaaggtggtggatgtcatcggggcacattaccctggcactcacagcgctaaggatgccaaactgacaggcaaaaaactttggtcgtctgaagacttttcgacactgaacagcgacatgggtgctggctgttggggacgaattcttaaccagaattacattaacggatatatgacttctaccatcgcctggaacctggtggcttcttactatgagcaactgccttacggccgttgcggtctgatgaccgcccaagaaccctggtcaggccattacgtagtggagtcccctgtttgggtgtccgctcacacgacacagtttacgcagcctggctggtactatctaaagactgtgggacacctggaaaagggcggtagttatgtggccctgaccgatgggcttggcaatttaacaatcattatcgaaaccatgagtcacaagcacagcaagtgtattaggccttttttgccttattttaacgtgagccaacagtttgcaacctttgtgctaaagggctcattctctgaaatcccagagctccaggtgtggtacaccaagttaggtaagacttctgagaggttcctgttcaagcagctggatagcttgtggctccttgacagcgacggatcttttacactctctttgcatgaagacgaattgttcactctcacaactttgactaccggcaggaagggcagctacccgctaccgccaaaatcccagcctttcccctctacctacaaagacgacttcaatgttgactatcctttcttttctgaagccccaaacttcgccgaccagaccggcgtcttcgagtacttcaccaatattgaggacccaggagagcaccacttcactctgaggcaggtgcttaaccagcgtcccatcacatgggcggcagacgccagtaatactatctctatcattggggactacaattggaccaaccttacaataaagtgcgatgtctacattgaaactccagatacagggggagtctttatcgcaggtagagttaacaagggcggtattttaatccgaagcgccaggggcattttcttttggatttttgctaatggctcctacagggtgactggcgaccttgcaggctggatcatctacgctttgggtagagtggaagtcactgcaaaaaaatggtacactctgacgctgacaattaagggccattttaccagcggcatgctaaacgacaaatccctgtggaccgacatcccagtcaacttccccaagaatggatgggcagccatcggcacgcattcctttgaatttgcgcaatttgacaacttcctcgtggaagccacgagatag

SEQ ID NO: 224196 - DNA, 1989 bp, Artificial Sequence
  Description of Artificial Sequence: Synthetic coding sequence
atggctgaatggctcctgagcgcttcttggcagagaagggcgaaggccatgactgccgcagccggaagcgctgggagagccgctgtgcctctgctcctctgcgccctgctagcacccggtggagcttatgtcctggacgacagtgatggattagggagggaatttgacggaatcggtgctgtatcaggtgggggacctaactttggcgcatcccttcacatcttaaaggtcgaaattggcggagacggacagacgactgacggaactgagccttcccacatgcattatgctctcgatgagaactacttccggggatatgaatggtggctgatgaaagaggctaagaaaagaaaccctaacatcacacttatcggcctgccatggtcgtttccaggctggcttggtaaagggtttgactggccgtacgtcaatttgcaactgactgcctattacgtggttacctggatcgtgggcgcaaagaggtaccacgatctggacatcgactacattggaatatggaacgagcgcagttataatgccaattatattaagattctgaggaaaatgttgaactatcagggattacagagagtaaaaataatagcgtcagacaacttgtgggaaagcatctcagcctccatgctccttgatgcagaactctttaaggtcgtcgacgttataggggctcattaccccggtacacacagcgcgaaagatgctaaactgaccggaaagaagctgtggagttcagaagacttcagcactttaaactccgatatgggggctggttgttggggaaggattctgaaccagaactacattaacggctacatgaccagtactattgcctggaatcttgtggcttcctactacgaacagcttccctacggtcgttgtgggctcatgaccgcccaggagccttggtcaggacactatgtggttgagtccccggtctgggtgtctgcccatacaacgcagtttacacagcccggttggtattatcttaagactgttggacatctcgaaaagggcggatcctacgtggctcttactgacggcctgggaaacctgacaattatcatcgaaaccatgtcacataagcactccaagtgcatacggcctttcctgccctacttcaacgtgagccaacaattcgccacttttgtcctgaagggcagtttttctgagattcctgaactccaggtgtggtacacaaaactcggtaagacatcggagcgttttttatttaaacagctggattccctctggctgctcgactctgatggatcttttaccttatcacttcacgaggatgaactttttaccctcactaccttaaccaccggacgcaaaggctcatacccactgccacccaaaagccaaccattcccaagcacatataaggatgactttaacgttgactatcctttcttttctgaggcccctaactttgcagaccagaccggtgtatttgagtacttcacaaatattgaggatccaggcgaacatcactttaccctccggcaggtactgaatcagagacctataacttgggctgccgatgcgagcaacacaatttccatcattggtgactataattggactaacttgacaataaaatgtgatgtgtacatcgaaactcctgacaccggaggagtgttcatcgcaggtcgagtcaacaaaggcggtatcttgatcaggtccgcccgtggaatctttttctggatctttgctaacggctcctaccgggtcaccggggacctcgcaggatggataatctacgcattaggcagagtggaggtgacagccaaaaagtggtatacccttaccctgactattaaggggcactttacctccggaatgctgaatgataagtcgctttggacagatattcccgtcaacttccctaagaacggatgggcagctattggcacgcatagctttgagttcgcccagtttgacaatttccttgtggaggccacaaggtag

SEQ ID NO: 224197 - DNA, 1980 bp, Artificial Sequence
  Description of Artificial Sequence: Synthetic coding sequence
atgctgggcaagtcacacggcagagccacccatggacctcttccccttgcagatctgggtattcatctcccatgcgtaaaggtgcttcatcaggtgaccccagaagaaaagccggctgctactagtcgcttgctcgtgaactatcctgagccctaccgtagtcaaattctagattacctgtttaaacccaactttggagcgtccctccacatcttgaaagttgaaatagggggagacggccagacaacagatggcacagaaccatcccacatgcactatgccttagacgagaactattttcggggatatgaatggtggctgatgaaagaggctaaaaaacggaaccctaatattacacttattgggttgccatggtccttcccaggttggttgggcaaaggattcgattggccttacgtgaacttgcagcttactgcctactatgtcgtcacctggattgtgggtgctaagcgctatcatgatctcgatattgactatatcggcatatggaacgagcgctcttataacgcaaattatatcaagatacttcggaagatgctgaactaccagggcttgcagcgcgtcaagattatcgctagcgataacctgtgggaatctatatccgcaagcatgctgctggatgcagaattatttaaagtcgttgacgtgattggcgctcattaccccggaactcacagtgcaaaggacgcaaaactgacgggtaagaagctatggtctagcgaagacttctccaccttaaatagcgacatgggagccggttgctgggggcgtatattaaatcaaaattatataaatggatatatgacctcaaccatagcctggaatttagtcgcgtcctattatgagcaactgccctacggtcggtgtgggttgatgaccgcccaggaaccttggtcgggtcactacgttgtagaatcgcccgtctgggttagcgcacacacaactcaatttacacaaccgggatggtactatctgaagacagtgggacacctggagaagggtggatcatacgtggctctgaccgatgggctaggaaatctaactattatcattgagacaatgagtcataaacacagcaaatgcataagacccttcctgccctatttcaacgtgtctcaacagttcgccacatttgtactgaaagggagcttttctgaaatccctgagcttcaagtctggtacacgaaactcggtaagacctcggaaaggttcctgtttaaacagctggactccctctggctgctcgattcagatgggtcgttcactctcagcctgcacgaggatgagttgttcactctgacaactctgactaccggcagaaaaggatcttatccacttcctcccaaaagtcaaccgtttcctagcacctacaaagacgatttcaatgtggactaccctttcttctctgaggccccaaacttcgccgatcagacgggcgtcttcgaatacttcacaaatatcgaagaccccggtgaacaccactttaccctgaggcaggtgctgaaccagcgtccaataacttgggcagctgatgcaagcaacacaatcagcatcattggagattataactggacgaacctcacaatcaagtgcgacgtctatattgaaaccccagatactggcggtgtttttatcgccggtcgtgtcaataagggaggcatcctgatccgaagcgctcgtggcatcttcttctggatttttgccaatgggtcatacagggtgactggggatcttgctgggtggattatttacgctctgggcagagtcgaagtgacagcaaagaagtggtatactctgactctcaccatcaagggacatttcacatctggcatgctgaacgacaaaagtctgtggacagatattcctgtcaattttcccaagaatggctgggccgcaatcgggacccactccttcgaattcgctcagttcgataatttcctggtcgaggcaacgcgttag

SEQ ID NO: 224198 - DNA, 1425 bp, Artificial Sequence
  Description of Artificial Sequence: Synthetic coding sequence
atgctgaattatcagggtttacagcgggtgaagattatcgcatccgacaatctgtgggagtccatatccgcttccatgctcctggacgccgagcttttcaaagtcgtcgatgtgatcggagcacactaccccggtacccattccgctaaggatgcaaagctcaccgggaagaaattatggagtagtgaggatttctccacccttaacagtgatatgggagcaggctgctggggaaggattctcaaccaaaactacattaatgggtatatgacctcaaccatagcctggaacttggtggcttcctattatgaacaacttccttacggtcgctgtggattgatgactgcccaggagccctggagcggacattacgttgtcgagtctccagtgtgggtttccgcgcacacgactcaatttacccagcccggttggtactacctcaagacggtgggccatcttgagaaagggggaagctacgtggcactgactgatggcctgggcaacctgaccataatcatcgaaaccatgtcacacaaacactccaaatgcataagaccgttcctgccatattttaacgtctcacagcaatttgccacttttgtgctgaagggcagcttcagcgagatccccgagttacaggtttggtatactaaattaggcaaaacttccgaacggttcctatttaagcaacttgattctctgtggctcctcgacagcgatggatccttcactttgagtctgcatgaggacgaattgttcaccctgacgaccctgacgacaggacggaaaggctcctaccccctgccgcctaagtcacagcccttcccatccacctacaaagacgatttcaacgtggattatccttttttttccgaggcacctaattttgccgatcaaactggcgttttcgaatatttcaccaatatagaagacccaggggagcatcattttacgctgaggcaggtactcaaccagcgccctatcacttgggctgcggatgcctctaataccattagtatcattggcgactataactggaccaaccttactatcaaatgtgacgtgtacatagagacaccggacacagggggagtctttatcgcaggcagggtgaacaagggaggcattcttattcgctcagccaggggaattttcttttggatctttgctaatggaagttaccgcgtcaccggtgaccttgcaggctggataatctacgctctcggacgtgtagaagtgactgctaagaagtggtatacactgaccctgaccattaaagggcatttcacttcaggaatgctcaacgacaagtccctctggactgatatcccagtgaacttcccaaaaaatggctgggcggcaataggcactcacagttttgagtttgcacaattcgacaattttttggtggaggccacccgctag

SEQ ID NO: 224199 - DNA, 1770 bp, Artificial Sequence
  Description of Artificial Sequence: Synthetic coding sequence
atggggttcatggtagccgacctgtgggctacctcccggttgctcgtgaactaccctgaaccgtaccggagccagatcttagattatctttttaaacccaacttcggtgcaagtctccatatactgaaagtagaaatcggaggagacggccagaccactgacggtactgagccatctcacatgcactacgcacttgatgagaactacttccgtggttacgaatggtggctgatgaaagaggctaaaaagagaaatccgaatatcactctgattggcctgccttggagcttccctggatggctggggaagggtttcgactggccttatgtgaatttgcagttaactgcctattacgtggtaacttggattgttggcgctaaacgttaccacgacctcgatatcgattatatcggcatatggaatgagcggtcctacaacgcaaattacattaagatcctgagaaagatgctaaactaccaagggctgcagagagtcaagataatcgcatcagacaacctgtgggagagcatatcggcgagcatgctgctagacgccgagctattcaaagtggtagatgtcatcggtgctcactatccaggaacccattcagccaaggacgcaaagctcacaggcaaaaaactgtggtcctccgaggacttttccaccttaaatagtgacatgggcgctggctgttgggggaggatcctaaatcagaactacatcaacggctacatgactagtaccattgcttggaacttggtggccagttactacgaacagctgccatacggcagatgcggcctaatgacagcccaggaaccctggagtggccactatgttgtggagagcccagtctgggtaagtgcacacaccacccagttcacacagcccggttggtactatctcaaaaccgtggggcacctggagaaaggcggttcctatgtggccttaactgatgggctcggtaatctcaccattattattgaaacgatgtcccataagcacagcaaatgcattcgcccattccttccatatttcaacgtgtctcagcagtttgctacgtttgtgttgaaagggtctttctcggaaattccagaattacaagtttggtacaccaaattaggaaaaactagtgagagattcctcttcaagcagctcgactccctgtggctcctggatagtgatggcagcttcacactgagccttcatgaggacgagttgttcaccctgaccaccctcaccacaggaagaaagggatcctacccactcccaccaaaatcacagccatttccctcaacatataaagatgactttaatgtagactacccattcttcagcgaggcccctaatttcgctgatcaaacaggggtttttgaatactttaccaatattgaggaccccggtgagcaccactttaccttaagacaggttctcaatcagcgcccaataacttgggccgcagacgcttctaataccatcagtataatcggtgattacaactggacaaacctaaccatcaagtgcgacgtgtatattgaaacgcccgacaccggaggcgtttttatagccggacgagtgaataagggtggcatcctcattagaagcgccagagggattttcttctggatattcgccaacggctcctaccgcgtgacgggagatctcgccggatggattatctatgccctggggagagtcgaagtaactgccaaaaaatggtataccctaacattaacgatcaaagtggctggacggagaaagaagacctag

SEQ ID NO: 224200 - DNA, 372 bp, Artificial Sequence
  Description of Artificial Sequence: Synthetic coding sequence
atggcacggggatccgctcttttgctcgcatccctcctgctggccgctgcacttagcgcctcggccggactctggagcccggctaaggagaagcggggttggacattgaacagcgccggatacctactgggaccacacgcagtcggcaaccataggtctttctctgataagaatggcctcaccagtaagagagagctgaggcccgaggacgatatgaaacccggaagcttcgatcgctctatcccggagaataacattatgagaactattatagagtttttgtctttcctgcatctgaaggaagccggagctctcgaccgattactggatctccctgctgcagccagttccgaggacatcgagagaagttag

SEQ ID NO: 224201 - DNA, 1050 bp, Artificial Sequence
  Description of Artificial Sequence: Synthetic coding sequence
atggagttggctgttggcaatctgtcagaaggcaatgcaagctggccagaacctcctgccccagagccgggaccactgtttggaattggcgtcgaaaatttcgtcaccttggtggtgttcgggttgattttcgcactcggcgtgctggggaactcgctggtgataacagtactggcgcgatccaagccaggaaaacctaggtcgactactaatttatttatcctgaatctcagcattgccgatctggcataccttttgttctgtatcccgttccaggcgacggtgtatgcacttccaacatgggtcctcggggctttcatttgcaagtttatacattatttcttcaccgttagtatgctcgttagcatctttaccctggccgctatgtctgtcgatagatacgtggccattgtgcacagtagacggtcctcgtcccttagagtgagtagaaatgcactcctcggggtgggctgcatttgggcgctctccattgccatggcgagccctgtcgcatatcaccaaggactcttccaccctcgcgcttctaatcagaccttctgttgggagcaatggcctgaccctagacacaaaaaggcctatgtggtgtgcactttcgtatttggctacttgctaccgctgctgctgatatgcttttgctacgctaaggtactcaatcatcttcataaaaagctgaaaaatatgtccaaaaagagcgaagcctccaagaagaagaccgcccagactgttttagtggttgtggtggttttcggtatcagctggctgcctcaccatatcatacacctgtgggccgagttcggagtgttcccccttactcccgctagctttttattccgtataaccgctcactgcctcgcgtacagtaactcctccgtcaacccgataatttacgccttcctgagtgagaattttaggaaagcctataagcaggtctttaagtgccatattagaaaggattctcatctcagcgataccaaggagagtaagagccgaatagacacgcctccgagcaccaactgtacccatgtctag

SEQ ID NO: 224202 - DNA, 1164 bp, Artificial Sequence
  Description of Artificial Sequence: Synthetic coding sequence
atgaatgtgtctggctgcccaggcgctggcaatgcttcccaggcaggaggcggaggcggatggcatcctgaggcagtgattgtacctctgctgttcgccctcatcttcttggtggggactgtggggaacaccctcgttttggccgtcctgttgcggggaggccaagcggttagtaccacgaatttatttattctgaacctaggagtggcagacctgtgctttattttgtgctgcgttccattccaagctacaatttacaccctggacggctgggtgttcgggtcactgctatgtaaagcggtgcactttcttatattcctgaccatgcacgccagtagctttacactggctgccgttagcctcgacagatatttagcaattaggtacccgctccattctagggaactcagaacaccacgcaacgctttggccgctatcgggctgatctggggactgagcctgctcttctctgggccatacctgtcttattatcggcagtctcaattggccaacctgaccgtgtgtcatcccgcttggtcagcccctcggaggcgcgctatggatatctgcaccttcgtattctcgtatctgcttcctgtgctggtgctggggctgacctacgccaggacgctgcgctatctctggcgcgctgtcgacccagtagctgcaggcagcggagcacggagagccaaaaggaaggtgaccaggatgatcctcatagtcgccgcactcttctgcctgtgttggatgccccaccacgccctgatactgtgtgtgtggtttggccagtttcctcttacgagggcaacctacgcccttcgtattctgagccatcttgtcagctatgccaattcgtgtgtgaaccctatcgtatacgctttggtgagtaaacattttcgcaaaggtttcaggaccatttgcgcagggctgctgggaagggcaccaggcagggcttctggtagagtgtgcgccgctgcgcgtggcacgcacagcggatctgtgctcgagcgcgagtccagcgatcttctgcatatgtctgaagccgctggcgctttacggccatgccccggagcatcccagccctgcatcttggaaccatgcccaggtccctcgtggcaagggccaaaagccggagatagcatcctgacagtcgatgttgcttag

SEQ ID NO: 224203 - DNA, 1107 bp, Artificial Sequence
  Description of Artificial Sequence: Synthetic coding sequence
atggctgacgcccagaatatatccctggatagcccagggtccgtgggtgcagtagccgttccagttgttttcgctctgatatttcttctggggacggtaggtaacggtttagttctggcagtgctgctgcagcccggtcccagtgcatggcaggaacccggttccacaaccgatctttttatcctaaatctggccgtggcggacctgtgcttcattctgtgctgcgtgccgtttcaggccactatttacactcttgacgcgtggttgttcggtgctcttgtgtgtaaggcagtacacctacttatctatctgacaatgtatgctagctcttttaccctcgcagccgtgtctgtggaccgatatcttgctgtccgccacccgttgcggtcaagggctcttcgaacacccagaaatgcgagagccgcagtcgggttggtgtggttactcgccgctctgttctcagctccctacctgtcttactacggcaccgtccgctatggcgctctagaactgtgcgtgccagcctgggaggatgcgagacgccgagctctggacgttgctacatttgctgccggatatcttctgcccgtcgcagtggtgtcccttgcttacgggcgaactctccgctttctgtgggctgccgtcggacccgcaggcgctgcagctgcggaggcacggcgaagagccaccgggcgagctggtcgggctatgctcgccgtggcggcactctacgctctctgctggggacctcaccatgccctgatattgtgtttttggtacggaaggtttgcctttagcccggcaacatatgcctgccgattagcctcccactgtttggcttatgccaactcatgcctcaatcctcttgtctacgccctcgcttctcgccactttagagccagatttaggagactatggccatgtgggagaagacggaggcatagggctcgtagagctctgagaagagtgcggcctgcctcaagtggaccacccggatgtcccggtgatgccagacctagcggacgcctgctcgccggaggaggacaagggccagagccacgcgaagggcctgtccacgggggagaagcagcccgaggaccagagtag

SEQ ID NO: 224204 - DNA, 1959 bp, Artificial Sequence
  Description of Artificial Sequence: Synthetic coding sequence
atgggcaacttacagtcggagccatccgccggagggggatcccgcaaggtccagccatccgatagggcgccagatagcagacgcacatccctggtggagcccgaaatgacatctcaggccatgaggctcaccagaggattgggcgtctggttcccaggatcagccacacctcccggactcatggtccccagggagccacaggcaagcccgtcaacactgcccttaacattggagcggccatctccagtgatgccgccacctgaagaggccgcagctgtgtctgccccaccgcctgctccagccggaacactgctccctggaccatcaaagtggcaaaagcctgcgggaactcctgttccaagaattcgcagactcctcgaggcttcacatcgtggtcaaggggatccaccatcactgcggcctctgaaaccgccaccccctcccaggcagttgtccgttaaggacaccgtccctcgagcgccatcccaattcccccctcccctcgaaacgtggaaaccgcctccgcctctaccctccgaacgacagcctgctgatagacgtataactccagcgctggctacccctgcctcaccaccaactgaatcccaggcaggacccaggaaccaaggacagactgcgggacgcgcacgtgggggagctccacctcacgccggtgagggcgaaatggcccaacccgctgactcggaatccgggctgtctttgctgtgtaaaattactttcaaatcacgaccttccctggccccaccagccgcaagttcatctctcgcggcaaaggctagccttggcggaggtggaggtggcggtctgtttgcagcctcgggtgcaatttcatacgcagaggtcttgaaacagggacccctacctcctggagctgctcggccactcggagaagtgtcccggggtgctcaggaggctgagggcggagacggtgacggcgaggggtgctccgggcctccttctgcccctgcctctcaggccagggctttgccccctcctccgtacacaacatttcccggttccaaacccaagttcgactgggtaagtgccccagacggcccagaacggcacttccgcttcaatggggcaggcggagggatcggcgcaccaagacgaagagcagctgctctctcgggtccatgggggtccccaccacccccacccgaacagattcattctgcaccaggccctaggcgacccgcacctgctttattggctccaccaacattcatctttcccgctcctacaaatggagaacctatgcggcctggcccacctggcctgcaggaacttccaccgctaccgcctcctacaccccctcctactcttcagcccccagccctccaaccgacaccccttccagtggcaccgccactcacaccaggcctgggccataaagaaagtgccctcgcccctacggccgctccagctcttccgcctgctcttgccgctgaccaagcccctgcgccttctccagcgccagcccctactgtggccgaaccctctccacccgtcagcgccccagctccggcagccgctcccatcaagactcggactcgcagaaacaagggctcccgcgcagcccgaggagcgacaaggaaggatggactgcatggggacgggccacgcgagcgagccacggctactgtcccggatagcagtggaggtggtgggggtggcagcggagcctctcaaacaggcgctgccaatactagagcagccagacactggttgcctttccaagtcctgaattcctgcccctgcaaatgctactgtcaccaccaaccacgccataggcgcttaccaaggaatgtgtccgcctggctctccacgagcaccaaccacctgggggagccaccctgggtggctacaatcaagctttctggctccctcgtggctaagctggagcattatgacttgcaggctacacactcaaattag

SEQ ID NO: 224205 - DNA, 675 bp, Artificial Sequence
  Description of Artificial Sequence: Synthetic coding sequence
atggggaaccttcagtccgagccaagtgctggcggaggcagtagaaaggtgcagccaagcgatagggctccagacagcagacgcacaagcctcgtggagccagagatgacgagccaagccatgagactcacccggggtcttggagtttggtttcctggaagtgctacgccaccaggccttatggtcccgcgtgagcctcaagcttccccatctactttgcctcttaccctcgagaggccgagccccgtgatgccccctccagaagaagctgccgctgtgagcgccccacctcccgctcccgctggcaccctgctgccaggacccagtaaatggcagaagcccgctggcacccccgtgccgcgaatccggagattattagaagcatcccaccgcggacaaggtgatcccccaagcctgagaccactgaagcccccaccgccaccacgccagttatccgtcaaagatacggtccccagggctcccagccagtttcccccacctcttgagacctggaaacctccgccacctctgcccagcgagcgccagcctgcagaccgtcggattaccccagctctcgctacgccagcctgtgttagagctagaactcggggatgcgcgcaccaggatccccacgcccaggagcagggctttccgtgttcccctggacgcgactag

SEQ ID NO: 224206 - DNA, 2094 bp, Artificial Sequence
  Description of Artificial Sequence: Synthetic coding sequence
atggcccgacttgttgccgtatgcagggacggggaggaagagtttcccttcgaaagacgtcagatacctctgtacattgacgatacactgaccatggtgatggagtttcccgataatgtgctgaacctggacggacaccagaacaacggcgcacaactgaaacagttcattcagaggcacggcatgcttaaacagcaggacctttcgattgccatggtggtaacgagcagggaggtgctgtcagctctttcacaattggtgccctgtgtaggatgtagacggtctgtcgaacgccttttcagccagctagttgagagcggaaatcccgcactggagccccttacagtaggcccaaagggcgttcttagcgtgaccagatcttgtatgactgatgctaagaagctttacacgctgttttacgtgcatggaagcaagctgaatgatatgatcgacgctatacctaagtcaaaaaaaaataaaagatgtcagctgcatagccttgacactcataagcctaagcctcttggtggctgctggatggatgtatgggaactgatgtcgcaggaatgcagagacgaggtggtcctgatagactcttcatgtttgctggaaacccttgaaacttacctgaggaagcacagattttgtacagactgtaaaaataaagtattgagggcatataacattttgatcggcgaactggactgctcaaaagaaaaagggtactgcgccgcactgtacgaaggtctcagatgttgcccccacgaaagacatattcatgtctgctgcgagactgactttatcgcacacctgttaggtcgggctgagcctgagtttgcgggtggcagacgagagagacatgccaaaaccatcgacattgctcaggaggaagtactgacctgtctcgggattcacctgtacgagcgactacacaggatctggcagaaactacgggcagaagaacagacctggcagatgcttttttatctaggtgtggatgccctcaggaagagcttcgagatgacggtcgagaaggtgcagggtatttcccgacttgaacagctctgtgaagaattcagtgaggaagagagagtccgggagctcaaacaagaaaagaaaagacaaaaacgtaagaaccgccgtaagaacaagtgtgtgtgcgacattcctacgccgttacagacggcggatgagaaagaagtgtcacaggaaaaagagactgacttcatcgaaaacagttcttgcaaagcctgcgggtcaactgaagacggcaatacatgtgtggaggtgatagtaactaatgaaaatacaagttgcacttgtccctcctctgggaacctgttagggagtccaaaaattaaaaaaggactcagcccccattgtaacggatcagattgtgggtattcctcatccatggaaggctcggagacagggtccagagaagggagtgacgttgcgtgtactgagggcatatgtaaccacgacgagcatggagacgacagttgcgttcatcattgcgaggataaggaagatgacggcgactcctgcgtggagtgctgggcaaactcagaagaaaatgatactaagggcaagaacaagaagaaaaagaagaaatcaaaaatcctgaagtgcgacgagcatattcagaagctgggaagctgtataactgaccctggtaaccgcgagacttccggaaatactatgcataccgtgtttcaccgcgacaagacaaaggacactcacccggagagctgctgcagctctgaaaaaggcggtcagccactgccctggttcgagcaccgtaagaatgtaccccaatttgcagagccaactgagaccctcttcggacctgactcaggaaagggggctaagagcctagtggagttattggacgaatccgagtgcacctccgacgaggaaattttcatttctcaagacgaaattcaaagtttcatggccaacaatcaatcattctactctaatcgcgaacagtatcgacagcacctgaaggagaagttcaacaaatactgtcgtttgaatgatcacaagcggcctatttgcagcggttggctcacaacagctggagccaattag

SEQ ID NO: 224207 - DNA, 1548 bp, Artificial Sequence
  Description of Artificial Sequence: Synthetic coding sequence
atgtcatcgccaaatatatggagtaccggaagtagtgtgtattccacgcctgtcttcagccagaagatgacagtttggattctcctgttattgtccctgtaccccggatttacatcacagaagtcagacgacgactacgaggactacgcctcaaacaaaacctgggtcctcacccccaaagttccagaaggggacgttaccgtaattttgaacaatcttctggaggggtatgacaacaagctgaggcccgacatcggagtgaagcccaccctgatacataccgatatgtacgtcaattccatcggccctgttaatgcaattaacatggagtacacaattgacatcttttttgctcagacctggtacgacagacgcctcaagttcaactcgactattaaagtcctgaggctgaattccaacatggtcggcaagatttggattccagatacttttttcagaaattcgaagaaggctgatgctcactggattacaacacccaacaggatgttgcggatctggaatgacggccgtgtgctgtacacgctgcggctcacaattgacgctgagtgtcagctgcagctgcataatttccctatggacgaacattcatgtcccttggagttttcaagttggtcgcgttctattgcacaggcaggaatgtgttccggggtgatttcagcccactactcgctgcgattctgggggtccactgaccctcccacattggcctctcgtgtggcaggaatctccgacggatacccaagagaagagattgtctaccaatggaagcgctcgtctgtcgaggtgggggatacacgttcctggaggctgtaccagttttccttcgtcggactaagaaacaccaccgaggtggtgaaaacaacctctggcgattatgtggtcatgtccgtgtatttcgacctgtcacgccgtatggggtacttcacgattcagacctatattccttgcacgctcatagtggtcctgagctgggtgagtttctggatcaacaaggacgccgtgcccgctcgcactagcctgggcattactaccgtattgacaatgaccacactctctaccattgcacggaaatcactgcctaaggtcagttatgtgaccgccatggacttgttcgtaagtgtgtgttttatttttgtgttctctgcattggtcgaatacggaaccttgcattacttcgtctctaatcgtaagcccagcaaggataaagataagaaaaagaagaaccctttgttacggatgttttcctttaaagctcctactatagacatcaggccgcgaagcgcgacgatccagatgaacaatgccactcacctccaggagcgagatgaagaatacgggtatgaatgtctggacggaaaggattgtgcaagcttcttctgttgtttcgaggactgcaggaccggcgcttggagacacgggagaatccacatccgaatagcaaaaatggattcgtacgctaggatctttttcccaaccgccttttgcctgttcaatctggtgtattgggtgtcttatctctacttatag

SEQ ID NO: 224208 - DNA, 762 bp, Artificial Sequence
  Description of Artificial Sequence: Synthetic coding sequence
atggctcctaaactactgctgcttctctgtctgttcagtggactgcacgcgagatctaggaaagtggaggaagacgaatacgaggacagctcctcgaatcagaagtgggtccttgcacctaagagtcaggacaccgatgtgaccttaattttgaacaagctacttagagagtatgataaaaagctgaggccggatatcggaatcaaaccgactgtaattgacgtggatatctacgtgaattcaattggacccgtaagctcaatcaacatggaataccagatcgatatcttcttcgctcaaacgtggactgactccaggttacgctttaacagcacaatgaagattctgacgttaaattcgaatatggtgggacttatctggatccccgatacaatctttaggaattctaagaccgctgaggcacactggattaccactcccaaccaactcctgaggatctggaacgacggcaagatactatacactctacggttgactataaatgccgaatgtcaattacagctgcataactttccaatggacgagcattcatgcccattaatattcagcagctatgggtacccaaaggaggagatgatctatcggtggcgaaagaactcagtggaggccgctgatcagaaatcttggcgcctgtatcagttcgacttcatggggttgagaaatacaaccgaaatcgtcacgacctccgctggcagaaacctccttaaagaagcacagcttagcaaggctagagaggcttag

SEQ ID NO: 224209 - DNA, 1371 bp, Artificial Sequence
  Description of Artificial Sequence: Synthetic coding sequence
atgcgaaaatcacccggtctgagtgactgcctgtgggcatggattcttctcttatccacactgactggcaggagctacgggcagccatctttacaagacgagcttaaagataacacaaccgtgtttacgcggatcctggatcgtctcctcgacggatatgacaaccgattaaggcctggcctgggcgagagagtgaccgaggttaagaccgatatattcgttaccagctttgggccagttagtgaccatgacatggagtatacaatagacgtctttttcaggcagagctggaaagatgagcgtcttaaattcaagggcccaatgacagtgctgagacttaacaatttaatggcctccaagatttggacaccggataccttcttccacaacggaaagaaatcagtagcccataacatgacgatgccaaacaaactcctgcgaattactgaagatggcactttactctatacaatgaggcttaccgtacgggcagagtgtccaatgcacctcgaggacttccccatggatgcccatgcttgcccgcttaaatttgggtcttacgcctacactcgggcagaggtggtttacgagtggacccgtgagcctgcacggtccgtggtggtggccgaggatggttcaaggctgaaccagtatgacctgctgggccagactgtggatagcggcatcgtccagtcaagcacaggcgaatatgttgttatgaccacacatttccatctaaagaggaaaataggttacttcgtcatccagacatatctcccctgcatcatgacagtgatcctgtctcaggtctccttctggctcaacagagaaagcgtgcctgctagaacggtgttcggtgtgactacggtcctcactatgacaaccttgtcgatatccgctagaaattcactccctaaagtggcttacgcaacagccatggattggtttatagccgtatgttacgcgtttgtgttcagtgcactcatcgagtttgcaaccgtgaattatttcacaaaacgagggtatgcgtgggatggcaagagtgttgtcccggagaagccaaagaaagtaaaagaccctttaatcaagaagaataacacctacgcccctaccgccacaagctatacccccaaccttgccagaggagaccccggactggccacaattgccaaaagcgccacaatcgagcccaaggaggttaaaccagaaactaagcctcctgaaccaaaaaagactttcaactccgtgtccaagatcgatagattaagtcggatcgccttcccattattgttcggcattttcaacctggtttattgggccacctaccttaatcgggaacctcagttgaaagctcctaccccccatcagtag

SEQ ID NO: 224210 - DNA, 1371 bp, Artificial Sequence
  Description of Artificial Sequence: Synthetic coding sequence
atgcgcaaatcaccaggcttgtctgattgcttatgggcatggatcctgctactgtctacattaacaggaaggtcatatggtcagccctctttacaggacgaacttaaggacaataccaccgttttcacacggattctagatcgcctactggatggttatgataatcgcctgaggccaggtctcggggaacgagtgaccgaagtgaagacagatatcttcgtcacaagttttggcccagtgtctgaccatgacatggagtacacgattgatgtttttttcagacagtcctggaaagatgagcgactgaaattcaaggggcctatgaccgttctccgtttgaataaccttatggcatcgaaaatctggacccctgataccttcttccacaacggcaagaagtctgttgctcacaacatgacaatgcccaataaattattgcgcatcacagaggacgggactctgttatacacaatgcgcctcacagtccgagccgagtgtcccatgcacctcgaggatttcccaatggatgctcacgcttgcccactcaaatttgggtcatatgcttatactcgcgctgaagtggtctacgagtggaccagggaacccgcacgtagtgtggtggtggcagaagatgggagcagactcaatcaatatgacctactcggacagaccgtcgatagcgggattgtgcagtcgtctaccggagaatacgtggttatgacgacgcatttccatctgaaacggaagattggttacttcgtcatacaaacatacctaccttgtatcatgacggttatcctgtcacaggtgagcttctggctgaatcgtgagagcgtccccgcacgcaccgtattcggggtgacgacggtgttgacaatgacgacactgtcgatttccgccaggaatagcttgcctaaggtggcatatgctacagccatggattggtttatcgccgtctgctacgcattcgtattcagtgccttgatcgagtttgcaaccgtgaattattttacaaagagaggatatgcgtgggacgggaaatccgtggtcccagaaaagcccaagaaagtgaaggaccccttaattaagaagaataatacatacgcccctaccgctacttcctacaccccaaacttagcccgaggcgacccaggactggccacgattgccaaaagcgccaccatcgagcctaaggaggtgaagcctgagaccaagcctcctgagccgaagaagacctttaattcggtgagcaaaattgaccgattgagcagaattgcgtttcctctattgttcggcattttcaaccttgtgtattgggccacctatctgaaccgagaaccccagctgaaagctcccactccacaccaatag

SEQ ID NO: 224211 - DNA, 1371 bp, Artificial Sequence
  Description of Artificial Sequence: Synthetic coding sequence
atgcgaaagtctcctggtctctctgattgcctctgggcgtggattcttttattgagcacgcttactgggagatcctatggacagccatccctacaggacgagttgaaggacaatacgacggtgttcacaagaatactggatcgtctactcgatggctacgacaatagactacgcccaggcttgggcgagcgggtcacagaggtgaagacggatatttttgtgacaagtttcgggcctgttagcgatcatgacatggaatacaccatcgacgtattctttagacagagctggaaagacgagcggctaaagtttaaggggcctatgacagtgctgaggctgaataacctgatggcctccaagatttggacccctgacacattctttcacaacggtaagaagtccgtggcacacaacatgaccatgccaaacaaactgctcagaatcaccgaggatgggaccctgttatatactatgcggctgacggtgcgcgctgagtgtccaatgcacctcgaagacttccctatggacgctcacgcctgcccgttgaagttcggcagttacgcatatactagagctgaggtcgtatacgaatggaccagagagcccgcaagatccgtagtggtcgctgaggatggcagtcgcctaaaccaatatgacctgctcgggcagacagtggattcgggcatagttcagtcgagtacaggtgagtatgttgtgatgaccactcatttccacctgaagagaaagatcgggtatttcgtcattcaaacctatttgccatgcattatgaccgtcattctttcccaggtctccttttggctgaacagggaaagtgtgcctgcaagaactgtgtttggcgtgactaccgtgctgacaatgactacgttgagtatttctgctcggaacagcctgcccaaggttgcctatgctactgctatggattggtttatcgctgtgtgctacgcgttcgtttttagtgcccttattgaattcgccacggtgaactatttcaccaagaggggatacgcctgggacggcaagtccgttgtacctgagaaacccaaaaaggtgaaagatcctctcataaagaaaaacaacacatacgcgcctaccgccactagctatacccctaacctggcaagaggtgatcccggattggccacaattgccaaaagcgccaccatcgaacctaaggaggtcaaaccggagactaagccccctgagcccaaaaagactttcaactccgtgtccaagatcgacaggttatctagaattgcctttcccctcctctttgggatctttaatctcgtttattgggccacatacctgaatcgtgagccccagctcaaggccccaactccacatcaatag

SEQ ID NO: 224212 - DNA, 1371 bp, Artificial Sequence
  Description of Artificial Sequence: Synthetic coding sequence
atgaggaagtcccctggactttctgattgtctctgggcgtggattctgcttcttagtacacttactggaagatcctacgggcagccatctctgcaggatgagctgaaggacaatactacagttttcaccaggatattagaccgactgctggatggttacgataaccgattgaggccgggactcggcgaacgcgtgaccgaggtgaagacagatatattcgtgacttcatttgggccagtcagcgaccacgacatggaatacaccattgacgtgttttttaggcagtcttggaaagacgagcggttgaagtttaaaggtccaatgaccgttctgcgactgaacaacctgatggctagcaaaatctggactccagatacctttttccacaatggaaagaagtccgtcgctcacaacatgacaatgccaaataagctgctgcgcatcacagaagacggcaccctcctgtataccatgcggctgaccgtcagagccgagtgccctatgcatcttgaagacttcccaatggacgcccacgcgtgtccactcaagttcggaagttatgcatatacccgagccgaggtggtttatgagtggacccgtgaaccagccaggagcgtcgtcgtagctgaagatggcagcaggttgaatcagtatgacctgctcgggcagaccgtggacagcggcatcgttcagagttctactggcgaatatgtggtgatgaccacacacttccatcttaaacgcaagatcggatatttcgtaatccagacctaccttccctgtattatgactgtgatcctcagccaggtgtccttctggctgaatcgcgagtcggtaccagccagaactgtatttggggtgacaaccgttctcaccatgacgacactgagtatcagtgcacgaaatagcctgccaaaggtggcttacgccaccgccatggattggttcatcgcggtttgctacgctttcgtgttctcagctctgatcgagtttgctacagtgaactacttcacaaagagaggctacgcttgggatgggaaatcagtggttccagaaaagcccaagaaagttaaagacccattgatcaagaaaaataacacatacgcccctaccgcgactagctatactcctaacctggctagaggagacccaggactggcaaccatcgctaagagcgccaccatagagcccaaggaagttaaacccgagaccaagccccctgaaccgaagaagacgttcaactcggtgtcaaagatcgatcggctttccagaatcgccttcccactgctgttcgggatctttaatctcgtatactgggctacgtacctgaaccgcgaaccgcagctgaaggccccaacaccacaccagtag

SEQ ID NO: 224213 - DNA, 1371 bp, Artificial Sequence
  Description of Artificial Sequence: Synthetic coding sequence
atgcgtaagtcccctggcctgagcgactgcctctgggcctggatcctccttctttccaccctgaccgggcgtagctacggacagcctagcctccaggatgagctgaaggacaataccacggtcttcaccaggattctggatcgattattggacgggtatgacaatcgcctgcgcccaggcctgggggaacgcgttactgaggtgaaaacggacattttcgtcacatccttcggacctgtgtcagaccacgacatggaatacacaattgacgttttttttagacagtcctggaaagacgagcgactgaaatttaaggggcctatgacagtactgagactcaataacctcatggcctccaagatctggactcctgataccttttttcataacggaaaaaaatcggtggcccacaatatgacaatgcccaacaagctgctgaggattactgaagatggaaccctactgtatactatgcggctcactgtgagagccgagtgccccatgcaccttgaagattttccaatggacgcgcacgcatgtcctcttaagtttgggtcttacgcctacactcgagcggaagttgtgtacgaatggacccgagagcctgcccgttcagttgttgtcgctgaggatggatctaggctgaaccagtacgatttactaggtcagaccgtggatagtggcatcgtgcagtctagcaccggtgaatatgtggttatgacaacgcattttcacctcaaacgcaagatcgggtactttgtaatccaaacctatctgccttgcattatgacagtgatactgtcgcaagtttcattttggctgaaccgtgagtctgtgcccgcacggacggtctttggggtgacgaccgttctgacaatgactacactaagtatctcagcccgaaacagtttgccgaaagtggcctacgctaccgctatggactggttcattgctgtgtgctatgcattcgtgttctccgctctaatcgaattcgctactgtcaattatttcaccaagagaggatatgcatgggacggcaaatcagtggtgcccgagaagcctaaaaaagtcaaagaccccctgattaaaaaaaacaacacatacgcccctacagccacatcttatacccctaatctggctcgcggagatcctggactcgcaacaatcgctaagtctgctaccatagaacccaaggaagttaagcccgagacaaaaccccctgagcctaagaagacgtttaactccgtgtcgaagatcgataggttgtccagaatcgctttcccactcctgtttggcatatttaacctcgtatactgggccacttacctgaacagagaacctcagctgaaagctcccaccccccatcagtag

SEQ ID NO: 224214 - DNA, 1371 bp, Artificial Sequence
  Description of Artificial Sequence: Synthetic coding sequence
atgcgtaagagccccggactgtccgactgtctttgggcctggatcctgctcctgagtaccctgaccggaagaagctatggccagccttccctccaagatgaacttaaagacaatactacggtgttcactcgcattttagatcgcttgcttgacgggtatgataacagactcagacctgggttgggtgaacgcgttactgaggtgaagaccgacatctttgtaacatcatttggccctgtttccgatcatgacatggaatatacaatagacgtcttcttccggcagtcttggaaggacgagcgcttgaaatttaagggcccaatgacagttctgaggctgaataatctcatggcttctaaaatctggaccccagacactttcttccacaatgggaaaaagtcagtcgcccacaacatgaccatgccgaataaactgctgagaattactgaagacggtacccttctgtacaccatgaggttaaccgtccgagccgaatgcccaatgcacctcgaggactttcctatggatgcccacgcatgccctcttaagttcggttcctacgcgtacacgcgggcagaagtcgtctatgaatggacacgagaaccagcgaggagcgttgtggtggcggaagacggatccaggctgaaccagtatgatctgttaggtcagacagtagacagcgggatcgtgcagagctcaaccggagagtacgtggttatgaccacacactttcacctgaagagaaaaatcggttactttgtgatccagacctatctgccttgcataatgaccgtaatcctatcccaagtttctttttggctgaatagggaaagcgtgccggctcgaaccgtcttcggtgtgaccaccgtgctgaccatgactactctgagtatcagtgcccgaaatagccttcctaaggttgcttacgctacagctatggactggtttatcgcagtatgctacgcttttgttttctccgctttgatagaatttgccacggtaaattacttcactaaaaggggatacgcctgggacgggaaaagcgtggttcccgagaagccaaaaaaagttaaggatcctctgattaagaaaaacaatacatatgctcccacagcgactagctacacgcccaacctagcaaggggggaccccggattggcaacaatcgccaagagcgccaccatcgaaccaaaggaggtaaagcctgagaccaaacctcccgagccaaaaaagacctttaacagcgtctctaaaatcgaccgtctctccagaattgcttttcccctgttgttcggaatcttcaatctcgtctactgggctacttacctgaaccgcgagccccagctgaaagcgccaacccctcaccagtag

SEQ ID NO: 224215 - DNA, 372 bp, Artificial Sequence
  Description of Artificial Sequence: Synthetic coding sequence
atgagaaagtctcccggacttagcgattgtctgtgggcttggatcttgctcctgtccacattgaccggaaggagctacgggcagccgtcactgcaggatgaactgaaggacaataccaccgtttttaccaggatcttggatcgcctcttggatggttacgacaaccgactgagacctgggttgggtgaacgagtcactgaggtgaagaccgatattttcgtgaccagctttgggcctgtaagcgaccacgatatggaatatactattgacgtatttttccgacagtcttggaaagacgagaggctcaagtttaagggtccaatgaccgtgctcagactcaataacctgatggctagcaagatctggacatag

SEQ ID NO: 224216 - DNA, 1356 bp, Artificial Sequence
  Description of Artificial Sequence: Synthetic coding sequence
atgaagacaaaactgaacatttataacatgcagttcctgctctttgtctttttggtctgggacccagcgaggctggttttagcaaacatccaggaggacgaagcaaagaataatattactatctttacgcgcatcttggatcggttgttggatggatatgataaccgtctgcggccaggccttggcgattctataacggaggtgtttacaaatatatacgttacgtcttttggccctgtgtccgataccgatatggaatacactatcgacgtgttttttaggcagaagtggaaagacgaacgtcttaaattcaagggccctatgaacattctgaggctgaataacttaatggcatcgaagatttggacccccgataccttctttcataatggcaagaagtctgtggcacataatatgacaatgcctaacaaactgctgcggattcaggacgacgggacacttctctataccatgcgcctgacagtgcaggcagaatgtcccatgcatctggaggactttccaatggacgcccacagttgtcctctcaagttcggaagttacgcctacactacttctgaagtcacgtacatctggacctacaacgcgtccgactctgtccaggtggcgcctgatggatccaggttaaaccaatatgatctccttggccagtccatcggcaaagaaaccatcaaatccagtactggagagtatactgtgatgactgctcattttcatctgaagcggaaaatcggatatttcgtaatacaaacctatctgccctgtattatgaccgtcatcctgtctcaggtgtccttttggctcaatcgggaatctgtgcctgccaggacggtctttggcgtgactacagtgcttactatgacgacactgagcattagcgctagaaactctttgccgaaggtggcatacgctactgccatggactggtttatcgccgtgtgttacgcatttgttttctcggccttgattgaattcgctaccgtcaattatttcactaaaagaggctgggcgtgggatggaaaatccgttgtgaacgacaagaagaaggaaaaagccagtgtcatgatccagaataatgcatatgcagtggctgtggctaattacgcaccaaaccttagcaaggaccccgtgctgtccacaataagcaaatccgcaaccacccccgaacccaacaagaaacccgaaaacaaaccagctgaggcgaaaaaaacatttaattccgtgtctaagattgataggatgtcacggatcgtgttccccgtgctgttcggaaccttcaatctcgtctactgggctacatacctcaatagagagcccgtgctcggtgtctctccttag

SEQ ID NO: 224217 - DNA, 1356 bp, Artificial Sequence
  Description of Artificial Sequence: Synthetic coding sequence
atgaagactaagctcaacatttacaacatgcaattcttattgtttgtgttcttggtctgggacccggcacggcttgtgctggcgaacatccaggaggacgaggcgaaaaataacatcaccatttttacgaggattctggatcgactccttgatggatacgataacaggctgagaccgggactgggcgattctataactgaagtctttacaaatatctatgtaaccagtttcggcccagtatctgataccgacatggaatatactattgacgtgttcttccggcagaagtggaaagacgagagactcaaatttaagggtcccatgaatatcctaagactgaacaatctgatggcaagtaaaatttggacccctgatactttctttcataatggcaaaaagagtgtggctcataatatgacaatgccaaacaagctcctccgaatacaggatgacggcacactcttgtacactatgagactgaccgtacaggccgagtgccctatgcacctagaggacttccctatggacgcacactcctgcccgcttaagttcggaagttatgcgtacactacatctgaggtgacctacatctggacctataatgcctctgacagcgttcaggtcgcccctgacggatcccggctgaaccagtacgatctgctgggtcaatccatcggtaaagagaccattaagtcctctaccggagagtacacagtcatgaccgcccatttccatctgaaaagaaaaatcggatattttgtgattcagacttacctgccatgcattatgaccgtgattctctcacaggtgagtttttggttaaatcgcgagagcgtacctgctagaacggtatttggagtgaccaccgtcctcacaatgaccaccctgagcatcagcgccagaaacagcctgcccaaagttgcctacgcaacagctatggactggttcatcgccgtgtgctacgcttttgtcttctctgctttaatcgagtttgctacagtgaactatttcacaaagagagggtgggcctgggacgggaagagtgtggtgaacgacaaaaagaaggaaaaagcgtcagtgatgatccagaacaacgcttacgccgtcgccgtggccaattatgcaccgaatttaagtaaggatcctgtgctctctaccatttccaagagcgctaccacgcctgaacccaacaaaaaaccagagaacaaaccggctgaagccaagaaaacatttaactcagtaagcaaaatcgatcgaatgtctcgcatcgttttccctgtcttgttcggcacattcaatctggtatactgggccacatacctaaatcgtgagcccgtgttaggggtgtccccgtag

SEQ ID NO: 224218 - DNA, 459 bp, Artificial Sequence
  Description of Artificial Sequence: Synthetic coding sequence
atgaaaacaaagctaaacatctataatatgcagttccttcttttcgtgttcctggtgtgggatcccgcacggctggtgctggctaatatccaggaagatgaggctaagaacaacattaccattttcacgcggatccttgatcggctattggacggctatgacaaccggcttcgtccaggcctcggggattccattacagaggtgtttacaaatatttacgtgacctcctttggcccagtgtctgacacggacatggagtatacaatcgatgtgttcttccgccagaaatggaaggacgagcgccttaaattcaagggtcccatgaacattctgcgcctgaacaacttaatggccagcaagatctggacaccggacactttctttcataatggtaaaaagtcagtggctcacaacatgacaatgcctaacaagctgctgagaatccaagatgatggttag

SEQ ID NO: 224219 - DNA, 414 bp, Artificial Sequence
  Description of Artificial Sequence: Synthetic coding sequence
atgaagacaaaactgaacatctataatatgcagttcctcctcttcgttttcctcgtgtgggatcccgctcggttggttctagccaatatacaggaggacgaagccaagaacaacataacaatcttcacccgtattctagaccgcttactcgatggctacgacaatcgtctgcgtccgggactaggtgattcaatcacggaagtttttactaacatttatgttacctcattcggtccggtaagcgatacagatatggagtatacaatagacgtctttttccggcagaaatggaaagacgagagactcaagttcaagggccctatgaacattctgcggctcaataacctcatggcctcaaaaatttggacaccagataccttcttccataacgggaaaaaatctgtggcacattag

SEQ ID NO: 224220 - DNA, 1536 bp, Artificial Sequence
  Description of Artificial Sequence: Synthetic coding sequence
atgaagaccaagctcaacatttataacatgcagttcctgctgttcgtcttcctggtctgggaccccgcacgcctggtactggccaacattcaggaagacgaagctaagaacaacatcaccatttttacacggatattagatcgcctcctggacggttatgataaccggttaagaccaggcctaggcgattctatcaccgaggtatttacaaacatatacgtgacaagcttcggccctgtgtccgatactgatatggagtacactatcgatgtgttttttcgccagaagtggaaggacgaaagactgaaattcaagggaccgatgaatatcctgaggctaaacaacctcatggcaagtaagatttggacccccgataccttcttccacaacggcaagaaaagcgtcgcccataatatgactatgcctaataaactgctaagaattcaggatgacgggaccctgctgtacacgatgcgattaactgtgcaagcagaatgccctatgcacctggaagatttcccaatggatgcacactcctgcccactgaagttcggctcctatgcatacaccacatcggaagtgacatacatctggacatacaacgcatcagactccgtacaggtggccccagacgggagcaggctgaaccaatacgatctgctgggccagagtataggcaaagaaaccattaaatcctccaccggtgagtacacagtcatgacagcccatttccaccttaagaggaaaattggatatttcgtgatccagacttatcttccctgtattatgaccgtcattctcagccaagtgagcttttggcttaacagggaatcggtgccagcacggactgtctttggcgtcactaccgtgctgaccatgaccacattatcgataagcgccaggaactcactgcccaaagtggcttatgcgacagccatggattggtttattgctgtgtgttatgcattcgtattctccgctctaatcgagtttgctaccgtgaattacttcacaaagcgaggatgggcctgggatggaaaaagcgtggtgaacgacaaatctccgtctattaaagcggaaggtattactctgacatacaacagtgtcaaggctatcctccaaggggctaagcttatctggtcaaagtatattgcattcagctggccttctctcttccaggaaaaaaccctggaatatctagagaagtggatggactgccttacctttaagcagtcttctaagaaagagaaagcttctgtaatgatccaaaataatgcctatgcagttgctgtggccaattacgcgccaaacctgtcaaaggatcctgttttgagcacaatcagtaagtccgccaccacacctgaaccgaataagaaacctgagaataaaccagccgaagctaagaaaacatttaatagcgtgtcaaagatcgaccggatgtcccgtatcgtcttccccgtcctcttcgggacatttaatttagtatactgggcaacatacctgaacagggaacctgttctgggtgtcagcccatag

SEQ ID NO: 224221 - DNA, 1356 bp, Artificial Sequence
  Description of Artificial Sequence: Synthetic coding sequence
atgaagacaaagctgaacatttacaacatgcaattcctgctcttcgtgttcctggtatgggatccagccagactagtcctggccaacatccaagaggacgaggcaaaaaataatattacaatatttacccgaatcttggatagactcctggacggatatgacaaccgtttgcgtcctgggttgggagacagcatcactgaagttttcactaacatttatgttacaagttttggccctgtctccgatacagatatggagtataccatcgacgtgttcttcaggcagaagtggaaagatgaacgcctgaaattcaaaggccctatgaacatcctcagactgaacaacctgatggcaagtaagatatggacgcctgacactttttttcacaatggaaagaaaagcgtcgctcataacatgactatgcccaacaaactgctgaggatccaggacgatggaactctgctgtacaccatgcgcttaacagtccaggctgaatgccctatgcacctggaagattttcctatggatgcacattcgtgtcccctcaagtttgggtcatatgcctatacaacttctgaggtgacttacatctggacttacaatgcaagcgattccgtgcaggtggcacccgacgggtctcgactgaatcagtacgacctactgggccagagtattgggaaggagactataaagtcaagtacgggtgaatacaccgtcatgactgcccattttcatctcaaacggaaaatcggttatttcgtgatccagacttatctgccatgtattatgacagttatcctgtctcaggtgtcattttggctgaaccgtgagtccgtgcccgctaggaccgtgtttggagttaccacagtacttacaatgaccacgttaagtatctcagccaggaactccttgcctaaggtggcctatgccactgccatggactggttcatcgctgtttgttatgcatttgtgttttcggccctcatagagttcgctaccgtcaactacttcactaagagaggatgggcctgggacggcaagtccgtcgtaaacgataagaagaaggaaaaagcaagcgtaatgattcaaaacaatgcttacgctgtggcagtggccaactacgcccctaacctgagcaaagatccggtgctcagcaccatctctaagtcagctaccacaccagagcccaacaagaagccggagaataagccagccgaagctaaaaaaacattcaatagcgtcagtaagatcgacagaatgtccaggatcgttttccctgtacttttcgggacctttaacttagtgtactgggccacatacctgaacagagagccagtgctgggcgtgtccccctag

SEQ ID NO: 224222 - DNA, 1356 bp, Artificial Sequence
  Description of Artificial Sequence: Synthetic coding sequence
atgaagaccaagttaaacatctacaacatgcagtttctactctttgtgttcctcgtttgggatccagctagactggtccttgccaatattcaggaagacgaggccaagaataacatcacgatatttacgcgcatactggacaggctgctagacggatacgataatcgccttcggcctggcctgggagatagcatcacagaagtcttcaccaatatctacgtgacgtccttcgggcctgtatccgatacagacatggagtacactatcgacgtgttcttccgacaaaaatggaaggacgagagactcaaatttaaagggcctatgaacatcctgcgtctgaacaacctgatggcgagcaaaatctggaccccagatacattcttccacaacggtaaaaaaagtgtcgcccacaacatgaccatgccaaataaactcttgcgcatacaggacgatggaaccctgctgtatactatgcggctcacagtgcaggccgaatgccccatgcacctggaggatttccctatggacgcccatagttgtccattgaagtttggtagctatgcatatacaaccagcgaggtgacttacatctggacctataacgccagcgattccgtacaagttgccccagacggcagcaggttaaatcagtatgacctgttgggccagtccatcggaaaagagaccattaaatcctcaaccggggagtataccgtcatgactgcccactttcacttgaaacgcaaaatcggttacttcgtgatccagacttatctcccttgtatcatgacagtcattctctctcaggtctcattctggctgaaccgggagagtgttcccgcacgtactgtattcggggtcaccaccgtgttgaccatgacgacactgagtatctcagccaggaactctttgcctaaggttgcctatgccacagctatggattggtttatcgccgtttgttacgcatttgtcttctctgcactgattgagtttgctacagtcaactatttcacaaagagaggatgggcctgggacggcaaaagcgtggtgaacgataagaagaaggaaaaggcttcagtcatgattcagaacaacgcctatgcagtggccgtcgccaattatgcaccaaatttgagcaaagaccccgtgctcagtacaatcagcaagagtgctacaaccccagagccaaataagaagccagaaaacaagccggctgaagctaaaaaaacattcaattccgttagcaaaatagaccggatgagccgcattgtattccccgtgctgtttggcacattcaatctggtatattgggccacttatctgaatcgggagccggtgctaggtgtgtccccctag

SEQ ID NO: 224223 - DNA, 1104 bp, Artificial Sequence
  Description of Artificial Sequence: Synthetic coding sequence
atgaaaacgaaactgaacatctacaacatgcagtttctgctgttcgtttttctcgtttgggatccagcgagacttgtcttggccaatatccaggaagacgaagcaaaaaataacattaccatcttcacaaggatcctggataggcttctggacggctacgacaatcggttgcgccctgggctgggcgactccatcaccgaggtttttactaatatatacgtgacttcttttgggcctgtctctgacacagatatggagtacaccattgatgtgttcttccgccagaagtggaaagacgaacggttgaagttcaagggaccgatgaacatcctgcgcctgaacaatctgatggcgtccaagatttggacccccgacaccttcttccataatggcaaaaaaagtgtggcccacaacatgaccatgcccaacaaattgttgaggatccaagatgacgggaccctgctgtataccatgcggctgacagtgcaggctgagtgtcctatgcatctagaagattttccaatggacgctcactcctgtccactgaaatttggcagctatgcttacacaacaagcgaagtcacatatatttggacatataacgccagtgacagcgtgcaggtggcacccgacgggagccggctgaatcagtatgaccttcttgggcagagcattggtaaggagactataaaatcctcaaccggagagtatacagtgatgaccgctcatttccacttgaaacgtaagatcggctacttcgtcatccagacctacctcccgtgtatcatgaccgtcatactgtcccaggtttccttttggctcaatcgcgagagtgtgcctgcacgcaccgtgttcggggtgactactgtcctcactatgaccaccctatctatctccgctaggaactctttgcctaaggttgcatacgctacggctatggactggtttatagccgtctgttatgccttcgtcttttctgccttgatcgagtttgctaccgtgaactactttactaagcggggatgggcatgggacgggaagtcagtggtcaacgataaggtgtcagaatctttccgtgtaattataattaagaagatcccatag

SEQ ID NO: 224224 - DNA, 1371 bp, Artificial Sequence
  Description of Artificial Sequence: Synthetic coding sequence
atgagactgaagatcacacttcctagccttcgtgagttcctcaccgacttctggatggtgaccattattggactagaccaggattgggaggaatacacgattgacgttttctttcgccagaagtggaaggatgaaagactgaaatttaaaggtcctatgaacatcctcaggttaaacaatctcatggcttccaagatctggaccccagatactttcttccacaatggaaaaaagtctgtggcacacaacatgacaatgcccaataagcttctgaggattcaggacgacggcactctgctgtacaccatgcgactgacggtgcaagctgagtgcccgatgcacttagaggactttccaatggatgcccactcctgccccctgaagtttgggtcttacgcatatactacctccgaggtgacgtacatttggacctacaacgccagcgattctgtgcaggtagctcctgatggaagccgtcttaaccagtacgatcttcttggccagagtatcggtaaggaaacaatcaaaagctcaaccggcgagtataccgtgatgactgcccatttccacctcaaaaggaagattggttacttcgtgattcagacatatctgccttgtatcatgaccgtgatcctgtcacaggtctcattctggttgaacagggagtcagtgcctgccaggactgtttttggggtcaccacagtgctcactatgacgaccctctcaatctccgcacgtaactcactcccgaaggtcgcatatgccactgcgatggattggttcattgccgtgtgttacgcatttgtgttcagcgcccttattgagttcgccactgttaactactttaccaaacgcggatgggcatgggacggcaaatccgtggtgaacgataaatccccgtccatcaaggcagagggaattactcttacttacaattccgtgaaagcaattctgcagggggcaaagctgatttggtctaagtacattgcattcagttggccttccctgttccaagagaagaccctcgagtatcttgaaaagtggatggattgccttacttttaaacagtcttcaaagaaggaaaaggctagtgtcatgatccagaataacgcctatgccgtcgctgtcgctaactatgcgccaaacctgtcgaaggatcctgtgttgtccacgatctcaaaaagcgctactacacctgagcctaacaagaaacccgagaacaaacccgcagaggctaaaaaaacgtttaattcggtgtctaagatcgacaggatgtcccggatcgtgtttccggttctgttcggcaccttcaacctcgtctactgggccacctacctgaacagggagcctgtcctgggtgtcagcccatag

SEQ ID NO: 224225 - DNA, 1479 bp, Artificial Sequence
  Description of Artificial Sequence: Synthetic coding sequence
atgattatcactcagacttcccattgttacatgacctcccttgggattctgtttctgatcaatatactgcctggcaccacaggtcagggagagtcccggaggcaggagccaggcgacttcgtaaaacaagacattggcggactgtcacccaaacacgctcctgatatcccagatgatagcaccgacaacataaccattttcaccaggatattggacagacttctggatggatacgataatcggttgcgtccagggcttggggacgcagtaacggaagtgaagaccgatatctatgtcacttccttcgggcctgtgtccgacactgacatggagtacacgattgatgtgttttttcgacagacgtggcacgacgagaggctaaaattcgacggacctatgaagatcctgcctttaaacaaccttctcgcctcaaagatatggaccccagatacattttttcacaatggcaaaaagtctgtagcacacaacatgacgaccccgaataaactcctcagactggtggacaacggcacgcttctctacaccatgagactgactatccacgccgagtgtcctatgcatctggaggattttcctatggatgtccatgcctgtcctctgaagttcggttcttatgcgtacactactgcagaagtggtgtactcctggaccctcggaaaaaacaagtcagtggaggtcgcgcaggatggctcaagactcaatcagtatgacttgctgggtcatgtagtagggactgagatcatccgaagctccacgggcgagtacgtggtgatgactacgcacttccacttgaagaggaaaattggatactttgttatccagacttacttaccctgcatcatgacggtgatcctgtcccaggtcagcttctggttgaatagagaaagtgtccccgctaggaccgtattcggagtgaccacggtgctcaccatgactaccctcagtatctcagcacggaacagcctgccaaaagtggcctacgccaccgctatggactggtttattgcggtgtgctatgcatttgttttctcagcccttattgaatttgctacggtgaattattttaccaagcggtcctgggcctgggaagggaagaaggttcctgaggcacttgagatgaagaaaaaaacgcccgctgccccagccaaaaagacaagtaccaccttcaacatcgtgggcacaacctaccctattaacctggcaaaagataccgagttctctaccatttccaaaggcgcagctcccagcgcgagtagtacacctacaatcatcgccagccccaaagcaacgtacgttcaggattcacccaccgagacaaaaacctataactctgtgtcaaaggtcgataaaattagcaggataatcttccccgtactctttgcaatattcaacctcgtctactgggctacctacgttaacagggaatccgcaattaaaggcatgatccgtaaacaatag

SEQ ID NO: 224226 - DNA, 1479 bp, Artificial Sequence
  Description of Artificial Sequence: Synthetic coding sequence
atgatcatcacccagaccagtcactgttacatgacgtcgctcggaattttatttctgatcaatatactgcccggaaccacaggtcaaggcgagagtcggagacaggagcccggagactttgtgaaacaggatatcggcggactcagccccaagcacgctcctgacattcccgacgactctactgacaacattactatatttacacgcatcctagaccggcttttagatgggtacgacaaccggcttcggccagggctgggggatgccgttaccgaggttaagaccgacatctacgtgacatctttcgggcctgtatcagatacagatatggaatacacaatcgacgttttcttccgccagacatggcacgatgaaagactgaagttcgacggacccatgaaaatcctgccactgaataacctcctcgcgtccaaaatttggacccctgacacgttcttccataatggaaagaagagtgtcgcccacaatatgacaaccccaaacaaactcctgcgactcgtggataatggcaccctgctctacaccatgcggctgacaatccatgctgagtgccccatgcatctggaagatttcccgatggacgtacacgcctgccctctgaaattcggaagttatgcttacacaaccgcagaagtagtgtacagctggactctcgggaaaaacaagtcagtagaggtagcccaggatgggagccggctcaatcagtacgatctcctgggtcacgttgtcggtacagagattataagatccagtacgggcgagtacgtggttatgactacccactttcacttgaaacgcaagatagggtactttgtaattcagacatacttgccctgcatcatgactgtgattctgtctcaagtgtccttctggttgaacagagaatccgtccctgcaagaacggtgtttggcgttaccactgtgttgaccatgactactcttagtatttccgcgaggaattcccttcccaaagtcgcttacgctacagcaatggactggttcatcgccgtctgctatgcatttgtgtttagcgccttgatcgagttcgccacagtcaattactttaccaagaggtcatgggcttgggaagggaaaaaagtccccgaggccttggaaatgaaaaagaaaaccccagcggcacctgccaagaaaacatctacgacattcaatatcgtcggcactacctatccaataaatctagcgaaggatacagaattttccaccattagcaagggtgccgcaccctcagcctcaagcacacccaccattattgcctcccccaaagccacatacgtccaggatagtcccaccgagaccaagacttacaactccgtgtcgaaggtcgataaaatttctaggattattttcccagtgctatttgcaatattcaacctcgtctactgggctacttacgtaaacagagagtcggccatcaaggggatgatccgaaaacagtag

SEQ ID NO: 224227 - DNA, 339 bp, Artificial Sequence
  Description of Artificial Sequence: Synthetic coding sequence
gaatataccatcgatgtttttttccgacagacatggcacgatgaacggttaaagttcgacggccctatgaagatccttccgctgaataacctcttagcgtccaagatctggactcctgacacgttctttcataatggcaaaaagtctgtcgcccacaacatgaccacccccaacaaactccttagactcgtggacaatggtaccctgctctacactatgcgcatcgaagaggtgcagaaacaccgctccatgatgaagccctccgtttcctacacggtcgccccttggattcaagaaggcggtcctggcggtaggcacagacttaagatggaaaaatag

SEQ ID NO: 224228 - DNA, 1479 bp, Artificial Sequence
  Description of Artificial Sequence: Synthetic coding sequence
atgatcattacccagacaagccattgctatatgacctctctcggcatcttgtttctgatcaacattctccccggtacaactggtcagggggagtctagacgccaagagcctggtgactttgtcaaacaggatatagggggactttcgccgaaacatgcaccggacattcctgatgatagcacagataacatcaccatatttactcgtatcttggataggttattagatggctatgacaatcggctgagaccaggtctgggggacgctgtgactgaagtgaagaccgatatctatgtcaccagctttggacccgtttctgataccgacatggagtacaccattgatgttttttttagacagacttggcatgatgagcgcttgaagtttgatgggccaatgaagattctgccactcaataacctgctggcctctaagatttggacaccagacaccttcttccataacggcaagaaatctgtcgctcacaatatgaccacccctaataagctcctgcggctggtggacaatggcacattgttgtacacaatgcggttgacaatacacgctgaatgtcccatgcatttggaagatttcccgatggatgtgcacgcttgtcctttgaaattcggtagctacgcctatacgaccgccgaggtcgtctactcttggacactgggaaagaacaagagtgtggaggtggcacaagacgggtctaggctcaatcagtacgatctgctgggccatgtggtcgggactgaaataatccggtccagtacaggcgaatatgtcgtcatgaccacgcattttcacctcaagcgcaagataggatacttcgtgattcagacatacctgccatgcattatgacggtgattttatcacaggtgagcttctggctgaaccgggaatccgtaccagcccgaactgtgttcggggtgacaactgtactaaccatgaccacacttagcatttcagctcgcaatagcctgcccaaggtcgcctacgccaccgcaatggactggtttatcgctgtgtgttatgcttttgtgttctccgcccttattgagtttgccaccgtgaattactttaccaaacgaagctgggcctgggagggcaagaaggttcccgaagctttagagatgaaaaaaaaaaccccagcagcccctgcaaaaaaaacatctactaccttcaacatcgtcggcacgacctaccccataaacctcgctaaggacaccgaattctcgacaatcagtaaaggtgccgcaccgagtgcttcttccacccctacaatcattgcttcacctaaggctacctacgtgcaagattccccaacagaaaccaagacttataacagcgtgtctaaggtggacaagatcagcagaataattttccctgtgttgtttgccatattcaacctggtttattgggccacctacgtgaaccgagaatccgctatcaaaggaatgattcgaaagcagtag

SEQ ID NO: 224229 - DNA, 1665 bp, Artificial Sequence
  Description of Artificial Sequence: Synthetic coding sequence
atggtgtccgccaagaaggtgcccgctattgccttaagtgccggtgtgtctttcgccctcctcaggttcctttgcctagccgtttgcctcaacgaaagcccagggcagaaccaaaaggaggagaagctctgcactgagaattttacccgtattctggatagcctcttggacggctatgataatcgcctgcggccaggatttggaggtcccgtgacggaggtgaaaacagacatttacgtcacatccttcggccctgtctctgacgtggaaatggagtacaccatggacgtctttttccgccaaacgtggatagacaagcgccttaagtacgacggccctattgaaattttacgtttgaacaacatgatggtaacgaaggtgtggacacccgatacattttttcgcaatgggaagaaaagtgtgtcacacaatatgaccgcgcctaacaaactgttcagaattatgagaaatggaactatcctctatactatgagacttacaatcagcgctgagtgtcctatgagacttgtggacttccctatggatggtcacgcctgtcccctgaaattcggttcctacgcctatcccaagtccgagatgatttacacctggacaaaaggccctgaaaagtcggtggaggtgccaaaggaatccagttcattggtacagtatgacctcatcggccaaacagtgtccagcgagacaatcaagtccatcacaggtgaatatattgttatgacagtatacttccacctcagaaggaaaatgggctattttatgattcagacatacatcccatgtattatgactgtaatcctctcacaggtgagtttttggattaacaaggagtcggtgcccgcacgcactgtgtttggaatcacgacagtgctgaccatgaccaccctaagcatctccgcccgacatagcctccctaaggtttcttacgccactgccatggactggttcatcgcagtgtgcttcgcttttgtgttctctgcgttgatagagttcgccgcagtgaattattttacaaacattcagatggagaaagctaaacgcaagacctctaagcctcctcaggaggtgcctgcagctccagtccaacgcgagaaacacccggaggccccattacagaatactaatgccaacctgaacatgagaaaacgcacaaatgctcttgtccactccgagagcgacgttgggaaccggacagaggtgggaaatcactcctctaagtcctccacggtggtgcaagagagctccaagggtactccacgttcttacctggcatcttctccaaatcctttttctcgcgctaacgcagcagaaactatttcagccgctcgtgctttacctagcgcgtctcctacatccatcagaacgggttacatgccgaggaaagcctctgtcggatcagcttcgacccggcatgtcttcggatccaggttgcagaggattaaaacaaccgttaacacaatcggcgcaaccggaaagctcagcgctacccctccaccatctgccccacctcctagcggcagcggtaccagtaaaatcgataagtacgcaagaatcttgtttcctgtgacttttggtgccttcaacatggtatactgggtagtttacctgtctaaagacacaatggagaagagtgagtccctcatgtag

SEQ ID NO: 224230 - DNA, 1389 bp, Artificial Sequence
  Description of Artificial Sequence: Synthetic coding sequence
atggacaatggaatgttctcaggattcattatgataaagaacctgctgctcttctgcatctctatgaacctcagttcccattttggcttctcccagatgccaacttccagtgtgaaagacgaaaccaacgataatattactatctttacaaggatcctggatggactgctcgacgggtacgataaccggttgagacccggtctgggtgagagaatcacgcaggtccgcactgacatctacgtgacctcttttggccctgtgtcggatacagaaatggagtataccatcgacgtgttcttcaggcagagctggaaagatgagcgtcttcgtttcaagggtccaatgcaaaggctcccactgaataatctgctggccagcaaaatttggacccctgacacattcttccacaacggaaagaagagtatcgctcataatatgacaactccaaataagctacttcgcttggaggacgacggcacgttactctacaccatgcgcctaaccatctcggcggagtgcccaatgcaacttgaggactttcctatggatgcccacgcgtgtccccttaagtttggaagctatgcctatcctaattctgaggtggtgtacgtctggacgaatggatcaacaaagtcagttgtagtcgctgaagacggatctcgccttaaccagtaccatctcatgggccagactgtggggaccgaaaatatcagcacctcaactggcgaatacactattatgactgcccacttccaccttaagaggaagatcggatatttcgtgatccagacgtatctcccctgcattatgaccgtgatcctgtcccaggtgtccttctggctcaaccgtgaatctgtgcctgcgcgtacagtgtttggggtgaccactgtgctgactatgaccactcttagcatttccgctaggaactctctgccaaaggtggcttacgccactgccatggactggtttatcgccgtgtgttatgctttcgtgttttctgccctgattgaattcgcgaccgtcaattactttaccaaaagaggttgggcttgggacgggaaaaaagctttggaggccgctaagattaaaaaaaagcgggaggtaatactgaataagagtacaaacgctttcactactgggaagatgagccacccccctaacattcctaaggaacagactcccgctggtacatccaacacgacatcggtatctgtgaagccctctgaggagaagacatctgagtcaaagaagacatataattcaatttccaaaattgacaaaatgagtcgtattgtctttccagtgctgttcggaacatttaaccttgtctactgggctacgtatcttaatagggagccggtcattaagggggcagcgagccccaaatag

SEQ ID NO: 224231 - DNA, 1389 bp, Artificial Sequence
  Description of Artificial Sequence: Synthetic coding sequence
atggataacggcatgttctcgggctttattatgatcaagaatctcctgctgttttgcattagcatgaacctgtcttcacactttggattttcacagatgccaacctcttccgtgaaggacgagacgaacgacaatatcaccattttcaccagaatcctcgatggcctgctggatggctatgataataggctgcggcctgggctcggggagcgcatcactcaggtgcgaactgatatatatgtgacttcgtttgggccagtctctgatacagagatggaatatacgattgacgtgttttttcgacaaagctggaaagatgagcgcctcagatttaagggccctatgcaacgtctgccactcaataatctccttgcgagcaagatttggaccccagacacattttttcacaatggaaaaaaaagtatcgcccacaacatgacgactcccaataagctgttacgcctcgaagacgatggaactttattatacactatgcggctaactatctcggccgagtgccctatgcagctagaagatttcccaatggacgctcacgcttgtcccctgaaatttgggtcttatgcctaccccaactccgaggttgtgtacgtctggacaaatggctcgactaagagcgtggtggtggcagaggacggctcaagactgaaccagtatcatctgatgggacagacagtgggcactgaaaacatctcaactagcaccggcgagtacaccatcatgaccgcccactttcatctcaagcggaaaatcggatatttcgtgattcaaacctatctgccttgtataatgactgttatcttgagtcaagtctccttctggctcaacagggagtcagtgcccgcaaggacagtgttcggcgtcactactgttctcacaatgaccacattgagtatttcggctagaaattccctgcccaaggtcgcttacgcaacggctatggattggttcatcgccgtgtgctatgctttcgtcttcagcgcgcttatagagttcgcgaccgtgaattatttcacaaagcgcggttgggcttgggatgggaagaaggcactcgaggctgccaagattaagaagaagcgggaagtcattctgaataaatccacaaatgccttcacaactggcaaaatgtcacatcccccaaatatccccaaggagcagacccccgctggaacatccaacacgacttctgtaagcgtgaagccatccgaggaaaaaacatccgagagcaaaaagacatacaatagcatctctaagatcgacaaaatgagtcgcattgtgtttccagttctgttcggaaccttcaatttggtttactgggccacctacctaaatagagaacctgtgattaagggagccgcatctccgaaatag

SEQ ID NO: 224232 - DNA, 1389 bp, Artificial Sequence
  Description of Artificial Sequence: Synthetic coding sequence
atggacaatggcatgttcagtggctttataatgatcaagaacttgctgctcttttgcattagcatgaatctgagtagccacttcggcttctcccaaatgccaacatctagcgtcaaggatgaaactaatgacaatataacaatctttaccaggatcctcgatggcttgctagacggatatgacaatagattacggcctggattgggggaacgcattactcaagttcgcaccgatatatacgtgacgtcctttggacccgtgtccgatacagaaatggagtataccatcgacgtttttttccgtcagtcttggaaagacgagcgcctgcgttttaaggggccaatgcagagactgcccttgaacaatctgcttgccagtaagatttggaccccagatactttcttccataatggcaaaaaatccatcgcacataatatgaccacccccaataagctactccgcctagaggatgatggcactctgttgtacaccatgagacttaccatctctgccgaatgtcccatgcaactagaggattttccaatggacgcccatgcttgtccactgaagtttgggagctacgcttatccaaattcagaagttgtttatgtgtggacaaacggtagtaccaagagtgtcgtggtggccgaggatgggtctagactgaatcaataccacctcatggggcagactgtgggcacggagaacatctccacttctacaggggaatataccatcatgacggcccactttcatctgaaaagaaaaattgggtatttcgtgattcagacatatcttccttgcataatgaccgtgatattatctcaggtttcattttggctgaaccgcgaaagtgtgccagccaggacagtctttggggttaccactgtgctgactatgactactctctcaataagcgctcgaaacagccttcccaaagttgcatatgctaccgcaatggactggttcattgccgtgtgctatgcctttgtgttcagcgcactcatagaatttgctaccgtgaattattttaccaaaaggggatgggcctgggacggcaagaaagcactggaagccgctaaaatcaagaagaagcgggaagtgatcctgaataagagcaccaatgctttcacaactggtaagatgtcacatcccccaaacatcccgaaagagcagacgccagcaggcacaagtaataccacgtccgtatccgtcaagcccagcgaagagaagaccagcgagagcaagaaaacatacaatagtattagcaagattgataagatgtctaggatagtgttccccgtgctgttcggcacatttaacctcgtgtactgggcgacctacctcaatcgagagccagttattaagggagctgcatccccaaagtag

SEQ ID NO: 224233 - DNA, 261 bp, Artificial Sequence
  Description of Artificial Sequence: Synthetic coding sequence
atggacaacgggatgttcagtgggtttatcatgattaaaaaccttctgctgttctgtatttcaatgaatcttagcagccatttcggcttcagccagatgcctacttcgagcgtaaaggacgagacaaacgacaatattacaatattcacacgtatactggatgggctgctagacggatacgataataggctgcgccctggtttgggcgaacggatcacccaggtgagaacagatatttatgtgacttctttcggcccatag

SEQ ID NO: 224234 - DNA, 450 bp, Artificial Sequence
  Description of Artificial Sequence: Synthetic coding sequence
atggacaatggcatgttcagtgggttcatcatgattaaaaacctgctgctgttttgcatcagtatgaacctgtcatctcattttggattcagtcagatgccaacatctagtgtgaaagatgagacgaatgacaacattactattttcacccggattctggatggcttgctggatggatacgataacaggcttcggcctggcctcggagagcggattacacaagtacgtaccgacatttatgtgaccagcttcggcccagtaagcgacactgagatggagtataccatcgacgtattctttagacagagctggaaggatgagaggctaaggttcaagggccctatgcagcgcctccccctcaataacctgctggcctcaaagatatggacccccgacacgttcttccacaacggtaagaaatcaatagctcataatatgacgacaccctag

SEQ ID NO: 224235 - DNA, 501 bp, Artificial Sequence
  Description of Artificial Sequence: Synthetic coding sequence
atggataatggaatgttctcgggctttatcatgataaaaaacctccttctcttctgtatcagcatgaacctgtctagtcacttcggcttctcccagatgcccacatccagcgttaaggatgagacaaacgataacattactatattcacccggattctggacgggcttctcgatggctacgataacagacttcgacccggactcggtgaacgtataactcaagtccggacggacatctatgtgacaagcttcggtcccgtctctgataccgagatggagtatactatcgatgtcttcttccggcagagttggaaggatgagaggttacggtttaaggggccaatgcagcggctaccccttaacaaccttcttgcctctaaaatttggacgcccgatacgtttttccacaacggtaaaaagtcgatagctcataatatgacaaccccaaacaaactccttaggctggaggacgacggaaccctgctgtataccatgcggtag

SEQ ID NO: 224236 - DNA, 51 bp, Artificial Sequence
  Description of Artificial Sequence: Synthetic coding sequence
atggacaacggtatgttcagcgggttcataatgatcaaaaacctcctttag

SEQ ID NO: 224237 - DNA, 1362 bp, Artificial Sequence
  Description of Artificial Sequence: Synthetic coding sequence
atggcctcatctctcccatggttgtgcatcattctttggctggaaaacgccctcggaaaattggaggtagaggggaacttctattctgaaaacgtcagcagaattttggacaacttgttggagggctacgacaatcggttacgaccaggctttgggggtgccgttaccgaagtgaaaacagatatctatgttacctcttttggccctgtaagcgacgtagagatggagtacacaatggatgtctttttccgacaaacttggaccgacgagcggctgaaatttggtggcccaacggagatcctaagcctgaataacctaatggtatcgaaaatttggacccccgatacattcttccgcaacggcaagaagagcatagcccataatatgaccactcctaataaactattccggatcatgcagaacggcacaatcctatatactatgcgtctgacgatcaacgctgattgtcctatgcgcctggtgaacttccccatggatggccacgcatgccccttgaagttcggatcctacgcctatcccaaatcggagatcatttatacttggaagaaaggcccactctattcagtagaggtcccagaggagagttcctcactgctacaatatgacctgatcggtcagacagtctccagtgaaactattaaatctaacacaggagaatatgtcatcatgaccgtgtatttccacctgcagagaaagatgggttatttcatgatccagatctacactccatgtatcatgacagtgattctgagccaggtttccttttggataaacaaggagagcgtcccagccaggacagtttttggaatcacgacggttctgacaatgacaaccttgagcatcagcgctaggcacagtttgcccaaggtgagttacgccactgcaatggattggtttattgctgtatgcttcgcattcgtcttttcagctctgatcgagtttgccgcagtgaactacttcaccaatttgcagacacagaaagcaaaacgaaaggcccagttcgccgcaccaccaactgtgaccatctccaaagccacggagccgctggaagcagaaatcgtgctgcacccagactctaagtatcacctcaagaagagaattacttctctttcactgcccatcgtttcttcgtccgaagccaataaagtcctgacaagagctcctatcttgcagtccacacccgtgacgccaccaccacttagccctgccttcggcggaacctcaaaaatcgaccaatatagcagaatactgtttcctgtagctttcgccggtttcaacttagtttactgggtcgtttacttgtcgaaagataccatggaagtctcttcttccgtcgagtag

SEQ ID NO: 224238 - DNA, 1332 bp, Artificial Sequence
  Description of Artificial Sequence: Synthetic coding sequence
atggcttcatctctcccttggctgtgtattatcctgtggctggaaaacgctctgggcaaactagaagtggaggggaatttttacagtgaaaatgtctcccggatactggataatctgttggagggctacgacaatcgcttgaggccaggatttggaggtgctgtcacagaggtgaaaactgacatctatgttacgagtttcggccctgtaagtgacgtagaaatgacctggactgacgagcgactgaaattcggaggacccacagagatcttgtccttaaataacctgatggttagtaaaatttggacccctgacacatttttccgcaacgggaagaagtcaattgcccacaacatgacaacccctaataaactatttcggatcatgcagaatggcacaatcctgtatactatgaggctgaccatcaacgccgactgtccaatgcggttagtgaattttccgatggatggccacgcctgccccctaaaattcggtagctacgcttatcctaagtccgaaattatctatacatggaaaaagggtcctctgtactccgtggaagttcctgaggagagcagctctctgttacagtatgacctgatcgggcaaacagtctcatcagagaccatcaagtctaacacaggggagtatgtaatcatgaccgtgtacttccacttgcagcggaagatgggttatttcatgattcagatctacaccccctgtattatgacagtgatcctatctcaagtgtctttctggattaataaagagtcagtgcctgcaagaactgtgttcggtatcaccaccgtgttgacaatgacgacgctgtccatctctgcaagacactcactccctaaagtgtcttatgcaacagctatggattggtttatagctgtttgctttgcattcgtcttctcggcattgattgaattcgcggcagtgaactattttactaacttacaaacacagaaagcaaagagaaaagcacagtttgctgcccctcccacagtgaccatctccaaagctaccgaacccctggaggccgagatcgtcctccaccctgatagcaagtaccacctcaaaaagagaatcacaagtctgagcctgcctatcgtgagctccagtgaggccaataaggtactgacacgtgctcccatcctgcagtctactcccgtgaccccgccaccccttagccctgcgtttgggggaacaagcaagattgatcagtactcccggattcttttccccgtcgcctttgctggtttcaatctcgtctactgggtggtgtacctgtctaaggatacaatggaagtgtcttccagcgttgaatag

SEQ ID NO: 224239 - DNA, 1425 bp, Artificial Sequence
  Description of Artificial Sequence: Synthetic coding sequence
atgtggacagtgcagaacagggagagtcttgggctcctgagttttcccgtgatgatcacgatggtgtgctgcgcacacagtaccaacgagccgagcaacatgtcgtacgtgaaagaaacagtcgatcgcctgctcaagggctacgacattcgactgagacctgatttcggcggacccccagttgacgttggaatgcgaattgatgtggcatctatcgatatggtgtcagaggtgaacatggattataccctgacaatgtacttccagcagtcctggaaagacaagagactgtcatattctggcattcctctaaatctcaccctggataatagagtggccgatcagctgtgggtcccggatacctatttcctcaatgacaagaaaagctttgtgcatggtgtgaccgttaaaaacaggatgattaggctgcatcctgatgggacagtgctgtacggactccggattacaacgaccgccgcatgcatgatggatctgcgtcgataccctctcgacgaacagaactgtacgctggaaatcgagtcgtatggatacactaccgacgatatcgaattttactggaacggcggtgaaggggctgtgacaggcgtcaataagatcgaactgcctcagttctctatcgtggattacaagatggtgagcaaaaaggttgagttcaccactggcgcatatcccagactcagtctcagctttaggctcaagcgcaacatcggatacttcattttacagacttatatgccgtccacattgatcaccattctctcctgggtgtcattctggatcaactacgacgcctcggctgctagagtagcactgggcattactacagtgctgactatgacgacaatcagcacacacttgcgcgagactctgcccaaaatcccttatgtgaaagccatagacatttacttaatgggctgtttcgtgttcgttttcctggcgctcctggaatacgcgtttgtgaattacatctttttcggcaagggcccacagaaaaaaggtgccagcaagcaggaccagagtgccaatgagaagaataagttggagatgaacaaggtccaagtcgacgctcatggcaacatcctgttgtctacacttgagattcgaaatgagactagtggatccgaggtgctgacctccgtgagcgacccaaaagccacaatgtactcatacgacagtgctagcattcagtatcgcaaacccctaagcagcagagaagcttatggccgtgcccttgatcggcatggggtgcccagtaaaggcagaatcaggagacgggcttctcaactgaaagttaagatccccgatctaacggatgttaacagcatcgataagtggagcaggatgttttttcccatcacattttctctgttcaatgttgtgtactggctgtattacgtgcactag

SEQ ID NO: 224240 - DNA, 1215 bp, Artificial Sequence
  Description of Artificial Sequence: Synthetic coding sequence
atgaccttcgcttgcggaagaacatcggaggattatactctaacaatgtacttccagcagtcctggaaggacaaaagactgtcctacagtggcatccctcttaacctgacacttgataatagggtggccgaccagctgtgggttcccgatacatacttcctgaacgataagaagtcatttgttcacggcgtgacggtgaagaatcgcatgattcgcctccaccctgacggtactgtcctctatggactgagaatcaccaccaccgcagcatgtatgatggacttgcggcgttaccccctggacgaacagaattgcaccttggaaatagagtcttacgggtacaccactgatgatatagagttttattggaacggaggggagggagctgtcacgggtgtaaacaaaatagaactgccccagttcagcattgtcgactacaaaatggtgagcaagaaggtggagtttactactggggcttatccaaggttaagtctgtctttcagacttaagcggaacatcgggtactttatcctgcagacatacatgccgtctacacttattaccatcctgtcctgggttagcttctggattaactacgatgcctcagcagcccgtgtggccctgggaatcacgacagttctgaccatgaccactatctctacccacctgagggaaactttgcccaaaatcccatacgtgaaggccattgacatataccttatgggttgtttcgtgttcgtatttttggccctactcgaatacgcctttgtcaattacattttttttggcaaaggaccacagaagaagggagcatccaagcaggatcaaagtgccaacgagaaaaataagctggagatgaacaaagtccaagtggacgcgcatggtaacattttgctcagcaccctggagatccgcaacgagacttcgggatccgaggtgcttacctctgtcagcgatcctaaggccactatgtatagctacgatagtgcttccatacaatacaggaagcccttgtcttccagggaggcctatggtcgggctctcgaccgccacggagtgccctcaaaggggcgtatccgaaggagagcctcccagctgaaggtaaagatacctgatctgactgatgtgaacagtatcgataagtggagtaggatgttcttccccatcactttctctctgtttaacgtggtgtattggctgtattacgtccattag

SEQ ID NO: 224241 - DNA, 1539 bp, Artificial Sequence
  Description of Artificial Sequence: Synthetic coding sequence
atgtggcgggtgaggaaacgtggatattttgggatctggtcttttccattgattattgccgcagtgtgtgctcaatcggtgaatgatccctccaacatgtctctagtgaaagagacagtggaccgcctgttgaaagggtatgacataaggctgagaccagattttggcggacctccagtagcggtgggcatgaatattgatattgcatccatcgatatggtgtcagaagtcaacatggattatactctgaccatgtacttccagcaagcttggcgtgacaagcgccttagttacaatgtcatcccactcaatctcacactggataatcgagttgccgatcaactgtgggtgccggacacctactttcttaacgataagaagtcctttgtacatggggtaactgtgaagaatcgcatgatccggctacaccctgacggaaccgtgctctacgggctgagaatcaccaccaccgcggcttgcatgatggacctacgcaggtacccccttgacgagcagaactgcacacttgagattgagtcatacggttatactaccgatgatatcgagttttattggcgcggtgacgataacgccgtgacgggagttactaaaatcgaactacctcagttcagcatcgttgattacaagctgattacaaagaaggttgtgttctctacaggctcttaccctaggctcagtctatctttcaaattgaagcggaatatcggatatttcatcctgcagacatatatgccgtctatcttgatcactatcctgagttgggtgagcttttggattaactatgatgcttccgcagccagggtagccttaggtatcactactgtactaaccatgaccaccataaatactcacttgcgcgagactcttccgaagataccatacgtgaaagcaatcgacatgtatcttatgggatgcttcgtctttgtgttcatggcactcctggaatacgccctcgtgaactatatcttttttgggaggggaccacaaaggcaaaaaaaggccgcagagaaggccgctagcgccaataatgagaaaatgcgactcgacgtgaataaaattttctacaaggacataaagcagaatgggacccagtatcgcagcttatgggacccaaccggaaatctgtcccccactcgacgtaccactaactatgacttcagtctttacacaatggacccgcacgagaacatccttctgtctactcttgaaataaagaatgagatggcgacctctgaagctgtcatgggactgggagaccctcgcagcacgatgcttgcgtacgacgcatctagcatccagtaccggaaggcaggcctaccacgccactctttcggccgaaacgccctcgagcgccacgtggctcagaaaaagagcagactccgcaggcgcgcttcacagctcaaaattactattccagatctcaccgacgtcaatgctatcgatcgatggagccggattttcttccccgtggtgttctccttcttcaatatcgtgtattggctgtactacgtgaactag

SEQ ID NO: 224242 - DNA, 1425 bp, Artificial Sequence
  Description of Artificial Sequence: Synthetic coding sequence
atgtggcgagtgaggaagaggggctacttcgggatctggagctttccgctcatcatcgcggcagtttgcgctcagtccgtcaacgacccttccaacatgagtctagtgaaggagactgtcgatcgattactgaaaggatacgatatcaggcttagacctgacttcggtggtccacccgtggctgttgggatgaacatcgacatcgcctccatcgatatggtatccgaggtcaacatggactacactttgaccatgtactttcagcaggcatggcgggacaagcgtctttcatataatgtgatccctttgaatctgaccttggataacagggtggctgaccagctgtgggtgccagatacctatttcctaaatgacaagaagtcatttgttcacggggtcaccgtgaaaaatcgcatgatacggctccatcctgacggcaccgtcctctatggactccggatcaccacaaccgcagcatgtatgatggacctgcgcagatatcccttagatgaacagaattgcacgttggagatcgaatcttatggctatacgacagacgacatagagttttactggaggggagatgataacgcagtaacaggggtgaccaaaattgaactcccccagtttagcatagtagactacaaactaatcaccaaaaaggtcgtgttttccacgggaagctaccctcgcctgagcctatcctttaaacttaagcgcaatatcggctactttatcttacagacgtacatgccctctatcttaatcactatcctgagctgggtatcattttggattaattacgacgccagcgccgctagggtggcccttggaatcacgactgttctgacgatgactacaatcaatacccatttaagggagacattgcctaagatcccgtatgtgaaggccatagatatgtatctcatgggctgttttgtgttcgtgtttatggctctgcttgagtacgccctcgtaaattatatcttttttggccgaggtccccagcgtcagaagaaggcggcagagaaagcagcaagtgccaacaatgagaaaatgcgcctggacgttaacaagatggaccctcacgaaaacatcctgctgtccacactcgagatcaagaatgagatggccactagcgaggccgttatgggcctaggcgacccacgttccaccatgttagcatatgatgccagttcaatacagtaccgcaaagcaggtttgccccgacacagtttcggcagaaatgccctggagcgacacgtagcacagaaaaaatccagactgcggaggcgcgcaagccagctaaagatcacaatcccagatctgacggacgtcaatgcaatcgaccggtggtctagaatattcttccctgtggtattttcctttttcaacattgtctactggctctactatgtcaattag

SEQ ID NO: 224243 - DNA, 1539 bp, Artificial Sequence
  Description of Artificial Sequence: Synthetic coding sequence
atgtggcgagttcgaaaacggggttatttcggcatctggtccttcccactcattattgcagctgtgtgcgcacaaagcgtcaacgacccaagcaacatgagcctggtgaaggaaactgtcgaccggctgctgaagggctatgatatcagacttaggcccgatttcgggggaccacctgttgccgtcggaatgaatatcgatatagcctccattgatatggtcagcgaggttaacatggattataccctgaccatgtattttcagcaggcttggagagacaaacgtttaagctacaatgtgatcccactcaaccttaccctggacaatagagttgccgaccagctctgggtacccgacacttatttcctgaacgacaaaaaaagctttgtgcacggcgtgacggtgaagaacaggatgattagactgcacccagatggtaccgtgctgtacggcctgcggattaccacgaccgccgcttgtatgatggatctccgccgatacccacttgacgagcagaactgcacactggaaatcgaatcgtatggctataccacggacgatattgaattctattggaggggagatgataacgcagtgaccggtgtgactaaaattgagcttccccagttttcaatcgtcgattacaaactgatcacaaaaaaggttgtgttttctaccggctcttatcctaggttgagtctgtcctttaagttgaagaggaacattggctatttcattctccagacttacatgccatcgattcttattaccattctaagttgggtgagcttttggatcaactatgatgcctcggccgcaagggttgctcttggaattacaactgttctgaccatgactacgataaacacccacttgcgcgaaacacttccaaaaattccatacgtaaaggcaattgatatgtatctgatggggtgctttgtttttgtcttcatggccttattggaatatgcactcgtgaattacattttcttcggtcgcggtccgcagcgtcagaagaaggctgccgagaaggctgcctccgctaataatgagaagatgagactggacgtcaacaagatcttctacaaggacataaaacagaatggcacccagtatcgttcgctctgggacccgaccggcaatctctcgccaactaggaggaccacgaattacgatttctctctgtataccatggatccacatgagaatatattgctgtctaccttggagatcaaaaatgagatggctactagtgaggcagtgatgggccttggggaccctcgatccacaatgttagcatatgacgcttccagcattcaataccggaaggccggtctgcccaggcactcttttggcaggaatgctctcgagaggcacgtggcccagaaaaagagcagattaagacgacgggcttcacagctaaagatcaccatccctgatctcacggatgttaacgctatcgacaggtggtcaaggatcttcttccctgttgtgttctctttctttaatatcgtttactggctgtactacgtcaattag

SEQ ID NO: 224244 - DNA, 945 bp, Artificial Sequence
  Description of Artificial Sequence: Synthetic coding sequence
atgatggaccttcgccgttatcctctggatgaacagaattgcaccctcgagatcgaatcgtatggttacacaactgacgacatcgaattttactggaggggagacgacaacgccgtaaccggcgtgacgaagatagaactgccccagttcagcatcgtcgattataaattaattaccaagaaggtggtgttcagtacagggtcctatcccaggctgtctttgagttttaaactgaaaagaaatatcggctacttcatcttgcagacgtacatgcccagcatcttgattacaattctgtcatgggtgagtttttggattaattatgatgccagtgccgcacgcgtggcactgggaattacgacggtcctaacaatgaccactattaatacccatcttagggagacccttccaaagattccctacgtcaaagccattgatatgtatctgatgggatgcttcgtgttcgtgttcatggccctcctcgagtacgctctggtcaactatatcttctttgggagaggaccacaaaggcagaagaaagcagccgagaaagcggcttcggcaaataatgagaaaatgcgtctggatgtaaataagatggacccacacgaaaatatattgctctccaccttagaaatcaaaaatgaaatggctacaagcgaggcagttatggggttgggggaccctcgcagcacaatgcttgcctacgacgctagttctattcaataccgcaaggcagggctgcccagacacagttttggcaggaatgcactggagcgacacgtcgcacagaagaaatcacggctgcgacgacgggcatcccagctcaaaattacaatacccgaccttactgacgtaaatgccatcgatcgctggtcccgaattttcttcccggtcgtgttttctttctttaacattgtgtactggctatattacgtaaactag

SEQ ID NO: 224245 - DNA, 1236 bp, Artificial Sequence
  Description of Artificial Sequence: Synthetic coding sequence
atgaatatagacatcgccagcatagacatggtatcggaggtaaatatggattacacactcactatgtattttcaacaggcatggcgagacaagcggctgtcctacaacgtgattccgttgaatctgaccctggacaatcgggtcgccgatcagctctgggtccctgatacctatttcctgaacgacaaaaagagcttcgtgcacggggttaccgtgaaaaatcgaatgatccggcttcatcctgacggaactgtactgtatggactgaggatcactacaacagccgcatgtatgatggacctccggagatatccattggatgagcagaactgcaccttggaaatcgagtcctatggctatacgactgatgatatcgaattctactggcggggtgatgataacgcggtgaccggggttaccaagatcgagttaccacagttttcgatcgtcgactataagctgatcaccaagaaggtagtgtttagcacagggagttacccacgcttgtccctatctttcaaactcaaaagaaacatcggctacttcattttgcagacatacatgccttcgatcctgatcacgatcctgagctgggtgagtttttggatcaactatgacgcatccgctgctcgtgtggcactaggaatcactaccgttctcacaatgaccaccataaacactcatttgcgcgagacgctgccaaagattccttacgtgaaagctatcgatatgtatctgatggggtgcttcgttttcgtctttatggcactgctggaatacgcactggttaattatatctttttcggcagagggccacaaagacaaaagaaagcagccgagaaagcagcaagcgcaaataacgagaagatgcgtctggacgtgaacaagatggatccccacgagaatatactgcttagcacccttgaaatcaaaaacgaaatggcgacctcggaggcagtgatgggactaggcgaccctcgcagcaccatgctggcctacgacgcctcaagcatacagtacaggaaggccggtctgcctcgacattctttcggacgcaatgcgttagagcgccatgtggcacagaagaaatcccggctgcggagacgggcttcgcaattgaagatcacaattcccgacttaacagacgttaatgcgattgatcgatggtcccgtatttttttccccgttgttttttcatttttcaatattgtctactggttatattacgtcaactag

SEQ ID NO: 224246 - DNA, 1425 bp, Artificial Sequence
  Description of Artificial Sequence: Synthetic coding sequence
atgtggcgggtccgcaaaaggggttacttcgggatttggagttttccattgattattgctgccgtctgtgcacagtcagtgaatgacccctctaatatgtcgttggtcaaggagactgtggaccgactgctcaaagggtacgacatacgcctgagacccgattttggcggtccccctgtcgcagtcgggatgaacatcgacatcgctagtatcgacatggtatccgaagtgaacatggattacaccctgacaatgtacttccagcaggcatggagagataagaggctctcctacaacgttatacccctgaacctcacactcgataatagggtggccgatcagctgtgggtacccgacacctatttcctgaacgacaagaagtcattcgttcacggcgtcactgtaaaaaacaggatgatccggttgcatccagatggaacagtgctgtatggcttaagaataacaaccactgctgcatgcatgatggacttaaggaggtacccgttggacgaacagaactgcaccctcgaaattgagtcgtatggatacacaacagacgatatcgaattttattggcggggtgatgacaacgcagtgacaggtgttaccaagattgagttaccccagttcagcattgtcgactataaattaatcactaagaaagtggttttctcaactgggtcctacccccgactaagtctgagcttcaagctgaaacggaacattggctactttattctgcaaacctatatgccttctatcctgataaccatcctaagctgggtatccttctggatcaattatgatgcatccgccgcaagagtggctctgggcataacgactgtgcttacgatgactaccattaatacgcacctgagagagacacttcctaaaatcccttacgtgaaggcgatcgatatgtacctgatgggctgcttcgtgttcgttttcatggccctgctggaatatgcactggtcaactatatattctttggccgtggacctcaacggcaaaagaaggccgctgaaaaagcagcgtccgcaaacaacgagaaaatgaggctcgatgttaataagatggacccacatgagaatatcctgttgtctacattggagattaaaaacgaaatggcaacctcagaggccgtcatggggctcggtgatccccgatccactatgctagcctatgatgcttcatccattcagtaccggaaggctggcctgccccgtcactcctttggcaggaacgcactggagaggcatgtcgcacagaagaagagcaggctgcgaaggcgagctagtcaactgaagattaccatccctgacctaaccgacgtgaacgcaattgaccgatggtctcggatttttttccccgtggttttcagctttttcaacattgtctactggctgtactatgtaaactag

SEQ ID NO: 224247 - DNA, 1422 bp, Artificial Sequence
  Description of Artificial Sequence: Synthetic coding sequence
atgtgcagtggtctgttggagctgttattgcccatttggttgtcttggacactggggacgcgtggcagcgaaccgaggtccgttaatgatccagggaacatgtctttcgtaaaggaaactgtggacaaattgcttaaaggctacgatattcgcctgcgccctgactttggcggaccgccagtgtgtgtggggatgaatattgatatcgcttctattgatatggtgtcagaggtgaatatggattacactctgaccatgtatttccagcagtactggagggacaagagattagcctatagtggaatccctttaaacttaacactcgataatagggtggccgaccagctgtgggtgccagatacctacttcctcaacgacaagaagagtttcgtccacggagtaaccgtaaaaaataggatgatcaggctgcaccctgacggcaccgtgctgtatggccttcggatcaccactacagcggcatgcatgatggacctacgaaggtaccctctggacgagcagaattgtacactggagatcgagagttacggctatacaacagacgatattgaattctattggagggggggagacaaagccgtcacaggtgtagagcgaatcgagttaccacagttcagtatcgtggaacatagattggtttcacgaaatgtggtatttgccaccggcgcatacccaaggcttagcttgtctttcagactaaaacggaacatcgggtactttatcctgcagacctatatgcccagtattcttatcaccatcctgtcatgggtgtcattctggatcaattacgatgcgtccgccgcacgggttgccctgggcatcacgaccgtgctgaccatgacgacaatcaacacacatctaagagaaaccctacccaaaatcccatatgtgaaggcaatcgacatgtatctgatggggtgctttgtgtttgtgtttctggctctcttggagtatgcattcgtgaattacattttttttggtcggggtccccagagacagaagaagttggccgagaagacagccaaagcaaagaatgaccgaagcaagagcgaaagtaaccgggtggatgcacacggaaatatactgttaacctctttagaggttcacaatgagatgaatgaagtgtccgggggaattggtgatactcgcaacagtgcaatctccttcgataactcaggcattcagtacagaaaacagtccatgccacgagaagggcatggcaggtttctgggcgatcgatctcttccacacaagaagactcatcttagaagacgatcgagccaattaaagattaaaattcccgacctcaccgacgtcaacgcaattgacaggtggtcacggatcgtgtttccatttactttttcactattcaaccttgtctattggctttactatgttaattag

SEQ ID NO: 224248 - DNA, 1422 bp, Artificial Sequence
  Description of Artificial Sequence: Synthetic coding sequence
atgtggggcctcgccggaggcagactgtttggcatattcagcgctcccgttctagtcgctgtcgtatgctgtgcccagagcgtaaatgatccgggtaacatgtcctttgtgaaggaaacagtcgacaaactcctcaaaggatatgacattcgcctccgacccgacttcgggggtccccctgtttgtgtggggatgaatatcgacatagccagtatcgacatggtttctgaagtaaacatggactatacactgaccatgtacttccaacagtactggagggataaacggctggcctatagcggaatccccttaaacttaacccttgataaccgcgtcgcagatcagctgtgggtgcccgacacttacttcttgaacgataaaaaaagcttcgttcacggagttacagttaagaatcggatgattaggctccatccggacgggaccgtgctgtacggactacgaattacgactacggccgcttgcatgatggatctgcgcagatacccactggatgagcagaattgcaccctggaaatcgagtcatatggctacaccacggatgatatagaattctattggcggggaggcgataaagcagtgaccggggtggaaaggatcgagctccctcagttcagcattgtcgagcatagattagtgtcccgcaacgtagtgtttgccacgggagcctatcccagattaagtctctcttttagattaaagcgaaacattggctactttattttacagacctacatgccgtcaatccttattaccatactgtcatgggtaagtttctggatcaactatgacgcttccgctgccagggtcgccctcgggataacaaccgtgcttaccatgacaacaatcaacactcacctccgcgagaccctgccgaaaatcccgtatgtgaaggcaatcgatatgtacctgatgggatgcttcgtcttcgtgttccttgctttgcttgagtacgctttcgtcaactacatcttcttcggtagaggacctcagcgacaaaagaaattagcagaaaagacagcaaaggcgaaaaatgatcgctccaagtcagagtccaaccgtgtggacgcccatggaaatattttactgacatctttagaggtccacaacgagatgaacgaggtaagcggcggaattggtgatacacgtaattccgcaatcagcttcgataacagtggcatacagtaccgaaagcagagcatgcctcgggagggacatggccgtttccttggcgaccggtctctgccacacaagaagactcatctgcgacgcaggtcgtcacagttgaaaatcaagatccctgaccttaccgacgtgaacgccatcgatcgatggtcacggatcgtctttccctttacattttcactgttcaacctcgtgtactggttgtattatgtgaattag

SEQ ID NO: 224249 - DNA, 1209 bp, Artificial Sequence
  Description of Artificial Sequence: Synthetic coding sequence
atgtgggcaacctatcagacggaggaggactacactctcacgatgtacttccagcaatactggcgagataaacgattggcctattctggaattcctctgaacctgactctggacaatcgggtagcggaccagttatgggtgcctgatacatacttcctcaacgataagaagtctttcgtccacggcgttaccgtcaagaaccgaatgattagattacaccctgacggaaccgtactgtacgggcttaggattaccaccaccgcggcatgcatgatggatctgcgtaggtatccacttgatgaacagaattgcaccttggagattgaatcttacggttataccactgacgatatcgaattctactggaggggcggtgacaaagccgtgaccggagtggagcggatcgagctgcctcaattcagtattgttgagcatagacttgtgagccgcaatgtggtttttgcaacgggagcctatcctcgactcagcctctcctttcggttaaagcgtaacatcggctattttattctgcagacatatatgccaagtattctgattacaattctttcatgggtcagcttttggataaattacgacgcaagtgcagcgagagtggcgctgggtattactacagttctcacaatgaccaccattaacactcaccttagggaaaccctgccaaagattccctatgtgaaggctatagacatgtaccttatgggctgcttcgtgttcgtgtttctggccttgttggaatatgcatttgttaactacatcttctttggcagaggtcctcagcggcagaaaaagctggccgaaaagacggccaaggccaagaatgatcggtctaagtctgaatctaacagagtcgacgctcatggcaacatcctgttaacaagcttggaggtccacaatgagatgaacgaggtatccggtggaattggagatactaggaattctgccatctcctttgataactccggaatccagtaccgcaaacagtctatgccaagagaggggcatgggagattcctgggcgataggtcacttccacataaaaagacccatttgagacgcaggagctcccagttaaagatcaagatccccgacctgactgatgtgaacgctattgaccgttggtccaggatagtgtttcccttcaccttttctctttttaacctggtttattggctttactacgtcaactag

SEQ ID NO: 224250 - DNA, 1167 bp, Artificial Sequence
  Description of Artificial Sequence: Synthetic coding sequence
atgtattttcagcagtactggcgagacaaaaggctggcatacagcgggatccctttgaatctcactctcgataaccgcgtggccgatcagctttgggtacctgacacgtatttccttaacgataaaaaaagcttcgtgcacggtgttactgttaagaacaggatgattcgcctgcatccagatggaacggtactttatggtctcaggataacaaccactgctgcctgtatgatggacttgcgtagataccctttggatgaacagaattgcactttagagatcgaaagctatgggtacacgaccgatgacatagagttttattggagaggcggagataaagccgtgaccggagtggagcgtatcgagcttccccagttctctattgtggagcatcgcttggtgtcacgcaacgtggtcttcgcaacaggcgcataccccagactatctctgagtttcagactgaagcgcaacatcggctattttattctgcagacttacatgccgtcaatcttaattaccattctcagttgggtgtctttttggatcaactatgatgcgtcagctgcccgtgtggccctgggtattacgacggtgctgacaatgacgacaattaatactcacctgcgcgagactctccctaaaataccctacgtaaaggccattgacatgtatctgatgggatgtttcgtcttcgtgtttctcgctctgcttgaatatgccttcgtgaactacatatttttcggcaggggcccacagcggcaaaaaaagttagccgagaaaactgcaaaggccaaaaacgacaggagtaaatctgagtcaaaccgcgtcgatgcccacggtaatatcctgctgacctcccttgaagtgcacaacgagatgaacgaagtgtccggcggaattggagatactaggaattccgctatctctttcgacaatagcggcatacagtaccgcaaacagtcgatgcccagagaaggacacggaaggtttctgggagatcgcagtctgccccataagaagactcatctgcgcaggagatccagtcagttaaaaataaaaattccggacttaaccgacgtgaatgccatagaccgctggagccgtattgtgttccccttcaccttttctttatttaacctagtttattggctctattacgtcaattag

SEQ ID NO: 224251 - DNA, 417 bp, Artificial Sequence
  Description of Artificial Sequence: Synthetic coding sequence
atgtactttcaacaatattggcgggacaagagactcgcctactccggcataccactcaatctgaccctggataatcgagtcgctgaccaattgtgggtacccgacacttatttcctgaatgataaaaagagctttgtccatggtgtgacagtcaagaatagaatgattcgcttacaccccgacggaacagtgctttatggccttagaataaccaccaccgcagcctgtatgatggacttgaggcgctaccccctggacgagcagaactgcactttggagattgaatcctacggatacactacggacgacatcgagttttattggaggggcggtgacaaggctgtgactggcgtagaacgcattgagttgccccaatttagtattgtcgaacataggctggtatcgaggaatgtctag

SEQ ID NO: 224252 - DNA, 1359 bp, Artificial Sequence
  Description of Artificial Sequence: Synthetic coding sequence
atggacgcgccagccagactgctcgctcccttgcttctgctgtgtgcacagcagctgcggggaactagggcgatgaatgatatcggagattatgtgggatccaatctggaaatctcgtggttgcccaacctggatggcctgatcgctgggtatgcccgaaactttagacctggaattggaggcccacctgtgaacgtcgccttggcactggaagtagcgagcattgatcacatcagcgaggcaaatatggaatacacgatgactgtgttcctccaccagtcctggcgggactcccggctgagttataatcacacaaatgaaacattggggctggactcgagatttgtagacaaactgtggctgccagatacattcattgtgaacgcaaaatccgcctggttccacgatgtgaccgtagagaataaattgattcggctccaacccgatggtgtgatactctatagcatacggatcacctctaccgtggcttgtgatatggatttagcgaaataccctatggatgagcaggaatgtatgctggatttagagtcttatggctatagttcagaagatatcgtctattattggtctgaatctcaggaacacatacacgggcttgataagctccaacttgctcagtttaccatcacttcctatagattcacgaccgaactgatgaactttaagagtgccggacagtttccccgtctgtcactccatttccatctgcgaaggaaccgcggagtttatattatccagtcctatatgcctagtgtactgctggttgctatgtcctgggtcagcttttggatctcacaggcggctgttccggctagagtgtccctcggcattacaactgttctgaccatgaccaccttgatggtgtccgctcgatcttccttacccagggcttctgcgatcaaggcactggacgtctacttttggatctgttatgttttcgtcttcgcagcactggtggagtatgcatttgctcactttaatgcagattacagaaagaagcagaaagccaaagtcaaggtgtctagacctcgggcagaaatggatgtccggaatgctatcgtcttgttttccttgagcgccgctggcgttacccaggaacttgccatatcccgtaggcagcgtcgtgtacccggtaacctcatgggatcctatagatcagtcggcgtggaaaccggcgagactaaaaaagagggcgctgctagatccgggggtcagggcggaatccgggcaagattacggccaatcgacgcagacaccattgacatctatgccagagccgtgtttccggctgctttcgccgctgtgaatgtcatttattgggccgcatacgccatgtag

SEQ ID NO: 224253 - DNA, 1521 bp, Artificial Sequence
  Description of Artificial Sequence: Synthetic coding sequence
atgctgtccaaagtgctgccagtgttgctgggcatcttgctgattctgcaaagtcgtgtggagggcccacagacggaaagcaagaatgaggcatctagccgcgatgtagtttacggccctcagccacagccgctggaaaaccagttgctgtctgaggagacaaaaagtactgaaacggagactggctccagagtcggcaagctcccagaggcgtctcgcattttgaatacgatactgagtaattacgaccacaagctaaggcccggaatcggagagaagccgactgtcgttaccgttgagatttctgtaaattctctcggaccactgtccatcctggacatggaatatacaattgatatcatcttctcccagacatggtacgatgaacggttgtgttataacgacacctttgagtcccttgtgctaaatggaaacgtggtcagccagttgtggataccagacacctttttcaggaactctaagcgaactcacgagcatgagataacgatgcccaaccagatggttcgaatctacaaagacggcaaagtcctttacaccattaggatgactatcgatgccggttgttccctgcacatgctaagatttccgatggactctcattcatgccctctgtcattcagttcctttagctaccctgagaacgagatgatatataagtgggaaaattttaagttggagataaacgagaagaacagctggaaattgttccagttcgacttcacgggcgttagcaacaaaactgagatcatcaccacccctgtaggcgacttcatggtcatgacaatattcttcaacgtgtcccggcgattcggttacgttgcctttcaaaactatgtaccatcatctgtgaccaccatgctatcttgggtcagtttctggattaagactgagagcgcacccgctcggacgagcctaggaatcacttccgtcttgacaatgacgacactgggaacattttctagaaagaacttccccagggtgtcatatatcacggccctggacttttacatcgccatctgttttgtcttctgcttctgcgcccttctcgagttcgccgtgctaaactttctgatctacaatcagaccaaggcgcatgcttcgccaaagcttcgccatccgcgaattaactcaagagctcacgccagaacaagggccaggtcaagagcatgcgctcggcagcaccaggaagcatttgtttgtcagatcgtgactaccgaggggtctgacggcgaagagcgaccgagctgttccgctcagcagccaccctctccgggatcccccgagggaccacgatccctctgctcaaaacttgcctgttgtgagtggtgcaaaaggttcaaaaagtacttttgtatggtgccagactgtgaagggtccacatggcaacagggcaggttatgtatccatgtgtatcgcctcgataattacagccgagtcgtttttccagtcactttttttttctttaacgtgctgtattggttggtctgcttaaacctttag

SEQ ID NO: 224254 - DNA, 420 bp, Artificial Sequence
  Description of Artificial Sequence: Synthetic coding sequence
atgagatccccttgtcccacacgatggtcggcgagtactcggatggctcgatgttgcacccaactcgtgagctacccggaaaatgaaatgatttacaagtgggagaacttcaaattggagattaacgagaaaaacagttggaagctgtttcagttcgatttcacaggcgtgtcaaacaagaccgaaatcataactacccccgtcggcgatctcaatgaggagcccagggatctgcccagagtcgctccacgagccacactcgaaacactgtttacacacccagatcaagtccaaggatctgaggggactgcattgattgtatcccgaatgtggatggaaccagtgacccagcccgcaatctgccgagagagacacctggtgttgctaccattcaaaattccaaggcaagaagatttttag

SEQ ID NO: 224255 - DNA, 1398 bp, Artificial Sequence
  Description of Artificial Sequence: Synthetic coding sequence
atgggaccgctgaaggccttccttttctcaccgttcctgctccgcagccagtcccgcggagtgcggctggtgttcctcctcttgacattgcacttaggcaattgtgtagacaaagctgatgatgaggacgatgaggatctcaccgttaataagacatgggtattggccccaaaaatacacgagggcgatataacccagatccttaatagtctccttcagggctatgataacaagctccggccagatatcggtgtacggcctacagtgatagagaccgacgtttatgtaaattctatcggacccgtagaccctattaacatggagtacaccatcgatattatttttgcccagacatggtttgattcccggttgaagttcaactccacaatgaaggtgctgatgctcaactccaatatggtggggaaaatttggatacctgatactttctttcggaacagcaggaaatccgatgcgcattggatcacaacgcctaacagactgctccggatttggaatgacggcagggtgctatacactttgagactgaccattaatgccgaatgctatttacaactccataactttccgatggacgagcattcctgtcctctggagtttagtagttatggctatcccaaaaatgaaattgaatacaaatggaaaaagcccagtgtggaggtggctgaccctaagtactggaggctctatcagtttgcatttgtgggcctcaggaattcgactgaaattacccacacaatatccggcgactacgtgataatgacaatttttttcgacctgtcgcggagaatgggttatttcaccatacagacatatatcccgtgtatactaacagttgtgctctcttgggtgtcattctggatcaataaggacgccgtccccgctagaactagcttggggatcaccaccgtcttgacgatgaccacactttcgacaattgctcggaagtctctacctaaagtgagttatgtcactgccatggatttgtttgtcagtgtttgcttcatcttcgtctttgccgctctgatggagtacgggacactgcactattttacttctaatcagaagggaaaaactgctaccaaagaccgcaagctaaagaataaagcctccatgactccgggtcttcaccctgggtccacactcatccccatgaacaatatcagtgtgccccaagaagatgattatggttatcagtgcttggaagggaaggactgcgcttcatttttttgctgcttcgaggattgccgcacggggagctggcgggagggtaggatccatatacgtatcgcaaaaattgattcttacagtcgtatcttcttccctactgcttttgctctgttcaatctggtgtattgggttggatacctctatctgtag

SEQ ID NO: 224256 - DNA, 1260 bp, Artificial Sequence
  Description of Artificial Sequence: Synthetic coding sequence
atgggcccactgaaagcgttcttgttttctcccttcttgctgcgcagccagtctcggggtgtgaggctggtttttttgcttctgacccttcatttaggcaattgcgttgacaaagcagacgacgaggacgatgaggacttgaccgtgaacaagacttgggtcctggctccaaagattcatgaaggcgacataacccaaatcttgaatagcctgctgcagggctacgacaataaattgcgacctgatataggggtgagacctactgtgatcgaaacagatgtgtacgttaacagtattggcccagtcgatccaattaacatggaatacaccattgatatcatatttgcccagacctggtttgactcccgcctgaaattcaacagtacaatgaaagtgctcatgttgaactcaaatatggtggggaagatatggattcccgatacgtttttcagaaatagcaggaaatctgacgcccactggataacgacccctaatcgacttctccgaatctggaatgatggacgggtgttgtacactctccggctcactataaacgccgaatgctaccttcagctccataatttcccaatggacgagcattcttgccccctggaattcagtagttatggctacccaaagaatgaaatcgagtacaagtggaagaagccaagcgttgaagtcgcagaccccaaatactggaggctttaccagttcgcctttgttggtctgcgcaactccaccgagatcactcacacgatcagcggcgactatgtgataatgacgatcttttttgatctctcgaggagaatgggttactttaccattcagacctacatcccatgtattctgacagttgtgctcagctgggtgtccttttggatcaacaaagacgccgtccccgctagaacaagccttggcattacaacagttcttaccatgaccactctttccactattgcccgaaagagcctccctaaggtgtcatacgtgacagccatggatctattcgtgagcgtttgtttcatcttcgtgttcgcggcactgatggaatacggtactcttcactattttacaagcaaccaaaaaggaaaaaccgcgaccaaagaccggaaactcaagaacaaagctagcatgacacccggattgcatcccggatcaacactgattccaatgaataatatcagcgtaccccaagaggatgattatggctaccagtgtctggaaggtcgcaaagatacccacacacattgtcagaactag

SEQ ID NO: 224257 - DNA, 1428 bp, Artificial Sequence
  Description of Artificial Sequence: Synthetic coding sequence
atgtcatccccgaacatctggagcacgggaagctcagtgtacagtacgccggtgttcagccaaaaaatgactgtatggattctactgcttctgtcgttatacccgggattcacctcccagaaatcagacgacgattatgaggactacgctagcaacaagacctgggtgcttacgccaaaggtgccagaaggagacgttaccgtgatcctgaacaatctgctggagggatatgataacaaactgcgcccagacattggtgtcaaacccaccctaatccataccgacatgtacgtgaacagtataggccctgtaaatgccataaatatggaatacactatcgatatctttttcgcacaaacctggtacgatcgccgtttgaagttcaactccacaatcaaggttctccgcctgaattccaatatggtgggtaagatttggatccccgataccttctttcgaaacagcaagaaggccgacgctcactggatcacaaccccaaacaggatgctacggatttggaatgacggacgggtgttatatacactgagactcaccatcgacgccgagtgtcagctgcagctccacaactttcccatggatgagcacagctgcccactcgaatttagctcttacggctatcccagggaggaaattgtataccagtggaagagaagctcagtcgaggtcggcgatacgcggagttggcggttgtatcagttttctttcgttggccttaggaataccaccgaggtggtgaaaactacatccggtgactacgtggttatgagtgtgtattttgaccttagtagaagaatgggatacttcacaatccagacgtacattccctgtaccctgatagttgtcctgtcatgggtgtcgttttggatcaacaaggacgcagtccctgctcggacttccctgggaatcaccacagtgctaacaatgacaacgctcagcactattgctcggaaatcactgcccaaggtctcatacgtgactgcgatggacctgttcgttagcgtgtgctttatattcgtgttcagcgccctcgtggagtatggcacattacactatttcgtttctaacaggaagccttccaaagacaaggacaagaagaaaaaaaacccgctcttgagaatgttctcctttaaagcccctacaattgacatccgccctagatccgccactatacagatgaataacgcgacacatttgcaagaaagagacgaggaatacgggtacgagtgccttgacggtaaagactgcgcaagcttcttttgttgctttgaagattgcagaactggtgcttggaggcacggacggatccacattcgcatcgccaagatggactcatatgccagaatcttcttcccaaccgctttttgtctgtttaatctagtgtactgggtgagctacctgtacctgtag

SEQ ID NO: 224258 - DNA, 1404 bp, Artificial Sequence
  Description of Artificial Sequence: Synthetic coding sequence
atgtcctccccaaacatttggtccaccgggagtagtgtgtattcaacccctgttttcagtcagaagatgacggtgtggatcctcttgctgctatctctgtatcctggttttacatcacaaaaatcagacgatgattacgaagattatgcctctaataagacctgggtcttaaccccaaaagtgcctgaaggcgatgtcactgtgatcctcaacaacctgctcgaagggtatgacaacaaacttaggcctgacatcggggttaaacccacgttaatccacacagacatgtatgtcaatagcattgggcctgtcaatgctatcaatatggaatacactatcgatatttttttcgcccaaacctggtacgaccgcagactcaaatttaattctactataaaagtacttcgcttgaattccaacatggtaggtaaaatttggatccctgatacgttcttccgaaactcaaaaaaggcagatgctcattggatcaccacacccaaccgtatgttacggatctggaatgacggtcgtgtgctgtacaccctgcggctaaccatcgatgctgagtgtcagctgcaacttcacaattttcccatggacgagcacagctgcccactggagttttccagttatggttatccaagagaggagatagtctatcaatggaagagaagctccgtggaggtcggggacaccaggagctggcgactataccagtttagcttcgtcgggctcagaaacaccacagaggtcgtgaaaacaacttccggcgactatgttgtcatgtccgtgtatttcgatttatcacggagaatggggtactttactattcagacttacatcccatgcacactgatcgtggtgctcagctgggtttccttctggatcaataaagatgccgtcccagctaggactagcttaggtattacgaccgtgttgactatgactaccctgagcaccatcgcaaggaaaagcctgccgaaagtgtcctatgttaccgctatggacttgtttgtgtccgtctgtttcatctttgtgttcagcgcactggttgaatacggaacattacattacttcgttagcaaccggaagccttccaaggataaagataaaaagaagaaaaacccggctccaacaatcgacatacggcctcgctccgctacaatccagatgaataatgccacacatctacaggagagggacgaagagtatggatatgagtgcttggatgggaaggactgcgcaagcttcttctgctgcttcgaagattgccggacaggggcatggcgtcacggcagaattcacattaggatcgcgaaaatggacagctacgctcgcatcttctttccaacagccttttgtctgttcaatctcgtgtactgggtgagttacctctatttatag

SEQ ID NO: 224259 - DNA, 1119 bp, Artificial Sequence
  Description of Artificial Sequence: Synthetic coding sequence
atgtacgtaaacagcattgggcctgtaaacgcaatcaacatggaatacacaatcgatattttcttcgctcagacgtggtacgatcgccgactgaagttcaactcaaccattaaagtgctcaggttgaacagcaacatggtgggaaaaatctggattcctgacacattcttccggaattctaaaaaagccgatgcgcattggatcactactccaaataggatgttacgcatctggaacgacggaagggtgctgtatacactgagactgactatcgacgccgaatgtcaactgcagcttcacaatttcccgatggatgaacactcctgtcccctggaatttagcagctatggctacccaagggaagagattgtttaccagtggaagcggtctagcgtggaagtgggtgatacacgatcctggcgactgtaccaattctccttcgttggtcttcgaaatacaacggaagttgttaagacaacctcaggcgactatgttgttatgagcgtttattttgacttaagccgtcgcatggggtatttcacaattcagacatatatcccatgcacgctgattgtggttcttagctgggtatccttctggattaataaagatgctgtgccggctaggacgtctctcggaattacgaccgtgctgacaatgaccacgttaagcactattgcccgtaaaagtctgccaaaggtgtcttacgtgactgccatggacctttttgtgtcggtgtgttttattttcgtatttagcgccctggtcgaatatgggacactgcactactttgtttctaacaggaaaccaagtaaagataaggacaaaaaaaagaagaatcctgcaccaactattgacatcaggcccagatcagcaactattcagatgaacaacgctacccatcttcaggagcgggacgaggagtatggctacgaatgcctggatggtaaggactgtgcttcatttttttgctgttttgaagactgccgaacaggtgcatggcgccatggcagaatacacatccggattgcaaagatggacagttacgctcggattttctttcctaccgccttctgcctgtttaatctggtgtattgggtttcttacctatatctgtag

SEQ ID NO: 224260 - DNA, 1404 bp, Artificial Sequence
  Description of Artificial Sequence: Synthetic coding sequence
atggctcctaagttactcttgcttctgtgtctgttcagtggccttcatgccagaagtcggaaagtggaggaggacgagtacgaggattccagctctaatcagaaatgggtgttggcaccaaagtctcaggatacggacgttaccctgatactcaacaagctcttacgcgaatatgacaaaaagctgcggcctgacatcggcatcaaaccaactgttatcgacgttgacatctatgtgaactctatcgggccagtttcgagcataaatatggaataccagatcgatatcttttttgcacagacatggactgactcacggcttcgcttcaactcaaccatgaagatcttaaccttaaatagtaacatggtggggctcatctggatccccgacacaatcttcagaaactccaaaactgccgaggctcactggatcaccacgccaaaccagctactgaggatttggaacgatggcaaaatcctctatacgctgcgactgactatcaacgccgaatgccaactccagctccacaatttccccatggatgagcacagctgccctctcatcttctcgtcgtatggatacccaaaagaggaaatgatctacagatggaggaagaatagcgtcgaggccgctgatcagaaatcctggagactgtaccagttcgactttatggggctgaggaacactactgaaattgtcacgaccagcgccggagattatgttgttatgaccatttatttcgaactgtctcggcgtatgggctattttacaatccagacgtatatcccttgcattctgactgtagtcctgagttgggtcagcttctggatcaaaaaagatgcaacccccgctcgcacagccctcggcatcactactgttttgactatgaccacactaagcaccattgccaggaagagtctccctagagtatcttatgtcacagccatggacttgtttgtaaccgtgtgcttcctgttcgttttcgccgcactcatggagtacgcgacgctgaactactatagttcttgtcgaaagcccacaaccacaaaaaagactacatctctactccatcctgactcaagtcgctggattccggagagaattagcctccaggcgccttcaaactattccttgctcgatatgaggccaccgcctactgccatgattacattgaacaattctgtgtattggcaggagttcgaggatacttgtgtgtacgagtgtctggacggtaaggactgccagtccttcttctgctgttacgaagaatgcaagtccggcagttggcggaagggtcgtatccacattgacatcctcgaacttgacagctacagtcgtgtcttctttcccacttcctttcttttattcaatttggtgtattgggtcggttatctctatctttag

SEQ ID NO: 224261 - DNA, 1323 bp, Artificial Sequence
  Description of Artificial Sequence: Synthetic coding sequence
atgaattactctctgcatctcgcctttgtatgcctttccttgtttaccgaacgcatgtgcatccaaggaagtcagttcaatgtcgaagttggaaggagtgacaaattgagcctccccggattcgagaacctaaccgccggatataacaaattcctcagacctaatttcggtggagaacccgtacaaatcgcattgacgttggacatcgcttccatttcttctatcagcgagtctaatatggactataccgccactatttatctccgccaaagatggatggatcagaggttggtgttcgagggaaacaagagcttcaccttagacgctcgcctggtcgagtttctgtgggttccagatacctacattgtcgaatcgaaaaaaagttttttgcatgaagtgaccgtgggaaatcgccttattcggttattcagtaatgggacagtcctctacgccctccggatcaccactacagtggcttgtaatatggacctatccaagtacccaatggacacccaaacttgtaaacttcagctggagtcctgggggtatgacggcaacgatgtggaatttacatggctccggggaaatgatagcgtgcgcggactggagcacctcagacttgctcaatatacaattgagcggtactttacactcgtgactagaagccagcaggagacgggaaactacacccgacttgtgctgcaatttgaactgcgtcggaacgtcctatactttatccttgaaacatatgtgccttctacatttcttgtggttctgagctgggtgtctttctggatttccctggatagcgtaccggctagaacatgcattggagtcactaccgttctgtctatgactaccctgatgatcgggagccgtacctcactgccaaatacaaattgttttatcaaagcaattgatgtctatttgggcatttgttttagctttgtttttggcgcattactcgaatatgccgtagcacactatagtagcctgcagcagatggcggctaaggatagaggcacgacaaaggaagtagaggaagtgtctatcactaatatcattaacagtagcatctccagtttcaagaggaaaatttcctttgctagcatcgagatctccagcgataatgtggactactccgatttgaccatgaagactagtgataaatttaagttcgtgttccgtgaaaagatgggcaggatcgtggactatttcaccattcagaatccaagtaacgtggatcactattctaagctgctcttcccattgatttttatgctggcaaacgttttttattgggcctattatatgtacttttag

SEQ ID NO: 224262 - DNA, 159 bp, Artificial Sequence
  Description of Artificial Sequence: Synthetic coding sequence
atgaactatagtctacacttggcttttgtgtgcctgtcgctgtttaccgagcggatgtgtatccagggatcacagttcaatgtcgaggtcggccgatcagacaagctttccctccccggattcgaaaacctgactgccggatataataaattcctgtag

SEQ ID NO: 224263 - DNA, 1323 bp, Artificial Sequence
  Description of Artificial Sequence: Synthetic coding sequence
atgaactatagtttacatctggccttcgtctgcctgagtttgtttaccgagcgcatgtgcattcaggggtcacaatttaatgtcgaggtcgggagatctgacaagttgtccctgcctggattcgaaaatctcactgctggttacaacaaattcttacggcctaatttcggaggtgaacccgtacaaatagcccttacactcgatatagcctccattagctcaatttctgaatccaatatggactacaccgcgactatctacctgagacagcgatggatggatcagcgtctggtgtttgagggaaacaaatctttcacactggacgccaggctcgtggaattcctgtgggtccccgacacatatatcgtagaaagtaagaagagctttctgcacgaagttaccgtgggtaatcgcctcatccggctgttttctaatggcacagtgctgtacgccctgcggatcaccaccaccgtagcgtgcaacatggatctgagtaaatatccaatggacacgcaaacctgcaagcttcagctggagtcatggggctacgacggtaacgacgtcgagttcacatggctgcgcggtaacgactccgtcagggggctggagcacctgcgcttagcacagtatactatcgagaggtattttactctcgtgacccgcagccagcaggaaacgggcaactacaccaggctagttcttcagtttgaactccgcagaaacgttctatactttatattagagacttacgtcccctcaacgtttttggtggtcttatcatgggtaagcttctggatttccttggattccgttcctgccaggacctgcattggtgtgactacagtcctgtccatgaccacattgatgatcggtagcaggacaagccttccaaacactaattgcttcattaaggccattgatgtgtacctcggaatctgcttttcctttgtgtttggggcactgttggaatacgctgtggcacattacagttccctgcaacagatggcagcgaaggaccgcggaacaaccaaggaagtggaggaggtttctatcactaacataatcaactcttctatttcttctttcaagcgcaaaattagcttcgcctcaatcgaaatttcctctgacaatgtcgattattcggatttaacgatgaagacatccgacaaattcaaatttgtgttcagagagaaaatgggccgaatcgtagattatttcaccattcagaatccatcaaacgtggaccactatagcaaattactgtttccactgattttcatgctcgccaatgtcttttactgggcttattatatgtacttctag

SEQ ID NO: 224264 - DNA, 180 bp, Artificial Sequence
  Description of Artificial Sequence: Synthetic coding sequence
atgaactacagcttgcacctggcgtttgtatgcctctccctcttcaccgaaagaatgtgtatccagggaagtcaattcaacgtggaagtggggcgttccgacaagctgagtctccccggtttcgagaatctcaccgccggatacaacaaatttctgcgtcctaattttggtggggagtag

SEQ ID NO: 224265 - DNA, 279 bp, Artificial Sequence
  Description of Artificial Sequence: Synthetic coding sequence
atgaattactctttgcatctggcctttgtgtgcctgagtctttttacggaacgtatgtgcatacagggatcccagtttaacgtggaagtgggtagatcagacaaactatctctacctggattcgagaaccttacagcagggtacaacaagttcctcagacctaactttggaggagaaccagtccaaattgccttgactctagacatagccagtatctcgagtatttctgagtccaacatggattatactgcaaccatttaccttaggcagcgatggtag

SEQ ID NO: 224266 - DNA, 516 bp, Artificial Sequence
  Description of Artificial Sequence: Synthetic coding sequence
atgaattatagcctacacctcgcattcgtgtgtctatccctgtttacagaaaggatgtgtatccagggttcccagtttaatgtggaggtggggaggagtgacaaactaagtctacccggtttcgagaatctcacagcaggttacaacaaattcttgagaccgaatttcggcggtgagccagttcagatagccctgacactggacatcgctagcatttctagtataagtgagtccaacatggattacacggccacaatctatctgcgacaacgctggatggaccagcggttggtttttgagggtaacaagtctttcacactcgacgcccgactggttgagttcctgtgggtgcccgacacctatattgtggagtcaaagaaaagcttccttcacgaagtgactgttggcaaccgtctgatccggctgttcagcaatggaacggttttgtacgcacttcgcataacaacaactgtggcatgtaatatggacctgtccaaatatcctatggacacttag

SEQ ID NO: 224267 - DNA, 570 bp, Artificial Sequence
  Description of Artificial Sequence: Synthetic coding sequence
atgaactacagcctgcatctggcctttgtctgccttagccttttcacagagagaatgtgtatccaggggagccagttcaatgtggaggtaggcaggagcgacaaattgtccctgcccggtttcgaaaacttgacagctggctacaacaagttccttaggcccaatttcggaggcgaaccagtgcagattgcattaacgttggatattgcatctatcagttctatctcagaatctaacatggactacaccgctactatctacctccgacagaggtggatggaccagcgtttggtcttcgaaggtaataaatcgtttacactggacgctaggctggtcgagtttctctgggtccctgacacatatatcgtggaatcaaaaaagtccttcttacacgaagtgactgtgggcaatcggctgatccgcttgttttctaatgggaccgtcctgtacgcattgcgcatcaccacgacagtggcctgcaacatggatctttccaaatatccaatggatacccagacctgtaaactacagctcgagagctggggctatgatggcaacgatgttgagtag

SEQ ID NO: 224268 - DNA, 564 bp, Artificial Sequence
  Description of Artificial Sequence: Synthetic coding sequence
atggattatactgccacaatttacctgagacagcgttggatggatcaacgactggtctttgaaggaaacaaaagcttcactctggatgaggtgactgtaggtaatcgactcatccggctgttcagtaatgggaccgttttgtacgccctgagaatcactaccaccgtggcttgtaacatggatctttccaaatatcccatggacacgcagacgtgcaagctgcagctagaatcatggggatatgacggtaacgatgttgagttcacttggctgaggggcaatgattccgtccggggtctggaacacctgcgactcgcacagtatacaattgagagatactttaccctggtgactcgctctcagcaggagactggcaactacaccaggctggtgctgcagttcgagctgcgtcgcaacgtactgtacttcatcctggaaacatatgtccccagcacatttttggtggtgctcagctgggttagtttttggatctccctggacagcgtcccagccaggacctgcataggagacaacaaaggtagtcggaggagccagtattattag

SEQ ID NO: 224269 - DNA, 2826 bp, Artificial Sequence
  Description of Artificial Sequence: Synthetic coding sequence
atggcctcccctcgatcttcaggccagcccggtccccctccccctcccccaccaccacctgctcggctcctgctgcttctactcctgccactgctgctgcccctggcaccaggcgcatgggggtgggctaggggcgcacccagaccgcctccctcctcaccacccctctctatcatgggcctgatgcccctcactaaggaggtggccaagggttccataggacggggagtcctgcccgctgttgagctggcaattgagcagatccggaacgaaagcttgctgcgcccatacttcctggacctcagactctatgatactgagtgtgacaacgcaaaggggttaaaggccttctatgatgccatcaaatatggcccaaatcatctgatggtattcgggggagtctgtccgtccgtgaccagcatcatcgctgagtctctgcaaggttggaacctggtgcagttatccttcgctgcaaccactcctgttctggcagacaagaaaaagtacccctacttctttcgcactgtgcccagcgataacgccgtcaaccctgctattctgaagctgctgaagcattatcagtggaaacgtgtcggtacacttacgcaggacgtgcagcgatttagtgaggtgagaaatgatttgactggggtcctctacggcgaggatattgagatttctgacacagaatcatttagtaacgacccttgtactagcgttaagaagctcaagggaaacgacgtgcgcataattctggggcagttcgaccagaatatggccgcaaaggtgttctgctgtgcttacgaagagaatatgtacggatccaagtaccagtggattatccccggatggtacgagccttcttggtgggaacaggttcacactgaggcaaatagctcccgctgcctgagaaaaaacctgttagcagcaatggagggatatattggcgtggattttgaacccttgtcatcaaagcagattaaaacgatctcaggcaaaacccctcagcagtacgagcgcgaatacaacaacaagagatccggtgtcgggccttcaaaattccacggctatgcctacgacggaatatgggtaattgccaagactctccagcgtgcaatggagaccctccacgcgagctcaaggcaccaaagaattcaagatttcaattatacggaccacacattggggaggataatcctgaatgcaatgaatgagaccaatttctttggtgtgacaggtcaggtagtgttccggaacggcgaacgcatgggcaccataaaatttacccaatttcaggattcgagggaagtgaaagtcggtgagtataacgctgtggccgacacactggagattatcaatgacacgatcaggttccagggaagcgaaccccctaaagacaaaaccatcattctcgagcagcttcggaagatcagtcttcccttgtattctatcctcagtgctctaacaatacttggcatgatcatggcaagtgcctttctgttcttcaacatcaaaaatcgaaaccaaaagctcatcaaaatgtccagcccgtatatgaataatctaatcatcctgggcggaatgctgagttacgcctccatatttctgttcggtctggacggttcttttgttagtgaaaagacctttgagaccctgtgtacggtgaggacctggattctgactgtgggatacacaacggcatttggcgcaatgtttgccaagacctggcgagtgcacgccatattcaaaaacgtcaaaatgaaaaagaagatcattaaagatcagaagctgcttgtcatcgtcggcggaatgctgctgatcgacctgtgcattttgatctgctggcaggctgtcgaccctcttcgacgtaccgtcgagaagtactctatggaacctgacccagcaggcagggatatcagcatccgtcccctactggaacactgcgaaaacacacacatgacaatctggcttggcattgtgtatgcttacaagggtctcttaatgttgtttggctgcttcctggcctgggaaacacgcaacgtgtctattcccgcactgaacgattcaaaatacatcgggatgagtgtctacaacgtgggcatcatgtgcattattggagctgctgttagctttctaacccgcgaccagccaaatgttcagttttgtatagtggctctggttattatcttttgttccaccatcaccctgtgccttgtctttgtccccaagctgattactctgcgtaccaatcctgatgccgctactcagaaccgcaggtttcagtttactcagaatcagaagaaagaggactccaagacctctacatcagtgacctctgtgaaccaagccagcacttcaagactcgaggggttacagtccgagaatcacaggttgcgcatgaaaatcaccgaacttgataaggatttagaagaggtgactatgcagctccaagatacacctgaaaaaacgacatatattaagcagaaccattatcaggagctgaacgacatcctcaatctagggaattttaccgaaagcacagatggtggaaaagccatcttgaagaaccatctggatcaaaatccccagctgcagtggaataccacagaacctagccggacttgtaaggatcccattgaagacattaatagcccagaacatattcagcgcaggctttcgttacagctgcccattcttcatcatgcttacttgccgtccataggtggagtcgatgcatcttgtgtgtcgccttgcgtgtccccgacagcctctcccagacataggcatgtgccacctagctttagggtcatggtgtccggattatag

SEQ ID NO: 224270 - DNA, 1179 bp, Artificial Sequence
  Description of Artificial Sequence: Synthetic coding sequence
atgagaccaggctttggcggaccagccatccccgtgggcgttgacgtacaggtggaatcacttgattccatttccgaagtggacatggactttacgatgacactgtacttaagacattactggaaagatgagcgtttgagttttcccagcacaaataatctgtccatgacattcgacggcaggttggtcaagaagatttgggtgcctgacatgttctttgtgcattctaagcggtcatttatccacgacacaacgacagataatgtcatgttgcgagtacaacctgatggaaaggtcctgtatagcctgcgggtgactgtgactgccatgtgtaacatggattttagccgcttccctctggacacacagacgtgttctctggaaatagagtcttatgcctacaccgaggacgacttgatgctatactggaagaaggggaatgacagtctgaagaccgacgaacggatctcgttgagccagttcctcatccaggagtttcataccacaactaagctcgcattctacagttccaccggctggtataaccgcctgtatatcaacttcacgttgcgtcgacatattttcttttttctgttgcagacatatttccctgccaccctaatggtgatgctcagctgggtgagcttctggatcgacaggcgcgctgttcccgcacgcgtccccctcggaatcacaaccgtgttaactatgagtacaatcattactggagtcaatgcatctatgcccagagtgagctatatcaaggctgtggacatctatctgtgggtcagttttgtcttcgtcttcctttctgtgctggagtacgccgcagtcaattacttgacgactgtacaggagcgcaaggaacagaaactgcgtgagaagctgccatgtacgagcggcctcccacctcccagaaccgccatgttagatggcaactattcggatggggaggtgaatgacctggacaattacatgccagagaacggagaaaaacccgaccgaatgatggtgcagctgaccctcgccagcgagcggagtagtccccagcggaagagtcagcgatcttcgtatgtctctatgcgcattgatacccatgctattgataagtacagcagaattatctttccagcagcatacattctttttaacctgatctactggtctatcttctcctag

SEQ ID NO: 224271 - DNA, 1389 bp, Artificial Sequence
  Description of Artificial Sequence: Synthetic coding sequence
atgctggctgtgcctaatatgagattcgggatatttcttctgtggtggggttgggtactggcaactgagtctcggatgcactggcccggaagagaagttcatgagatgtccaagaaaggcagcccaatcctaagacgatcccccgatatcacaaagagcccactgaccaagtcggaacagctgctgcgtattgacgatcatgactttagtatgagaccagggttcggaggaccagctatccccgtaggggtggacgtccaggtggagtcacttgactcaatctctgaagttgatatggattttaccatgacactttacctgcgtcactattggaaggatgaacggctctctttccccagtactaataatttgtccatgactttcgatggcagattggttaaaaaaatttgggttcccgacatgtttttcgtgcactctaagaggtctttcatccacgacaccaccaccgacaatgtcatgctgcgagtccagccggatgggaaggtgctctattctctgcgggtgaccgttactgcaatgtgtaacatggacttctccagatttcctctcgatacacagacgtgctccttagagattgaatcatacgcatacactgaggacgatctcatgttatactggaagaagggcaacgactctctcaagaccgatgagaggatttcactgagccagttcctcatccaggagttccacacaactacaaagcttgcgttttactcaagcactggatggtataaccgtttgtacattaattttaccctacggcgacatatcttcttcttcctcctccagacttatttccctgcaacgctcatggtcatgttgtcttgggtgagtttctggattgaccgaagggccgtcccagccagggtcccattggggattacaacggttctcaccatgtccaccataattacaggagtgaacgcctcaatgcctagagtaagctacatcaaggccgttgatatctacctctgggtgtcttttgtgtttgtgttcctgagcgtgctggagtatgccgctgtcaattacctcacaacagtgcaggaacggaaagaacagaagctgcgtgaaaaactgccctgcacaagcggtttgcccccacctcgcacggccatgctggatgggaactacagtgacggcgaggtcaatgatctggacaactatatgccagagaatggcgaaaagcctgacaggatgatggtccagctgacactggcctcggagcgatctagtccgcagcggaagagccaacggtcctcctatgtgagcatgcgtatcgacacacacgctatagataagtatagccgaatcatttttccagcagcgtacatactgttcaacttgatatactggagcatcttttcctag

SEQ ID NO: 224272 - DNA, 1179 bp, Artificial Sequence
  Description of Artificial Sequence: Synthetic coding sequence
atgcggcctgggttcggaggccctgcaataccggttggcgtagatgtccaagtggagtcattggattctatttctgaggtagacatggactttactatgacactgtacctgcgacactactggaaagacgaaaggctgagcttccctagcacaaataacctcagcatgacattcgacggacggctggtgaagaaaatctgggtgcccgatatgttcttcgtacattcaaaaagaagcttcatccacgacactacaactgacaatgtaatgttgagggtacagccagatgggaaagtgctctactctcttagagtgaccgttacagcaatgtgtaacatggatttttcacgattccctcttgacactcagacatgcagcctggagattgaatcctacgcatacaccgaggacgatctgatgctctactggaaaaagggaaacgactccctaaagacagatgagcgaatctcgctgagtcagtttttgatccaggagttccataccacaacaaagctcgccttttactcaagcaccgggtggtacaatagactttacattaattttactttacgacggcatatattcttctttctgctgcagacttactttccagctaccctgatggtgatgctgtcttgggtctctttttggatcgaccgccgagccgttcccgctcgggtgccactaggcataacaaccgtgctcaccatgtccacaatcatcaccggggtgaatgcctctatgccccgagtatcatatataaaagccgtagatatttatttgtgggtgagctttgtgtttgtgtttctgtctgtccttgagtacgcagctgtgaattatcttacaacagtgcaagagcgaaaagagcagaaactgagggagaagctgccatgtacaagcggtctacctccccctagaaccgccatgctggatggaaattattccgacggagaggtgaacgatctggataattacatgcctgaaaacggcgaaaagcccgaccggatgatggttcagctgacacttgcttctgagcgcagctcaccccagcgaaagagtcagagatcaagttatgttagcatgagaatcgacacgcacgccatcgataagtactctaggatcatcttccccgctgcctatattctgtttaacctcatttattggtcaatttttagctag

SEQ ID NO: 224273 - DNA, 1440 bp, Artificial Sequence
  Description of Artificial Sequence: Synthetic coding sequence
atgcttgctgtgcctaacatgcgctttggaatctttctgctgtggtggggctgggtgttggctaccgaaagccgaatgcactggccgggacgggaggtgcatgaaatgtccaagaaagggaggccacagcgccaaaggagggaggtacacgaggacgctcataaacaagtgtccccaatcctacgcaggtcacccgatataactaagagcccactgaccaagtctgagcagctgttgcgcatcgacgatcacgatttttcaatgcgtccgggtttcggtggaccagcaattcccgtgggagtggacgtccaagtcgagtctttagatagcatttcggaggtcgatatggactttacaatgaccctgtatctccgccactactggaaggatgagcgtctcagcttcccatccaccaataatctgagcatgacttttgacggtcgactcgttaaaaaaatatgggtaccagatatgttcttcgttcattctaaacggtcgttcatacatgacaccactaccgataacgttatgctgagagttcagcccgacgggaaggtcctctactccctcagggtaacagtgacagcaatgtgcaacatggacttttcccgttttcctttagatacccagacttgctccctggagatagagagttacgcctacactgaggacgatctcatgttgtattggaagaagggcaatgatagtcttaagaccgatgagcggatttccctttcacagttcttaatccaggagttccacactaccacaaagcttgccttctatagttcgacgggttggtataatcgattgtatatcaactttaccttgcggaggcacatcttctttttcctgcttcaaacctacttccccgcaaccctcatggtcatgctgagctgggtgagcttttggattgaccgcagagccgttccagcaagggttcctctggggattacaaccgtgcttactatgtctacgattatcacaggcgtcaatgccagcatgccgagagtttcctatatcaaagcagtggatatctacctgtgggttagctttgtgttcgtgttcctgtccgtccttgagtacgctgctgttaactatttgaccactgttcaggaacgaaaggaacagaaattgcgcgaaaagctgccgtgcacctctgggctgcctccaccacgtacggctatgttagacgggaactattcagatggcgaagtcaatgacctggacaactacatgcccgaaaacggcgagaagccagaccggatgatggtgcagttgaccttggcctccgagcgctcctccccgcagagaaaatcgcagcggtctagctatgtttctatgaggattgatactcacgcgattgacaagtacagtcgtattatattccctgctgcttacatactgttcaacctcatctactggtccatttttagttag

SEQ ID NO: 224274 - DNA, 1473 bp, Artificial Sequence
  Description of Artificial Sequence: Synthetic coding sequence
atggtgaaacccggagggatttgctccgcaacgggatactggaaggctgcattttgcctgaccgatgtccacaagatgccctacttcacacgcttaatactcttccttttttgtcttatggtcttggtggagtcccgcaagcccaaacgaaaacgctggaccggacaggtggagatgcctaaaccatctcacctgtacaaaaaaaatctggatgtgactaagatccgcaaaggaaagccccagcagctacttcgggttgacgagcacgacttttccatgcgacccgcattcggaggccctgcgattcccgttggggttgatgtccaggtggagagtctcgattcaatatcagaggtcgacatggactttacaatgactctctatctgagacattactggaaggatgagaggctggccttctcctcagccagcaataaaagcatgacgtttgacggacggctcgtcaaaaagatatgggtcccggatgtattttttgtgcattcaaagagatcattcactcatgacactacgaccgacaatattatgctcagggtgtttcctgacggccatgtgctttacagcatgcgcatcacagtgactgccatgtgtaatatggatttcagtcattttccactggattcacaaacatgctcactcgaactcgagagctatgcttacacggacgaagatctgatgctgtactggaagaacggtgatgagtctttgaagaccgacgaaaagatatccctgtcacaatttctaatacagaagttccatacaacatctcgactggccttctacagttccactggctggtataatcgactctatataaatttcacattgaggcgccacattttctttttcctgcttcaaacctatttccccgctactcttatggtcatgctatcgtgggtgtcattttggatcgataggagagctgtcccagccagggtatctctggggatcacaaccgtcctgacaatgaccacaataataaccggcgtgaacgcttctatgccccgtgtctcttacgtgaaggccgtggacatctacctatgggtctcattcgtgttcgtgtttctgagcgtccttgaatacgccgctgtcaactacttaactacggtgcaagaacgaaaagaaaggaagcttagagagaagtttccttgcatgtgcggtatgctgcattccaaaactatgatgttggacgggagctacagtgaatcagaagctaacagtcttgccggttatcctcgatcccatatcctcacagaggaggagcgccaagataaaattgttgtccacctaggactgtccggagaagcaaatgcagccaggaaaaaaggcttacttaagggtcagacggggttcaggatttttcagaacacccacgcaatcgacaagtacagccggcttatcttccctgcctcatatatttttttcaatcttatatattggagtgtgttttcttag

SEQ ID NO: 224275 - DNA, 453 bp, Artificial Sequence
  Description of Artificial Sequence: Synthetic coding sequence
atgttgagagccgcagtaattctccttctgatcagaacttggctggcagaagggaattaccccagccctattcctaaattccattttgaattttccagtgctgttcccgaggtggtgttaaacctcttcaattgcaagaactgtgccaacgaagctgtggtccaaaaaatcctggaccgagttttgagccggtatgacgtgagactgaggcctaatttcggaggagtgctcgaaactaactcgacttgggggctcaacgacgatgagctcatggcgcatggccaggaaaaagacagtagttccgagtctgaggactcatgcccccctagcccaggatgtagctttaccgagggcttctccttcgatctgtttaacccagactacgtacccaaggtggacaagtggtctcgattcctgttccctttggctttcggccttttcaatattgtgtag

SEQ ID NO: 224276 - DNA, 1899 bp, Artificial Sequence
  Description of Artificial Sequence: Synthetic coding sequence
atgggcattaggggaatgctgcgggcagctgtgatcctcctcctcatcagaacatggcttgcagaagggaattacccaagccctattcccaaatttcattttgaattctcatccgccgtgcccgaagtggtgctgaacttgttcaattgcaagaattgcgccaacgaggccgtggtgcagaagatcctggatagggtcttatctaggtatgatgttcggctgcgcccaaacttcggaggcgctcctgtgccggtcaggatcagcatatatgtgactagcatcgagcagattagcgagatgaatatggactatacaatcacaatgttttttcatcaaacctggaaggattcaagactcgcttattacgagaccaccctgaatctgacattggactacaggatgcacgagaagctctgggtgcccgactgctacttcctgaactccaaagatgccttcgtgcacgacgtgactgtagaaaatagggtatttcagctgcacccagacggaaccgtacgctatggaatcaggctcaccacaacggctgcttgttccctcgatcttcacaagtttccaatggataaacaggcttgcaatctggtggtcgagagttatggttacaccgttgaggacataattcttttctgggacgataacggtaacgctatccacatgacagaagaacttcacatcccccagttcacgtttctggggagaactattacctccaaggaggtgtacttctacaccggttcatacatccgactaatactgaagttccaggtacagcgcgaggtgaatagttacttagttcaggtgtactggccgacagttctcactaccataaccagctggatttccttctggatgaactacgactcctccgcagctcgtgttactatcggtctgaccagcatgcttatactcaccacgattgacagccatcttagagataagctgccaaacatttcctgcataaaggcgatcgatatctacatcttggtctgcctgtttttcgtctttctctccctgctggaatacgtgtatatcaactaccttttctactcacggggtcctcggcgacagcccagacggcatcggaggcctaggcgtgtgatcgcacgttaccgctaccaacaagtggtggtggggaacgtacaggatgggcttatcaacgtggaggatggcgtttcttctctccctataactccagctcaagcgcctttggccagccccgaatctttagggtctttgacctccacctccgaacaggcgcagctggccacctcagaaagcctttcaccactgacctccctaagtggacaggcgccattggcgaccggcgaaagcctgtccgatctgcccagcacaagcgagcaagccagacacagctacggcgtccgttttaacgggtttcaagctgacgacagtatcttcccgactgaaattagaaatcgcgtggaagcacatggacacggcgtcacccacgaccacgaggattccaacgagtctctcagcagtgacgaaagacatggccatgggccttctggcaaaccgatgctgcaccacggagagaaaggggtgcaggaagccggttgggacctggatgacaataatgataaatcagattgtctcgctattaaggagcagttcaaatgcgacacgaacagcacctggggcctgaacgatgatgaacttatggcccatggccaggagaaggacagtagctcagagtctgaggactcgtgtccgccaagccctggctgtagcttcaccgagggcttttcttttgatcttttcaatcccgattacgtacctaaggtcgacaaatggtcccggttcctcttcccgctcgccttcggtctgttcaacatcgtgtattgggtataccacatgtactag

SEQ ID NO: 224277 - DNA, 1083 bp, Artificial Sequence
  Description of Artificial Sequence: Synthetic coding sequence
atggacagctccaattgcaaggtgatagcacccctgctatcccagaggtacagacgcatggttactaaggatgggcactctaccctgcaaatggatggggctcagcggggtttggcctacctgcgcgatgcctgggggatcctgatggatatgcgatggaggtggatgatgctggtgttctccgcctctttcgtcgtgcattggctggtttttgccgtactgtggtacgtactggccgagatgaatggagacctcgaactcgatcacgacgctcctcctgagaatcatactatctgcgtgaagtacatcacctcttttacagcagcctttagtttctctctggaaacacagctgacaattggctatgggaccatgtttccatctggagactgtccatccgcgattgcccttctggctatccagatgctgctcggcttaatgctggaggcttttatcacgggcgcttttgtcgccaagatcgccaggccaaagaacagggccttctcaatcagattcacggatactgccgtggtggcgcacatggacggaaaaccgaacctaatttttcaggtagctaacacacggccatccccacttaccagcgtccgcgtctctgcagtgctgtaccaggagcgagaaaatggaaaactataccagaccagcgtggactttcatctcgacggcattagttctgacgagtgtcccttctttatttttccgttgacatactatcattcaataactccgtcatccccattggcaacgctcctgcaacacgagaatccctcgcattttgagctcgttgtgtttttgtctgccatgcaggaagggactggtgagatttgtcagcgccgtaccagttacctgccgtccgaaatcatgctgcatcattgctttgcaagtttgttgactaggggtagcaagggcgagtatcagattaaaatggagaacttcgacaagacagtgcccgaatttcccacaccactggtgtccaaatctccaaatcgcacagatctcgatattcacatcaacggccagtctatcgataacttccagatctccgagaccggcctaacggagtag

SEQ ID NO: 224278 - DNA, 2106 bp, Artificial Sequence
  Description of Artificial Sequence: Synthetic coding sequence
atggcagtgtccgctggaagcgctcgcacatccccctccagtggttttctgatggttctggatatccctcaggagagaggattaagctccttggatagaaaatacctggacggcctggatgtgtgtaggtttcccttgctagatgcactgaggccactccctctggactggatgtacttggtgtacaccattatgttcctcggagcgctggggatgatgcttggcctgtgttaccgtattagttgcgtcttgtttctgcttccgtactggtacgtgttcttactcgacaaaacatcttggaacaaccattcatacctgtacggattgctcgccttccagttaaccttcatggacgccaatcattactggagtgtcgatgggctgttaaacgctcacaggaggaatgcccatgtgcctttatggaattacgccgtgctgagaggccaaatctttattgtatactttattgcgggagtgaaaaaattagatgctgactgggtggagggatactctatggaatacctgtcacgccattggctgttcagccccttcaagctgctcctttccgaggaactgacctctctgcttgtggtacattgggggggattactgctggacttatctgctggcttcttgctgtttttcgacgtgtcaaggagtattggcctgtttttcgtgtcctattttcattgcatgaatagtcagctttttagcattggcatgttcagctacgtgatgctcgcaagttctccactgttttgttctcctgagtggcccaggaagttagtatcatactgtcctaggaggctacagcagctgctgccactgaaggccgctccccagccctcagtgtcatgtgtgtataaacgatcgaggggcaaatcgggacagaagcctggattgagacatcagttgggggctgcattcaccctgctctacctgctcgaacagctgttcctcccctactctcactttctgacccagggatataacaattggacaaacgggttatatgggtactcctgggatatgatggtgcatagtcgcagtcaccaacacgttaagattacttaccgtgacggaagaaccggagagctgggatatctgaaccctggtgtatttacacaatcaagaaggtggaaagatcatgcagacatgctcaaacagtacgcaacatgcctgagccgactgctcccaaaatataacgtgacggaacctcagatttattttgacatctgggtgagtatcaacgaccgctttcagcaacggatcttcgatccgagagtggacattgtccaggccgcatggtctccatttcagaggacctcgtgggtccaaccactgctgatggatttatcaccctggcgagctaagcttcaggagattaaaagtagccttgacaatcacactgaagtcgtttttattgcggacttccctggtcttcatctcgagaactttgtaagcgaagacttggggaacacctccatccaactgctgcagggcgaagttacagtcgaacttgtggctgagcagaagaatcagactctaagagagggagagaaaatgcagctgcccgctggggaataccataaggtgtataccaccagcccatctccctcgtgctacatgtatgtctacgtgaacacaactgagctcgctctagagcaagatctcgcatatctccaggaactcaaggaaaaagttgagaacggaagcgaaacaggacctctgccgccagagctgcaaccactcctggaaggggaagttaaaggcggacccgagccaactccattagtccagacattcctgaggagacaacagcggctgcaagagattgagcgcagacgcaacactccgtttcacgaacgctttttcagattccttctgagaaagctctatgtattccgacgcagcttcttgatgacttgcatcagtctgcgcaacctgattctagggaggccatcactggaacagctcgcccaagaagtcacctatgcgaacctgagaccttttgaagccgttggggagctcaatccgtctaacaccgacagcagccatagtaaccccccagaaagcaatccagaccccgtgcacagcgaattctag

SEQ ID NO: 224279 - DNA, 957 bp, Artificial Sequence
  Description of Artificial Sequence: Synthetic coding sequence
atggcatcacctgggtgcttgttgtgcgttcttggccttttgttgtgtggtgccgcatctctagaactgtcgcggcctcacggtgatacagcgaaaaagccaatcattgggattctaatgcagaagtgccgaaacaaggtcatgaaaaactacggacgatattatatcgcggcatcatatgtgaaatacctggagtccgccggagccagagtagtgccagttcggttggatctgacagagaaagattacgagatcttattcaagagcatcaatggcattctgttccctggtggctctgtggaccttagacggtcagattatgccaaggtcgccaagatcttttataacttatccatccagtccttcgatgatggagattatttcccagtgtgggggacttgtctcgggttcgaggagctctctctcctcatctccggcgaatgtctgctaacggctaccgacaccgtggatgttgccatgccactcaacttcaccggaggccaactacacagtcggatgttccaaaacttccccaccgagcttctcctgtctctggcagtggaacctctaactgcaaattttcacaaatggtccctttcggtcaagaattttactatgaacgaaaagctcaagaaattttttaacgtcttgactacgaacactgacggaaaaatcgagtttatatccaccatggaggggtacaagtatcccgtgtacggtgtgcaatggcacccagagaaagcgccttatgaatggaaaaacctggatgggatcagtcacgctcccaacgctgtgaagacagccttttatttggccgagttttttgtaaatgaggctaggaagaataaccaccactttaaatcagagtccgaggaggagaaggctttaatttaccagttcagtcctatttacacaggaaacatcagtagtttccagcagtgctacatcttcgactag

SEQ ID NO: 224280 - DNA, 345 bp, Artificial Sequence
  Description of Artificial Sequence: Synthetic coding sequence
atggctaattccggatgcaaagacgtaaccggacctgatgaggagtctttcctgtactttgcttatggatccaacctgctgacagagcggatccaccttaggaatcccagcgccgcttttttctgtgtcgcaaggttgcaggacttcaaactcgactttggcaacagccagggaaaaacaagccagacctggcatggcggaatagccacaatctttcagtccccgggagacgaggtgtggggtgtcgtctggaaaatgaacaaaagcaatctgaactcgttagatgaactttttgcctgggtccagaaaaagatggtgtgcaggtggagtataaaacgctcttag

SEQ ID NO: 224281 - DNA, 567 bp, Artificial Sequence
  Description of Artificial Sequence: Synthetic coding sequence
atggccaactccggatgtaaagacgtgaccggccctgatgaggagtcctttttgtactttgcatacgggtctaacttactcaccgagaggatacacttaagaaatccaagtgccgctttcttttgcgtagcacgcctgcaggattttaaactcgattttggcaactcacagggcaagacgtcacaaacatggcatggaggcattgcaaccatcttccagtcgcccggagacgaagtgtggggtgtggtctggaagatgaacaagtctaacttaaactctctggatgagcaagagggcgtgaaaagcgggatgtacgtcgtaatcgaggttaaggtggccacccaggagggaaaggagatcacctgtcgtagctacctcatgactaactacgaatcagcacccccttctccacagtataaaaaaattatatgcatgggcgcaaaggagaacggacttccattggagtaccaggaaaaactaaaagccatcgagcctaacgattacactggcaaagtgtcagaggagatcgaggacatcatcaaaaagggcgagactcagacattgtag

SEQ ID NO: 224282 - DNA, 384 bp, Artificial Sequence
  Description of Artificial Sequence: Synthetic coding sequence
atgtttaatccaatccatcacttagactactataaaaaaacgctcccctccgaattgaactggctggggcagatgtggcttaagtttggctgtagtggtttccgccaagagggagtaaaaagcggtatgtatgttgtgatcgaggtaaaggtagccacacaggagggcaaggagatcacatgccgctcgtatcttatgacgaactatgagagtgcacctccttctccccagtataagaaaataatatgtatgggcgctaaggagaacggcctgcctctggagtaccaggaaaaacttaaggccatcgagcctaatgattataccgggaaggtgagcgaagagattgaggatatcattaagaagggcgagacacagacactttag

SEQ ID NO: 224283 - DNA, 285 bp, Artificial Sequence
  Description of Artificial Sequence: Synthetic coding sequence
atggcgaacagcggatgtaaagatgtaacagggcctgacgaggaatccttcctgtacttcgcttacggtagcaacttactgacagaacgcatacatctgcgcaatccaagtgctgcctttttctgtgtcgcaagactgcaaattatttgcatgggcgcaaaagaaaatgggcttcccctagagtatcaggagaagctcaaggccattgagcccaatgactacacgggaaaggtgagcgaagaaattgaagacattattaaaaaaggagagacacagaccctctag

SEQ ID NO: 224284 - DNA, 501 bp, Artificial Sequence
  Description of Artificial Sequence: Synthetic coding sequence
atggcaaacagtggctgtaaagatgtcacaggaccggatgaagaatcctttctgtacttcgcctacggttccaatctcctaactgaacgaattcacctgcgaaacccctctgccgcatttttttgtgtggccagattacaagactttaaactggacttcggcaatagtcagggaaagacaagccagacttggcatggaggcatcgccactatttttcagtccccaggagatgaagtctggggcgtagtctggaagatgaacaaatccaacctgaatagtctggatgaatggcgaaagaagagacacaccgcctttcagaatcaggggaatcatccatgtaagcataagacccggatgtgggatcgcgatcctaagatccctgtgcagaacctttctctggctctgtgctggcaggcacagagtggacatggcacatgtaaccggctgttcgcctgggtccagaagaagatggtttgccgctggtccattaaacgcagctag

SEQ ID NO: 224285 - DNA, 1710 bp, Artificial Sequence
  Description of Artificial Sequence: Synthetic coding sequence
atgaagaaaaaattagtggttcttgggctgttggctgttgttctggtgttagtgatagttggtttgtgtctgtggctcccgagtgccagcaaagaacctgacaatcatgtctatactcgggctgccgttgcggcagatgccaagcagtgctcgaagatcggtagggacgcactgcgggacggaggatctgccgtggatgccgcaatagccgctctgctgtgcgttggacttatgaacgcacattcaatgggaatcgggggtggcctcttcttaacgatatacaattccacaactcgcaaagccgaagtcattaacgcgagggaggtggctcccagattagcttttgccacaatgtttaactcctcagagcagtcgcaaaaggggggattgtctgtagctgtgcccggagaaatacgaggctatgaattagcgcaccaacggcacggtcgcctaccatgggccagattgttccaaccttcaatccaacttgcgagacaggggtttcctgttggtaaagggttagccgctgcactggagaacaagcggaccgttatcgaacagcagccagttctgtgcgaggtgttctgtcgtgataggaaggtgctgcgcgagggggaacgtctgactcttccacagctggccgacacttatgaaacactggctattgagggcgcacaggctttctataacggatcactgacagcccagatcgtcaaagacatccaggcagccggaggcatcgtgacggctgaggacctgaataattacagagcagagctaatcgagcatcccctgaacatatccttgggcgatgtagtcctatacatgccatccgcccctctctcggggcctgtcctcgcgttgatcctgaatatcctgaaagggtataacttcagccgagaatccgtagagtctcccgagcagaagggtctgacttaccacagaattgtggaggccttcagattcgcctacgccaaaagaaccctgctgggcgacccaaagttcgtggacgttactgaagtggtgcggaatatgacctccgagtttttcgctgcccagctccgggcacaaatttccgacgatacaacacacccaatctcctactataaacctgaattctatacccctgatgacggcggaacagcgcacctgtccgtagtcgcggaggatgggagcgcagtttcagctaccagtacaatcaatctctacttcggctctaaggtgaggagccccgtatctggcatcttgttcaataatgagatggatgacttcagcagcccctcgatcactaacgagtttggcgtgcctcctagcccagccaacttcatccagcccggtaagcagccgctgtcatcaatgtgccccaccatcatggtgggccaggacggccaggttcgtatggttgtgggtgctgctgggggtactcagatcacaacagccaccgctttggcaattatctataatctgtggtttggatatgatgttaagagagctgttgaagaacctcgacttcataatcagctccttcctaatgtgaccaccgtagaacggaatatagatcaggctgtgaccgcagcactggagacccgccaccaccatacacaaatcgcgtcaacctttatcgccgtggtccaagcaatagtgaggaccgctggtggttgggcagcggcatcggattctcggaaaggcggtgagccagcgggatactag

SEQ ID NO: 224286 - DNA, 1710 bp, Artificial Sequence
  Description of Artificial Sequence: Synthetic coding sequence
atgaaaaaaaaactcgtggtactgggtctactggccgtggtactagttcttgtgatcgtggggctgtgtctttggctcccaagcgcgagcaaggagcctgacaaccacgtctacacaagagctgccgtcgcggcagatgctaaacagtgcagtaagatcggtagagatgccctccgtgacggcggatcggccgtggacgccgcaattgccgcactactctgtgtggggctgatgaacgcccattcaatggggatcggaggtggactctttctgacaatctataattcaacgactcgcaaggctgaagtgatcaacgcgcgtgaagttgcacccaggctggccttcgccacaatgtttaacagcagcgaacaatcacagaagggaggcctgtctgtggctgtgccgggtgagattcggggatatgagctcgcgcaccagagacacgggcgactaccctgggccaggctgtttcaacctagcatacagttagcaaggcagggttttccggtgggaaagggcctggctgcagctttagaaaataagcgcacagtcatcgagcagcagccagtgctgtgcgaggtattttgtcgagaccgaaaggtgttacgggagggggagagattgactctcccccagctggccgatacttacgagaccctggctatagaaggtgcccaggctttctacaatggcagtctgaccgcgcagatcgtgaaagacattcaagccgcaggcggtattgtaaccgctgaggatcttaacaactaccgggcagaactcattgagcacccgctgaacatctctcttggtgacgtagtcttgtacatgccttctgctccgctgtcaggtcctgtgctggctctaatccttaacattctgaagggctacaacttctcgcgcgaatcagtcgaatcgcctgagcaaaagggcttgacatatcatcggattgtggaagcttttaggtttgcttacgctaaacggaccctgttgggggacccaaagttcgtcgatgtgacagaggtggtgcggaacatgactagcgaattttttgcagcacagctgcgggcacagatctccgatgataccacacaccccattagttactacaagccggaattctataccccggatgacggtggaaccgcccacctcagtgttgtagcagaagacggctcggctgtcagcgcaacatctactatcaacctctatttcggatcaaaagtgcgtagtcctgtgtccgggattctgtttaacaacgaaatggacgacttctcctccccctcaattacaaatgagtttggcgtgcctccttctcctgccaactttattcagccagggaagcagcctctaagttccatgtgcccaacaattatggtagggcaagacggacaggtacgcatggtcgtgggcgcagccggagggacccagatcaccaccgctactgctctggcgattatatataacctctggttcggctacgacgtgaaaagggccgtagaagaaccccgtcttcataaccaactcctgcccaacgtcaccaccgttgaacgaaatatagatcaggccgtgactgcggctcttgagacacgccaccaccacactcagatagcctccacttttatcgccgtggtacaggctattgtgaggacagcgggaggctgggctgcagccagcgacagtagaaagggcggtgagcctgcagggtactag

SEQ ID NO: 224287 - DNA, 1710 bp, Artificial Sequence
  Description of Artificial Sequence: Synthetic coding sequence
atgaagaagaaactggttgtgctgggattgctcgcagtcgtcctggtcctagttatagttgggttgtgtctatggttgcccagcgcttctaaggagccagataatcatgtttatacacgggctgccgtagccgcagatgccaaacaatgttccaaaatcggacgagatgccctgcgcgatgggggttctgcagtggacgccgcaattgctgctctgctgtgtgtgggcctgatgaacgctcacagtatggggatcggtggcggacttttcctcaccatctataactccacaacccgcaaggctgaagtgattaacgcccgtgaggtggctcctcgcctggcattcgccactatgttcaatagttccgaacaatcacagaaggggggactgagcgtagccgtgcctggagagatccgcggatatgaactggcccaccagcgccacggaaggttgccttgggccagattgttccagcccagcatccagctcgctagacagggatttccggtggggaaggggctggctgcagcgctagagaataaacgcaccgtgatcgaacagcagcccgtactctgcgaggtcttctgcagagacagaaaagttctgcgcgaaggcgaaagacttactctgccccagttggccgacacctatgagacccttgccatcgaaggcgcacaagctttctacaatggcagcctgacagcccagattgtgaaggacatccaagccgctggaggcatagtgaccgctgaagatctcaacaattatagggcagagctgatcgaacatcccctgaatatcagcctcggtgacgtggtgctctatatgccgagcgcccctctgtcaggcccagtgctggcccttattttgaatatccttaaaggctataattttagccgtgaatccgtggaaagtcccgaacagaagggcctgacttaccatcgaatcgtcgaggcctttcgctttgcctatgcaaagaggactcttctcggcgatccgaaatttgtagacgtaactgaagtggtccgcaatatgacctctgaattcttcgccgcacagctcagggcacagatctccgacgataccacccatccgatcagctactacaaacctgaattctacacccctgatgatggcggtactgcccacctctcagtcgtggccgaagacgggagcgctgtgagcgctacgtccactataaacctgtattttggatcaaaggtgcggtccccggtatcaggaatcctgtttaacaatgagatggacgactttagctcccctagtatcaccaatgagtttggggtgcccccatcccccgctaatttcatccagcctggcaagcagcccctctcttctatgtgcccgaccattatggtggggcaagatgggcaggttaggatggttgtcggcgctgccggtggcacgcaaataacaaccgccaccgcccttgcgattatctacaatctgtggtttggctacgacgtaaagcgagccgtggaagaacctcgtctgcataatcagctgctacctaatgtgaccactgttgaaagaaatattgaccaagccgtgactgccgcactggaaactcgccaccatcacacccagatcgcttctacgtttatagccgtcgtgcaagcaattgtgagaaccgctggcggatgggcggcagcttctgacagtagaaagggtggtgaaccagccggatattag

SEQ ID NO: 224288 - DNA, 1710 bp, Artificial Sequence
  Description of Artificial Sequence: Synthetic coding sequence
atgaaaaaaaaactggtagttctcggtctgcttgccgtagtgctggtcctggttatcgttggactgtgtctctggctccctagcgcaagtaaggagcccgacaaccacgtatacaccagagccgctgtcgccgcagacgcgaaacaatgttctaagatcgggagggacgccttgcgtgatgggggtagcgctgttgatgctgcaatcgccgctctcctttgcgttgggctgatgaacgcccattctatgggtatcgggggtgggttgttcttgaccatctacaacagtaccacaagaaaggccgaggtgattaacgctagagaggtcgcacccagactggcattcgccaccatgtttaactcgagcgagcaaagccaaaagggcggactctctgtggccgtccctggcgaaatcaggggctatgagttggcccaccagagacatgggaggctgccttgggctcgtctgtttcagccgtcaatccagctggcgaggcagggctttcccgtagggaagggcctcgcggcagccttggagaacaaacggaccgttattgagcagcagcccgtgctctgcgaggtgttttgccgcgatcgaaaggttctgagggagggagaacgtctgacattaccccagcttgccgatacatacgagactctcgccatagaaggggcacaagcattctacaacggaagcctgaccgctcagatagtgaaagacatccaggctgcgggagggattgtcacagccgaggacctgaacaactatagagccgaactcatagaacatcccctaaatatttctctcggtgatgtcgtgctctacatgccttccgcacccctgagtggaccagtgttggctttaatcctgaatatcctgaagggctataacttctcccgcgagagcgtggagtctcctgaacagaagggactcacttaccataggattgtcgaagcttttcggttcgcctatgcaaagcggaccctgctgggtgatcccaaattcgtggatgttactgaggtagtgaggaatatgacctccgagttcttcgcagcacaactgagggcgcaaatcagtgacgacacaactcatccaatctcctattacaagcccgaattctatacacccgatgatggcggaacagcccatctcagcgtagtggccgaagacggatcagctgttagcgctacaagcacaataaacctgtatttcggctctaaggtgcggtctccagtctctggcattctatttaataacgagatggatgatttttccagtccatctatcacaaatgaatttggtgtcccacccagtcccgctaattttatccagcctgggaagcagcctctatctagcatgtgtcctacgattatggtgggacaggatgggcaagtgcggatggtggtaggtgctgccggaggcacacagatcaccaccgcaaccgccctagcaattatttacaatctctggtttggatacgatgtgaagcgggcagttgaagagccgaggctccataatcagctgcttcctaatgtgaccaccgtggagcgcaatattgaccaagccgttactgctgccctggagacacggcatcaccatacacaaatagcctctacctttatcgctgttgtacaggctatcgtccggactgctggaggctgggcggctgcctccgatagtcggaagggcggagaacccgctggctactag

SEQ ID NO: 224289 - DNA, 678 bp, Artificial Sequence
  Description of Artificial Sequence: Synthetic coding sequence
atgacttctgagttctttgccgctcaactgcgggctcaaattagcgatgatacgacccaccctattagttattataagcctgaattttacacgccggacgacgggggaacagcccatctttctgtcgtggctgaggacggctccgccgtaagtgccacctccacaataaatctgtattttggcagcaaagtgcggagtcccgtcagtggcatcctgtttaataacgagatggacgatttttccagcccaagtattacaaacgaattcggggtgccaccatctcctgcgaattttatacagccagggaaacagcctctctcaagtatgtgtcctaccataatggtgggacaggacggccaagtgcgcatggtcgtcggagcagcagggggaacccaaatcaccacggccacggcactggctatcatttacaatttgtggtttggctatgatgtcaagagagccgttgaggaaccacgattacacaaccaactcttgcctaatgtgaccacagtggagaggaacattgaccaggcagtgacggccgcactggagacacggcaccaccacacccagattgcatctacatttatcgccgttgtgcaggccatcgtacgaaccgcgggtggttgggcagccgcttccgacagtagaaagggcggtgagccggctggatactag

SEQ ID NO: 224290 - DNA, 678 bp, Artificial Sequence
  Description of Artificial Sequence: Synthetic coding sequence
atgacgtccgagttcttcgctgcacagctccgggcacaaattagtgatgatactacgcaccccatctcttattacaaacctgaattttacactccggatgatggtgggaccgcccacctctcagtggttgcagaggatggatcggcggtgtctgcgactagcacaatcaatttgtatttcggcagtaaagttagatctccagtgtcggggatcctctttaacaacgagatggatgatttctccagcccttctattaccaatgaattcggggtgccaccatctcctgccaacttcattcagccaggtaaacagccactctcatcaatgtgccccactatcatggtagggcaggatggtcaggtgcgaatggtggtgggagctgctgggggaacccaaattaccactgccactgcactggcaattatatacaatctctggttcggctatgacgtcaaacgcgctgttgaagagcctagactacacaaccagttgttgccgaatgtgacaaccgtggagcgcaacatcgatcaagctgtaacagcggcactggagacacggcatcaccacacccaaatagcttccacatttatagccgtggttcaggccatcgtgcggacggctggtggttgggccgcagctagtgatagtcggaaaggtggcgagccagcaggatattag

SEQ ID NO: 224291 - DNA, 678 bp, Artificial Sequence
  Description of Artificial Sequence: Synthetic coding sequence
atgacctccgaattcttcgctgcacagctgcgggcacagatcagcgacgacaccacccacccgatctcttattataaaccggaattctacactccagatgacggaggcacagcccatctgtcagttgttgcagaggatgggtcagccgttagtgcgacatcaaccatcaacctgtacttcggctcaaaagtacggtcccccgtgtccggaatcctgttcaataacgaaatggacgactttagctccccaagtattacaaacgagttcggcgttcccccaagccctgccaacttcatccaaccaggtaagcaacctcttagttcgatgtgcccgaccattatggtgggccaggacggtcaggtgaggatggtggtgggggctgctgggggaacccagataaccacagcaaccgcactggccataatttacaacttgtggttcggctacgacgtcaaacgagccgtggaggagccacgactccacaaccagctgttaccaaacgtgaccactgtggagagaaatatagatcaagccgtgaccgccgctctcgaaactaggcaccaccatacccagatcgcttcaacatttatcgcagtggtccaggcaattgtccggacagctggcggatgggctgcagcctcagattcccgcaaaggtggagaacccgcaggctactag

SEQ ID NO: 224292 - DNA, 1710 bp, Artificial Sequence
  Description of Artificial Sequence: Synthetic coding sequence
atgaaaaagaaactcgtggtacttggattgctggcagtagtccttgtgctggtgatcgtaggtctgtgtctgtggctgcctagcgcctctaaagagccagacaaccatgtttacacgcgggcagctgtcgcagccgatgcaaaacagtgctccaaaatcggcagagatgccctgcgggatggcggatctgctgtggacgccgctattgccgctttgctctgtgtgggtcttatgaatgcccacagcatggggatcggagggggtttatttctgacaatctataattccaccactcgcaaggccgaagtgataaatgccagagaggtggcaccaagattggcgtttgccactatgttcaactcatccgagcagagccagaagggtgggttgagcgttgcggtgcctggtgaaatcagaggttatgaacttgcccatcagagacacggtcggctgccatgggctcggttgtttcagccctcgattcagctggctaggcagggattccccgtcggtaagggtctcgcagctgccctggagaataagaggacagttatcgagcagcagcccgttctctgtgaggtgttttgcagagaccgaaaggtgctaagggaaggcgagcgcctcacccttcctcaactggccgacacctacgaaaccttggccatcgagggcgctcaggctttttataacggctcactgactgcccaaatagtcaaagatatccaggcagccggaggaatcgtaaccgccgaagatctcaataactaccgtgccgagctgatagaacaccccctgaatataagcctgggggatgtggttttgtacatgcctagcgcaccactgtctggaccagtattggctctgatcctgaacatcttgaaggggtataatttctcaagagagtctgtggagagcccggaacaaaaggggttgacttatcatagaattgtggaggccttcaggttcgcttacgccaagcggactctgcttggagaccccaaattcgttgatgtcaccgaagtggtgagaaatatgacgagcgagttttttgcggcacagctgcgggcacaaattagcgatgacacaacacatcctatcagctactacaagccagagttctacacgccggacgacggcggtaccgcacatctgagcgtggtggccgaagacggctctgccgtgtccgccacatcaaccatcaatttgtatttcgggagcaaagtacgctcacccgtatctgggattctgtttaataatgagatggacgacttctcttccccatctattaccaatgagttcggtgtcccgccatcacctgccaactttatacaacccggaaaacaaccccttagtagcatgtgtccgaccatcatggtggggcaagacggtcaggtcaggatggtggtgggggcagcaggcggaacccaaattacaactgctaccgcgctggcaataatctacaacctgtggtttggctacgatgtcaaaagggccgtggaagagccaaggctgcacaatcaactgctgcctaacgtgaccaccgttgagcggaacatcgatcaggccgtcacagccgctttggagactcggcatcatcatacccaaatcgcatccacctttatagcggtcgttcaagcaattgtgcggaccgccggaggatgggcagccgcttctgactccagaaaggggggagagcccgctggatactag

SEQ ID NO: 224293 - DNA, 363 bp, Artificial Sequence
  Description of Artificial Sequence: Synthetic coding sequence
atgaagaagaagctggtggtgctggggctgctggcagtagtactagtgctggtaatcgtcgggctctgcctctggttaccttcagcttccaaggagccagataatcacgtgtacaccagagcagccgtggccgctgacgcaaagcaatgttccaagatcggacgagatgccctgcgggatggcggatcggcagtagatgccgctatagctgctttgttgtgtgttggcctgatgaacgcccatagcatgggtatcggtggcggattgttcctcacaatctataactccacaacgcgaaaagccgaggtgatcaacgctcgggaagtggcacccaggctggccttcgcaaccatgttcaactag

SEQ ID NO: 224294 - DNA, 1392 bp, Artificial Sequence
  Description of Artificial Sequence: Synthetic coding sequence
atgaaaaagaagctggtcgttctgggcctcctggctgtagtccttgtactggtcatcgtcggactttgcctgtggttgccatccgcctcgaaggaacctgataatcacgtgtacacacgcgcagcggttgcagctgacgctaaacagtgcagcaaaatcggcagggatgcgcttagggatgggggatctgccgtggacgcagcaatcgcggcacttctctgtgtgggcttaatgaacgcccatagcatggggatcgggggagggctgtttctcactatttataactcaacaacaagaaaggccgaagtgatcaatgcgagggaggtcgcacctaggcttgcctttgcgaccatgtttaactcttccgaacagtctcagaaaggaggtctctcagttgcagtgcccggtgagatcagaggatacgagctggcacaccaaaggcacggtaggctgccctgggccaggcttttccagcccagcatacagctcgctaggcagggattccccgtcggtaaggggctggctgccgctttggagaacaaacggacagtgattgagcagcagcccgtgctgtgtgaagttttctgcagggacagaaaggtgctgcgggagggagaacgcctaaccttgcctcagctcgctgacacctacgagacgctggccattgaaggcgctcaggctttttacaatggctccctcaccgctcagatagttaaagatatccaagcggctggcggaatagtcaccgcggaagatctcaataactatcgggctgagctgattgagcacccactaaacatttccctgggggatgtggtgctgtacatgccatccgcccctctgtctggtccagtcctggcgttgatcctgaacatcttaaagggctacaatttttctagagagtcggttgagtcacccgaacagaagggcctcacctatcaccgaattgtggaggcatttcgctttgcctacgcgaagaggactctgcttggggatcccaagttcgtggatgtgacagaagtagtcagaaacatgactagtgagttttttgcagcacaactccgggctcagatttcagacgacaccacccatccgataagttattacaagccggagttctatacccccgatgacgggggtacggcacacctgtcagtggtcgcagaggacggctcggcagtttctgccacttccacaataaatctatacttcggctcaaaagtgagaagtcccgtttcagggattttgtttaacaacgaaatggatgactttagctccccctctattaccaacgaattcggagtgcctccaagtccagcaaatttcatacaaccagggaaacagccgttgagcagcatgtgccccaccattatggtgggccaagacgggtag

SEQ ID NO: 224295 - DNA, 243 bp, Artificial Sequence
  Description of Artificial Sequence: Synthetic coding sequence
atgaaaaaaaaattagtcgtgctgggattgctggccgtcgtgctggtcctggttattgttggactgtgtctgtggctccccagcgcaagcaaggaacccgataatcacgtctatacaagggcggctgtggcggctgatgctaaacagtgcagcaagattggtcgggatgcgctgcgagatggtggctccgcggttgatgccgctatagcggctttgctgtgtgtggggctgatgaacgcctag

SEQ ID NO: 224296 - DNA, 525 bp, Artificial Sequence
  Description of Artificial Sequence: Synthetic coding sequence
atgaaaaagaagttggtagtcctggggctgctagcagtcgtgcttgttctggtgatagttggactgtgtctgtggctgccgagcgcaagcaaggagcctgacaaccatgtatacaccagagcagctgttgccgcagacgctaaacagtgtagcaagatcggacgagacgctctgagggacggaggaagcgctgtggacgcagcaatagccgcactcctgtgcgtggggctgatgaatgcacatagtatggggatcggcggaggcctatttctgaccatttacaacagtactacgcgaaaagccgaggtgataaatgctagggaagtcgctcctcgcctggccttcgcgacaatgtttaatagttccgaacaatcacaaaagggaggcctctccgtagctgtgccaggcgagattaggggctatgagctagcccatcagcgccacggcaggctaccatgggccagactgttccagccctctatccaactggcgcgacagggatttcctgtgggcaaaggtttatag

SEQ ID NO: 224297 - DNA, 381 bp, Artificial Sequence
  Description of Artificial Sequence: Synthetic coding sequence
atgaaaaagaaattggtcgtcttgggcctgcttgccgtggtcttggtacttgttatcgtgggattatgcctgtggttaccctcggcaagcaaggaacccgataaccacgtgtacactcgtgccgctgtggccgcagacgccaagcagtgcagcaagattggccgagatgctcttagagacggagggtctgctgtggacgccgcaatagcggctctgctgtgcgtgggactgatgaatgcgcactctatgggcatcggagggggactgtttctgacaatatataatagtacaacacgcaaggcggaagtgattaacgcccgtgaggttgcgccaagactggccttcgccacgatgtttaactcttccgaacaaagtcagtag

SEQ ID NO: 224298 - DNA, 330 bp, Artificial Sequence
  Description of Artificial Sequence: Synthetic coding sequence
atgaagaagaagctggttgttctgggcttgctcgccgtggtgcttgtcctggtgattgtaggattgtgcctctggctaccatcggcaagtaaagaacccgataatcacgtctacactagggcagctgtggcagccgacgcaaagcagtgtagtaagattggaagagacgcccttcgagatggcggatctgccgtcgatgccgcaatcgccgctctgctgtgcgtgggcctgatgaacgcccattctatgggaatcggcggaggccttttcttaaccatttacaacagcactacacgaaaggccgaggtgatcaacgcaagggaggtttag

SEQ ID NO: 224299 - DNA, 336 bp, Artificial Sequence
  Description of Artificial Sequence: Synthetic coding sequence
atgaaaaagaagttggtagtacttggactcttagcagttgtccttgtccttgttatcgtcggcctgtgcctctggttgccctctgcatctaaagagccagataatcacgtatacacacgagccgcagtggcagctgatgctaaacagtgctccaagataggaagagatgccctccgggatggtggaagtgccgtcgacgctgcgatcgcagcactgctgtgtgtgggactaatgaacgcccactctatgggtatcggcggaggacttttcttgactatttataattcaacaacaaggaaggctgaggttattaacgcaagagaggtcgcaccctag

SEQ ID NO: 224300 - DNA, 114 bp, Artificial Sequence
  Description of Artificial Sequence: Synthetic coding sequence
atgaagaaaaaactggtggtgctgggtctgctggcagtggtgcttgtgctggtaatcgtaggtctctgtctgtggttgccttcagcatctaaggagcccgataatcatgtgtag

SEQ ID NO: 224301 - DNA, 207 bp, Artificial Sequence
  Description of Artificial Sequence: Synthetic coding sequence
atgaaaaaaaaactggtggttctgggacttctggccgtcgtcctggtgctggtgattgtggggctgtgcctatggctgccctccgccagcaaagagcccgacaatcacgtctacacccgtgccgctgtcgccgctgacgcgaagcagtgttccaagattggaagagatgctcttcgagacggcggatccgccgttgatgcggcatag

SEQ ID NO: 224302 - DNA, 381 bp, Artificial Sequence
  Description of Artificial Sequence: Synthetic coding sequence
atgaagaaaaagcttgtcgttctgggcctgctcgctgttgtgttagtgcttgtgatagtggggctgtgtctatggctaccttccgcatccaaggagccagataatcatgtttacactagggccgctgttgcagccgatgcgaagcaatgtagcaagattggtcgggacgcactgagggacggcggaagcgccgtggacgcagccattgctgccttactgtgcgtgggcctgatgaatgcccacagtatgggcatagggggaggtctattcctcaccatctacaacagtaccacacgcaaggccgaggtgatcaacgcccgagaggtggctcctaggctggcattcgcgacaatgttcaattcctcagagcagagccagtag

SEQ ID NO: 224303 - DNA, 351 bp, Artificial Sequence
  Description of Artificial Sequence: Synthetic coding sequence
atgaagaaaaagctggtggttttaggtctcttagcagtcgtgcttgtgctcgtgatcgtggggttatgcttatggctaccctctgccagtaaggaacccgataaccacgtgtatactcgcgctgcagttgcagctgatgccaaacagtgttcaaagattggcagagacgccctgagagatggcggatctgctgtggacgccgctatcgcagcgctgctgtgcgtcgggctcatgaacgcccatagtatgggcatcggaggcggactgttcctgaccatctacaattccactacacgcaaggctgaggtaatcaatgcgcgagaggtcgctccgagactcgcattcgcttag

SEQ ID NO: 224304 - DNA, 384 bp, Artificial Sequence
  Description of Artificial Sequence: Synthetic coding sequence
atgaagaaaaaacttgtggtcctggggttgctggcggtggtgttagtgttggtcatagtagggttgtgtctgtggttgccatctgccagtaaagagccagataaccatgtgtacacaagggcagccgtggccgctgacgctaaacagtgttctaaaattgggagggatgcactccgggacggcggtagtgccgtcgatgcggcaattgcggctctgttatgcgtgggcttaatgaatgcacactcaatggggattggtgggggattattcttgacaatatataattcgacgacgaggaaggcggaagttatcaacgcaagggaggtcgcccctcggctggcctttgctaccatgttcaatagcagcgagcagtcccagaagtag

SEQ ID NO: 224305 - DNA, 297 bp, Artificial Sequence
  Description of Artificial Sequence: Synthetic coding sequence
atgaaaaaaaaattagtggttttaggactgctggcagtcgtcctggtgctggtcatcgtggggctttgtttgtggctaccctctgccagcaaggagccagacaaccacgtttatacaagagccgcagtggccgctgacgccaaacaatgttcaaagatcggcagggatgctctacgggatgggggttcagccgtggacgccgcaatcgccgctttattgtgcgtgggtctgatgaatgctcacagtatgggtataggcggagggttgtttttgaccatatacaactctacaacatag

SEQ ID NO: 224306 - DNA, 93 bp, Artificial Sequence
  Description of Artificial Sequence: Synthetic coding sequence
atgaaaaagaagcttgtggtgctggggctactggccgtagtattagtgctggtgatagtgggactctgcctgtggctgcccagtgcgtcatag

SEQ ID NO: 224307 - DNA, 1710 bp, Artificial Sequence
  Description of Artificial Sequence: Synthetic coding sequence
atgaagaagaagctggtggtgcttggcttgctggctgtcgttttggtcttagtgatagtggggctgtgtctgtggctgcccagcgcctcaaaggaaccagacaatcacgtgtacaccagggcagccatggcggctgatgccaaacagtgcctggagattggacgggacaccctgcgggatggtggaagcgctgtggatgcggcaattgccgcactcctgtgcgtaggcttgatgaacgcacattctatgggtatcggggttggactcttcttaacgatttacaactccaccacccgcaaggccgaagtaattaatgcacgggaagtagcgccacgcctggcattcgcctcaatgtttaacagtagcgagcaatcacaaaaggggggtttaagcgttgctgttccgggagaaatccggggttacgaattagcccaccagcgacatggcagactgccgtgggctcggcttttccagccctccatccagctcgcacgccaagggttccccgtgggaaaggggctcgcggcagtgttggaaaacaaaaggactgttatagaacagcaaccggtgctgtggtatgtgttttgcagagatcggaaagtactccgcgagggagaaagactcacactgcccagactggctgacacttatgagatgcttgctatcgagggcgctcaggcattctataatgggagtctgatggcgcagattgtaaaagacatacaggcggctggaggcatcgtcactgccgaggacctaaacaactatcgcgctgagcttatcgaacaccccctcaacatctctctaggcgacgctgtcctctatatgccctccgccaggctgagcggcccagtgctagcgctcatcctgaacatccttaagggctataatttttctagggaatctgtggagactccagagcagaaaggattaacctatcacagaatcgtcgaggcatttagatttgcctatgcaaagaggacactgctaggtgacccgaagtttgtggatgtcaccgaagttgtcagaaatatgacgagtgagttctttgccgctcaactccgctcccagattagtgatcatacgactcatccaatcagctactataaaccggagttttatacacccgatgatggcggaaccgcacacttgtctgtagtggccgaggacgggtcggcagtttcagcgacaagcacaatcaacttatattttggttctaaggtttgctcccctgtgtcagggatactgtttaacaacgaatggactacctccgcactgccagcctttacaaatgagttcggagcccctccatcacccgctaactttattcagcccggtaaacagccactgctgtccatgtgcctcactattatggttgggcaggatggacaggtgaggatggtagtaggagccgctggcggtacccagataaccacagataccgccttagccattatttataatctctggtttggttacgatgtaaagcgcgctgtcgaggaaccgcgactgcacaacaagctgctgccaaacgtgaccactgtcgagcggaatattgaccaggctgtgaccgctgcgctagaaacccggcatcatcacacccagatcgcgtctacattcatcgctgtagttcaagcaatcgtccgcacagcaggaggatgggcagcagcaagcgattcacgcaaggggggagagccagctgggtattag

SEQ ID NO: 224308 - DNA, 1680 bp, Artificial Sequence
  Description of Artificial Sequence: Synthetic coding sequence
atgaagaagaagctggttgtgctaggcctgctagcggtcgtgctagttctagtgatcgtcggcctgtgtttatggctgccgagcgcctcaaaagagcccgacaaccacgtttacactcgagcagccatggctgctgatgccaagcagtgcctggagataggcagagacactctgagggatgggggatcagctgttgatgctgcgattgctgccctgttatgcgtcggcctgatgaacgctcatagcatgggcattggagtcgggttatttctgacgatttataacagtactactcgaaaggccgaagtaatcaacgccagggaagtggccccacggttagcgttcgcttcaatgttcaattcctctgaacagtctcagaagggcggtctttctgtagcagtgcctggcgagataagagggtacgagctggctcatcagcgccatgggagactgccatgggccagactgttccagcctagcatccagttggccaggcagggattccctgtgggcaaaggactcgcagcagttttagagaataagaggacagtgatagaacaacagcccgtactatggtatgtgttctgccgggaccgcaaagtcctccgggaaggggaacggctcactctcccaaggctggccgacacttatgagatgctggctatagaaggcgctcaagccttttataacggatccctcatggcccagatcgtaaaggacatccaggccgctggtggtatagtcaccgccgaagacctgaacaactatagggccgagctgattgaacacccacttaacatttccctgggggacgcggtcttatacatgcccagcgctagactgtccggtcccgtgcttgccctgatactcaacattctgaaaggctacaacttctcacgcgagtcagttgagaccccagagcagaaagggctgacctaccacagaatcgtggaagctttcaggttcgcctatgccaaacgcacattgttgggcgaccccaagttcgtcgacgtgactgaagtagtgaggaacatgacttccgaattctttgcagcacaactccgcagccagatctcagatcacacaacccaccccatatcatactataaacccgagttttatacgccagacgacggtggtactgcccacctgtctgtagtggccgaagacgggtcagcagtgagtgccacttccacaataaatctgtacggtattctctttaataatgagtggacaacctccgctctgcctgcattcaccaatgagttcggggctccgcctagtcccgctaattttatccagcctgggaaacagcccttgctgtcaatgtgtttaacaatcatggttgggcaggatggccaggtccgcatggtggttggcgcagcaggaggaacgcagattacaaccgataccgctctagccatcatctataacctgtggttcggatacgacgtgaaacgggctgtcgaggagcctaggctacacaacaagcttttacccaacgtgacgaccgtggaaagaaatattgaccaggcggtgacagctgccctggagacacgccaccaccacacccagattgcgagtacttttatcgccgtcgtgcaggctattgtgaggaccgccggtggttgggccgctgcgtcagactcacgcaagggaggggagcccgcaggctattag

SEQ ID NO: 224309 - DNA, 1710 bp, Artificial Sequence
  Description of Artificial Sequence: Synthetic coding sequence
atgaagaagaagctggtcgttctgggtctgctggctgtggtcttggtgctggttatcgtgggactgtgcctgtggctgccgtcggcatctaaggaacccgataaccacgtctacacgcgggctgcgatggctgccgacgccaaacagtgtcttgaaatcgggcgagatactctgcgggacggaggaagtgctgtggatgcagctattgccgcactcctgtgtgttggcctgatgaatgctcattctatgggtatcggcgtaggcctattcctgacaatctacaactctacaactagaaaagccgaggtgatcaacgctagggaagtcgccccaaggctggcgttcgcttccatgtttaattctagcgagcagagccagaaaggcggtctttcagtggctgttcccggagaaatccgcggatatgaacttgcgcaccagaggcacggcaggctcccatgggcgagactgtttcaaccctcgatccaacttgctcggcagggttttcctgtaggcaagggactggcggctgtgcttgagaacaaaagaacggtcatcgagcagcagccagtgctctggtatgtgttttgcagggatagaaaggtgctccgggagggggagcgacttactctcccccgactggctgacacctatgagatgttggccatcgagggcgcacaggctttctataatggctccttgatggcccagatcgtgaaagacatccaggccgctggaggcatagtgaccgccgaagaccttaacaactatcgtgctgaactgatagagcatcccttaaacattagcctgggagatgccgttctttacatgccctcagcacggttatcaggtccagtgctcgcgctgatccttaacatccttaaaggctacaatttcagcagggagtccgtcgagacaccagagcagaagggtcttacctaccaccgcattgttgaagccttcagattcgcgtacgctaagcggacactcttgggagacccaaaatttgttgacgtgactgaagttgtaaggaatatgaccagcgaattctttgcagcgcagcttaggagccagataagcgaccatacaacccatcctattagctattataagcccgagttttacacccctgatgacggtggcaccgcccatctgtcggttgtggcagaggatgggtccgctgtcagcgccacttccaccatcaacctgtattttggaagcaaggtttgcagtcccgtcagtggaatcctttttaacaatgagtggaccaccagcgccctgcccgcattcacgaacgaatttggagctcccccatcccctgcaaatttcattcagcctggcaagcagcctctgctgtctatgtgcttgactattatggtaggccaagacggccaggtacggatggttgtgggggctgccggaggcactcagataactactgacactgccctcgctattatttataacctttggttcggctacgatgtgaagcgcgctgtcgaggaaccgcgtctgcacaacaagctgttaccaaacgtgacaactgtggaacgcaatatcgaccaagccgtaaccgcagctctcgaaacacggcaccaccacacccagatagcttctactttcattgccgtcgtgcaggcaattgttagaactgctgggggatgggccgcagcttctgactcgagaaagggcggtgaaccggcaggatactag

SEQ ID NO: 224310 - DNA, 1665 bp, Artificial Sequence
  Description of Artificial Sequence: Synthetic coding sequence
atggcaaggggttatggagctactgttagcctggtcctgctgggactgggattggcattagcggtcatagtgttggctgtggtgttgtccagacaccaggcaccatgcggaccacaggccttcgcacacgcagccgtggctgcagactctaaggtgtgttccgatattggacgcgcaatccttcagcagcaggggtctccggtggatgccaccatagctgccctagtttgcacatctgtcgtgaacccccagtctatgggactggggggtggagtgatattcacgatctacaacgttacaaccggtgcccagtggataggcgtccccggagagttacgtggctatgcggaggcacaccggcgacacggaaggctgccttgggcacagctgtttcagcccacaattgctttattaaggggaggtcacgtcgtggcacctgtcctgagccggttcctgcataattcaattttaagaccctccttgcaggcctccaccctgcggcagctctttttcaacggaactgaacctctgagaccgcaagatccactcccctggccagccctggctacaactttggagaccgtcgctaccgagggggttgaagtgttttatactggaaggcttggacagatgctcgtggaggacattgctaaggaggggagccagctgacacttcaagatctggccaagttccaacctgaggtggtcgacgcactcgaggttcccctcggcgattataccttgtactccccaccgccacccgctggaggggcaatcctgtcttttatactgaacgtgttgagagggttcaatttcagcacggaaagcatggctcgccctgaggggagagttaatgtttaccatcacctagtggagacactgaagtttgctaaggggcagcggtggagactgggagaccccaggtcccatccaaaattacagaacgcatcgagagacctgctgggcgaaacgctggctcagctgatcagacagcagattgatgggaggggagaccaccagctcagccactactctctagcagaggcttgggggcacggcacagggacatcccatgtttcagtgcttggggaagatggatcggccgtggccgcaacttctactataaataccccttttggtgccatggtatacagtccacggaccggcatcatcctcaacaacgagttgctggatttgtgcgagagatgcccacggggtagcggaaccactccctccccagtgagtggcgaccgcgtggggggagcacctgggaggtgctggccccctgttccgggagaacggagcccgtccagcatggtgccatctatactcataaacaaggcccagggaagcaagcttgtgatcggtggagccggaggcgagctgatcattagtgccgtcgcacaggcgataatgagcaaattatggctgggcttcgacctcagagctgccatcgcggcacccattctgcacgttaactccaaaggctgtgttgagtacgaaccaaactttagccaggaggttcagcggggtcttcaggatcgaggccaaaaccagacccaacggccttttttcctaaatgttgtgcaggccgtgagccaagagggggcatgcgtctacgccgtctccgacctgcgcaagtccggcgaggccgctggctactag

SEQ ID NO: 224311 - DNA, 1761 bp, Artificial Sequence
  Description of Artificial Sequence: Synthetic coding sequence
atggctagaggctatggtgcaactgtgtccctcgtgctgctgggactgggactagccctggctgtgatcgtgctggcagtcgtgctatccaggcaccaagcgccttgtggcccacaggccttcgctcacgctgccgtcgcagcagactccaaagtctgctctgacattgggagagctattctgcagcagcagggatctccagtggacgccacaatcgccgcactggtgtgcacatccgtggtgaatccgcaaagtatgggcctgggcggtggggttatctttaccatctacaacgtgaccaccgggaaagtggaggtcattaatgcccgtgagacagtgcccgcttcacacgcaccctcgctgctggatcaatgcgctcaagctctgcctctgggcacgggagcacaatggatcggagttcctggggaattgcgcggttatgccgaagcccatagacggcatgggcgacttccatgggcccagctgttccaacctacgatcgctctgttacggggtggtcacgtcgtggcgccagtactctcgaggttcctacacaattcaatcttgcgcccttctttacaagcgagcactctgagacagttgttcttcaatggaacagagccccttcgcccacaagacccattgccatggcctgccctggcgactacattggaaactgtagccacagagggtgttgaggtgttctatacaggtagacttgggcagatgctagtggaagacatcgcaaaagaagggtcgcagcttaccttacaggatcttgctaagttccagccagaagtcgtggatgcgttagaggtgcctctgggcgactataccttgtattctccccctcccccagccggaggtgcaatcctgtcctttatcctgaacgtgctgcggggattcaatttcagcaccgaatctatggccaggccggagggtagagtcaacgtatatcatcatctcgttgagacgctgaagttcgcaaagggccagaggtggcgattgggtgatcctagaagtcatcctaagcttcaaaatgccagcagagacctgttgggggagaccctggctcagctcatcagacaacaaatcgacgggcgaggtgatcatcagcttagccattactcactcgccgaagcctggggccacggtactgggacgtcccacgtatcagtcctgggggaagacggaagtgctgtagccgcaactagtactatcaacacccccttcggcgcaatggtttatagcccaagaacggggattattctaaataatgagctgctggatctctgcgagcgttgcccacggggatccgggactacacccagtcctgtctccggcgaccgggtgggcggagcccctgggaggtgctggccaccagtgccgggagaacggtccccttcttctatggttccgagtattttgataaataaggcccaaggttccaaactggtcatcggcggtgcgggaggcgagctcatcatctcagctgtggcccaggccatcatgagcaaactttggcttggatttgacctgcgcgctgcgatcgccgcacccatcctgcatgtgaacagcaaaggatgcgtagaatatgaaccgaattttagccaggaggtgcaaagaggacttcaagataggggccaaaaccagacccagcgtcctttcttccttaatgtggtacaggcagtgtctcaagaaggtgcttgtgtttatgcagttagcgacctccgaaagtctggcgaagccgcagggtattag

SEQ ID NO: 224312 - DNA, 1764 bp, Artificial Sequence
  Description of Artificial Sequence: Synthetic coding sequence
atggcccgaggatacggcgcaacagtatcactggtgctgctgggcctcgggctggcgctggctgtgatcgttcttgcagtggtgttaagtcggcaccaggcaccctgcggccctcaagccttcgctcacgcagccgtggccgctgattccaaagtctgctctgacatcggacgagcgatcctccagcagcagggctcaccggtggacgctaccattgcagccctcgtgtgtacgagtgtggtgaatcctcagtctatggggttaggtggcggagtcatctttaccatctataacgttaccacaggcaaagtcgaagttatcaatgcgagggagaccgtacccgcaagtcatgccccttctctgctcgaccaatgcgcccaggctttacccctcggcaccggagcacagtggattggtgtcccaggcgagcttaggggatacgctgaagctcataggagacacggcaggttgccatgggcgcagctcttccaaccaactatagcactgttgcgaggcggacacgtagtggcacccgtactgtcgcgttttctccacaattccattctgcggccttctttgcaagctagcacgctgcgacagctttttttcaatgggacggagccgttgagaccacaggaccctcttccttggcccgctcttgcgactaccctggagactgtggccacagagggagttgaggtgttttacactggacgactgggtcagatgctcgtcgaggatatcgcaaaagaggggagtcagttgactctccaggatctcgctaagttccagccagaagtggttgatgccctcgaggttccccttggcgattataccctttactccccaccacccccagcagggggtgccatcctctccttcatactcaacgtcctgagaggatttaatttctcaactgagtccatggctcggccagagggaagggtgaacgtgtaccatcacctcgtcgagaccctcaaatttgcaaagggacagaggtggcgactcggtgacccgagatcacatccaaagctgcagaatgcctcgcgtgatctcctgggggaaaccctggcccaactaatccggcagcaaattgacggcagaggagaccatcagctgagccactattcattagccgaggcatgggggcacggaaccggcacttctcacgtatcagttctgggagaagacggttcagctgtagccgctacctcaactatcaacaccccgttcggcgcaatggtttacagccccagaacaggtatcattctcaacaatgagctgcttgatctgtgtgagagatgtccccgaggcagtggcaccacacctagtccagctgtgtcgggtgatagagtggggggagcgcctggcagatgctggccccctgtccctggagagaggtccccttcttctatggtccccagtatccttattaataaagcacagggtagcaaactagtgattggcggagcaggcggtgaactgattatcagcgctgtggcccaggcaataatgtccaaactgtggctcggctttgatctgcgggcagcgatcgctgccccaatccttcacgttaattccaaaggatgtgtggagtatgagcctaatttttctcaagaggtgcagaggggtctgcaggaccggggacaaaaccagacacagagaccattcttccttaatgtggtccaagctgtatctcaggaaggcgcatgtgtttacgctgtgagcgatctcagaaagagtggcgaggcagcaggatactag

SEQ ID NO: 224313 - DNA, 1533 bp, Artificial Sequence
  Description of Artificial Sequence: Synthetic coding sequence
atggccaggggatatggcgctactgtaagtcttgtgttgctggggcttgggttggctctcgctgtaattgtcctcgcagttgtactcagtcgtcatcaggccccttgtgggccacaggcatttgcgcatgcggcagtggcagccgattctaaagtgtgctctgatattggaagaggaccagtagaccggggagctcgcggagccccatggttgtgtagaggaccaccacccccttggccacctgccctcggggctgcagtccccgctcaccacagggctgcacctcggggagcttgcggcggtccgtgtcctcagcccttcccagcccagcagcatcccgcagcttttcttgctggggttaaccctgctctcttttttaacggcaccgagcctctacgccctcaggacccactcccctggcccgctttggccactacattagagaccgtggccacagagggggtcgaggtgttctacaccggccgtctgggccagatgttagtggaagacatcgccaaggaggggagtcagctgaccctccaggatctggcaaaatttcaacccgaggtggtggatgctctggaggtgcctctcggcgattatacattgtactcaccccctcctcctgcgggtggtgccattctttcattcatcctgaatgtcctgagaggcttcaacttcagcactgaaagcatggcacgacctgaaggcagggtcaatgtgtatcatcacttggttgagacactcaagttcgccaaggggcagcggtggcggctgggtgacccacgcagccaccccaagttgcagaacgcttccagagacttgcttggagaaaccctggcccaactaatcagacaacagatcgacgggaggggcgaccatcaactgagccattacagcctggcggaagcgtggggacatggtacaggtacaagccatgtctctgtgcttggggaggacggatcagccgttgccgcaactagcacgattaatactccctttggagccatggtatacagcccccgaacaggaatcatcctgaacaatgagttgctggatctctgcgagcgctgccccagaggtagcgggacgactcccagtcccgcagtcagtggggacagggtcgggggtgcacccggaaggtgttggccccctgtccccggagagcgcagcccttctagcatggtgcctagcatcctgataaataaggctcaaggcagtaagcttgtgatcggcggagctggaggagaactcatcatatctgccgttgcgcaggccataatgtccaagctgtggctgggcttcgacttgcgcgctgctatcgcggcacctatcttgcatgtgaacagcaaaggatgtgtagagtacgagccaaatttttcgcaggaagtacagcgaggactgcaggataggggtcagaaccagactcagcggcctttcttcctcaacgtagtgcaggcagtgagtcaggaaggcgcatgtgtgtatgcagtgtctgacttgcggaaatctggcgaagccgctggatactag

SEQ ID NO: 224314 - DNA, 1506 bp, Artificial Sequence
  Description of Artificial Sequence: Synthetic coding sequence
atgggactcggcggaggcgtcatattcaccatctataacgtcacaacggggaaggtggaagtcatcaatgctcgggagacggtgcctgcatctcacgcgccaagtttgcttgaccagtgcgcgcaggctctccccctcggtaccggagcacagtggatcggcgtccctggagagctgcgtggctatgccgaagcccaccgacgccatggcaggctgccctgggcccagttgtttcagccgactattgctctgctccgcggaggtcacgtggtggccccagtcctatcacggtttctgcataacagtatcctgagaccgtcactgcaggcctcaacacttcgccagctgttcttcaacgggacggagccactgcgacctcaggaccccctgccgtggccggcattggctacaaccctggaaactgtagctacagagggagtcgaggtcttttataccggcagattgggacaaatgctggtcgaggacattgcaaaagaaggctcccagctaacactccaggatttggctaagtttcagcccgaggtggtagatgctctggaagtacccctgggagattacacactctactctcctccaccaccagcaggtggggcaatcctatctttcatcctgaatgttctccgagggttcaatttttctacggagtctatggcccgtcccgaaggcagagtaaatgtctatcatcacctggtggaaactttgaagtttgccaagggtcagagatggagactgggcgacccacgcagccatccgaagttacaaaacgccagcagggatctcctcggcgaaactctcgcgcagctcatcagacagcagatcgacggtagaggggatcaccagctgtctcactacagcctcgccgaggcctggggccacggaacaggaacctctcacgttagcgtgcttggtgaagatgggtctgctgtagcagcaacctctacaataaacacgccatttggcgctatggtgtattcaccccgtacaggtatcattctcaacaatgaactactcgatttatgtgaacggtgtcctagaggaagcggcacaactccgagtcccgtgagtggcgaccgggtgggtggcgctccgggtagatgttggcctcccgtgccgggagaaagatctccgagttctatggtgccctccatcctgatcaacaaagctcagggctccaagctcgttattggtggcgcagggggagagctcattatttccgcagtagctcaagccatcatgtcaaaactctggctcggattcgatctgagagctgctatcgctgcccctatactgcacgtgaattccaagggatgcgtagagtacgagcccaactttagtcaggaggttcagcgcggtttgcaggaccggggtcagaatcagacccagaggccatttttcttgaatgtggttcaggcagtcagtcaggaaggggcatgtgtttatgccgtttccgatctacgcaagtctggtgaggcagccggttactag

SEQ ID NO: 224315 - DNA, 1386 bp, Artificial Sequence
  Description of Artificial Sequence: Synthetic coding sequence
atggagagagcggaagaacctgtcgtttatcaaaagctgcttccctgggaaccatcactggaatctgaggaggaagtggaggaggaagaaacttccgaagcactggtgctgaatcccaggcgccatcaggacagtagtagaaacaaggctggtgggctgcctggaacctgggcgagagtggtggccgctctgctcctcctcgccgtgggatgcagcctcgcggtccgtcaattgcagaaccagggacggagcaccggaagtctgggatcagtggctcctcccccagggggacattcacatgggcctggagtgtaccaccacggagcaataatttctccagcgggtgctatgttctggggcttattccacgacagcagcagtgggaattcaacagcactaacatcggggccagcccagactctggctcccggactgggtctgcccgctgcattgcccactttgcacctcctgcatgcacgcttcggtcgattgccctggccccgtttgctggtggggcctactaccctggcccaggaggggtttctggtggacacccccttagctagagcactggttgctaggggaaccgagggtctgtgccctctcctgtgccacgccgacggcacgccactgggcgctggcgctagagccacgaatcctcagcttgctgcggtactgagatctgctgctctggcaccaacctccgatcttgctggagatgccctcctgagcctcctggccggtgatctgggtgtagaggtgccgagcgctgtcccaagacctactctggagcccgctgaacaactgcctgtgccccagggcatcctttttacgaccccctctcccagcgctgggcctgaactgctcgccctgctggaggcagctttaagaagtggggcacctattccagacccctgccccccatttctgcagacagcggtttcacctgagtcttcagcgttagctgccgtcgatagctccggctctgtgcttctgctcacatcttccttgaactgttcctttggcagcgcccacttgtcgccatccacgggggtcctgttaagcaacctggtagcgaagagtactaccagcgcatgggcctgccccctgattctacggggttcactcgacgatactgaggcggacgtgctaggattggtggcatccgggacacccgatgtcgccagggcaatgacacacacactgctgagacacttggcagcgagaccacctacccaagcacagcaccaacatcaggggcagcaagagcctacagagcatccctctacctgcggccagggtacattgctccaagttgctgcccacacggagcacgcccacgtgtcctccgtaccccacgcatgttgcccgtttcaaggcttctag

SEQ ID NO: 224316 - DNA, 1482 bp, Artificial Sequence
  Description of Artificial Sequence: Synthetic coding sequence
atggaaagagcagaggagccggtagtgtatcaaaaactcctgccatgggagccaagccttgagagcgaagaggaggtcgaagaagaggagacctctgaggcattggtgctgaatcctagaagacaccaggattcgtcacgcaacaaggccggaggattgcccggtacttgggcacgcgtcgtggcagcgctcctcctgctagctgtaggctgcagccttgcggtccggcagctgcagaatcagggcagatcaactggcagcctgggctcagtcgcgcctcctcctggtgggcactcccatgggccaggcgtttatcaccacggtgccatcatttcccccgctggacgtgaactgctggttgctggtggcaacgtcgtggatgcaggtgtgggcgctgccttatgtttggcagtggtgcacccgcatgccaccgggcttggcgctatgttctggggcctctttcacgactcatcttcaggaaactcgaccgccttgaccagcgggcctgcccagactctggcgccagggctgggcttgccagcagcgctgcctacattgcatttattgcacgccaggttcgggagattgccctggccacggcttctggttggacctacaacactggcgcaggagggttttctagttgacactcccctggcgagagctctggttgctagggggaccgagggactctgccctttgctctgccacgcagacggaacaccactcggcgctggcgcaagagccacgaacccacagttggcagcagtcttacggtccgccgctctggcgccaactagtgacctggctggggacgcgttactttcccttctggctggcgaccttggcgtggaagtccctagcgcagtacctagaccgacactcgagcccgctgaacagttaccggttccccaagggattcttttcactaccccgagtccttccgcaggaccagaattactcgccctgctggaagccgcactccgatcaggggctcctatacccgatccgtgcccaccgttcttgcagacagctgtgtcacccgaaagctccgcgctggccgcagtcgattctagcggctcggtgttactcttaacaagcagtctgaattgctccttcggcagcgcccatcttagtcctagtactggagtgctcctgtcaaacctggtggccaagtccacgacctcagcttgggcatgccccctaatcctgcgtgggagcctggatgatactgaggcagatgtgctcggattagtcgcctctggaacacctgacgtagcccgagccatgacacataccctactccgccacctggcagccagacctcccacacaggcccagcaccagcaccaaggacagcaggagcccaccgaacatccgagtacttgcggtcagggcaccctccttcaggtggcagctcacacagagcacgcccacgtctcctccgtaccacacgcctgttgtccttttcaaggcttttag

SEQ ID NO: 224317 - DNA, 1038 bp, Artificial Sequence
  Description of Artificial Sequence: Synthetic coding sequence
atgttttggggccttttccatgactctagttccggcaattccacagccctcacctcaggccctgcacagacacttgcccctggactagggctgccagccgctctcccaactctgcatctgctccatgcgaggttcggcagattaccttggcccagactattggttgggcctacaaccctggcccaggaaggatttctagtggatacccctttggcccgagcgctagtcgctagagggaccgaagggctctgccccctactttgtcacgcagacggcactcccctcggtgcaggcgcaagagccaccaaccctcaattagcggctgtgctaagaagcgcagccctggctccaaccagcgatttggctggggatgctctgctgagtctgctggctggggatctgggtgtggaggtgccaagcgccgtaccgagacccacgctcgaaccagccgagcagctccccgtccctcagggaatcctctttacaaccccgagcccctctgctggacctgaactcttagccctgctggaggcagcgttgagatccggcgctccaataccagatccatgtccacctttcctccagaccgctgtaagcccagagtcctctgcgctcgcagccgtggactctagtggcagcgttctgttactgactagttccttgaattgttcattcggatccgcacacctgtcgccatccacaggggttctcttgagcaacctagttgcaaaatctacgacaagtgcctgggcatgtccgttgatactacgcggttcattagacgataccgaggctgacgtgttgggcttagtcgctagcgggacccccgacgtggccagagcaatgacccatacactgttgcggcaccttgccgctcggcctcccactcaggcccagcaccagcaccagggccagcaggaaccaaccgagcatccctccacctgtggccagggtaccctcttacaggtggccgcacacacagagcacgcacatgtcagctccgtgcctcatgcctgttgtccattccaagggttttag

SEQ ID NO: 224318 - DNA, 1482 bp, Artificial Sequence
  Description of Artificial Sequence: Synthetic coding sequence
atggagagggcggaagaaccagttgtctaccagaagctactcccttgggaaccgtcattggaatctgaggaggaggtggaagaggaagaaaccagtgaggccctggttctgaatcctcgcaggcaccaagattctagcagaaacaaggccggtgggctgcccggaacttgggcccgagtcgtcgccgctcttcttttactcgctgtgggctgctctctcgccgtgcgacaacttcagaaccaaggaaggagtaccggctctttagggtccgtcgctccccctccaggtggtcacagccacgggccaggcgtgtatcaccacggggcaattattagccccgctggcagggagctgttggtcgccggtggcaacgtggtcgacgccggtgtaggtgccgcactgtgtctagccgtcgtacaccctcacgccactgggctaggggctatgttttggggattgtttcatgactcatcttctgggaacagtactgctcttacctcagggccagctcagactctggcgcctggtctcggactgccagccgctctcccaaccctccacttactccacgccaggtttgggagactgccttggccacgcctgctagtgggccctacgactttagctcaagagggattcttagtggatactcccttggctagggcgttggtcgccagggggactgagggactctgcccgctgctctgccacgcagatgggacaccactcggggcaggagcacgcgcaactaatccacagttggccgctgttcttcgcagcgccgcactggcccctacttccgacctggccggagacgccctactgagtctgctggccggagacctgggagtcgaggtgcctagtgcggtaccacgaccgaccctggaaccggcagagcagcttccggtccctcagggaatcctctttacgacgccctcaccctcagcaggacctgagctgctggccctccttgaagctgctctcaggtctggggctccaatccctgatccttgccccccattcctacagaccgccgtgtctccagagtcatcagccttggcagccgtggattcttccggctccgtcttgcttctgacctcgtcactgaactgctctttcgggtcagcccatttgtcccctagcaccggggttctcctgtcaaacctcgtggccaagagtacaacgagtgcgtgggcttgtccgctcatcctgagaggctcactggatgatacagaagcagacgtcttaggactggtagcttctggcacgcctgatgtggcaagggcaatgacccataccctgctgaggcatttggccgcacgtccccctacccaagcccagcaccagcaccagggacagcaagaaccgacagaacacccttccacctgtggacaaggtaccctcctgcaagtggctgctcatacagagcatgcacacgtttcctctgtccctcacgcctgttgcccatttcaggggttctag

SEQ ID NO: 224319 - DNA, 678 bp, Artificial Sequence
  Description of Artificial Sequence: Synthetic coding sequence
atgacctctgagttctttagcgctcagctgcgggcacaaatctccgatgataccactcacccaatatcatactacaaaccagaattctatatgccggatgacggcggaaccgcccacctctctgtggtcgccgaagatggctcagctgtgagtgccacgagcactataaacctatatttcggaagtaaggtgcgcagccctgtttccggcattctcctcaataacgaaatggacgatttctcttccacctcgatcactaatgaattcggagtgcccccatcccccgcaaatttcattcagcccggaaagcagccactgtcgtcgatgtgtcccacgatcatggtcgggcaggatggacaagtgcgcatggtcgtgggtgccgcaggcggtacgcaaattacgatggcaaccgctctcgcaatcatttataatctttggttcggttatgacgtcaaatgggccgtggaagagccccgattgcacaaccaactcttacccaacgtgactactgtggagcgaaatatcgatcaggaggtgacagccgcactggaaacacggcatcaccatactcagataacctctacattcattgccgtggtccaagcaatcgtcaggatggccggagggtgggccgctgcatccgactccagaaagggaggggaaccagcagggtattag

SEQ ID NO: 224320 - DNA, 678 bp, Artificial Sequence
  Description of Artificial Sequence: Synthetic coding sequence
atgactagcgagttcttttccgcccagttaagagctcagataagcgacgatactacacacccaataagctattacaagcccgagttttacatgcctgacgacggtggtacggctcacctgtctgtagtggccgaagatggcagtgcagtgtctgccacctcaacgataaatctgtatttcggttctaaagtgagatccccagtttccggaatattgctgaacaatgagatggacgacttttcaagcacctctatcaccaatgaattcggggtgccccctagccctgcaaatttcatccaacccggtaaacaaccgctctcatccatgtgccctaccatcatggtgggtcaggacggtcaggtgcggatggtggtgggcgctgcaggcggaactcagattacaatggccacggcactcgctattatatataatctgtggtttggatatgatgtgaaatgggcagtagaggaacctagactgcataaccaactgctgccgaatgtcaccactgtggagagaaacatcgatcaggaggtgacagccgctttagagactaggcaccatcacacacagataaccagcacattcatcgcagtggtgcaggccatcgtgcgaatggcaggcggatgggctgccgcaagcgacagcagaaaggggggagagccagccggatactag

SEQ ID NO: 224321 - DNA, 678 bp, Artificial Sequence
  Description of Artificial Sequence: Synthetic coding sequence
atgacttccgagttcttttcagcacagctacgtgcgcagatctcagatgacacgactcacccaattagctattataaaccggaattttacatgccagatgatggcggaaccgcccacctgtctgtcgtagccgaggacggcagcgcagtgagcgctacatctaccatcaatctgtattttggctccaaagtccgcagtccagtctcagggatactgttaaacaatgagatggatgacttctcgtcaacatcaattaccaatgaattcggcgtgccaccctcccctgctaactttattcaacctgggaagcagccactttcctcaatgtgtccgacgatcatggtcgggcaggacggccaagttaggatggtggtcggtgctgcgggtggcacccaaattaccatggccacagccctagcaatcatctacaatctgtggtttggctacgatgtcaagtgggcagtcgaagagccaagactacacaatcaactgctgccgaacgtgaccactgtggagcgtaacatagatcaggaggtaaccgcagccctcgaaacgcgtcatcatcacacacaaattacctccacatttatagctgtagttcaagccatcgtgagaatggccggaggctgggcagccgcaagcgactcccggaaggggggagagcccgctggctactag

SEQ ID NO: 224322 - DNA, 678 bp, Artificial Sequence
  Description of Artificial Sequence: Synthetic coding sequence
atgacgagcgagtttttcgcagcccaattgcgcgctcagatttctgatgacactacgcaccccatatcttattataaacctgagttttacacccccgtggacggaggcacggcccatctgtcggtggtggccgaagatggtagtgccgtcagcgctacttcaaccattaacttatattttggtagtaaagttcgctcaccagtatctgagatactgtttaatgacgagatggacgatttttccagtcccaacatcaccaacgagttcggagtccctccatcacctgccaattttatacagcccggaaagcagcctctgtcctccatgtgccctactatcatggtcggacaggacgggcaggtccgaatggtggtgggtgctgcgggaggaacccagattactactgcgaccgctcttgcaatcatttataacctgtggtttggatatgatgtgaagagagcagtagaagaacctaggcttcacaaccaactcctcccgaacgtcaccactgtggaaaggaatattgatcaggctgtgactgcggctctggagaccagacatcaccacacccaaatcgccagcacctttattgctgtcgttcaggcgatagtccggactgcgggtggctgggccgcagcctcagattcgcgtaagggcggagagcctgctgggtactag

SEQ ID NO: 224323 - DNA, 657 bp, Artificial Sequence
  Description of Artificial Sequence: Synthetic coding sequence
atgacctctgaattttttgctgcgcagctgagggctcagataagcgacgataccactcatcctatatcgtattataaacccgaattttacacccccgtggacggcggaacagctcatctgtcagtggtcgctgaggatggaagcgccgtgtccgccacatccacaataaatttatactttggcagcaaggtgaggtcaccagtatctgaaatactgttcaacgacgagatggatgacttttctagcccaaatatcacgaatgagtttggggtgccacccagcccagctaatttcatccagcccggtaagcagccgttgtcatccatgtgtccaactattatggtgggccaggatgggcagccaccttctcacgccgaccatactcccatgccgcaggccattatctataacctctggttcggatatgacgttaaaagggccgtggaggagccacgcctacacaatcaactgcttccaaacgtgaccactgttgagcggaacattgaccaggcggttactgctgctctcgagacgagacatcatcacactcaaatcgcctcgactttcatagcggttgtgcaagctatcgtccgtaccgccggaggttgggccgctgctagcgacagccggaaggggggagaacccgctggttactag

SEQ ID NO: 224324 - DNA, 678 bp, Artificial Sequence
  Description of Artificial Sequence: Synthetic coding sequence
atgactagcgaattctttgccgcacagctaagatcccagatttccgaccacactactcaccctattagctactataaacccgagttctacacacccgatgacggcggaactgctcacctaagcgttgtggccgaagatggttctgcagtctcagccaccagtacgatcaatttatacttcggttctaaagtgtgctctcctgtatcagggatcctgtttaacaacgagtggactacctctgccctgccagcttttaccaatgagtttggagcgccaccaagcccagcaaactttattcagcctggcaagcagcctctcctgtctatgtgtcccacgattatggttgggcaggacggtcaagttaggatggtcgtgggagcagctggtggcactcagataacaacagacacagcactggctattatctataatctgtggtttggctatgacgttaagcgagctgtggaggaacccaggctgcacaacaagttgttgcctaatgtcacaactgttgagagaaacatcgaccaggcagtgactgctgcattggagactcgacatcatcatacacaaattgcatcgacatttatcgctgttgtgcaggcaattgtccgcaccgctgggggatgggctgccgcatccgactcccgaaaaggtggcgagccagcaggctattag

SEQ ID NO: 224325 - DNA, 711 bp, Artificial Sequence
  Description of Artificial Sequence: Synthetic coding sequence
cctgcactgggcagccaacaggttgtccgtaacatgacatctgagttcttcgcagctcaactccgctcgcagatctcagaccacaccactcatcctatcagctattacaagcccgagttctataccccagatgacggcggtacggcccacctgagtgtcgttgcagaagatgggtctgctgtttctgccacgtccactatcaatctgtactttggatccaaagtgtgttctcctgtgtctggcatcttgttcaacaacgagtggacgacctccgcacttcctgccttcaccaatgaattcggggcacccccttcacctgcgaacttcatccagcccggtaaacagccccttttgtccatgtgtccaactattatggtcggccaagatgggcaagtgcgcatggtagttggcgctgccggtggcactcagatcactaccgataccgcccttgccatcatctataatctttggtttggttatgacgttaagcgcgcagttgaggagccgaggctccacaacaaactcctgccaaacgttaccaccgtggagaggaacatcgaccaggctgttaccgccgctctcgagaccaggcaccaccatacccagatcgccagcacctttattgcggtggtgcaggctatcgtgaggacggccggtggctgggccgcagcttccgactcaaggaaaggcggtgagcccgctgggtattag

SEQ ID NO: 224326 - DNA, 675 bp, Artificial Sequence
  Description of Artificial Sequence: Synthetic coding sequence
atggtggccgctgtactgttgggcctcagttggctgtgtagccctttaggtgcactggtgctcgatttcaataacataaggtctagtgccgatttgcatggagctcgaaagggcagtcagtgtctctcagataccgattgcaacactcggaaattttgtctgcagcctcgagatgagaaacctttttgtgccacttgtcggggtctgcggagacgatgccagagagatgccatgtgctgcccagggaccctctgcgtgaatgacgtatgcaccaccatggaagatgctaccccaatcctggaacgccagctggatgaacaggatgggacacacgcggagggcacaaccggacaccctgtgcaggaaaaccaacccaagcgcaaaccaagcatcaaaaagtctcaaggacgaaaggggcaggaaggcgaatcctgcctcaggacttttgattgtgggcctggactttgttgcgcaaggcacttctggaccaagatatgtaaacctgttctgctagagggacaggtgtgctcacggaggggacataaggatacggcacaggctcctgagatcttccagcgctgcgactgcggcccaggcctgttgtgtcgttctcagctgacatccaataggcagcatgctcgcctgagggtatgtcagaaaatagaaaaactgtag

SEQ ID NO: 224327 - DNA, 873 bp, Artificial Sequence
  Description of Artificial Sequence: Synthetic coding sequence
atgagactcaattccactggggaggtgccagtcctgattcatggtgaaaacatcatttgcgaagcaacacagatcatagactacctcgaacagacattcttagacgagcgaacacccagactcatgccggacaaagagtccatgtactatcctagggtccaacattacagagagctgctcgacagtctcccgatggacgcctacacccatgggtgtatcctccacccagaactgaccgtggactctatgatccccgcttacgctactacgcggatacgctcccaaattggcaacaccgagagtgaattgaagaagctcgctgaggaaaacccagacctgcaggaggcgtatattgcgaaacagaagcgactcaagagtaaactgttggaccatgataatgtcaagtaccttaaaaagattcttgacgagctggagaaggtgctggaccaggtagagacagagctccagcggcgaaatgaagaaacccctgaagagggccagcagccgtggttgtgcggtgagtccttcacccttgccgacgtatctctggcggttacgctgcaccgactaaagttccttggcttcgcacgtagaaactggggcaatggcaaacgccctaatttggaaacctattatgagcgtgttctgaaaagaaagacttttaacaaagtcctgggacacgtcaataatatcttgatctctgcggtgctgcctaccgcgttccgggttgctaaaaaacgggctccaaaagtgttgggcaccacactggtcgtcgggctgctggctggcgtcggctactttgccttcatgttattcagaaaacggcttggctcaatgatactcgcttttcggcctaggccaaattatttctag

SEQ ID NO: 224328 - DNA, 1632 bp, Artificial Sequence
  Description of Artificial Sequence: Synthetic coding sequence
atgggggactggaacttgctgggcggaatcctggaagaagttcactcccattccaccatcgtgggaaagatatggctgacaatattattcattttccgcatgctcgtgctcagagtcgcagcagaggatgtgtgggacgatgagcagtctgcctttgcctgtaatacaagacagcctggatgcaataatatctgttacgacgacgccttccccatctctctcatccgcttttgggtgctgcagatcatcttcgtatcatccccttcgctggtgtatatggggcatgcattgtataggcttagggcctttgagaaagacaggcaacgaaaaaaatctcatctcagggcccagatggaaaaccctgacctggatttggaagaacagcagagaattgaccgcgaactacgaaggttggaagagcagaagaggatccacaaagtgccccttaaggggtgtttgctgaggacatatgtgctccatatactgaccagatctgtgttggaagttggattcatgattgggcagtatattttatacgggttccagatgcacccactgtacaaatgtactcaaccgccttgccccaatgcagtcgactgtttcgtgtctcggcctaccgagaagacaatctttatgctgttcatgcactccatcgccgcaatttcgctgctgctgaacatactagagatctttcatctcggcatccggaaaatcatgagaactttgtataagaagagctcctccgaaggcatcgaggacgagacaggcccaccttttcacctcaagaaatattccgtagcccaacagtgtatgatctgctcctccctgccagaaaggatctctccgctgcaagccaataatcagcagcaggttattcgggtgaacgtgcccaagagtaagaccatgtggcagattccccagccccgacagctcgaagtggacccctctaatggcaagaaagactggagtgagaaagatcagcactccggccagctgcacgttcacagcccttgcccgtgggcagggtccgctggcaatcaacacttgggtcagcagagtgatcattcctcattcggattgcagaacactatgtcccagtcttggttaggcactaccacagccccaagaaattgtccaagcttcgcagttggcacgtgggagcagtcacaggatccagagcctagtggggagcccttgactgacctacactcgcactgcagggatagcgagggctccatgagagagtccggcgtatggatcgacaggtccagaccgggatctcgcaaagcgagttttcttagtaggctgctctctgagaagcgccacctccatagcgatagtggcagctcaggaagcagaaatagctcatgtctggattttccacattgggagaatagtccttcacctctaccatccgtcacaggacatcgaactagcatggttagacaggccgcactgccaatcatggagctgagtcaggaactgttccactctggctgcttcctgttccccttttttcttcccggtgtatgtatgtatgtgtgcgtagatagggaggctgatgggggaggggattatctgtggcgtgataaaattattcatagtatccattccgtgaagtttaattcatag

SEQ ID NO: 224329 - DNA, 1308 bp, Artificial Sequence
  Description of Artificial Sequence: Synthetic coding sequence
atgggtgattggagcttccttggccgtctcctggagaacgcacaggagcattccaccgtgatagggaaagtatggctgactgttctcttcatcttccggatcctggttcttggggcagctgccgaggacgtgtggggcgatgagcagtctgattttacttgcaacacccagcaaccaggctgtgaaaacgtgtgctacgatcgagcctttccgatttctcatatcagattttgggccctgcagattatttttgtatcaaccccgactcttatttacctgggccacgtgctgcatatcgtgcgcatggaggagaagaagaaggaaagagaagaggaggagcagttaaagcgggagtcccctagccctaaggagccccctcaggacaaccctagcagccgcgatgaccgaggccgagtcaggatggctggggcactcctgcgcacctacgtctttaacataatctttaagaccttatttgaggtcggcttcattgccggtcagtactttctgtatggcttcgaactcaagcccctctaccggtgcgacaggtggccttgcccaaacaccgtagattgttttatctctaggcctacagaaaagactatctttatcatctttatgctggccgtggcttgcgcctcactcctgttgaacatgctggagatctaccatttgggctggaaaaaacttaagcagggcgtgacctcacggcttggaccagacgcctctgaggctccattgggaaccgccgatccccctcctctccctcctagttcccgaccaccggcagtggcaattggttttcccccatactacgcccacacagcagcgccactgggacaagccagagcggttggctatccaggagctcctcctcccgctgccgacttcaagctgctggcccttacggaagctcggggtaaaggccaatcagccaaactatataacggccaccatcacctgctgatgacggagcagaattgggccaatcaggcagccgagagacagccaccagcactgaaagcataccctgctgcaagtacccctgccgcaccttcccccgtggggagcagctccccacccctggcacacgaggcagaggctggcgcagccccactgctgttagatggatctggctcgtcgttggaggggagcgcgttagccggaactccagaagaagaagagcaggcagttactacagctgctcagatgcaccagcccccactaccactaggagatccgggtagagctagcaaggcatcccgggcttcttccggcagagcacggcctgaagaccttgcgatttag

SEQ ID NO: 224330 - DNA, 1002 bp, Artificial Sequence
  Description of Artificial Sequence: Synthetic coding sequence
atgggggattggggctttctagaaaagctgctcgaccaggtacaggagcactctacggtggtgggcaagatctggttgactgttttatttatcttccgaattctaatcctgggacttgctggtgagtccgtgtggggggatgaacagtccgactttgagtgtaacacagcccaacctggctgcaccaacgtctgttatgaccaggcctttccgatcagtcacattcggtattgggtattgcagtttttattcgtttccacccccacgttggtctaccttggacatgtcatttacctgtcaaggcgagaggaacgcctaaggcagaaggagggcgaactaagggccctgcctgccaaggatccccaggtcgagcgggcacttgccgcagtagaacggcagatggcaaagatcagcgtggccgaagacgggagacttcgaattaggggggctctgatgggtacatatgtcgcttctgtcttgtgtaagtccgtattagaggccggtttcctgtacggtcagtggcgtctgtatggatggaccatggaaccagtgtttgtttgtcagcgtgccccatgtccctatctggtcgattgtttcgtctctaggccaaccgaaaagacaatcttcatcattttcatgctggtggtcggactcatttcattggtgctgaatttgttagagctggttcatctgctgtgtcgctgtttgtctcggggaatgcgcgcacgccagggccaggacgcgccaccaacccaggggacctctagcgacccctacacagatcaagtattcttttatctgcctgtggggcagggtccatcgagccctccttgccccacgtacaatggtttgtcttcctccgagcagaactgggcgaacctgacaacagaggaaagactagcttcttcgcgacctccgctcttcctagatcctccaccccagaacgggcagaagcccccatcacggccttcctcatctgcctccaaaaaacagtatgtgtag

SEQ ID NO: 224331 - DNA, 879 bp, Artificial Sequence
  Description of Artificial Sequence: Synthetic coding sequence
atgggagattggggttttctcgagaagctcctggaccaggtgcaggagcacagcaccgtggttgggaagatctggctcacagtgctgttcatctttagaatcctgattcttggcttggccggagaaagcgtatggggcgatgaacagtccgacttcgagtgcaatactgcgcagccaggctgtaccaatgtctgctatgaccaggcctttcctatctcccatatccgatactgggtcctgcagttcttgtttgttagtacacccaccttagtgtatttgggacacgtgatatacctgtctagaagggaagagcgtctccggcagaaagagggagagctcagggcactgcccgcaaaggacccgcaggtggagagggccctggcagcagtcgagcgacagatggccaagatcagcgtggctgaagacggtaggctcaggatcagaggtgccctcatgggcacttatgtggctagcgtcttatgcaaaagcgttttggaggcagggtttctgtatggtcagtggcgcctgtacggatggacaatggagcccgtgtttgtctgtcagagagccccatgtccatacctggtggattgcttcgtctcaagaccaacggagaagacaatcttcattattttcatgctcgtggtgggtctgatatcgttggtgctcaacctgttggagttagtgcacctcctgtgccggtgtttgtcgcgagggatgcgggctaggcaagggcaggatgccccaccaactcagggcacctcgtctgatccttatacggaccaggtgttcttctatctgcccgttggtcaaggcccttcatccccaccatgtccgacttacaatgggttatcttcaagtgagcagaactgggcatag

SEQ ID NO: 224332 - DNA, 882 bp, Artificial Sequence
  Description of Artificial Sequence: Synthetic coding sequence
atgggagattggggcttcctggagaagttactggaccaggtccaggagcactctacagttgtaggcaagatttggctgaccgtgctgtttatattccgaatacttatccttggcctagccggtgagagcgtgtggggggatgagcagtccgactttgaatgtaataccgctcaacccggatgcacgaatgtatgttacgaccaggcttttccaatttctcacataaggtattgggttcttcagttcctatttgtatctacgcctaccctggtgtatttgggccatgtgatatacttgtcccgccgagaagaacgattgcgccaaaaagagggggaactgcgcgcattgccggctaaggatccgcaggtggagagagccctcgcagctgtagagcgacagatggctaaaatcagtgtcgccgaggatggccgtctccgtatacgtggcgcactgatgggaacctacgtggcatctgtcttgtgcaagagtgtcctggaagctggatttctgtacgggcagtggcgactctacgggtggacaatggagcccgtatttgtgtgccagcgagccccatgcccttaccttgtagattgttttgtcagcaggccgactgagaaaaccattttcatcatctttatgttggtggtgggccttatctccctcgtgttgaacctgctggagttagtgcacttgttgtgtaggtgcctctctcgcggtatgcgagctcggcaaggccaggatgcacctcccacgcagggcaccccacagacattgacccgcactcgtagcagttccaccagcccatgggcaaggggaccccacccccatcacgccccacccactatgggttctcatccggtgagccgcaccggaccaacatag

SEQ ID NO: 224333 - DNA, 1077 bp, Artificial Sequence
  Description of Artificial Sequence: Synthetic coding sequence
atgggagactggtcgtttctgggtaatttcttggaggaggtccacaaacactccacagttgtgggcaaggtgtggttaacggtgctcttcattttccggatgctggtgctgggaacggccgcagaatctagctggggcgatgaacaggcggatttccgttgtgataccattcagccgggttgtcaaaatgtgtgttacgaccaggccttccccatatcccatatcagatactgggtcctccagatcatctttgtctctactccctccttggtctacatggggcatgcaatgcacacagtgaggatgcaggagaagcggaagcttagggaagccgagcgcgctaaagaagtgcgcggaagcggcagttatgaatatccagtggctgagaaagctgagctgagttgctgggaagagggcaacggaagaatagctctgcaaggcactctgttgaatacatacgtgtgtagtattttaataaggaccaccatggaggtagggttcattgtgggccagtattttatatatggcatattcctgactacactccacgtctgcaggagatcaccgtgcccacaccctgtgaattgctatgtctctcgtcctacagagaaaaatgtgttcattgttttcatgctcgccgtggctgcattgtcacttctgctcagccttgctgaattgtatcaccttggatggaagaaaatcagacagcgcttcgtgaaaccccgtcagcacatggccaaatgccaacttagcggcccaagtgtcgggattgtgcagtcctgcaccccccctcccgattttaaccagtgcttggagaatggacctggaggcaagttctttaatcccttcagcaataacatggcatcacaacagaacactgacaatttggtgacggagcaggtgcgcggtcaggaacagactcctggagaagggtttatccaggtgcggtacggccaaaaacctgaagtgccaaatggagtaagcccaggccatcggctgccacatgggtaccacagcgacaaaaggagactgagcaaggcttcctcaaaagcccgttccgatgatctctctgtttag

SEQ ID NO: 224334 - DNA, 1077 bp, Artificial Sequence
  Description of Artificial Sequence: Synthetic coding sequence
atgggcgattggtccttcctgggcaacttcctggaggaggtgcacaaacacagcacagtggtagggaaggtttggctgaccgtcctctttattttcaggatgctcgtgctgggaacagcggcagaatcctcttggggggatgaacaagccgacttcaggtgcgatacaatccaacccggatgccagaatgtctgctacgaccaggcttttcctatcagccatattcgctactgggtgctgcagatcattttcgtctcaacaccctctctggtttacatgggccatgcaatgcatacagtgaggatgcaagaaaagaggaagctaagagaggcggagcgggcaaaagaggtccgcggtagtggcagctacgagtatcctgtggctgaaaaagcagagctatcttgctgggaagagggtaacggtcggattgctttgcaaggaaccctcctcaacacttatgtctgctctattcttattcgaacgaccatggaagtgggttttatcgtcggacaatattttatctacggtattttccttactaccttacatgtatgcagaaggtccccctgcccacacccggtcaattgctatgtgagccggcctaccgaaaagaacgtctttatagtcttcatgctggccgtagccgctttaagcttactgctgtcgttggccgagctctatcatctcggctggaaaaaaatacgccagaggtttgttaagcccaggcagcacatggctaaatgtcaactctctggtcccagcgtgggaatcgtccaaagttgtacgccgcctcctgatttcaatcagtgtcttgaaaacggtccaggtggcaagttcttcaaccccttctccaacaacatggctagccagcagaataccgacaatctcgtcacggaacaagtgagaggccaggagcagaccccgggtgagggcttcatccaggtgagatacgggcaaaagccagaggtccctaatggtgtctcacctggacaccgcctgccgcacggatatcattctgataagagaagactgtcgaaagcgtcgagtaaagccagaagtgatgacctctccgtctag

SEQ ID NO: 224335 - DNA, 759 bp, Artificial Sequence
  Description of Artificial Sequence: Synthetic coding sequence
atgggtgactggtctttcctcggcaattttttggaagaggtgcataaacattccaccgtggtcgggaaggtatggctcactgtcttgttcatatttaggatgctggtgctgggtaccgcggctgagtctagctggggagatgagcaggcagatttccgatgcgacacaattcagccagggtgtcaaaatgtatgctatgatcaagcctttcccatatcccacattaggtactgggtgctccagatcattttcgttagcaccccaagcctagtctacatgggacacgccatgcatactgtccgcatgcaggaaaagagaaagctccgcgaagcggaacgagccaaagaagtgagaggaagtggatcttacgaatacccagtagcagagaaggctgaactgagctgctgggaggagggaaatgggagaattgccctgcaagggacactgctcaatacttatgtctgttcgatcctgattcggaccactatggaggtcgggttcattgtgggtcagtactttatctacggaatttttctgactaccctgcacgtatgtaggcgctctccctgccctcaccctgtgaattgttatgtatcccgcccaacggagaagaacgtgtttatagtctttatgctcgcagtcgcagccctgtcactcctgttgtccctggctgagctctaccacctaggttggaagaaaatccggcagagattcgttaagcctcgccaacatatggccaaatgccagttatcaggatag

SEQ ID NO: 224336 - DNA, 1302 bp, Artificial Sequence
  Description of Artificial Sequence: Synthetic coding sequence
atgggcgactggtcctttttaggcaacattctagaagaagtgaacgagcactctaccgtcattggacgcgtgtggttaactgtgctttttattttcaggatcctgattcttggaacagctgctgagtttgtgtggggcgatgaacagagcgatttcgtctgtaatacgcagcagcccggatgcgagaacgtctgttatgatgaggcatttccgattagccacataaggctgtgggtactgcagataatattcgtatcaacaccatcactgatgtatgtgggtcatgccgtgcattatgtgcgtatggaagagaagaggaaaagccgcgaggccgaagagctgggtcaacaggcaggtacaaatggcggacccgaccaaggttcagttaagaagagcagcggctccaagggaactaagaaattccggcttgaaggtaccctgctgagaacctacatctgccacatcatctttaagaccctgttcgaggttggtttcatagtaggacattattttctttatgggtttcgtattctgcccttgtacaggtgtagtagatggccatgtcctaacgtcgttgattgctttgtgtctcggcctacagagaagaccatcttcattcttttcatgctgagtgtggcctcagtgagtctgtttctgaacgtgatggagttgggccatctcggccttaaaggcatcagatccgctttgaaacggccagtggagcagccactcggcgagatcccagaaaagagcctgcattccattgcagtgtcgagcatccagaaggccaaaggctaccaattgctggaggaggaaaaaattgtaagccactacttccccctgacagaggttggcatggtggaaacgtctccactccctgcaaaaccgtttaaccagttcgaagaaaagatttcgaccgggcctttaggcgacctctcccggggataccaagagacattaccatcctatgcgcaggtaggggctcaagaggtggaaggtgagggcccaccagctgaggagggcgcagagcccgaagtgggggagaagaaggaagaggctgaacgattaaccaccgaagaacaagagaaggtggccgtacccgagggagagaaagtggaaacaccgggagttgacaaggaaggtgagaaagaggagccacagtccgagaaggttagtaagcaggggcttccggctgaaaagaccccgagtctgtgccccgagctgacgacagatgatgcacgcccactgtcacggctgtcaaaagcaagcagtcgggctaggtctgacgaccttactgtatag

SEQ ID NO: 224337 - DNA, 1302 bp, Artificial Sequence
  Description of Artificial Sequence: Synthetic coding sequence
atgggggactggtccttccttggcaacattttggaggaggtgaatgaacattcaactgtaatcggccgagtctggctcacagtcctattcatattccgtatcctcatcctgggcaccgctgcggagttcgtttggggtgacgagcagtccgactttgtgtgtaatacacagcaacccggttgcgaaaacgtgtgttacgatgaagcatttcctattagtcatattcgcctgtgggtcctgcagataatcttcgtcagcacaccttcactgatgtatgtcggccatgctgttcattatgttcgcatggaggagaagaggaagtcccgcgaggctgaagaactgggccagcaggctgggaccaacggcggtcctgaccagggttctgtcaaaaagtcctcaggatccaaagggacaaagaagtttaggttagagggcacattattgcggacttatatttgccatattatcttcaagaccctgttcgaggtcgggtttatagtgggtcactatttcttatacgggttccgcatactgcctctttataggtgctccaggtggccatgccctaacgtagtggattgctttgtgtcccgccctacagagaaaacaattttcatcctcttcatgctgtccgtcgcttccgtgtccctctttttgaacgtgatggagctggggcacttgggcctaaaagggatccgttcggctctcaagcgacctgtagaacagcctctcggagaaataccagaaaaatccctgcactcgatcgctgtgtcatcaatccagaaggctaagggatatcagctcttagaggaggaaaaaatcgtcagccactacttccccctcactgaagtcggaatggttgaaacttccccactccctgcaaagccctttaaccagttcgaggaaaaaattagcactggaccactcggcgatttatctcgagggtaccaggagacactgccgtcttacgctcaagtaggtgcccaggaggtggaaggggaagggccacctgcggaggagggtgctgagccggaggtgggcgaaaagaaagaggaagcggaacgcctgactacagaggaacaggaaaaggtcgctgttcccgaaggggaaaaagtcgagactccaggcgtggataaagagggagagaaagaggagccacagtctgaaaaggtctctaagcagggactgccagctgagaaaaccccttccctgtgcccagagctcactacagacgatgctaggcccctgtctcgcctgtctaaagcatctagcagagcccgatccgacgacttgaccgtctag

SEQ ID NO: 224338 - DNA, 1548 bp, Artificial Sequence
  Description of Artificial Sequence: Synthetic coding sequence
atgggggactggaacttgctcggtgacacccttgaggaggttcacatccacagtaccatgattggtaagatttggcttacgatcctgtttatcttccgaatgttggtgctaggcgtcgcagcggaggatgtatggaacgacgagcaaagcggctttatttgcaatacggaacagcccggatgccggaatgtgtgctatgatcaggccttcccgatctccctcattcgatactgggtgcttcaggtgatctttgtgagttctccaagcctggtttacatgggacacgctctgtacagacttcgggtgctagaagaagaaagacaacgaatgaaggcacagctgagagtggaacttgaggaagttgaatttgagatgcctcgggaccggcgtagattggagcaggagctgtgtcagctggagaaaagaaaactcaacaaggcaccactgcgcggaacactgttgtgtacatacgtgattcacatattcactagatccgtggtggaagttggatttatgatcggacaatatctcctgtatggctttcatttagaacctctgttcaagtgtcacgggcacccttgtcctaacataatagattgttttgtgtcccgacctaccgagaaaactatttttctgctttttatgcagtcaatcgcaacaatttctttgtttcttaatattctagagatttttcacctgggcttcaagaaaatcaagagaggcttatggggcaaatataagttaaagaaggagcacaacgagtttcacgcaaataaagccaagcagaatgtagccaaataccaatctacgtcagctaattcattgaagcgcctgccctccgctcctgactacaatttactcgtcgagaaacagacccacactgcagtatacccctccttaaacagctcctccgtgtttcagcccaacccggataaccactcagtgaacgatgagaagtgcatcctggacgagcaggagactgtactgagtaatgagatttcaactctctctaccagttgttctcatttccagcatataagctccaataataataaggatacccacaagatttttggcaaagaactgaacgggaatcagctgatggagaaacgcgagacagaagggaaagacagcaaacggaactattactctcgaggacatcgctctattccaggagtggccatcgatggcgagaataacatgaggcagtctccccagacagtcttctctttgccagccaactgcgattggaaacccagatggctcagagccacgtggggatcctcgacagagcacgagaatcggggttccccacctaaggggaatctcaagggtcagttccggaaagggactgtgaggaccctacctcccagccagggagactcccaatccctggacatccctaacacagccgatagtctggggggactcagcttcgaaccaggtctcgtgcgcacttgtaacaatcccgtgtgcccccctaaccatgtggtatctttaacgaataatctaattgggagaagggtgccgactgatctgcagatttag

SEQ ID NO: 224339 - DNA, 1548 bp, Artificial Sequence
  Description of Artificial Sequence: Synthetic coding sequence
atgggcgactggaatcttctcggggacaccttagaggaggtccacattcacagtaccatgataggaaagatttggctcacgatcctgttcatcttcagaatgcttgttctgggcgttgcggctgaagacgtttggaatgacgaacagtccggcttcatttgcaacaccgaacagccgggatgtcgcaatgtgtgctatgaccaggccttcccaataagcttgatccggtattgggtgctacaagttatcttcgttagtagcccttccctagtgtacatgggacacgcactatatcgactcagagtgttagaagaggagaggcagcgcatgaaagctcagttgagggtcgagctcgaggaggtggagtttgaaatgccccgtgatcggcgaagactggagcaggaactttgtcagctagagaagcggaagctaaacaaggcgcctctccggggaaccctgctgtgtacatacgtcattcacatatttactcgctcagtcgttgaggtgggcttcatgataggacaatacttattgtacgggttccacttggaacccctcttcaaatgccacgggcacccatgtccgaacatcatagattgttttgtctcgcgacctacagagaagacgattttcctgctgttcatgcagtcaattgcaactattagcttatttttgaatatcctcgaaattttccacctgggattcaaaaagatcaagcgaggtttgtgggggaagtataagctgaaaaaggagcataacgagttccacgccaacaaggctaagcagaatgtggctaaataccaaagcactagcgccaatagcctaaaaaggctcccctccgctccagactacaacctgctggtggaaaaacagacacacacagccgtttacccgagcttgaacagctcatccgtgtttcagcctaaccccgataaccattccgtgaacgacgagaagtgtatcctcgatgagcaggaaaccgtgctctcgaatgagataagcactttgtccacgagctgttcccactttcaacatatttcttccaataacaataaggacactcacaagatatttgggaaggagctgaatggtaaccaattgatggaaaaacgagaaaccgaaggcaaggactcaaaacggaattactactctcgcggacatcgctccatccctggcgtggccattgacggcgaaaataacatgaggcaatctccccagaccgtcttctcgcttcctgccaactgtgactggaaacccaggtggctgagggccacttgggggtccagcaccgaacacgaaaaccggggaagccccccaaagggaaatctcaaaggccagtttagaaagggcaccgtgcgcaccctccccccttctcagggggattcacaatctctggacatacctaatacggccgacagcctgggtggcctatctttcgagccaggactggtacggacatgcaacaatccggtctgtccgccaaatcacgtagtaagcctaacgaacaatctaatcgggagaagagtgccaactgacctccagatatag

SEQ ID NO: 224340 - DNA, 1545 bp, Artificial Sequence
  Description of Artificial Sequence: Synthetic coding sequence
atgggtgactggaatctactgggtgataccctcgaagaagttcacattcacagtaccatgatcggcaagatttggctgacaatactgtttatcttcagaatgctggtacttggtgtcgccgcagaggatgtttggaatgatgaacagtctggctttatttgcaataccgagcagcctggctgtagaaatgtgtgttacgaccaagccttcccaattagtcttatcagatactgggtgctgcaggttatttttgtcagctcacccagcctcgtctacatgggccacgctctgtatcgcctgcgggtactggaagaagaaaggcagaggatgaaagcgcagttgcgcgttgaactcgaagaagtggaatttgaaatgcctagggaccggcgacgcctggagcaggagttatgtcagctggaaaagcgcaaactcaataaagctccactgagaggcaccctactgtgcacatatgtgattcatatttttacccgcagcgtggtggaggtgggctttatgatcggacaatacctcctgtacggatttcatctagaacccttgtttaagtgccacgggcatccctgtccaaacataattgactgtttcgtgtcccggccaactgaaaagacaatttttctcctcttcatgcaatccatcgctactatttcactttttctcaacatcctcgaaatcttccatctgggattcaaaaagatcaaacgagggctgtgggggaagtacaaactgaagaaggagcataatgagttccacgccaataaggccaagcagaatgtggccaaatatcaatccacctccgcaaattctctgaagcgacttcccagtgctccggactataacctgctagtcgaaaagcagacacacacggctgtatatccgtcccttaattccagctctgtttttcaacccaatcctgataatcattcagtgaacgacgagaaatgtatcctggacgaacaggagaccgtgctgagcaatgagatttcgaccctctctacaagctgcagccatttccagcatatttcctccaataacaataaagacacacataagatctttgggaaagaactgaacgggaatcagctcatggagaaaagagaaacagaaggcaaagactccaagaggaactactacagtcgcggacacagatctatcccgggagtggcaatagatggtgaaaataatatgagacagtccccccaaacagttttttccctccccgctaactgtgattggaagccacgttggctgcgggctacttggggatctagtaccgagcacgagaatcgcggaagtccacccaaggtcccagggagcaaggctaccgctagcagcttacttttaattttacagaggccgacatcctcccagcctcgcctgaaggagacacccaaaattaaggctgaggcaaagatctacgattcgaagcatccaccacggctgttgcagagtacggtttctactttcagcggccgagaaccgagatctcctgcacccatgggacaccactcctttcggggaccgagatag

SEQ ID NO: 224341 - DNA, 852 bp, Artificial Sequence
  Description of Artificial Sequence: Synthetic coding sequence
atgaactggacaggtctttatacccttctctcaggcgtgaaccggcacagcacagccatcggcagagtgtggctgagtgtgatcttcatctttcgaatcatggtactagtggttgcggctgagtccgtgtggggtgatgaaaaaagttcatttatttgcaacactctccagcccggatgcaactctgtgtgttacgatcagttcttcccaattagccatgtgcggctatggagcctccagctgatcctcgtcagtacccctgccttgctggttgcaatgcacgtcgctcaccagcagcacattgaaaagaagatgctgcgtctggaaggccacggcgatccattgcacttggaggaagtaaaaagacataaggtccacatcagcggtactttatggtggacttatgttatctcggtcgtgttccggcttttattcgaagcggtgttcatgtacgtattctatctgctgtatcctgggtatgcaatggtgaggctcgtgaaatgtgatgtttacccatgtccaaatacagtggattgtttcgtatctagaccgactgagaaaaccgtttttacagtattcatgctagcagcttccggtatatgtattatcctgaacgttgccgaggtggtctacctgatcatccgggcatgcgcgagaagggcccagagacgttcaaacccaccatcaaggaaggggagtggctttggacacagactcagcccagagtacaagcagaacgaaattaataaactcctgtcggagcaggatggctcgctcaaggacatcctgcgtcgctcaccgggaaccggcgctggactggccgagaagagcgaccgatgttctgcctgctag

SEQ ID NO: 224342 - DNA, 852 bp, Artificial Sequence
  Description of Artificial Sequence: Synthetic coding sequence
atgaattggacggggctttacactctcctctccggggtgaacagacattccactgccatcggtcgggtgtggctgtcagtgatcttcatctttagaattatggtccttgtcgtggcagctgaatccgtttggggagatgagaaatctagcttcatttgcaacaccctgcaacctgggtgcaatagtgtgtgctacgaccagttctttcccatttctcacgtgcgtttgtggagcctgcaattaatccttgtgagcacaccggcattgctcgttgccatgcatgtggcccaccaacaacatatcgagaagaagatgctgaggctagagggacatggtgatcctttgcatctggaggaggtgaagcggcacaaagtgcacatcagtggtaccctgtggtggacctacgtaatcagcgtcgtctttagactcctttttgaggctgtcttcatgtatgtcttttacctcctgtatcccggatatgccatggtgcgtctcgtcaaatgcgacgtctatccatgccccaacactgttgactgctttgtcagtcgcccaactgaaaaaactgtgtttacggtgttcatgctggccgcttcaggcatctgcattatactcaacgttgcggaggtggtgtacctgataatcagggcctgtgccagacgtgcccagcggagatcaaaccccccttcaagaaaaggttcggggttcggacatcgcctatcccccgaatacaagcagaatgaaatcaataagttgctaagcgagcaggacggcagtctgaaggacattctgcgtaggtctccaggaaccggcgctgggctggccgaaaaatccgataggtgctcggcatgttag

SEQ ID NO: 224343 - DNA, 852 bp, Artificial Sequence
  Description of Artificial Sequence: Synthetic coding sequence
atgaattggaccggtctgtatacccttctgagcggagtgaacagacacagcactgctattgggcgagtctggttgtcagtgatcttcatttttcggataatggttctggttgtggcagctgaatccgtgtggggtgatgagaaatcttcgtttatctgtaacaccttacagcccggttgtaacagcgtgtgttacgaccagttctttccgatttcacacgtgcgattgtggagcctgcagctgatactggttagcacgcccgcattgctggtagcaatgcacgtagcccatcaacaacatatagagaagaagatgttgcggctcgaggggcatggggaccctcttcacctggaagaagttaaacgccataaggtacatatatcaggcacgttgtggtggacatatgtgatttcggtggtgtttaggctgctgttcgaggccgtattcatgtatgtattctatctcctgtatcccggatacgccatggtgcgcctggtcaaatgtgatgtgtatccctgtcctaacaccgtcgactgctttgtgtctagaccgaccgagaagacagtgtttacagtgttcatgctggcggcttcgggcatatgtataatactgaatgtcgctgaagtcgtgtacctcatcattagagcctgtgccagaagagcccaaagacgaagcaaccctccgtctcgcaagggcagcggtttcggccacagactgtctccggaatataagcaaaatgaaataaataaactcctgtccgagcaagatggctcattgaaggatattctacggagaagcccagggaccggggctggcctcgctgagaaatcagatcgatgtagcgcttgttag

SEQ ID NO: 224344 - DNA, 255 bp, Artificial Sequence
  Description of Artificial Sequence: Synthetic coding sequence
atgaactggaccggtctttacactttgttgtctggggtcaaccggcactctactgccatcggtagggtctggctgagcgtgatatttatcttccggatcatggtgttggtggttgccgctgaaagtgtctggggcgatgaaaaatccagcttcatctgtaacaccttacagcccggatgtaatagcgtctgttatgatcagttcttccccattagccacgtaagattgtggagcctacagctgattctggtgtag

SEQ ID NO: 224345 - DNA, 681 bp, Artificial Sequence
  Description of Artificial Sequence: Synthetic coding sequence
atggactgggggaccctgcagaccatcctcgggggagtcaacaaacactccactagcattgggaagatctggctgactgttctcttcatcttccggattatgatcctggtagtcgccgcaaaagaagtgtggggcgacgagcaggcagatttcgtgtgtaacacattgcaacccggttgcaaaaatgtgtgttacgatcactactttcccatatcccatatcaggctgtgggctctgcaactgattttcgtgagcacgccagccctgttggtggccatgcacgtggcctaccgaagacacgagaagaaaaggaaattcatcaagggagagattaagtcagagtttaaggatatcgaagaaatcaagacccagaaggttcgaattgaaggctccctgtggtggacctacacatcctcaatcttctttagagtcatcttcgaagctgcttttatgtacgtgttctatgttatgtacgacgggtttagtatgcagcggcttgtgaaatgcaacgcttggccctgtcccaacacagtggattgttttgttagccgccctacagagaagaccgtgttcactgtgtttatgatcgctgtctcggggatttgcattcttctgaatgtaaccgagctctgttacctccttattcgctactgctccggtaaatccaagaaaccagtctag

SEQ ID NO: 224346 - DNA, 681 bp, Artificial Sequence
  Description of Artificial Sequence: Synthetic coding sequence
atggactggggaaccctccagaccatccttggcggagttaacaagcactctacctctattgggaagatctggctgactgtgctcttcatcttcagaataatgatcctggtggtggcagccaaggaggtgtggggcgacgagcaggcagacttcgtttgtaacacattacagccaggatgcaaaaacgtgtgctacgaccattacttccccataagccatatccggctatgggctcttcaactgatattcgtaagcacccctgctcttctcgtggccatgcacgttgcttaccggcgacatgaaaaaaagagaaagtttataaaaggggagataaaatctgagttcaaggatattgaggagataaaaacgcaaaaagtgcggatcgagggaagtctgtggtggacatacacctcaagtattttcttcagggtgatttttgaggcggcttttatgtatgtgttctacgtaatgtatgacggattttcaatgcagcgacttgtgaaatgcaacgcctggccatgccctaacacggtggattgttttgtgagccgcccaacagaaaaaactgtgttcactgtgtttatgattgccgtgtctggcatctgtatactgctcaacgttactgaactctgttaccttcttataaggtactgttcaggcaagagcaaaaagcccgtgtag

SEQ ID NO: 224347 - DNA, 813 bp, Artificial Sequence
  Description of Artificial Sequence: Synthetic coding sequence
atggattggaagactctgcaggcgttgctgtccggagtgaacaagtatagcacagcgttcggcaggatttggttaagcgtcgtgtttgtgtttcgcgtcctagtgtatgtagtggcagccgagcgggtgtggggggacgaacaaaaagattttgattgcaatacaaaacaacctggctgcactaacgtctgttatgacaactacttcccaattagtaacattaggctctgggctctgcaactcatttttgtgacttgtccaagcctactggtgatcctccacgtggcctaccgggaggagcgtgagcgccgtcataggcaaaagcatggggatcagtgcgcaaagctttacgacaatgccggaaaaaaacatggcggtctttggtggacttatctgttttccctcatctttaaactgattatcgagttcttattcctataccttctgcacactttgtggcatggatttaacatgcccaggttggtgcagtgtgcaaatgtggctccttgccctaatattgtcgactgttatattgcacgtcctacagaaaagaagattttcacatatttcatggtgggggcatccgccgtgtgtatcgtgctgaccatatgcgagctttgctatctgatttgtcatcgcgtcctgaggggcctgcacaaggacaaacctcgaggtgggtgctcaccctccagctccgcctctcgcgcttcaacatgcagatgccaccacaagctggtggaagctggcgaggtcgatcccgatccgggaaacaacaaattgcaggcgagcgcccctaacttgacccctatttag

SEQ ID NO: 224348 - DNA, 813 bp, Artificial Sequence
  Description of Artificial Sequence: Synthetic coding sequence
atggactggaaaactttgcaggctttgttatccggtgtgaataagtactctacggcctttggccgtatatggctgtccgtagtgtttgtctttagggtcttggtgtatgtggtcgccgcagagcgtgtttggggcgacgagcagaaggatttcgactgcaatacgaagcagcccggatgcacgaacgtgtgctatgataattacttcccaatcagtaatatccgactgtgggccctgcaacttatctttgtgacttgtccctccctgttagtgatccttcatgtggcataccgggaggagcgggaacgcaggcacagacaaaagcacggcgaccagtgcgcaaagctctatgataacgcaggcaaaaagcacgggggactctggtggacatacctgtttagtttgattttcaagctgatcatagagttcttgttcctttatttgttgcacactttgtggcatgggttcaacatgccgagacttgtgcaatgcgccaatgtggccccttgtcctaatatagtggattgctacattgctaggcccaccgagaaaaaaatcttcacctattttatggtgggtgcgtccgccgtgtgcatcgtgctgaccatttgcgagctgtgctatctgatatgccatcgagtgctgcgcggtctgcataaggacaagccaagaggagggtgctccccaagcagtagcgcgagtcgcgcttctacctgccgctgccatcacaaactcgtggaggccggagaagtcgacccggacccaggcaacaacaagctgcaggctagcgccccaaatctcacccccatttag

SEQ ID NO: 224349 - DNA, 765 bp, Artificial Sequence
  Description of Artificial Sequence: Synthetic coding sequence
atggactggaaaacgctgcaggcactcctgagcggcgtgaataagtacagcactgccttcggcaggatttggctctccgttgttttcgtattccgggtcttggtgtacgtggtggccgctgagagggtctggggagacgaacagaaagatttcgattgtaacacaaagcagccgggttgtacaaatgtctgctatgataattacttcccaatctccaacattcgattatgggcattgcaactgatatttgttacatgtccttcgttactggtgattctccacgttgcctatcgcgaagagcgcgagcgcagacatcggcaaaagcacggggaccagtgcgctaaactgtatgacaatgccggtaagaagcatggtggtttgtggtggacctacctgttacacacgctgtggcatgggttcaatatgcccaggctggtgcaatgcgctaacgtggccccatgtcctaatatcgttgactgctacatagcacgcccaacggaaaagaagatctttacttatttcatggtgggcgctagtgccgtctgtatcgttcttactatttgtgaactgtgttacctgatttgccatcgagtcctccggggactccataaagataagcccaggggcggatgctccccctcctctagcgcgtctcgtgcgagtacgtgccgctgccatcataagcttgtggaagccggagaggtggatcccgaccctggtaacaataagctgcaggccagtgccccaaacctgacccctatatag

SEQ ID NO: 224350 - DNA, 801 bp, Artificial Sequence
  Description of Artificial Sequence: Synthetic coding sequence
atgaactgggcctttcttcaaggactactctccggcgtgaacaaatatagtaccgttctctcaagaatatggttgagcgtggtgttcatatttagagttctggtttatgtagtcgcagctgaggaggtttgggatgatgagcagaaagacttcgtgtgcaatactaaacagccaggatgtcctaacgtttgctatgacgagtttttcccggtttcacacgtgaggctgtgggcattgcagcttattttggtgacatgtccatcgctcctggtcgtgatgcatgtggcatatcgcgaggagcgagagcgcaaacatcatttaaaacatggccctaacgcgccatccttgtacgataatctcagcaaaaaacgtggcggtctttggtggacgtacctcctgtccctgattttcaaagccgctgtagacgccggtttcctgtatatttttcaccggctgtataaagactacgacatgcctagagtcgtggcctgcagtgtggagccctgtccccatactgtagactgttatattagccgtcccacagaaaagaaagttttcacatatttcatggtcacaaccgcagccatttgcatcctgctgaacctttccgaggtcttctatttagttggcaagcggtgcatggagatcttcggtccgcgacacaggcgacctcggtgccgcgagtgtctgcccgatacctgcccgccatacgtgctgtcgcaggggggacatccggaggacggaaacagtgtgttgatgaaggcaggctctgcccctgttgatgccggaggatatccttag

SEQ ID NO: 224351 - DNA, 822 bp, Artificial Sequence
  Description of Artificial Sequence: Synthetic coding sequence
atgaattggtcaatcttcgaggggctgctttcaggggttaacaaatattccacggccttcgggcgaatatggctgagtctcgttttcattttccgagttctggtttatctcgtcaccgctgagcgagtgtggtcagatgatcacaaagattttgattgcaacacgaggcaacctgggtgctcaaatgtctgcttcgatgagttctttccagtgagccacgtgaggctctgggctctccagctaatcctggttacatgcccgtctctgctagtcgtgatgcacgtggcataccgcgaagtacaagagaagcgacaccgggaagcccatggagagaactccgggcgtctgtacctgaaccctggaaagaaacgcggtggactgtggtggacttatgtctgctccctggtgttcaaagcatcagtggacatcgcctttttatacgtttttcattccttttaccctaaatacattttacctccggtcgtgaaatgccacgccgatccatgtccaaatatagttgactgttttatctctaagccatccgagaaaaatatcttcacactattcatggtcgccacagctgcaatctgtattctattaaacctggtggagttgatatatctagtaagcaagaggtgccacgaatgtctcgccgcacgcaaggctcaggcgatgtgcaccggacaccatccccacggcacaacttcttcttgcaagcaagatgacctcctgagtggcgatttgatttttttgggcagtgatagtcacccgccacttttaccagacaggccaagggaccacgtaaagaagactattctttag

SEQ ID NO: 224352 - DNA, 786 bp, Artificial Sequence
  Description of Artificial Sequence: Synthetic coding sequence
atggattggggaacgctgcataccttcatcgggggtgtgaataaacatagcacatcaatcggtaaggtttggattacagtcatatttatttttcgcgttatgattctggtcgttgccgctcaggaagtgtggggggatgaacaggaggatttcgtgtgcaatactcttcagccaggctgcaaaaatgtgtgctacgaccactttttccccgtgagtcatatccgactttgggccctgcagctgatcttcgtctccacacctgctcttttggtggctatgcacgtcgcatactatcgccatgagaccacacggaaattccgaaggggagaaaagagaaatgatttcaaagatatcgaggacatcaagaaacagaaggttcgcattgaggggtctctgtggtggacgtatacgtcttccatttttttcaggatcatttttgaggccgctttcatgtacgtattttacttcctgtacaacggctatcatctgccctgggtactcaaatgtggtatcgatccttgtccaaatctggtcgactgcttcatctctagaccaactgaaaaaactgtgttcacaatcttcatgatcagcgccagcgtaatctgtatgctgttgaatgtggccgaactgtgttatctgttgctgaaggtttgtttcagacgcagtaaaagggcccagactcaaaaaaaccaccctaaccatgccctgaaggagagcaagcaaaacgaaatgaatgaactcattagcgactcaggacagaatgctatcaccggattccccagctag

SEQ ID NO: 224353 - DNA, 786 bp, Artificial Sequence
  Description of Artificial Sequence: Synthetic coding sequence
atggattggggaaccttgcacacattcatcggaggggtgaacaagcatagtacgtctataggtaaggtttggattaccgtgatcttcattttccgcgtaatgatcctcgttgtcgccgcacaggaggtgtggggcgacgaacaggaggatttcgtgtgtaacacattacagcccggatgcaagaacgtctgctatgaccactttttccctgtttcgcacataagactgtgggcgctccagttgatcttcgtgagcactcctgcactgctcgtggccatgcacgtggcgtactaccgtcatgagacgacaaggaagttcaggagaggcgaaaagaggaatgacttcaaagacatcgaagacatcaaaaagcagaaagtgagaatcgagggttcgctgtggtggacttacacaagctcaatttttttcagaattatctttgaggctgctttcatgtacgtattctatttcctgtacaatggctaccacctcccttgggtgttgaaatgtggtattgatccatgtccaaacctggtggactgcttcattagtcgtcccaccgaaaagactgtttttacaatttttatgatctccgcatctgtgatttgcatgctgctgaatgtggccgagttgtgctatttattgctcaaagtgtgttttaggaggagcaaacgcgcacagacacaaaaaaaccatccgaatcatgctttgaaggaatccaaacagaatgagatgaacgaattaatttctgattcaggccagaacgctatcactggattcccatcatag

SEQ ID NO: 224354 - DNA, 786 bp, Artificial Sequence
  Description of Artificial Sequence: Synthetic coding sequence
atggattgggggaccctgcacacctttatcgggggagtgaataaacatagtactagcatcggaaaggtgtggatcaccgtcatcttcatttttcgggttatgattctggtcgttgcagctcaagaagtatggggcgatgaacaggaggattttgtgtgtaatacgctgcagcccggttgtaagaacgtgtgctatgaccactttttccccgtttcacacatccggttgtgggctctgcagctgatctttgtctccacgcccgctctgttagttgccatgcacgtggcttactatcggcacgagaccacgcgcaaattccgtcgaggggagaaaaggaatgatttcaaggatattgaggacattaagaaacagaaagtgcggatcgagggatccctgtggtggacctacacttccagcatctttttcagaattatttttgaagcagcattcatgtacgtgttctattttctgtacaacggatatcatctcccctgggtgctcaaatgcgggatcgatccctgcccgaatctggtggactgtttcatcagccgtccaactgagaaaaccgtgttcaccatcttcatgattagcgcctcggtgatctgtatgctactgaacgtagcagagctgtgttatctgttgttaaaggtttgctttcggcgatctaaacgagctcagacccagaagaatcatcccaaccacgctctgaaagaatctaaacaaaatgaaatgaacgaactgataagtgactccggccagaacgctattacgggattcccttcgtag

SEQ ID NO: 224355 - DNA, 786 bp, Artificial Sequence
  Description of Artificial Sequence: Synthetic coding sequence
atggattgggggacactccatacctttataggcggtgtcaataaacacagtactagcatcggtaaggtctggattaccgtgatttttattttcagggttatgattttagtggtcgctgcccaagaagtctggggcgacgagcaagaagattttgtttgcaacaccctccagccaggctgtaagaacgtgtgctacgaccacttcttcccagttagccacatccggctctgggcacttcagctgatatttgtgtctactccggctctgttggttgcaatgcacgtcgcctattacagacacgagactactcgcaagttccggagaggcgagaagaggaacgatttcaaggacattgaggacatcaagaagcagaaggtccggattgagggatccctgtggtggacgtatacgtcctctatcttctttcggatcattttcgaggctgcgttcatgtacgtgttctattttctgtataatggctaccacctcccctgggtgctgaagtgcggtatcgatccttgtcctaatctggtggactgctttataagccggcctacggagaagaccgtctttacaatattcatgatctctgcttccgtaatatgcatgctgcttaatgtggcagagctctgctacttactgcttaaagtctgttttaggcgatctaaaagagcccagacccaaaagaaccacccaaatcatgcactgaaggagtcgaagcagaacgaaatgaatgagctgatcagcgattctggccagaacgcaattacgggatttccttcttag

SEQ ID NO: 224356 - DNA, 672 bp, Artificial Sequence
  Description of Artificial Sequence: Synthetic coding sequence
atgtcctggatgttcctgagagatctgttgtcgggggttaacaagtactcaacaggcaccggttggatctggctggccgtggtgttcgtgttccgattgttagtatatatggtcgcagcagaacacgtgtggaaagatgaacagaaagagttcgagtgtaactcacgacaaccgggttgcaaaaatgtctgtttcgacgatttttttcctatctcccaggtcaggctttgggccctacagctaataatggtttctaccccaagcctgctagtcgtgctacacgtggcctatcacgaaggcagagagaagcgccatcgaaagaagctctatgtgagccctggaacaatggacggcggtctctggtatgcgtacttaatctccttgattgtcaagaccgggtttgagatcggcttcttggtgctcttctacaaactatatgatggtttctctgttccatacctcattaaatgcgacttaaagccctgtccgaataccgtagattgctttatatctaaacctacagaaaagacaatcttcatactgttccttgtgattacttcctgcctgtgcattgtactcaacttcattgagctcagcttcttagtcctgaaatgttttattaagtgctgtcttcaaaagtatttaaagaagcctcaggtgctgtctgtgtag

SEQ ID NO: 224357 - DNA, 492 bp, Artificial Sequence
  Description of Artificial Sequence: Synthetic coding sequence
atgtcctggatgttcctgagggatctgttatctggggtgaacaaatacagtacggggactgggtggatttggctggccgtggtatttgtgttcaggctcttggtgtatatggtggcagcagagcatgtttggaaggatgaacagaaggaatttgagtgtaattcaagacagcctggttgcaagaatgtttgcttcgatgactttttcccaatcagtcaggtgcgcttgtgggccctccagctgattatggtgtccacaccttcactgttggtcgtgctgcatgtggcgtaccatgaaggcagagaaaaaagacaccgcaaaaaactgtacgtctcaccaggtaccatggatggaggtctgtggtacgcttacctgatcagtctaattgtgaaaacaggtttcgagattggttttctggtgctcttctataagttatatgatggcttcagcgttccgtaccttatcaaatgtgatctgaaaccatgcccctag

SEQ ID NO: 224358 - DNA, 672 bp, Artificial Sequence
  Description of Artificial Sequence: Synthetic coding sequence
atgagctggatgttcctccgggaccttctcagcggcgtgaataagtatagcaccggtacaggatggatatggctagcagtggtgttcgtttttcgactcttggtgtacatggtggctgccgagcacgtgtggaaggatgaacagaaagagttcgaatgcaatagccgccagccaggctgtaagaacgtctgctttgacgatttctttccaatttcccaggtcaggctctgggctctccaacttatcatggtaagtacgccctcgcttctggtggtgctgcatgttgcctatcacgagggtagagagaagcgtcaccgcaagaaattgtacgtcagtccagggacaatggacggtggcctttggtatgcgtatctgatctcactcattgtcaagacagggtttgagatcggtttcttggtcttattctataagctgtatgatggattctctgttccttatttaattaaatgtgacctgaaaccctgccccaacaccgtggactgcttcatctcaaagcccaccgagaagacaatctttatccttttcctcgtgataacttcttgtctttgcatagtccttaacttcatagaactgtctttcctggtccttaagtgcttcataaagtgctgccttcagaaatatctaaaaaaacctcaagtgcttagtgtgtag

SEQ ID NO: 224359 - DNA, 966 bp, Artificial Sequence
  Description of Artificial Sequence: Synthetic coding sequence
atgggagaatggacaatcctcgaacgactccttgaggcggctgtccagcagcactctacgatgatcggaaggatcctactgactgtggttgtgatcttccgaatcctgatagtggctattgtgggggaaaccgtgtacgatgacgagcagactatgttcgtgtgcaataccctgcagccagggtgcaaccaggcatgttacgatcgggcttttccaatctcccacatccgatattgggtgtttcagatcatcatggtttgcacacctagtttgtgcttcattacctactctgtccaccagtcggctaagcagcgggagagacgttatagcaccgttttcctggccctggatcgagacccgcctgaaagcatcgggggaccagggggaacaggaggcggaggctccgggggaggcaaacgcgaggacaaaaaactccagaatgccatcgtcaatggcgtgctgcagaacaccgaaaataccagcaaggagactgaacccgactgcctggaagtgaaagagctgactcctcatccctctggcctcagaactgcatcaaagagtaaattacggcgtcaggaaggcattagcaggttctatattatccaagtagtgttccgcaacgctctggaaatcggattcctcgtcggccagtacttcttgtacgggttttcagtcccagggttgtatgaatgcaatcgatatccttgcatcaaggaagtagaatgctacgtcagtaggcctactgagaagactgtctttctggtctttatgtttgcggtatcggggatctgtgtcgtgttgaacctggctgagctgaaccacctaggttggcgaaagattaagctagccgttaggggtgctcaggccaaacgtaagtctatatacgaaattagaaacaaggatttgccacgggtgtcagttccgaacttcggacgtacccagtcgagcgatagcgcgtacgtgtag

SEQ ID NO: 224360 - DNA, 891 bp, Artificial Sequence
  Description of Artificial Sequence: Synthetic coding sequence
atgggggagtgggcttttctggggtcattacttgacgccgtgcagctccagtcaccgctggtcggccgactctggttggttgtaatgcttatttttcgcatactggttctggccactgttggcggtgcagtgtttgaagacgaacaggaagagtttgtatgtaataccctgcagccaggttgtcgacagacctgttacgacagagcgttcccagtgagccactatcgattctggctgtttcacatcctgctgctcagtgcccctccagtgctgttcgtcgtgtactccatgcaccgtgctggtaaggaggcaggaggtgccgaagctgcagctcaatgcgctcctggattgccagaggctcagtgtgcaccctgcgctctgcgcgcaagacgggcaaggaggtgttaccttttgtcagtcgcgctcaggcttctggcagaactgactttccttggcggacaggcgctgttgtatgggtttagggtggccccacacttcgcatgcgccggacctccttgtccacataccgttgattgctttgttagcaggccaactgaaaagacagtgtttgttctgttctactttgctgtaggacttctctctgcacttttgtccgtggcagaattgggtcacctgttatggaaggggagaccacgggctggggagcgggataataggtgcaacagagcacacgaagaggcgcaaaagcttttgccaccaccccctcctcccccacctatagttgtcacgtgggaggagaacagacacctacaaggagagggtagccctggctctccacacccgaagaccgagctggacgccccaaggtttcgcagggagtccacaagtccagcaggttggcactgttcactgccttttcacggtacctag

SEQ ID NO: 224361 - DNA, 1113 bp, Artificial Sequence
  Description of Artificial Sequence: Synthetic coding sequence
atggagggagttgacctcctcggattcctcattattactttgaattgtaacgtaaccatggtggggaaattgtggtttgttctgacaatgctcctgcggatgttggttatcgtacttgctggtagacccgtgtaccaggatgaacaggagagattcgtctgcaacacccttcagccgggttgcgccaacgtctgctacgacgtgtttagcccagtctctcacttacgtttttggctaatacaaggagtgtgcgtgctgctcccaagcgcggttttcagcgtctatgtacttcatagaggagcgactcttgccgcactgggcccacgaagatgtccggaccccagggagccggcttcgggacagcgacggtgcccaaggccattcggtgagaggggcggacttcaggtccccgacttctctgccggatacataatccacctcctcctacgtacactgcttgaggcagccttcggcgctttacactattttctcttcgggttcctggccccaaaaaaattcccctgtacacgacctccctgcacaggagtggtagactgctacgtgagcaggccaactgagaagagtctcttgatgctattcctctgggccgtgagcgctctttccttcctgcttgggctagcagatctcgtatgcagtctgcggcgacggatgcgcaggagacccggtcctcctacgtcaccaagtatacgtaaacagtctggagcatcagggcatgccgagggccgtcggactgatgaggaggggggtagggaggaagagggcgctcctgcaccgcctggcgctagggctgggggagagggagccggaagccctcggagaacgtcacgagtatcaggccacaccaagatcccggatgaggacgagtccgaggtgacaagctctgccagcgagaagctgggaaggcagcccagaggacggcctcacagagaggccgctcaagaccctagaggctcagggagtgaagaacagccctccgcagccccaagccgccttgccgctcctcctagctgtagctcacttcagcccccagatccaccagcaagtagttctggggcacctcatctgcgggcaaggaaatctgagtgggtgtag

SEQ ID NO: 224362 - DNA, 1191 bp, Artificial Sequence
  Description of Artificial Sequence: Synthetic coding sequence
atgtcttggtcttttctgacacggctccttgaggagattcacaatcacagtacattcgtaggcaagatatggttaacagtattaatcgtgttccgaattgtgctgactgcagtgggaggcgagtctatttattacgatgaacagagcaagtttgtctgcaacaccgagcagcccggatgcgagaacgtgtgctatgacgccttcgccccattgagtcacgtgcgtttctgggtattccagatcattctggtggccactcctagcgtgatgtatctgggctacgcaatacataaaatagctaagatggagcatggagaggcagataagaaggctgctcgcagcaaaccctacgccatgaggtggaagcagcaccgcgctctggaggagacagaagaggacaatgaagaagaccctatgatgtaccccgaaatggagttggagtcagacaaagagaataaggaacagtcccagcccaaaccaaaacacgacggacgaaggcggattagggaagacgggcttatgaagatctatgtgttgcagctcctagccagaacagtgtttgaagttggatttctcattggccagtatttcctatacggcttccaggtgcatcccttttatgtctgtagcagactgccatgcccccacaaaatcgattgcttcatctcacgaccaaccgagaagaccatatttctccttataatgtatggtgtcacgggcttatgtctgctgctaaacatttgggaaatgctgcacctgggattcggcaccatccgagactcattaaacagtaaacggagggagctggaggatccgggagcctataactatccgttcacgtggaacacccccagcgcacccccagggtataacatcgctgtaaagcccgatcagattcagtacactgagctaagcaacgcaaaaattgcgtacaaacagaataaagcaaacaccgcccaggaacagcaatacgggtctcatgaggagaatctgcctgctgaccttgaggctctccaacgagagattcgaatggcacaggaaagactcgatctcgctgtccaggcatactctcatcaaaacaatccacatggacccagggaaaaaaaagctaaagtcggttcaaaagcgggttctaacaagtctactgccagttccaagagtggcgacggtaaaactagcgtctggatctag

SEQ ID NO: 224363 - DNA, 1191 bp, Artificial Sequence
  Description of Artificial Sequence: Synthetic coding sequence
atgagttggagcttccttacccggctgctggaggaaatccacaaccattctaccttcgtcggtaagatttggctgacagtactcatcgtgtttcgaatcgttctaacagcagtgggcggtgagagcatatattatgacgagcaaagcaagtttgtgtgcaatacagagcagccaggctgcgagaatgtctgctatgacgcttttgcacccttgtcccacgtacggttctgggtgtttcagatcatactggtggcaacaccctccgtgatgtacctgggctatgcaattcacaagatagccaaaatggagcatggtgaggcggataagaaggctgccagaagcaagccttacgctatgaggtggaagcagcatcgggcattggaagagactgaagaggacaacgaggaggatcctatgatgtaccccgagatggagttagaaagtgacaaggagaacaaggagcaaagtcaacctaagcccaaacacgatggacgcaggcgaatccgggaagacggactcatgaaaatctatgtgctgcagctgctggcccgtacggtgtttgaggtcggcttcctgattggacagtacttcttgtatggtttccaggtgcacccattctatgtgtgctctcgcctgccctgccctcacaagatagactgctttatcagtagacccactgagaaaacaatcttcctcctgatcatgtatggagtgacaggcttgtgtctgctgctcaacatatgggaaatgctgcacctgggcttcggaacgatccgtgattctctgaactccaagaggcgcgagctcgaagatcctggtgcgtataactatccatttacctggaacactccaagtgcaccgcctggatataacatcgctgtcaaacctgaccaaatccagtatactgaactttcaaatgctaaaatcgcatataagcagaacaaggctaacactgcccaggagcaacagtacggatcccatgaggaaaacctcccagcagacctggaggctctgcagagggagatccggatggcccaggagcgcctcgatctggcggtccaggcctacagccaccaaaataacccccatggtccacgggagaaaaaagctaaggtggggtctaaagctggaagtaacaagtcaacagcatcatctaaatctggcgatggtaagactagtgtctggatttag

SEQ ID NO: 224364 - DNA, 1320 bp, Artificial Sequence
  Description of Artificial Sequence: Synthetic coding sequence
atgaccaacatgagctggtcttttctcacgcgtctgctcgaggagattcacaatcatagtacctttgttggaaaagtctggctgaccgttctagtcgtgtttagaattgtgctgaccgctgtcgggggagaggcgatatattccgatgagcaggcgaaatttacctgcaatacgaggcaacccggttgcgataacgtgtgttatgacgccttcgcacccttgagtcatgttcgtttctgggttttccagatcgtggttatcagcacaccctccgttatgtatctgggctacgcagtgcacagattggctcgggcttccgaacaggagcgcaggcgcgcattgaggagacgcccagggcctcgtcgggctccaagggcacacctaccaccgcctcacgccggatggcccgaacccgcagacctgggggaggaggaaccgatgctggggctgggagaagaggaggaagaggaggaaacaggcgcagccgagggcgcaggcgaggaggccgaagaggcaggggctgaagaggcgtgcactaaggcagttggagcagatggcaaggcggcaggaactccaggccctactggacagcacgacggtagacgcagaattcaaagggaggggttaatgcgggtctacgttgcccaactggttgctcgcgcagccttcgaggtagcgttccttgtgggccagtaccttctttacggttttgaggtgaggccattcttcccctgttctagacaaccctgcccgcacgtggtcgattgttttgtgagtcggccaactgaaaagacagtgttcctgctggtcatgtatgtagtttcctgtctctgtcttctgctgaacttatgcgagatggcccacttaggcctgggctccgcacaggatgccgtgcgcggtagaagagggcctccagcctcagctccggcacctgccccacgccctcccccatgcgcattcccagcagccgctgcaggcctagcatgccccccagattacagtctggtcgtgcgagccgcagagcgggctagggcacacgaccagaacctcgctaacctggccctgcaggcccttcgcgatggtgccgctgcaggagacagggaccgagattcgtctccatgcgtgggcctcccagccgcaagtcgaggcccacctagagccggtgctcccgcatcccgtacgggatcagctacaagtgctggtactgtgggcgagcaggggcgtcctggcacacatgagaggccaggtgcaaaacctcgggctggctcagaaaaaggtagtgctagcagtcgagacggaaagaccactgtgtggatttag

SEQ ID NO: 224365 - DNA, 840 bp, Artificial Sequence
  Description of Artificial Sequence: Synthetic coding sequence
atgtgcggccgattcctcagaaggctcctcgctgaggaatcacgacgtagcaccccggttggcaggctcctgctgcctgttctgttagggtttcggctggttctgctagctgcttcaggccctggcgtctatggggacgaacagtcagagttcgtctgccatacgcaacagcctggctgcaaagccgcatgttttgatgcattccatcccctgtcaccactccgtttttgggtctttcaggtgatcctggtagccgtaccttctgccctatatatggggttcacactgtatcacgtgatatggcactgggaactgtcgggaaagggaaaagaggaggagacattgattcaggggcgagaaggcaataccgatgtgcctggcgctggcagcctaaggctgctgtgggcatacgttgcccagctcggcgctcgcctggtgctggagggagcggcactgggacttcagtaccatctgtacggattccaaatgccttcgagctttgcgtgccgtcgcgaaccgtgtctgggatctatcacatgtaatctgagtaggccttctgaaaaaaccatctttctgaaaacaatgtttggcgtgagtggtttctgcttgctcttcacttttctggagctggttcttctggggctcgggaggtggtggcgcacctggaagcataagtcatcaagtagcaagtattttctaacgagcgagagcactaggcggcacaaaaaggcaacggattccctcccagtcgtggagacaaaggagcagtttcaggaagcggtgccaggcaggtctctggcccaggaaaagcagagacctgtcggcccacgggatgcatag

SEQ ID NO: 224366 - DNA, 1338 bp, Artificial Sequence
  Description of Artificial Sequence: Synthetic coding sequence
atgactatgtttgaaaatgtgacccgggcactggctaggcagttgaacccccgaggcgatcttacccccctcgattccctgatcgattttaaaagatttcatccgttctgtctggtgctccggaaacgtaagtctacactcttctggggggcacgctatgtccgaaccgactacactctcctcgacgtgctcgaacccggatcttcgcctagtgatccaaccgacacagggaacttcggttttaagaatatgttagacactagggtggaaggagatgtcgatgtgccaaagaccgtcaaagtgaaaggcaccgctggactatcccagaattccaccctcgaagttcagacgttgtccgtggctccgaaggcactcgaaactgtacaggagcgcaagctggcagccgatcacccattcttaaaggagatgcaagatcaaggagagaatctgtatgtggtgatggaagtggtggaaaccgtccaggaggttacactggaacgtgcaggcaaggccgaagcatgcttcagcttaccatttttcgctcccttgggactccaggggagtatcaaccacaaagaagccgtcaccattccaaaaggctgtgtcttggcatttagggtgcggcagttgatggttaaagggaaggatgagtgggatattccccacatttgcaatgacaatatgcagacattccctcccggtgagaaatctggggaagagaaagttatactgatccaggccagcgatgtgggtgatgtccatgagggatttcggacgctgaaggaggaggttcagcgcgagactcagcaggttgaaaagctgtctcgggtgggtcagagctcacttctttctagtctgtctaagcttctcggaaagaagaaggaactacaagaccttgagctcgcccttgaaggagctctggacaaagggcatgaagttaccctggaagctcttcccaaggatgttttacttagcaaggaggccgtcggagcgatcctgtatttcgtcggggctttaacagagttatctgaagcacagcagaaactgctggttaagtccatggagaaaaagatacttcctgttcagctgaagctggtggagtccaccatggagcaaaattttctccttgacaaagaaggagtgttccctctgcagccagaactcctgtcctccttaggggatgaggaattgaccctcaccgaagccctggtcgggctctcaggactcgaggttcagagaagtggtccgcagtatatgtgggacccagatacactaccccgactgtgtgcactgtatgctggcctgagcctgctgcagcagttaaccaaggcgagttag

SEQ ID NO: 224367 - DNA, 1212 bp, Artificial Sequence
  Description of Artificial Sequence: Synthetic coding sequence
atgtttagcgtcttcgaggagatcacacggattgtggtcaaggaaatggatgcaggcggtgatatgatagcagtccgaagcctggtggacgccgatcggtttcgatgtttccacttggtcggcgagaagagaacgttttttggttgccggcattacacaacaggtctgacccttatggatatcctcgacaccgacggtgacaagtggttggacgaactggatagtgggctgcagggacagaaggcagagttccaaatccttgacaatgtcgactcaacaggagaacttatcgtccggttgccgaaggagattacgatcagcggaagctttcaaggattccatcatcaaaagataaagatttctgaaaataggatcagtcagcagtatctggccaccctcgaaaaccggaagcttaagcgggaactgcctttttcctttcggtcgatcaacaccagggaaaacctgtatctggtaacagagacattggagaccgtcaaggaagaaacgctgaagagcgaccgccagtacaaattctggtctcagatatcacagggccacttgtcttataagcacaaaggacagcgggaggtaaccatacctcctaatagggttttaagctacagggtgaaacaactggtgttcccgaacaaggaaacgatgaaaaaagatggagcttcatcatgcttgggcaagtccttgggctccgaggatagccgcaacatgaaagaaaaactggaagatatggagagcgtgctgaaggatctgaccgaggaaaaaaggaaggacgtcctcaacagcttggcaaagtgcttgggcaaggaagatattcgccaggatctggaacagcgggtcagcgaggtcctgatctcaggcgaactacatatggaggatcccgataagcccctgctgtcaagcctattcaatgctgccggagtactggtggaagcacgagccaaggcaatccttgatttcttggacgcactgctagaactgtccgaggagcagcagtttgtggcagaggccttggagaaggggaccctgcccctgcttaaagaccaagtcaagtcagtcatggagcagaattgggatgagctggcgtcgtctcctccggacatggactacgaccctgaggctcgaatcctctgcgcattgtatgttgttgtgtccattctactggagttggccgaaggccctaccagcgtgagcagctag

SEQ ID NO: 224368 - DNA, 1236 bp, Artificial Sequence
  Description of Artificial Sequence: Synthetic coding sequence
atgttttcagtcttcgaggagattacccgcatagtggtaaaggaaatggacgcaggaggggacatgatcgccgtccgcagtctggtagatgccgataggttcaggtgtttccacctggttggcgagaagcggacattctttggttgtcggcattacaccacaggccttacactgatggacattctcgatacagatggggacaagtggttagatgagctggactctgggctgcaaggccagaaggcggaatttcagatcctggacaacgttgactctactggcgagcttatcgtgcgcctgcccaaagaaatcaccatttcggggtcattccagggattccaccatcaaaaaattaagatctcggagaatagaatatcccagcagtacctggctacacttgagaaccgtaaactcaagcgggagctgccattctccttcagatcaattaacactcgtgagaacctatatctggtgaccgagacactggaaacagtgaaagaggaaacgcttaagagcgataggcagtataaattttggtcccagatcagtcagggacatttgtcttacaaacataagggccagagggaggtcacaattccacccaatcgggtcctcagttacagagtcaaacagctagtgttccccaacaaggaaacaatgtcagccggacttgatatacacttcaggggaaaaactaagtcctttccagagggcaagtctcttggctcagaggactctaggaatatgaaggagaagctggaagacatggagtctgtactgaaggacttgactgaggagaagcgcaaagacgtattgaactcactggccaaatgcctcggaaaggaggatatccgacaggatttagagcaacgcgtgtccgaagtactaatttcgggagagctccatatggaggaccccgataagcctctgctttcttcactcttcaacgccgctggggtactcgtggaagcacgcgcaaaggccatcctcgactttctagacgcactgctcgagttgagcgaggagcagcagtttgtcgccgaagcattggaaaaaggcacacttcctttattgaaggatcaggtgaagtcagtgatggagcagaattgggacgaactcgcgtcttccccgcctgatatggactatgacccggaggcgaggatcttatgtgccttgtacgtggtagtcagtatactgttggaattagcagaaggccctacgagtgtgagtagttag

SEQ ID NO: 224369 - DNA, 1185 bp, Artificial Sequence
  Description of Artificial Sequence: Synthetic coding sequence
atgtttagtgttttcgaagagattacaaggatcgtggtcaaagagatggatgcaggcggagacatgattgccgtgagatccctggtcgacgcagatcgctttcgatgctttcatctggtaggggaaaaaaggactttcttcgggtgccggcactataccacagggctgacactgatggatattctcgataccgatggtgataaatggctcgatgagctggacagtggcctgcagggtcaaaaagctgagttccaaattctagataacgtggatagcaccggggagctcatagtcagactgcccaaagagattactatctccgggagcttccaggggttccaccatcaaaagattaagatctcagagaaccgcatttcccagcagtacctggccaccctggagaatcggaagttgaagcgcgaactgccttttagcttcaggtctataaataccagggaaaacctgtacctcgtcactgagaccctggaaacagtaaaagaagagactctgaaatcggaccggcagtacaagttttggtctcagatttctcagggccacctgtcgtataagcacaaagggcagcgtgaagtaaccatccctcctaatagagtgctgtcatatcgcgtaaaacagttggtcttcccaaacaaggagacaatgcggaagagcctgggaagtgaagacagtagaaatatgaaagagaagttagaggacatggagagtgtactcaaggacttaaccgaggaaaagaggaaggacgtgctgaattcactggctaagtgtctcggcaaggaggatattcgtcaagatcttgagcagagggtctctgaagtccttatctccggggagctgcacatggaagaccctgacaaaccacttctatcatccttgtttaatgcagcgggtgtgcttgtggaggcgagggcaaaggctatcctagactttcttgacgctctgcttgagctttctgaggaacagcagttcgtcgctgaagcgctagagaagggcacactgccgttactcaaggatcaggtaaagtcggtcatggaacagaattgggatgagttagcttcgagcccccctgatatggactatgacccagaggctaggattttatgcgcactgtacgttgtggtgagcatcttgctggagttagctgagggacctacctctgtgagttcatag

SEQ ID NO: 224370 - DNA, 1236 bp, Artificial Sequence
  Description of Artificial Sequence: Synthetic coding sequence
atgtttagcgtctttgaagaaattacccgaatagttgtgaaggaaatggacgcagggggagatatgatagcagtgcgttcattggttgatgctgatcgatttaggtgtttccacctggtgggggaaaagagaactttttttggttgtcggcattacactacagggctcacgttgatggacattctcgacaccgacggcgataaatggctggatgagctggacagtggtttacaaggacagaaggctgagtttcagattctggacaatgttgatagtaccggtgagctaatagtaaggcttccgaaggaaattaccatttcaggatccttccagggattccaccatcaaaagatcaagatctcagaaaatcgaatatcccaacaatatcttgctacgctggaaaataggaagctcaaacgagaactgccgttttctttccgaagtatcaacacaagggagaatctatatctcgtaactgaaacattggaaacggtcaaggaagagacccttaagtccgataggcagtacaagttctggagccagatctctcagggtcatctgtcctacaagcacaaagggcaacgagaggttacaatcccgcctaatcgtgtgttaagctatcgcgtcaaacagctcgtcttccccaacaaagagactatgagtgccggactagatatacattttcggggtaagactaagagcttcccggagggaaagtccttaggctcagaagacagtcgcaatatgaaggagaaactggaagacatggagtcagttctcaaggacttaacagaagagaagcgcaaggatgttctgaattctttggccaagtgtctcggcaaggaggatatccgacaggatctggaacagagagtgtcggaggtcctaataagcggcgagctccatatggaggatcctgacaaacctctcctatcatcactgtttaatgcagctggcgtgctggtggaggccagggcgaaggcaattctggacttcttagacgcccttttggagctctctgaagaacagcagttcgtggccgaggcccttgagaaaggtactctcccccttttgaaggatcaggtcaagtccgtgatggagcagaactgggacgagctggcctcttctcctccggatatggactacgatcctgaagcaaggatcctgtgtgccctttatgtcgttgtatcgatcctgctagagctggccgagggcccaacctccgtttcaagctag

SEQ ID NO: 224371 - DNA, 1251 bp, Artificial Sequence
  Description of Artificial Sequence: Synthetic coding sequence
atgtttagtgtgttcgaggaaatcacaagaattgtagtgaaggagatggacgcaggtggagacatgatcgctgtacgatctcttgtcgacgccgaccggtttagatgttttcatctcgtgggggagaaaagaacctttttcggctgtcgccactacacgactggccttactctaatggacatcttagatacagacggagacaagtggcttgacgaactcgactccgggctgcagggccagaaagcagaattccaaatcctggataacgtggactctacaggcgaattaattgtaaggctgccaaaagagattaccatatctgggtcattccagggctttcaccaccagaaaattaagatttccgaaaacaggatctcgcaacagtacctggcgacccttgaaaacaggaaacttaagcgggagctgccctttagttttcgttctattaataccagagagaacctatatctggtgaccgagacactggaaactgtgaaggaagagactctgaagtcagatcgccagtacaagttttggagccaaatctcccagggccacctcagttataaacataaaggacaaagagaggtgacaattcccccaaaccgggttctgagttaccgtgtcaagcagttggttttcccgaacaaagagacaatgaacattcatttccgagggaagacaaagtcttttccagaggagaaagacggagcaagctcatgtttgggtaaatctctcggctcagaagacagcaggaatatgaaggagaagctggaggatatggagagcgtgttgaaagatctgaccgaggagaaacggaaggatgtgctcaattctcttgcaaaatgtctcggaaaggaggatatacgccaggatctggaacagcgagtgtccgaggtcctgataagcggagagctgcatatggaggatccagataagcccctgctgagcagtctgttcaacgccgctggggtcttggtggaggccagggcaaaggcaattctcgactttctcgacgccctcctggagctgtcagaagagcagcagttcgtggccgaggctctggagaaaggtacacttccgctgctaaaggatcaagtgaagtccgttatggaacagaattgggatgaattagccagctctcccccagacatggactatgaccctgaggctcggattctgtgcgcattatacgtcgtggtcagcatcctgctggagcttgctgaaggccctactagtgtgtccagttag

SEQ ID NO: 224372 - DNA, 1047 bp, Artificial Sequence
  Description of Artificial Sequence: Synthetic coding sequence
taacttgacgagctggattctggcttgcagggccagaaagctgaattccagattctcgacaatgtggactcgactggagagcttattgtgaggctccccaaggaaattaccatcagcgggtcgttccagggatttcaccaccaaaagatcaaaatttccgaaaaccgtattagccagcaatatctggccacattggagaacaggaagcttaaacgtgagctaccattctcctttaggtcaatcaatactcgagagaacctgtatcttgtgacagaaactttggagacagttaaggaggagacgttaaaatctgacagacagtacaagttttggagccagatcagtcagggccacctgtcatacaaacacaagggacagcgcgaagttaccatcccacccaatcgggtgctgtcataccgtgtgaagcagctggtgttcccaaacaaggaaactatgaatattcatttccgtggaaaaacaaaaagcttccccgaggaaaaggacggggctagctcgtgtctgggaaaatcccttggatcagaggactcaaggaacatgaaggagaaactggaagatatggagtcagtcctgaaggacctcactgaggagaagcggaaggatgtgctgaattctctggcgaaatgccttggcaaggaggacatacgacaggacctcgaacagcgggtgtcggaggttctcatcagcggggagctccatatggaagaccccgacaagccactcctgagctccttattcaatgccgctggagtgcttgtggaagcccgagcaaaggctattctagactttttagacgctttattggagctttcagaggaacagcaattcgttgccgaagcactggaaaagggaactttaccactgctgaaggaccaagtgaaaagcgttatggagcagaattgggacgagctggcctcatctccaccagacatggattacgatcccgaagccagaatcctgtgtgccctatatgtcgtggtaagtattctgctggagctggcagagggaccaacctctgtgagtagctag

SEQ ID NO: 224373 - DNA, 1224 bp, Artificial Sequence
  Description of Artificial Sequence: Synthetic coding sequence
atgttttccgtattcgaagagataacaagaatcgtggtgaaggagatggacgcgggtggagacatgatcgctgtccgctcgctggtggacgccgatcgattccgctgcttccatttagtcggcgagaagagaacatttttcggttgtcggcattatacaacaggattaacgctgatggatattctggataccgatggcgacaagtggttggatgagctggacagcggactgcagggccagaaagccgagttccagatcctggataatgtcgatagtactggggaactcatcgtgcggttacccaaagagatcactatctccgggagcttccagggttttcatcaccagaagatcaaaatatccgagaatcgcattagtcagcagtacttggccactcttgagaacaggaagctgaagcgggagctcccgttcagttttaggtcaatcaatacacgggagaatctgtacctcgtcaccgagacactcgaaactgtgaaggaagagacccttaagtcggaccgtcagtacaagttctggagtcagatctcacagggacatctgagttacaaacataaggggcagcgggaagttacgatacccccaaaccgagtactgagctatcgcgttaagcagctggtctttcctaacaaggagacaatgaatatccatttccgcggtaagactaagtcgtttcccgagggcaagagtttaggtagtgaggattctaggaatatgaaagagaagttggaagatatggaatccgtactgaaagacctcaccgaggaaaagaggaaagatgtcctcaactcgcttgctaagtgcttaggtaaggaggacatcagacaagatctggagcaaagggtcagtgaggttctaatcagcggtgagttgcatatggaggatcctgataaacctctcctttccagtctgttcaacgcggcaggtgttctggttgaagcaagggctaaggccatcttagatttcctggacgccctactggagctgtcagaggagcagcagttcgtggcagaggccctcgaaaaaggaacgctgcctttgcttaaggaccaagtgaaaagcgtaatggaacaaaactgggacgaactggccagcagccctcctgacatggactatgatccggaggccagaatcctgtgcgccctgtatgtggttgtgagcatactgcttgaattggccgagggcccaacatctgtcagttcctag

SEQ ID NO: 224374 - DNA, 1527 bp, Artificial Sequence
  Description of Artificial Sequence: Synthetic coding sequence
atgccctcaatgttggagcgcatctccaaaaatctcgtgaaggagattgggagcaaagatcttacacctgttaagtatctgctgtccgcgaccaaactcaggcagttcgtcatcctacggaagaagaaagattccaggagcagcttttgggaacagtctgactatgtgccagtagagttcagcctgaatgatattttggagccttcctcttcagtgttagaaaccgtggtgacgggaccattccactttagtgacatcatgatccaaaaacacaaagccgacatgggggtgaatgttggcatagaagtaagcgtaagcggagaggcctcagtggaccacgggtgttccctcgagttccagatcgtgaccattccttcccctaacttagaggacttccaaaaacgcaaactcctggaccctgagccgagtttcctcaaagagtgtcgcagaagaggggacaatctgtacgtcgtgacagaggccgtggagctcattaacaatactgtcctgtatgattcgagtagcgttaacatcctgggtaaaatcgctctctggataacatacgggaaagggcagggacagggcgagtccttacgtgttaaaaagaaggcgctgaccttgcaaaaagggatggtcatggcttataagcggaaacagctcgtgattaaggaaaaagccattctgatcagcgacgacgacgaacagaggacctttcaggacgagtacgagatatccgagatggtgggttactgcgctgcgagaagcgaaggccttctgccatccttccacacaatttcacccacgctgttcaacgcttctagcaatgatatgaagctcaagccagagttgttcctaacacagcaattcctgagcggccatcttcccaagtatgagcaggtccatattttgcccgttggcagaatcgaggagcctttctggcagaactttaagcacttgcaggaggaggtgttccagaaaataaaaaccctagcccagttgtccaaggacgtacaggacgtaatgttctattccattctggctatgcttagggacagaggcgcactgcaggacctcatgaatatgctagagctcgatagttccggacatctggatggcccaggtggggctattctgaaaaaactgcagcaggatagcaaccacgcgtggttcaaccctaaggatccaatcctgtacctcttggaggccatcatggtcctgagcgacttccaacacgaccttctcgcttgctccatggagaagcgaatattgctccagcagcaggaactggtacggtcgatcctcgagcccaacttccgctacccatggtccattccattcacattaaagcctgagttactggcgcctctccagtctgagggactggccatcacctacggcctgttggaggaatgcggtcttagaatggagctcgataatccgagaagcacttgggatgtcgaggccaagatgcccctgtcggctctatatggcacgctctctctgctgcagcagctcgctgaggcgtag

SEQ ID NO: 224375 - DNA, 462 bp, Artificial Sequence
  Description of Artificial Sequence: Synthetic coding sequence
atggttgctacaaagaccttcgccttactgttgctcagcttgttcctcgctgtcgggcttggagagaaaaaagagggccacttcagcgctctacctagcctgcccgtcgggtcacacgctaaagtaagcagtccccagcccaggggtcctcgctacgccgaagggacattcatttccgattattctattgccatggataagatccaccagcaagacttcgtgaattggctgctggctcagaagggaaagaaaaatgactggaaacacaatatcacgcaaagagaggcgagagccctcgaactggcctcgcaggctaatcggaaggaggaggaggcagtggaaccccagtcatcacctgccaaaaatccctctgacgaggacctgctgcgggacctgcttattcaagaactgcttgcttgtctgcttgaccaaaccaatttgtgcagactccgttctagatag

SEQ ID NO: 224376 - DNA, 1401 bp, Artificial Sequence
  Description of Artificial Sequence: Synthetic coding sequence
atgaccacaagccccatcctccaactactgctgcgattgtctctgtgtggtctcctgctccagagggctgagacggggtccaaaggacagactgccggagaactctatcaacgctgggaacggtaccggagggagtgccaggaaactctcgccgctgccgaacctccatctggactggcttgcaatgggtcattcgatatgtatgtttgttgggactacgccgcacctaacgctacagctagggcctcctgcccttggtacctgccctggcatcatcacgttgccgctggtttcgtgcttcgtcagtgtggtagcgacggccagtggggactctggcgtgaccacacacagtgtgagaatccggaaaagaacgaagcttttctcgatcagagactcatactggagcgcctacaggtcatgtacacagtaggctattcactgtccttagctacccttctactggctttgttaatcctgtccctgttcaggagactccactgcacgagaaattatatccacattaatcttttcacctcttttatgttaagggcagccgcaattctgagtcgagatcgactgttgcctagaccagggccttatctgggcgaccaggcactcgcactctggaaccaggctcttgctgcctgtcgcaccgcccagatcgtcactcaatactgtgttggcgctaattacacctggctcctggttgagggcgtctatttgcacagtctcctggttctggtgggtggtagcgaggaggggcatttccggtactaccttctgctagggtggggagcacccgctctcttcgtgataccatgggtgatcgtgcggtacctgtacgaaaacacacagtgttgggagaggaatgaagtgaaggcaatctggtggattatcagaactcctattcttatgaccatccttatcaacttcctgatatttattcgcatactaggcatactactgtccaaactgcgaacacgacagatgcgatgcagggattacaggcttaggctggccagatctactctcactctggtcccactcctgggtgtccatgaggtcgtctttgcacctgtgactgaagaacaggcccgtggcgctctgaggtttgccaagctcggctttgaaatatttttgagttcctttcaggggtttttagtcagcgtgttatattgctttattaataaggaagtgcagtcagagattaggcgcggttggcatcattgtaggttacggaggtctctgggggaggaacagcgacagctcccagaaagagcttttagggccctccctagcggctcaggacccggtgaggttccaacgtctcggggattgtcttccgggacactccccggtccaggcaacgaggcgagccgagagcttgagtcgtattgctag

SEQ ID NO: 224377 - DNA, 1293 bp, Artificial Sequence
  Description of Artificial Sequence: Synthetic coding sequence
atgacgacttcccctatcctgcaactgctgctgcggctgtccctgtgcggcctgctcctccaaagagccgagacagggagtaaagggcaaactgccggagaactgtatcagaggtgggaaagatatcgcagggaatgccaagagacactggcagctgccgaacctccatcagttgctgctggtttcgtcctaagacagtgcggaagcgatgggcaatggggtctctggagagaccacacgcagtgtgaaaacccagaaaaaaacgaagcattcttggatcagcgtctcatattggagcgtttgcaggtcatgtacacggttggatattccctctccttggccacactgctgttggccttactcatcctctccctgttccggaggttgcattgcacgcgcaattacattcacattaatctgttcacgagctttatgctgcgcgctgcagccatcctgtcccgcgaccgcctcctgccacggccaggcccatacctgggcgatcaagcactagccttgtggaaccaggccctagcggcttgtcgaacagcccagatagtgactcaatattgtgtaggtgccaactacacatggctccttgtggaaggtgtgtatttacatagcttactggtgctagtcggaggctccgaagaaggacatttccggtactacctcctgctgggctggggagcacccgcactgttcgttatcccttgggtgatagtccgctacttgtacgagaatacgcagtgctgggagcgcaatgaagtgaaggcgatctggtggataatccgcacacctattcttatgactatccttatcaatttcttgatattcatcaggatccttgggattttgcttagtaagctccggaccagacagatgcggtgtcgcgattatcgacttcgcctggctcgctccacgttaacccttgtgcccctgttaggagtgcacgaggtggtcttcgcacccgtcacagaggaacaggctagaggtgcactcaggttcgccaaactcggcttcgaaatctttctatccagttttcagggatttcttgtcagtgtcctctactgttttatcaataaggaagttcagagcgagatcagacgcggatggcaccattgccgcctgagaagaagtctgggggaggagcagcgccagttgcctgaaagggcattcagggccctaccctctggctctggaccaggggaggtccccaccagtcgaggcttgtcaagtggcaccctgcctggacccggaaatgaagccagcagagagctggaatcctattgttag

SEQ ID NO: 224378 - DNA, 1401 bp, Artificial Sequence
  Description of Artificial Sequence: Synthetic coding sequence
atgacaacctccccaatcctgcagctgctcctgcgactgtcactgtgtggtctcctgctgcagcgcgcagagacggggagcaaaggacaaacagccggagaattatatcagcgctgggagaggtaccgtagagaatgtcaggagacactggccgctgctgagccgcctagcggactggcctgcaacggatcattcgacatgtatgtttgttgggactacgccgctccaaatgccacagcgagagccagttgcccctggtacttgccctggcatcatcacgttgctgctggatttgtcctacgccagtgtggctccgacggacagtggggtctctggcgggaccacacacagtgcgaaaatcctgagaagaatgaggcattccttgaccagcgacttattctggagcgactgcaggttatgtatacagtgggctactctttgagcctagctacactcctactagccttgctcatactctcattatttaggcgtttgcattgtacccgcaactacatccatataaatctcttcaccagtttcatgctacgcgctgctgccatcctttcccgagaccggctgctgccaagacccggaccctatctaggggatcaggcactcgcactctggaaccaggcgcttgctgcttgccgcacggctcagatagttactcaatactgtgttggcgctaattacacttggctactcgtcgagggtgtatatcttcacagcctgttagtgctcgttggcggttctgaggaaggtcatttcaggtactacctcttgctggggtggggagctcccgcactgttcgtgattccttgggtgattgtcagatatttgtatgagaatacccagtgctgggagcgaaacgaggttaaggccatatggtggatcatacggactcccatactgatgacaattctgataaattttctcatctttatacggattctgggaatactcttatccaagttgcggactaggcagatgaggtgtcgtgactaccggcttcggctggctaggtctaccctgacgctggtacccctacttggagtgcacgaggtggttttcgcaccagttacagaggaacaggctcgtggggctctgcgttttgcgaaattaggattcgagatcttcctgtcaagtttccaaggattcctcgtctccgttctttactgttttattaacaaggaggtgcaatcagaaatccgacgaggctggcatcactgccgacttcgtcgctccctaggagaggagcagagacagcttcccgagagagcctttagggcactcccctcaggaagcggccctggggaggttccaacctccaggggtctatccagcgggacattgcccggtcctggaaacgaggccagtcgggaactcgagagttactgctag

SEQ ID NO: 224379 - DNA, 1254 bp, Artificial Sequence
  Description of Artificial Sequence: Synthetic coding sequence
atggcctggttcgccctttatctactttctctgctgtgggctaccgcaggcaccagcactcagacacagtcaagttgcagtgtaccgagtgcccaggagcccctagtcaatggcatccaggtgcttatggagaacagcgtgactagcagcgcttatcccaaccccagtatcctgattgcgatgaatctggccggagcctacaatcttaaggcacagaagttgctcacttatcagcttatgtcctcagacaacaacgatttgactatcggccaactgggactcactatcatggcgctgacttcatcttgccgagatcctggagataaagttagcatccttcagagacaaatggagaactgggctccttctagccccaatgcggaagcaagtgctttttacgggccttccttggcaatcctggccctgtgtcagaaaaactcggaagcaaccttacccatagcggtccgcttcgctaaaaccctccttgctaacagctccccctttaacgtggataccggtgcaatggctactctggcactgacttgcatgtacaacaagattcctgtgggttctgaggagggatacaggagcctctttggccaggtgctcaaagatatcgtcgaaaaaatcagcatgaaaatcaaggacaacggcattattggagacatctatagcactgggcttgccatgcaggccttgtccgtaacacctgagccctctaagaaagaatggaactgtaaaaagacaaccgatatgatcctcaacgagataaagcagggaaagtttcataacccaatgagtattgctcagatactcccctcgctgaaagggaagacttatctcgacgtaccccaggtgacatgctcccccgatcacgaggtccaacctacgctgcctagcaaccccggtccagggcctacttcggcctcaaatatcactgtgatttacacaatcaataatcaactccgtggggtggaactgctgttcaatgagactatcaatgtgagtgtgaagtctgggtctgtgttgctggttgtcctggaagaggcacaaaggaagaatcctatgttcaagttcgagaccacaatgactagttggggcctcgtggtgagcagtattaataatatcgctgagaatgtgaaccataagacctactggcagtttctgagtggggtgacacccctcaacgaaggtgtggctgattacattcccttcaatcacgaacatattacagcgaatttcactcaatactag

SEQ ID NO: 224380 - DNA, 1179 bp, Artificial Sequence
  Description of Artificial Sequence: Synthetic coding sequence
atggcagtaccatctgcacaggaacctctcgtcaacggtattcaagtgctcatggagaattcagtgacgtcgtccgcataccccaatccgagcattttgatcgcgatgaaccttgcaggggcttataacttgaaagctcaaaagctgctaacttaccaactcatgtcaagcgacaataatgacctgacgatcggacaattgggtttgaccattatggctctgacctcttcttgtcgggatcccggtgacaaagtgagcatcctacagcgacagatggagaattgggcgccttcgagccccaatgctgaggctagcgcattttacggaccctccctcgccatactggcattatgtcagaagaacagtgaggctacactcccgatcgccgttaggttcgctaaaaccctccttgcgaatagtagtccttttaacgtggacaccggagctatggcgactttagccctaacctgcatgtataataagattcctgtggggagtgaagaagggtacagatctttatttggccaagtcctgaaggatatcgtcgagaagatatccatgaaaatcaaagacaatggcattatcggcgatatatattcaacgggcttggccatgcaggccctcagtgtcacaccggaaccctccaagaaagagtggaattgtaagaagaccacggacatgatactgaacgagattaaacaaggaaaattccataacccaatgagtatagcccaaattctcccctctttgaagggtaaaacctatctggatgtgccacaggtaacctgtagccccgatcacgaggtgcagcccacccttcctagcaatcctgggccaggacccacctcagcctctaatatcacggtgatctacactataaacaatcagctgcgcggagttgaattactgttcaatgagactatcaatgtgtccgttaaatctggctcagtgctcctcgtggtcctggaggaggctcagaggaagaaccccatgtttaaatttgagacaactatgacctcctggggtctggttgtgagttctattaacaacatagctgaaaacgtcaatcataagacgtattggcagtttctgagcggagtgacgccgcttaatgaaggggtagccgattacatcccatttaatcatgagcatatcaccgccaatttcacacagtactag

SEQ ID NO: 224381 - DNA, 306 bp, Artificial Sequence
  Description of Artificial Sequence: Synthetic coding sequence
atgcagagactgtgcgtctatgtactaatttttgccctagccctggctgctttcagcgaggccagctggaagcctcgatctcagcagccagatgcgcctctggggacaggcgctaaccgggaccttgagctgccttggctggaacagcagggtccagcttctcatcatcggagacagcttgggccacagggacctcctcacctcgtggccgaccctagcaagaagcaaggaccgtggttggaggaagaagaagaagcatatggatggatggatttcggtaggcggagtgccgaagacgagaactag

SEQ ID NO: 224382 - DNA, 447 bp, Artificial Sequence
  Description of Artificial Sequence: Synthetic coding sequence
atgaggggtagggaactgccgttagttctactcgccctcgtcctctgtttggcccctaggggtagggccgtgccgcttcctgcgggagggggtacagtgctgaccaagatgtacccgaggggaaatcattgggctgttggtcacttgatgggaaaaaaatcaactggagaaagtagttcggtttcagagcggggaagtttgaaacagcagctgcgcgagtatatccggtgggaagaggccgctagaaaccttcttgggctgatcgaggccaaggagaataggaatcaccagcctccacagcccaaggcacttgggaaccaacagccaagttgggattctgaagattcaagcaattttaaggacgtgggctctaaggggaaagtggggaggttgagcgctcctggctcacagagagagggacgcaatccacaactgaaccagcaatag

SEQ ID NO: 224383 - DNA, 426 bp, Artificial Sequence
  Description of Artificial Sequence: Synthetic coding sequence
atgcgcggacgcgagctgcccctcgtcctactggctctggtcctgtgcctggcaccccgaggaagagccgtgcctctacccgctggcggaggaaccgttctgaccaagatgtatcctcgaggcaaccactgggctgtgggacacctaatgggaaagaagagcacgggcgagtcaagcagcgtttcggagcgcggttctctgaaacagcagttaagggagtacattcgatgggaagaggcagccagaaaccttctgggcctgatcgaggcaaaggaaaacaggaaccatcaacccccacaaccaaaggccctcggaaatcagcagccatcttgggacagcgaggactcctcaaattttaaggacgtgggatcaaagggaaagggatctcagcgggaaggtagaaacccccagctcaaccagcagtag

SEQ ID NO: 224384 - DNA, 417 bp, Artificial Sequence
  Description of Artificial Sequence: Synthetic coding sequence
atgcgtggcagggaacttccacttgtgcttctcgcactggttctgtgtttggctccaagaggcagggctgtcccgttgccagctggaggcggtacagtcttaactaagatgtaccccagaggcaaccattgggccgtgggccacctgatgggcaaaaagtctacaggagagagttcttcagtttctgaacgaggatctctgaaacagcagctccgagagtatatcaggtgggaagaggccgcacgcaatttactggggctcatcgaagccaaggaaaatcgcaaccaccagccccctcagcctaaggcccttggcaaccagcagccgtcgtgggactcagaagattccagcaacttcaaagacctcgtggactctctcttgcaggtgcttaatgtgaaggagggtactccaagctag

SEQ ID NO: 224385 - DNA, 1155 bp, Artificial Sequence
  Description of Artificial Sequence: Synthetic coding sequence
atggctcttaacgactgttttctgctgaaccttgaagtggaccatttcatgcactgtaatatatcctctcattctgccgatttacccgtgaacgatgactggtctcatcccggtatcctgtacgttatccccgcagtgtatggcgtgataattctgattgggctgatcgggaacatcacgctgatcaaaatcttctgcactgtgaagagcatgagaaatgtgccaaatttattcatttcctccttagctttgggcgaccttctgctcctaataacatgcgcccctgtcgacgcttcccgctatttggctgacagatggctgttcgggcgtatagggtgcaaattgatcccttttattcagctgacatcggtcggggtgtctgtgtttacactaactgctttatccgctgaccgttacaaggctatagtccggcctatggatatacaagcgtctcacgcccttatgaaaatatgtttaaaagcggctttcatctggattattagcatgctcttggcgattccagaagctgtcttctctgatctgcacccatttcatgaggaatcgacaaaccagactttcatctcgtgcgcgccataccctcattcaaacgaactgcatcccaagatacatagtatggcatcattccttgtgttttacgttattccacttagcattatctctgtttactactacttcattgcaaagaatttgatacagtctgcctataatctgcccgtggaaggcaatatccatgtcaaaaagcagatagaatctagaaaaaggttagcaaaaacagtgttggtgttcgtaggccttttcgctttttgttggttgcctaaccatgtcatctatctttaccggtcttatcactacagcgaggttgatacctcaatgctgcacttcgtgacctcaatctgcgcgaggctccttgcttttacaaattcttgtgtgaacccattcgccctgtacctgttaagcaaaagcttccgcaagcagtttaacacccagctgctgtgctgccaacccggattgatcataagaagtcactcaacaggtaggtctactacctgcatgacttcattgaagtcgaccaacccttcagtcgccacattcagccttataaatgggaatatctgccatgaaagatacgtatag

SEQ ID NO: 224386 - DNA, 480 bp, Artificial Sequence
  Description of Artificial Sequence: Synthetic coding sequence
atggcctccttcttagtgttctatgttattcccttgtcaataattagtgtgtactattatttcattgcaaagaacctgatacagagtgcgtacaatttgcctgtggagggcaacatccacgtgaaaaagcagatagagagtcgcaaacgcttagcaaaaaccgttctggtgtttgtgggcttattcgccttctgctggctccctaaccatgttatatacctatacaggtcttatcactatagcgaagtagacacttctatgcttcattttgtgacaagcatatgcgccaggctgctggcctttacaaatagctgtgtgaaccccttcgccctgtacctgttaagcgagttccaggagaccgtacagcactccgccgcactgctgcccgcatggcctgaccaccctgtgtctcagcactggaaggagtacaacctgcacgacctcccccaagaataccagccgctgagaggccatctgtag

SEQ ID NO: 224387 - DNA, 600 bp, Artificial Sequence
  Description of Artificial Sequence: Synthetic coding sequence
atgcttgcgtactcttctgtacactgttttagggaagacaagatgaagttcaccatagtctttgcgggtctgttgggcgtgttcctggctccggctctggctaattacaatatcaatgtgaacgatgataataacaacgcagggagcggccagcagtccgtgagcgtcaataatgaacataatgtggctaacgtggataataacaatgggtgggacagttggaactccatctgggactacggcaacggttttgctgcaactcgcttgttccagaagaagacctgcatcgtccacaagatgaacaaggaggtcatgccaagtattcagtccctggatgcccttgtcaaagagaagaaacttcaaggtaagggcccagggggtccaccccctaaaggattgatgtatagcgtgaatccaaataaagtcgatgacctttctaagttcggaaaaaacatcgccaacatgtgtaggggtattcctacctatatggcggaggagatgcaggaggcttccttattcttttactccgggacgtgctatactacctccgtcctgtggatcgtggatatctcattttgcggcgatacagtagaaaactag

SEQ ID NO: 224388 - DNA, 1092 bp, Artificial Sequence
  Description of Artificial Sequence: Synthetic coding sequence
atgcaacgagccggaggcggatccgcaccaggtggaaatggtggtggtggcggtggcggtccaggtaccgcttttagtattgacagccttatcggcccacccccaccgagatcaggacatttattgtacacaggctaccctatgtttatgccttaccgcccactggtattgccgcaggctttggcacccgctccactcccagctgggcttccaccactggccccattggcctcattcgcagggcgactgaccaataccttttgcgccggattagggcaagccgtccctagtatggtggccctcaccacggccctaccttcctttgccgagcccccagacgccttttacggcccacaggagctagcggcagcggctgcggcagctgccgctacggcagcccgaaataaccctgagcctggtggtaggcgtccagagggtggacttgaggcagacgagctgctccccgctcgtgagaaggtcgccgagccacccccaccaccccctccgcactttagcgagacgttccccagtctgcccgcagagggaaaggtgtattccagtgacgaggaaaagttggaggcttctgctggagaccccgcagggagcgagcaggaagaggagggcagcggcggtgattcagaagacgacggattcttagacagcagtgctggtgggcctggggcactgctaggtcccaagcccaagctgaaaggctccctgggtactggcgctgaggaaggcgcacctgtgacagctggagtcacagcgccaggcggaaaaagccgcaggcgaagaaccgccttcacaagtgagcaactgctcgaactcgaaaaggagtttcattgcaagaaatacctgtccctgactgagagatcccagatagcccatgctctgaagctgtcggaagtgcaagttaagatttggttccagaatcgcagggcgaaatggaagcgcatcaaggctggcaatgttagctccaggagcggagagccggtgcgcaatcctaagatagtggtccctatccctgtgcatgtaaaccgcttcgccgttcggagccagcatcagcaaatggagcagggcgctagaccatag

SEQ ID NO: 224389 - DNA, 1047 bp, Artificial Sequence
  Description of Artificial Sequence: Synthetic coding sequence
atgagcgccgcttttccgccttctctgatgatgatgcagaggcctctggggtccagcaccgcttttagcatagacagccttatagggtctccgccacaaccctcccccggtcactttgtctataccggataccccatgtttatgccgtatcgacctgttgtcttaccccctcccccaccacctccaccggctctgccccaggctgctctccagcctgccctaccaccagcccacccccatcaccaaatcccctccctccctactggtttctgctccagcctagcccaaggcatggcccttacctccacccttatggctaccctgcccggtggcttttctgcctcaccgcagcatcaagaagcagccgcagcacgtaaatttgctcctcaaccacttcctgggggaggtaattttgacaaggccgaggcacttcaagctgacgccgaggatggcaaaggtttcctggccaaagagggcagcctcctggcattctcagctgcagagacagtgcaggcttcactggtcggagctgtgagaggtcagggaaaggatgaatcgaaggttgaggacgacccaaagggtaaggaagaatctttcagcctggagagcgacgtggactattccagcgacgacaaccttactgggcaagccgcacataaggaagaggacccaggccacgcactggaggaaacacccccttcttccggagccgcagggtccacgacctcaaccggaaagaacaggaggcgacggaccgcatttacatctgagcagcttctggaactggaaaaggagtttcattgcaagaaatatctatctcttaccgagagatcgcagatcgcacacgctctgaagctgtcagaggttcaggttaaaatttggttccagaacaggagggctaagtggaagagagtcaaagccggtaacgcaaactcgaagaccggggaacccagtcgcaaccctaagatagtggtgccaattccagttcacgtgtcccgcttcgcaatcaggtctcaacatcagcagttggagcaagcgagaccctag

SEQ ID NO: 224390 - DNA, 1443 bp, Artificial Sequence
  Description of Artificial Sequence: Synthetic coding sequence
atggaggtggcacctgaacagccgcgatggatggcacatccagccgtcttaaacgcccagcatccagactctcaccacccaggtctggcacacaattatatggaaccagcacagctgctgccacccgacgaggtggacgtcttcttcaatcacctggatagtcagggcaacccttattatgcaaaccctgcacatgcacgcgcaagagtgagctattctcccgcacacgcaagactaaccggcggacagatgtgcagaccacatctactgcatagtcctggtttgccctggctagatggtgggaaggcagcccttagcgccgcagctgctcatcatcataatccttggactgtcagccccttcagcaagactccattgcacccctctgcagcaggcggaccaggaggcccactctcagtctatcctggcgcaggcggtgggagcggtggcggatctggttcttctgttgcaagtctcacccccactgccgcacattcgggcagtcacctctttggcttccctcctacaccgccaaaagaagtgtccccagacccaagcacgaccggtgcagcgtcccccgcaagctcttctgcgggtgggtctgcagccaggggcgaagacaaagacggggtgaagtaccaggtctcactgacagagagcatgaaaatggagagcggcagtcctttgagaccaggtctggccaccatgggcacgcagcccgcaactcatcatccaatcccaacctatcctagttacgtcccagctgctgctcatgattactcctctggattgttccaccccggaggtttccttggaggcccagcttcctcctttacgcccaagcagcggtccaaggcaaggagctgctcagaaggtcgggagtgtgtcaactgcggggctaccgccactcccctttggaggcgcgacggtactggccactacctttgcaatgcttgtggcctctatcacaagatgaatggacagaatcgccctctgataaagcccaagcgcagactgtccgccgctaggcgagccggtacatgttgcgctaactgtcagacaaccacgactacactttggcgtcgaaacgctaatggagacccggtgtgtaatgcctgtgggttatactacaagctgcacaatgtaaatcgccctctaactatgaagaaggaagggatccagactagaaacaggaagatgtcaaataaaagtaagaaatctaagaagggtgctgaatgtttcgaggaactttccaaatgtatgcaggagaagagctcccctttttcagcagcagctctggcgggacacatggctccggtcggccacctccctcctttcagccatagtgggcatatcctgcctacaccgacaccaatccacccatccagctctctctcgttcggccatccccacccctctagcatggtgacagcaatgggatag

SEQ ID NO: 224391 - DNA, 1401 bp, Artificial Sequence
  Description of Artificial Sequence: Synthetic coding sequence
atggaagtagcccctgaacagccaagatggatggcacatcctgctgtcttaaacgctcagcacccggatagtcatcatcctggactcgcgcataactatatggagccggcacagcttctcccgcctgacgaggtcgatgttttctttaatcacctggattcccaaggaaacccgtattatgccaatccagcccacgctagagccagagtttcgtattcaccagctcacgcaagactgacaggcggacagatgtgccgcccacacctcctgcattcccctggcctgccctggctggacggagggaaagccgcactgtctgccgctgcggctcatcaccataacccttggacggtctcaccattcagcaagacccctttgcacccttcagcagccggaggacctgggggtcctctgagtgtttaccccggtgcaggcggaggctcgggagggggaagtggcagttccgtggcaagtctgacgccaacagccgctcattcagggtcccacctctttgggttccctccaacacccccaaaggaggtgagtcccgatccttccacaacaggagctgcttctcccgcatctagctccgccggaggctctgccgcacgcggagaggacaaggacggtgtgaaataccaagtaagcttaactgaaagtatgaagatggagtcaggcagccccctcaggcccggattagccactatgggaacacaacccgctacccaccaccctatccccacttacccatcgtacgtgcccgcagcagcacacgattacagttcaggattatttcatcctgggggatttctcggcggaccagccagtagtttcacaccaaagcagaggtccaaggctagaagttgttcagagggcagggaatgcgtgaactgcggcgcaacagctaccccactgtggcggcgagacggaacgggacattatttgtgtaacgcgtgtggattgtatcacaaaatgaatggtcagaataggcctctcatcaaaccgaagcgcaggctgaccaccaccaccaccctgtggagacgcaatgcaaatggtgacccagtatgtaatgcatgtggactgtattataaattacacaacgtgaatagaccactgactatgaaaaaggagggcatccagactagaaatagaaaaatgagcaacaagagcaagaagagcaagaagggagctgaatgcttcgaagagctgtctaaatgcatgcaggagaagtcctcaccgttctctgcggctgcgctcgccggtcatatggcgcctgttggacatcttcctccattttcgcattctggccatatactgcccacacctacccctattcacccgagttcctccctgagcttcggccatccccacccaagctccatggtgacagccatgggttag

SEQ ID NO: 224392 - DNA, 1443 bp, Artificial Sequence
  Description of Artificial Sequence: Synthetic coding sequence
atggaggttgccccagagcagccacgctggatggcccatcccgcagtcctcaacgcacagcatcctgactcacaccatcctggactggcacacaactacatggaacccgcacaactcctgcccccagatgaggtcgacgtgtttttcaaccacttggacagtcaagggaatccttactacgccaacccagcccacgcccgagccagagtttcttactctcccgcacatgcccgtttaaccggcggacagatgtgccggcctcatttgctccactcaccgggactgccatggttagacggagggaaagcagcactgtcagcagcagccgctcatcaccacaacccctggacagttagtccattttccaagactccgctgcatcctagcgccgcaggcggaccaggtggaccgttgtcagtttatcctggggcagggggagggagcggcggtggttccgggagttccgtcgccagcctaactccaacggccgctcattccggcagtcacctatttggctttccccctacccctcccaaagaagtgtctcctgacccttctaccacgggtgcagcctccccagccagctcatccgctggcggatccgctgccagaggcgaagacaaggacggcgtgaagtaccaagtgtccttgacggaatccatgaaaatggaatccggcagtcccctgcggcctggactcgctacaatggggactcagcctgcaacccatcatccaattccgacatacccctcatatgtgcccgcagccgcacatgattacagttcaggactgtttcatcccggtggctttttaggaggacccgcttcaagttttacccccaagcagaggtccaaggctcggagctgctctgagggcagagaatgtgtgaattgcggcgctacagcgactcctctttggaggagggatggaaccggtcactatctctgcaacgcctgcggtctctatcacaaaatgaatggtcagaacaggcctctgatcaaacccaagagacgcctctctgccgcacggagggcgggaacttgttgtgcaaactgccagacaacaaccactactctgtggcgcaggaacgccaatggggacccggtctgcaacgcctgcggtctctactacaaacttcacaatgtcaatcgacccctcacaatgaaaaaagagggaattcagacgcggaatcggaagatgtcaaataagtctaagaagtctaaaaaaggcgctgaatgttttgaagagctctccaaatgcatgcaggagaaaagctctccttttagcgcagccgcactggcgggacacatggcaccggtgggacatctccccccattctcccactctggtcacatactgccaacacctactcctatccacccctcctcttcactgagtttcggccacccacatcctagctctatggttacagcaatgggatag

SEQ ID NO: 224393 - DNA, 453 bp, Artificial Sequence
  Description of Artificial Sequence: Synthetic coding sequence
atggaagtggctccagagcagcctagatggatggcacatcccgcagtcctgaatgcccaacaccctgactcgcaccaccccggactggcacataactacatggagccagcccagctcctcccccctgatgaggtagacgtgttcttcaatcacctcgacagtcaggggaacccatattacgcaaaccctgcacatgcacgagccagggtttcatatagtcctgcacacgccagattgacgggcggtcagatgtgccgccctcatcttctccatagccctggccttccatggctggatggaggaaaggcggctctgtccgcagcagcggcacaccaccacaacccttggacagtgagcccattttcaaaaacccctctgcatccctcagccgctggaggaccgggaggaccactgtccgtgtacccgggagcaggtggcggtagtggaggatag

SEQ ID NO: 224394 - DNA, 27 bp, Artificial Sequence
  Description of Artificial Sequence: Synthetic coding sequence
atggaggtggcaccagagcagccctag

SEQ ID NO: 224395 - DNA, 1326 bp, Artificial Sequence
  Description of Artificial Sequence: Synthetic coding sequence
atgtaccagtccctgccttggccacccacgaccggaagacccccagtgccaactcggagggccgcaccagcacccagctgcacggccagagctcccaggccacgtcagtccacttgtcctcatagaggtgctctgctcagggcaggaccagtcctgcccccaggccgtcggcgtgggttgtgtgtgagacgggcatccggaggatcgagtggaggggctgcaagtggtgctggaccaggcacacagcaggggtcccctgggtggtcgcaggcgggagcagatggggcagcttatacgccccctccagtttcaccaaggttcagtttcccaggaacaacagggtcattggcagccgctgctgccgcagctgccgcaagggaggcagctgcctattcctccggcggaggtgcggcaggcgcaggcctcgcaggcagggaacagtacggccgagccggttttgccggttcttactcatccccttatcccgcatatatggcggacgtcggagcgagttgggccgcagcagccgcagcgtctgctggccctttcgacagcccagtcctgcattctctgcccggacgagcaaatccagcagcccgacatcccaatctggatatgtttgacgacttttccgaaggaagagaatgcgtgaattgcggcgcaatgagcactccactctggcggagagacgggactggacattacttgtgcaatgcttgtggcctgtatcataagatgaacgggatcaacagaccactgattaagccacagcgccgattgagcgctagtaggcgggtcggattatcttgtgctaattgccaaaccacgacaacgaccctttggaggcggaacgctgagggcgagccggtctgtaacgcctgcggcttgtacatgaagctccatggcgtacctagacccctggccatgagaaaggaggggatacagaccaggaagaggaagcctaaaaatttgaacaagtctaaaactcctgcagctccaagtggaagcgagtccctgccacccgcaagcggggcttcctcgaattcaagtaatgcaactacatcgagtagcgaagaaatgcgccctattaagacagagcctggactgtccagtcactatggccattcttcttccgtctctcaaaccttcagcgtgtctgccatgtcaggccacggaccaagtatacacccagtgctttccgcattaaaactaagcccccaaggctatgccagccccgttagccagagccctcaaacctcctccaagcaggattcatggaactccctggttctcgctgattctcacggggacattatcacggcctag

SEQ ID NO: 224396 - DNA, 1329 bp, Artificial Sequence
  Description of Artificial Sequence: Synthetic coding sequence
atgtatcagagcctggccatggcggctaatcacgggccacctcctggtgcatatgaggcagggggaccaggggcattcatgcatggtgccggagccgcatcatctccagtatacgttcctacgcctcgggtgccgagtagtgtgctgggcctgagctacctacagggcggtggggcaggcagcgcctccggtggagcctccggcggatcatccggaggtgccgcatcaggtgcgggacctggcactcagcaggggtctcccggttggtctcaggcaggggctgatggggctgcttacacacctccacccgtgtctcctcgtttttctttcccgggaacgaccggaagcctcgctgcagcagctgccgctgccgcagctcgggaagcagcagcctattcctcgggaggcggagccgcaggtgcaggcctcgcaggacgggaacagtacgggcgagctggtttcgccggttcctactcgagcccctaccccgcttatatggcagacgttggagctagctgggcggctgctgcagcagcaagtgcagggccttttgattccccagttctgcactccctaccgggacgtgcgaacccagcagccagacaccccaacctcgacatgttcgatgacttttctgaaggcagagagtgcgtgaactgcggcgctatgagtactccgctgtggcggagagacggcaccggccattacctgtgtaatgcgtgtggcctttaccataaaatgaatgggatcaatcgaccgcttatcaaacctcaacgaaggctgagcgcctccagaagagtagggctgagctgtgctaactgtcaaaccactactaccactctatggcgtaggaatgctgaaggggagccagtttgcaacgcttgcggcctctacatgaagctgcacggggtcccgcgacccctggcaatgagaaaggaaggcatccagacacgcaagcgcaagcccaaaaacctgaataaatcaaaaacgccggcagcgcctagtggttcagagagtctccctcccgctagtggggcaagcagtaattcaagcaatgctacaacatctagtagtgaagaaatgagacccattaaaaccgaaccaggcttaagttctcattacgggcactctagcagtgtaagccagaccttctcagtgagtgctatgtcaggccacggccctagcatccacccagtgcttagcgccctgaagttgagccctcaaggctacgcatcaccagtcagccagagcccgcagacgtcatccaagcaggatagctggaacagcttggttttggctgacagtcacggcgacatcattacggcatag

SEQ ID NO: 224397 - DNA, 528 bp, Artificial Sequence
  Description of Artificial Sequence: Synthetic coding sequence
atgttcgatgacttcagtgaagggcgagagtgtgtgaattgtggagccatgagtactcccctgtggagaagagatgggactgggcattatctgtgcaacgcctgcggactgtaccacaagatgaacggtatcaaccggcctcttataaagccccagcgacggttgagcgcgagtagacgcgtgggcctcagctgcgcaaattgtcagacaactacaacaaccctttggcgtcggaatgccgagggcgagcctgtctgtaatgcatgtggattgtatatgaagttgcacggcgttcctcgaccgctggccatgcggaaggagggtatccaaacgagaaagagaaagcctaaaaatctgaataaaagcaaaactccagctgcgccttctggtagcgaaagcctccccccagcatcgggagcatccagcaactcctcaaatgcgaccactagctcatctgaagaaatgagaccgataaagaccgagcctggcctcagctcacactatggacactcttcatccgtttcttag

SEQ ID NO: 224398 - DNA, 354 bp, Artificial Sequence
  Description of Artificial Sequence: Synthetic coding sequence
atgtaccagtcgctagccatggctgccaatcacgggcctcctccaggcgcatatgaagctggtggtcccggagccttcatgcacggtgctggggcagcaagttcaccggtgtacgttccaacaccacgggtccctagttcagttctgggcctgagctacttacagggagggggagccggtagcgcctctggcggagcgagcggtgggtcttccggcggagctgcaagtggagccggacctggaacccaacaaggatcccccggatggagccaggccggagctgacggcgctgcgtacacaccacctcccgtgtcccccaggttcagcttccctgggaccaccggctcgttgtag

SEQ ID NO: 224399 - DNA, 711 bp, Artificial Sequence
  Description of Artificial Sequence: Synthetic coding sequence
atgtttgatgacttctctgagggaagagaatgtgtaaactgtggcgcaatgtccacccccctctggcggcgtgacgggactggccattacctatgcaacgcttgcgggctatatcataaaatgaacggtattaatagacccctaattaaaccccagaggaggttgagcgccagccgaagagtcggcctgtcctgcgcgaactgtcagactacgaccaccacgctctggcgtcgcaatgccgaaggcgagccagtgtgcaacgcctgcgggctttacatgaagctgcatggcgtgccaagacccttggctatgcgcaaggaaggaatccagacaagaaaacgaaaaccaaagaatctaaacaaaagcaagactcccgcagcacctagcggctctgagagtctgcctcctgcctctggggctagtagcaactcctccaacgcaacgacgtcaagctctgaagaaatgcgccctatcaaaacagagcctggactgtcatctcactatggccacagctcctcagtgtcccagactttctctgtctccgctatgtcaggtcacggaccttccatccaccctgtgttatctgcccttaaattgtccccgcaaggctatgcttctccagttagtcagtctccccagaccagctccaaacaggattcctggaactcgctagtccttgccgacagtcacggcgatatcataacagcatag

SEQ ID NO: 224400 - DNA, 1332 bp, Artificial Sequence
  Description of Artificial Sequence: Synthetic coding sequence
atgtaccagtccctcgccatggcagcgaatcacggtcctccacctggagcctacgaagccggtggtccgggtgccttcatgcatggggctggagcagcttcatcccctgtgtatgtacccaccccgagagtgcctagctctgtcctcggcttaagctacctgcagggagggggagcaggatcagctagcggaggagcgagcgggggatcatctggcggtgccgctagcggcgctggccctggaactcagcagggctcacccggatggtcacaggcaggagccgacggagcagcctacactcctcctccagtgtcccccagattcagttttcccggaactaccgggtctctcgctgctgcggctgcagctgcagccgctcgggaagccgctgcatattcaagcgggggaggcgcagccggagctggactggcagggcgagaacagtacggcagagctgggttcgccggatcgtactccagcccatatcccgcatatatggccgacgtcggagccagctgggccgctgccgcagcggcatccgcaggtccgttcgattcccctgtcttacactccctgcccggtcgcgctaatcccgctgcacgccacccgaacttggttgacatgttcgacgatttcagtgaaggccgtgagtgtgttaactgcggggctatgagcactccgctatggcggagggatgggaccggccattacctgtgtaatgcgtgtggattataccacaagatgaatggcatcaatcgtccactcattaagcctcagcgcaggctgagcgcctcccggagggtcggactttcctgcgcgaactgccaaacaacgacgacaacactttggaggcggaatgccgaaggcgagcccgtctgtaacgcctgtgggctatacatgaagttgcatggagttcctcgccctttggctatgaggaaggaggggatccaaacccggaagcgcaagccaaagaaccttaataaatcaaaaactcctgctgctccgtccggctctgaatccctcccaccagctagcggggctagttcaaactccagcaacgccactacctctagcagtgaggaaatgcgacctatcaagaccgagcccggtctcagttcccattacggacattcatcgagcgtgagccagacttttagcgtcagcgccatgtcgggacatgggccatccatccatccagttctttccgctctaaaactgagtccacagggttatgctagcccagtttcgcagagcccacagacctcttcaaaacaggatagctggaattctctggtgctcgctgatagccatggcgacataattacagcatag

SEQ ID NO: 224401 - DNA, 1194 bp, Artificial Sequence
  Description of Artificial Sequence: Synthetic coding sequence
atgtatcaaagcctggctctggccgcatctccacgtcaggcagcgtatgccgacagcggctcttttcttcatgctccgggagctggcagcccgatgtttgttcctccagccagagtaccgagtatgttaagttacctgtctggatgcgaaccctctcctcaaccacctgaactggccgcacgccctggttgggcccagactgccacagccgactcaagcgcgttcggacctggttcacctcatccaccggcagcacacccgcctggtgctacggctttcccttttgctcacagccccagcgggcctggcagcggcggttcagcaggcggtcgcgatggctccgcgtatcagggagccttgctgccccgtgaacagtttgccgctccactgggccgaccagtgggcacttcttatagcgcaacatacccagcttatgtgtctcccgacgtcgcacagtcctggacagctgggccatttgacggctctgtgttacatgggctcccagggaggcggcctacttttgtgtctgattttctggaagagttccccggagaaggcagggagtgtgtaaattgcggggctctgtcgacccccctctggcgtcgcgacggtacagggcattatctttgcaatgcctgcgggctgtaccataaaatgaatggggtaaatcgtccactggtgagaccccagaagcgactgagctcatcacggagggctggattgtgctgcactaattgtcatactaccaatacgacactctggcgcagaaactctgagggagaaccggtgtgcaacgcttgtgggctgtatatgaaactgcacggcgtccccagaccccttgctatgaagaaggagtctatccaaaccagaaagagaaaacctaaaacaattgccaaagcgcgaggctcttcagggtctaccagaaatgcttcagctagccccagcgctgttgcttccactgattcttccgctgccacatctaaggccaagcccagcttggcaagccctgtttgtccgggtccaagcatggctccccaggcctccggccaggaagacgacagcctcgctcctggccatctagaatttaagttcgagccagaggactttgcattcccttccacagccccatcaccccaggccggactcagaggcgctcttagacaggaggcttggtgtgcccttgcgttagcttag

SEQ ID NO: 224402 - DNA, 1194 bp, Artificial Sequence
  Description of Artificial Sequence: Synthetic coding sequence
atgtatcagagcctggcgctggccgcttctcccagacaagccgcatacgcggactcgggatcttttttgcacgcaccgggtgcgggatcccctatgttcgtgcctccggcaagagtcccgagtatgcttagctatctcagtgggtgcgagccttcaccacagcctcccgagttggctgcaaggcctggctgggcacagaccgcaaccgccgacagcagcgccttcggccctggcagcccacaccctcctgccgcacatccacctggcgctaccgctttcccctttgcccattctccgagcgggcctggttcgggcggttctgccggtggcagggatggctccgcctatcagggagccctgctccccagggagcagtttgctgcgcctctagggcgtcctgtcgggaccagctactcggcaacctatcctgcatacgtcagccctgacgtggcgcagagctggacagccggtccatttgacggatccgtcctgcatgggctgccgggtaggaggccgacattcgtttctgattttctggaagaattccctggcgagggaagagagtgcgtgaactgtggtgcgttgtccactccgctctggcggagagatggtactggccactacctgtgcaatgcctgtgggctctaccataagatgaacggggttaatcggccattggtaaggcctcaaaagcggctgagttcctcacggagggccggtctatgctgtactaattgtcataccacaaacactaccttgtggagaaggaactcagagggcgagcctgtgtgcaatgcatgcgggctttatatgaaactccatggagtcccacggcctctggccatgaaaaaggaatccattcagacgcgaaagcggaagccaaagaccatcgctaaggctcgtggctcctctgggagtaccaggaacgcgtccgcctcccctagcgccgtggcttccactgactccagtgccgctacctccaaagctaaaccgtccctggcgtctcctgtttgccccggaccctccatggctccccaggcttccgggcaagaggatgacagcctggcaccgggtcatctcgaattcaagtttgagccagaggattttgctttcccgtcgaccgccccatctcctcaggcaggtcttagaggagccctgcggcaggaggcttggtgtgctcttgcactggcttag

SEQ ID NO: 224403 - DNA, 1254 bp, Artificial Sequence
  Description of Artificial Sequence: Synthetic coding sequence
accgccacagctgtgccttgtagaccaccctgcccactggtcaagacaacgcctgggcgtatgtatcaatcactcgccctagcggcaagcccaaggcaggctgcctacgctgattcagggagctttttgcacgctcctggcgcagggtcccctatgtttgtaccccctgcccgtgtcccatctatgctctcgtatttgtccgggtgcgagccgtctccccaacctcccgagctggcagcccgacccggttgggcccagaccgcaacagccgactctagcgcctttggacctggatccccacacccacccgctgcacatccacccggagctaccgccttcccttttgcgcattcaccatccggcccaggttccgggggttctgctgggggtcgagatggcagcgcttaccagggcgcactgctgccaagggaacagttcgctgctccactgggccgacccgttggcaccagttatagcgcaacttacccagcctacgtgtcacccgacgtggctcagtcctggactgccggtccgttcgatggctccgtactacacggtctcccgggaaggcggccaacgtttgtgtccgacttcttggaggagtttcctggtgagggaagagagtgtgtcaattgcggggcactgtccacccccctgtggcggcgagacggtactggtcattacctctgcaacgcctgtggtctctatcacaaaatgaacggagtgaaccggcctttggtaagaccacagaaaaggctaagtagtagcaggcgggctgggctgtgctgtactaattgtcacaccacgaatactacactgtggaggcggaatagcgaaggcgagccagtgtgcaatgcctgcgggctctacatgaagctgcacggggtgcccagaccgctggccatgaagaaagagtcaattcagacaaggaaaagaaagccgaagaccatcgctaaggccagggggtcctccggctcaactagaaatgcgagtgcctcaccttctgctgtggcctctacagatagcagtgcagcaacaagtaaggccaagccgagcttggcctctcccgtatgccctgggccatctatggctccgcaggcgtccggtcaagaggatgactcccttgctcctgggcatttggaatttaagttcgagccagaagactttgctttcccctcaacagctccgtcacctcaggcaggcctgaggggcgctctgagacaggaggcttggtgcgccctggccttggcctag

SEQ ID NO: 224404 - DNA, 1788 bp, Artificial Sequence
  Description of Artificial Sequence: Synthetic coding sequence
atggcccttacagatgggggttggtgcctccccaaaagatttggcgctgccggagctgatgcttcagactctagggctttccctgctcgggaaccatccacacccccaagcccaatctcctctagctcttcctcgtgttccagaggcggagaacggggtcccggaggggcatccaattgcggaaccccccagctggacactgaagccgctgccggtccgccagcgcgatcacttctgctgagtagctatgcttcccacccgtttggggcaccgcacggccctagtgcacccggtgtggcagggccagggggaaatctgagctcatgggaagatttgcttctttttaccgaccttgatcaggccgctacggcctccaaactcctgtggtcttcgagaggtgcaaaattatccccattcgctcctgagcagcctgaggaaatgtatcagaccctcgctgccctatctagtcaaggaccagcagcttatgatggggctccgggaggatttgtacattctgccgctgcagcagcagccgcagcagccgctgctagtagtccggtgtatgtgcccacgactcgtgtgggaagcatgctgccgggattaccctatcatctgcaaggcagtgggtcaggccctgctaaccacgctggaggcgctggtgctcatcctggctggccacaggcgtctgccgactcgcctccgtatggaagcgggggaggggcagccggaggaggtgccgcagggccaggaggagcaggttccgccgcagctcacgtgagcgctcgctttccgtacagccccagcccccctatggcaaatggagcagccagagaaccaggtggctatgccgctgcaggctcgggaggtgcgggaggcgtcagtggcggaggcagcagtctggcagccatgggcggaagggagccccaatattcttcactttcggccgcaagacccctgaatggaacctatcaccaccatcatcaccatcatcatcatcatccgtccccctactcgccatatgtcggcgcacctcttacccccgcttggcccgcagggcctttcgaaacacctgttcttcattcccttcagagcagagcaggggcacctctaccagtccccaggggaccctcggctgacctgttggaggacctttctgagtctcgcgagtgcgttaactgtggcagtatccagacccccttgtggcgaagagacgggactggtcactatctgtgtaatgcctgcggactgtattccaaaatgaatggactgagtaggcctctaatcaaaccgcagaaacgtgtcccgtcttcccggaggctgggtctgagttgcgcgaattgccataccacaactacgactctatggcggcgaaacgccgaaggtgagccagtctgcaatgcatgcggtttgtacatgaagctccacggagttccacggccactggctatgaaaaaagaaggaattcagacccgaaaacgtaagccaaagaacattaacaaaagtaagacttgttcagggaattcaaataatagcatacccatgacaccgacttctacttctagtaactcggacgattgttctaaaaacacgtcccccactacacagccaaccgcatctggggctggtgctccagtgatgaccggcgcaggagagtctacgaaccccgagaactcagaactcaaatatagtggacaggatgggctgtatatcggcgtatcactggcatctccagcagaagtgacaagctccgtccggccagatagctggtgtgccctggcactcgcgtag

SEQ ID NO: 224405 - DNA, 8015 bp, Artificial Sequence
  Description of Artificial Sequence: Synthetic coding sequence
atggctgccgacactcaggtgtccgagacactgaagcggttcgccggaaaggtgacaacagcctctgtgaaagagagacgcgaaatcctctctgagctgggcaagtgtgtggcaggaaaggatctgccggaaggggcagtcaaaggtctttgcaagctgttctgcttgacccttcaccgctaccgcgatgcggcatctagaagagctctgcaggccgctatccagcagttggcagaggcccaacctgaggccactgccaagaatctgctccactcactccagtcctctggaataggctcaaaggctggtgttccctccaagtcgtccggttccgctgctctactggccctgacatggacctgcttactggtgcgcatcgtgtttccctccagggcaaagagacaaggggacatttggaataagctggttgaagttcagtgtctactgctgctcgaagttttaggagggagccataagcacgccgtcgacggagctgtcaagaagctgactaagctctggaaagagaatcccggactagtagagcaatacctcagcgcaattctgagcctggagccgaatcagaactacgccggaatgctaggccttctggtccagttctgcacatcccacaaggagatggatgttgtgtcgcagcataaatccgcactgctggacttttatatgaagaacatcctgatgtccaaagtgaagcctccaaaatacctccttgattcgtgtgccccactactccgctatcttagccactctgagttcaaagatttaattctgcctactatccagaagagcctccttagaagcccagagaacgttattgagaccattagttccctgctcgcgagcgtgacactggacctgtcccagtatgccatggatatagttaaaggcctggcgggtcacctcaaatcgaacagccctcgactcatggatgaggctgttctggcccttcgcaacttagctagacaatgttccgattcgtctgctatggagtcattaaccaaacacctgtttgcaatactggggggatctgaaggaaaacttacggtggttgcgcagaagatgtctgtactgtctggcatcggctctgtgagccaccatgttgtatctggcccatcttcgcaagttctcaatggcatagtggctgaactgttcattcccttcctgcagcaagaggtgcacgagggcaccctggtacacgcagtctctgtcctagctctgtggtgcaaccgattcaccatggaggtgcctaaaaaactcacagagtggtttaagaaggccttctctctgaagacctcaacatctgctgtcaggcacgcatatctgcagtgcatgctggcctcttaccggggtgatacgctcctgcaagccctggacttactgccactgctcatacagacagtagaaaaagctgccagccagtccacacaagttcctactattactgaaggagtggccgctgccctcctactgcttaagttgtctgtggccgattcacaggccgaggctaagctatctagcttctggcagttaatcgttgacgaaaaaaaacaagtctttacttctgagaagttccttgtgatggcgtctgaagatgcactgtgcactgtgcttcacctcacagaacgcctgttcctcgaccatccgcaccgactcacaggcaataaggtgcagcagtaccaccgcgcactggtggcagtgctgctctctaggacttggcacgtgagaaggcaggctcagcagaccgtcagaaagctgctgagcagtcttggcggtttcaaactggctcacgggttgttagaggaactgaaaacagtcctttctagccacaaggttttaccactagaggctctggtgacagatgcaggcgaagttactgaagctggcaaggcttacgtacccccacgagtcctgcaggaggccctgtgtgttatctccggcgtccccggacttaagggggatgtgaccgataccgaacagctggctcaggagatgcttatcattagtcatcacccaagcttggtggccgtgcagtctggtttgtggcccgcactcctggctaggatgaaaatagaccccgaagcctttatcactaggcatctggaccagataattcctagaatgaccacacagtctcccctgaatcagtcgtcaatgaacgctatggggtcattaagcgtcctgtcccctgatcgtgttctccctcagctcatctccacaatcactgctagcgtgcagaaccctgcgctcagattggtgacccgggaggagttcgcaattatgcaaactcccgcaggcgaactctatgacaaatcaattatccagtccgctcaacaggattcaatcaagaaagctaatatgaaaagggaaaataaggcgtatagctttaaagagcagatcattgagctggaacttaaggaggaaattaagaagaaaaaaggtatcaaagaggaggtccaactcacaagcaagcaaaaagaaatgcttcaagcgcagttggaccgtgaagcccaggtgaggcgtcgacttcaggagctggacggggaactggaggccgcattaggtctgctcgacatcattctggctaagaatcctagcggcctgacgcagtatattcctgtccttgtggactcttttctaccgctgctgaagtcccctctggccgctcctcgcatcaagaatcccttcctatctctcgcggcatgtgtcatgccatcaaggttgaaagcactggggacattggtcagtcatgtgacactcaggctgcttaaacccgaatgcgtcctcgataagtcctggtgtcaagaggagctctcagtggcagtgaagagggctgtgatgctgctccatacacacaccatcacgtccagggttggcaagggggagcctggcgcagcccctttaagcgcaccggctttctccctcgtgtttccttttttgaagatggtcttaacagagatgccacatcatagcgaggaggaggaagaatggatggctcagatcctgcaaattttgaccgtgcaggcacagctgagggcctcacccaacactccaccaggacgagtggatgagaatggtcccgagttgctgcctcgcgtggcaatgttgcgcctcctgacttgggttataggaactgggtcacccaggctgcaggtcctcgccagtgacaccttaaccactctgtgcgcttcctccagtggcgacgacggttgtgctttcgccgaacaggaagaagtcgacgtgctcctgtgtgccctccagtctccatgtgccagtgtgcgggagactgtgcttaggggcttgatggagctgcacatggtgttgccggcaccggacaccgatgaaaaaaacgggcttaacctgctccgacggctgtgggtggtgaaatttgataaggaagaagagatcaggaaactggccgagcgcctgtggtcaatgatgggactggacctccagcccgatttgtgctctcttctcattgatgacgttatctaccacgaggctgccgtccgtcaggccggagccgaggctctttctcaagccgtggcacggtaccagaggcaagccgctgaagtgatggggaggctaatggaaatttatcaggagaagctctacaggccgcctcctgtgctagacgccttgggtcgcgtgatttccgaaagtcctcctgatcagtgggaggcccgttgcggtctcgcgctggccctgaataaactcagtcagtatttagacagcagtcaggttaagccactttttcagtttttcgtgcctgacgccctcaacgatagacaccctgatgtgcgaaagtgtatgctggacgctgccctcgcgaccctcaacacacatggaaaggagaacgtgaattcactcctgcctgttttcgaagagtttctaaaaaacgccccaaatgacgcttcatatgacgctgtgcggcagagcgtggtcgtgctcatgggatctctggccaagcatcttgacaagtctgatccgaaagtcaaaccaatcgtcgcaaaactcattgcagcactttcaacaccaagccagcaggtacaagagagcgtggcctcatgtctgccccctctcgttccagccataaaggaagatgctggcggaatgatccaacgcctgatgcagcaactgttggagtccgacaaatacgccgagcggaagggcgcagcatacgggcttgctggtttggtgaagggccttggcattctgtcgctaaaacagcaggaaatgatggcagctcttacagatgctattcaagacaagaagaattttcgacgcagagaaggtgctctatttgcattcgaaatgctctgtaccatgctgggaaaactttttgagccgtatgttgttcacgtgctgccgcatctgttactctgcttcggagacgggaaccaatatgtccgagaggctgcggatgactgtgcaaaggccgtgatgtctaatctgtccgcccacggggtgaagctggtcctccccagtttactggccgctttggaggaagaaagctggcgtaccaaggctggtagcgtggagttgttaggtgctatggcctattgcgctccaaagcagctctccagctgcctgcccaacattgtccctaagctaactgaggtactgaccgactcgcatgtaaaggtgcagaaagccggacagcaggcgcttaggcaaatagggagtgtgattcgcaatcctgagatcctggcaatcgccccagtgttgctggatgcactgaccgaccctagtcggaagacgcagaaatgcctacaaaccctactagataccaagttcgttcactttatagacgccccttcccttgcgctaattatgcccatagtgcagcgggcattccaggacaggagcacagacacccgcaaaatggccgctcagataatcggtaatatgtactcgttgactgatcaaaaagatctcgccccttatttacccagtgtgacccccggtctgaaggctagcctccttgaccccgtccctgaggtccggactgtttccgcaaaggcgcttggcgctatggtgaaaggaatgggtgaaagctgttttgaagacctgctgccctggttaatggaaactctgacctatgagcaatcctctgttgatcgcagcggcgctgctcagggcctcgcagaggtgatggccggacttggagttgagaaactcgaaaaactaatgcccgagatcgttgcgacggctagtaaggtcgatattgcaccgcatgtgagggatggctacattatgatgtttaactatctgccaatcacttttggggacaagttcacaccttacgttggccctataatcccctgcatcctgaaggcattagccgatgaaaatgagttcgttcgtgatactgcactgcgcgctgggcagcgggtgatctcaatgtacgctgaaacagctattgctctgttgctgcctcagctggagcaaggcctgtttgatgatctgtggcgaatccgcttttcttcagtccagctgctgggagacctgctctttcatatttctggtgtgacagggaaaatgactactgagacagccagtgaggatgataactttggaacagcgcagtccaataaggctattatcaccgccttaggcgtggaacggagaaacagggtactagccggattatacatgggaagaagcgatacacagctagtcgtgcgccaggcatctctgcacgtctggaaaatcgtagtctcaaacactcctcgaacccttcgtgagatcctacctactctattcggcctcctactgggatttctggcgtcaacatgtgcagataagcgcactattgccgcacgcaccctgggcgatctcgtgagaaagctgggagaaaagatcctccccgaaattataccgattctggaagaagggctgcgtagtcagaaatccgatgagaggcagggagtctgtatcggactgtccgagatcatgaaaagcacttcacgcgacgctgttctctacttctctgagtccttagttcctactgccaggaaagcactctgcgatccactggaggaggtcagagaggctgcggctaaaacattcgaacaattgcactccacaattggccatcaggctctagaggacatcttgccatttttgctgaagcaactggacgacgaagaggtttctgagtttgccttggatggtctgaagcaggtcatggctataaaatccagagttgtcttgccatatctggtccccaagctcactactcctccagtgaacactcgggtgctggctttcctctccagcgtggccggagacgccttgacaagacatctgggggtgatcctgcccgctgtcatgctagcgttaaaagagaaacttgggaccccggacgagcagctggagatggctaactgtcaggcggttatcctttcggtggaggatgacaccgggcacaggattattatagaatatctccttgaagccaccaggagccctgaggtggggatgcggcaagcagcagcaatcatcttaaatatctactgttcccggtctaaggcagactataccagtcaccttaggtctctggtgtccggattaatacgtttgttcaacgattcctctccggtcgtcctggaagaatcctgggacgctctgaacgccatcaccaagaagttggatgcaggaaaccagctggcattgattgaagagcttcataaggagataagactaatcggaaacgaaagtaaaggtgaacacgtgcccggtttttgcctgcctaaaaagggcgtcacatccattctccccgtgttacgcgaaggggttctcactggttctcccgagcagaaagaagaagctgccaaagctcttgggctcgtaataaggttaacatccgctgacgccctgaggcccagcgtcgtcagcattaccggacctctgatccggatcctgggggatcggttttcctggaacgtgaaagctgctttattagagactttgagtctgctgctggccaaggtgggaattgccctgaaacccttcctgccacagctccagaccacttttacaaaggccctgcaggactctaaccggggagtcaggctaaaagcggctgacgcactgggaaagttgatctccattcacatcaaggtggaccctcttttcactgagttactgaatgggattcgggcaatggaagaccctggcgttagagatacgatgctccaggccctcaggttcgtgatccaaggagctggcgcaaaagtcgacgctgtcattagaaagaatatcgtctctctgcttctgagcatgcttggccacgacgaggacaacactagaattagcagtgctggatgcctcggagaactatgcgcctttctaacagaggaagagctttccgcggtgttacaacaatgcctgctggccgatgtgtccggtattgactggatggtaaggcacggtaggtccttggccctgtctgttgctgtgaacgtggcgccagggagactttgtgccggacgctactcctctgacgtgcaggaaatgatcttgagtagcgccaccgctgaccgcattcctattgccgtgagcggcgtgagaggaatgggcttcctgatgcgccaccacatcgaaacaggtgggggtcaacttccagcaaaattaagcagcctgttcgtgaagtgtctgcagaatcccagtagcgacataagactggtggcagaaaaaatgatctggtgggccaataaagatcctttaccaccattagatcctcaagccattaagcccatactcaaggcactgctagataacactaaggacaagaacacagtggttagagcttactcagatcaggccatcgtaaatctcctaaagatgaggcagggagaggaggtttttcaatctctgtctaaaattttagacgtggccagtctcgaggtccttaacgaggtgaatcgaagatctctcaagaaattggcaagccaagccgatagcacagagcaggtggacgatacaatcctgaccta

SEQ ID NO: 224406 - DNA, 1443 bp, Artificial Sequence
  Description of Artificial Sequence: Synthetic coding sequence
atggcacagcatgacttcgctccggcatggctgaatttccccacgcccccatcttccaccaaggtcctgacgtcttccttgaagtcaagcttgaattttgaaaaacactctgagaatttcgcatggacggagaacagatatgatgttaatagaaggcggcacaatagctctgacgggttcgatagtgcaataggtcgccctaacgggggaaatttcgggcgtaaggaaaagaatggctggcgcacccatgggaggaatgggaccgagaatattaatcacaggggcggttaccatggaggttcttcaagaagcaggtcttctatcttccacgccggaaaatctcagggcctgcatgaaaataatattcctgacaacgagaccggcagaaaagaggataaacgtgaacgcaaacaatttgaggccgaggacttcccttcgcttaaccctgagtacgaacgcgaaccgaatcacaacaagtcactggccgctggagtgtgggaatacccccctaacccgaagagtcgagctccccgaatgctggtgatcaagaagggcaacaccaaagatctgcaactctcgggctttcctgtggtggggaatctgccgagtcagccagtgaagaacggcaccggccctagtgtgtacaagggtctagtccccaagcccgctgctccccctactaagccaacccagtggaagtcccagactaaagagaacaaggtcggcacttcttttcctcacgaaagtaccttcggagtggggaatttcaatgcctttaagtctaccgccaaaaatttcagcccatccactaacagtgtcaaagaatgcaatcggagcaatagttccagccctgtggataagcttaatcaacagccgaggctcacaaagctgacgcgcatgcgcaccgacaaaaagtctgaatttctgaaagcactgaagagagaccgagtggaagaagaacatgaggacgagtccagggctgggtccgaaaaggacgacgactctttcaacttacacaacagtaactccactcatcaggaacgggacatcaatcgcaactttgatgaaaacgaaattcctcaggaaaacggtaatgccagcgtgatcagccagcagataataaggagtagtacgtttccccagacagacgtgctgtcgtcgtctctggaggctgagcaccgcctccttaaagagatgggttggcaggaggactcggagaatgacgaaacctgtgctccattgacggaagacgagatgcgcgaattccaggtgatatccgagcagttgcagaaaaatggactccgaaaaaacggcatactgaaaaacggattgatctgcgatttcaagtttggcccttggaaaaactccacttttaagcctaccaccgagaatgacgacacagagacaagcagtagcgacactagtgacgacgatgatgtatag

SEQ ID NO: 224407 - DNA, 1482 bp, Artificial Sequence
  Description of Artificial Sequence: Synthetic coding sequence
atggcccaacatgatttcgctccagcctggcttaatttcccaacacctccgtcctccacaaaaagttctctgaatttcgagaagcacagtgaaaatttcgcctggacagagaacaggtatgatgtcaaccgaagacgtcataatagttccgacggatttgactctgctatcgggaggccaaacggtggaaacttcggtcgcaaagaaaagaatggatggcgcactcatggccgaaatggcaccgagaacatcaaccatcgcggagggtatcacggcggttcatctagaagtcgcagctccatcttccacgccggaaagtctcagggcctgcacgagaataacataccagataatgaaacggggagaaaggaggataagcgcgaaaggaaacagtttgaagctgaagactttccctcgttgaaccctgagtatgaacgagaacccaaccacaacaaatccctggccgctggagtctggggcctccatgctcagactcacacctatcctaccaaaaagataagccaggcaccactgcttgagtatcctccaaaccccaagtctagggccccacgaatgctcgttattaagaagggtaataccaaggatttacagctttccggatttcctgtagtgggaaatctgccgagccagcctgtgaagaatggcaccggaccctccgtttacaaaggcctggtcccaaagccagccgcacctcccacgaagcctacacagtggaagtcccagactaaagagaacaaggtgggcacctcctttcctcatgagagcacctttggagtaggcaactttaacgcgtttaagtccactgccaagaacttctccccctctacgaatagcgtgaaagagtgcaacagaagcaattcttcctctcccgtcgacaaacttaatcagcagccacggctcaccaaactgactcgcatgcgtactgacaaaaagtccgaatttctcaaagccctgaaacgtgatagggttgaagaagagcatgaggatgaatcacgcgcagggagcgaaaaggacgacgattctttcaatctgcataattctaactccacccatcaggaacgtgacataaatcggaacttcgatgaaaacgagattccccaagagaatgggaatgcttcagtgataagtcaacaaatcatcaggagcagtacatttccacagactgacgtcctctccagctcactggaagcagaacaccgacttttgaaggaaatgggttggcaagaagatagtgagaacgatgagacttgtgcccctctgacggaggacgaaatgagagaatttcaagtgatttcagagcagcttcagaaaaatggtctgagaaaaaatggcatcttgaaaaacgggctgatttgtgactttaagttcggcccatggaaaaactcaacatttaaaccgacaacagagaatgacgacaccgaaaccagtagcagcgatacaagcgatgatgacgacgtctag

SEQ ID NO: 224408 - DNA, 1482 bp, Artificial Sequence
  Description of Artificial Sequence: Synthetic coding sequence
atggctcagcatgatttcgcccctgcctggcttaatttcccgacgcctccaagttccactaaatcatcactgaactttgaaaagcacagtgagaattttgcttggacagagaaccgttacgatgtgaacagacgacgccataactcatctgacggcttcgactctgccattggcagaccaaacgggggaaacttcggacgcaaggagaaaaatggctggcgtacccatgggagaaatggcacagagaacatcaaccacagaggcggttatcacgggggatctagccgctctagaagctctatctttcacgcaggcaagagtcagggccttcacgagaacaatatcccagacaacgaaaccggccgaaaagaggataaacgtgagcggaagcaattcgaagcagaggattttccaagcctgaaccccgagtacgaaagggagccgaaccacaataagagccttgctgcgggagtgtgggggctccacgctcagacccacacctatcccactaagaaaatcagtcaggcgccactgttagaatacccccctaaccccaagtcccgtgcaccgcgtatgcttgtgattaaaaaaggaaatacaaaagatcttcaactctcaggctttcctgttgttggaaacttgccgtctcagccagtcaagaatggtacagggccatctgtttataagggcctggtccctaagccggctgcccctcccaccaaacccacacagtggaagagccagaccaaagagaacaaggtcggaaccagtttcccccacgagagtacatttggtgtgggaaattttaacgcttttaaaagcactgctaaaaacttttcccccagtacaaattccgtcaaagaatgcaatcgatctaacagtagctccccggtggacaagctgaatcagcagccccgtctcactaaattgacaagaatgagaactgacaagaagtccgagttcttgaaggcactgaagcgggatcgggtcgaggaggaacacgaagatgagagtcgggcaggatcagagaaggatgacgatagctttaacctgcacaacagcaattccactcaccaggaacgagacatcaaccgcaatttcgatgaaaacgaaatacctcaggagaatgggaatgcctccgtgatctctcagcagatcatcaggtcatcaaccttcccccagaccgacgtgctgagcagttcactggaggctgagcaccggctattgaaggagatgggttggcaagaagactctgaaaacgatgagacgtgcgcccctttgacagaggatgaaatgagagagtttcaagtgataagcgaacaactgcagaaaaacggactaagaaaaaatggaattcttaaaaacggtctgatttgcgactttaaattcggcccttggaagaactccacattcaaacccaccaccgagaacgatgacacggagacatcctcatcggatacctccgacgacgacgatgtgtag

SEQ ID NO: 224409 - DNA, 1422 bp, Artificial Sequence
  Description of Artificial Sequence: Synthetic coding sequence
atggctcagcacgactttgcccctgcttggctgaacttcccaacccctccatccagcacaaagagctcattaaacttcgagaagcactcagaaaatttcgcttggaccgagaatcgctacgatgtgaatagaagaagacacaacagctcagatggcttcgactccgccatcggacggcctaacggcggaaatttcggcaggaaagagaaaaatgggtggagaacccatgggaggaatggcacggagaatatcaatcaccggggtggctatcacggaggctcctcgcgctctcgcagctcaatatttcacgctggcaagagccaaggccttcacgaaaacaacattccagataacgaaacaggaagaaaagaggataagagggagaggaagcagtttgaggcggaggactttccctcacttaaccctgagtacgagcgtgagcccaaccataacaagtctctagctgccggagtttgggaatacccgcctaacccaaaatcccgcgctccaagaatgctggtgatcaaaaagggcaatacaaaggacctacagctgtcaggcttccctgttgtaggcaacttgcctagtcaacctgttaaaaatggcacaggtccctctgtgtataaaggactggtgcccaaacctgctgcaccccctacaaagcccacacagtggaaaagtcagactaaggaaaataaagtgggaacctcttttccacatgaatcgacctttggcgtgggcaacttcaatgctttcaagagcacagcaaagaacttttcaccgagtaccaattctgtgaaggagtgcaatagaagcaattccagttctcctgttgacaagctgaatcagcagccacgcctgacgaaactcacccgcatgcgcacagataaaaagagtgagttcttgaaggcactcaagcgggatagggtcgaggaagagcatgaagatgaaagccgggctggaagcgaaaaggatgacgacagcttcaatctacacaattcgaactccacgcatcaggagcgagacataaacagaaattttgatgagaatgaaatccctcaggaaaatggtaacgctagtgtgatctcacagcagatcatccgatcgtctaccttcccacagacagacgttctatcctctagcttggaggctgaacatcggttgttgaaggaaatgggttggcaagaagattcggaaaatgacgagacatgtgcacccctcacggaagacgagatgcgggagttccaggtgatcagcgagcaattacagaagaatggtctgaggaagaatggaattcttaagaacggcctaatttgcgattttaaattcggtccctggaaaaacagcaccttcaaacccaccaccgaaaacgatgatacggagaccagttcatccgatacatcagacgatgacgatgtgtag

SEQ ID NO: 224410 - DNA, 1398 bp, Artificial Sequence
  Description of Artificial Sequence: Synthetic coding sequence
atggcccagcacgattttgccccagcgtggttaaacttccccacgcctccctcctcgaccaaagtgctgacgtcaagcctcaagtcaagcctgaacttcgaaaagcatagtgaaaatttcgcctggacagaaaataggtacgacgttaatcgtcgcaggcataactcatctgacggctttgacagcgcgatcggaagacctaatgggggtaacttcggcaggaaggaaaagaatggctggcgcacgcacgggagaaatggaacagagaacattaatcaccgcggagggtatcatggcggttcttccaggtcaagatctagcatcttccacgccggtaagagtcaagggctccacgaaaacaacatacccgacaacgagaccggcagaaaggaagataaacgggaaagaaagcagttcgaagccgaagacttcccatcactcaatccagaatatgagcgggaacctaatcataataagtcattggctgcaggggtttgggagtatcctcccaacccgaagtcacgcgcaccacgtatgttggtcatcaagaagggtaataccaaagatttgcagttatccggcttcccagtggtcggcaatttaccatcccaacctgtgaagaacgggacaggcccttccgtgtacaaaggtctcgtaccgaagccagcagctcctcctacaaaacccacccaatggaagtcccagacaaaggaaaacaaagtgggtaccagcttcccccatgaatcaactttcggagtcggcaattttaatgcctttaagagtacggcaaagaacttctcgcccagcactaactctgttaaggagcaacctcggcttaccaagctgacaagaatgagaacagataagaaatccgagtttctgaaggcactgaaacgggaccgagtcgaggaagaacacgaagatgaaagccgcgcaggcagcgagaaagacgacgactcttttaatctgcataactctaacagcacacatcaggagcgggatattaataggaatttcgatgagaacgaaatccctcaagagaacgggaacgccagtgtgatatcccaacagattatacgatcatcaacttttcctcagaccgatgtgcttagcagctcccttgaagccgagcacaggcttctcaaggagatgggatggcaggaagacagcgagaatgacgagacctgtgcccctctcacagaggatgagatgcgtgagtttcaggtgatctcggagcagctgcagaaaaatggcttacgaaaaaacgggatcctaaagaatggcctgatctgcgacttcaagttcggcccttggaagaatagcacctttaagccaaccaccgaaaatgacgatacggagacgagtagctcagacacatcagatgacgacgatgtctag

SEQ ID NO: 224411 - DNA, 909 bp, Artificial Sequence
  Description of Artificial Sequence: Synthetic coding sequence
atgctggtcatcaagaaaggcaacacaaaagacctccaactgagtggtttcccggtggtgggcaacctgccctcacagccagtgaagaacgggacggggcctagcgtgtataaaggactggtcccaaaacctgctgccccacccacgaagcccacccaatggaagtcacagacgaaggaaaataaagtgggcaccagctttccccacgagtccactttcggagtgggaaacttcaacgctttcaaatccacagcgaaaaactttagcccctctactaattccgtcaaagaatgtaatcgcagcaactcaagtagcccggtggataagcttaatcagcaacctcggttaacgaagctgacccgtatgaggaccgacaagaaaagtgaatttctgaaagctctcaaaagagacagggtcgaggaggaacacgaggatgaatcccgcgctggttccgagaaggatgacgactcattcaacctccataacagcaactctacacaccaggagagagacattaatcgaaattttgatgagaacgaaatcccacaagagaacgggaacgccagtgtcattagccaacagattatcagatcttccacttttccccaaacagacgtcctcagttcctcgctagaggccgaacacagactcctaaaggagatgggatggcaggaggactcagagaacgacgaaacttgcgccccactgaccgaggatgaaatgcgggaattccaagtaatctccgagcagctgcagaaaaatgggctgagaaaaaacgggatattgaagaacggattgatttgtgattttaaatttgggccttggaagaattctacctttaagcctacgacagagaacgatgataccgaaacatcatcatccgataccagcgacgatgacgatgtctag

SEQ ID NO: 224412 - DNA, 1443 bp, Artificial Sequence
  Description of Artificial Sequence: Synthetic coding sequence
atggcacagcacgacttcgcaccagcttggctgaatttccctacaccccctagctccaccaaggtgcttagcaatactttgaaaagctccttgaacttcgagaaacacagcgagaattttgcctggaccgagaaccggtacgacgtgaaccggcgaaggcataactctagtgatggctttgattccgctatcggacgccctaatggcggtaacttcggtagaaaagagaagaacggatggagaactcacggcagaaatggtacggagaacattaatcaccgtggcggttaccacgggggaagctcaaggtcacgcagtagcatattccacgcgggaaagtcacagggtctgcatgaaaacaacattcctgacaacgaaactgggcgtaaggaggacaagcgcgaaagaaagcagttcgaggccgaggatttcccaagcctgaaccccgagtacgaacgggagccgaatcacaacaagtcacttgcggctggcgtatgggagtacccgcctaatcctaaaagtagggcccctaggatgctggtcatcaaaaagggtaacacaaaagacctgcaactgtccgggtttcctgtcgtaggcaatctcccttcacaaccagtgaaaaatggaaccgggcctagcgtgtataagggtctggttccaaaaccggcagctccaccaacaaagcctacgcagtggaagtcccagactaaggagaacaaagttggtaccagttttccacatgaatctacctttggagtgggcaatttcaatgcttttaagagcactgcaaaaaatttcagcccctccacaaactcggtaaaggaatgcaacaggagtaactcaagttcacccgtggataagctcaaccagcagccacgattaaccaagctgactagaatgagaacggataagaagagcgaattcttaaaggctctgaaacgtgatagggtggaagaggagcatgaagatgagtctagagcgggttccgagaaggatgatgactcctttaatctgcacaattcaaatagcacacaccaagagcgggacatcaatcgcaatttcgacgaaaacgagattcctcaagaaaatggcaacgcgagcgtcattagccagcagattatacggtcttcaacgttcccacagaccgatgtattgtctagttccctggaagccgaacatcggctgttaaaagaaatggggtggcaggaagactccgaaaatgacgagacatgcgcaccgctaacagaagacgagatgcgagaattccaagtcatcagtgagcaactccaaaaaaatgggttgagaaaaaacggaatcctaaagaatgggctgatctgcgattttaagttcggtccatggaagaacagcaccttcaaacccaccacagaaaatgacgataccgagacctctagtagtgatactagcgatgacgacgacgtgtag

SEQ ID NO: 224413 - DNA, 1383 bp, Artificial Sequence
  Description of Artificial Sequence: Synthetic coding sequence
atgttcctggctaccctttatttcgcacttcctctgttggatctgctgctgagcgcggaggtttcagggggtgataggctcgactgcgtcaaggcttcggaccaatgcctgaaagaacagtcatgttcaaccaagtatcgtaccttaagacagtgcgtagctgggaaagaaactaatttctccctcgcttctgggttagaagccaaggacgagtgcaggtctgccatggaggccctgaagcaaaagtccctttacaattgtcgctgcaaacgagggatgaaaaaagagaagaattgcctacgtatttactggagcatgtaccagtccctccaaggcaacgatctgcttgaggattccccatatgaaccagtgaattccagactgtccgacatctttagagttgtgcccttcatctctgtggagcatatacctaagggcaataactgcttggacgccgctaaagcttgtaacctagacgatatctgcaagaagtaccgttctgcttacatcaccccctgcactacgagcgtttcgaacgacgtgtgtaatcggagaaagtgtcacaaagctcttagacagttcttcgacaaggtgccggctaagcacagctatgggatgttgttctgcagctgcagggacatcgcctgtactgagcgccgacgccagacaattgtaccagtttgctcatacgaagagcgggaaaagcctaattgcctgaatctgcaggactcctgcaaaacgaactatatttgtcgatcccgtctggcagatttcttcacaaattgtcagcccgaaagcaggagcgtgagtagttgtttaaaagagaactatgccgactgcctgctggcttactccggactcatcggcacagtgatgaccccaaattacattgactccagctctctctccgtggcgccttggtgcgactgttctaatagtggaaatgatcttgaggagtgcctgaaattccttaatttcttcaaagacaatacttgcttaaagaatgcgatccaggcctttggcaacggcagtgatgttaccgtgtggcagcccgctttccctgtacagacaacgaccgcaaccaccactaccgctctccgagttaagaacaagccgctgggcccagccggttcagaaaacgaaatcccaacgcatgtcttgcctccttgtgctaatcttcaggctcagaagctcaagtctaacgtctcaggtaacacccatctgtgtatatccaatgggaattatgaaaaggagggcttgggagcttcctcccacatcaccaccaagagtatggccgcacccccatcgtgtgggctgagccccctgttagtgctggtggttacagcactaagtacccttctctccctgacggaaacatcctag

SEQ ID NO: 224414 - DNA, 1383 bp, Artificial Sequence
  Description of Artificial Sequence: Synthetic coding sequence
atgttcctcgcgaccctatatttcgcgcttcccctgctagatcttctgttaagtgcagaggtcagtggaggagatcgcttagactgcgttaaagcctctgaccaatgcctcaaagaacaaagctgcagcaccaagtatcgtactctaaggcagtgcgtcgccggtaaagagaccaatttttccctggcgtccgggctggaggctaaggatgaatgcagatcggcgatggaggcactcaaacagaaatccctgtacaactgtagatgcaagcgtggcatgaagaaagaaaagaactgtctgcgcatttattggtctatgtatcaatcattgcaaggaaacgaccttctcgaagattccccttacgagcctgttaattcccgcctgtctgatatcttcagggtggtaccattcataagcgtggagcatatccctaagggcaataactgtctcgacgcagctaaggcctgcaatctggatgatatctgcaagaaatatcgctccgcctacatcaccccctgtacaactagcgtctcgaacgacgtctgcaatcgcaggaaatgccacaaggccctaagacagtttttcgacaaagttcccgctaaacacagttacgggatgctattctgctcatgtagggatattgcatgcaccgaaagaagacggcagacaatcgtgcctgtgtgcagttacgaggagcgtgagaaacccaactgcctgaacctgcaggattcctgcaaaactaactacatttgcagatcccgtctcgccgacttcttcacgaactgccaaccagagagtcgctctgtgagttcttgtttaaaggagaactatgctgattgcctgctggcgtattctggattgatcggtactgtgatgacaccaaattacatcgatagttcctctctgagtgttgctccatggtgcgattgttccaactcgggcaacgacttggaagagtgtctgaagtttctcaacttctttaaagacaacacctgcctaaagaacgctatccaggcctttggcaacggaagcgacgtgactgtgtggcagcccgcttttcccgtgcaaacaacaacagccaccaccacgacagcgctgcgcgtgaaaaataaacctcttggtccggctggcagtgaaaatgagataccgactcacgtccttcccccttgcgccaacctgcaggcccagaaactgaaaagtaacgtttccgggaacacccatctgtgtatcagcaatggaaattacgagaaggagggcctgggcgcaagctcacacatcaccacgaaatctatggccgcacctccaagctgcggcctgagccctttgctggtgctcgtcgtgaccgcgctctccacactcctgtccctgactgagacaagctag

SEQ ID NO: 224415 - DNA, 1383 bp, Artificial Sequence
  Description of Artificial Sequence: Synthetic coding sequence
atgttccttgccacactgtactttgccttgccgctgttggatctgctgttaagcgccgaggttagcggaggcgatcggctggactgcgtcaaggcttctgaccaatgtctgaaagaacagtcatgttctacgaaatacaggaccctgagacagtgcgtggcagggaaggagactaactttagtctggctagcggactggaagccaaagatgaatgcagatctgctatggaagccttgaaacagaaatcattgtataattgtcgatgtaagaggggcatgaaaaaagaaaaaaattgcctgaggatatactggtccatgtaccaatcacttcaaggaaatgacctgttagaggatagtccctacgagcccgtgaactccaggttgagcgacatatttagagtggtgccatttatctctgtggaacacattcctaagggaaataactgcttggacgccgcaaaggcttgcaatctcgacgacatttgcaagaagtaccgcagtgcttatataaccccctgtacaactagcgtctcaaacgatgtgtgtaatcggcgtaagtgccataaggctctgagacaattttttgacaaggtcccggcaaagcactcttatggcatgttattttgtagttgtcgagatatcgcgtgtactgaaaggcgccgtcagactatcgtccccgtttgttcatatgaagagagagagaagcctaattgtctgaacttacaggactcatgcaagaccaattatatctgcagatcacgattagcagacttcttcacaaattgccagcccgagtcccgttctgtcagcagctgcctcaaagaaaattatgcagattgtttactggcctattcaggcttgatcgggacagtgatgacacctaattacatagactcttcctccttatctgtggcaccttggtgcgattgtagtaactcaggcaatgacctggaagaatgcctaaaatttcttaacttctttaaagacaacacttgcttgaagaatgcaattcaggcctttggcaatggctcagacgtaacagtgtggcagcccgcttttcctgtacaaacaaccactgctaccacaacaaccgcgctgcgcgttaagaataagccactcggacctgccggatcggagaatgagatccccactcatgtccttccaccttgtgcgaatcttcaagctcagaagctgaaaagcaatgtgtccggaaatacacatctgtgtatcagtaacggcaattatgaaaaggaggggctaggggcaagttcacacatcacaactaagtcaatggcagcacccccaagttgcggactgagtccgctcctcgttcttgttgtgaccgcgttaagcactctgctgagcctgactgagaccagctag

SEQ ID NO: 224416 - DNA, 1398 bp, Artificial Sequence
  Description of Artificial Sequence: Synthetic coding sequence
atgttcttggctaccctttattttgccctgccgttgctggatctgcttctttccgccgaagtttcaggcggagacagattggattgcgtaaaggccagcgatcagtgcctcaaggagcagtcgtgctcaaccaagtacaggacactaaggcagtgcgttgccggaaaggaaacaaacttctcattggcatcaggcctcgaggcaaaggacgaatgtcgcagcgctatggaggcactgaagcagaagagcctatacaactgccgctgcaaacgaggaatgaaaaaggagaagaactgcctgagaatctattggagcatgtaccaatccctgcaaggaaatgatctattggaggacagtccttacgagccagtgaatagccgtcttagcgacatctttagagtggtgccttttatcagtgatgtgttccagcaggtggagcacattcccaaggggaacaattgtctggacgccgctaaagcttgtaacctggatgatatctgtaagaaataccgttccgcctatatcactccctgcaccacttctgttagcaatgacgtttgcaatcgtcgtaagtgccataaggccctgcgtcagttctttgacaaggtaccagccaagcactcttatggaatgctgttttgttcctgccgcgatatcgcttgtaccgaacggaggcgccagaccattgtgccagtgtgctcctatgaggaaagagaaaaacctaattgcctaaatttgcaggactcttgcaagaccaattacatctgtcgctcccggctggctgatttctttaccaattgccagccagagtctagaagcgtgtctagttgtctaaaagaaaattacgcagactgcttgctggcctactcgggcctgatcggcacggttatgacgccaaactatattgacagctctagcctaagcgtggccccttggtgtgactgcagcaattccggaaatgacctggaggagtgcctcaagttcctcaatttcttcaaggataatacttgtcttaagaacgctattcaggcgtttggcaacggctctgatgtcaccgtctggcaacccgcattccccgtacaaacaactaccgcaacaactacaaccgctctgcgagtgaaaaataagcccttgggccctgccggaagcgagaacgagatccctacacatgtgctgccaccatgcgctaaccttcaggctcagaagttgaagtcaaatgtgtccggcaacacccatttgtgtattagcaatgggaattacgaaaaagaaggcctaggcgcaagtagccatatcactacaaagagcatggctgcccctccctcatgtggactatcccctctgctggtgctcgtggttacagccctgtccacgctgcttagcctgaccgagacgtcttag

SEQ ID NO: 224417 - DNA, 1035 bp, Artificial Sequence
  Description of Artificial Sequence: Synthetic coding sequence
atgcaggaggggaaattctggaaaggaatggctgaaacagggatgtggggatgcggggagtggatacccgtggagcatattcctaagggtaataactgcctggacgcggctaaggcttgtaatctcgatgatatttgtaagaaatacagaagcgcatatatcacaccatgcaccacatcggtgtctaacgacgtttgcaaccgccgaaaatgccacaaggccctcagacagttttttgacaaggttccagccaaacatagttacgggatgctgttttgtagctgcagagatatcgcttgcacagaacggaggcgccagactatagtccccgtgtgcagctatgaggaacgcgagaaaccgaattgcttgaacctccaggatagttgcaagacaaattatatatgcaggagcaggctggccgattttttcacaaactgtcagcctgagtcccggagtgtttccagctgcctcaaagagaactatgcagactgcttattggcctacagtgggctgatcgggaccgtaatgacccctaattatattgatagctcctcgttgtccgttgccccatggtgcgactgttccaatagcggcaacgacctggaggagtgtctgaaatttctgaacttttttaaggataatacttgcctaaagaacgccattcaagcctttggcaacggaagcgatgtaactgtctggcagcccgcatttcccgtgcaaaccactaccgctacaactacgaccgcactgagggtaaagaataaaccactcggcccagctggtagtgagaatgagatacctacgcacgtgctaccaccatgcgccaacctccaggcacagaaactcaaatctaacgtttcagggaatacgcacctgtgcatcagcaacggaaactatgagaaggagggactgggggcttcgtcacacattactactaagtcaatggccgcaccccctagctgtgggctctctcctctgctggtattagtggtgactgccctgtccacgctgctgtctttgaccgagacatcctag

SEQ ID NO: 224418 - DNA, 1080 bp, Artificial Sequence
  Description of Artificial Sequence: Synthetic coding sequence
atgatcttggcaaatgtcttctgtctgttcttcttccttggggaggagttctatgaggcgtcaccatatgagcccgtgacatcaaggctgagtgacatctttaggctggctagtatcttcagcggcaccggagcagacccagtcgtgagcgccaagagtaatcactgcctggacgcagcaaaggcatgtaacctcaacgataattgcaagaaacttagaagttcttatatctctatctgtaacagggaaattagcccaactgaacgatgtaatcgtagaaagtgccataaggccctcaggcagttttttgacagagttccctcagagtacacttaccggatgctgttttgttcatgccaggaccaggcctgcgccgagcgcagaaggcagactatactcccatcctgtagttatgaagataaagagaaacccaattgcctggatctgaggggagtctgtcggaccgaccacctgtgcagatcacgtctggccgacttccacgccaattgtcgagcaagctaccaaaccgtgactagctgccccgcagacaactaccaagcttgcctcgggagttacgccggaatgataggcttcgatatgacacctaattatgtggactcctcacccacaggcatcgtggtttccccctggtgtagctgtcggggaagtggaaacatggaggaagaatgtgagaaatttctgcgagactttaccgaaaacccatgtctcagaaacgccatacaggcatttggaaacggaaccgatgtcaatgtgtcacctaaggggccatctttccaagctactcaggccccaagggtcgagaaaacgcccagtctcccagacgacctgagcgattctacctctctaggcacctccgtgatcactacctgtacctcggtgcaggagcagggcctgaaagctaacaatagcaaggagttgagtatgtgttttactgaactgacaactaatattataccgggatcgaataaggtcataaaacctaactccggccctagccgggctaggccctccgcggcattaaccgtgcttagcgtattgatgcttaagctagccctgtag

SEQ ID NO: 224419 - DNA, 1395 bp, Artificial Sequence
  Description of Artificial Sequence: Synthetic coding sequence
atgattctggccaatgtcttctgtctgttcttcttcctggacgagaccctgcggtcgcttgcgtccccctcatcattacagggaccagagctgcacggctggcgaccaccagtggattgtgttcgggctaatgagctctgtgccgctgaatcaaactgctctagcaggtaccgtacccttcgccagtgtctcgcaggaagagatcgtaatactatgctggccaataaggaatgccaggccgcactggaagtgctccaggagagccccttgtacgattgccgctgcaagagaggcatgaaaaaggaattgcagtgcttgcaaatatattggtcgatccacctggggttgacagagggtgaggaattttatgaagcctctccttatgaacctgtgaccagtagactctccgacatcttcagactggccagtattttcagtggaaccggcgctgaccctgttgtgtccgctaaaagcaatcactgcctggatgcagccaaagcctgtaatctcaatgataattgtaaaaaattacgatcgagctacatctctatttgtaaccgagagatcagccctactgagaggtgtaacagacgtaaatgtcataaagcactgcgacagtttttcgacagagtgccttctgaatatacataccgcatgctcttttgcagttgccaggaccaggcctgcgctgaaaggcgaagacaaaccatcctgccaagttgctcctacgaggataaagagaagcctaactgtctggacctccgcggagtctgtaggacagaccacctttgcaggtcccgtctagctgatttccacgccaactgtcgcgctagctaccagacagtcacatcctgccccgcagacaattaccaggcctgtttggggtcttatgccggtatgattggattcgacatgacccccaattatgttgatagctcgcccactggaatcgtcgtctcgccctggtgttcctgcaggggaagtggaaacatggaggaggagtgcgaaaaatttctcagagacttcacagaaaatccgtgtctaagaaatgccattcaggcttttggaaacgggacagatgttaacgtttcccccaagggaccgagttttcaggccacacaagcccctagggttgaaaaaactccttccttgcctgacgaccttagcgatagcacctcattagggacctcagtgatcactacatgtacttcagtgcaagagcagggtctaaaagccaataattcaaaggagctatctatgtgtttcactgaactgacaactaacatcatacctggaagcaataaggtaattaaaccaaattccggtcccagtcgagctagacctagtgcagctctgaccgtgctctccgttctgatgctgaaactggccctgtag

SEQ ID NO: 224420 - DNA, 996 bp, Artificial Sequence
  Description of Artificial Sequence: Synthetic coding sequence
atgattttggctaacgtgttctgcctgttcttcttcctgggcacaggtgccgatcctgttgtgagtgcaaagagcaatcactgtctggacgccgcaaaggcgtgcaatctcaatgacaactgcaaaaaactgcgaagtagctacatcagcatctgcaatagggagatatcccctaccgagagatgtaacaggaggaagtgtcataaagccttacgccaattttttgacagggttccgtccgagtacacatatcggatgctcttctgctcttgtcaggaccaggcatgtgccgagagacgtcgacaaaccatcctgccgtcttgctcatacgaggataaagaaaagcccaattgtctagatctcaggggtgtgtgtcgaacagaccacctctgccgcagcaggctggctgatttccatgccaactgcagagccagctatcagacggtgacatcttgtccggctgataattatcaggcctgccttggaagctacgccggaatgatcgggtttgacatgaccccaaattatgtggacagctcccccaccgggattgtggttagtccttggtgtagttgcagggggagcggcaacatggaggaagagtgcgaaaagttcctccgggattttacggagaacccatgcctgcgcaacgcgattcaggcttttggaaatgggaccgacgttaatgtctcaccaaaaggcccaagcttccaggctacacaagcgcctcgggtggagaagacgccctccctcccagacgacctgtccgacagcacttccttggggactagcgtgatcactacctgcacaagcgtgcaggaacagggcctcaaagccaataattccaaagagctgagtatgtgtttcacggagctgacaactaacatcattcctgggtcaaataaagtgataaaaccaaactctggccctagtagggcaagaccgagcgctgccctgaccgtgctgagcgtacttatgttaaagctggcgttatag

SEQ ID NO: 224421 - DNA, 798 bp, Artificial Sequence
  Description of Artificial Sequence: Synthetic coding sequence
atgattctggctaacgtgttttgcctgttcttctttctcgatgagacattgaggtctctggcgtctccttcatcactgcagggacctgaactgcacggatggaggccccctgtggactgtgtgcgagccaacgaactgtgcgctgctgagagcaattgttcttcgagatatagaacactgagacaatgtctcgctggacgtgatcgtaatacaatgctggcaaataaagaatgtcaggccgctctcgaggtccttcaggagtcacccttgtatgactgccgctgcaagcgcggaatgaaaaaagaactccagtgtctgcagatctattggagtatccacctagggttaaccgagggcgaggaattttacgaggcatcaccctacgagccagtaacatctcggctcagtgatattttccgtctggccagcattttctcaggaacaggggcagacccagtagtgtctgcaaagagcaaccactgcttagatgccgcaaaggcttgcaacctgaatgataactgtaagaagctccgaagctcatacatatctatctgcaatcgcgaaatcagtcctacagagaggtgtaatagacggaagtgccacaaggcactacggcagttcttcgatcgcgtgcctagtgaatatacatacaggatgttgttctgctcttgtcaggaccaagcctgtgcagagaggaggaggcaaacaatcctcccgtcttgttcctacgaggacaaggaaaaaccaaattgtcttgacttaagaggcgtctgtcgcaccgatcatctctgtcgttag

SEQ ID NO: 224422 - DNA, 1395 bp, Artificial Sequence
  Description of Artificial Sequence: Synthetic coding sequence
atgatcctggctaatgtgttttgcctgttctttttcctcgacgaaacacttcgcagcctcgcttctccttctagcctgcaggggccagagctgcatgggtggcggccaccagtagactgtgtgcgggctaatgagctgtgtgccgctgaaagcaactgctctagccgctacaggaccctccgccagtgcctggccggaagagatcgtaacacgatgctcgccaataaagaatgtcaggcagctctggaggttttacaagaatctccgctgtatgactgtcggtgcaaacgaggaatgaaaaaggagcttcagtgtctgcaaatatattggagcatacatctgggtctgaccgaaggagaggagttctatgaggcctcgccttacgagcctgtcacgtctcgcctttctgacatcttccggttggcaagcatcttctccggaaccggtgcagatcccgttgtgtccgcaaagagtaaccactgtctcgatgctgccaaagcctgcaatctcaatgacaactgtaagaagcttcgatctagctatatctctatatgtaatcgggagatcagccccacagaaagatgtaatcggagaaaatgccataaggcactgcgacagtttttcgaccgagtgccttcggagtacacataccggatgcttttttgctcttgccaagaccaggcctgtgcagagcgacggcgacagacaattctcccctcatgttcctacgaagacaaggagaagccaaattgtttagaccttaggggggtgtgtaggacggaccacctgtgccgctcccgcctggccgactttcacgccaattgccgagcttcatatcagactgtcaccagctgcccagctgataactaccaggcctgccttggatcctatgctggcatgatcggattcgacatgacccctaactacgtggactccagtcccaccgggatagtagtatccccctggtgttcatgtagagggtcaggaaacatggaagaagagtgcgaaaagttccttcgagattttacagagaatccctgcctccgcaatgctatacaggcattcggcaacgggactgatgtgaacgtaagcccaaaagggccttctttccaggctacacaggccccacgtgttgaaaaaacaccaagtctccccgatgacctttctgactcaacatccctgggtactagtgtgattacgacatgcacatcagtacaggaacagggattgaaggcaaataactccaaagagctaagtatgtgtttcaccgagttgaccacgaatatcatccccggttctaacaaggtaataaaacccaatagtgggccatcgcgcgctaggccgagtgctgctctaacagtgttgtccgtgctcatgttgaagctcgctctgtag

SEQ ID NO: 224423 - DNA, 1203 bp, Artificial Sequence
  Description of Artificial Sequence: Synthetic coding sequence
atggtgcggcctttgaatcccaggccattgcctcccgtagttctcatgctgctgttactgttgcctccctcccccttgccactggctgccggagatcccctgcctaccgagtcccgactcatgaactcctgcctacaggcccgtcgaaaatgtcaagccgatccaacctgctctgcagcctatcaccatttagactcttgtacctcctcaatttcaactccattaccctcagaggaaccatccgtgccagctgactgtctcgaggctgcccagcagcttcgtaattcgtctctgattggctgcatgtgccatagacgcatgaagaatcaagtcgcttgtctggacatctactggaccgttcatcgagcgagaagcctgggtaattacgaattagatgttagcccctatgaagacaccgtgacctctaagccatggaagatgaatctgagcaaactgaacatgctgaaacccgattccgatctttgtctgaaatttgcaatgctgtgtacactgaacgataagtgcgatcggctgcgcaaagcctacggagaggcttgttctggtccacactgccagcgccatgtgtgcctgcgccagctacttactttttttgaaaaggctgccgaaccgcacgctcagggactccttttgtgtccctgtgcgccaaacgaccggggatgtggggagcggcgaaggaatacaattgcacctaattgcgccctaccccctgtggccccaaattgcttggagctgcggaggctctgtttttctgatcccctgtgccgcagtaggctggtggattttcagacacattgtcacccaatggacattctgggaacgtgtgcaactgaacagtccaggtgtctgcgagcctatctgggactgatcggaactgcgatgacccctaactttgtgagtaatgtgaacacaagcgtggccctgtcatgcacgtgtcggggatccggcaacctgcaggaagagtgtgagatgctcgagggctttttcagccacaatccctgcctgaccgaagctattgcagccaaaatgaggtttcactcacagttgttttctcaggattggcctcatcctacgttcgccgtgatggcgcaccaaaacgaaaaccctgccgtgaggccgcagccgtgggttcccagtctattcagttgtaccctgcctctgatcctgttgttgagtttgtggtag

SEQ ID NO: 224424 - DNA, 1110 bp, Artificial Sequence
  Description of Artificial Sequence: Synthetic coding sequence
atggtacgtcctcttaacccgaggcccctgcctcccgtggtgttaatgctcctgctgctccttcccccttcacccctgccgcttgcggctggtgaccctctgccaaccgagtcacggctgatgaacagttgtctgcaggcgagacgcaagtgccaggcggatcctacctgcagcgccgcttaccaccatttagattcatgtacctcctcaataagtacccccctccctagcgaagagccttccgttcctgcagactgcctcgaagcagcccagcagttgagaaactcatccctgatcgggtgcatgtgtcaccggaggatgaaaaaccaagtcgcttgtcttgacatatattggactgtccatcgagctcggtcattggacagtgacctctgcctcaagttcgccatgctctgcaccctcaacgacaaatgtgacagactgcgcaaagcttacggagaagcttgcagcggaccacattgccagcgacacgtgtgtctgaggcaactgctaaccttttttgagaaggccgctgagccacacgcccagggtcttttgctgtgcccatgcgcacccaacgatcgcggatgtggcgagagacggaggaatacaattgctcccaattgtgctctaccccctgtcgcgccaaactgcttggaactaagacggttatgcttctcggaccccctgtgcaggtctaggctcgtggatttccaaactcactgtcaccccatggacattctgggtacttgtgcaaccgagcaatcccgctgcttgcgggcttatctcggtctgattggtaccgctatgactcctaattttgtctccaatgtcaacacttcagttgctctgagttgcacttgtaggggctccgggaatttacaagaagagtgcgaaatgctggaaggctttttcagtcacaacccgtgtctaaccgaagctatagccgctaagatgcgattccatagtcaactgttttcccaggactggcctcatcctacctttgcagtgatggcccatcagaacgaaaatcccgctgtgaggccgcagccttgggtgccttcactgttctcgtgtactctgcctcttattctcctcttgagtctgtggtag

SEQ ID NO: 224425 - DNA, 2136 bp, Artificial Sequence
  Description of Artificial Sequence: Synthetic coding sequence
atggagagcggggctgtgctgttggaatccaaaagcagccctttcaacctgctgcatgaaatgcacgaactacggttactgggacatctatgcgatgtgaccgtctccgtggagtaccagggggtgcgtaaggatttcatggcccataaggccgtcctggccgctacctcgaaattcttcaaagaggtgtttctcaatgaaaagagcgtagacgggacgagaacgaatgtttaccttaacgaagtccaagtagccgacttcgcgtccttcttggagtttgtctatacagctaaggtgcaagtggaggaggaccgtgtacaaaggatgctcgaggtggccgagaagctgaaatgcctggacctgtctgagacgtgtttccaactcaaaaagcagatgctggaaagtgttctgttggagctacagaatttctctgagtcccaggaggttgaggtgagctccggcagtcaggtgagcgcagcgcctgcccctcgcgcaagcgtggctactgatggtccgcacccaagtggactcacagactcgctggactaccctggcgagagagcctccaatggcatgtcctccgatttaccgcctaagaaaagtaaagacaagttggacaagaagaaggaggtggtaaagccaccctatccaaaaattaggcgcgcatcaggacgactggcgggtcgcaaggtgtttgtagagatcccaaagaagaaatacacaagaaggctcagagaacagcaaaagaccgcagaaggcgatgtcggcgactaccggtgtccgcaggatcagtcgccagacagagtcggcacagagatggagcaggtttccaagaacgaagggtgtcaggctggggctgaactcgaggaactgagcaagaaagccggacctgaggaagaggaggaggaagaagaagaggacgaagaaggagagaagaaaaaatccaactttaagtgttcaatttgtgagaaggcctttctgtacgaaaaaagcttcctgaagcattccaagcacaggcacggggtggcaacggaggtagtgtatcggtgtgacacctgcggccagacgtttgccaatcgctgtaacctgaaatcacatcagcggcacgtgcactcttctgagcggcatttcccttgtgaactgtgcgggaaaaaatttaaaaggaagaaagatgtcaaacgccatgttttacaggtgcacgaaggcggaggcgaaaggcatcgatgcgggcaatgtggcaagggtctctcttccaagactgctctgaggcttcacgagaggacacataccggagatcggccttacggttgtactgagtgcggagcgagattctcccaaccctcagccttgaagacacacatgcgcatccataccggcgaaaagccgttcgtgtgcgatgagtgtggcgcacggttcacacagaatcacatgctgatatatcataagcgctgccatactggagagagaccctttatgtgtgaaacatgtggtaaaagctttgcatccaaggaatatctaaaacatcataatcggatccataccggaagtaagcctttcaaatgtgaggtgtgcttcaggacctttgcccagcgtaattccctctatcagcatatcaaggtgcacaccggggaacgcccttattgctgcgaccagtgtgggaaacagttcacgcagcttaatgcattgcagagacatcgacggatacacaccggagagaggccattcatgtgtaacgcctgcggtaggactttcacagataagagcacactgagacggcacacctcaatacatgataaaaacacgccatggaagtccttcttggtcatcgtcgatggctctccaaagaacgatgacgggcacaagactgaacagccagatgaggagtacgtgtcctccaaactgagcgacaagctgctcagcttcgccgagaatggacacttccacaatctggctgctgtgcaagacacagtaccaacaatgcaggaaaatagtagcgctgataccgcttgtaaagccgatgatagcgtggtcagtcaagatacgcttttggcgacaactatctcagaattgagtgagttgaccccacagactgacagtatgcctacgcaactgcattccctatcgaatatggaatag

SEQ ID NO: 224426 - DNA, 2136 bp, Artificial Sequence
  Description of Artificial Sequence: Synthetic coding sequence
atggaatctggagcagtacttctcgaaagcaaatcctccccctttaatctgctgcatgagatgcatgaactacgtctcctcggccatctgtgcgacgtgaccgtgtccgtggagtaccagggcgtgaggaaagatttcatggcccacaaagccgtgctggccgctacaagcaagttttttaaggaagtttttctgaacgaaaagagtgtcgacggcactagaaccaacgtatatctcaacgaagtgcaggttgccgatttcgcctctttcctcgagttcgtatataccgccaaagtgcaggtggaggaagaccgcgtgcagaggatgctcgaagttgctgaaaaactcaaatgcctggatctgagcgagacatgctttcagctcaagaaacagatgctggaaagtgtccttctggagttacagaacttcagcgagtcgcaggaagtcgaagtgagcagtggcagtcaggtatcagctgcccctgcccctcgcgcttccgtcgcaactgatgggcctcaccctagcgggttgaccgatagcctagattatccaggggagagagctagtaacggcatgtcttccgatctgccacctaaaaagtctaaggataagctggacaagaagaaggaggtcgtcaagcccccttatcctaaaatcagacgggcaagcggccgactggccggtcgcaaagtgtttgttgagatccccaagaagaagtacactcggcgactcagagaacagcagaagactgccgagggcgacgtaggagattaccggtgccctcaagaccagtctcctgaccgggtggggactgagatggaacaggtttcaaagaacgaggggtgtcaggccggagctgagttggaagagttaagcaagaaggctgggccagaagaggaagaggaagaggaggaagaagacgaggagggggaaaagaagaagtctaatttcaagtgctcaatatgtgagaaggcctttttgtatgaaaagtcatttctcaaacacagcaaacacagacacggagtggcgaccgaggtggtgtacagatgtgatacctgtggacagacctttgcgaaccggtgcaacttaaagtcgcaccaaaggcacgtacactcttctgaaaggcactttccctgtgagctttgtggaaagaagttcaagcgcaagaaagatgtcaaacgtcatgttctccaagtccacgagggaggtggagagaggcaccggtgcgggcagtgcggcaaagggctaagctcaaaaacggctctacgtttgcacgagaggacacacaccggagatagaccttacggctgtacagaatgtggggctcggttcagtcagccatccgcacttaagacacacatgcgcatccacacgggggagaagccttttgtctgtgatgagtgcggggctcggttcacacagaaccacatgctcatatatcataagcggtgtcacacaggagagcggcctttcatgtgtgagacatgcggtaagtcttttgccagcaaagagtacctcaagcatcataacagaatccataccggcagcaagcccttcaagtgcgaggtatgcttccgcaccttcgcccagcggaatagtctttaccaacacatcaaggtgcataccggggaaaggccatattgctgcgaccagtgcggaaagcagtttacacagctcaatgcactccagagacatagaagaatccacacgggagagcggccattcatgtgcaatgcctgtggtcgaacatttacggataagtccaccctgcggagacatacaagcatccacgacaagaatactccttggaagagctttctcgtcattgtcgatggctcccctaagaatgatgatggccacaagacagagcagccagacgaggagtacgtgagctccaagttgagtgataaactgctgtctttcgcagaaaatggtcatttccataacttggccgcagtgcaggacacggtaccaaccatgcaagaaaattccagtgccgacacagcctgtaaagccgacgactcagttgtctcacaggacacccttctcgctaccacaatctcagaattatccgagttaacaccacagaccgactctatgccaactcagttgcattcgttgtccaacatggaatag

SEQ ID NO: 224427 - DNA, 147 bp, Artificial Sequence
  Description of Artificial Sequence: Synthetic coding sequence
atggagagcggggctgtgcttctggagagtaaaagcagcccattcaatctgctgcatgaaatgcatgaactacgcttactcggtcacttgtgcgacgtgacagtatctgtggaataccagggagtgcgtaaagacttcatggcgtag

SEQ ID NO: 224428 - DNA, 663 bp, Artificial Sequence
  Description of Artificial Sequence: Synthetic coding sequence
atgtgcgagacctgcgggaagagttttgcgtccaaggagtatcttaagcaccataaccgcatccacaccggcagtaagccctttaagtgcgaggtgtgctttcggacctttgcgcagaggaacagcctgtaccagcacatcaaggtccacaccggagagcggccttactgttgtgatcagtgcggcaaacagtttacccaactgaacgccctgcagcgccaccgcagaatccacacaggtgagagacctttcatgtgcaacgcctgcggaaggaccttcactgacaagagtactctgcgtaggcacacaagcattcacgataagaacacaccttggaagagctttctcgttatcgtcgatggttccccaaaaaatgatgatggtcacaaaacagaacaacccgacgaggaatatgtcagcagtaagttgtccgacaaactccttagcttcgccgaaaacggccactttcacaaccttgcggctgttcaagatacagtccccactatgcaagaaaacagcagtgccgacactgcgtgtaaggccgatgattctgttgtgagccaggatactctattagctacaactataagtgaactatccgagctaacccctcaaactgatagcatgccaacacagctgcatagcctatcgaacatggaatag

SEQ ID NO: 224429 - DNA, 708 bp, Artificial Sequence
  Description of Artificial Sequence: Synthetic coding sequence
atgttgatttatcataagaggtgtcacacgggcgaaaggcccttcatgtgtgaaacctgcggtaaaagctttgcttccaaggagtacttgaagcaccacaatcggatccacaccggatccaagcctttcaagtgtgaggtgtgcttcaggaccttcgcccagcggaatagcctgtaccaacacatcaaggtccacaccggagaacgcccttattgctgcgaccagtgtggcaagcagttcacacagcttaatgcccttcaacggcaccgcagaatacacactggcgagcgcccatttatgtgtaacgcatgtggccgaaccttcactgacaaaagtaccctgagacggcacacttcgattcatgacaaaaacactccctggaaatccttcctggtcatcgtggatggaagccctaaaaacgacgatggccacaaaaccgagcaaccggacgaggaatatgtgagttctaaactttctgacaaattgttgtcctttgcagagaacggacatttccacaatctagctgccgtccaggacacagtgcccactatgcaagagaatagctccgccgacacggcatgcaaggccgacgactcagtggtgtctcaagatactcttctcgccacaaccatttccgaactcagtgagttgacacctcagaccgactcaatgccgacccagctacattctctgtccaatatggagtag

SEQ ID NO: 224430 - DNA, 1254 bp, Artificial Sequence
  Description of Artificial Sequence: Synthetic coding sequence
atggacgaggaatacgacgtaatcgtgttgggcaccggcctgactgagtgtattctcagcggaatcatgagcgtgaatgggaaaaaggtacttcatatggaccggaacccttattatggaggtgagagcagcagtatcacacccctagaagagctgtacaaacgtttccaacttctagaaggcccaccagaatccatgggtcgaggcagagattggaacgtggatctcatcccgaagtttctcatggctaatgggcagctcgtgaaaatgctcctgtatacagaggttacacggtatcttgatttcaaggtggtggaggggtccttcgtatacaaaggcggaaagatctataaagtgccgtccactgagacagaagcgctcgctagtaacctgatgggaatgttcgaaaacgatcccaaaacattcgaaggcgtcgatccccagacaacgtctatgagggatgtgtatagaaagttcgacctgggtcaggacgtaatcgacttcaccggacacgctctggcactgtaccggactgacgactaccttgaccagccatgcctggagaccgtgaatcgcatcaaactgtactctgagtctctggcaaggtacggcaaatccccatacctgtacccgctgtacggccttggggagctcccccaggggtttgccagactgtcagctatttatgggggaacttacatgcttaataaacctgtggatgatataattatggagaacggtaaggtcgtgggtgtgaagagcgaaggcgaagtggcaaggtgtaaacagttgatttgcgacccatcttacattcccgaccgggtgagaaaagcaggtcaggtgatcaggatcatctgtatcctgagccaccctatcaaaaataccaatgacgctaattcttgccaaatcatcattcctcaaaatcaggtgaatcgaaaaagtgacatttatgtttgcatgatatcttatgcccacaacgtggcagcgcaggggaagtatatcgcaatcgcatcaacaaccgtggaaaccaccgacccagaaaaggaggtggagcctgctctggaattgcttgagcccatagacgatggttgtgagtcccaggtattttgtagttgcagttacgacgccactacacattttgagaccacatgtaatgatatcaaagacatatataaacggatggcaggaaccgcatttgattttgaaaacatgaagaggaaacagaacgacgtcttcggggaagcggaacaatag

SEQ ID NO: 224431 - DNA, 1344 bp, Artificial Sequence
  Description of Artificial Sequence: Synthetic coding sequence
atggatgaagagtacgacgttatcgtgcttggaactgggctgaccgaatgcattctgtccggaattatgtctgtaaatgggaagaaggtgctgcacatggataggaacccctactatgggggtgaatccagcagcattacccctctagaggagctctacaaaaggttccagttgctcgagggacctccggagagcatggggcgaggtagggattggaacgtagacctcatcccaaaattcctcatggctaatggacagctcgtgaagatgctgctttatactgaggtgacccgttacctcgattttaaagtggtagaaggatcattcgtgtataagggagggaaaatttacaaagtgccaagtacggagactgaagcgctggcttctaatttaatgggcatgtttgagaaacgtagatttcgaaagttccttgtcttcgtggccaatttcgacgagaatgacccgaagaccttcgaaggggtggaccctcaaactacgagcatgcgcgacgtgtataggaaatttgatctggggcaggacgtgatcgactttactggacatgccctggcactgtatcgcaccgacgactatttggaccaaccctgcttggagactgtgaaccggataaagctatactccgaatccctggctaggtacggaaagagcccttacctgtacccattatacggactgggggagctcccacagggctttgctagactttcagctatttacggagggacctatatgctcaacaagcccgtggatgatatcattatggagaacggcaaagtggtgggcgtcaagtccgaaggcgaggtcgctcgatgcaagcaactaatctgcgatccttcatacatacctgacagagtccgcaaggcagggcaggtgattcgtatcatctgcatactgtcacaccctataaaaaacaccaatgatgccaatagttgtcaaatcataattccacagaaccaggtgaatagaaaatccgatatctatgtgtgtatgatcagttacgcccacaacgtggcagcgcaggggaaatatatagcaatcgcttctactactgtggagaccaccgatccagagaaagaagtagagccagctctcgagctgctggaacccattgatcagaaatttgtggctatatctgacctgtatgaaccaattgatgacggatgcgagagtcaagttttttgctcttgcagttatgacgctacaactcacttcgagacaacctgtaacgacattaaggacatctacaaacgtatggcaggtaccgccttcgactttgagaacatgaagcgcaaacaaaatgatgtgtttggcgaagcagagcagtag

SEQ ID NO: 224432 - DNA, 447 bp, Artificial Sequence
  Description of Artificial Sequence: Synthetic coding sequence
atgagtttgggaaagcggaaacctagcaatttctacttggccaacttcctgggcaaggagtgcatactgagcgggataatgagtgttaatggcaaaaaggtgctgcacatggatcgaaacccatattatggaggggagtctgccagcatcacccctctggaagacctctataaacgctttaagatcccagggagcccaccggaaagcatggggagagggagagattggaacgtggacttaatccctaagtttctaatggctaacggccagctcgtgaagatgctgctctataccgaggtaacgaggtatctcgatttcaaggtgactgagggctctttcgtctacaaaggtggcaaaatatacaaggtaccgtcaaccgaggctgaggctttggccagctcacttatgggcctctttgaaaaaagacgattccgcaagtttctgtag

SEQ ID NO: 224433 - DNA, 1350 bp, Artificial Sequence
  Description of Artificial Sequence: Synthetic coding sequence
atgtcgttaggcaagcgcaagccatccaacttttatctcgcaaactttctgggtaaagagtgcatactttccggtatcatgagcgtgaatgggaagaaggtgcttcacatggatcgaaatccttactatggcggagagtcggcaagtatcaccccactggaggatttgtataagcgatttaaaatccccggatcgccacctgagagtatgggacgcggaagggactggaacgtggatctgatccctaagtttctgatggccaatgggcagttggtgaagatgctcttgtacaccgaggtgacgaggtatctcgatttcaaggtgaccgaggggagcttcgtgtataagggagggaagatatacaaggttcccagtactgaggcagaagctttggcctcaagcctgatgggactgttcgaaaagagacgattccgcaagtttctggtgtacgttgctaatttcgacgaaaaggatccacgtacatttgagggtatcgatcccaaaaagacaaccatgcgggacgtgtacaaaaagtttgacttagggcaggatgtgatcgactttacaggccacgccttggccctctatcggacggacgactacctggaccagccctgttacgaaaccatcaatcgaatcaaactgtacagcgagtcactggccaggtatggcaaatcgccgtatctctatcccttatatggcctcggcgagctgcctcagggattcgcaaggctgagcgcaatctacggcggaacatatatgttgaacaagccaatagaggagatcatcgttcagaatggcaaggttatcggcgtgaaatccgaaggcgaaatcgctaggtgcaagcagcttatctgcgatccttcctatgtaaaggaccgcgtggaaaaagtggggcaggtgatcagagtcatttgtatcctttcgcaccccattaaaaacaccaacgatgccaattcctgccagatcataattccacagaaccaggtaaatcgaaaatcagacatatacgtttgcatgatttcgtttgctcacaacgtggctgcgcaggggaagtatattgcaatcgtctctactactgttgaaaccaaggaaccggaaaaggaaatacgtcctgcactcgaactgctggagccgatcgaacagaagttcgtctccatcagcgatttactcgtacccaaagatctcggaacagaaagccaaatttttatatctagaacgtatgatgctacaacccactttgaaactacgtgcgacgatattaagaatatctataagcgcatgaccggctccgagttcgacttcgaggagatgaaacggaaaaaaaatgacatttacggcgaggactag

SEQ ID NO: 224434 - DNA, 627 bp, Artificial Sequence
  Description of Artificial Sequence: Synthetic coding sequence
atgcgtgatgtctacaaaaaatttgacttgggacaagatgtgatagactttaccggacatgcattggcgctgtaccggactgatgattacctcgaccagccatgttacgagacaatcaaccggattaagctttacagcgagagtttggcacggtacggaaagagtccctacctgtaccccctatacgggctgggagagctgccacagggattcgcaagactgtctgccatatacggcggaacatatatgctcaataagccaatcgaagagatcatcgtacagaacggcaaagtcatcggagtcaaatcagaaggggagatcgcacgctgcaagcagctgatctgcgatccatcatatgtgaaggaccgtgtagagaaggtcggccaggttatacgggttatttgtatcctgtcacaccccatcaagaatacaaacgatgcaaattcctgtcaaataatcatccctcagaatcaagtgaaccgcaagagcgatctgctggcttcagtgacgtcctggtatcagaaaacttgggaacagaaggcccgatccctgtttcctgctcatatgatgccaccgcttattctgaggcagcgcgtgatgacgctcaaaacttctatccgtggctag

SEQ ID NO: 224435 - DNA, 1203 bp, Artificial Sequence
  Description of Artificial Sequence: Synthetic coding sequence
atgaacgaggaatatgacgttatcgttctgggcactggcctgacggagtgtatattgtccggaattatgtcagtcaatggcaagaaagtgttgcacatggacagaaacccgtactatggtggggaatctgcctctatcactccactggaggatctctacaagaggttcaagattcccggatctcccccagagtctatgggacggggtcgggactggaatgtcgacctgatccctaaatttctgatggctaacggattgatgggcctattcgagaagcggagattcagaaagtttctcgtgtatgtcgccaattttgacgagaaagaccccaggacctttgaaggaattgatccgaagaaaaccacaatgcgggacgtctataagaaattcgaccttggacaggatgtgatcgactttacgggacacgctctcgccctttaccggactgacgattacctcgatcaaccctgctacgaaaccatcaacaggatcaagctctatagtgagagcttggctagatatggaaagagcccgtacctgtaccccctgtatggcctcggggagctcccccaggggttcgcccgactatctgctatctacggcggaacgtatatgctgaataagccgatagaagaaatcattgtgcagaatggcaaagtgatcggagtgaaaagcgaaggtgagattgctcggtgtaaacagctcatatgcgacccgtcctatgtcaaggaccgggttgaaaaagtgggccaggtaatccgcgtgatttgcatccttagtcacccaattaagaataccaacgacgccaacagctgtcagataattatcccgcagaatcaggtcaaccgaaagtccgacatttatgtgtgcatgatttccttcgcgcataatgttgccgctcagggcaagtatatcgccatcgtttccactacggtagagactaaagagccagaaaaagaaattaggccagcgttagaactgctcgaaccgatcgaacagaagtttgtctccattagcgatctgctggtgcccaaggacctcgggacagagtcgcagattttcatctcacgcacatacgatgccaccacgcatttcgagaccacctgcgatgacatcaaaaacatctacaagagaatgaccggctccgagtttgacttcgaggagatgaagaggaaaaagaacgatatctacggcgaagattag

SEQ ID NO: 224436 - DNA, 1338 bp, Artificial Sequence
  Description of Artificial Sequence: Synthetic coding sequence
atgaacgaggaatacgacgtgattgtgttaggcacggggctgaccgagtgcatattaagcggcatcatgtccgtgaatggaaaaaaagtgctccacatggatcgcaacccatactacggaggcgaatccgccagcattactcccctcgaggatctctataaaaggttcaaaattccaggatcacccccagaatctatggggcgaggcagagactggaatgttgatctgattcctaaatttctcatggctaatggtcagctggtaaagatgcttctgtatactgaggtgactaggtatctcgacttcaaagtgacggagggttctttcgtgtacaaaggcggaaaaatttacaaagtgccatctaccgaggccgaggcccttgcctcctccctgatggggctgttcgagaagaggcgtttccggaagtttttggtgtacgttgcgaatttcgatgagaaagatcccaggacctttgaggggatcgaccccaaaaagaccacaatgcgcgacgtgtacaagaagttcgatctcggccaggatgtaattgacttcaccggccatgctctggcactgtataggacagacgattacctggaccagccctgctatgaaaccattaaccggatcaaattatacagcgaaagtttagcacgctatggaaaatccccctatctctaccccttgtacggtcttggggaactccctcaaggctttgcacggttgagcgcgatttacgggggaacatacatgctcaataagcccattgaagaaattatagttcagaatggtaaggtgattggcgtgaagtctgaaggggagatcgctcgctgtaagcagctgatttgtgatccgtcatatgtgaaggacagagtggagaaggtgggccaagtgatccgggtcatatgcattttgtcacatcctatcaaaaacactaacgatgcgaacagctgccagatcattattccacagaaccaggtgaatcggaagtccgacatctatgtctgcatgatatctttcgcccacaacgtggctgctcaggggaagtacattgccatcgtgtccacaaccgtggaaactaaggagcccgagaaggaaatccgccctgctctggagttgcttgaaccaattgaacaaaaattcgtgtcaataagtgacctattagtgcccaaggatctgggaactgagtcccagatttttatctcccgtacatacgacgcgaccactcatttcgaaaccacctgcgacgacattaaaaatatttacaagcgtatgacaggatccgagttcgattttgaggagatgaagcgcaaaaagaatgacatttacggtgaagactag

SEQ ID NO: 224437 - DNA, 468 bp, Artificial Sequence
  Description of Artificial Sequence: Synthetic coding sequence
atgaacgaggagtacgatgtgattgtgctggggaccggtcttacactgtataagcgcttcaagatccctgggtctcccccagagtctatgggccgaggcagagattggaatgtggacctcattcccaagttcctcatggcaaacgggcaattggtaaagatgttactatacacagaggtgactagataccttgactttaaggtgacagagggatcattcgtgtataagggcggaaagatatacaaagtgccatcaactgaagccgaggctcttgcgtcatctctcatgggtttgtttgaaaaacggaggttcagaaaattcctagtttacgtcgcaaactttgatgaaaaggatccaagaactttcgagggaatcgaccctaaaaaaaccaccatgcgggatgtgtacaaaaagttcgacctaggccaagatgtcattgattttaccggacacgctctcgccctgtag

SEQ ID NO: 224438 - DNA, 612 bp, Artificial Sequence
  Description of Artificial Sequence: Synthetic coding sequence
aagaaattcgatctgggccaggacgtcattgatttcaccgggcacgccctggcgctataccgcaccgatgattatctggatcagccctgctatgagaccattaatcggattaagctctactctgagagcctggccaggtatgggaagagcccttatctctaccctctttacggccttggtgagcttcctcagggtttcgccagactgtcagctatctatggcggaacctacatgcttaacaagcctattgaagagattattgtgcaaaacggaaaggtaatcggagttaaatccgagggggagattgctcgttgcaagcagctgatctgtgatcccagctacgtgaaggatcgggtggagaaagttggccaggtgatcagagtcatctgcatactgtctcacccaatcaaaaatacaaacgatgccaatagttgccagataataattcctcagaatcaggttaatcgcaagtccgatctcttggcatcagtgacctcttggtaccagaaaacatgggagcagaaagctaggtctctgtttcccgcacacatgatgcctccgctgattctgcgccagagagttatgacactcaaaacatccatccgaggttag

SEQ ID NO: 224439 - DNA, 792 bp, Artificial Sequence
  Description of Artificial Sequence: Synthetic coding sequence
atgaatgaggaatatgatgtgatcgtcttaggcactggcctaacagaatgcatcttgtccggaattatgtcagtcaacggcaaaaaggtgttgcacatggatagaaacccgtattatggcggtgaatcagcctctatcactcccctggaggatctgtacaaaaggtttaaaattcctggctcacccccagaatcaatgggcagaggacgagactggaacgtagatctgatacccaaattcctcatggccaatgaggtcaccagatatctggatttcaaagtaacggaggggtcttttgtgtacaagggtggtaaaatctataaggttccaagcactgaagccgaagccttagcctcgagcctgatgggcctgttcgagaagaggcgttttaggaagttcctcgtctacgtagcaaactttgatgaaaaagaccctaggactttcgagggcatcgaccctaaaaaaaccaccatgcgcgacgtgtacaagaagttcgacttaggccaggacgttattgacttcacaggtcatgctcttgctctgtatcgtaccgacgactatctggatcagccgtgctatgagacaatcaacagaatcaagctttactccgagtcccttgctagatatggcaagagtccctacctgtacccactatacggcctgggtgagttaccacagggtttcgcacgattaagcgctatctatggagggacgtacatgctgaataagcccatcgaggaaatcattgtgcaaaacgggaaggttatcggggtaaaaagtgagggtgagtag

SEQ ID NO: 224440 - DNA, 1119 bp, Artificial Sequence
  Description of Artificial Sequence: Synthetic coding sequence
atggctcacgcaccagccaggtgccccagcgccagaggctccggagacggcgagatgggaaaacctaggaatgtcgccttgatcacagggattactgggcaggacggatcctatctcgccgaattcctactcgagaagggctatgaggttcatggtattgtccggaggagctccagttttaatacgggccgtatagagcacctgtacaagaatcctcaggcacacatcgagggtaacatgaaactccactatggagacctgacagatagtacttgcctcgtgaaaataataaacgaagtcaaaccaactgaaatctataacctgggcgcacagtctcacgtcaaaatttcttttgacttggctgaatatacggctgacgtggacggcgtcgggaccctgagactgctggacgcggtgaagacttgtgggttgataaacagtgttaagttctatcaagctagtacttcggagctctacggtaaggtgcaagaaattccacagaaggagactactcccttctatcctaggtctccatatggagccgctaaattgtacgcctattggatcgtggtcaatttccgagaagcctataacctattcgcagtgaacggtatcctgtttaaccatgaatccccaaggagaggggctaatttcgtaacccgcaagatctcacggagcgtggccaaaatatatcttgggcaactggaatgcttctctttgggtaacttggacgcgaaacgggactgggggcatgctaaggattacgtggaagcgatgtggctgatgctccaaaacgatgagcccgaagattttgttattgcaacaggcgaggtgcactctgtaagagaattcgtcgagaagtcatttctgcacattggtaagactatcgtgtgggagggcaaaaatgagaacgaggtcggaagatgcaaggagactggaaaggtccatgtgactgtcgatctgaaatattatagacctacagaagtagattttctgcaaggcgactgcacaaaagcgaaacaaaagcttaattggaaaccacgtgtcgcttttgatgaactggtgcgtgagatggtacacgcggacgtagagcttatgagaacaaatccaaacgcctag

SEQ ID NO: 224441 - DNA, 1029 bp, Artificial Sequence
  Description of Artificial Sequence: Synthetic coding sequence
atgtgtaaaatggatgggtcctacctcgctgagttccttctagagaagggatacgaagtgcatggcattgtccgtcggagcagctctttcaatactggcaggatcgagcacctgtataagaatccccaggctcacattgaaggcaacatgaagctgcattatggagacctcacagattccacttgtttggtgaaaatcattaacgaggtgaaacccaccgagatttacaatctgggagcccagagccacgtaaaaattagctttgacctcgccgagtacactgccgacgtggacggggtggggactctcaggctgttggacgctgtgaagacatgcgggctgatcaatagcgtgaagttttaccaagcctctacctctgagttgtatggaaaagtccaggagataccccagaaagaaaccacacccttttaccccaggtctccatatggggctgccaaactgtatgcttattggatagttgtgaattttcgggaagcctataacttatttgccgtgaatggaattttgttcaaccatgaatccccaagacgcggtgctaatttcgttacacgcaaaatttcaagatccgtggcaaaaatatatctgggccagctcgagtgctttagtctcggcaatctggatgctaagcgagattgggggcatgccaaagactacgtggaagctatgtggttgatgctgcaaaatgacgaaccggaggatttcgtgatcgcaacaggggaggtgcactctgtgagggaattcgttgagaagtcttttctacacatcgggaaaactatcgtgtgggaaggtaaaaacgagaacgaggtgggacgttgcaaagagacgggaaaggtccacgtgactgttgatctgaagtactaccgtcctaccgaggtagattttttgcaaggcgattgtacaaaggctaagcagaaactgaactggaagccccgtgtggcttttgacgaattggtgcgtgagatggtccacgccgatgtcgagttgatgcgcactaatcccaatgcttag

SEQ ID NO: 224442 - DNA, 2196 bp, Artificial Sequence
  Description of Artificial Sequence: Synthetic coding sequence
atggtagtggaacacccagaattcttaaaggcaggtaaggagcccggtctccagatctggcgggtggagaagttcgatctggttccggtgcccaccaacctgtacggggacttcttcacaggtgacgcctatgttatcctgaagactgtgcagttacgcaacgggaatctccaatacgatctccactattggctcggcaatgaatgctcccaggacgagagtggagccgcagcaatcttcacagtccaattagacgactatctgaatgggagagccgtgcagcaccgagaagttcaaggctttgaaagtgccacctttctgggatactttaaatcaggactcaagtacaaaaaaggcggagtcgcttcaggatttaagcacgtggtgcctaacgaagtggtggtccaaaggttgtttcaggtgaaaggacgccgtgtggtgcgggcaaccgaagtgccggtgagttgggagtcctttaataatggcgactgctttattctcgatttggggaacaatatccaccagtggtgtggctccaacagtaacagatacgagcggctgaaagcaactcaggtctccaagggaatccgagataacgagagatccggcagggccagggtccacgtgtcagaggagggcacggagcccgaggcaatgctgcaggtgctggggccaaagcctgccttgccggctgggactgaggatacagctaaggaagatgctgctaatagaaaactcgccaagctctacaaggtgagtaatggggctggaactatgagcgtgtccctagtcgctgatgagaaccctttcgcccaaggggcactgaaaagcgaggactgctttattttagaccacggaaaggacgggaagatttttgtgtggaagggaaaacaggcaaacacagaagagagaaaagctgctttgaagacggcttcagactttattaccaaaatggactaccctaagcagactcaggttagtgtgttgccagaaggcggtgaaactccactctttaagcagttttttaaaaactggcgggaccctgatcaaacagacggtctggggctgagctatctgtcgtctcacatagcaaacgtggagcgtgtgccatttgacgccgcaaccctccatacctcaacagccatggcggctcagcacggaatggacgatgatgggaccggccaaaaacagatctggaggatagagggatctaataaggtaccagttgaccccgcaacctatggacagttctacggaggggatagctatatcatcctttataactacagacatggcggacgccagggacaaataatctataactggcagggagcccagtcgacgcaggatgaagtcgcagccagcgccatactgactgctcagctggatgaggagttaggtggtacacccgtacagtcaagggtggtacaaggcaaggaaccggcacacctgatgagccttttcgggggtaagccgatgatcatttacaaaggcggaacttcacgcgaaggcggtcagactgctccggcttcgactaggctttttcaggtgagggccaacagcgccggtgctacaagagccgtggaggtcttgccaaaggcgggtgccctaaacagcaacgacgcattcgtgctaaaaacaccgtccgccgcttatttgtgggtgggcaccggggctagtgaggccgaaaagacgggggcacaggaactgctgcgcgtgctgcgggcacaaccagtgcaggtggctgagggtagcgaacccgacgggttttgggaagctctgggcggtaaagcagcatatcggacaagccctcgactgaaagataaaaagatggatgcgcaccccccaagactgtttgcctgcagcaataagattggcaggttcgtaatcgaggaggtgcctggcgagctgatgcaggaggatctggccaccgacgatgtgatgctactcgacacctgggaccaggtgtttgtctgggttggcaaggattcccaggaggaggagaagaccgaagcactgacctctgctaaacgatatatagagacagaccccgctaatagagacaggagaacacctattacagtggtaaagcaggggtttgagcctccatcgtttgtgggatggtttctgggttgggatgatgactattggagtgtggatcccctggaccgggcaatggcggaacttgccgcttag

SEQ ID NO: 224443 - DNA, 2196 bp, Artificial Sequence
  Description of Artificial Sequence: Synthetic coding sequence
atggtggtcgaacatcccgagtttctcaaggccggaaaagagccaggcctccagatatggagagtcgaaaaatttgacttggttccagtcccaaccaacttgtacggagattttttcactggcgatgcctatgtcatactaaagactgtgcagttgcgaaacggaaatctgcaatacgatcttcactattggctgggcaatgagtgcagccaggacgagtccggtgcagcggctatatttaccgtgcagctggatgactacctgaatggaagagcagtccagcaccgagaagttcaggggtttgaatccgccactttcttaggctatttcaaatcgggcctaaagtacaagaaaggcggtgtcgcgtccggcttcaagcacgttgtgcccaacgaggtggtcgtgcagaggctgtttcaggtcaaggggaggcgggtagtacgggcaacggaagtcccagtgagttgggagtcgttcaataatggggactgcttcatcctggacctggggaacaacattcaccagtggtgtggctccaactccaacaggtatgagcgcttgaaggctacgcaggtcagcaaggggattcgggataatgagaggagtggaagggcgagggttcatgtgagtgaagagggaaccgaaccagaggccatgcttcaggtccttgggcctaagcctgcgttaccagctggtaccgaggacaccgccaaggaggatgctgctaataggaagttagctaaactttataaagtctcgaacggtgccggaaccatgtctgtttctcttgtggccgacgaaaacccctttgctcagggggctctcaagtctgaggactgctttatcctagatcatgggaaggacggtaagattttcgtttggaagggaaagcaggctaataccgaggaacgaaaggcggcactgaaaacagcttcagatttcatcactaaaatggactatcctaaacaaactcaagtgagcgtgctgcccgagggcggagagaccccattgtttaaacagtttttcaaaaactggcgtgacccagaccagaccgatgggcttggactctcctacctgtcttctcacattgccaatgtggaacgcgtgccctttgatgccgcaacactccacacatccaccgccatggccgctcaacacggcatggacgacgacgggaccgggcagaagcagatatggcgtatcgaaggaagcaacaaggttccggtcgatccggctacatatggccagttttacggcggagattcctatataatcctatacaattatcggcatggtggtaggcaggggcagattatctacaattggcagggcgcacagtcaacccaggacgaggtggccgcaagcgccatcctgaccgcccagctggacgaggaactgggcggaactccagtgcagtcccgtgtagtgcagggaaaagaacccgcacatctcatgtctctgttcggaggtaagcccatgataatctacaaggggggaacatcccgcgagggaggacaaacagcccctgcctctacccggctgttccaagtgagggccaactccgcaggagccacccgggcagtggaggtgctccccaaagccggtgcacttaactcaaatgatgcctttgttttaaaaaccccctccgccgcttatctctgggtgggaacaggtgcgagtgaggcagaaaaaaccggagctcaagagctcctcagggtcttgcgtgcacagcccgttcaggtcgccgaagggagcgagcctgacggattctgggaggcactaggcggtaaagccgcttaccgtaccagcccacggttgaaagataagaaaatggacgctcatccccctcggctgtttgcatgctccaataaaatcggacgatttgtgatcgaggaagtgcccggagagctgatgcaggaggacctggccactgacgacgtgatgctactggacacatgggaccaggtattcgtgtgggtcggaaaggactcccaggaagaggagaagacagaagcactgactagcgctaagcggtatattgagaccgatcctgcaaatagggacaggagaactccgattaccgtggttaagcagggatttgaacccccttccttcgtaggctggttcttaggctgggacgatgactattggagcgtggacccactggaccgcgctatggcagagctggccgcatag

SEQ ID NO: 224444 - DNA, 2349 bp, Artificial Sequence
  Description of Artificial Sequence: Synthetic coding sequence
atggcacctcacagaccggctccagccctgctgtgtgcactgagcctcgccctatgcgccttatccctgcccgtacgcgctgctaccgcctctcggggtgctagccaggcaggggctccccagggaagggttcccgaagccagaccgaatagtatggtggtggagcacccagaattcttgaaggccggtaaagagcccggactgcagatctggagagtggaaaagtttgacttggtgcccgtcccaaccaacctttatggcgacttctttaccggagacgcctacgtaattctaaaaaccgtgcagttgaggaacgggaacctgcagtatgaccttcattattggttaggcaacgagtgctcacaggatgaaagcggggctgcggctatctttaccgttcagttagacgactatttaaatggcagagcggtacagcatcgcgaggtgcagggcttcgagagcgcaacttttctgggatatttcaagtctggtttgaagtataaaaaaggaggagtagcgtccggattcaagcacgtcgtaccgaacgaagtggtggttcagagattgtttcaggtaaagggaaggcgcgtggttcgagccacagaggtccctgtgagctgggaaagctttaacaacggagactgttttattctggatctcggcaacaatatccaccagtggtgtggcagtaattcaaatcgatatgagagactcaaggccacccaggttagtaaaggtatcagggacaacgaacgctccgggagggccagagtacatgtgtccgaggaaggcacagaacccgaggcaatgctgcaggttctgggtcctaaaccagcattgcccgcaggtaccgaggatactgctaaggaagatgccgcaaataggaagcttgctaagctttacaaagtgtccaatggagcaggtaccatgagtgtcagcctggtggctgatgaaaatcccttcgcccagggggctctgaaatctgaggattgtttcattcttgatcatggcaaggacggaaagatctttgtctggaaggggaagcaggccaacaccgaagagcgcaaagctgcgctcaagacggcatctgacttcatcaccaagatggactatcccaaacagactcaggtatctgtgctccccgagggaggcgaaacgcctttgttcaagcagttcttcaaaaattggagagatcccgatcaaaccgacgggctggggctgtcctacctctcatctcacattgcaaacgtagagagggtaccgttcgatgcggctactctgcacacatccaccgcaatggccgcacagcacgggatggatgacgatggcaccgggcagaaacagatttggaggatcgaaggctccaacaaggtgcctgtggacccagccacctatgggcaattctatggcggtgattcctacataatattatataattacaggcatggcggtcggcaaggccaaattatttacaattggcaaggagctcagtccacacaggacgaagtagccgcaagtgccatcctgacagctcaactagacgaggaattggggggaacccccgtacaaagcagagtagtccagggaaaggaacccgctcaccttatgtccctgtttgggggtaaacccatgatcatctataaaggaggtacttccagagaggggggacagaccgctcctgctagcaccaggctgttccaggtccgggcaaacagtgccggagctacccgcgctgttgaagtcctgcctaaggccggtgccctgaacagcaatgacgcattcgtgctcaagacaccgtcagccgcttacctctgggtaggaaccggtgcctcagaggccgagaaaacaggcgcacaggagctgttacgggtactacgcgctcaacccgtgcaggtggctgaaggatcagaacccgatggtttctgggaggctctcggcggaaaggccgcatataggacctcaccacggttaaaagataagaagatggacgcacaccccccaaggctgttcgcctgctccaataaaatcgggcgatttgtcatcgaggaggtgccgggtgagctgatgcaggaggatttggccactgatgacgttatgctactggatacttgggaccaggtgtttgtgtgggttggtaaggattcccaagaggaagagaaaaccgaggcgctcacctcagccaaacggtatatagagaccgatcccgctaaccgcgatcgccgaacccctatcactgttgttaagcaagggttcgagccgccatcctttgtgggttggtttctgggttgggatgacgattattggagcgtcgaccctctcgatagagccatggccgagctcgcggcttag

SEQ ID NO: 224445 - DNA, 2196 bp, Artificial Sequence
  Description of Artificial Sequence: Synthetic coding sequence
atggtcgtggagcatcccgagtttctcaaggctgggaaggaaccgggtctacagatttggcgagtggaaaaattcgatctggtgcccgtgccgaccaacttgtatggggattttttcactggcgatgcttacgtaattctgaagacagttcagttacggaatggcaatctgcagtatgatctgcactattggctcggcaacgagtgttcccaggatgagagcggggcagctgcaatctttaccgttcaactcgacgactaccttaatggaagggccgtgcagcaccgcgaagtccaggggttcgaatcagccacttttctggggtactttaaaagcgggctgaagtataaaaaaggcggtgttgcctctggattcaagcacgtggtgcctaatgaggtcgtggtgcagcgcctcttccaggttaagggccgaagagtcgtgcgtgctactgaggtgcctgtcagttgggaaagttttaacaatggcgactgctttattctggatttgggcaataatatccaccagtggtgcggctcaaatagcaatcgttatgagaggcttaaggcgacccaagtatctaagggtatcagggacaacgaacggtctggacgagcaagagtgcatgtatctgaggagggcaccgagcccgaagcaatgctgcaggtactgggtcccaaaccagctctccctgcgggaaccgaagatactgcgaaggaggacgccgctaatagaaagctggccaaactatataaagtttcaaatggcgcaggcactatgtctgtgagcctggttgccgacgaaaatcccttcgcccagggagctctaaagtccgaggattgcttcatactcgaccacgggaaggatgggaagattttcgtatggaagggtaagcaggctaatacagaggaaaggaaggccgcactgaaaaccgcctctgacttcatcactaagatggactaccccaaacagacgcaggtctccgtgctgccagaggggggtgagacaccactatttaaacaattcttcaaaaactggcgcgatcccgaccaaaccgacgggctgggcctgtcttatttgagcagtcatatagccaatgtagaacgcgtgcccttcgatgcagccaccttgcacacctctacggcaatggccgctcagcacggcatggatgatgacggcactggccaaaaacagatctggagaattgaaggttccaacaaagttcccgtcgaccctgccacctacggccaattctacgggggagattcttatattattctatacaactatcgtcacgggggtaggcagggacaaataatatataactggcagggcgctcagtccacccaagatgaggttgcggcaagcgcaattttaacggcacagctggacgaagaattaggaggcactccagtgcaatcccgcgtcgttcagggcaaagagccggctcatctgatgtcccttttcgggggtaaacctatgatcatatacaagggaggcacctctcgcgaaggtggtcagactgcaccagcatcaacccgacttttccaggtcagggcaaatagcgccggagcaacccgcgcagtggaggtgctgcctaaagcaggggcattaaactccaatgacgcatttgtgctgaagacaccatcagcagcgtacttatgggtcgggacaggggctagtgaagctgaaaagactggagcccaggagttgctcagggtgcttagggcacagcctgtgcaagtggccgaggggtcagagcccgacggattctgggaggcactgggtggtaaagctgcatacaggacaagcccgaggcttaaggacaagaaaatggacgcacacccgcctagactgtttgcatgtagtaataagatcggtcgcttcgttatcgaggaagtgcctggtgaactgatgcaagaagatctggcgacagacgatgtaatgctcctggacacctgggaccaggtttttgtctgggtgggcaaggactcacaggaagaggagaaaaccgaggccctaacatccgctaagagatacatcgagactgatccagctaatcgtgaccgtaggacaccaatcacggttgtgaagcaagggtttgagcccccttcctttgtgggctggttcctcggatgggatgatgactactggtccgtagaccccctggaccgcgctatggccgaactggctgcatag

SEQ ID NO: 224446 - DNA, 2148 bp, Artificial Sequence
  Description of Artificial Sequence: Synthetic coding sequence
atggtcgtggagcaccctgagtttctgaaggccggaaaagagcccggtctgcagatatggcgagtggaaaagttcgatgcttacgttatcctgaagacagtgcagctaagaaatggcaacttacagtacgatctccactactggctcggcaacgagtgctcccaggatgagagcggcgctgcggctatttttaccgtgcagctcgatgactacctcaatggcagagcggtgcagcaccgagaggtacagggattcgagtcggcaacgttcctgggttacttcaagagcggtcttaagtataaaaagggcggagttgcatctggattcaagcacgtagtgccaaatgaagttgtagtacagaggcttttccaagtgaaaggacgcagggtggtgagagccactgaggttccagtatcctgggaaagctttaacaatggcgattgtttcatccttgacttggggaataatattcatcagtggtgcggcagcaacagcaaccggtatgaacggctgaaggcgacacaggtgtcaaaaggcatcagggacaatgaaagatccggtcgggcaagagtgcacgtctccgaggagggcaccgaaccagaagccatgttacaggtactgggcccaaaacctgctctacctgccggaactgaggacaccgctaaggaggacgctgccaaccggaaacttgccaaactttacaaggtatcgaacggagcaggcacaatgagcgtgagtctggtggcagatgaaaaccccttcgcacagggcgcattgaaaagcgaggattgttttatcctggaccacggcaaggacggaaagatcttcgtgtggaaaggtaaacaagctaatactgaggaacggaaggccgctctgaagacagcttcagacttcattacaaagatggactaccccaaacagacccaggtctctgtgctgcccgaaggcggagaaacccctctcttcaagcagtttttcaagaattggagagatcccgatcaaaccgatgggctgggcttgtcgtacctttcttcgcatatcgctaatgttgaacgcgttccatttgacgccgctaccttgcacacctccaccgctatggctgcacagcacggtatggatgacgacgggacaggacaaaaacagatatggcgaatcgaaggctctaacaaagtcccggtggaccccgctacctacggccagttttatggcggagatagctacatcattctgtacaattatcgccatgggggtcgacagggccagattatttacaattggcaaggcgcacaaagcacacaggacgaagtggcagctagcgccatcctgaccgcccagcttgacgaggagctcggaggcactccagtccagtctagggttgtgcaggggaaagagcctgctcatctgatgagcttgtttggcggtaaacctatgataatctataagggcggtacctctagggaaggagggcagactgcacctgccagtacacggctgtttcaggttcgagcgaatagcgccggagctacccgggctgtcgaggtgctgccaaaggctggtgctctgaattccaatgacgcttttgtactgaagacccctagcgctgcctatctgtgggtgggaaccggagcttctgaagccgagaagaccggggcacaggagctacttagagtgctccgggcacagcccgttcaggtggctgagggatccgagccagacggcttctgggaagctttagggggtaaggcggcttatagaacctcccctcgcctgaaggataagaaaatggatgcccaccctcctagactgttcgcatgttctaataagatcggcaggttcgtaatcgaggaggtgcccggtgaacttatgcaggaagacctggccaccgatgatgtgatgctgcttgacacatgggaccaagtgttcgtatgggttggtaaggatagtcaggaagaggaaaaaacggaggccctaacttccgctaagcggtatatcgagaccgatccagcaaaccgggaccgcagaactcctatcactgtcgtcaaacaaggtttcgaacccccttcctttgtaggatggttcctcggttgggatgatgactattggagtgtggaccccttggaccgagccatggctgaactggccgcatag

SEQ ID NO: 224447 - DNA, 2229 bp, Artificial Sequence
  Description of Artificial Sequence: Synthetic coding sequence
atggagaagctgttttgctgttttcctaattcaatggtggtcgagcatcctgagttccttaaggccggaaaagagcccggactacagatttggagagtggagaaatttgatcttgtgcctgtccccacaaatctctatggcgatttctttacaggagacgcctacgtcatcttaaaaacagtccagctcagaaacggaaacctccagtacgacctgcattattggttaggtaacgaatgcagccaagacgagtcaggcgctgcggctatctttaccgtgcagctcgatgattacttgaacggccgtgccgttcagcacagggaggtgcaggggtttgagagcgcaacgttcctggggtactttaagtctggtttaaagtacaagaaaggtggcgtggcatcagggttcaagcacgtcgtcccgaatgaagtggtggtgcagcgcttgttccaagtaaaggggagaagagtggtgcgcgcaaccgaagtgcccgtgtcttgggaaagtttcaataacggagattgctttatactagacctaggcaacaatattcaccagtggtgcggttctaattccaaccggtatgagagactcaaagcgacacaggtgagtaagggcataagagataacgaacgctccggccgtgcacgtgtccacgtgagcgaggaagggacggagcctgaggccatgctgcaagttctggggcctaagcctgctttgcctgcgggaactgaagatacggctaaagaagacgccgctaacagaaagttggccaagctgtacaaagtgagtaatggagcaggtaccatgtcagtcagcttggtggcagacgaaaatccttttgctcagggagccctaaaaagcgaggattgttttattctcgaccatggtaaggacggcaaaatctttgtgtggaaggggaagcaggccaacacagaggaaagaaaagccgcactcaagacggcatcagatttcattactaagatggattaccctaaacagacccaggtgagcgttctcccagaaggcggagagactcccttgtttaaacagtttttcaagaattggcgagaccccgaccagacggatgggttggggctctcctacctcagctcccacattgcaaatgtggagagagtgcccttcgatgccgcaacacttcacacatcaacagcaatggcagctcaacatgggatggacgacgacggtacaggacagaagcagatctggcggattgagggttcaaataaggtccccgtggaccccgctacctatggccaattttatggcggagactcatatatcattttatacaattatcgacacgggggtagacaaggacagatcatttataactggcaaggggctcaatccacacaagacgaggtagccgcttcggctatacttacggcacagctggatgaggaactggggggaactccagtgcagtccagagtggtgcaaggaaaggagccagcccatctcatgtccctgtttggcggaaagcccatgattatttacaagggtgggactagccgcgaggggggacagaccgccccagcatccacccggctctttcaggtgcgagccaatagcgctggcgctactagggccgtcgaggtcctcccgaaggccggagctctgaactccaatgacgccttcgtcctgaaaacccctagtgcagcttacttgtgggtcggtaccggcgcttctgaggcggagaaaaccggcgctcaggagttactacgcgtactcagagcccagccggttcaggtggccgaaggtagtgaaccagatggcttttgggaagccttggggggtaaggctgcttacagaacaagtccacgtcttaaagacaaaaagatggacgctcatccgccacgccttttcgcttgcagtaacaaaattggacggttcgtaatcgaggaggtaccaggagagctgatgcaagaagacctcgcaactgatgatgtgatgctgctcgacacttgggaccaagtgttcgtgtgggttggcaaagacagtcaggaagaggagaaaaccgaggcgctgacctccgcaaagcgctatattgaaactgaccctgctaacagggatcggagaacaccgattacagtggtgaagcagggctttgagccaccatcattcgtcggttggtttctgggatgggacgacgattactggtccgtggaccctctagacagagccatggccgaacttgctgcttag

SEQ ID NO: 224448 - DNA, 2196 bp, Artificial Sequence
  Description of Artificial Sequence: Synthetic coding sequence
atggtggttgagcaccccgagttcttaaaggcaggaaaagagcccggtttgcagatctggagagtggaaaaattcgatctggttccagtgccaacgaatctgtacggagattttttcaccggagatgcttatgtgatcctgaagaccgtgcaactccgaaacggaaatctgcaatacgacctgcattactggttagggaacgaatgctcgcaagatgagagtggagctgctgccatcttcaccgtgcaactggatgattacctaaacggtcgggctgtccagcatagggaggtgcagggattcgagagcgccactttcctgggttatttcaaatcaggactcaagtataaaaagggtggagttgcctctgggtttaaacacgtggtccccaacgaggtagttgtgcaacggctgttccaggttaaggggcgaagagtggttagggctacagaagttccagtgtcttgggaaagctttaacaatggcgattgctttatcctcgacctaggaaacaacatccatcagtggtgcggcagtaatagtaatcgatacgagcggctcaaggccacgcaggtcagcaaaggtatccgcgacaatgagagatccggaagggctagggtgcatgtttcggaggaaggtacagagcccgaagcaatgctgcaagtactggggccaaagcctgccctccctgcgggaaccgaagacacagccaaggaggacgccgctaacagaaaactagctaagctctacaaagtgtctaacggcgcaggaacaatgtccgtttccctcgttgcagacgaaaacccctttgcccagggcgcactaaagtctgaggactgttttatcttggatcatgggaaagacggcaagatattcgtctggaaaggcaaacaggcgaacacagaagagaggaaagccgcacttaagacagcgagcgacttcatcaccaaaatggactaccccaagcagacgcaagtgagcgtgctccccgagggcggtgagacccccctgtttaaacagtttttcaagaactggcgtgaccccgatcaaaccgacggcttgggcctgagctatctctccagccacattgcaaatgtcgagcgggtaccttttgatgctgccaccctccacacgtcgacggcgatggccgctcagcatggcatggacgatgatggcaccggtcagaagcagatttggcggatcgaaggatctaacaaggtgccggtggatccggctacttacgggcagttctacggaggggactcttacatcatcctctacaattataggcatggagggaggcagggacaaatcatatataactggcagggtgcccagagcacgcaagatgaagtggctgccagtgctattctcacagcccagctcgacgaggagctcgggggtacaccagttcagtcacgtgtcgttcagggcaaggagcccgcacatctaatgagcctattcgggggaaagccaatgattatctacaagggaggcacatctagagagggcggtcagaccgccccagcttcaacacggttattccaggtgcgggcaaactccgctggtgctaccagagccgtggaggtattacccaaagccggtgctctgaacagcaacgacgcattcgtgctcaagactccttcagccgcatacctgtgggtgggcactggagcgagtgaggcagaaaagaccggggctcaagaactcctgcgggtgctaagagcccagcctgtgcaagtagcagaggggtcagaacctgatggcttctgggaggcacttggaggcaaggctgcataccggacctctcctcgtctgaaggacaagaagatggacgcccaccccccaagactgttcgcctgcagcaataaaattgggagattcgtaatcgaggaagtccccggtgagctgatgcaagaggacttggctactgacgatgttatgctcctggacacatgggatcaggtcttcgtttgggtgggaaaggactcacaggaagaagagaaaactgaggcgctgacctccgctaagcgctacatagaaaccgatcccgctaatcgggatcgcagaacgcccatcaccgtggtgaaacagggattcgagcctccctcgttcgtgggctggttcctgggctgggacgatgactactggagtgtcgacccccttgatagagccatggccgaacttgcagcatag

SEQ ID NO: 224449 - DNA, 783 bp, Artificial Sequence
  Description of Artificial Sequence: Synthetic coding sequence
atggtggtcgagcatccggagttccttaaggcgggaaaagaacccggactgcaaatctggcgcgtggaaaagttcgatctagtacccgtcccaacgaatttgtatggcgactttttcactggagatgcctatgtgatactgaagactgtgcagcttcgcaacggaaacctccaatatgacctacattactggctcgggaatgagtgtagccaggatgagtccggggcagctgcgatattcaccgttcagctggacgattatttgaacggtcgtgctgtgcagcacagggaggtacaggggttcgagtctgctacattcctcggatatttcaagagcgggttgaaatataagaagggaggagtcgctagcggatttaagcatgtcgtgcccaatgaagtagtagtacagaggctgttccaggtgaaaggcaggcgggtggtgagggcgacggaggtgccggtgtcttgggaatcatttaataatggagattgcttcatcctcgacctggggaacaatatccatcagtggtgcgggtctaactctaaccggtatgagaggctgaaggctacgcaggtcagtaaaggaatccgggataacgaaagatcaggcagggccagggtgcacgtgagcgaggaggggacggagccagaagccatgttacaagtgctcggccctaaaccagctctgcctgcagggactgaagacactgccaaagaagatgcagccaataggaagctggccaagctgtataaggtctccaatggcgctggcactatgtcatag

SEQ ID NO: 224450 - DNA, 2229 bp, Artificial Sequence
  Description of Artificial Sequence: Synthetic coding sequence
atggagaaacttttttgttgtttcccgaatagcatggtggttgagcacccagagtttctgaaagccggaaaggagccaggacttcagatttggagagtcgaaaaatttgacttagttccagtaccaacaaacctgtacggcgatttcttcactggtgatgcttacgtgatcctgaaaaccgtacagctgcgaaatgggaatctgcaatacgaccttcactactggctgggtaacgagtgttcccaggatgagtctggtgcggcagcaatctttacggtgcagctagacgattatctaaatggtcgggctgtgcaacacagagaagtccagggatttgaatctgctacatttctgggatacttcaagtctggcctcaagtacaaaaaaggcggtgtcgcttctggattcaagcacgtcgtgcctaatgaggtcgtggtgcagcgcctttttcaggtgaaagggaggcgggtcgtgagagctaccgaggtccctgtctcctgggaatcatttaacaacggcgattgctttatactggaccttggaaataacattcatcagtggtgcggctccaactctaatagatacgagcgactgaaggcaacccaggttagtaagggcattcgagacaatgaacgaagcggaagggcccgagtacatgtgtcagaagagggcactgaacccgaagctatgttacaggtgctcgggccaaagcctgccctgcccgcaggcacggaagacactgcaaaagaggatgctgccaataggaagcttgctaagttgtacaaggtaagcaacggcgctggcacaatgtccgttagtctcgtggcagatgagaatccctttgcgcagggtgccctcaaatccgaggattgcttcatactggatcatggtaaagatgggaagatcttcgtgtggaaaggaaagcaagcaaatacagaggagcggaaagcagcactcaagaccgcctcagacttcattaccaaaatggattaccctaaacagacgcaagtgtccgttttacctgaggggggtgagactccccttttcaagcagttttttaaaaattggcgagatccagaccaaacagacggattgggtctcagctatctgtcctcccatatcgccaacgtagaaagagtgccattcgacgctgctacgttgcacacaagtaccgccatggctgcccagcatggtatggatgatgacggcaccgggcaaaaacaaatctggagaattgaaggaagcaacaaggttccagtggatccggcaacatatggccagttttacggaggcgattcttacattatactgtacaattacaggcatggtgggaggcaggggcaaatcatttacaattggcagggcgctcagagtactcaggacgaagtcgctgctagtgctatcctgacagctcagcttgacgaagaactaggcggtacaccggtccaaagccgggttgtccaaggtaaggagcccgctcacctcatgtccctcttcggcggaaagccgatgattatctataagggaggcacgtccagggagggcggtcagacagcacctgcaagtacccgtctgttccaggtgagagcaaactctgcaggggctactagggcagtggaggtgctcccaaaagctggagcccttaattccaatgacgcgttcgtcctaaaaacgccaagcgctgcctatctgtgggtcggtacaggggcttctgaagctgagaaaacaggtgctcaggagcttctgcgagtgctgcgggctcagccagtacaggttgccgagggctctgagcccgatgggttctgggaggcactgggaggcaaggctgcgtacaggacgtctccgagattaaaggataagaagatggatgcacatcccccacgcctatttgcgtgttccaacaagatcggaagattcgtaatcgaagaggtgccaggtgaacttatgcaggaggatctcgccacagacgacgttatgctcctcgacacttgggaccaggtttttgtgtgggtgggtaaagactcacaggaagaggagaagaccgaagccctgacgtccgccaaacggtacattgagaccgatcctgctaaccgtgatcgcaggacccccattaccgtggtcaagcaggggtttgaaccaccgtcatttgtcggctggttcctggggtgggacgacgactactggtcagtggaccctctggatcgagctatggcagaactggctgcttag

SEQ ID NO: 224451 - DNA, 2196 bp, Artificial Sequence
  Description of Artificial Sequence: Synthetic coding sequence
atggtggtggaacaccctgaatttcttaaggcaggaaaggagcccggtctccagatctggagggttgaaaaatttgatttggtgcccgtgcccactaacctgtacggtgatttctttacgggcgatgcctacgtcatacttaagaccgtgcagctgagaaacgggaacctgcagtacgatttgcactattggctgggtaatgaatgctcacaggatgagtcaggcgctgccgctatttttaccgtacagctggatgattatctgaatggcagggcagttcagcaccgcgaagtgcaaggtttcgagagcgcaacattcttggggtatttcaaaagtgggctgaagtacaagaagggaggagtcgcctcaggattcaagcacgttgtcccaaatgaagtggtggtgcagcggctgtttcaggtcaaggggaggagagttgtacgagccactgaggtaccagtgtcttgggaaagcttcaacaacggggattgcttcattctggaccttggcaataacatccatcagtggtgcggaagcaacagcaaccggtacgagcgcctcaaagcaactcaggtgtccaaggggatccgagacaacgagcggagcggaagagctcgcgttcatgtgtctgaggaaggcacagagcctgaagccatgctgcaggtgctgggacctaaaccagccttgccagctgggactgaagacacggctaaggaggacgctgcgaatagaaaactcgctaaactgtataaggtcagtaatggcgctggcacaatgagtgtgtccttggtggccgacgagaaccctttcgcccaaggagcgctgaagtccgaagattgtttcatcctggaccacggcaaggacggcaagatatttgtttggaagggtaagcaggccaatacagaggagcgcaaggctgcccttaaaaccgcttccgactttattaccaagatggattacccaaaacaaacgcaagtatcagtcctaccagaaggaggcgaaactcccctgttcaagcagtttttcaaaaactggcgcgaccccgaccaaaccgatgggttaggcctcagttacctctcttctcatattgccaatgtggaacgcgttcccttcgacgccgcaactttgcacacctctaccgctatggctgcccaacacgggatggatgacgatggcaccggccagaagcagatctggagaattgagggcagtaacaaggtgcccgtggaccccgcaacatatggtcagttctatggcggtgatagctatattattttatacaactaccgacacggaggccgtcaagggcagattatctataattggcagggagcgcaaagtacccaggacgaggttgcagcatctgcaatcctgacagcccaactggatgaggagttagggggtacccctgtgcaatcacgggtcgtgcagggcaaggagcccgcacatctcatgtccctcttcggcggaaagccgatgataatctacaaagggggaaccagtagggaagggggacaaaccgcccctgcttcaacccgtctgtttcaggtacgtgccaactcggctggcgctacaagggccgttgaggttttgccaaaagctggcgctctgaactctaatgatgcctttgttctgaaaactccgtcagccgcttacctctgggttgggactggcgcttccgaggccgagaagactggggctcaggaattgcttcgggtcttgagggcccagcccgtccaggtcgccgagggatcggaacctgatggcttctgggaggcactcggcggtaaggctgcttatagaacatccccccgtcttaaggataaaaagatggacgctcatcctccaagattattcgcctgttccaacaaaattgggcgttttgtcattgaggaggttccaggagagcttatgcaggaggatctcgccaccgatgatgtcatgttgcttgatacttgggatcaggtgttcgtttgggtaggtaaggatagccaagaggaggagaagaccgaggccttgaccagcgctaagcgctacattgagaccgatcccgctaatcgtgatcgacgcacgccaataactgtcgttaaacagggcttcgagcctccatcgttcgtcggctggtttttgggctgggatgatgactattggagtgtagaccccctggatcgggctatggcggagttagccgcatag

SEQ ID NO: 224452 - DNA, 2118 bp, Artificial Sequence
  Description of Artificial Sequence: Synthetic coding sequence
atggtggtggagcaccctgagttcctgaaggcgggtaaagagcccggtttgcagatctggcgcgtggagaaattcgacctggtgcccgttccgacgaatctttacggcgatttttttaccggggacgcctacgtaatcctgaaaactgtccagctgaggaacggcaaccttcagtatgacctccactattggctggggaatgaatgcagtcaggatgaaagtggtgcggcagctatattcacagtgcagcttgatgactacctgaaatacaaaaagggtggtgtcgctagcggcttcaagcatgtcgttccgaatgaagtggttgtgcagaggctttttcaggtgaaaggacgccgtgtggtccgggcaacagaagtaccagtatcctgggaatcttttaacaatggggactgttttatactcgatctggggaacaatatccatcagtggtgcggctcaaattcaaacaggtatgagagattaaaggcaacacaggtgtctaagggtatccgagacaacgagcgctccggcagagcgagagttcacgtttccgaggaaggtacagagccagaggccatgctacaggtactggggccaaagccagccttgcctgccggtacagaggacacagctaaggaagatgcggctaatcgcaaactcgcgaaactttacaaggtttcaaatggagccggaacgatgagcgttagcctcgttgcagatgagaatccctttgcgcagggcgctctcaagtcggaagactgctttatcttagatcatggtaaagacgggaagatctttgtgtggaagggaaaacaggccaatacagaagagcgtaaggccgctcttaaaactgcttcagatttcattaccaagatggattaccccaagcaaactcaagtgtcagtgctgcctgaaggcggtgagacccccctgttcaagcagttctttaagaattggcgtgatccagatcagaccgatggcctcggactgtcgtatctctcttcacatatcgcgaatgttgaacgcgtgcccttcgacgccgctacacttcacacctctacagctatggcggcacagcacggcatggacgatgatggcacagggcagaagcagatctggcgaatagagggatctaacaaagttcccgtcgatcctgccacctatggtcagttctatggtggagatagttacatcatcctgtacaactacaggcacgggggacgccaagggcaaattatttacaactggcagggggcacagagcactcaagacgaagtggctgcatctgcaatcttgacagcccaactagacgaggagctggggggaacacctgtacagagccgggttgtccagggaaaggagcccgctcatctgatgagtctttttggagggaaacccatgattatctataaagggggaacctctagggaaggaggccagactgccccagctagtacacgcctttttcaggtgagagcaaattccgccggagccacccgcgcagtggaagtgttgccaaaagctggcgctctcaactccaatgatgcgtttgtgctaaagaccccctccgctgcttatctgtgggtgggaacaggggcttcagaggccgagaagacaggggcacaggagttattgagggtgctgcgcgcacagcccgtccaggtggccgaaggatctgagcctgatggcttttgggaagccctcggcggaaaagccgcataccgcactagtccaaggctcaaggacaaaaaaatggatgcacatcctccgagattgttcgcctgtagtaataagatcggacgcttcgtaatcgaggaggtgcccggagaactcatgcaggaagacctggccacagacgacgttatgctgctcgatacctgggaccaggtgttcgtgtgggtgggtaaggactctcaggaagaggaaaaaaccgaagcactgacatcagccaaacgctacatcgaaacggatcccgcaaatagggacaggcgcactcccatcaccgtggtgaaacagggctttgagcctccctctttcgttggatggtttctgggctgggacgatgactattggtcagtagacccgcttgaccgagccatggcagagttggccgcatag

SEQ ID NO: 224453 - DNA, 2220 bp, Artificial Sequence
  Description of Artificial Sequence: Synthetic coding sequence
atgcccctatgcaccccaaactcaatggtagtggagcacccagagtttctgaaggccggtaaggagcccggactgcagatctggcgcgtggaaaagttcgatctcgtaccagttcccacgaatctctatggcgatttctttaccggcgacgcctacgtcatcctcaaaacggtgcaactccgtaacggtaatctacagtatgatctgcactattggctgggtaacgagtgttcccaggacgaaagcggtgcagccgctatttttaccgtgcagctggatgactacctcaacggcagagctgtccagcaccgggaggtgcaaggatttgaaagtgcaaccttcctgggatacttcaagtccggactcaaatataagaaagggggtgtcgcttctggattcaagcatgtggttcccaatgaggtcgtggtgcaacggcttttccaggtcaaggggcgtcgggtggtgcgggctacagaagtgcccgtttcctgggagtcgttcaataatggtgactgtttcattcttgaccttggtaataatatccatcaatggtgtggaagtaacagcaaccgatacgagcgtctcaaagcaactcaggtttcaaaggggattagggacaatgagcggtcaggcagggcgagggtccacgtgtctgaagaaggaaccgagccagaagcaatgctccaggtgctgggccctaagcccgcactccctgcgggaaccgaagataccgctaaagaagacgctgccaacaggaagttagctaagttgtacaaagtgagcaacggcgctggcactatgtctgtttcactggttgcggacgagaaccctttcgcacaaggggctctgaagtcagaggactgtttcatactcgatcatggtaaagacgggaagattttcgtgtggaaaggtaaacaggcaaacaccgaggagcgcaaggcggcactcaaaaccgcttcagacttcatcacgaagatggattacccaaagcagacgcaggttagcgttcttccagaaggcggtgagaccccgctgtttaaacagttcttcaagaattggagggaccccgaccaaaccgatgggctggggctgtcctacctttcctcacacattgctaacgtcgagagggttccgtttgatgcagcaacattgcataccagcacagctatggcggcacagcacggcatggatgacgacgggactggccaaaaacaaatttggaggattgaaggctccaacaaggtgcctgtggacccagccacctacggtcagttctacggcggagattcttacataatactgtacaactatcggcacggcggaaggcagggacagatcatctacaattggcagggagcccaatcaactcaagacgaggtggccgcaagcgcgatactgaccgctcagcttgatgaggaactgggtggtacccctgtacagtctagagtagtgcaggggaaagagcctgcacacttgatgtcccttttcggaggtaaaccaatgatcatctataaaggcggtacctcccgagaaggcggacagacggcacctgcaagcacgcgcttattccaagtccgggcaaattcagcgggagccacgcgagctgtagaagtgctgccaaaggcaggggctttgaactcgaatgatgcatttgttctgaagaccccatctgccgcttacctttgggtgggaactggggcatccgaagccgagaagacaggcgctcaagagctgctgcgcgttctgagagcgcagccagtccaggttgctgaagggtccgaacccgacgggttctgggaagccttgggcggtaaagcagcctaccgcacttcaccaaggctcaaggataaaaagatggatgctcacccaccaaggttattcgcttgctctaacaagatcggcaggttcgtgatcgaagaagtccctggggaactgatgcaggaagaccttgctactgatgatgttatgctgctcgatacatgggaccaggtttttgtgtgggtgggcaaggattcgcaggaagaggagaagacagaagccttgacaagcgctaaacgatatattgaaaccgaccccgcaaacagagacaggagaactcccattactgtcgttaaacaaggatttgaacccccatcttttgtcggttggttcctggggtgggacgatgactactggtctgtggatccactggacagggcgatggcagagctggctgcttag

SEQ ID NO: 224454 - DNA, 4527 bp, Artificial Sequence
  Description of Artificial Sequence: Synthetic coding sequence
atgggccaagaacccagaactctgccaccctctcccaactggtactgtgctcgttgtagcgacgccgtgcccggagggctctttgggttcgccgcaagaacatccgtcttcctggtcagggtaggacccggtgccggtgaatcccctggcacacccccattccgcgtgattggagagctcgtaggacatactgaacgggtgtctggctttactttttcccaccaccctggacagtataatctgtgcgccacttcaagcgatgatggtacagtaaagatatgggacgtagagaccaagaccgtcgtgacagagcacgctctgcaccaacataccatttccaccctccattggtcaccacgcgtgaaggacctcatcgtgtccggtgacgagaagggagtggtcttctgctactggtttaatcgaaacgacagccagcaccttttcatagagccacgcaccatattctgcctcacatgctcgccccaccacgaagacctggtagccattgggtacaaagatggtatcgtcgtgatcattgacatttctaaaaagggagaagtcattcacagactgcggggacatgatgacgagattcactccattgcttggtgcccgctgcccggtgaggattgtctgagcattaatcaggaggagactagtgaggaggctgagatcaccaatggtaatgctgttgcccaggccccagtgaccaaaggatgctatctcgctacgggctccaaagatcagactattagaatttggagttgctctagggggaggggagtcatgatccttaagctgccattcctcaagcgtcgcggtgggggaatcgaccctacagtcaaggagcggctgtggctcacgctccattggcctagcaatcagccaacacagctggtcagctcttgctttggtggcgaattattgcagtgggatctcacccagtcctggcggaggaagtacaccctgttcagcgcctctagcgaagggcaaaatcactctcgcatcgtgttcaatctctgcccgcttcagaccgaggatgataagcagctcctacttagcacctccatggatcgagacgttaaatgttgggatatcgccaccctggagtgttcttggactctgccctctctcggaggctttgcctacagcctggccttctcaagcgtcgatataggatcactggctatcggggtgggtgacgggatgattcgcgtgtggaacacactttccatcaaaaataactacgacgttaagaacttttggcagggagtgaagtctaaagtcactgctctttgctggcacccaactaaagagggttgcttagcctttggcaccgatgacggaaaggtgggcctttacgacacttattctaacaaaccccctcagattagttccacctaccacaaaaagaccgtttacacccttgcctggggtcccccagtgccacccatgtctctcggtggcgaaggagatcgtccgtccctggctctgtattcttgcggcggagagggcattgtgctgcagcataatccttggaagctttccggggaagcgttcgatattaacaagttgattagagacacaaactcaatcaaatataaactgcctgtgcacaccgaaatcagctggaaagccgatggcaagattatggctctggggaacgaagatgggtccatagagatatttcagataccgaatttgaaactaatatgcaccattcaacaacaccataagctggttaacaccatcagctggcatcatgaacacggctctcagcccgagctctcttatcttatggccagcggctccaacaacgccgtcatctacgtgcataatcttaaaaccgtgatcgaaagctcccccgaatctccagttacaataactgaaccgtatcgcacactctcaggtcacacagcaaaaatcacgtccgtggcttggtcccctcaccatgacggtcgactggtttctgcttcatatgacggcaccgcccaggtatgggatgctctcagagaagagccgctttgtaatttcagagggcacagagggcgtttgctctgtgtggcctggagcccgcttgatccagattgcatatactccggggcagatgacttttgcgtgcacaagtggctgaccagcatgcaggaccacagccggcctccccaaggtaagaagtctatcgaactggagaaaaagcgtctaagtcagcccaaggcgaagcctaaaaaaaagaaaaaacctactctgcggacgcccgtcaaactggagtccattgatggcaacgaggaggaatcaatgaaagagaacagcgggccagtggaaaatggcgtgagtgatcaagaaggcgaagaacaggcgcgagagcctgaactgccatgcgggctggctccggcagtgtctcgggagccagtcatatgcacacctgtgtcatctgggttcgagaaaagtaaggtgacaatcaacaataaggtcatcttactcaagaaggagcctcctaaggaaaagccggaaaccctaatcaagaagcgtaaggccaggagtcttctaccattatccacgagtctagaccacagatctaaggaggagctgcatcaggactgtctggtgctggctactgctaagcattcacgagagttaaacgaagatgtgtctgcagatgtagaggagcggtttcacctaggactgtttacagacagggctaccttgtaccgaatgatcgacatcgagggcaaagggcatctggagaatggccacccagaactgtttcatcagctcatgttgtggaaaggcgacctcaaaggggtcctgcaaacagcagctgagaggggagaattgacagacaatctcgtggcgatggcacctgctgccggataccacgtctggttgtgggctgtcgaggctttcgcaaaacagctttgctttcaggatcagtatgtgaaagccgcatcccatctcctgtctatccataaggtgtatgaggccgtggagttattaaaatcgaaccatttctatagagaagcaattgctatagccaaagctagactgaggcctgaggaccccgtgcttaaggacctgtacctgtcttgggggacagtcctggaacgggacggtcattatgccgtcgccgctaagtgctacctgggcgctacctgcgcttatgacgccgctaaagtcttggcgaagaaaggggatgccgcaagcctccgaacagcagccgagttggcggctatcgtcggggaggacgagctctcggcctctttagccctgagatgcgcccaagagctgctgctcgccaacaactgggttggcgctcaggaagcattacagttacatgagtccctccagggccagagactagtgttttgtctactcgagctgctctccaggcatttggaagaaaaacaactctctgagggtaaaagttcatcgagttatcatacttggaacacaggaaccgagggccctttcgtagagagagtcactgctgtgtggaagagcatttttagccttgacaccccagaacaatatcaggaagctttccagaagctccagaacatcaagtacccaagtgccacgaacaacactcctgcgaagcaattgctcctccatatctgtcacgacctgacactcgccgttctgagccaacaaatggcctcttgggatgaagccgtgcaggcacttttgagggccgtggtgcgctcctatgactctggtagctttacaattatgcaggaagtgtatagcgcctttttaccagatggatgcgaccacctcagggataagcttggcgatcaccagtctccggctacccctgctttcaagtctctggaggctttttttctgtacgggaggctctatgagttctggtggagcctatcccgtccatgtcctaactcctccgtatgggtgcgggcaggccataggaccctctctgttgaaccaagtcagcagctggacacagcttccaccgaagagactgaccccgagacaagccagcctgagcctaatagacccagtgagctcgacctgcggctgacggaggagggagagagaatgctctctacctttaaggagctattcagtgaaaaacacgcaagtctccagaatagccagaggaccgtcgcagaagtgcaagagactttagccgaaatgatccgacagcaccagaaaagtcagttgtgtaagtctaccgctaatggcccagacaagaacgaacccgaggtcgaggcagaacagcccttatgctcgagccaatcacaatgcaaggaggagaaaaacgagcctctatcactgcccgagctaacaaaaaggctgaccgaggctaatcagcgcatggctaaattccccgagagtatcaaggcctggccattccctgacgtcctggaatgctgtctggtcttgcttctcatcagatcacacttccctggttgccttgcgcaagagatgcagcagcaagcccaggaactgcttcagaaatacggcaacaccaagacctatagaaggcactgccagaccttctgtatgtag

SEQ ID NO: 224455 - DNA, 396 bp, Artificial Sequence
  Description of Artificial Sequence: Synthetic coding sequence
atgcagactccggtcaatatacccgtccctgttttgcgactaccccgaggacctgatggattcagcagaggctttgcccctgacggccgacgcgcacccctgaggccagaggttcctgaaattcaggagtgtccaattgctcaggagagcctcgagtcccaagaacaaagggccagagcagctctgagggaaagatatcttagaagcctgctcgcaatggtggggcatcaggttagtttcactcttcacgagggcgtgcgcgttgctgctcatttcggagctacagacctggatgtggccaatttttacgtgtcccagctgcagaccccaatcggggtccaggcggaggccctcttgagatgttccgacataatttcttacacctttaaaccttag

SEQ ID NO: 224456 - DNA, 396 bp, Artificial Sequence
  Description of Artificial Sequence: Synthetic coding sequence
atgcagacaccggtcaacatacctgtgcccgttttacgactgccacgtggccctgatggattctccagggggtttgcacccgatggacgccgtgctcccttaagacccgaagtgcctgaaatccaggagtgtcctattgctcaggagagcttggagtctcaggaacagcgagccagagcggcactccgggagcgttacctccgttccttgctagccatggtgggccaccaagtgtcttttactctgcacgagggggtgcgagtcgctgcacactttggggcaaccgatctggatgtggccaatttctatgtgagccaactgcagacccctatcggagtgcaggccgaagctctactgaggtgcagtgacattatctcttatacgttcaaaccctag

SEQ ID NO: 224457 - DNA, 2913 bp, Artificial Sequence
  Description of Artificial Sequence: Synthetic coding sequence
atggacgccgcagaacctggactcccccctggacccgaaggtcggaaacgatatagcgatattttccggagcctcgacaatttggagatcagtcttggaaacgtgacgctggaaatgttggctggtgatccgctgttgtccgaggatccagagcccgataagactcccacagccacagtgactaatgaagcttcttgctggtcgggtccctctccggaagggccagtgccactgactggcgaggagctggatctaaggcttattaggaccaagggcggtgtggacgctgctctcgagtacgctaaaacctggtctcggtatgccaaagagctattggcctggacggagaagagggcctcttacgagttggaattcgccaagagtactatgaagattgcagaggcaggcaaggtgtctatccagcagcagagccacatgccgctgcagtacatttatacattgtttctagagcatgacctttccctgggaacacttgccatggaaacagtagcacagcaaaaaagggattactatcaacctctggcggctaaacgcaccgaaatcgaaaaatggaggaaagaatttaaggaacaatggatgaaagagcaaaaacggatgaatgaggctgtacaggccttacgacgagcccagttgcagtatgtgcagcggtctgaagatttgcgagcacgctcccagggcagtcccgaggactccgcaccgcaggcatcacccggaccctcaaagcagcaggagaggcgtcggcgatcaagagaggaagctcaagcgaaggcgcaggaggctgaggcactttatcaggcttgcgtgcgcgaggctaatgcgcgacagcaggacttggagatcgccaaacagcgcattgtttcccacgtccgcaagctggtcttccaaggcgatgaagtgctgaggcgagtcaccctgagtctgttcggcctgcgaggagcccaggcagagcgagggccaagagcctttgctgcactggctgagtgttgtgctccatttgagcctggtcagagataccaggagttcgtacgtgctctcagaccggaggctccacctccgcctccacctgctttcagcttccaagaattcttgcccagtctgaacagctcccctcttgacattcgcaagaagctctccggaccgctccccccacgccttgacgagaattcagcagagcctgggccttgggaggatcccggaactggctggcgctggcagggcacgcccggaccgacccccggatcagatgtggattcagttggagggggatccgaatcacgtagcctcgacagtcctactagttcccccggtgcaggcaccagacaacttgtgaaggcttcttcgaccggtaccgagtccagtgatgatttcgaggagcgcgaccctgacctgggtgacggtctggaaaatggactcggctctcccttcggtaagtggacactgtcctccgctgcacaaacccaccaactgagacgccttcgcggaccagccaagtgtcgggagtgcgaagctttcatggtctcaggaacggaatgcgaggagtgtttcctcacatgccacaaaaggtgcctggagactctcctgatcttatgcggacaccgacgtctgcccgctagaacccctctattcggagtcgactttcttcagctgcctagggactttcctgaagaagtcccttttgtagtgaccaagtgcactgctgagatcgagcaccgcgcactggacgtgcaaggcatctaccgggtgagtggttccagggtgcgcgtggaaagactctgccaggccttcgagaatggacgggctttggttgagctttccggcaacagcccgcacgacgtcagctcagtgttaaagcgcttcctgcaggagcttacggagcctgtgataccattccatctctacgatgcctttatctctttggcaaagactctccacgccgacccgggagatgatccaggtaccccctcaccctcccccgaggtgatccgcagtctcaaaaccctcctggtgcaactgccagactctaactataataccctgaggcatctggttgcccatttgttccgtgtagctgctaggttcatggaaaacaagatgtctgcgaacaatctgggcattgtgttcggtcctaccctcctccgccctccggacggtcctcgggcagcctctgctatccctgttacatgtctgcttgattccggtcatcaagcccagcttgtggaattcctgatcgttcactatgagcagatcttcggaatggacgagctgccccaagccaccgagccaccccctcaggatagctcacctgcaccgggtcctctcacgacttccagtcaacctccccctccccatttggaccctgactcccagcctcccgtgcttgcttcggatccgggtcccgacccgcagcaccactcaaccctggagcagcatcctactgcgacccctaccgaaattcccacccctcagtcagaccagcgcgaggatgtggctgaagacactaaagacggcggaggggaggtctcttcccaaggccctgaggactcgttgctgggcactcaatcacgcggacatttttcgaggcagccggttaagtatcctcggggtggtgtccgtcctgtcacgcaccagctaagtagcctggcacttgttgctagtaagctgtgcgaggagacccccatcacttctgtccctagggggtcgcttagggggaggggacccagccccgcagccgcatccccagaggggtcccctctgcgcagaacgcctctgcctaaacacttcgagataactcaggaaacggctcgcctcctcagcaagttagacagcgaagctgtaccgagggctacctgctgcccagacgtgcagccggaagaggccgaagatcatctgtag

SEQ ID NO: 224458 - DNA, 2826 bp, Artificial Sequence
  Description of Artificial Sequence: Synthetic coding sequence
atggacgcggctgagcccggactgcccccaggacccgaaggtcgcaagcgctatagcgacatcttccgcagccttgataacctggagatctctcttggcaacgtgacattggaaatgcttgccggagaccctctgctgtccgaggatccggaacctgataaaactccaactgcgactgtcacaaatgaggccagttgctggagcggacccagtcccgagggccctgtcccactgactggagaggagctggacctccgactcatacgcacaaagggcggagtggacgctgcactggaatacgctaagacatggagtaggtacgcaaaagagctcctcgcctggacagaaaaacgggcttcttacgagctggagttcgcaaaaagtacaatgaagattgccgaggctggaaaagtttcaatccagcagcagtctcatatgcctttgcagtatatctataccctatttttggaacatgatcttagccttggaactttggccatggaaactgtcgcacagcagaagcgagattactaccaaccgctggccgcaaagagaacagagatagaaaagtggagaaaagagttcaaagagcaatggatgaaggagcagaaaaggatgaacgaggcagtgcaggcccttcgaagggcacagctgcagtacgtgcaacgatccgaagacctgagagctcggagtcagggcagccctgaggacagtgcacctcaggcatcacctggaccaagcaagcagcaggaacgacgcagaaggagtcgggaggaagctcaggccaaggctcaggaagcagaggctctttaccaggcatgcgtccgagaggctaacgcacggcagcaggacctcgaaatcgcgaaacagcgcattgtgtctcatgtcaggaagctggtgttccagggggatgaagtgcttcgcagagtcaccctgtcgttatttggactgcgtggcgcacaagcggagagaggtcctcgggcattcgctgcactagccgaatgctgtgcgccatttgagcccggtcagcgctaccaggaattcgtgcgtgcactgcgacccgaagctccacctcctccaccacctgcattctcgttccaagagttcctcccgtccctgaattcctctccactcgacattcgaaaaaaactctccggaccactgccaccccgactcgacgagaactcggccgaaccgggaccttgggaggatcctgggacaggttggcgctggcaagggcctacacctggttccgacgttgatagtgtgggtggtggttctgaatctcgcagcttagattcacccacctcctccccagatctgggagacggacttgagaacgggctggggtccccctttggtaagtggaccctttcatcagccgctcagacccaccagctccggagactcagaggccctgccaagtgcagggaatgcgaggcctttatggtctcaggtactgagtgcgaagagtgctttctgacctgccacaagagatgcctggagacgctactgatactctgtggtcaccgacgcctgcctgctagaactccactctttggggttgacttcctacaactcccacgggatttccccgaagaggttcccttcgtcgtgacaaaatgtacggctgagattgagcaccgcgcacttgatgtccaggggatatatagagtatcaggctcaagggtaagggtagaaagattgtgccaggcattcgagaatgggcgagccttggtagagctgagcggaaattctccccacgacgttagctcagttttgaaacggtttttgcaggagctgacagaacccgtgatcccctttcacctgtacgacgcgtttatcagtctggctaaaaccctgcacgctgatcccggtgacgatcctggcacacctagtccatctcctgaagtaattcgctctctgaagacattactggtccagctgccagattccaactataatacgttgcggcatttggtggcccatctgtttcgcgtggctgccaggttcatggagaacaaaatgtctgcaaacaatttgggcatagtgttcggacctactctgctgaggcccccagatggaccaagggctgcttccgccattccagtgacatgtctgttggattcaggacaccaggctcagttagtggagtttctgatcgttcactatgagcagatatttgggatggatgagctgccccaggctaccgaacctccgcctcaagatagctcccctgctcccggacccctgactaccagctcgcagccaccccctccccacttagatccagatagtcagccaccagttctggctagcgaccccggtcccgaccctcagcatcactccaccctagaacagcacccaactgcaacaccaacagaaatccccactccccagagcgaccagcgcgaagacgtggctgaagacaccaaagacggtggcggtgaggtgtcctcccagggtcccgaagattctttgctcggaacccagagtaggggccacttttcacgacagcctgttaaataccccagagggggtgtgagacctgtgactcaccagctgagttccctcgctctagtggccagcaaactttgtgaagagactcccattacatcagtccctcgcggatcactccggggaagaggtccgtctcctgctgctgcgtctccggaagggagtcctctccgcaggactccactacccaaacacttcgagatcactcaagaaactgccaggctactaagcaaactggactccgaggccgtacccagagcgacatgctgcccagatgtacaaccagaagaggcagaagaccatctgtag

SEQ ID NO: 224459 - DNA, 1005 bp, Artificial Sequence
  Description of Artificial Sequence: Synthetic coding sequence
atgaatactatcctgccctgccaggaccagtacttcgttggcggacaaagctataactgcccctactcaactaccacctcagaatcctccgtggatgtgtctaccgagacctgggtctctttctgggccgctggcctgctggataacagggaactgcagcaggcccctcaggcacaggagtctttttcagacagtaattttccattacctgacctttgcagctgggaggaggctcagctatctagccagctttaccgcaacaagcagctccaggatacactcgtgcagaaggaggaagagctcgcgcgactgcatgaggagaataatcaccttcgccagtacctgaacagtgcactggtgaagtgcttagaggaaaaggccaagaagctgctttctagcgacgagttttccaaggcgtatgggaaatttcgaaagggtaagagaaaatccaaagagcagcggtactccccagcagagattccacatcctaaaaacgcaaagaggaacctgagttcagagtttgccaattgcgaagaacaggcaggtccacctgtcgacccgtgggtactacaaactcttgggctgaaagacctcgatactattgatgatacctcttctgccaactattctgcactcgctagccatcctcggagagtagcctcaaccttcagtcagtttcccgatgacgctgtggattataagaacatccccagagaagacatgcccattgactacagaggagataggaccaccccactgcactccacagcaacccatggggaggactttcatatactgagccagcttagtaatcctccggtcggcctgaagacactgccctattacactgcacacgtgtcaccgaacaaaaccgaaatggccttcagtacgagcctctctccccattgcaatgtcaaaacacacagcttccaccagggccaggccttcgtgcggagagacgaggaaggcggttggaaattcacttgggtccccaagcagtcctag

SEQ ID NO: 224460 - DNA, 2727 bp, Artificial Sequence
  Description of Artificial Sequence: Synthetic coding sequence
atgggagtcaacgatctgtggcagattctcgaaccggtcaaacaacacatccccttgagaaacctgggcggaaagactatagccgtggatctgagtctgtgggtgtgcgaggcccaaacagtgaagaaaatgatgggcagcgtgatgaagccgcatctgcggaacctcttttttaggatcagctacctgacccagatggatgtaaaactagttttcgttatggaaggcgagccaccaaagcttaaagcggacgtcataagtaaacgtaatcagtcaagatatggctcatcaggtaaatcatggagccaaaaaaccggcaggagccattttaaaagcgtgttgagggagtgtttgcacatgctcgagtgtctggggattccgtgggtgcaggctgctggggaggcggaagcaatgtgtgcttacctcaatgctggaggacacgttgatggatgcctcacaaatgatggagatacgtttctgtatggagcccagaccgtgtatcggaatttcaccatgaacacaaaggacccacacgtagattgttacactatgagttccatcaaatctaagctgggactagaccgggacgctctggtcggactggcaatactgttggggtgcgactatctgccgaaaggagtgcctggagtcggaaaggagcaggccctgaagcttattcaaattctcaagggccaatccttgcttcagcggttcaatcgatggaacgagacttcttgcaacagcagcccccagctcctcgtaactaaaaaactcgcacactgtagcgtgtgctctcatcctgggagccctaaagatcatgaaagaaacggttgccgcctgtgtaaaagcgataaatactgtgaacctcatgactatgagtattgctgtccctgcgagtggcacaggaccgaacacgatcggcagttgagtgaggtggagaacaacattaagaagaaagcgtgctgctgcgagggattcccattccatgaagtcatccaagagttcctgctgaataaggataagctcgtaaaagtgattagataccagagaccagacctgttgctgtttcaacggttcaccttagagaagatggagtggccaaatcattatgcctgtgagaaacttctggtccttcttacacactatgatatgattgagcgaaagctcgggagtcggaattctaatcagctgcaacctattcggattgtcaagacgcggatacgtaacggagtgcactgctttgaaatagaatgggagaaaccagaacactatgccatggaggataaacagcatggagagtttgcccttctgactatcgaggaggagagtttgttcgaggcggcttaccccgaaattgtggccgtctaccagaagcagaagctcgagattaaaggcaaaaagcagaagcgcatcaagcccaaagagaataatctgcccgaaccagacgaggtgatgagctttcagagtcatatgacactcaagccaacctgcgagatttttcacaaacagaatagcaagctgaattcaggcattagtccggacccaaccctgccacaggaaagcatctccgcaagtttgaacagcctgttactcccaaaaaacacaccttgcctgaacgcccaggagcagttcatgtcatccctgcgcccactcgcaattcagcagatcaaggccgtgtccaagtccttgatctccgagtcgagccaacccaacacttcctcacacaacatttctgtgattgctgatctgcacctcagtacaatcgactgggaaggtacatcttttagcaactcccccgcaatccagcgcaataccttcagccacgatctgaagagcgaagtggaatcagaactaagtgccattccagacggcttcgagaacattcctgagcagctgtcatgcgagtcagagcggtatacagctaatatcaagaaggtactcgatgaagactcggacggaatctcacctgaggagcacctcctctcgggaataacagatctgtgcctgcaggacctacctctgaaggagcgcatattcactaagttgtcttatccacaggataacctgcaaccagatgtgaacctgaagaccctctcgatactgtctgtgaaggagtcatgcatagcaaattcaggctcagattgcacgagccacctgagcaaagatctcccaggtataccgctgcaaaacgaatctcgggattctaagattctgaagggagaccaacttctgcaggaagactacaaagttaacacaagcgtaccctactctgtgagcaacacagtggtcaagacctgtaatgtgcggcctcccaatacagccttggatcattcccggaaggttgacatgcagaccacgaggaagattctgatgaaaaagtccgtctgcctcgacagacacagctccgatgaacagagtgccccagttttcgggaaggctaaatatactacccaacgaatgaaacactcttcccaaaagcacaattcaagtcactttaaagaaagcgggcacaacaaacttagcagcccaaagattcacatcaaagagactgagcagtgtgttagatcttacgaaaccgccgagaacgaagagtcatgttttcctgactctactaaaagtagccttagctcgctgcagtgtcataagaaggagaataattcaggtacatgcctggattcccctttaccactgcggcagcgcctgaagctacgctttcagagtacttag

SEQ ID NO: 224461 - DNA, 2727 bp, Artificial Sequence
  Description of Artificial Sequence: Synthetic coding sequence
atgggagtgaacgatttgtggcagatcctggaaccggttaagcagcacatcccgctgcggaacctggggggtaaaaccatcgccgtcgacctgtccctctgggtgtgtgaagcgcagacagtgaagaaaatgatgggcagtgtgatgaaaccccatctgaggaatctgtttttccgcatctcctatctaacccagatggatgtcaagttggtattcgtcatggaaggcgagcctcctaaactgaaggctgacgtgatcagcaagaggaatcagagtagatacggatctagcggaaagtcatggtcccagaaaactggtcgctctcatttcaagtcagtgctgagggagtgtctacacatgctagaatgtctcggcatcccttgggtacaagccgctggcgaagccgaggccatgtgcgcgtacctcaatgcaggcggtcacgtggacgggtgcctgacaaatgacggagacacctttttgtacggagcgcaaaccgtatatcggaacttcactatgaacaccaaagaccctcacgtggactgctatacgatgagcagcattaaatcgaagcttggtctggacagggatgccctggttggcctcgctatcctgctgggctgcgactaccttcctaaaggcgttcctggcgtcggaaaagagcaggcactgaagttgatccagatactgaagggccagtccctgcttcaacgcttcaaccgctggaacgaaacatcatgcaatagttcgccccagttgttggtgactaaaaaactcgctcattgttccgtgtgcagccatcccggatcccctaaagaccatgaaagaaacggctgtagactctgtaaaagcgataagtattgcgagcctcatgactacgagtactgttgtccctgtgaatggcataggactgagcatgataggcagctgtctgaggtcgaaaacaacataaagaaaaaagcctgttgctgcgagggattcccattccacgaggttattcaagagtttttgttgaataaagacaaacttgtaaaggtgatccggtaccagcgacccgacctgctcctgtttcaacggttcaccctggaaaaaatggagtggcctaaccactatgcatgcgagaagctcctggtgcttcttactcactatgacatgatcgaaagaaaattaggctctcgaaattccaaccaattacagccaataagaattgtaaaaactcggattaggaacggagttcactgttttgagattgaatgggagaagcccgaacattatgccatggaagataaacagcatggcgagttcgcactactgacaatagaggaagagtcccttttcgaagccgcttacccagagattgtagccgtgtatcagaagcagaaactggagataaagggaaaaaaacaaaaaaggatcaaaccaaaggagaacaacctaccagagcctgatgaagtcatgagcttccagtcccacatgactttaaagcccacgtgcgagattttccacaagcaaaatagcaaacttaatagtggcattagccctgatcccaccctacctcaggaatcgattagcgcctcgctgaactctctgctgctgccaaagaacactccttgcctgaacgcccaggaacagtttatgtcctcactcaggccactcgccattcagcagatcaaggctgtctccaagagtctcatatcagaaagttctcagcctaatacatcctcccacaacatctcggtgattgcagatctgcatctctctaccatcgactgggagggaactagcttctcaaatagcccagcaatccagcgaaacactttctctcacgacttgaaatcggaagttgagtccgagctgtccgccattcctgacggcttcgaaaatatccccgaacagttatcttgtgagtccgaaagatacacagccaatatcaaaaaagtgctggatgaagactctgacggtatttcgcccgaagaacacctattatccgggataaccgacctctgtctccaggatctgcccctcaaggaacgaattttcacaaagttatcatatccacaggacaatttacagccagatgtaaacctgaagacattgagcatcctctcggtaaaagaatcgtgtatagcaaactccggctctgactgcactagccatctttccaaggatcttcctgggattccattgcagaacgaatcaagggatagcaagatccttaagggcgaccagcttctgcaggaagactacaaagtgaacacaagcgtcccttattctgtctctaacactgttgtcaagacttgtaatgtaaggccccctaatacggctctcgaccattctcgcaaagtcgacatgcagacgacccgaaagattctgatgaagaaatcagtgtgcctggataggcatagttctgacgagcagagtgctcctgtgttcggaaaggctaaatataccacacagcgaatgaaacactcaagccagaagcataatagctctcacttcaaagagtctggtcacaacaaactgagcagtcctaagatacacattaaggaaactgaacagtgcgtgagatcctatgagaccgcagagaatgaagaatcgtgtttccctgattccactaagtcctcactgtcaagcctgcagtgccacaaaaaagaaaataacagtggcacatgcctggacagccccctccctctgcggcagagattgaagctccgatttcagagcacctag

SEQ ID NO: 224462 - DNA, 381 bp, Artificial Sequence
  Description of Artificial Sequence: Synthetic coding sequence
atgggagtcaatgacctctggcagattctcgagccagtgaagcagcacattcctctacggaatttggggggaaaaaccatcgcggttgacttatctctgtgggtgtgcgaagcccagacagttaaaaagatgatgggttcggtgatgaaaccacaccttcgcaacttgttctttagaattagctacctgactcagatggacgtaaaactcgttttcgtaatggagggtgaaccacccaaattgaaagccgacgtgatttccaaacgcaatcaatcccggtatgggagcagtggtaagtcttggtcgcagaagacaggtagatcccacttcaagtcagtattacgggaatgtctgcacatgctggagtgcctgggcatatag

SEQ ID NO: 224463 - DNA, 282 bp, Artificial Sequence
  Description of Artificial Sequence: Synthetic coding sequence
atgggggtgaacgatctctggcaaatcctggagcctgtgaaacagcatatacctttacggaacctggggggaaaaacaatagcagttgacctgtcactgtgggtttgcgaagcacagactgtgaagaaaatgatgggaagcgtcatgaaaccgcatcttagaaacctattcttcagaatcagctatcttacccagatggatgtgaaacttgtgtttgtgatggaaggagagcctcccaagctgaaggccgatgttatttcgaagcgtaatcagagcagatag

SEQ ID NO: 224464 - DNA, 1431 bp, Artificial Sequence
  Description of Artificial Sequence: Synthetic coding sequence
atggagtggcctaatcactatgcatgcgagaagcttttggttttgctgactcactatgacatgattgagcggaaactaggatcgagaaacagcaaccagctccagcctatccgtatcgtgaaaactcggatcaggaacggggtacactgctttgagatcgagtgggaaaagcctgagcactacgccatggaggataaacagcacggcgaattcgcactgctaacaatcgaggaagagtcactctttgaagcagcctatccagaaatcgtggcagtgtatcagaaacagaagctggagatcaaaggaaagaagcagaaacgaataaagccgaaagaaaacaatctacccgagcccgatgaagtcatgtctttccaatcacacatgaccctgaaacccacctgcgagatattccacaaacaaaacagcaagttgaattccgggatatccccagatccaacccttccccaagaatccatctcagcttccctgaacagtcttttgctcccaaagaacaccccgtgtctcaatgcgcaagaacagttcatgagttctttacggccactcgcaatccagcagattaaggctgtctccaagtctctcatttccgagtctagccagcctaacaccagtagtcataatatatccgtgatagcagacttgcatctgagcaccattgactgggaaggtacttcgttttctaacagccctgcaatacagcgcaacacgttcagccacgacctcaaatccgaggtggagtctgaactttccgccatccctgacggctttgaaaacattccagaacagctgtcctgcgagagtgagcgctataccgccaatattaaaaaagtgctagatgaagactctgacggcatcagtccagaggagcatctgctgtccggaatcaccgatctttgtcttcaggatctgccactcaaggagcgcatcttcaccaagttatcctatccccaggataacctccaacctgacgttaatctcaaaaccctcagtatactgagtgtgaaggagtcatgtatcgcgaattcaggcagcgattgtacttcccacctgagcaaagatcttccgggtattccactgcagaacgagagtcgggatagcaaaatccttaaaggtgaccagctcctccaggaggattacaaggtcaataccagtgtaccatacagtgttagcaatacagtagtgaagacatgtaatgttaggccccctaatacagcccttgaccatagccgcaaggttgatatgcagaccacacgaaagattctgatgaagaagtctgtctgtttggatcgacacagctccgacgaacagtctgcccctgtctttggcaaggctaaatacactacgcagagaatgaaacacagctcccaaaaacacaacagcagccatttcaaagagtctgggcacaatgaatag

SEQ ID NO: 224465 - DNA, 1437 bp, Artificial Sequence
  Description of Artificial Sequence: Synthetic coding sequence
atggcatgcctgaatcccgtaccaaaattgtatcgatcagttatcgaagacgtgatcgagggtgtcagaaacctgtttgccgaggaggggatagaagaacaagtgcttaaggatctaaagcagttgtgggagaccaaagtcttgcagagtaaggcgactgaagatttcttccggaacagcattcagagccccctgtttacactccagctaccccatagtctgcatcaaactctgcagagttctacagcttccctggtgattccagctggccgaacactcccaagctttacgacagctgagctcggaaccagcaacagttccgctaactttacattcccagggtaccccatacacgtgcccgcaggagtgaccctccaaaccgttagcggccatctgtacaaggtgaatgtgcccattatggtaacggaaacttcgggcagagcgggtatccttcagcaccccattcagcaagtgttccagcaattggggcaaccttccgtcatccagacgagcgtgccacagctgaatccttggagcttgcaggccacgacagagaagtcccagcgcatagaaaccgtgctgcaacaacccgctatacttccaagtggtccagttgaccgaaagcacttggagaatgcaacctcagatatacttgtatctcctgggaacgaacacaagattgtgccagaggccctgctttgccatcaggaaagctcacactacatttccctgcccggagtggttttttcaccccaggtaagtcagacaaatagcaacgtggagtcagtactgtccggctccgcttctatggcacagaatctccacgatgaatctctgtctaccagcccgcacggcgctctgcaccaacacgtgacggatatccagctgcatatccttaaaaacagaatgtacggctgcgacagcgtgaagcagccccgaaacattgaagaaccttcaaacatacccgtgtccgagaaggatagcaattcgcaggtcgacctcagtattcgcgtgactgatgatgacattggcgaaattattcaggtggatggatccggggatacatcctctaatgaagagattggtagcacgagggacgccgatgaaaacgaattcctggggaacatcgacggcggagatctcaaggtccccgaggaggaggcggattccattagcaatgaggatagcgctacaaacagttctgacaacgaagatccccaagtcaatattgtagaggaagatccgctcaactctggtgatgatgtgtctgagcaggacgtacccgacctcttcgatacagataatgttatagtgtgccagtacgataagatacacaggtctaaaaataaatggaagttctacctgaaggacggtgtgatgtgcttcggcggaagggactacgtgttcgctaaggcaatcggtgacgctgagtggtag

SEQ ID NO: 224466 - DNA, 1335 bp, Artificial Sequence
  Description of Artificial Sequence: Synthetic coding sequence
atggcatgtcttaatcctgtcttatgggaaactaaagtcctacagtccaaggctaccgaagacttctttcggaattcaatccagtccccactcttcactctacagctcccccattctctccatcagaccttacagtctagcaccgcatctttggtgatcccagccggacgaactctgccaagtttcactaccgctgagctgggcacaagcaactcttcggccaactttacattcccagggtaccccatccacgtgcccgctggggtgacactccagaccgtgagtggccacctctacaaagtcaacgtgcccataatggtgaccgaaaccagcggccgagctgggatccttcaacacccaatccaacaggtttttcaacagctggggcagccatcagttatccagacatccgtgccacagctgaatccatggtccttgcaagctactaccgagaagtcgcagagaattgagaccgtacttcagcagccagccatccttccgtctggtcctgtggatagaaagcacttggagaatgctacctcagacatcctggtaagccctggcaacgaacacaaaattgtgcctgaggcccttctttgccaccaggagtcatcccattacatctccctgcccggagttgtattctcaccacaggtgtctcaaactaatagtaatgttgagtcagtgcttagcggttccgcatccatggcccaaaacctgcacgacgagtctctttccacaagtccccatggtgccttgcaccaacacgtcaccgatatccagttgcacattcttaaaaatcggatgtacggatgcgactcagttaaacagcctagaaacattgaggagccttcgaacatccccgtcagtgaaaaagatagcaatagtcaggtcgacttatctatcagagtgaccgacgacgatatcggtgagattattcaagtagatggcagcggcgatacatcgagcaatgaggaaatcgggagcacccgggatgctgacgagaatgaattcctgggaaatattgacggcggagacctgaaggtcccagaggaggaagctgactctatctcaaacgaagattccgcgactaactcttcagataacgaagacccccaggttaatatcgtggaggaagaccctctgaactccggtgatgacgtctccgagcaggacgttcccgacctctttgatactgataacgttattgtttgtcagtatgacaagatacatcggagcaagaacaagtggaagttttatcttaaggatggcgtgatgtgtttcgggggacgcgactacgtgttcgccaaagcgatcggtgatgccgagtggtag

SEQ ID NO: 224467 - DNA, 951 bp, Artificial Sequence
  Description of Artificial Sequence: Synthetic coding sequence
atggcttctactagtaggctcgacgcccttcccagagtaacgtgtccgaatcaccctgatgcaatcctggtagaggattatagagcaggggacatgatctgcccagaatgcggcctggtagttggagatcgagtaatcgacgttggcagcgagtggcgcacctttagcaacgacaaagccacaaaagacccatccagggtgggggattctcaaaaccctctgctgtccgacggagatctgtctactatgattggcaaaggaaccggagccgcatctttcgacgagttcggcaatagcaagtatcagaaccggcgtaccatgagcagcagcgaccgtgctatgatgaacgcctttaaagaaatcactaccatggctgatcggataaatctcccaaggaatatcgtggaccgaacgaataacttgtttaagcaggtgtatgagcagaaatctctaaaaggcagagcaaacgacgccatagcatctgcttgtctatacattgcttgccggcaggaaggtgttccacggactttcaaggagatttgcgctgtgagccgtatttcaaagaaagagatcggcagatgttttaagctgatcctcaaggctttagaaaccagcgtggatctcatcaccacgggagatttcatgagtcggttttgctccaacttgtgcttgcccaagcaggtgcaaatggcagccacacatattgctaggaaagccgtagagctcgacctagttcctggtaggtcaccgataagcgttgcggctgccgctatctacatggcctctcaggccagtgcagagaagagaacccagaaggagatcggcgacatcgccggagtcgcagacgtaacaatacgccagtcttatagattgatctacccgagggccccagatctgtttcccacagacttcaagtttgacaccccagtggacaagttaccacaactatag

SEQ ID NO: 224468 - DNA, 696 bp, Artificial Sequence
  Description of Artificial Sequence: Synthetic coding sequence
atggcaagcacctctagactggatgccctgccccgtgtcacttgccccaaccaccctgatgctatattggttgaggactacagagctggggatatgatatgccccgagtgtgaccgagtgatcgatgtcggttccgaatggcggacattctcaaacgacaaagcaaccaaagatccttctagggtgggcgactcacagaacccactgctctctgacggagacctcagtaccatgatcgggaaaggcaccggagcagcaagttttgacgagttcggaaatagcaagtatcagaatcggcgtaccatgagctcgagcgacagggctatgatgaacgcgttcaaggagatcacaacaatggctgatagaatcaatctaccacgcaatattgttgacagaacgaacaatctttttaagcaggtgtacgagcagaagtccctaaagggccgtgcaaatgacgctattgcttcagcctgcttatatatcgcatgccgacaggagggagtgcccaggacttttaaagaaatctgcgcggtctccagaattagcaagaaagagatcgggcgttgcttcaagctgatcctaaaagccttggagacatctgtggaccttattacgactggcgattttatgagcagattttgctctaatctctgtctgcccaaacaggtacaaatggctgcgacgcacattgcttag

SEQ ID NO: 224469 - DNA, 675 bp, Artificial Sequence
  Description of Artificial Sequence: Synthetic coding sequence
gcctccactagccgactggacgcactcccacgagtgacctgccccaatcaccctgacgccattctcgtggaggactacagagccggagatatgatttgcccagagtgtggactcgtcgtgggcgacagggtaattgatgtgggaagtgagtggcggaccttcagtaatgacaaggccacaaaggacccttccagggtgggagattcacagaatcccctgttgtccgatggggatctgagcacaatgatcggtaaagggacaggagccgcatcctttgacgaatttggcaactcaaagtaccaaaaccggaggacaatgtctagctcggaccgagccatgatgaatgccttcaaagaaataaccacaatggccgataggatcaatttacccagaaacattgtagatcgaactaataatctgttcaagcaggtctatgaacagaaatctctcaaggggcgagcgaacgatgcaatcgcctctgcatgtctgtatatcgcttgcaggcaggagggcgttccgaggactttcaaggaaatttgtgctgtttccaggatttcgaagaaagagattggtaggtgttttaagctgatcttaaaggccttggagacgtccgtggatctgatcacaaccggagacttcatgtcacgcaattggcgatattgctggtgttgctag

SEQ ID NO: 224470 - DNA, 876 bp, Artificial Sequence
  Description of Artificial Sequence: Synthetic coding sequence
atggatccttctctcctccgtgaacgcgagttgttcaagaaacgagctctcagcactcctgtggtcgagaagcgctccgcaagctccgagagttcaagctcctcatctaagaagaaaaaaactaaggtggagcacgggggatcaagtggatctaaacagaactccgaccattccaacgggagcttcaaccttaaggcattgtcgggcagtagtggatacaagtttggagtcctggccaagatcgtaaattatatgaagactcgccatcagcggggtgatacccacccacttaccctggatgaaattcttgacgaaacacagcatctggatatcggactgaaacaaaaacagtggttaatgaccgaggctctggtcaataaccctaaaatcgaagtgattgacggcaagtacgcctttaagccaaagtacaacgtcagagacaagaaggccctgctgcgcctgctggaccaacatgaccaacggggactgggcggtattctgctagaagatattgaagaggcactgcctaattcgcagaaagctgtgaaggccctgggcgaccaaattctctttgtgaatagacccgataaaaagaaaattttgtttttcaatgacaaaagttgtcagtttagcgtagacgaagagttccaaaagctgtggagatcagtcaccgtcgattccatggacgaggaaaagattgaggaatatttgaaacggcaaggaatctcttcaatgcaagagtctggtccgaaaaaagtggcccctatccagaggcgcaagaagcccgcaagtcagaaaaagaggcgcttcaaaactcataatgagcacttggctggcgtcctgaaggattatagtgatatcacctcctctaaatag

SEQ ID NO: 224471 - DNA, 381 bp, Artificial Sequence
  Description of Artificial Sequence: Synthetic coding sequence
atggaccccagcctccttagagaacgagaactctttaaaaagcgcgcattgagtacgccagtggttgagaagcgaagtgcaagctcagaaagtagttcctcctcaagcaagaaaaagaagactaaagttgaacatgggggttccagcggctcgaaacaaaattccgaccactctaacggctcgtttaaccttaaagcattaagcgggagctccgggtacaagttcggggtgctggccaaaatagtaaattatatgaagactcgccatcagaggggcgatacacatcctttgaccttagacgaaatcctggacgaaacccagcatctggacattggcctaaaacaaaaacagtggctgatgactgaagcacttgtaaactag

SEQ ID NO: 224472 - DNA, 597 bp, Artificial Sequence
  Description of Artificial Sequence: Synthetic coding sequence
atggatcctagcttattgcgggagagggagttgttcaaaaaacgcgcattaagtaccccagtcgtagagaagcggtctgcgtcctccgaatcttcaagttcgagctctaaaaagaagaagactaaagtggaacacgggggttcatctggatcgaaacagaattcagatcatagtaatggctcctttaacttgaaagctttatctggtagcagcggatacaaatttggggttttagcaaaaattgtcaactacatgaaaaccagacatcaaaggggagacacacatccgctcaccctggacgaaattctcgatgagacccagcacctggatattggcctgaagcagaagcagtggctcatgacagaggcccttgtgaataatcccaagatcgaggtcattgatgggaaatacgcttttaagcccaagtacaatgtgcgggacaaaaaggccttgctgaggctgctggatcagcatgatcaacgtggcctgggtgggattttgctcgaagacatcgaagaggccctaccaaacagccagaaagccgtcaaagctctgggagatcagatcttattcgtcaacaggccagataagaagtag

SEQ ID NO: 224473 - DNA, 1554 bp, Artificial Sequence
  Description of Artificial Sequence: Synthetic coding sequence
atggccgcactcggaccatcatctcaaaatgtaaccgaatacgtagtcagagtgcctaagaacaccacgaagaagtacaacattatggcgttcaatgcagctgacaaggtcaacttcgctacgtggaaccaagctcgtctcgaacgcgatctttccaataagaaaatctaccaggaggaggagatgccagagtccggcgcaggctccgaatttaaccgtaagttgcgtgaggaagccagacgtaagaaatacggcatcgtgttaaaggagtttcgacctgaggatcagccctggctcttacgagtgaatggcaagtcaggaaggaagttcaaggggattaagaagggcggagttaccgaaaatacttcgtactacatcttcacccaatgcccagacggagccttcgaggcatttcctgttcacaattggtacaacttcacccccttagccaggcatcgaactctcaccgcagaggaagctgaggaggaatgggaacgtcgcaataaggtcttaaaccactttagtattatgcagcagcgcaggctgaaggaccaggatcaggatgaggacgaggaagaaaaggaaaaaagagggcgaaggaaagcctccgaactgaggatacacgacttggaggacgatcttgagatgtccagcgacgcaagtgacgctagcggcgaggaaggcggaagggtgccgaaagccaagaagaaggcaccactggcaaaaggcggtaggaagaaaaagaagaagaaggggagtgatgatgaagcgtttgaggattccgatgacggcgattttgaaggacaagaagtggactatatgtccgacgggagttcctcatcacaggaagaacctgagagtaaggctaaggcccctcagcaagaagaaggacccaaaggcgtggacgagcagtctgatagcagcgaagaatcagaagaggaaaagcctcctgaagaggacaaagaagaagaagaggagaaaaaggctcctactccacaggagaagaagagaaggaaggactcgtcagaagagtcggattcttccgaagaatcggacatcgattccgaggcatcatcagcactctttatggccaagaagaaaactcccccaaagcgagaacgcaagcccagtggaggatctagtagggggaacagcaggcctgggaccccaagtgctgaaggagggagtacgtccagtactctgagagctgctgcttcgaagctggagcaggggaaaagagtgtcggagatgcccgctgcgaagaggttgcggcttgacacgggtccccagagtctgagcggcaaatctacccctcagccccctagcggcaagaccacacccaatagcggggatgtccaggttactgaagacgccgtgcgtaggtatctgaccaggaaaccgatgacaacgaaagatttgctcaaaaagttccaaaccaagaagactgggctctcttccgagcaaacagttaatgtactggctcaaattctcaagaggctgaatccagaacgtaagatgatcaacgacaaaatgcacttcagtttaaaagagtag

SEQ ID NO: 224474 - DNA, 1299 bp, Artificial Sequence
  Description of Artificial Sequence: Synthetic coding sequence
atggctttcaacgctgctgacaaagttaactttgccacctggaaccaggcaaggctggaacgcgacctgtccaataagaagatttaccaagaggaggagatgcccgaatctggagcaggatccgaatttaataggaaactgcgcgaggaggcaagacggaagaagtatggaatcgttctcaaggaatttagacccgaggaccagccctggctgctgagagtcaatgggaaaagcggcaggaagagaaataaggttctgaaccatttctctatcatgcagcagcggaggctcaaagatcaggaccaagatgaggacgaggaagaaaaggagaaaaggggacgacgcaaggccagcgagcttcgtattcacgacctcgaggatgacctggagatgagtagcgacgcctcagatgctagcggtgaagagggaggtagagtgccaaaggccaagaagaaggccccattagcaaaaggcggacgaaaaaaaaaaaagaaaaagggatctgacgatgaagccttcgaagactccgacgacggggacttcgaaggccaggaagtcgactacatgtctgatggaagtagctcctcacaggaggagccggaaagcaaagccaaggcccctcagcaggaggaaggacccaagggggtcgatgaacagagcgattctagcgaagagtcagaggaagagaaacctccagaggaagataaggaagaggaagaggagaagaaggcccctactccccaggaaaaaaaaagacgaaaggacagttccgaagagtccgattcatccgaggagtctgacatagactctgaggcctccagcgctttgttcatggctaaaaagaaaacccctcctaaacgggagaggaaaccctccggtggatcaagtcgaggaaactcccggcctgggaccccatctgccgagggcggaagtacctcaagcactctgagagcagccgcttcgaagctcgaacagggcaagcgtgtttcagaaatgcctgccgctaaacggctgagactggatacgggacctcagtccctttcagggaagtccacaccacagcccccatctggaaagacgacccctaattctggtgatgtgcaggtgaccgaggatgccgtgcgacgctacctcactcggaagcccatgaccacaaaggacctgctgaagaagtttcaaaccaaaaaaacggggctgagttccgaacaaacagtaaatgtgcttgcccaaattctaaaacgtctgaatccagagaggaaaatgattaacgataaaatgcacttcagcctgaaggagtag

SEQ ID NO: 224475 - DNA, 384 bp, Artificial Sequence
  Description of Artificial Sequence: Synthetic coding sequence
atggcagctctcggacccagcagccagaacgtaacagagtacgtggtgagagtacccaagaacaccacaaagaaatacaatatcatggctttcaatgctgctgataaagtcaatttcgccacttggaatcaagcaagattggagagagatttatcaaacaagaagatataccaggaggaggagatgccagagagcggagctgggtccgaatttaataggaagttgagagaggaagctcgtaggaagaaatacggaattgttttgaaagagtttaggccagaggaccaaccgtggttgctgcgggtgaatggcaagtctgggcgaaagttcaagggcatcaaaaaaggaggggtgacagaaaatacctcctactacatcttttag

SEQ ID NO: 224476 - DNA, 1647 bp, Artificial Sequence
  Description of Artificial Sequence: Synthetic coding sequence
atggcgacgtcgagcgaagaggtgctgttaattgtgaagaaggtgaggcagaaaaagcaggatggtgcactgtacctcatggcggagagaatcgcctgggcccctgaaggaaaggacaggtttaccatctctcacatgtacgctgacatcaaatgtcagaaaatctctcccgagggtaaagccaaaatccagctacagttggtactgcacgctggcgatacgaccaactttcatttctcaaatgaatccacagccgttaaggaacgggatgccgtcaaggatctgttgcagcaactgttacccaaatttaagagaaaagccaacaaggaactcgaagagaagaatcgtatgctgcaagaggacccagttttgttccagctttacaaagacttggtagtatcccaggtgatcagtgcggaggagttttgggcaaatcgtctgaacgtgaatgccactgactcgtcgtcaacctcaaaccacaaacaggatgtgggcatcagtgccgctttcctggccgacgtgagacctcaaacggatggctgtaacggactgaggtacaatctcacatcagacatcatagagagtattttcaggacttaccctgccgtgaagatgaaatatgcagagaatgtgcctcacaatatgactgagaaagagttctggactcggttcttccaaagccattacttccatagagaccgtctgaacactggtagcaaagacctgtttgcagagtgtgctaaaatcgacgaaaaagggctcaagactatggtgagtctgggagttaagaatccactcctcgatctgaccgcacttgaagacaaacccttagacgaaggatacggcatttcaagtgtgccatcagcttctaactcgaaatcaatcaaggaaaactcgaatgccgcaatcattaagcgctttaatcatcacagtgcaatggtcctcgcagccggactgcggaagcaggaggcgcagaatgagcaaacaagcgaaccaagcaacatggacggtaacagtggcgacgcagactgttttcagcccgcagtaaagcgggctaagttgcaggagtcgattgagtacgaagacctgggcaagaacaacagcgtgaaaaccatcgccctgaacctaaaaaaatcagaccgatactatcacggacctactccgattcagagccttcagtatgctacaagtcaggatataatcaacagttttcaatctatccgccaggagatggaagcctataccccaaagttaacccaggtcctgtctagcagcgctgcgtcctccacaatcacagctctgtctccagggggagcacttatgcagggagggacacagcaggccatcaatcaaatggtccctaatgacatacagtcagagttgaaacacttgtacgtggcagtcggcgaactgttgcgccacttctggagctgctttcctgtgaatacaccgtttctggaggaaaaagtggttaaaatgaagagcaacctggagcggttccaggtgacaaaattgtgcccctttcaggaaaagatacggcgacagtatctgtccactaacttggtgtcacatattgaggagatgctgcaaacagcatacaacaagcttcacacatggcagagccgacgcttgatgaagaaaacttag

SEQ ID NO: 224477 - DNA, 1647 bp, Artificial Sequence
  Description of Artificial Sequence: Synthetic coding sequence
atggccacttcgagcgaggaggtgttgctgatagtcaaaaaggttaggcaaaaaaagcaggacggtgccctctacctaatggcagagcgaatcgcttgggcgcctgaaggaaaggaccgcttcacaattagtcacatgtatgctgacatcaaatgtcaaaaaatctcaccagaaggtaaagcaaagatacaactgcagcttgtactccatgcaggggacactaccaacttccatttctctaatgagtccaccgcagtgaaagagagagatgcggtgaaagacctgctgcagcagctcctacccaagttcaagagaaaagcaaacaaggaactcgaagaaaagaaccggatgctccaggaggatccagttcttttccagctgtataaggaccttgttgtcagccaggtcatcagtgcagaggaattttgggctaaccgccttaacgttaacgcaacggactcaagctcgacttcgaaccacaaacaggacgttggaatttcagcagctttcttggccgatgttcggccacagaccgatggttgcaacggtttgcgttataacctaacatcagacatcatcgagtccatctttcgcacttaccccgctgttaaaatgaagtatgccgaaaacgtcccacataacatgaccgagaaagaattctggacgcggttcttccagtcgcactatttccatagggaccgcctgaacacgggtagtaaagatctgttcgccgagtgcgccaagattgacgagaaaggattgaagaccatggtgagtcttggggtgaagaatcccctgctagatctgacggcattagaagataagcctttagacgaagggtacgggatatcaagtgtcccatcagcgtcgaattccaagtccattaaagaaaatagtaacgccgcaatcataaaacgtttcaaccaccacagtgccatggtgctggccgcagggcttcgaaagcaagaggcccagaatgagcagacctccgagccatcaaacatggacggaaatagcggtgatgcggattgtttccagcccgctgttaagagggccaaactccaggagtccatagaatatgaagacttagggaagaacaacagcgtgaaaaccatcgccttaaatttgaaaaagtcggacagatattaccacgggcctacacctatccagagcctccagtatgctacaagccaggacattattaattctttccagtccatccgacaggagatggaagcttatacacccaaactaacacaggtgctgtcgtcatcagccgcatcatctacaattactgctctcagccctgggggagccctgatgcagggcggaacacaacaggccatcaaccagatggtgcccaacgatattcagtcagaactgaaacacctatatgtagctgtgggggagctgcttcgacacttttggtcgtgcttcccagtgaacaccccgttcctcgaagagaaagtcgtgaaaatgaagagtaatttagaaaggtttcaggttacaaagttgtgcccctttcaggaaaaaatccgccgacagtacctgtcaaccaatctggtctcccacattgaagaaatgctccaaactgcctataataaactgcacacctggcaatctcgcaggctgatgaagaaaacttag

SEQ ID NO: 224478 - DNA, 288 bp, Artificial Sequence
  Description of Artificial Sequence: Synthetic coding sequence
atggcgacatcaagcgaggaagtgctccttatcgttaaaaaggttcgccagaaaaagcaggacggagccctatacctgatggctgagagaatcgcgtgggcaccagaaggaaaggatcggtttacaatctcacatatgtatgccgatattaagtgccagaagatctcgcccgaggggaaagccaagatccagcttcaattggtcctccacgccggtgatactacaaattttcatttcagcaatgaatcaaccgcggtgaaagagagggatgctgtgaaagacttgtag

SEQ ID NO: 224479 - DNA, 1299 bp, Artificial Sequence
  Description of Artificial Sequence: Synthetic coding sequence
atgctgcaggaggatccagttctgttccagttgtacaaggacctggttgtgagtcaggttatctcagcggaggagttttgggcgaaccgcctgaatgtgaatgctacagactcttcctctaccagcaaccataaacaggacgtagggatctctgccgctttcctggccgacgtgcgtccccaaacggacgggtgcaacgggctgaggtacaatttgacgagtgatattatcgagagcatattcaggacgtacccagctgtaaagatgaaatatgccgaaaacgttcctcacaacatgacggaaaaagagttttggacccgattctttcagagccattactttcaccgcgacaggctgaacaccgggtccaaagacctgttcgcagagtgtgctaaaattgacgagaaaggtctcaagactatggtcagccttggagtgaagaacccacttctggacttgactgcactggaggacaagcccctggatgagggctacgggatatccagcgtcccctctgcgtctaattcaaaatctatcaaggagaattccaacgccgctatcatcaagcggttcaatcatcactctgctatggttttggccgctggcctgcggaaacaggaggctcagaacgaacaaacctctgaaccgtctaacatggatgggaacagcggcgatgctgactgttttcaacccgctgtgaagcgggcaaagttgcaagaaagcattgaatatgaagatttgggcaaaaataactctgtgaaaaccatcgccttgaatctgaagaaatcagaccggtactatcacggccctacgcctatacagagcctgcagtatgctaccagtcaagacatcatcaacagcttccagagtattagacaggagatggaggcctacacacctaagttgactcaggtcctatctagcagtgccgcatcctctacaatcacagccctctcgcctggtggagctcttatgcagggcggaactcaacaggccatcaatcagatggtgccaaatgatatccagtccgagttaaagcatctgtatgttgcggtgggggaactgctgaggcacttctggtcctgcttccccgtgaatactcccttcctggaggaaaaggtggtgaaaatgaagtctaatctggagcgcttccaggtgacaaagttatgtccttttcaagagaagatcaggcgacagtacctgtcaactaacctggtgtctcatatcgaagagatgctgcagacggcctacaacaaactgcatacctggcaatcccgtcgcctaatgaagaagacttag

SEQ ID NO: 224480 - DNA, 1188 bp, Artificial Sequence
  Description of Artificial Sequence: Synthetic coding sequence
atggatgaggaacctgaaagaactaagcgatgggagggcggttacgagagaacctgggaaattcttaaggaggacgagagcgggagcctgaaggcaacgattgaggacatcctttttaaggcgaagagaaaacgtgttttcgagcatcacggccaggtccgtctgggcatgatgcgccatttgtatgtggtggtggacgggtcccggactatggaagatcaggatctgaagcccaacaggcttacctgcaccctcaagctgctagaatacttcgttgaagagtactttgatcaaaatcccataagtcaaatcggcatcattgttaccaagagcaaaagagcggaaaaactcactgaactgtccgggaatcccaggaaacatattacgtctctgaagaaggccgtagatatgacctgtcatggcgaaccttctctatataattctctgagcattgcgatgcaaacccttaaacatatgcccggacacactagtcgcgaggtgctcattatatttagttcactgacgacctgtgacccatctaatatatacgatttgatcaagactttaaaggcagcgaagatcagggttagcgtgatcggcctgagcgctgaagtcagagtctgcaccgtactcgcacgggagaccggcggaacctaccatgtaatactggacgaatcccactacaaagagttgctgacacaccacgtttcaccaccccctgctagttcctcatcagagtgttccctgatccgcatgggattcccacaacacactattgcatctctctctgaccaggacgcaaaaccatcctttagcatggctcacctggacgggaatactgagcctggcctaacgctgggtgggtacttttgtccgcagtgccgtgccaagtactgtgagctgcccgtcgagtgtaagatctgtggtttgactttggtctccgcaccacatctggccaggagttaccatcacttatttcctctcgatgcctttcaggaaattccgttggaggaatacaatggggaacgattctgttatggatgccagggggaactgaaggaccagcatgtgtacgtgtgcgctgtgtgccagaacgtcttctgcgtggactgtgacgtgtttgtgcacgattctctccattgctgtcctgggtgtattcacaagatacccgctccctcaggagtttag

SEQ ID NO: 224481 - DNA, 1188 bp, Artificial Sequence
  Description of Artificial Sequence: Synthetic coding sequence
atggatgaagagcccgagcgcaccaagcggtgggaggggggatacgaacgaacctgggagatcctcaaagaggacgaatcaggaagcctgaaggcaacgatcgaggatatcctgttcaaggcaaaaaggaaacgagttttcgagcatcacggtcaggttagactgggaatgatgcgccacctgtatgtagtcgtagatgggtcaagaacaatggaagaccaagacttgaaacctaaccgactgacttgtacactgaagcttttagagtattttgtggaggagtacttcgatcagaatcctatctcccagatcggcattatagtcacgaaatcaaagagagcagaaaagttgactgagctcagcgggaacccccgtaagcatatcacgagtctgaagaaagcagttgatatgacatgccacggtgaaccatccctgtacaattccctgtccatagctatgcagacgctgaaacacatgcccggacatacttcacgcgaggtactgattatcttctcaagtctgactacatgcgatcccagcaacatttacgatctgataaaaacactgaaggcagccaagattcgcgtctctgttatcggcctgtctgcagaggtgcgggtctgcacggtgctagctcgcgagacaggcggaacttaccatgttattcttgatgagtctcattacaaagaactgctcacccatcacgttagcccacctcccgctagcagctcaagtgagtgttctctgatccggatgggcttccctcagcacacaattgcctctctatctgatcaggatgcgaagccctccttctctatggctcatctcgatgggaataccgagcccggtttaactctaggcggatatttctgcccacaatgcagggcaaagtactgcgaattacccgtggagtgcaagatctgcggtttaaccctcgtttcagcgcctcatctcgctagatcgtatcatcacctgtttcccctggacgcttttcaagagatacccctggaggagtataacggggagaggttttgctatggctgtcagggggagctcaaagatcaacacgtatatgtgtgcgccgtgtgccagaacgtcttctgcgtagactgtgatgtgttcgttcatgattccctccactgctgtccagggtgcatccacaaaatacccgcaccctcaggggtgtag

SEQ ID NO: 224482 - DNA, 1017 bp, Artificial Sequence
  Description of Artificial Sequence: Synthetic coding sequence
atgcgtcatctatacgtagtcgttgacggttcacgcaccatggaggaccaggaccttaaacctaatcgcctcacatgtactctgaaactgctcgagtattttgtggaggaatactttgatcagaatcctatcagccagatcggaataatagtgacgaaatctaagagagcagaaaagctcaccgaacttagtgggaacccaagaaaacacattacatccttgaaaaaagctgtcgatatgacatgtcacggtgagccaagcttgtataattcactctccattgcaatgcaaaccttgaagcacatgccgggacacactagtcgggaggttcttattatcttcagctcccttactacatgtgaccccagcaatatttatgacctcattaaaaccctgaaggctgccaagattagagtgtcagtgatcggtttgtcagcagaggtgcgtgtctgtaccgtgttggcacgggagactggcggtacgtatcacgtgattctcgacgagtcccattacaaggagttgctgacccatcacgtgtctccccctccagcatcctcctcctccgaatgcagtctgattagaatgggattcccccaacacaccatcgcatccctctctgaccaggacgcaaaaccatccttttcaatggcccacctggatggcaatacggaaccaggcttgaccctgggaggatacttctgccctcaatgtcgagccaagtattgtgagttgccagttgaatgtaaaatctgtggacttacactggtgagcgccccacatcttgccagatcataccatcatctcttccctttagacgctttccaagaaatcccattagaggaatacaacggcgaaagattctgttacggctgccagggagaactcaaggaccagcatgtgtacgtgtgtgccgtgtgccagaacgtcttctgcgttgattgcgatgttttcgttcatgactctctccattgctgccccggttgcattcacaaaatacctgcacctagcggcgtctag

SEQ ID NO: 224483 - DNA, 1188 bp, Artificial Sequence
  Description of Artificial Sequence: Synthetic coding sequence
atggacgaggagcctgaacggaccaaacggtgggagggcggatatgagcgcacatgggaaattctgaaagaggacgaaagcgggagcttgaaggccacgatagaggacattctcttcaaggccaagaggaaacgcgtcttcgaacatcacgggcaggtacgtctcggcatgatgcggcatctttatgtggtggtcgatggtagcagaacaatggaggatcaggacctcaagcccaaccgcctgacctgcactttaaagcttttggagtacttcgtggaggagtattttgatcagaaccctattagtcaaatcgggattattgtgactaaaagcaaacgagccgagaagttgaccgagctgagtggcaaccctagaaaacatattacatctttgaagaaggctgtggacatgacttgccacggcgagccttcactgtacaactccctgagtatcgctatgcaaacattgaaacacatgcccggacacacaagccgcgaggtgctgattatattctcatccctgacgacgtgcgatcctagcaatatttacgacctaatcaaaaccttgaaggctgcaaaaatacgtgtgtcagtaattggtctttctgctgaggttcgagtttgcaccgtgctggcaagagagactggtggcacttatcacgttattctcgatgagagtcattacaaggagcttctaacccaccatgtgagccctccccctgctagttcttcctcagaatgtagcttgatcaggatgggattcccccagcatacaatcgcaagcctgtcggaccaggacgccaagcctagcttctccatggcgcaccttgacggaaacacggagcctggacttaccctaggcggatatttctgccctcagtgtcgcgctaaatattgtgaattgcctgtcgaatgtaagatttgcggccttacactggtatcagctccacaccttgcccgatcctatcaccaccttttcccactagacgcttttcaggagatacctctcgaggaatacaatggagagaggttctgctacggttgccagggggagctcaaggatcaacatgtctatgtttgtgccgtgtgccagaacgtcttttgtgttgattgtgatgtattcgtccacgacagcctccactgttgccccggttgcatacacaagattccagccccatctggtgtgtag

SEQ ID NO: 224484 - DNA, 1389 bp, Artificial Sequence
  Description of Artificial Sequence: Synthetic coding sequence
atggaaagtactccctctcgaggtttaaacagggttcatctgcagtgcagaaacttgcaggagttcctgggaggcctgagcccaggagtgctcgatcgtttgtacggtcacccagccacctgtctagctgtgtttagagagcttccatccctagctaaaaactgggtcatgcgcatgctgttcttggagcagccgctgccacaggccgctgtggcattatgggtgaagaaagaattttccaaggcccaggaggaatcgacgggattactctcgggcctcagaatatggcatacacagctgctgccgggtgggctacagggcctaatactcaatccgatttttagacagaatctgcgcatagcattactcggaggcggtaaagcgtggtccgacgataccagtcagctcggacctgataaacacgcgagggacgtaccttccctggacaaatacgccgaagagcgatgggaggtcgtgttgcactttatggtaggctcgcccagtgccgctgtgagccaggatctcgcccagctgttgagccaggcagggctaatgaaatctacggaacctggggagcctccatgtattaccagcgcgggttttcaatttttgctcctggacacacctgcccagctgtggtatttcatgctccaatacttgcagacggcccagtcccgtggaatggatctggtggaaatactgagctttctgtttcagctgagcttcagcacactggggaaggactactcggtggaagggatgtccgacagcctgctcaatttccttcaacacttgagggagttcggtttagtttttcagagaaagcgcaagagcagacgatattatcctacaaggctcgccataaaccttagctctggcgtgtcaggagccggaggcacggtgcatcagccgggatttattgtcgttgagaccaattatcggctgtacgcctacacggagtccgaactgcagatcgccctgatcgcactgttcagtgaaatgttatatcggttcccgaatatggtggtggctcaggtgacccgggagtcagtccagcaagccatcgctagcggcattaccgcgcagcagatcattcattttctgcggactagggcgcatcctgttatgttgaagcaaacacctgtgctaccgcctactataaccgaccaaattcggctatgggaactggaaagagatcggctgcgcttcactgagggggtgctgtacaaccagtttctttcccaagtggacttcgagttgctgctggctcatgccagagagctcggagtgcttgtgttcgagaactccgccaagcggctgatggtcgttactccggcagggcacagcgacgtgaaaaggttttggaaacggcagaaacattctagttag

SEQ ID NO: 224485 - DNA, 1389 bp, Artificial Sequence
  Description of Artificial Sequence: Synthetic coding sequence
atggagagcaccccatcacggggactgaatcgtgtgcatctgcagtgtcgcaatctgcaggagttcctcggagggttgtcccccggagttctggatcgcctgtacggacaccccgctacatgccttgccgtctttcgagaacttcccagtcttgctaagaattgggtcatgagaatgctcttcctagagcagccactccctcaggccgcagttgccctctgggtcaaaaaggagttttcgaaagcccaggaagaatccacagggctgctcagtggactgcgaatctggcacactcaactacttcccggaggtctgcagggcttgattttgaaccccatttttaggcagaatctcagaatcgccctgctgggcggaggcaaggcctggtccgacgatacatcccagttaggcccagataaacatgcaagggacgtgccgtctcttgacaaatacgccgaagagaggtgggaagtcgtcctgcacttcatggtgggttccccgagcgcagctgtgtcccaggatttggcacaactcctgtcacaggctggcctaatgaagagcacagaaccaggggagcccccatgtatcactagcgcgggattccagttcctcctactggacacacctgcccaactttggtatttcatgctgcagtacttacaaaccgcccagtcccgcggtatggatcttgtcgaaattctatccttcctctttcagctgagtttttcaactttgggaaaagactattcagtcgagggcatgtcagattcgctcctcaattttcttcagcacttgagggagtttggtctggtgtttcagaggaagcgtaaatctcggcgttattaccccactcgtctggcaattaacttatcgtctggcgtttccggggctggagggaccgtccatcagccagggttcattgtggtggaaaccaattatcgcctgtacgcctacaccgagtcagagttgcagatcgcactcattgctctgttcagcgaaatgctctaccggttccctaatatggtggtagcccaggtgacacgggagtcagtgcagcaggcaatcgcatccggaattaccgctcagcagattatccactttctccgcactcgggctcatcccgtgatgttaaagcaaaccccagtgctgccccctactattacggaccagatccgtttgtgggagctagaacgtgaccggctgaggtttaccgagggcgtgctttataatcagtttttgagtcaggttgatttcgaactgcttctggcacatgctagggaactcggcgtgctcgtgttcgagaattccgcgaagcgattgatggtcgttacacctgccggacactccgatgtcaaacggttttggaagcggcaaaagcatagcagctag

SEQ ID NO: 224486 - DNA, 1389 bp, Artificial Sequence
  Description of Artificial Sequence: Synthetic coding sequence
atggagtcgaccccaagtaggggcctcaatcgtgttcatctgcagtgtagaaatctgcaggagtttctcgggggactgtctcccggagtgttggatagactttacggtcacccagcgacatgcctggcagtctttcgggaactgccgagcttggccaaaaactgggtcatgcgcatgctgttcttagagcagccgcttcctcaggccgcagtcgcattatgggtgaaaaaggagtttagcaaagcccaggaggagagtacagggctgctttcgggcttaagaatttggcatactcagctgttgccaggaggactgcagggcctgatcctcaacccaattttcaggcagaatctcagaatcgcactgttagggggtggtaaagcttggagcgacgacactagtcaactgggacccgataaacacgccagggatgtgccttctcttgacaagtacgccgaggagcgttgggaagtggtgctgcacttcatggtcgggagcccctctgccgctgtatctcaagacttggcccagcttctcagccaggccggactaatgaagagtacagagccaggcgagcctccctgtatcacttctgccggttttcagtttctgttgctagacactccagcccagctttggtactttatgcttcagtacctacaaaccgcccagtcccgcggaatggacctggtcgagatcttgagtttcctattccaactctctttttctacactaggaaaggattatagcgttgaaggtatgtcagattcgctgctgaattttctgcaacacctcagagaattcgggctcgtttttcaacgaaaaagaaagagtaggcgatactacccaacccggttggcgattaatcttagctctggtgtcagcggtgccggaggaaccgtacaccaacccggattcatcgtcgtggaaacgaactaccgtctgtatgcctacactgagtccgagctccagattgcacttatcgccttattctcagagatgctgtataggttccctaacatggtagtggcgcaggtcacccgggagagtgtccaacaggccatagcatctggtattactgcacagcagattattcatttcctccggactcgggcacacccggtcatgctaaagcagacgcccgtcctaccgcctaccatcaccgaccagatccggctgtgggaactggagcgggaccggctgcgcttcacagaaggagtcttatacaaccagtttttgtcccaggtggatttcgagctgctgctcgcacacgctcgggaactcggtgttctagtgttcgagaatagcgccaagagacttatggtggttacccctgcgggacattctgacgtgaaaagattttggaagaggcaaaagcattcctcctag

SEQ ID NO: 224487 - DNA, 1389 bp, Artificial Sequence
  Description of Artificial Sequence: Synthetic coding sequence
atggagagcaccccctcacgaggtctgaaccgggtccatctgcaatgcagaaatctacaggagtttctcggcggactctcgcccggagttctggacagactctatggccaccctgctacctgtctcgcagtctttagggaattacccagtctggccaagaactgggtaatgcgtatgctgtttctggaacagcctctgcctcaggccgctgtggccctttgggtgaaaaaggagttttccaaagcccaagaagagagcactggacttctgtccggcctccggatctggcacacccagctcctccctggaggccttcagggcctgatactgaatcctatctttcgccagaatctccgcatcgccctgctgggtggaggcaaagcctggtccgacgacacatctcaattgggcccagacaaacacgcacgcgacgtgccctctctcgacaaatacgccgaagagaggtgggaagtagtcttgcacttcatggttggttctccttcagctgccgttagccaagatttagcccagttattgtctcaggctggcctgatgaaatccaccgaaccgggagagccgccttgtataacgtctgccggatttcaatttttgctgctcgacacacccgcacaactatggtattttatgctgcagtacctgcagactgcgcagtcccgaggaatggatctggtggagattctgtcctttctttttcaactctctttctccacacttgggaaggactattcagtcgagggcatgtccgattcccttctgaacttcctgcaacatttgcgcgagtttggtttagtcttccagcgaaaaaggaaaagcaggagatattacccaactaggctggctatcaatctgtctagtggcgtgagtggtgcagggggtactgtgcaccaacccggtttcatcgtagtggaaacgaattaccggctctacgcttatacagagtcagaattgcagattgcgcttattgctctcttttctgagatgctgtaccgatttccaaatatggtggtagcccaggtgacacgggagagtgtgcagcaagcgattgcatccgggattaccgcccaacagataatccattttttaaggacccgggcacaccccgtcatgctcaagcagaccccagtcttgcctcctacaatcacagatcaaatccggctgtgggagctggagagggaccgcttgcgatttactgaaggggtgctgtacaatcagttcctcagccaagtggactttgaactgctcttggcccacgcgagggaattaggcgtcttggtgttcgagaacagcgctaaacgattaatggttgtcacaccagcgggtcacagcgatgtgaaacgtttttggaaacggcagaagcatagttcgtag

SEQ ID NO: 224488 - DNA, 1389 bp, Artificial Sequence
  Description of Artificial Sequence: Synthetic coding sequence
atggaatccacccctagtcgaggtcttaatagggtgcatctccaatgtcgaaacttgcaagaatttctgggagggctgtcgcccggagtcctagaccgcttgtatggacaccccgctacctgcctggctgtttttagagagctgcctagccttgcaaaaaattgggtgatgcgcatgctcttcttggaacagcctctgccacaggccgcagtggccctgtgggttaagaaagagttctcgaaggctcaggaagagtcaaccggtcttctaagcggcctgcgaatctggcatacacagttgctgcctggcggactgcaaggcctgatcctgaatcccatatttaggcagaacctacggatagcactactgggtgggggtaaagcctggtccgacgacacctcccaactggggccagacaagcatgcccgtgacgtgccgtcacttgacaagtacgccgaggagaggtgggaggtggtgctccattttatggtgggaagtccatctgcagctgttagtcaggacctggcccaattactgtctcaagctgggctcatgaaatcaaccgaacctggagagcctccctgtatcactagtgcgggattccagttcctcttgcttgacaccccagcacaactctggtatttcatgttgcagtaccttcagaccgctcagagcagaggaatggacctagtcgagatcttaagtttcctctttcagctttccttcagcaccctgggcaaggactactccgtcgagggcatgagcgattcactccttaatttcttacagcatctccgggagttcgggctggtgtttcagagaaagcgcaagtctcggaggtactacccaactcgtttagctattaacctcagttctggcgtctctggcgctggtggaacagtgcaccagccaggattcatagtggtagaaacaaactatcgactgtacgcatataccgagtctgagctgcagatagctctgattgctctgttctccgaaatgctgtataggttcccaaacatggtggtcgcacaggtcactcgtgagtcagttcagcaggcaatcgcttccggcatcaccgcccagcagattattcatttccttcggacacgggcacatcccgtcatgctaaaacagaccccggtgttgcctcctacaatcaccgatcagattagactgtgggagctggagcgcgacaggctgagatttaccgagggggttctctacaaccagtttctttcccaagtggattttgaactcctccttgctcacgccagggaattgggcgtgctggtctttgaaaattctgccaagagactgatggttgtgacacccgctggccatagtgatgttaagagattttggaaacgacagaagcattcatcctag

SEQ ID NO: 224489 - DNA, 417 bp, Artificial Sequence
  Description of Artificial Sequence: Synthetic coding sequence
atggagagcaccccaagccgcggactgaacagagtgcacctgcagtgtagaaacttgcaagaattcctgggaggtctgagtccaggggttctggaccgtctgtatggccaccccgctacctgtctggccgtcttcagagaactcccaagcctagctaagaattgggttatgcgtatgctgttccttgaacagccactgccacaagccgcagtggccttgtgggtcaagaaggagttcagtaaggcacaagaagagagcaccggcctgctgtctggcctgcgaatttggcatacacagctgttgcctgggggactgcagggactgattctcaaccctatcttccgccagaatctgcgtattgcacttttaggcggaacaggtatcacaggggttagtcattgtgcttggccaggttag

SEQ ID NO: 224490 - DNA, 1389 bp, Artificial Sequence
  Description of Artificial Sequence: Synthetic coding sequence
atggaatccaccccatctaggggcctgaaccgtgtgcatctacagtgtaggaacctccaggagtttctcggcggtttatctcccggtgtgcttgatcgactctacggccaccccgctacatgtctagcggtgtttcgagaactgcccagtctggctaaaaactgggttatgcgaatgctgttcctcgagcagccactaccgcaggctgctgttgcattatgggtgaagaaggaattctcgaaggcgcaggaagaaagcacgggactgctctctgggctcagaatttggcacactcagctcttgcccggagggctgcagggcctcatcctcaacccaatcttcaggcagaatcttcgaatcgctctgcttggcggaggaaaagcttggtccgacgacacaagccagcttggtcccgacaagcacgccagagacgtgccttctctggataagtatgctgaagaaaggtgggaggtcgtcttacatttcatggttggcagcccctccgccgctgtgagccaggacctggcccagctactttctcaagcaggattaatgaagagcacagaaccgggtgaacccccatgcattacctccgccggatttcaattcttgcttctggacacgcctgctcagctctggtatttcatgctgcagtatttacagactgcacaatcgcggggtatggacctggttgaaattctgtccttcctgttccaactgagtttcagcactctcggtaaggactacagtgtcgagggcatgagcgatagcctgcttaattttctgcagcatttacgagagttcggactggtgtttcaaaggaaaaggaagtcccggagatactaccctacccggttggcaattaacttatccagtggggttagcggagccggtggaacggttcaccagccgggattcatcgtggtggagaccaattaccgattgtacgcctatactgagtctgagttacagatcgccttgatcgctttattctccgagatgttgtatcggttccctaacatggtcgtggctcaggtgaccagggagtcggtgcagcaggctattgcttcagggattaccgctcagcagataatccacttcctgaggacgcgggctcaccctgtgatgctgaaacagacccctgtgctgccccctaccattacagaccagatcaggttatgggagttggagagagataggcttaggtttaccgaaggggtcctttataaccagtttctgtcccaggtcgactttgaattgctgcttgcccatgcccgtgaactgggagttctagtgtttgagaacagcgccaagagactaatggtcgttactcccgctggacactcagacgtgaaacgattctggaagcgtcagaagcacagtagttag

SEQ ID NO: 224491 - DNA, 417 bp, Artificial Sequence
  Description of Artificial Sequence: Synthetic coding sequence
atggagagcacccccagccgaggcctgaacagggtgcatctgcagtgccggaacctgcaagagtttttgggcggtttgtctcccggagttcttgacaggctgtacggtcaccctgcaacctgtctggccgttttcagagagctgccttccctggccaagaactgggtcatgagaatgctctttttagagcagcctctgccccaggcagctgttgcactttgggtgaagaaagaattctctaaggctcaggaggaatcgacggggctcttgagcgggttgcgtatttggcacacccagctgttaccaggaggcctacagggccttattctgaacccaattttccgccagaatctccgaatcgccctcctgggaggaactgggatcacaggcgtgagccattgcgcatggccgggttag

SEQ ID NO: 224492 - DNA, 1389 bp, Artificial Sequence
  Description of Artificial Sequence: Synthetic coding sequence
atggaatctactccatctagaggactcaacagggtccacttacagtgcaggaatctgcaggagtttctaggcggattgtcacctggggtgctagacagactatacggacatcctgctacatgtctcgcagttttccgggagctgcccagcctcgctaaaaattgggtcatgcgcatgctgttcctggaacagcccctgccccaagctgcagttgcgctttgggtaaagaaggagttcagcaaagcccaggaggagagtacgggattgttaagtgggctgagaatttggcatacccagcttctgcctggaggcctgcagggtcttatactgaaccccatattccgtcagaatctgcgcattgccctattgggcggaggcaaggcctggagcgatgatacttctcagctgggacccgataagcatgcgagagacgttccgtcactcgataagtacgctgaggagagatgggaggtcgtcttgcacttcatggtaggatctccatccgctgcagtgagccaagaccttgctcagctgttgtcccaggctggcctgatgaagagtacagagccaggcgaacctccctgcatcacctccgccggtttccaatttctcctgcttgatacaccagcccagctgtggtatttcatgttacaatacctacagactgcccagagtagaggcatggatttggtggaaatactgtcatttctgttccagctgagcttttcaacactgggcaaagactacagcgtggaaggcatgtctgattctcttctcaattttttgcaacacctacgagagttcggactcgtctttcagcgaaagaggaaatctcgtcgttactaccccacaaggcttgccatcaacctaagctctggagtcagcggtgccggtggaaccgtccatcagccaggtttcatcgtggtggaaactaactaccggctgtatgcttatacagagtccgaactgcagatcgcactcatcgccctcttctctgaaatgctataccgcttcccaaacatggtggttgcacaggtgacccgagaaagcgtgcagcaggcaatagcctccggtattacagcacagcagatcatacacttccttcggactcgcgctcatccagtaatgctgaaacaaaccccggtgttacccccaacaattacggaccaaataaggttatgggagttggagcgcgacaggcttcgttttacggagggagtgctttacaatcagtttctctcacaggtcgattttgagctgctgctcgcccacgccagagagctcggtgtcctagtgtttgagaacagtgccaaaagactgatggtggtcactccagccggacactccgatgtgaaaaggttttggaaacgtcagaagcatagctcttag

SEQ ID NO: 224493 - DNA, 417 bp, Artificial Sequence
  Description of Artificial Sequence: Synthetic coding sequence
atggagagtaccccaagccgcggattaaacagggtgcacctgcagtgtcgaaatttgcaggagtttctgggcggactgtcaccgggagttctcgaccgcctctacgggcatcctgctacttgcctcgctgtgttccgcgagttgccgtctctcgccaaaaattgggtaatgcggatgctttttctggagcagccattaccacaggctgccgtcgcactgtgggtcaaaaaggagttctcaaaggcgcaggaggagtcgaccggcctgctttcaggcctgaggatctggcacacacaactgctgcctggcggacttcaaggtcttatcttgaaccccatctttcggcagaacttacgaatcgcgctcctcggcggaactggtattaccggggtttcccactgtgcgtggccaggatag

SEQ ID NO: 224494 - DNA, 1389 bp, Artificial Sequence
  Description of Artificial Sequence: Synthetic coding sequence
atggagagcacacctagccgaggcctgaatcgcgtgcacctgcagtgcagaaacctccaggagttcttgggcggtctaagcccaggtgtattggataggctgtacggacacccagcgacatgcctcgctgtctttcgcgaacttccctctttagccaagaactgggttatgagaatgctgtttctggagcagcctcttccacaggccgctgtggctttgtgggtgaaaaaggagttctccaaagcccaggaggaatcgactggcctcttgagcggcctacggatctggcatacccagttgctgcccggtggcctgcagggtctcatcctcaatcctattttccgccagaacctgaggatcgctttgcttggcggtggaaaagcctggtccgatgacaccagtcagttgggtcccgataaacacgcacgcgacgtcccatcacttgacaaatacgcagaggagaggtgggaagttgttctgcactttatggttggctcaccttcagcagccgtgagtcaggaccttgctcaactgctctcacaggcaggtttgatgaagagtactgagcctggggaaccaccttgcattactagcgcaggattccaatttttgctgctggacaccccagcccagttgtggtattttatgctccagtacctgcagacagcacaatcccgtgggatggacttggtcgagattctgtcctttctgttccagctctctttctctacattggggaaagactactctgtggagggaatgtctgattcgttgctcaattttctgcagcacctacgggaattcggactagttttccagcgcaaacggaaaagcaggagatactatccgacccgactcgcaataaatctgtccagcggggtgtccggggctgggggaactgtgcatcagccaggcttcatcgttgtggaaacgaattaccggctgtatgcctacacagaaagcgaactccagattgcgctcatcgcacttttctctgagatgttatacaggttccctaacatggtcgttgctcaagtgacacgcgagtccgttcaacaagcaatagccagcggcattaccgctcagcagataatacacttcttgagaacgcgggctcaccccgtgatgctgaaacagactccagtgctcccacctactatcactgaccaaatcagactttgggaactcgaaagagaccggttgaggtttactgagggcgtcctttataaccagtttctgtctcaagtggattttgaattactcctggcacatgctcgcgaactcggggttctagttttcgagaattccgctaagaggctgatggtcgttacgcccgctgggcactccgatgtaaagagattctggaagaggcagaagcacagttcatag

SEQ ID NO: 224495 - DNA, 1389 bp, Artificial Sequence
  Description of Artificial Sequence: Synthetic coding sequence
atggagtcaactcccagcaggggtttaaacagggtccacctgcagtgcagaaacctgcaggagttcctgggcggattgtcgcccggtgttctagaccgcctctacggacacccagctacgtgcttggccgtgtttagagagctcccgagcctggccaagaactgggtgatgcgtatgctgttcctggagcagcccctaccacaagccgctgtggcactctgggtgaagaaagagtttagcaaggcccaggaggaatcgacaggtctgctatctggtctccgtatttggcacacacagctccttccgggtggactgcagggtctgattttgaatccaatctttcgccagaaccttcgtatagccctcttggggggtggtaaagcttggtctgatgatacctctcaacttggacctgacaagcatgcccgagacgtgccgagcttagacaaatacgcagaagaacgctgggaggtcgtgctgcactttatggtggggagccctagcgccgctgtcagccaggacctcgcccagctcttaagccaggccggactgatgaagtccacagaacccggagagccaccatgcatcacaagcgcgggttttcaatttcttctcctggacacccccgcacagctctggtatttcatgctgcagtatttacagacggcccagtcgcgagggatggatctcgtggaaattctgagcttcctgttccagctctccttttccaccctcgggaaggattattcagtagagggaatgagcgacagtctgctcaattttcttcaacacctaagagagttcggactggtgtttcagaggaaaaggaagagcagacgatactaccctacgcgcctcgcgatcaatctgtcttcgggcgtgtctggggcagggggtactgtgcaccagcctggtttcattgttgttgaaactaactaccgtctctacgcttatacagaatctgagctccagattgctctgattgcattgtttagcgagatgctctacagattccctaacatggtggttgctcaagtaacaagagagtctgttcagcaggccatcgcttcaggcataacagcccagcaaatcattcatttcctgagaactagggctcatccggtgatgcttaaacagactccggtgttaccacctacgataactgaccagattaggctctgggagctagaacgggatcgtttgagattcacggagggtgtgctgtacaatcagttcctgagccaggttgacttcgaactccttctggcccatgcccgtgaacttggcgtcctggttttcgagaactctgctaaaagattaatggttgtgacccccgctggacattctgacgtgaagagattctggaagcggcagaaacattcctcttag

SEQ ID NO: 224496 - DNA, 1389 bp, Artificial Sequence
  Description of Artificial Sequence: Synthetic coding sequence
atggaaagcacccctagtcgcggactgaaccgggttcatctgcagtgtaggaatctccaggagtttctgggagggttatctcccggagtcctcgataggctttacgggcaccccgctacgtgcctggcagtctttcgcgagcttccatccctggccaaaaactgggtaatgcgcatgcttttcctcgagcaacccctgccccaggccgctgtcgcactgtgggtgaagaaagagttcagtaaagcccaggaggaatcaaccgggcttctgtctggtctccgaatatggcatacccaacttctccctgggggtctgcaaggactgattctgaatcccatatttaggcagaacctgcgcattgccttgctgggtggtgggaaagcttggtcagacgacacttcacaactggggccagataaacatgctagagatgtgcccagcctggacaagtatgccgaagaacgttgggaagtggtactgcatttcatggttggatctccctccgcagcagtgagtcaggacctggcccagctgctctctcaggccggtctgatgaagtccacagagcctggagagccgccatgtattaccagcgcaggattccagttcctgttgctggacacgccggctcaactgtggtacttcatgttgcagtatctgcaaacggcacagtccaggggcatggatctggttgaaatactctcctttttgttccagctgagtttcagcactctgggcaaagactactcagtcgaagggatgtccgacagtcttctcaactttctgcagcatctacgcgagtttggccttgtgtttcagagaaaaaggaaatcccgaaggtactaccctacacgactggcaatcaatttatcctctggggtgtcaggtgccggaggaaccgtgcatcagcctgggttcatcgttgtggaaaccaactacagattgtacgcctatacagagtccgagctgcagatcgccttgatcgccttgtttagcgagatgctctacaggttccctaatatggttgtggcccaggtcacccgcgaaagtgtgcagcaggcaattgcctctggcataacagcacagcagatcattcactttctgcggactagagcccatccagtcatgctgaaacagaccccggtcctgcctcctactataactgatcagataagactgtgggaacttgagagggataggcttcgatttactgagggcgtattgtacaaccagtttttatctcaagtggactttgagctgctactcgctcatgcaagagagttgggggtcctggtcttcgaaaattcagccaaacgcctaatggtggtgacgcctgccggacattcagatgtgaagagattctggaagaggcaaaagcactccagctag

SEQ ID NO: 224497 - DNA, 1389 bp, Artificial Sequence
  Description of Artificial Sequence: Synthetic coding sequence
atggaatcgacacccagcagaggcctcaatagggtgcacttacagtgtcgcaacttgcaggaatttctaggaggacttagccccggtgtgttagataggctgtacggtcatcctgcaacatgcttagcagtcttccgagagctgccatcactcgccaaaaactgggttatgcggatgctctttctcgagcaaccactgccccaggcagctgtcgccctgtgggtcaagaaggaattttcgaaggcccaggaggagtccacaggcctcctgagcggtctgcgcatctggcatacacaactcttgcccggaggtctacagggtctcatactaaatccaatttttcgccagaacctgcgtatcgctttactgggtggcggtaaggcctggtccgatgacacatcccagttggggccagataaacacgccagagatgtgccgagccttgataaatacgcagaggagcgttgggaggtggtcctgcacttcatggtggggagcccgtctgccgctgttagtcaggatttggcacagttattaagccaggccggtctgatgaaatctaccgaaccgggagaacctccctgtattacttccgctggattccagttcctgttgttagacacccctgcccaactctggtatttcatgctgcaatacttgcaaacagcacagtccagaggcatggacttggtcgagattctgtcctttctctttcagctgtctttcagcaccctgggtaaagattacagtgtggagggaatgtcagattccctacttaatttcttacaacatctgagagagttcggcctcgtctttcaaagaaagagaaaatccaggagatattaccctacgagactagcgatcaacctgagcagcggtgtgagcggcgcaggcggaactgtccaccaacccggatttatcgtggtggagactaactaccgcctctatgcttatacagagtccgagctgcaaatcgcccttatcgctctcttttctgagatgctgtaccgatttcccaatatggtggtggcccaggtcaccagagaatccgtgcagcaagccattgccagtgggattacagcacagcagatcatccattttctccgaacccgggctcaccctgtcatgctgaagcagacacccgtccttccacctactatcacagaccaaattcgtctttgggaattagagagggatagattgaggtttaccgaaggcgtgctctataatcagtttctctcccaggtagactttgagcttcttctagctcacgcacgggagttgggggtcctcgtctttgagaattcagccaagcgcttgatggtagtcacgccggctggtcattcagatgttaaaagattctggaagaggcagaagcactcctcttag

SEQ ID NO: 224498 - DNA, 417 bp, Artificial Sequence
  Description of Artificial Sequence: Synthetic coding sequence
atggagagtactccaagtcggggtttgaatcgcgtgcacttgcagtgccgcaatctgcaagagtttcttgggggtctgagcccaggggtcctcgatagactgtacggtcacccagcgacatgcctggctgtcttccgagaactccctagtctggccaagaattgggtgatgagaatgctctttttggagcaacccctgcctcaggccgctgttgcactctgggtgaaaaaggagttttctaaagctcaggaagaatccactgggctgctttccggtttaagaatttggcacacccagcttctgcccggtgggctacagggactgatattgaatcccatttttaggcagaaccttcgtatcgccctgctcggcggaacaggcattacaggagttagtcattgcgcatggcctggctag

SEQ ID NO: 224499 - DNA, 417 bp, Artificial Sequence
  Description of Artificial Sequence: Synthetic coding sequence
atggaatcaaccccttcccgcggactgaaccgcgtgcacctgcagtgccggaacctgcaagagttcctcgggggtctgtctcctggggttcttgatcggttgtatgggcaccccgcaacctgcctcgccgtgtttcgtgagctcccatctttggcaaagaattgggttatgcgcatgttgttcctggagcagcctcttccccaggccgcagtggccctctgggtgaaaaaagagttttccaaggcacaagaggagtccaccggcctgctaagcggacttcggatttggcacacccagcttttgcctgggggtttgcaaggtctgatactgaaccctatcttcaggcagaacttgcggatcgctctactgggcggtaccggcatcacaggcgttagccactgcgcttggccgggatag

SEQ ID NO: 224500 - DNA, 417 bp, Artificial Sequence
  Description of Artificial Sequence: Synthetic coding sequence
atggaatctacaccctcacgcggtctcaacagagtccatcttcagtgccgaaacttacaggaatttctgggcggactgtcacctggcgttctggaccgcttatatgggcacccagccacttgcctggcagtgttcagagaattgccgagcctggcgaagaactgggtgatgagaatgctttttctggagcaacctctacctcaggcagccgtcgccctctgggtcaagaaggagttttctaaggcacaagaagagtcaacgggtctgctcagtggtctgcgcatctggcatacacagcttctgcctggtggcttgcaaggcctgattttgaatcctatttttagacaaaacttgcggatcgcactcttggggggaacagggattaccggcgtgagccactgtgcgtggccgggttag

SEQ ID NO: 224501 - DNA, 1389 bp, Artificial Sequence
  Description of Artificial Sequence: Synthetic coding sequence
atggagagtacgccgagcagggggctcaatagagtgcatctccaatgccgaaacttgcaagagtttttgggtggcttgtcacctggtgtactggatagactgtatgggcacccggctacctgcttggcagttttcagggagctgccgtccctggcaaaaaactgggtcatgagaatgcttttcctggaacagcccctccctcaggctgccgtggcactgtgggttaagaaagaattctccaaggcccaggaagagtccaccggcttattgtcgggcctgagaatatggcacacccagctgctacccggaggactccagggactcattctgaaccctatattcagacagaatctccgaatcgctttacttggtggaggcaaagcatggtcagacgatacaagccaactgggaccagataaacacgccagggacgtgcccagcctggacaagtatgcagaggagcgctgggaggttgttctacacttcatggtcggatctccttccgccgctgtcagccaggacctggctcaactgttgagccaggccggtctgatgaaatccacagagccgggtgaaccaccctgcatcacatccgcgggtttccagttcctgctcttggacacacccgctcaactgtggtactttatgcttcagtacttgcagaccgctcagtccagaggaatggatcttgtcgagatcctctcattcctttttcagctgtctttttcaacactcggaaaggactattctgtcgagggaatgagtgactcactcctgaatttcctgcaacacctgcgcgagtttggtctggtgttccaaaggaagcggaaatcaagaagatactatcctacaaggcttgctataaacttgagctccggagtgtcaggcgcaggcggaactgtgcaccagcccggttttattgtggtcgagactaactatcgcctttatgcttatacagaaagcgagctgcaaatcgctctgatcgcattgttctccgaaatgctgtatagattcccaaatatggtcgtggctcaggtcaccagagaatccgtccaacaggccatcgcctccggcatcaccgcccagcaaatcattcattttcttcgtactcgggcacaccccgtcatgctaaagcaaacccctgtgttgccacctactatcacagaccagatccggctgtgggaactggagcgggataggctgcgattcactgagggggtgctctacaatcagttcctctcgcaagtcgactttgaactgctgttagctcatgcccgagagctaggtgtcctggttttcgagaacagcgctaaaaggctaatggtggttactccagcgggacattctgacgtcaaacgtttctggaaaaggcaaaaacactccagctag

SEQ ID NO: 224502 - DNA, 663 bp, Artificial Sequence
  Description of Artificial Sequence: Synthetic coding sequence
atgcgaatgctgtttctggagcagcccctgccacaggcggcagtggcactttgggtgaaaaaggagttctcaaaggcacaagaagaatctacagggctgctgtcgggattgagaatttggcacacccagctcctgcccggtggactgcaggggctcatcctgaaccccattttccgacagaatctgcggatagccttgctggggggaggcaaggcttggtctgatgataccagccagttgggtcctgataagcacgcccgagacgtaccctccttagacaagtacgctgaggaacgctgggaagttgttctgcatttcatggtgggctcaccaagtgcggctgtgtctcaagacctcgcgcagttactgagtcaggccggtctcatgaaatctaccgaacctggagaacctccatgtattaccagcgccggttttcaatttctgctcctggataccccagcccaactctggtattttatgctgcagtacctgcagacagcccagtcaagggggatggacctggtggagatcctgagcttcttgtttcagctatcattctctacccttggaaaagactactccgtggaaggtatgagtgacagtctactgaacttcttacagcatcttcgcgaattcggcttggtctttcagcgcaaagtttag

SEQ ID NO: 224503 - DNA, 663 bp, Artificial Sequence
  Description of Artificial Sequence: Synthetic coding sequence
atgaggatgctattcctggagcaacccctgcctcaggccgctgtggcattgtgggtaaaaaaggaattcagtaaggcgcaagaagaatcaaccggtctccttagcggcctgcgtatttggcatacccagttgctaccaggtggactgcagggcctgattttaaatcccatctttcggcagaatctgcggatcgcactgttgggagggggtaaagcctggagcgatgatacaagtcagctgggcccagataaacatgctcgggacgtaccatccttggacaaatatgcagaggagcgatgggaggtcgtgctccacttcatggtgggaagcccgtccgcagctgtgagccaggacctcgctcagctcctgagtcaggctggcctaatgaagtctaccgagcccggagaacctccttgtataacttccgctggctttcaattcctcctgttggacactccagcacagctgtggtacttcatgctgcagtaccttcagactgcgcagtctcgaggtatggatctggtcgaaattttaagttttctctttcagttatccttttcaactttggggaaagactatagtgtggaggggatgtcagactctttacttaatttcttgcaacacctgcgggagttcggactcgtctttcagaggaaagtgtag

SEQ ID NO: 224504 - DNA, 663 bp, Artificial Sequence
  Description of Artificial Sequence: Synthetic coding sequence
atgcgcatgctattcctggaacagcctttgccccaggctgctgtagctctgtgggtgaaaaaggaattctcgaaagctcaggaggagtcaactggtctcctgagcggcctacgtatatggcacacacagttgctgcctggcggattacaggggctgatccttaaccccattttccgccagaacctgaggatcgctcttcttgggggaggaaaggcgtggagcgatgacacaagtcagctcggcccagataaacatgctcgtgacgtcccttcactggataaatacgcagaggagaggtgggaagtcgttcttcatttcatggttggatccccatcggccgctgtgtcacaggacttggctcagttgctctcccaggcagggctgatgaaatcaactgaacctggagagcctccttgtattacatcagccggttttcagtttctcctcctggatacacctgctcagttgtggtacttcatgctgcaatatttacagactgcccagtctcgaggaatggatttggtcgagatcttaagctttctattccaactgtctttcagtaccctcgggaaggattattctgtggagggaatgtccgactcactcctcaatttcttgcagcatttgcgcgagttcggactggtgttccaacggaaagtttag

SEQ ID NO: 224505 - DNA, 663 bp, Artificial Sequence
  Description of Artificial Sequence: Synthetic coding sequence
atgaggatgttgttcctggaacagcctctgccacaagctgctgtggccctttgggtaaagaaggagttttctaaggcacaagaagagtcaactggcctactgtctggactgagaatctggcacacccagcttctgcccggaggtttgcaaggcctcattctcaaccctatctttcgccagaacctacgaatcgctctgttagggggagggaaggcatggtcagatgacactagccagctggggcctgataaacatgcaagagatgtaccttcgctggataaatatgccgaggaaaggtgggaagtggtgttgcattttatggttggatcacccagtgctgccgtgagccaggacctggcgcagctgctgtcacaggccggtttgatgaagtctacagagcctggagaacccccatgcattacaagcgccggatttcagttccttctactagacacacctgcgcagctctggtactttatgctgcagtacctgcagacagcacagtccagagggatggacttggtcgaaattctatcattcttattccagctgtccttcagcaccctagggaaagattactcagtggaaggaatgagcgattccctattgaatttcctccagcatctcagggagttcggacttgtctttcaaagaaaagtgtag

SEQ ID NO: 224506 - DNA, 663 bp, Artificial Sequence
  Description of Artificial Sequence: Synthetic coding sequence
atgcgaatgctttttctcgaacaacccctgccccaggctgccgtggcgctgtgggtcaagaaggagttctccaaagcgcaagaggaatcaacaggtcttttgagtggattgcgtatctggcacacacagttactgcccggtgggttgcaagggctaattttaaatcctatcttccgacagaatcttcggatcgcgctactgggaggcggaaaagcctggtctgatgacacctctcaattggggccagacaagcacgccagagacgtgcccagcctggataagtatgccgaagagcgatgggaggtcgtgctgcacttcatggtgggctctccaagcgcagcagtctcacaagatctggcccagcttctgtcccaggccggattgatgaagagcacagaaccaggtgagcctccctgtatcacttccgcaggcttccaatttcttcttttggacactccagcccagctgtggtattttatgctccaatatctgcagaccgcccagtcccgcggaatggaccttgtagagatcctgagttttctgttccagctgagtttcagcaccctcggcaaagactacagtgttgaagggatgtccgattcactgctgaacttcctccagcacctcagggaattcggcctagtcttccagagaaaagtctag

SEQ ID NO: 224507 - DNA, 663 bp, Artificial Sequence
  Description of Artificial Sequence: Synthetic coding sequence
atgcggatgctgttcctggagcaaccgttaccacaggcagccgtggcgctctgggttaagaaggaattttctaaggcgcaggaggaatctacgggactgctcagtggattgagaatttggcatactcaactcctgcctggcggactccaggggctaatcctcaatcccattttccggcaaaatctgaggatcgccctgctgggcggtggtaaggcgtggtcagatgataccagccagctcgggcctgataagcacgccagagacgttccttccctcgacaagtacgctgaagaaaggtgggaggtggtgctccacttcatggtagggtcccctagcgctgctgtatctcaggaccttgcacagctgctgtcgcaggccggtctgatgaaaagcactgaacccggagagcccccttgcataacctctgccggtttccagttcttattgctggacacaccagcccagctatggtactttatgttacagtacttgcagacagctcagtccagaggtatggacctggtagagatactgtcctttctgtttcaactgtcattcagcacactcggtaaggattattccgtggaaggtatgagcgacagcctgctgaacttccttcaacacctgcgggagtttggccttgtttttcagcgtaaggtgtag

SEQ ID NO: 224508 - DNA, 216 bp, Artificial Sequence
  Description of Artificial Sequence: Synthetic coding sequence
atggtcaatgttctgaagggagtgcttatagaatgtgacccggctatgaagcagttccttctgtacctcgatgagagcaacgctttaggcaaaaagttcatcattcaagatatcgatgacacgcacgtgtttgtcatcgcagagttggtaaacgtgctgcaagagcgcgttggcgagctgatggaccagaatgctttttccctgacgcagaagtag

SEQ ID NO: 224509 - DNA, 2997 bp, Artificial Sequence
  Description of Artificial Sequence: Synthetic coding sequence
atggcacaagtggcgatgtctacccttcctgtcgaagacgaggaaagcagcgagagtaggatggtagtgacatttttgatgagcgcattagagagcatgtgtaaagaacttgctaaatcaaaggcagaggtggcctgcatcgctgtctacgagactgatgtattcgtcgttggcacagaaagaggcagggcttttgtcaataccagaaaggatttccaaaaggacttcgttaagtactgcgtcgaagaagaagaaaaagcggctgaaatgcacaagatgaagagtaccacacaggcaaatcgcatgtccgttgacgctgtggagatcgaaactctgcggaagaccgtcgaggattatttctgtttctgctatggcaaggccctcggaaagagtacggtcgtcccagtaccatacgagaagatgctgcgagaccagagtgcagtggtcgtccagggcttaccagaaggcgtcgcctttaagcatcctgaaaactacgacttagccaccctgaaatggattctggagaacaaagcgggaatcagtttcattatcaagagaccctttttggagccgaaaaagcacgtgggcggtcgagttatggtcaccgatgccgaccgctccattctctcccctggtggctcttgtggcccaattaaggtcaaaacggaacctactgaggactctgggataagcctcgaaatggcagccgttacagttaaggaggagagtgaggatcctgactattaccaatacaacattcaggccggaccctccgagacagatgacgtagacgaaaaacagcctctgtctaagccgctgcagggatcccatcactcttcagagggcaacgaaggcacagagatggaagttccggcagaagacagtactcaacacgtcccctccgagaccagtgaagatcccgaggtagaggtcaccattgaagacgatgactacagccctcctagtaagagacctaaagcaaacgaactgccccagccaccagtcccagagccagctaatgccggtaaaagaaaagtgcgagagttcaattttgagaagtggaacgctcggattactgacctacggaagcaggtggaagagctgtttgagcgaaagtacgcacaggcaattaaggccaagggccctgtcaccatcccttatcccctgttccagtcgcacgtggaggatctgtatgtggagggcctgcctgaaggcatccccttccgcaggccaagcacctatggaattccaaggctggagaggatattgctggctaaggagaggatcagatttgttatcaagaaacacgaactgctcaatagcacacgggaggacctgcaactggacaagccagcgtccggcgtcaaagaggaatggtacgcaagaatcacgaagctcaggaaaatggtagatcagctcttttgcaaaaaatttgcagaggcactcggctctaccgaggcaaaagccgtgccatatcagaagttcgaggcccaccctaacgatctgtatgtcgaaggattgcctgaaaacataccattcaggtctccgagctggtatggaatccctcgcttggagaagattatccaggttgggaatagaatcaagtttgttataaagagacctgagctccttacccattctacaaccgaagtgactcagcccaggactaacacccccgttaaagaagactggaacgtcaggatcacaaagttaaggaaacaggtggaagagatctttaacttgaagttcgcacaggctttggggctgaccgaagccgtgaaggtgccttaccccgtcttcgaatctaatccagagtttctttatgtggagggcctgcccgaaggcatcccgttccgcagccctacttggtttggcattcccaggctggaacggatcgttcgcggttcaaacaagatcaaattcgttgttaaaaaaccggagcttgttatttcataccttccgccagggatggcctctaaaattaatactaaagccctccagagccccaaaaggccgagaagccctggctccaactcaaaggtgcccgagatcgaggtcacagtggagggaccaaacaacaataaccctcagactagcgccgttagaactcccactcagacaaacggctcgaatgtcccgttcaagccaagaggcagggagtttagttttgaagcttggaatgccaaaatcactgacctcaagcagaaggttgagaacctgtttaatgaaaaatgcggagaagctctcggcctgaaacaggccgtgaaggtcccatttgcccttttcgagtccttccctgaagatttttatgtggaaggtttgcccgaaggagtgccctttagaaggccctccacctttggaatacctagactggaaaaaatcttacggaataaagcaaaaataaagttcattattaagaagcctgagatgtttgaaactgctatcaaagaaagtacctcatctaagagccccccacgcaagataaactcatcccctaatgtgaataccactgcctcgggggtcgaggatctaaacattatccaggtgacaattccagacgatgataatgagaggctgagtaaggtggaaaaggctcggcagctgcgagagcaggtcaatgacctgttcagtcggaagtttggcgaggccattggaatgggctttcccgtgaaggtaccctatcggaagataaccattaatcctggttgcgtggtggtggacggaatgcctcccggagtgagcttcaaggcccctagctatctggagattagtagcatgcgcagaatactcgattcggcggaattcatcaagtttaccgtcattagaccctttccaggccttgtaataaacaaccaactcgtcgaccagagcgagtccgaagggccagtgatccaggagtccgctgagccgagccagctggaagtcccagcaactgaggagatcaaggaaactgatgggtctagccaaattaagcaggagccagaccccacctggtag

SEQ ID NO: 224510 - DNA, 2934 bp, Artificial Sequence
  Description of Artificial Sequence: Synthetic coding sequence
atggcccaggtggccatgtcaacgctgcccgtggaagacgaggagagctctgaatctcggatggttgtcacttttctgatgtccgcactggagtcaatgtgtaaggaattggctaaaagtaaagcggaagtggcgtgcattgccgtttacgaaacagacgtgttcgtggtgggaactgaacggggtagagcctttgttaatacccggaaagattttcagaaagacttcgtgaagtactgtgtagaggaggaggagaaggccgcagaaatgcacaagatgaagtcaacaacccaggctaacaggatgagcgtggacgccgtggagattgagacactcagaaagaccgttgaggactatttctgcttctgttatgggaaagccttggggaagtccaccgtagtacccgtgccctatgaaaaaatgctgcgcgatcagtcagcagttgttgtgcagggactcccagagggagtggcttttaaacatcctgagaactatgatctcgcgaccttgaaatggattctggagaacaaagctggaatttcatttattatcaagcgccctttcctggaacccaagaagcacgttggcggacgggtgatggtgaccgatgcagatcggtcgatattgagtcccggaggcagctgtggccctatcaaagtgaaaactgagccaaccgaagatagcggaatttcgctcgaaatggctgcagttacagtaaaagaagagtctgaggaccctgattactatcagtataatatacaggccggacccagcgaaactgacgacgtcgacgagaagcaacccttgagtaaacccctccagggatcgcaccactcctcagagggaaatgaaggcaccgagatggaagtacccgctgaggacgatgattatagcccgccatccaagcgtccaaaagcaaatgagttgccgcagcctcctgtgcccgaaccagctaacgccggaaagagaaaagtgcgtgaatttaacttcgagaaatggaacgccaggattactgacctcagaaagcaggtggaggagttgttcgaaaggaagtatgctcaagctatcaaagctaaaggccctgtcaccataccgtatcccctttttcagtcccacgtcgaggacctctatgtggaaggtctccccgagggaatccctttcagacgtccatcaacatacggaatacccaggctggagcgcatcctcctggccaaggagagaattcgctttgtgattaagaagcatgagctgctaaatagcacccgtgaggacctgcagcttgacaagcccgcatcgggcgtaaaggaagagtggtacgcccgaataacaaagctgcgaaagatggttgaccaattgttttgtaagaagttcgctgaggccctcggcagtaccgaggctaaggctgtgccttaccaaaagttcgaagcacaccctaacgacctgtacgtcgaggggcttcctgagaacatccctttcaggtcaccgtcctggtacggaattccccgtctcgagaaaatcatccaggtgggcaaccggattaagtttgttattaaacggccagagctgctgacccattctacgaccgaggtcacccagccaaggaccaacacaccagtcaaagaggactggaatgttaggattactaaactgcgaaagcaagtagaggagatcttcaacctgaagtttgctcaggccctcggacttaccgaggcagttaaggtgccgtatcctgtttttgaatctaatcctgagtttctttacgttgagggtctcccagaagggatccctttcaggtccccaacgtggttcgggatcccaagactggagcgaatcgtccgagggtccaataagatcaaatttgttgtgaagaaaccagaactggtgatcagttatctgcccccaggcatggcaagcaagataaatactaaggcccttcagagccctaaacgccctagatcccctggatcaaatagcaaggtgcctgaaatcgaagtcactgtggaaggacctaataacaataacccgcaaacatccgccgtgcggaccccgacgcaaacaaatggtagcaacgttccattcaagccccgagggagggaattttcattcgaagcctggaacgccaagataaccgacctgaagcagaaggtggagaatctgtttaacgaaaagtgtggagaggcactcggcctaaagcaggctgtgaaggttccatttgccttattcgagtcattcccagaagatttctatgttgagggactgccagaaggtgttccctttagacgtcctagtactttcggcatcccaaggctggaaaagatcctcagaaataaagcaaaaattaagttcataatcaagaaaccagaaatgttcgaaactgccatcaaagaatccactagttccaagagcccgccacgtaaaattaacagtagtcccaatgttaatacgacagcctctggagtggaggatctgaatattatccaagtcacaattccagatgacgacaacgagcggttgtctaaggtggagaaggccaggcagctacgcgaacaggttaatgatctgttctctcgaaagttcggagaggcaatcggaatgggatttccagtaaaagtcccttaccgcaaaataaccataaacccgggttgcgttgtcgtcgatggcatgccgccaggcgttagttttaaggctccaagctatctggaaatctcttctatgagacgaattctggatagcgctgagttcatcaagttcacggtgatcagaccatttcccggacttgtgattaacaatcagttggtcgaccaaagcgaaagcgagggtccagtgatccaggagtccgccgaaccaagccagctggaagtccccgcaaccgaagaaattaaagagacagacggttcatcccaaatcaagcaggaaccagaccctacctggtag

SEQ ID NO: 224511 - DNA, 2937 bp, Artificial Sequence
  Description of Artificial Sequence: Synthetic coding sequence
atggcccaagtggctatgtcgacattacccgttgaggacgaggaatcctctgagagcaggatggtggtaacttttctgatgtcagccttagaaagtatgtgtaaggagctggccaaatcaaaagccgaggtcgcatgcattgccgtctatgagaccgacgtcttcgtcgtgggtaccgaaagggggcgagcttttgttaatactcgtaaagattttcagaaggacttcgtcaagtactgcgtcgaggaagaggaaaaggctgctgagatgcataagatgaaaagcactacgcaggccaataggatgtcagttgatgctgttgagatagagacgttgaggaaaacagtagaggattacttttgcttctgttatggcaaggccctggggaagtctaccgtggttcccgttccttacgagaagatgttgcgtgaccagagtgccgtggtcgtgcagggcctacccgagggggttgcttttaagcaccccgaaaactatgacctggcaacgcttaaatggattcttgaaaacaaagccggtatctcttttatcatcaaaagaccgttcctggaaccgaagaagcacgtcggaggacgagtaatggtgaccgacgctgataggagtatcctgtccccgggtggatcatgcggccctatcaaagttaaaactgagcctacggaagactcaggcatatcacttgaaatggccgctgtaacagtgaaagaggagagcgaagatcccgattattaccagtataatatccaaggaagtcatcactcatcagagggcaacgagggaaccgaaatggaagttcccgcagaagactctacacagcacgtccccagcgagacgtctgaggacccggaagtggaagtgactattgaggacgacgactactctcctcccagcaaaagaccaaaagctaatgagttgcctcagcctcctgtgcctgaacctgccaatgccggaaagagaaaagtgagggagtttaacttcgagaaatggaacgctcggattaccgacttgagaaaacaggttgaagagctgttcgagcgaaaatacgcacaggctattaaggccaagggacccgtcaccatcccctaccccctgtttcagtcacacgttgaagatttatatgtggagggcttaccagaaggaattcctttcaggcgcccttccacttacggtatccccagactcgaacgcattctattggctaaggagcgcattaggttcgtgataaaaaaacacgaactgctcaattccactagagaagaccttcagttggataagccagcttccggagtcaaggaagaatggtatgccaggattaccaagctccgcaagatggtggatcagctgttttgcaagaagtttgccgaagcgctaggctccacggaagcaaaagccgttccttatcaaaagttcgaagcacacccaaacgacctttacgtagaggggctgcccgagaacatcccattccggtccccctcctggtacggtattccaaggctggagaaaattattcaggtgggcaaccggatcaagttcgtaattaaacggccagaactcctgacccattccaccacagaagtcactcagcctcgcacaaacacaccagttaaggaagactggaacgtgcgaatcacaaagttgagaaagcaggttgaagagatctttaatctgaagttcgcacaagcactgggtttgaccgaagccgttaaagtgccatatcctgtttttgaatcaaaccccgagtttctctacgtcgaaggactccccgagggcatacctttcaggtcccccacttggttcgggatccccagacttgagaggatcgttaggggctctaacaagattaagttcgtggtgaagaaacccgaactggtgatttcatacttaccacccggaatggcatccaaaattaatactaaggcccttcagtctcccaaacgccctcgcagtcccggaagcaacagcaaggttcccgaaatcgaagtgaccgtggaaggaccaaataataataatccgcagacgagcgctgtgagaaccccaacccaaaccaacggaagcaatgtgccattcaagcctcggggtagggagtttagttttgaggcttggaacgccaaaatcactgacctgaagcagaaggtagaaaacctttttaacgagaagtgtggcgaagctttaggactcaagcaggcagtcaaggtgcccttcgccttgttcgaaagctttcccgaagatttctacgtagaagggttaccagaaggcgtcccattccgcagacccagcaccttcggaatccctagactcgagaaaattttacgtaacaaagcgaagattaaattcatcattaaaaaacccgaaatgttcgagactgccatcaaggagagtacctcatccaaatctccccctcgaaagattaactcaagcccaaatgtcaatacaactgccagtggtgtggaggatctcaacatcatacaggtgactatccccgatgatgataatgaaaggctgagtaaagtcgaaaaagcccgtcaactcagggaacaagtaaatgatctgtttagtcggaagttcggggaggcaatcggaatggggtttcccgtcaaagtgccttataggaaaataacaattaaccctgggtgcgttgtcgttgatgggatgccgcctggagtgtcatttaaggccccatcttatttggagatctcaagcatgaggagaatactggatagcgccgagttcatcaaattcacagtcattagaccctttcctgggcttgtgatcaataaccagctggttgaccaatccgaatcagagggcccagtcatccaggagtctgctgaaccatcccagctagaggtccctgcaaccgaagagattaaggaaacagacggctcctctcagatcaaacaggagcctgatcccacatggtag

SEQ ID NO: 224512 - DNA, 2874 bp, Artificial Sequence
  Description of Artificial Sequence: Synthetic coding sequence
atggcacaggtggccatgagcacattgccggttgaagacgaggaaagctctgagtcccgcatggtggttacgttcttaatgagcgccctcgaatctatgtgtaaggagttggccaagtctaaggcagaggtggcctgtatcgccgtttacgaaacagacgtgtttgtcgtcggaacagagcgcggacgagcattcgtcaacacccgcaaggactttcaaaaagacttcgtgaagtactgtgtggaagaagaagagaaagccgcagagatgcacaagatgaagagcaccacccaggctaatcggatgagcgtggatgctgtggaaatcgagacactgaggaaaacagtagaagactacttctgcttctgctatggcaaagcgctcggaaaatccacagtggttcccgtgccctacgaaaaaatgttgcgcgatcagagcgctgtcgtcgtacagggcctgcccgaaggcgtcgccttcaaacatcccgaaaactatgatttggccacactcaagtggattctcgagaacaaggccggaatcagttttatcataaaacgccctttcttggagccgaagaaacatgtgggtgggagggttatggtgacggacgcggataggtcaattttgtctccagggggttcttgcggtcccataaaggtgaagacagaacctacggaggattccggcatctctttagaaatggctgccgttaccgtgaaggaggagtcagaggaccctgattactatcagtacaatatccaggggtctcaccactcctccgaggggaacgagggcactgaaatggaagtgcccgctgaggatgacgactactccccaccttctaagcgacccaaggctaacgagttgccccagcccccagtgcccgagcccgcaaacgccggtaagcgaaaagttagggagtttaactttgagaagtggaacgcacgcatcacagacttgcgtaaacaggtcgaagagctctttgaacgcaagtacgcccaggccatcaaggctaaggggcctgtaacaatcccctacccattgtttcagagccatgtggaggacctctatgtggagggcttgccagagggcataccctttcgccgaccctccacgtatggcatcccgaggcttgagcgtattcttctagcaaaagagcggataagatttgtgatcaaaaaacacgaattgctgaatagcacaagagaggacttgcaactcgacaaacccgcaagcggcgtaaaagaagagtggtatgcccgtatcacaaaattaagaaagatggtggaccagcttttctgcaaaaagttcgctgaggctctcgggtccactgaggctaaagcagtgccctatcagaagttcgaggcccacccaaacgatctgtacgtggagggactcccagagaacatcccttttaggagtcccagttggtacggtattccaaggctggagaaaataattcaggtcgggaataggatcaaattcgtaataaaaaggcccgagttgctgacccactcaactaccgaggttacacagcctcggaccaacaccccggtgaaggaggactggaacgtccgtataaccaaattaaggaagcaggtggaggaaatttttaacttaaagttcgctcaggccctgggcctgaccgaagccgtaaaggtcccctaccctgtgttcgaatctaatcccgagttcttgtacgtggagggactaccagagggcataccgtttcgatcacctacctggttcggcatccccaggcttgagcgcatcgtcagaggcagcaacaaaatcaaatttgtagtgaagaagcccgaattggtgatatcatatctgccccctgggatggcatcaaaaattaacaccaaggccctgcaaagcccgaaaagacctagatcacccggttccaactcgaaggtgccagagatcgaagtcaccgtggaaggtcccaacaacaataacccccagacaagcgccgtccgtacccccacccagacaaacggttctaatgtcccgttcaagccgagaggccgagaatttagctttgaggcctggaacgcaaaaattacagatctcaagcagaaagtcgaaaatttgtttaatgagaaatgcggcgaagcgttgggtctgaagcaagccgtgaaagtgcccttcgccctcttcgaaagtttccctgaggatttttatgtagagggtttgcccgagggcgttccttttaggcgaccctccacttttgggatacccaggctggaaaagattttaaggaataaggcaaaaatcaaatttataattaagaaacccgagatgtttgagaccgcaataaaggaatcaacctccagtaagagcccccctagaaaaattaactcttcaccgaatgtgaataccactgcatccggtgtggaagacctgaatatcatccaggttactattcccgacgatgataacgaacggctcagcaaggtcgagaaagcccgacagcttcgggagcaggtcaacgacctgttttctcggaaatttggggaagccatcggcatgggattccccgtcaaggtgccttatcgaaaaataaccattaatccgggatgtgtcgtggttgacggcatgccaccaggcgtatccttcaaggctccctcctatctcgagatctctagtatgagacggatactcgactctgccgaatttattaaatttacggtaatcaggccttttcccggattagtgataaacaaccagttagtggaccagtctgagtctgagggaccggtcatacaggaatcagccgagccttcacaactcgaggtaccagcgaccgaggagatcaaggaaacagacggttcctctcagattaagcaggagcccgaccccacttggtag

SEQ ID NO: 224513 - DNA, 321 bp, Artificial Sequence
  Description of Artificial Sequence: Synthetic coding sequence
atggctcaggttgcaatgtcaacattgcctgttgaggatgaagaaagctcagaatctcggatggtggtgaccttcctaatgtcagccctcgagtctatgtgcaaagagttggctaagagcaaagcggaggtggcttgcatcgccgtttatgaaaccgacgtctttgtcgtgggcaccgaacggggacgcgctttcgtgaacacccgtaaggatttccagaaagattttgtgaaatactgtgtggaggaggaagagaaagctgcagagatgcacaaaatgaaaagcacaacacaggctaatagaatgtcagttgatgcctag

SEQ ID NO: 224514 - DNA, 825 bp, Artificial Sequence
  Description of Artificial Sequence: Synthetic coding sequence
atggcgcaagtggcgatgagcacgctgcccgtagaggacgaggaatcatcagagtctaggatggtggttaccttcctcatgagcgctctcgagagtatgtgtaaagagctggccaaatcgaaagccgaagttgcatgcatagcagtttacgagaccgatgtgttcgtggtgggtactgaacgaggccgagccttcgtcaataccagaaaggatttccagaaggacttcgtgaaatactgcgttgaagaggaggaaaaagcagccgagatgcataagatgaagtccaccactcaggccaatagaatgtctgttgacgccgtggagattgaaactctacggaagactgtggaggattacttctgcttttgttacggcaaggcgttggggaaatccacagtggtgccagtgccctacgaaaagatgctcagagatcaatcagcggtagttgttcaaggtctacctgaaggtgtggcattcaaacatccagagaattacgacctcgcaacgctcaaatggatactcgaaaacaaggcgggtatttcatttattattaagaggccctttctagaaccaaagaaacacgtgggaggtcgagttatggtgacagacgctgatcgatcaatcctgtcacctggcggttcctgcgggccaattaaggtgaagaccgagcccaccgaagacagcggaatctccttggaaatggccgctgttactgtgaaagaagaaagtgaagaccccgattactaccagtataatatccagggctcccatcattcatccgagggaaatgaggggactgaaatggaggtgcctgccgagggatag

SEQ ID NO: 224515 - DNA, 2982 bp, Artificial Sequence
  Description of Artificial Sequence: Synthetic coding sequence
atgagcaccctccccgtggaggacgaagagagttctgaatcaaggatggtggtgacttttctcatgagtgctctagagagcatgtgcaaggagctagctaagtctaaagccgaggtggcttgcattgccgtatacgagaccgacgtgttcgtggtggggacagaaaggggacgtgctttcgtgaacacacgaaaggactttcagaaggacttcgtgaaatactgcgtcgaggaagaagaaaaggctgctgagatgcataagatgaagtccactactcaggcaaacaggatgtctgttgacgcggtcgaaattgaaacactgagaaagaccgtggaggactacttttgcttctgctacggaaaagccctcggcaaatccacggttgtgcccgtgccctatgaaaagatgcttcgcgatcagtctgcggttgtggtccaggggctgccggaaggggtggcttttaaacaccctgagaattatgacctggccacccttaaatggatcttggagaacaaggccggaatctccttcatcataaaaagaccctttcttgaaccaaagaagcacgtgggcggacgagtcatggtgactgatgcagatcgcagtatattatccccgggagggagctgtggcccaattaaggtcaaaactgagcctaccgaagactctgggatctctttggagatggcagccgtgaccgtgaaggaagagtctgaagatccggactactaccagtacaatattcaggccggaccctctgaaacagacgatgtggatgaaaagcaaccacttagcaagccattgcaaggatctcaccactccagcgaggggaacgagggaaccgagatggaggtgcccgcagaggacagtacacaacatgtcccgagtgagaccagtgaagatccagaagttgaagtgactatcgaggatgacgactattcgcccccaagcaaacggccaaaagcaaatgagctgccccagcctccagtgccagaacccgcaaatgcaggcaagcggaaagtacgggagttcaactttgaaaaatggaacgccagaattaccgacctcaggaagcaggtggaagaactctttgagcgcaaatatgctcaagcaattaaggccaaggggcctgtgaccataccctatccactattccagagtcacgtggaggatctctacgtcgagggactccccgagggaatcccttttcgtcgtccctcaacatacgggataccacgcctggaaagaatcctgctcgccaaggagcggattcggtttgtgattaagaaacacgaactcttgaatagcaccagagaagatctacaacttgataagccggcaagcggggttaaggaagagtggtacgctcgtattaccaaactccggaaaatggtcgatcagctattttgcaagaagttcgcagaagccctcggaagcaccgaggccaaggccgtcccttatcagaaattcgaggctcatcctaacgacctgtacgttgagggattacccgaaaatattcccttccggtccccgtcctggtatggaatcccgcgattggagaagattatacaggtgggcaatcggattaagttcgtcattaaacgacccgaactccttacccacagtacaacggaggtgacccagcctagaacaaatactcctgttaaggaagactggaatgtcaggattacaaagttgcgcaagcaggttgaagagattttcaacctcaagttcgcacaggccttggggctgaccgaagcggtcaaggtcccgtaccccgtgttcgagtccaatccagagtttctgtacgtagaggggctgcccgagggcattccattcaggtcgccaacatggtttggcatcccaaggttggagagaattgtgcggggaagtaataaaattaagttcgttgtgaaaaagcccgaactggtcataagctacttgccgccaggcatggctagcaagatcaacaccaaagccctgcagtccccaaaacgacccagaagtccagggagtaactccaaggtccccgaaattgaagtcaccgtggaggggcctaacaacaacaacccccagacgagcgcagtgcggacaccaacacagaccaacgggtcaaacgtccccttcaaaccacggggacgcgagttcagcttcgaagcgtggaacgctaaaataacagatctgaaacagaaggtggaaaacttgtttaacgaaaagtgcggcgaggccctcggtctgaagcaggccgtgaaagtgcctttcgccctgttcgaatcattcccagaggatttctacgtggagggtctgccggaaggtgtgcctttcagaagaccaagcaccttcggtattccacgactcgaaaagatcctgaggaataaggccaaaataaagtttatcatcaagaaaccagaaatgtttgaaacagctataaaggaatcgactagttctaagagtccacccaggaagataaactcatctcccaatgtcaacaccactgcctcaggagtagaggacctgaatattatccaggttactataccagacgacgacaatgaacgactgagcaaggtggagaaagcgaggcagctccgtgagcaggttaatgaccttttttccaggaagttcggcgaggccattggaatgggatttccagttaaggtcccatacaggaaaattacgattaatcctggatgtgtggttgtggatggtatgcccccaggtgtaagtttcaaggctccgtcctacctcgagattagcagcatgcgaagaatactcgactctgccgagtttataaaatttaccgttataagaccttttcccggtctagtcattaacaatcagctggtggaccagagcgagagcgaaggccctgttattcaggaaagcgctgagccgagccagcttgaggtacccgctaccgaggagatcaaagagacggatgggagctctcagatcaagcaggaaccagatcccacctggtag

SEQ ID NO: 224516 - DNA, 642 bp, Artificial Sequence
  Description of Artificial Sequence: Synthetic coding sequence
atggcagctgctgcggacgagaggtctcccgaagatggcgaggatgaagaggaggaggaacagctggtgctggtggagctctccggaatcatcgactccgatttcctgagcaagtgcgaaaacaaatgtaaggttctcggcatagacacagaacgaccaatactccaggttgattcttgcgtcttcgccggagagtatgaggatacactagggacttgcgtgattttcgaggagaatgtggaacatgccgacacagaagggaacaacaagactgtcctcaaatacaaatgccacactatgaaaaagctttcaatgactagaacactacttaccgagaagaaagaaggcgaagagaacatcggcggagtcgagtggttgcagatcaaggacaatgatttttcctataggcctaatatgatatgcaacttcttacacgaaaacgaggacgaagaggtggtggcctccgctcccgataagagcctggaactcgaggaggaagaaatacagatgaacgactctagcaatctcagctgtgaacaagaaaagccaatgcacctggagattgaggacagcgggccactgatcgatattccttccgagactgaaggatctgtgtttatggagacacagatgctcccatag

SEQ ID NO: 224517 - DNA, 2118 bp, Artificial Sequence
  Description of Artificial Sequence: Synthetic coding sequence
atggctaccgaaggaatgattctgaccaatcacgaccatcagatccgtgtcggcgtgttgactgttagcgattcatgctttcgcaatctcgccgaggaccgatccggcatcaatctcaaggacctggtccaggacccctcattactcggagggactatctccgcctacaagatcgtccccgacgaaatcgaggagatcaaggcgaccaaagaggtgatcgagcgcgaggctcccggaatggcactcgctatgcttatgggatctttaaacgtaacaccattgggcatgttatctaggccggtctgcggcattagaggtaagacacttatcattaacctgccaggatctaaaaagggatctcaagagtgctttcagttcatcctccccgctttgccacatgccatcgacctgctgagagacgcaattgtgaaggtgaaggaggtgcatgatgagttagaggatctcccatccccacctccgcctctcagtccccctcccaccacaagtcctcacaaacagaccgaagacaaaggcgtgcagtgcgaagaagaggaagaggaaaaaaaggattccggggtggcaagcaccgaagacagttcctcgagccacatcacagccgcagccattgcagccaagattccagattcgatcatcagtagaggcgttcaggtgctcccaagagacacagccagtttgagtactacaccttcggaatctccgagagcccaggctactagtagactatcgacagccagttgtcccactcctaaggtccagtccagatgctccagcaaagagaacattctgcgcgcatcacatagcgctgtagacattaccaaggtcgccagaaggcaccgcatgtcgccctttccattgacatccatggataaagcgtttatcactgtgctagagatgacgcccgtactgggcaccgaaattatcaactatagagacggtatgggcagagtgttggcccaggacgtctatgccaaagacaatctgcccccttttcctgctagcgtgaaagacggctatgccgtcagagcggcagacggaccaggggacaggtttatcataggagagagccaagccggagaacaacctactcagactgtgatgcccggacaagtgatgcgggttacaacaggggctcctatcccttgtggcgcagatgccgtggtccaagttgaggacaccgaactcattcgcgaatctgacgatggcacagaggaactggaggttcggattctcgtgcaggccagacctggacaggatatccgcccaatcggtcacgacataaagaggggggagtgcgtgctggccaagggcacccacatggggccaagtgaaatcggcctgttggctactgtgggtgtcacagaggttgaggtcaacaaatttcccgtggtggctgtaatgtctaccgggaatgaactcctcaaccctgaggatgatctactgcccggtaagatccgcgatagtaaccgtagcactctccttgctacaattcaggagcacggataccctacaattaatttgggcatagtcggtgataatccggacgatttactcaatgccctgaacgagggaatttcaagagccgacgttatcatcacctccggcggtgtaagcatgggcgagaaagattacctgaagcaggtcctagatatcgatctgcacgcacaaatccacttcggccgagtcttcatgaagcctggtctgccgactacatttgcgaccctggatattgacggcgtgaggaagattatttttgcccttccagggaacccggtgtctgctgttgtcacctgcaatctgttcgttgttccggcactccggaagatgcagggcattctcgatccaagaccaacaatcataaaggcccgattaagttgtgatgtcaagcttgatccaaggcctgagtatcatagatgtatccttacatggcaccatcaggaacctctgccgtgggctcagtcgacgggtaaccagatgtcaagtcgtctgatgtccatgcgctccgctaatggcctgttaatgctgcccccaaagactgagcagtacgttgagctgcacaagggcgaagttgtggacgtcatggtgattggcagactgtag

SEQ ID NO: 224518 - DNA, 2211 bp, Artificial Sequence
  Description of Artificial Sequence: Synthetic coding sequence
atggctactgaaggcatgatcctcaccaatcacgaccaccagatccgagtgggcgtattaaccgtatcagattcatgcttccggaacctggctgaagatagatcaggcatcaatctgaaggatctggtgcaggacccctctctcctcgggggaacaattagtgcttataagattgttcccgatgaaattgaagaaatcaaggagaccttgattgattggtgtgatgagaaggaactgaatctgatactgaccactggcggaacgggctttgcaccgagagacgtgaccccagaggccaccaaggaggtgatcgagcgtgaggctcctggcatggccttggccatgctgatgggcagtctcaatgtcactcctctcgggatgctatctcgccctgtgtgtggaattagagggaaaacgctgatcattaatctgccaggtagtaagaaaggctcacaagagtgtttccaatttatacttcctgccctcccccacgcgatcgatctcctgagagacgccatcgtcaaggtgaaagaggtgcatgatgaactggaggacctgccgagccctcccccaccactatcacctcctccaacgacaagcccccataaacagactgaggacaagggcgtgcagtgcgaggaagaagaagaagagaagaaggactcaggcgttgcctctacagaggattcgtctagctcccacatcaccgctgcagccatcgctgccaagattccagactcaataatctcacggggagtacaggttctcccccgtgatacggcaagtctgtctactaccccaagtgaatcccctagggctcaggccacctcgcggctgtcaaccgcaagttgtcctactcctaaagtccagtctcggtgctccagcaaggaaaatattttacgggcttcccattccgcggtcgatatcaccaaggtcgctcgacgacatcggatgagcccatttcctctgacctctatggacaaggccttcatcaccgtcttggagatgacaccagtattgggaaccgagattatcaactatagagacggtatgggacgggtcctggcacaggacgtatacgctaaggacaacctaccacccttccctgccagtgtcaaggatggttatgccgtgagagcagctgatggacccggtgaccggttcatcattggggaaagtcaagcgggtgagcagccaactcaaacagtgatgcctggccaagtgatgagagtgactaccggagccccaattccttgtggagctgatgccgtggtgcaggtggaggatactgagctgatcagggaatctgatgatggaacagaggagttagaagtgcgcattctagtccaggctcgccctggtcaagatattcggcctatcggccacgacatcaaacgcggtgagtgcgtgctcgccaagggtacccacatggggccttctgagatcggcctcctcgcaacagttggcgtgaccgaggtagaagtaaataaatttccggtggtggctgtcatgtcaacaggaaacgaattactcaaccctgaagatgacctcctcccagggaaaatacgcgactccaaccgatctacattactcgctacaatccaggagcatggctaccccactattaaccttgggatcgtgggagacaaccctgacgatctgctcaatgccttaaatgaggggatttctagagcagacgtcattataaccagcggcggagtctccatgggagaaaaagactatttaaaacaggtccttgacatcgacctgcacgcccagatccactttggcagggtcttcatgaagcccggtctcccgacgaccttcgctaccctagacatcgatggagtgcgaaagataatctttgcactgcccggtaacccagtatccgccgtggttacttgtaacctcttcgtggtgcccgcacttagaaaaatgcaagggatattggaccctcggcctacaattataaaagccaggctcagctgcgacgtgaagctggaccctaggcctgagtaccatagatgcattttaacttggcatcatcaggagcctctcccatgggcacaaagtactggcaaccaaatgtccagcaggctcatgagtatgcgcagcgctaacggtctgttgatgctccctccaaagaccgagcaatatgtggagctccataagggggaggtggtggacgtgatggtgatagggcgtttatag

SEQ ID NO: 224519 - DNA, 2310 bp, Artificial Sequence
  Description of Artificial Sequence: Synthetic coding sequence
atggcaacagagggaatgattctgacaaatcacgaccaccaaatccgagtcggggtgctcaccgtgtcagactcgtgttttcggaaccttgctgaagatcgttctggcatcaacctcaaggacctcgtgcaggatccttctctgcttggtgggaccattagcgcatacaagattgtccccgatgagattgaggagattaaggagaccttgatagattggtgcgacgagaaggaacttaacttgatcttgacaactgggggaaccggctttgcacctagagacgtcacccctgaggcaactaaggaagttatcgaacgagaagctccaggaatggctctggccatgcttatgggtagtctcaacgtcacccctctcggcatgcttagcagaccagtgtgcgggatccgaggaaaaaccctcatcattaacctgccaggtagtaaaaagggcagccaggagtgtttccagttcatcctgccagccctgccccacgctattgatttgctgcgcgacgcaatcgtgaaagtgaaggaggtgcacgacgagctcgaagacttaccctctcccccacccccactgagcccccctccaactacaagcccacacaagcaaaccgaggacaagggcgtacagtgcgaggaggaggaggaggagaagaaggattcaggcgtggcatctactgaagactcctcctctagccatatcacggctgccgcaattgccgctaagaagcatccattttacacatcacccgcagtggtcatggcgcacggggagcagccgattcctggcctgatcaactacagtcaccactcgaccgacgaaagaattcccgactctatcatctctcggggtgtacaggtcctgcccagagatactgcctcactgtccactacaccgagtgagtcccccagggctcaggccacctcgcgtctcagtaccgccagttgtcccactcccaaagttcagtcccggtgttctagtaaagaaaatattttaagggctagccacagtgccgtagacattacaaaagtggcaagaagacataggatgagcccgtttcctctgacatcgatggataaagcttttataacagtccttgaaatgaccccggtgctcggaaccgaaatcattaactatagggacgggatggggagggtcctggcacaggatgtatatgcgaaagacaatctccccccatttcctgcctcggttaaagatggatatgctgttcgtgcagcggatggtccaggcgacagattcatcattggagaaagccaggccggagaacagcctacccaaacagttatgcccggacaggtgatgcgggtgactactggagcccctattccatgcggcgctgatgctgtagtgcaggttgaagacacagagctgatccgtgagagcgatgatggaactgaagagctggaagtgaggatcctcgtccaggctaggcctggtcaggatataagacccatcgggcatgacatcaagcgtggagagtgcgtgctcgctaagggaacacacatgggaccctcagaaattggcctgctcgctactgtaggggtgaccgaagtggaagtgaataagtttccagtggtcgccgttatgtcaaccggtaatgagctactgaatcccgaagatgacctgctcccagggaaaatcagagattcaaatcgctcaaccctacttgccactatacaagaacatgggtatccgactataaatctgggcatcgtcggcgataatccagacgacctattgaatgccctgaatgaagggatttccagggcggacgtgataattacaagtggaggcgttagcatgggcgaaaaagactatctgaagcaagtgctggatatcgatctgcatgcccagattcacttcggacgagtgtttatgaaaccaggtttgccaacaacctttgccaccctggatattgacggcgttcgtaaaatcatcttcgccctacccggaaaccccgtgagcgccgtcgtgacttgcaacctgttcgtggtgcctgccctgcgaaagatgcagggcatcctcgatcctaggccaaccatcataaaggccaggctgtcctgtgacgtaaagctggaccctaggcccgagtaccataggtgcatcctaacttggcatcatcaggagcctctgccctgggcccagtcaactggcaatcagatgtctagcagactcatgagtatgcgttcagctaacggactcttgatgctgccgcctaaaacagaacagtatgtggagctgcacaagggcgaagtagtcgatgttatggttattggccgactgtag

SEQ ID NO: 224520 - DNA, 903 bp, Artificial Sequence
  Description of Artificial Sequence: Synthetic coding sequence
atggagaagacccaggagacagtgcagcggatcctccttgagccttacaaatatttactgcagttgcccggaaagcaggtgcgtaccaagttgagtcaagcttttaatcactggctgaaggtgcctgaagacaagcttcaaattattatcgaggtcacagaaatgctgcacaatgccagtcttttgatagacgatatcgaggataactctaagctgcgcaggggctttccggtcgcacacagcatatatggtataccaagtgtcatcaattctgccaattacgtgtatttcttgggactggagaaggtgttaaccctcgaccatcccgatgcagtcaagctctttacccgccaactgctagagctgcatcaaggacaaggcctcgatatttactggcgagataattatacttgtcctaccgaggaagagtacaaagcaatggttctccagaaaaccggaggtttatttggcctagcagtgggactcatgcaactgttttctgactataaagaggacctcaaaccactcctgaacacactgggtttattcttccagatcagagatgactacgccaacctgcatagcaaggaatattctgagaataagtcattctgcgaagatctgacggaggggaagttttctttcccaaccatccacgcaatttggtctagaccagaatcgacccaggtgcagaatattctgcggcagagaactgagaatattgacatcaagaagtattgcgtgcattatctcgaggacgtaggcagctttgagtatacacgtaacacattaaaagagctcgaggctaaagcatataagcagattgatgccaggggcggaaatcctgagctggtggctctggtaaagcacctttctaagatgtttaaagaagagaacgaatag

SEQ ID NO: 224521 - DNA, 903 bp, Artificial Sequence
  Description of Artificial Sequence: Synthetic coding sequence
atggaaaagacacaggagactgtgcagcggattctactggagccctacaaataccttctccagttgccaggcaagcaggtgagaacaaagctctcccaggcctttaatcattggcttaaggtcccggaggacaagctgcagatcattatcgaggttaccgaaatgttacataatgcttctttgctgatcgatgatattgaggataattccaagctcaggcgaggcttcccagttgcgcactctatctatggcataccctccgtgattaatagcgctaactatgtctacttccttggtctcgagaaggtcctgactcttgatcaccctgatgcagtgaaattgtttaccagacagctattagagcttcatcagggtcagggcctcgatatctattggcgcgataattacacatgtccaactgaggaggagtataaggcgatggtgctgcagaagacaggaggattgtttggcctcgccgtggggttgatgcagttgttctcagactacaaggaagatctcaagccgctgttaaatacactgggcctatttttccaaattcgggacgattatgctaatctgcactctaaggagtactccgaaaacaagtctttttgcgaagacctaacggaaggcaagttctcgttccctacaatccacgcaatctggagccggcctgagtcaacccaggtgcagaacatcctccgccagagaacagaaaacatcgatattaagaagtactgcgttcactatctggaagatgttggtagtttcgaatacacaagaaatacacttaaggagttagaggccaaggcttataaacagattgatgctcggggaggaaaccctgaactggtggctctcgtgaaacatctgagtaaaatgttcaaagaggaaaacgagtag

SEQ ID NO: 224522 - DNA, 729 bp, Artificial Sequence
  Description of Artificial Sequence: Synthetic coding sequence
atggagaaaacacaagagaccgtccagcgaattctgctggagccgtacaaatatctgttgcagctacccggaaaacaggtgaggaccaaattgtcccaagcatttaaccactggctcaaagtccctgaggacaagctgcagatcatcatagaggtaacagaaatgctccacaatgcgagccttcttatagacgatatcgaagataacagtaagctgcgtcggggatttcccgtggctcactcgatttatggaattccatcagtgataaactccgcgaattacgtgtacttcctggggttggagaaggttctgaccctggaccatcctgacgccgtcaagctcttcacgagacaactgttagagttgcaccaagggcagggcttagacatctactggcgcgataactacacttgtcctaccgaggaagaatacaaagccatggtgctgcaaaagaccggtggattgtttggcctggccgtggggctgatgcagctcttttcagactacaaggaagatctaaagcctctcctgaacacccttggcttattctttcagatccgcgacgattatgcgaatttacactcaaaggaatattccgaaaataagtctttttgtgaagacctgaccgaaggcaagtttagctttccaactattcatgcaatttggtccaggcctgaatcaacgcaggttcaaaatatactgaggcagcgaaccgaaaatatcgattag

SEQ ID NO: 224523 - DNA, 903 bp, Artificial Sequence
  Description of Artificial Sequence: Synthetic coding sequence
atggaaaaaacccaggaaacagtgcagcggattttgttagagccctataagtatctcttacaacttccgggaaagcaggttcggactaagttgagccaagctttcaaccactggttgaaggttcctgaggataagcttcagatcattatagaggttactgaaatgctacataacgctagcctgcttatcgacgacattgaagacaattctaaactgcgcagggggttcccagtggcacactctatatacggcattccctcagtcataaattccgcaaactacgtgtatttcctcggactggaaaaggttctgactctcgaccacccagacgccgtgaagctgtttacacgccagctactggagctccaccagggccaaggcctggatatatactggagggataattatacttgccccactgaggaagaatacaaggccatggtgctccagaaaactggcggtctgttcgggctggccgtgggtctgatgcagctattctccgattacaaggaagacttgaagccgctgcttaacacactgggcctctttttccagatccgggatgactacgccaacctgcactcgaaagagtatagtgagaataaaagtttctgcgaagatctgactgaaggcaagttttcctttccaaccattcacgctatctggtcccgccctgaatctacacaggttcaaaatatcctccgccagcgcactgagaacattgacattaaaaaatactgtgtgcactatttggaagacgttggatctttcgaatatacacgtaataccttaaaggaattagaagccaaagcttacaaacagattgacgctcgcggagggaatccagagctggtggcactagtgaaacatttaagcaaaatgttcaaggaggagaacgagtag

SEQ ID NO: 224524 - DNA, 903 bp, Artificial Sequence
  Description of Artificial Sequence: Synthetic coding sequence
atggaaaagactcaggagacggttcagcgcattctgctggaaccatataaatacctcttacagttgcccggtaagcaagtgaggaccaaactgagtcaggcatttaaccactggctgaaggtgcctgaagacaaactgcagatcataatagaagtgacagagatgttacacaatgcctccctgctgattgacgatattgaggacaacagtaagctcagacggggattccccgtcgcccactcaatctatggcattcccagcgtaatcaacagcgctaactatgtgtatttcctagggctcgaaaaggtcctaacgttggaccacccggatgcagtcaagctgtttaccaggcaactgctggaactgcaccaggggcagggcctggatatttattggcgcgacaattatacatgcccgacagaggaggagtataaagctatggtcctccagaagactggtggcctctttgggttggctgtcgggctcatgcagctcttctcagactataaagaggacctgaagccgctcttgaatacactgggactgttcttccagatacgagatgactacgccaacttgcactcaaaggagtatagtgagaacaaaagcttctgcgaggacctgaccgaagggaaattttcttttccaacgatccacgcaatctggtcacgaccggaatcgacacaggtacagaatatactccgccagcgcacagaaaacattgatataaagaaatactgtgtccactaccttgaagatgtgggctcgttcgagtatacaaggaatacacttaaggaactggaagcaaaggcctataaacaaatcgacgccaggggcggaaacccagaattagttgccctggtcaagcacctgagcaaaatgtttaaggaggaaaacgaatag

SEQ ID NO: 224525 - DNA, 693 bp, Artificial Sequence
  Description of Artificial Sequence: Synthetic coding sequence
atggaaaagactcaggagactgtgcagagaatcttgttagagccgtacaaatatcttcttcagctgccgggtaaacaggttcgaactaagttgtctcaggcttttaatcattggctgaaggtacccgaggataagctccagatcataatcgaggtcaccgagatgctgcataacgcctcattactcatagacgacatagaggataattctaagttgcgcagaggcttcccggtggctcattccatctacggtatcccgagcgtaatcaactccgctaattatgtgtacttccttggtcttgaaaaagttttgaccctcgaccatccagacgcggttaagttattcacgcgtcaacttctagaactgcaccaaggccaggggcttgacatttattggcgggataattatacctgcccgactgaggaagaatacaaagccatggttttgcagaagaccggaggcctttttggcctcgctgttgggttaatgcagctgttttcagactacaaggaagatcttaaacccttactcaatactctgggactgttcttccagatcagagatgattacgcaaacctccattcaaaggagtattccgagaataagtcattctgtgaagatcttaccgaaggtaaatttagttttccaacaattcacgcaatctggtctcgcccagaatcaacccaggtgtag

SEQ ID NO: 224526 - DNA, 537 bp, Artificial Sequence
  Description of Artificial Sequence: Synthetic coding sequence
atggggaatagcctgctgcgagaaaacaggcggcaacaaaatacccaggagatgccatggaatgtgaggatgcagtcccctaagcagaggacatctaggtgttgggatcaccacatcgctgagggctgcttctgcctgccatggaaaaagatcctcatttttgagaaacgacaggactcgcagaacgaaaatgaacgcatgtcttctacccccatccaagataacgtggaccagacttattcagaagagctgtgctacacacttatcaatcaccgcgtgctgtgtacccggcctagcgggaacagcgctgaagaatactacgaaaacgtgccttgcaaagcggagcgcccaagagagtccctgggcggaaccgaaaccgaatactccttgctgcacatgccttccacagacccaaggcatgccagatccccagaggacgagtacgaactgctaatgccacatcgcattagcagccacttcctgcagcaacctaggccactcatggccccaagtgagacgcagttctctcatttatag

SEQ ID NO: 224527 - DNA, 492 bp, Artificial Sequence
  Description of Artificial Sequence: Synthetic coding sequence
atgggcaactccctcctgcgtgagaataggagacagcagaatacgcaggaaatgccatggaacgtacgaatgcagagccccaagcagaggacctctcgcaagaagatcctgatatttgaaaagcgccaagactcacagaatgagaatgagcgtatgagtagcacaccaattcaagataacgtcgaccaaacttatagcgaagagctgtgctacactctaatcaatcacagagtcctctgcacacgcccttcaggcaactctgccgaggaatactacgagaatgtgccctgtaaagctgagagacccagggaaagcctggggggtaccgaaactgagtactctctgcttcacatgccctcaacagatccccgacatgccagaagcccggaagatgagtatgagctgttgatgccgcaccggattagctcacacttccttcagcagccgaggcctttaatggctccatcggagacccagttttcccatctttag

SEQ ID NO: 224528 - DNA, 543 bp, Artificial Sequence
  Description of Artificial Sequence: Synthetic coding sequence
atgggtaacagtctgttgagggaaaacagcttcaggcgccagcaaaatacccaagaaatgccttggaacgttcgcatgcagtccccaaagcagagaacatcacgttgctgggaccaccatattgcagaaggctgcttctgtcttccatggaagaagattctgattttcgaaaagcgacaggatagccagaacgagaatgagaggatgtctagcactccgattcaggacaacgtggatcaaacatacagcgaagaactatgttacacgctgatcaaccacagagtcctctgcacacggccatcaggtaattcagcggaagagtactatgaaaacgtcccatgtaaagcagaacggcctagagagagcctcggcggaactgaaacagaatactccctgctgcacatgcccagcacggatccccgacatgcccgttcccctgaagacgagtacgagctactgatgcctcacaggatatcatctcacttcttacaacagccgagaccactcatggcaccatccgaaactcagttctcccacctgtag

SEQ ID NO: 224529 - DNA, 351 bp, Artificial Sequence
  Description of Artificial Sequence: Synthetic coding sequence
atgccatccccaggcaccgtctgcagccttctgttattaggcatgctgtggcttgaccttgctatggcagggtcaagttttctgagtccagaacaccagcgagtgcagcgcaaggaatccaaaaagcccccagccaagctccagcctcgtgcacttgcaggctggctgagacccgaagacggcggacaggccgagggagcagaagacgagctggaggttcgttttaacgccccttttgacgtgggaatcaaactctcaggggtacaataccagcagcacagtcaggcccttggcaaattcctgcaagacattctctgggaagaggctaaggaagcacccgctgacaaatag

SEQ ID NO: 224530 - DNA, 354 bp, Artificial Sequence
  Description of Artificial Sequence: Synthetic coding sequence
atgccttctcccggaacagtgtgttccttgctcctactcgggatgctgtggcttgaccttgctatggccggaagttcttttctttctcccgagcaccaaagagttcagcagagaaaagagtcaaagaaacctcctgctaaacttcaaccgcgtgccctcgctggatggctcagacctgaggacggtggacaggccgagggcgcagaggacgaacttgaggtgaggttcaacgctccttttgacgtgggcattaaactgtccggcgtccagtaccaacagcatagccaggcgctggggaagtttctccaggatatcctgtgggaagaagccaaggaggctcccgctgataagtag

SEQ ID NO: 224531 - DNA, 276 bp, Artificial Sequence
  Description of Artificial Sequence: Synthetic coding sequence
atgccttctcccggaacagtgtgctctttgctgctgctgggaatgctgtggctggatcttgctatggcagggtcgagcttcctgagccctgagcaccagagagtgcagcaacggaaggagagcaaaaagccgcctgctaagttgcagcctcgtgcattggcgggatggctgaggcctgaagacggtggtcaagctgagggggctgaggatgaactcgaagttcggcgaccacagcccacatctgaccgcccacaggcattgttaacatccctctag

SEQ ID NO: 224532 - DNA, 102 bp, Artificial Sequence
  Description of Artificial Sequence: Synthetic coding sequence
atgccctcacccggtaccgtctgctctcttctgctcctgggcatgctgtggcttgatctggcgatggccggaagctcgtttttgtcacctgaacatcaatag

SEQ ID NO: 224533 - DNA, 354 bp, Artificial Sequence
  Description of Artificial Sequence: Synthetic coding sequence
atgccatcgccaggaaccgtgtgcagtcttctcctccttggtatgctctggctggacctggccatggctggctctagcttcttgtcaccagaacaccaaagagttcagcagcgaaaagaatctaaaaaaccaccagctaagctgcaacctcgagcgctggcaggttggttgagacccgaggacggcggacaggcagagggcgctgaagacgaacttgaagttaggttcaacgctccgtttgacgtgggcataaagttgagcggcgttcagtaccagcaacactcccaggctctggggaaatttctacaggatatcctgtgggaggaggctaaggaggcaccagccgacaaatag

SEQ ID NO: 224534 - DNA, 351 bp, Artificial Sequence
  Description of Artificial Sequence: Synthetic coding sequence
atgcctagcccgggaacagtctgctccctattactgttgggaatgttgtggctggacctggctatggccggttcttcatttctatcgcccgagcaccagcgcgtccagcggaaggagtccaaaaagccacccgcaaaactgcaaccgagagcactggccggatggttgcggcctgaggatggtgggcaggcagagggcgctgaggacgagctcgaggtaagatttaatgccccttttgatgttgggattaaactgtcgggggtccagtaccagcagcacagccaagctctgggcaagtttctgcaggatattctgtgggaggaggcgaaagaagcgcctgcagacaagtag

SEQ ID NO: 224535 - DNA, 318 bp, Artificial Sequence
  Description of Artificial Sequence: Synthetic coding sequence
atgttcacctgctggtggagttacttaaggagtacattagccgcagtgcctggcgaggccagtcgggtgcagcagagaaaagaatccaagaagccacctgctaaactgcagccgcgagccttggccggttggcttcgccctgaagacgggggtcaggctgagggtgcagaggatgagttagaagtacgctttaacgcccctttcgacgtcggaattaagctgtctggagtccagtaccaacagcattcacaggccctggggaagtttttacaggatatcttgtgggaggaagcgaaggaagctcccgctgacaagtag

SEQ ID NO: 224536 - DNA, 201 bp, Artificial Sequence
  Description of Artificial Sequence: Synthetic coding sequence
atgttcacctgctggtggtcctacctgagatcgactcttgccgcagtccctggtgaagcatctagggtccagtttaacgcacctttcgatgtaggtatcaagttgagtggcgtgcaatatcagcagcactcccaggcactcggtaagttcttgcaagatatcctgtgggaggaggccaaggaggcccctgccgataagtag

SEQ ID NO: 224537 - DNA, 315 bp, Artificial Sequence
  Description of Artificial Sequence: Synthetic coding sequence
atgtttacatgctggtggagctatctgcgatccaccttggctgcggtgccaggcgaggcctctcgtgtgcagcgaaaagaatctaagaaacccccagcaaaactccagcccagggctcttgctggctggctgagaccggaggatggagggcaagccgagggcgctgaggacgagctcgaagttaggtttaatgccccttttgatgttgggattaagctcagcggcgttcagtaccagcagcatagtcaagcactcggcaagttcttacaggacatcctgtgggaggaagccaaagaggccccagcggataagtag

SEQ ID NO: 224538 - DNA, 351 bp, Artificial Sequence
  Description of Artificial Sequence: Synthetic coding sequence
atgccaagtcctggcaccgtttgctcactgttgttactgggaatgctatggctggatctcgctatggcaggatcttcattcctgtctcctgagcaccaacgggtgcaacggaaggaatcaaaaaagccaccagccaagttacagcccagggccctggccggatggctgcggccagaggacggcggtcaggctgaaggagccgaggacgaattagaggtgcgatttaacgctccgttcgatgtaggcattaaactctctggtgtccagtaccaacaacatagtcaggcactgggaaagtttctgcaggacattttgtgggaggaagcaaaggaggcccctgcagataagtag

SEQ ID NO: 224539 - DNA, 354 bp, Artificial Sequence
  Description of Artificial Sequence: Synthetic coding sequence
atgcccagccctggaactgtctgttccctcttgctcttgggcatgctgtggctggatctagccatggcaggaagctcattcctgagcccggaacatcaacgcgtgcagcaacggaaggagagtaaaaaacccccagctaaattacagcccagagcccttgctggttggctacggcctgaagacggcggacaggcggaaggcgcagaggatgagcttgaggttcgtttcaacgctccttttgacgtggggataaagctgagcggagttcaataccagcagcactcccaggcactcggaaagttcctgcaggacattttgtgggaggaggcgaaagaggctcccgcagataagtag

SEQ ID NO: 224540 - DNA, 354 bp, Artificial Sequence
  Description of Artificial Sequence: Synthetic coding sequence
atgccttcccccggaactgtctgtagtctgctactgcttggaatgctctggctcgatttggccatggctggatcaagtttcctgtcgccggagcaccagcgggtgcagcagaggaaggaatccaagaagccaccagcgaagctccaaccacgcgcacttgcgggttggttaagaccggaggacgggggtcaggctgaaggagccgaggacgagttggaggtgaggtttaatgcacccttcgacgtgggcatcaaactgtccggggtgcagtaccagcagcacagccaggccttaggaaagttcctacaggatattctctgggaggaagctaaggaagcacccgcagacaaatag

SEQ ID NO: 224541 - DNA, 1794 bp, Artificial Sequence
  Description of Artificial Sequence: Synthetic coding sequence
atggccgagggtagtgcagtcagtgacccccagcacgccgctcgtctgttaagagctttatcgtcctttcgcgaggagtcgcgattctgcgatgcacacctagtgctcgatggtgaggagatccccgtgcagaaaaatatcttggctgccgcttctccctacatccggaccaagctgaactataacccccctaaggacgacggttcgacctataagatcgagctagaaggcatttctgtgatggtgatgagggagattctggattacatcttctctggtcagatacgtttgaacgaagacaccattcaagacgttgttcaagccgcagacctactgcttctaaccgacctcaaaaccctgtgttgtgagttcctggaaggatgcatcgcggctgagaattgcatcggaatacgggactttgccctgcattattgcttgcatcacgtccattacttggccactgaatacctggagactcacttccgggacgtcagttcaacagaggaattcctggagctctccccccagaaactcaaagaagttatatcactcgagaaactgaatgtgggtaacgagcggtatgtttttgaggctgtcattcggtggatcgcccatgatactgaaatccggaaggtccatatgaaggacgtcatgtccgcactgtgggtgtctggcctcgactcttcttatctgagggagcagatgctgaatgagccccttgtgcgagaaattgtgaaggagtgctccaatattccattgagtcagccccagcagggcgaggccatgctagccaatttcaagccacgcggttatagcgaatgtattgtcactgtggggggtgaggagagagtgtcccggaagccaactgccgcaatgcgttgcatgtgtcctctgtatgatcccaatagacagttgtggattgaactcgctcctttaagcatgcctaggattaaccatggtgtactgagcgcggaaggatttctttttgtctttgggggtcaggatgaaaacaagcaaaccctgtcttcaggcgaaaaatacgaccccgacgccaatacttggaccgcgctcccacctatgaacgaggccaggcataactttgggatcgttgagatcgacggcatgctgtatattctagggggtgaggatggagagaaggagttgatctccatggagtgctatgatatctactccaagacctggacaaaacagcctgaccttaccatggttaggaaaattggatgttacgcggcaatgaaaaaaaagatctatgctatgggcggtggcagctatggcaaactgttcgagtctgtcgagtgctatgacccacggacccaacaatggacagcgatttgcccccttaaggaaaggcggtttggagccgtcgcatgcggggtggccatggaattgtatgtgtttggcggagtgcgcagtcgcgaggacgcgcagggatcggagatggtgacctgcaagagtgagttttatcatgatgagtttaagcgctggatctacttgaatgatcagaacctttgcatccccgctagttccagctttgtgtatggggctgttcctattggggcaagtatttacgttataggggatctagataccggtacgaattatgattacgtgcgagagtttaaacggtcaaccggcacctggcaccataccaaacccctccttccatcggatttacgacgaaccggctgtgccgcactacgtatcgccaactgcaagttgttccgcctgcaattgcagcagggcttgttccgcattcgcgtccacagcccatag

SEQ ID NO: 224542 - DNA, 591 bp, Artificial Sequence
  Description of Artificial Sequence: Synthetic coding sequence
atgttctgcgagaaggcaatggagctcatcagagagctgcacagggctccagaaggacaactgcccgcatttaatgaggacggcctgagacaggtgctggaggagatgaaggccctttacgagcagaaccaaagcgacgtaaacgaggctaaatctgggggtcgaagcgatttaatccctaccatcaaatttcgccactgctctctactcagaaacagacgatgtactgttgcatatctctatgacagactgttaaggatccgggctctcagatgggaatatggatctgtgttacccaacgctctgaggtttcatatggcagcggaggagatggagtggttcaataactacaaacggagcctggcgacctacatgagaagcctcggaggagatgagggtttggacattactcaggatatgaaacctcctaagagtctttatatcgaagttcgttgtctgaaagattatggtgaattcgaagtggacgatggcacctctgtgctgctgaaaaagaacagtcagcactttttgccacggtggaaatgcgaacagctgatacgacaaggggtccttgagcatattctcagttag

SEQ ID NO: 224543 - DNA, 498 bp, Artificial Sequence
  Description of Artificial Sequence: Synthetic coding sequence
atgttctgtgagaaagccatggagcttatccgggaacttcaccgggcaccggaaggccagttgcctgcctttaatgaggacgggctacggcaggtcctcgaagagatgaaagccttatacgagcagaatcagtccgatgtgaacgaggcaaagtcaggcggacgcagtgaccttattccgaccattaaattccgtcactgctctctcctgcgcaatcgcagatgtactgtagcctacctctatgatcggctgctgaggatacgggcacttaggtgggaatacggatccgtgctgccgaacgcacttcgtttccacatggctgcagaggagatggagtccagatctgttgcccaagctggcgtgcagtggtgcattctgtgttctctccaattacctccaccaggtttcaaacagttctcctgtctgagtctgccatcttcgtgcgactatagatggagtggactgatcatcattaaagacctgttgctcctcatttag

SEQ ID NO: 224544 - DNA, 558 bp, Artificial Sequence
  Description of Artificial Sequence: Synthetic coding sequence
atggacgctgctgaagttgaatttctggctgagaaggaactggtgaccattatcccaaattttagcttggataagatttatttgattggaggcgatttggggccattcaatcccggtctaccagtagaggtgccactgtggctggcaattaacctgaaacagaggcagaaatgcagactattaccgccagagtggatggacgtcgagaaactggaaaaaatgcgggaccacgaaagaaaggaggagactttcacacccatgccttccccctattacatggaactgacaaagctcctcctcaatcacgcttccgataacattccaaaggcagatgaaattaggaccctggtgaaagatatgtgggacacacggattgccaagctgagggtttctgcagattctttcgtcaggcagcaagaggcgcacgccaagctggacaatctcaccctaatggagattaatacttccggaaccttccttacacaggcattaaaccacatgtacaaactgaggaccaacctgcagcctctggaatcgacccagtcacaagacttctag

SEQ ID NO: 224545 - DNA, 651 bp, Artificial Sequence
  Description of Artificial Sequence: Synthetic coding sequence
atgagcgaggcttacttccgggtggaatccggtgcactaggaccggaggagaacttcctgtccttggatgatatcctgatgtcacatgagaagttacccgtgaggacagaaactgcaatgcctcgactgggagctttctttctggaacgttccgcgggagccgagaccgataacgccgtgccacaaggatcaaagcttgagctcccgctctggctcgcaaaaggcctctttgacaacaagcgcaggatcctgagcgttgagctgcccaagatctaccaagaaggctggaggaccgtgttcagcgccgacccaaacgtggttgaccttcacaagatgggccctcacttttatgggttcggatcacagctgttgcactttgattctcccgaaaatgctgacatcagccagtccctgctgcagaccttcattgggagattccgccgtattatggattccagccagaacgcgtacaatgaagatacaagcgccctggtggcgaggctggatgagatggagcggggtctttttcaaaccggacagaaaggtcttaacgacttccagtgctgggaaaaaggccaggcaagccagatcacagcctccaatctggttcagaattacaagaaaagaaaatttacagacatggaggactag

SEQ ID NO: 224546 - DNA, 417 bp, Artificial Sequence
  Description of Artificial Sequence: Synthetic coding sequence
atgtccgaggcttatttccgcgtcgaatcaggggctctcggaccagaggagaactttctgtcacttgatgatatcctcatgtcacacgaaaaactgcccgtccggactgaaactgcgatgcctaggctcggagctttcttcttggaacgtagtgccggagccgagaccgacaacgcggtcccccagacattcattgggcgattccggaggattatggactctagccagaacgcctataatgaggatacttctgctctcgtcgcgagactcgacgaaatggaacgcggattattccaaactggccaaaagggcctgaacgatttccagtgttgggaaaaagggcaggcttcccaaattacggctagtaacctcgtgcagaattataagaaaaggaaattcactgacatggaagactag

SEQ ID NO: 224547 - DNA, 768 bp, Artificial Sequence
  Description of Artificial Sequence: Synthetic coding sequence
atgtccgaggcttattttagagtggaaagcggcgcattgggtccggaggagaatttcctttctctagatgatatattgatgtcacacgagaagctgcctgtcagaaccgaaacagcaatgcctagattaggagctttctttctggaacggagcgctggggctgaaacagataatgccgttccacagggtttcgcccttctgcctcggctcgaatgctctggagtgatttggctgactgccgctttgacctcccaagcgccagaaattctgcctccgcaaccccctatgtggctcgtgctgcagggttctaagctcgaactccccctctggcttgccaaagggctcttcgacaataagcgcaggatcctttccgttgagttgcccaaaatttaccaagaaggctggcgaaccgtcttcagcgctgatccaaatgtcgtggatctgcataagatggggcctcatttttatgggtttggcagccagttactccatttcgactcacctgaaaacgccgatataagtcagtcgctcttgcaaacatttataggacggttccgtcgaattatggacagctcccaaaacgcatataacgaggatacgagcgcgctggtggcaagactggatgagatggagcgaggcctcttccagacaggccagaagggcctcaacgacttccagtgttgggagaagggtcaagccagccaaatcacagctagtaacttagtgcagaattataaaaagaggaagtttactgacatggaagattag

SEQ ID NO: 224548 - DNA, 672 bp, Artificial Sequence
  Description of Artificial Sequence: Synthetic coding sequence
atgacagaagaagtggactttctgggacaggattccgacgggggatcagaggaggtggttctaacacctgccgagctaattgaacgcttagaacaagcttggatgaatgagaagtttgccccagaattgttggagagtaagcctgagattgtcgaatgtgtgatggagcagttggaacatatggaggagaacttacggagagcgaagagggaagatctcaaagtgagtattcaccagatggagatggagaggattcgatatgtgctttcaagctacttacggtgcagactcatgaagattgaaaaattttttccacatgtccttgagaaagagaagactagaccggagggcgagccctcttccctgtccccagaagaactcgcgttcgcacgggaattcatggccaataccgaaagttacctgaagaacgtcgccctcaaacacatgccacccaacctacaaaaagtggatttgtttagggcagtgcctaagcctgacctcgacagctacgttttcctacgcgttcgcgagagacaggagaatatcttagtggagccagacacggatgagcagcgcgactacgtcatcgaccttgagaaaggcagtcagcatcttatacggtataagacaattgccccactcgtggcctcaggggctgtgcagctgatttag

SEQ ID NO: 224549 - DNA, 672 bp, Artificial Sequence
  Description of Artificial Sequence: Synthetic coding sequence
atgaccgaggaggtggattttctaggccaagactccgatggcggatcagaggaggtagtgcttacaccggctgaactcattgagaggttggagcaggcatggatgaatgagaagtttgctcccgaactcctggagagcaagccagagatcgtggaatgcgtgatggaacagctggagcacatggaggagaatctgcgacgcgcaaaacgcgaagacctgaaggtcagtattcatcagatggaaatggaacgaattaggtacgttcttagctcctacctgcgctgtcgcttaatgaagattgaaaagtttttcccccacgtcttagagaaggagaagacccgcccagaaggcgaaccatcctctcttagcccagaagagctggcatttgccagggagtttatggccaacacagaatcatacctgaagaacgtggcgttgaaacacatgcctcccaatctccaaaaggtggatctatttcgagccgtgcccaaacccgaccttgactcatatgtctttttgcgagtgagagagaggcaggagaatatccttgtagagcccgatactgatgagcaaagagattacgtgatcgacctggagaaagggtctcagcacttgatcagatataaaacaatcgctcccttggtggcctcaggggcagtgcagctgatttag

SEQ ID NO: 224550 - DNA, 303 bp, Artificial Sequence
  Description of Artificial Sequence: Synthetic coding sequence
atgacagaggaggtggatttccttggtcaggatagcgatggcggtagcgaggaggtcgtccttacacctgccgagctcatcgagcgactggaacaggcctggatgaacgagaaatttgctccagagcttctggagtctaagccggagatcgttgagtgtgttatggagcaactcgagcatatggaggagaacttgaggcgcgctaagagagaggacctaaaggtgagcattcatcaaatggaaatggaaagaattaggtacgtgttgagctcatacctaaggtgcaggttaatgaaggtttag

SEQ ID NO: 224551 - DNA, 939 bp, Artificial Sequence
  Description of Artificial Sequence: Synthetic coding sequence
atggaaggtgctgcggcacgcgaagcccgaggcacagagacccctcgcgcttccgcaccaccacctgcgccatcggagccaccagctgcccctagagcaagacctaggctggtctttaggacccagcttgcacacggttcacctactggaaaaatcgaaggcttcactaacgtacgggaattgtatgccaaaatagccgaagcgttcggtatcgcaccaacggaaatccttttctgcactctgaatagccataaagtcgatatgcagaaactgctcggcggacaaataggtctggaagatttcatatttgcccatgtgcggggagagaccaaagaagtggaagtgacgaagactgaggacgctttgggactgaccatcaccgataatggggcagggtacgcctttataaagaggataaaagagggttccatcattaaccggattgaggctgtgtgtgtgggggactccattgaagccatcaatgaccattccatcgtgggatgcaggcattatgaagtcgccaagatgctgagagagctacctaagagtcagccttttactctccgccttgtccagccaaagagagcctttgatatgattggtcagcggtccaggagcagtaagtgccccgtcgaggccaaggtgactagtgggagggagaccctgcggctgcggagcggcggtgcggcaaccgtggaagaagccccatccgagtttgaagaggaagctagtcgcaaggtcgacgatctgctggaatcctacatgggtatcagagacccagaacttgcttctacgatggtcgagacaagcaaaaaaacagcgagcgctcaagaatttgctcggtgcttggattccgtgctgggtgagtttgctttccctgacgaatttgttgtggaggtctgggcagcgatcggcgaagcacgcgaggcgtgtggctag

SEQ ID NO: 224552 - DNA, 2097 bp, Artificial Sequence
  Description of Artificial Sequence: Synthetic coding sequence
atgccttccgagggtcgctgctgggaaactttaaaagccctccggagtagcgacaaaggccgtctctgctactatcgtgattggctgctgcgacgcgaggatgtgctggaagaatgtatgagcttgccaaagctgagctcatacagcggttgggtggtagaacatgtgctgcctcatatgcaagagaaccagccgctttcagagacgagcccttcctctacatcagcaagcgcccttgatcaacctagttttgttccaaaaagcccggatgcgagctccgctttcagtcctgcttctcctgccaccccaaatggcaccaaggggaaggatgagagccaacacacagagtccatggtgctgcaaagctctaggggtatcaaagtcgagggctgcgtgaggatgtacgaactggtgcacagaatgaaaggaacagaaggtcttagattatggcaggaggagcaggagagaaaagtgcaggccttgagcgaaatggcaagcgagcaattgaagcgatttgacgagtggaaagaactaaagcaacataaagaatttcaggatctccgtgaggtgatggagaagtcttcgcgcgaggcattaggccaccaagagaagctgaaagccgaacatcgccaccgcgctaagatcctgaacttaaagctgcgggaagccgaacaacaacgggtcaagcaagccgagcaggagcggctgagaaaggaagaggggcaaattaggctgagagctctctacgcacttcaggaagagatgctgcaattgagtcaacaactcgacgcttctgagcagcataaggcacttttgaaagtagatctggcagcctttcagactaggggcaatcagctctgctcccttatttctggcatcatccgcgcttccagcgagtcctcgtacccaacggctgagagccaagcggaggcagagcgcgctttacgggagatgcgtgatttgctgatgaatctcgggcaagagattacaagggcctgtgaagacaagcgacgtcaggacgaggaggaagctcaggtgaagctgcaggaggcccaaatgcaacaaggtcctgaggctcacaaagagcccccagctccaagccaaggacctggcggtaagcagaatgaagacctgcaggtgaaagtgcaggatattaccatgcagtggtatcagcagctccaggacgctagcatgcagtgtgtcctgacatttgagggcctaaccaatagcaaggacagtcaggctaagaaaataaagatggatttgcagaaagctgccaccattcctgtctctcaaatctcaaccattgcgggatcaaaactgaaggaaatcttcgacaaaattcacagcttgcttagtggaaagcccgttcagtcgggtggaaggtccgtctctgtgaccctgaatccccaggggttagactttgtgcaatataagttagccgaaaagtttgttaagcagggggaagaggaggtcgctagtcatcacgaagccgctttccctatcgcagtcgtcgcatcaggcatctgggagctccacccacgggtcggagacctaattctcgcccaccttcacaagaagtgtccctatagtgttccattttatcccacattcaaagaggggatggccctagaggactaccagcggatgctcggataccaggttaaggacagcaaagttgagcagcaggataacttcttaaagcgcatgtcaggtatgatcaggctctacgctgctattatccagcttaggtggccctatggaaaccggcaggaaatacaccctcacggcctcaatcacggctggagatggctggcacagatactgaatatggagcctctgtccgacgtcactgctactttgctttttgacttcctcgaggtgtgtgggaatgctctgatgaaacaataccaggtgcagttttggaagatgctcatcctgattaaagaggactactttcctcgtatcgaggcgatcacttcctctggacagatgggcagttttattagattgaaacagttcctggagaagtgtctgcagcataaagatatcccagttcccaaagggttcctaactagcagtttctggcggagctag

SEQ ID NO: 224553 - DNA, 1980 bp, Artificial Sequence
  Description of Artificial Sequence: Synthetic coding sequence
atgccttcagagggtagatgttgggagacactgaaggcactgagatcctccgataaaggacgactctgctattatagagattggttgctgcgacgagaagacgttctggaggaatgcatgtctctcccaaaactgagcagctactctggttgggtcgtggaacatgttctgccacatatgcaagagaatcagccacttagtgagaccagtccttcaagtacaagcgccagcgccctggaccagcctagcttcgtaccgaagtcacccgacgccagctcagcattttcaccagcaagccccgctaccccaaacgggacaaagggtaaggacgagagtcagcacacggagtccatggtcttgcagagctccaggggtatcaaggtggaaggctgcgtgcgaatgtacgagttagtccaccgaatgaaaggcactgagggattgagactgtggcaggaggaacaggagagaaaggttcaggccctctccgaaatggctagcgagcaacttaaacggttcgatgaatggaaggaactcaaacaacataaagaatttcaggatctccgtgaagtaatggaaaaaagctcacgcgaggccctgggacaccaagagaaacttaaagctgaacatcgtcatcgcgctaagatactcaacctcaagctgcgggaagccgaacagcaacgcgtgaagcaggctgagcaggaaaggctccggaaggaagagggtcaaatcaggctcagggctctatacgcactgcaagaggaaatgttgcagttaagccagcagctcgacgctagtgagcagcacaaggcactgctgaaagtggacctggccgcatttcagacaaggggaaatcagctatgctccctaatttcgggaattatccgcgctagttccgagtccagctaccccaccgctgagtctcaggccgaagccgaaagggccctgagagaaatgcgagacctgctcatgaaccttgggcaggagattactagagcttgcgaggataagcgccgtcaggatgaggaagaggcgcaggtgaagctccaggaagcgcagatgcagcagggaccagaggcccacaaggagcctccggctccaagccagggcccagggggaaaacagaacgaggatctgcaagtaaaggtgcaggatattacaatgcagtggtaccagcaactgcaggacgcctcaatgcaatgcgtattgaccttcgagggccttactaactcaaaggattcacaggccaaaaagattaaaatggatcttcagaaagccgctaccatccctgtgtctcaaattagtactatcgctggtagcaagttaaaagaaatcttcgataaaatccacagtctgctcagtggtaaaccagtccagtccggtgggcgatccgtctccgtcacactcaatccacagggactggacttcgtacagtataagttggccgagaagtttgtgaagcagggggaagaggaggtggcctctcaccacgaggccgcttttcccattgccgtcgtcgccagcggcatttgggagctgcacccacgagtcggagacctgattttggcccacctgcacaaaaaatgtccttattccgtgcccttttaccctacctttaaagaaggcatggctctggaggactaccaacggatgctgggctaccaggtgaaagattctaaagtggagcagcaggacaacttcctgaaaaggatgagcgggatgatacgactatacgcagctatcattcaactccgatggccatacggcaacaggcaagaaatccacccccacggactgaatcacggatggcgatggcttgcccagatcctgaatatggagccactgtcggacgtgacagctacactgttatttgattttctggaggtgtgtgggaatgctcttatgaagcaatatcaggtgcagttttggaaaatgctcattctgatcaaggaggattactttcctaggtaccaagcctgttag

SEQ ID NO: 224554 - DNA, 1335 bp, Artificial Sequence
  Description of Artificial Sequence: Synthetic coding sequence
atgctgcaactcagtcagcagttggatgcttccgaacagcataaggctttgctgaaagtagatctcgccgcatttcagacccggggtaaccaactgtgttcactaatctccggcattatcagggcatcctccgagagctcttaccccaccgccgaatcccaggctgaagctgagagggctctccgtgaaatgagggacctgctgatgaacttggggcaagagatcacaagggcatgtgaagacaaaagacgtcaagacgaagaagaagcacaagtcaaactgcaggaagcccagatgcagcagggtcctgaagcacacaaagagcctcccgctccttcccagggaccaggagggaagcaaaatgaagatctgcaggtgaaagtacaggatatcaccatgcagtggtaccagcagctccaggacgccagtatgcagtgtgttctcactttcgaggggctcactaattctaaggatagtcaggcgaaaaaaatcaaaatggatctccaaaaagccgctactattccagtgagccagatttcaacaatcgcaggcagtaagctgaaagaaatctttgacaagatccattctttgctgtccggcaagccagtgcagtcaggtggtagatcagttagcgtaaccctcaatccacagggactggactttgtgcagtataagctggcggaaaagttcgtcaagcagggcgaagaggaggtggcaagtcaccacgaggcggcattccccatcgccgtggtcgcctctgggatatgggaattgcaccctcgtgtgggcgacctcattctggcccatttgcataagaagtgcccttattccgtccctttttaccccacgtttaaggaggggatggccctggaagactatcaacgcatgctgggatatcaagtgaaagactccaaggtagagcagcaggataattttctgaagaggatgtccggtatgattcggttgtacgccgctattattcaactccgttggccctatggcaaccgtcaggaaatacatccgcatggccttaaccatggctggagatggttagcccagattttgaacatggaaccccttagcgacgtcacggccactctattgtttgatttccttgaagtctgcggaaatgccttgatgaaacagtaccaggttcagttctggaaaatgctgatcttaatcaaggaggattacttccctcgcatcgaggccatcacatctagcggacagatgggctcttttattcgattaaagcagttcctcgaaaagtgtcttcagcacaaagacatccctgtgccaaagggtttcttaaccagttcgttctggcgcagctag

SEQ ID NO: 224555 - DNA, 2490 bp, Artificial Sequence
  Description of Artificial Sequence: Synthetic coding sequence
atggccttgacaagcatcaatgccactccgacacagctgtctagttcttctaactgcttgagcgatacaaaccaaaataaacagtcctccgaaagcgccgtctccagtacggtgaacccagttgccatccacaagcgctcaaaggtcaagaccgagccagaaggcctgaggcccgcttcccctctggccctgacacagggtcaagtttctggacacggctcgtgtggttgcgcccttccgctgtcccaagagcagctcgcagacctcaaggaagatcttgatcgcgacgattgcaagcaagaggcagaagtggtcatttacgaaaccaactgtcattgggaggattgtacaaaggagtatgatacccaagaacagcttgtgcaccacattaacaacgagcatatacacggcgagaaaaaagagtttgtgtgcaggtggcaagcatgcacacgggaacaaaaacctttcaaggcacaatacatgctagtggtacatatgaggagacacactggagaaaagccacacaaatgtacatttgaggggtgctcaaaggcgtattccaggttagagaatttaaaaactcaccttaggagccatactggggaaaagccctatgtatgtgaacacgaaggctgcaacaaggcctttagtaatgcgtccgaccgtgcaaaacatcagaatcgcacccattccaatgagaagccctatatctgcaaaattccgggatgcacaaagaggtacaccgatccttcgtctctacggaagcacgttaaaacagtgcatggccctgatgcacacgtgactaaaaagcagcgcaatgacgtccatctccgcacaccccttctgaaggagaatggtgattctgaagctgggacagaacccggtgggcctgagtcaaccgaggcttccagcacaagccaggcggtagaggactgcttacatgtaagggctataaagaccgaaagctctggtctttgccagagctcacctggggcacagtccagttgttcatccgagccctctcccctgggtagcgcaccaaataacgacagtggtgtcgaaatgccaggcactggcccaggatcattgggcgacttgacggcgttggacgacactccccctggggcagacaccagtgctctggctgcaccttcagccggtggcctccagctgcgtaagcatatgacgaccatgcaccgctttgaacagcttaagaaggagaagcttaagtctctgaaagatagctgcagttgggccggaccgacacctcacaccagaaacactaagctacctccgctgcccggaagcggctctatcctggaaaatttttccggatcgggagggggtggcccagcaggcttgctaccaaacccccgacttagcgaactctctgcttctgaggttactatgttgtctcagctgcaggagcgtagagacagctcaaccagcacagtatcttctgcttacactgtctctaggcggtctagtggaattagtccctactttagctctaggcggtccagtgaggcatccccattgggtgccggtcggcctcacaacgctagtagtgccgactcatatgatccaatttccactgacgcttcaaggcggagcagtgaggcctctcagtgctcaggaggatctgggctgctgaatttgacccctgcacagcagtattctttacgagccaagtacgcagccgctactgggggaccaccgcctacaccacttccgggtttagaaaggatgtcactccgaacacggctcgcattgctggacgctcccgaacgcaccctaccagccggatgcccacgtcccctaggccctcgacgagggagtgatggcccaacctacgggcacgggcatgctggtgcggctcctgcctttccgcatgaggcacccggaggcggtgctcgcagagcctccgaccctgtgcgaaggcccgatgcgttgtctttgcccagggtacagcggttccacagtacgcataacgtgaatcccggaccattgcccccatgcgccgacagacgcggacttcgcctccaaagccaccctagtactgacggaggtctggcgagaggggcttattcccctcgcccaccttctatttctgagaatgtggccatggaggccgtggccgcaggcgtggatggagctggacccgaagctgacctgggcctgccagaagatgacttagtgctgcccgacgacgtagtgcagtacataaaggcacacgcatccggggcacttgacgaaggtactggtcaggtttacccaacagagagtacgggcttcagtgataatcctaggctaccatcacccggactgcacggccagaggaggatggtcgcggcagatagcaatgttggcccatcagcacctatgctcggtgggtgtcagcttggcttcggagctccgtctagcctaaacaagaacaatatgcccgtccaatggaatgaggcgtcggccacctggctgtcagggacgtag

SEQ ID NO: 224556 - DNA, 4761 bp, Artificial Sequence
  Description of Artificial Sequence: Synthetic coding sequence
atggagaccagtgctagtgcaaccgcctctgaaaaacaagaggctaaatccggcatactcgaggcagccggatttcctgaccctggcaaaaaagcttccccattggtggtggccgctgccgctgccgcagcggttgccgctcagggggtgccccaacatttgctccctccctttcacgcacccctcccgattgacatgagacaccaggagggccgataccactacgaacctcattctgttcatggggtgcacggcccacccgcattgtcaggcagtcctgtgatctctgacatctctttgatccgcctttcgccacacccggcaggacccggtgaatcgcctttcaacgcccctcacccctacgttaatccacatatggaacactacctccggtcagtgcacagctccccaacacttagcatgataagcgctgccagaggcctgtcacctgctgatgtggctcaggagcatctcaaagaacggggactgttcggcctacctgcacccggtactacaccgagtgactactatcaccaaatgactctggtggccggtcaccccgcaccctatggagaccttctcatgcaaagcggcggagcagcatccgctccacatctccacgactacctgaacccagtggatgtgtctagatttagctcgcccagggtcacacctagactctcgagaaaacgtgctctttctattagccctctttctgacgcgtcattagatctccagcgtatgattcgaacgtcacccaactctctcgtggcctacataaataacagccggtctagctctgctgcatcaggcagctacggccatctgtccgcaggagcactttctcccgcatttaccttcccacacccaatcaacccagtggcataccagcagatcttaagtcagcagcgcggattaggctctgcctttggacacacccctcctctcatacagccaagcccaaccttcttagctcagcaaccaatggccctaacttccatcaatgccaccccaacccagctgtcctctagtagtaattgcttgtctgacaccaaccaaaataagcagtcctctgaaagcgcagtgtcatcaactgtcaatcccgtggcaatacataagcggagcaaagtgaaaaccgaaccagagggcctccgacccgctagcccactagccctgacgcagggccaggtgagcggacacgggtcttgcgggtgcgccctgcccctgtcgcaggaacagctcgccgatctgaaagaagatctggacagagatgactgcaagcaagaggctgaagttgtgatatatgaaacaaactgccattgggaggactgtacgaaggaatatgatacccaggagcagctggtgcatcatattaataatgaacatatacacggggaaaagaaggaatttgtgtgccgctggcaagcttgtactagggaacagaaaccatttaaagctcagtatatgcttgtggtgcacatgcgcaggcatacgggcgaaaaaccccacaaatgtactttcgagggctgcagcaaggcatacagcaggttggaaaacttaaaaactcacctgcgcagtcatactggcgagaagccgtacgtatgtgagcatgaaggatgcaacaaggcgttcagcaacgccagcgatcgagccaaacaccagaaccgcacacattcaaatgagaagccttatatttgtaagatcccaggctgtacgaagcgatacaccgatccttccagcttgcgcaagcacgtcaagaccgtgcacggacctgatgcccacgtgaccaagaaacaacgcaacgacgtgcatctgcgcactccactcttgaaggagaacggtgacagtgaggcgggtaccgagcccggtggtccagaatcaaccgaggcttcatccacgagtcaagccgtcgaagactgtcttcacgtaagagcgattaaaacagaaagttctgggttatgtcaatctagccccggagctcagtcctcatgctcttccgaaccgagcccactggggagtgctcccaacaacgacagtggagtagagatgccgggtaccggccctgggtctttgggagatctgacggccctcgacgatacccccccaggagcagatacttccgctttagccgctccgtctgccggaggactacagctaaggaagcacatgactaccatgcaccggtttgaacagttaaaaaaggaaaaactgaaatcactgaaagactcatgcagctgggcaggccctaccccacacactcgcaatactaaactgcccccacttcctgggtccggtagtattctggaaaatttttctgggtccggcggtggtggccctgctggccttctgcctaaccctagattaagtgagctgtccgcctcagaggtcaccatgctgtcccagctgcaggaacgccgagattcaagcacgtcgacagtatcctccgcttatacagtgagccgcaggtcttcagggatttcgccgtacttctcgtcgaggcgctctagcgaagcttcgccgcttggggcaggtcgacctcacaacgctagtagtgcagactcctatgacccgatatcgaccgatgcttcgcgccgaagcagcgaggcttctcagtgttccggaggatcaggcctcctcaacctaactcctgcccaacagtacagcttgcgggctaaatacgctgccgcaacaggcggacctccacctactccgctgcctgggctcgagcgcatgagcctgcgtacccggctcgccttgctggatgcacccgagcgaactctgccggctggatgcccgagacccctcggaccacgtcgcggtagtgacgggcctacatatgggcatggacacgcaggggctgcccctgccttcccccacgaggcaccgggaggtggtgccagacgagcttctgaccctgtcaggagaccggatgctttaagcctccccagggttcaacgatttcatagcacccacaatgttaacccagggccactccctccctgcgcagacagacgagggttacgcctgcaatcccatccatccacagacggtggattggcgagaggggcatactcccctcggcctccctcaatttcggaaaacgtagccatggaagcggtcgcagccggagtcgacggggctggtccagaggcagatttgggcctgccagaagacgatctggtcctgcccgatgacgtggtgcagtatataaaagcccacgcttcaggtgccctcgatgagggtactggacaggtgtatcccacggaaagcactggcttctccgacaacccacgcttgccaagtcctgggctccacgggcagcggagaatggtggcggctgacagcaatgtaggcccatctgctcccatgcttggaggatgtcagctgggattcggtgctccatccagtttgaacaagaacaatatgcctgtccagtggaatgaagtatctagcgggaccgtggacgcactggcctctcaggtgaagcctcccccatttccacaggggaacttagctgttgtgcagcagaaacccgcattcggacagtatccgggatacagcccgcagggcttgcaggcgtcaccaggcggtttagacagtacacagccccatttgcagccacgctccggtgctccctcccagggcatcccacgggtgaactacatgcagcagctccgccagcctgttgctggttcccagtgtccaggcatgacaaccactatgtccccccacgcctgctacggtcaagttcatcctcagctgtcaccaagcacaatctcaggtgctctgaaccagtttcctcagagttgtagtaatatgcccgcaaagcccggacaccttggccaccctcagcagaccgaagtagcccctgatccaacaaccatgggaaataggcacagagaactaggagtgccagacagcgccttagcaggggtgccacctccccatccagttcagtcctaccctcaacagagtcaccatctagccgcttccatgtctcaggagggttaccatcaagtgccatcccttttgccggcacgccagcccggttttatggaaccccaaactggcccaatgggagtcgcaaccgcaggctttgggctcgtacaacctcggccacccctggagcctagccccacagggagacacagaggcgttcgggcagtgcagcagcagctggcgtatgccagagccactggtcatgccatggccgctatgccatccagccaggaaactgcagaggcagttcccaagggcgctatgggcaacatgggctccgtcccgccacaacctccgccacaggacgctggcggagctccagatcacagcatgttgtactattacggccagatccatatgtatgagcaggacggtggcttagagaacctcgggagctgtcaggtgatgaggtcccagcctccacagccacaagcctgccaagatagtatacaacctcagccccttccctcacctggagttaatcaggtgtcctccacagtggattctcagctgctggaggctccccagatagattttgatgctatcatggatgatggcgaccatagttctctcttcagcggagctttgagcccaagcctcttgcacagcctttcccagaatagctctcggctgacaacaccaaggaatagcctgacgctgccctcaattcctgccggaataagtaatatggcagtgggcgacatgtcatcaatgctgacttcacttgcagaggagtccaagtttctcaacatgatgacttag

SEQ ID NO: 224557 - DNA, 249 bp, Artificial Sequence
  Description of Artificial Sequence: Synthetic coding sequence
atggaaacgtcggcatccgctaccgccagcgagaaacaagaagccaaatcgggcatactggaggccgctggattccccgatcctggtaagaaggcctccccgttggttgtggccgcagccgctgccgcagccgtggcagcgcagggcgtgcctcagcacttgttaccgcctttccacgctcctctgccaattgacatgcgacaccaagagggcagatatcactacgaacctcactcggtccatgggtag

SEQ ID NO: 224558 - DNA, 660 bp, Artificial Sequence
  Description of Artificial Sequence: Synthetic coding sequence
atggagacctccgctagcgcaactgcgtccgagaaacaggaggccaaaagtggcattctggaagcagccggatttcccgatcccggtaagaaagcgagccccctggtcgtggcagcagccgctgccgcagccgtggcggcacagggagttcctcagcacctcctcccaccttttcacgcccctcttcccatcgatatgaggcatcaagaaggacgctatcattatgagcctcactcagtgcatggtgtgcatggcgtgccttttcttcagcccgctggggacgcacctcccgaaccacaggccggagcagtgcacctgcctacactgagaaggcaaccaggtcctgcagcggatgatccccaccttacacagctggcctccgggcttcaccagcaattacctaaacagcttggcggtcagcggtttcttcgagcctccgtctcgggctgcccccagccctcactacatcttccaccccctcatcagcccagagggttgcctgctgactctgaacctgccgaaggatccggcgtgtctttgtggacccacaccactccagatcctgctctgacccatctgcccggtcccgctgcacacggcccacatctgcatcagtgccacgcccacccagcacagcagcaacaacaactgagtgagtag

SEQ ID NO: 224559 - DNA, 4761 bp, Artificial Sequence
  Description of Artificial Sequence: Synthetic coding sequence
atggagacttccgcaagtgccaccgcctccgaaaaacaggaggccaaatctggcatcttggaggccgcagggtttccagatcctggaaaaaaggcttccccactggtggtagcggctgccgcagcagcggctgtggccgctcaaggagtgccacagcatttgctccccccatttcacgctcctctccctatagacatgcgccaccaggaggggcgatatcactacgaacctcacagtgtgcacggcgtgcacggcccaccggctctttccggcagcccagtaattagtgatatatcactcattagactttcaccgcacccagcagggccaggggaatctccttttaacgctccccacccgtacgtaaacccacacatggagcattatctgcgctcagtccatagttcgcccactctgtctatgatcagcgctgcacggggtctgtcacctgccgatgttgcacaggagcatttgaaagagcggggtctcttcgggctgcccgcacctgggaccaccccaagtgattattatcaccagatgactcttgtcgcgggtcacccagccccttacggtgacctgttgatgcagtcaggtggagccgctagcgcaccccatctacacgactacctgaacccagtggacgtgagtagattcagctctccccgagttacgcctcgcctgtcgcgcaaaagagcgttgtcaatatccccgctgagcgacgctagcctggatcttcaacgaatgatacgaaccagccccaactccttggtggcttacattaacaattcaaggagctcttccgctgccagtggctcctacggtcacctgagcgctggagcactctcccctgccttcaccttccctcatccaataaaccccgttgcttatcagcagattctgtcccagcagcgcggactcggcagtgcctttggccatactccacccctaatacagcctagccccacattcctagcccagcaaccaatggccctcacttcaatcaacgcgactcctacccagctctcatcctcttccaactgtcttagcgacacaaatcaaaacaaacagagtagcgagtcagccgtgagctctacagttaatccagtcgccatccataagcgctcaaaggtgaaaacagaacctgaagggctaagacccgcaagtcccctggccctcacacagggccaagtgtctggccacgggagctgtgggtgtgcactgccactctctcaggagcaattggcggatctgaaggaggacttagaccgtgatgactgtaagcaggaggcagaagtggtgatctacgagaccaactgccattgggaggactgtaccaaggagtatgacacccaggaacagctggtgcaccatataaataacgagcacatccatggagaaaagaaagaattcgtgtgccgctggcaggcctgcactcgcgagcagaaaccttttaaagcacagtatatgttggtggtgcacatgcggcgtcacacaggcgaaaaacctcataagtgcacttttgagggatgttccaaggcttatagccgcctcgagaacctcaagactcatctccggtcccacaccggcgagaagccgtatgtgtgcgagcacgaaggctgcaataaggctttttccaacgcatcggatcgggctaagcatcaaaacagaacccattctaatgaaaagccatacatatgcaaaatacccggttgcacgaagcgctatacagacccatcttccctgcgtaaacacgttaaaacagtacacggcccagacgctcacgtgactaaaaaacagaggaacgatgtacacctgaggaccccgctgctgaaggagaatggtgactctgaagctggtaccgaaccagggggaccagaaagcactgaagctagcagcacaagccaggcagtcgaagactgtctccatgttcgggctatcaaaacagagagctcaggactgtgtcagagcagcccgggtgcccaatcatcttgcagcagtgagccctctccactgggcagcgcaccgaataatgacagcggagtggagatgcctggtacaggccctggcagcttgggcgatttgaccgccttggacgacacaccacccggtgctgacacatctgccttggcagctccaagtgctggtggactccagctgagaaaacatatgacaaccatgcacaggttcgaacagcttaaaaaagagaagttaaagtctctaaaagattcctgttcttgggccggaccaaccccacacactagaaacacaaagctgccgccactcccagggagtggaagcatcttagaaaattttagcggttccggaggcggaggacctgcgggactccttcctaatccaagactatccgagttgagtgcctctgaggtgacaatgttgtcgcagttacaagagcgcagggacagcagtacttccaccgtctcctctgcctacactgttagtcggagatcctctggaattagtccatacttttcatctcggagatcctcggaggcttcccccctgggagcagggaggccccataatgccagctctgcggactcttacgatccgattagtacagacgccagtaggcgttcgtctgaggcgagccagtgcagtggtggaagcgggctgctgaacctgactcctgcccagcaatattctctccgcgcaaaatacgctgcggcaacgggcggtcctccaccaactcccttacccggactggagaggatgtctcttaggaccaggctggccctgctggatgccccagagaggaccctgccagctgggtgtcctaggccccttggccctcgacggggttccgacggcccaacctacgggcacgggcatgctggcgcagctcccgcttttccccatgaggcccctggaggcggtgccaggagggcctccgaccccgtccgtaggcctgatgctttatccctgccccgagtgcaacgctttcactctacgcacaatgttaatcccggtccactgcctccctgtgccgatagacgcggactgcggcttcagtcacatccgtcaactgatggagggcttgcgcgtggtgcttactcaccccgaccccctagcatctcagagaacgtggctatggaggccgttgctgctggcgtcgacggcgcaggaccagaggcagacttgggtctccccgaggacgacttggttcttcctgacgatgtggtgcagtacataaaggcgcatgcgagtggcgcactcgatgaaggaacagggcaggtgtaccctacggaaagcactggattcagcgataaccccagactgccttctccaggcctccacggacagagacggatggtagctgctgactctaatgtaggcccaagcgcccctatgctggggggatgtcagctcggattcggagcgcctagctcactcaataagaataacatgcccgtccagtggaacgaggtctcttcaggtaccgtggatgccttagcctctcaggtcaagcctccgccttttcctcagggcaacctggcagttgtgcagcagaagcccgctttcggacagtaccctggctactccccacaggggctgcaggcctctccaggcggtttggattccacacagccccacctacaaccaaggtcaggggcaccttctcagggcattcccagggtcaactacatgcagcagctgagacagccagtggcgggttcacagtgccctggcatgactaccactatgtccccacacgcctgctacggccaagtgcacccccagttgagtccatccacaatttccggggctctgaaccaatttccccagagttgctccaatatgccagcgaagcccggacatcttggccacccacagcagacggaggtggctccagatcccactaccatgggaaaccggcaccgggaactgggtgttccagactccgctctcgctggggtgccgcctcctcaccctgtacaatcatacccccagcagtcacatcacctagctgctagcatgagccaggagggatatcaccaggtacctagcctcttgccggcacgtcaaccagggtttatggagccacagaccggaccaatgggcgtcgcaactgccggatttgggctggtccagccaagaccgccactggaaccatccccaaccggacgacacaggggagtccgtgccgtgcagcaacaattagcttacgctcgggcaacaggccatgccatggctgcaatgcccagctctcaagagacggctgaggcggtgcctaaaggggcaatgggaaatatggggagcgtgccgcctcagccacctcctcaagacgctggtggggctccagatcacagtatgctgtattactacgggcagatccacatgtacgaacaggatggaggtctcgaaaatttaggatcgtgccaggttatgaggtcacagccacctcaaccccaggcttgtcaggacagcatccaacctcagcccctgcctagcccaggtgtgaaccaagtgagttctactgtggactctcaactgctggaggctccccaaatcgatttcgatgcgattatggacgatggcgaccactccagcctgttttctggagcgctcagcccctctttgctgcattctctgtctcaaaacagctctaggctcacaaccccccgaaactcgcttacattgcctagtataccggctggcatcagcaacatggccgtgggggatatgtccagtatgctgacttcactggcagaagagtctaagttcctgaatatgatgacctag

SEQ ID NO: 224560 - DNA, 4742 bp, Artificial Sequence
  Description of Artificial Sequence: Synthetic coding sequence
atggaggctcagtcgcatagctcaaccacaactgaaaagaagaaggtggagaactctattgtgaaatgctctactcggactgacgtctccgaaaaagcagtcgcatcatccactacaagtaacgaggacgagtccccaggtcagacttatcaccgcgaaagacggaacgctatcaccatgcagccacagaatgtgcagggactgtccaaagtgtctgaggaaccgtccacatcctctgacgagagagcttctctgatcaagaaggagattcatggaagcctgccccacgttgcggagccctcagtgccttaccgtggcacggtattcgccatggatcctagaaacgggtatatggagccacattaccatcccccacatctattccccgcattccatccacctgtgccgattgacgctagacatcatgaggggagataccattacgatccaagtccgatcccaccgttgcatatgacctctgcactgtccagctctccaacctaccctgatttaccttttattaggatttctccacataggaatccaacggccgcatccgagtcgccttttagccctccccacccctatattaacccctacatggactatatcaggtcattgcatagcagtccgtccttaagtatgatcagcgctaccagagggttgtctcccacggacgctccgcatgccggtgttagtcccgcagagtactaccaccagatggcgctgttaacaggccagcggtcaccatacgctgatatcataccatctgcagccaccgctgggaccggtgctatccatatggaatatctgcatgccatggattctacccggttctcttcacctcggctatcagcacggccttccagaaagcgaacacttagtatctctcctttgagcgaccactcttttgaccttcaaaccatgatacggacctcccctaacagtctggtgacaatcctcaacaactcccgatcatctagctctgctagcggttcctacggtcatctctcagctagcgctatctcccctgctctcagctttacatattccagcgcacctgtgagtctccacatgcatcagcagatactatcccgccagcagagcctagggagcgccttcgggcactctccccctctgatccatcccgctcctaccttcccaacccaaagaccaattccaggtatacccactgtgctcaatcccgtgcaggtgtccagcggtccctcggagagttctcagaacaaaccaacttccgaatcagcagtgtcatcaactggagatccaatgcacaataagcggtcaaagatcaaacccgacgaggacctgccctcccccggtgcccgtggccagcaggagcagcccgaaggcactacccttgtgaaagaggagggggacaaggacgagagcaagcaggaacccgaagtaatttacgagactaattgtcactgggagggttgtgcccgagaatttgatacacaggaacaactggtgcaccacatcaataatgaccacattcacggggagaaaaaggagttcgtctgccggtggttggactgtagcagagagcaaaagcctttcaaggcacagtacatgctggttgtccacatgcgccgtcacacgggcgagaagccgcataagtgcaccttcgaagggtgtacgaaggcatactccagacttgaaaatctgaaaacccacctcagaagtcacaccggcgagaagccatacgtgtgcgagcatgagggatgcaacaaagcattctccaacgcctctgatcgcgctaaacatcagaaccggactcattccaacgagaaaccatacgtttgcaaaatcccaggatgcaccaagagatatactgatcccagtagcctcaggaagcacgttaaaaccgtccacggccctgaggcacacgtgacgaagaaacagcgcggagatattcatccacggccaccccctcctagagactctggatcacatagtcagagccgttcgcctggcagacctacccagggggctctaggcgaacagcaggatctgtcaaataccacctctaagcgagaggaatgcttgcaggtgaagaccgtaaaagctgagaagccaatgacttctcaaccgtcacctggaggccagtccagttgttcgagtcaacaatccccaattagcaactactcaaacagcggcctggaactcccgttgaccgatggcggatccattggcgacctctccgcaatcgatgaaacaccaattatggattctaccatctcaaccgctacgaccgcactggctctccaggcaaggcgaaatcccgctgggacaaagtggatggaacacgtgaaacttgaacgactgaaacaggttaacgggatgttcccaagattgaaccccatattgcccccaaaggcaccagcagtgtccccgctgattggcaacggcacgcagagtaacaatacatgctcactgggcggaccgatgaccctcctacctgggaggtctgacctgtccggcgtcgatgtgacaatgctgaacatgctgaatcggcgtgacagtagtgcgagcactatttcaagcgcctacctgtcatcacggagaagtagtggaatcagcccatgttttagtagtagaaggtccagcgaggcatctcaggctgaagggcgaccacagaacgttagcgtggctgattcatatgatcccatctccactgatgcctctagacgcagctcggaggcctctcagagtgacggactcccctccctactgagcttaactccagcccagcagtacagactgaaagctaaatacgccgcagccacagggggtccgccaccaacccctctgcctaacatggaacggatgtccctgaagactagattggctttgttgggggatgcgctggagccaggcgtggcgctcccaccagtccacgcccctcgcagatgctcagacggcggtgcccatggttatggcaggcgccatttgcaaccacatgatgcccctggccacggcgtccggagggcctccgatcccgtacgcacggggtctgaagggctagccttgccacgcgtgcctagattcagttcattatctagttgcaacccacctgcaatggccacctcggctgagaagcggagtctggtcttgcagaattatactaggccagagggtggacagtctagaaatttccattccagtccatgtccgccaagtatcacagagaacgtaacccttgaatctcttactatggatgccgacgcaaacctgaatgacgaagattttttgcccgatgacgtggtgcagtacctaaatagtcagaaccaagccggatacgagcagcactttccaagtgctctgcctgatgattcaaaagtgccccatgggccaggtgactttgacgctccagggctgcctgatagccacgctggccaacagttccacgcacttgaacagccttgtcctgaagggagtaaaacggacctaccgatccagtggaatgaggtgagctcaggatctgccgatttgtccagctccaagctgaagtgtggcccacgaccagccgtccctcagacacgcgcttttggcttctgtaatggcatggtggtgcacccgcagaacccgctccgcagtggccctgctggcggataccagactctgggggagaattctaatccctacgggggaccagagcatctcatgcttcataactcacctggaagcggcaccagtggaaacgcattccatgagcaaccctgcaaggctccgcagtatggcaactgtcttaaccggcagccggttgccccaggagcactggacggcgcttgcggcgcaggcattcaggcttccaagctgaagtccacccctatgcagggtagcggtggtcagctgaatttcgggctacctgtcgctcccaacgaatccgccggaagtatggtgaacgggatgcaaaaccaggaccccgtaggtcaggggtacctggcacatcagttgctgggagattccatgcagcatcccggagctgggagaccaggacagcaaatgctgggccagatcagtgccacctcacacatcaacatctaccaaggacctgaaagctgcctgccaggtgcacatggaatgggaagccagccttctagtctcgcggtggtgcgcggatatcagccgtgtgcctcattcggcggatccaggagacaggctatgccaagagactcattggccctgcagagcgggcagctgtccgatacctctcaaacgtgtagagtcaatggcatcaagatggagatgaagggacagccacatccgctgtgcagcaatctccagaactactcaggacagttctacgaccagaccgtcgggttttcgcagcaggacactaaagccggaagtttctcaattagcgatgcctcctgcctgcttcagggcaccagtgccaaaaatagtgagctgctttctccaggagccaatcaggtaactagcactgtggattctctcgattcacacgatttggaaggggtccagatcgatttcgatgccattatcgacgatggagatcattcctccctcatgagtggcgcactcagcccttccattattcagaatctctcacactcaagttcccgattaacaacgcccagggcctctctgcctttccccgcactgtcaatgtcaaccactaacatggcaattggagacatgagtagcctactcactagtctcgcagaagaatccaaatttctggcagtcatgcagta

SEQ ID NO: 224561 - DNA, 543 bp, Artificial Sequence
  Description of Artificial Sequence: Synthetic coding sequence
atggaagctcaatctcactcatctaccacaacagagaaaaagaaggtggagaattccatcgtcaaatgcagtacaagaacagatgtaagtgagaaggccgtcgcatcttctaccacgtctaacgaggacgagtcccccggtcagacttaccacagggagagacgaaacgctattacgatgcaaccccaaaatgtccagggtctgtccaaggtgtcggaagagccatctacatcatcagacgaacgtgcgtctcttatcaagaaagagattcatggcagtttgcctcatgttgcggaaccttcggtcccatacaggggcacagtattcgcgatggacccaaggaacggctacatggagccccattatcatccacctcacctgttccctgctttccatccccctgtgcccatcgatgctagacatcatgagggtaggtaccattacgacccttcaccaattcctccactacacatgacgagtgcattaagctctagtccaacatatccagacctccccttcattcggattagtcctcataggtag

SEQ ID NO: 224562 - DNA, 1131 bp, Artificial Sequence
  Description of Artificial Sequence: Synthetic coding sequence
atggcggctttgggtgacattcaggagtcaccaagcgtgccttcccctgtgtcactgtcaagcccgggtactccagggacccagcatcacgaacctcagctccacctccacggccaccagcacggctcccccggtagctcaccaaaggttctttctcagccaagtgacttagacctccaagatgttgaggaggtggagattggcagagatacgttctggccagactccgaacccaagccagaacaggcccctcgcagtcccggaagccaggctcctgatgaaggtgcaggaggggctctgagaagtctcctaagaagccttccgcgaagagctagatgttcagcaggctttggacccgagtcttctgccgaaagaccggctggacagccacctggagccgttccttgtgctcaaccgaggggcgcttggcgggtcactcttgtacagcaggctgccgctggtccggaaggagctccagagagggccgctgaacttggggtcaatttcgggaggtcaagacagggatcggccagaggagcaaagccccaccgctgcgaggcctgcgggaagtcgtttaagtacaacagtttactgctcaaacaccagcgaatccacactggcgagaagccgtacgcttgtcacgaatgcggcaagagatttcgcggttggtctggtttcatccagcaccataggatccacactggcgaaaagccctatgagtgcggccagtgtggccgtgcattctcgcatagctcccatttcacccagcacctgcgcatccacaatggggagaaaccttataagtgtggggagtgtgggcaagccttctctcagtcttccaacctcgttaggcaccagagactgcataccggcgaaaagccctacgcgtgctcacagtgcggcaaggcctttatttggtctagtgtcctaattgagcatcagaggattcataccggcgagaagccctacgagtgctccgattgcggaaaggccttccggggtagaagccacttctttcgacacttacggacccacaccggtgaaaaaccttttgcatgcggagcttgtggcaaggcattcggccagtcgagccagctgatacagcaccagcgggtgcactatagggagtag

SEQ ID NO: 224563 - DNA, 1131 bp, Artificial Sequence
  Description of Artificial Sequence: Synthetic coding sequence
atggccgcacttggggatatccaagagtcaccaagcgtaccttcacccgtttccctgagttccccaggcacacctggaacacagcaccatgagccacaacttcatctgcacggccatcaacatgggtctcctgggagttcaccaaaggtcctgagccagcctagcgacttggacctgcaggatgttgaagaggtggagatcggcagggatacattctggcctgactccgagcctaagcctgagcaggccccacggagtccgggaagccaggctcctgacgaaggagctggcggtgcactgagatcgttgctcagatctctgcctcgcagggcccgatgtagcgctggcttcggcccagaatctagtgcagaacgacctgctgggcagcctcccggtgctgtgccctgcgcccagcctaggggtgcatggcgggtcaccttggttcagcaggccgcagctgggccagaaggggcacctgaacgggcagctgaactgggcgttaatttcgggaggtctcggcagggctcggctagaggcgctaagccacacaggtgcgaagcttgcggtaagtctttcaagtataacagtctgctcctcaagcaccaaagaattcacactggagagaagccttatgcttgtcatgagtgtggaaaaaggtttagaggatggagtggattcatacaacaccaccgaatccacacaggagagaaaccatacgagtgcggccagtgcggacgcgctttttctcatagttctcactttacccaacacctgaggatccacaatggggagaaaccctataaatgcggcgagtgcgggcaagcgttcagtcagagtagtaatttggtgcgccaccagcgactgcatacgggtgaaaagccttacgcatgctcacaatgcggcaaggccttcatttggtcctccgtgcttatcgagcatcagcggattcatacaggggaaaagccctatgagtgctccgattgcggaaaagctttccggggaagaagccacttcttccgacacttgcggacacatacgggagagaaaccatttgcatgcggcgcttgcggcaaggcatttggtcagtcctcacaactcatacagcatcagcgggtccattaccgcgagtag

SEQ ID NO: 224564 - DNA, 801 bp, Artificial Sequence
  Description of Artificial Sequence: Synthetic coding sequence
atgcgagtgactttagctactatcgcctggatggtgtccttcgtgtcaaattattcccacactgccaatattttaccagacatcgaaaatgaggactttatcaaagactgcgtccgaatccacaataaattcagatctgaggtcaagcccacagcctcagacatgctgtatatgacatgggatcccgcactagctcagatcgctaaggcctgggctagcaactgtcaattctcacataacacccgcttaaaacctccccacaaactgcaccctaacttcacaagtttgggagaaaacatctggacgggctccgtgcctatcttcagcgtgtcttctgccattacaaattggtacgacgaaatccaggactacgattttaagacccgaatttgcaaaaaggtgtgtgggcactatacacaggtggtatgggctgactcttacaaagtcggttgtgccgtccagttctgccccaaggtttctgggttcgacgcattgagcaatggtgcccatttcatatgcaactacggaccaggcggtaactacccaacgtggccctacaaacgaggagctacctgttccgcctgccccaacaatgataaatgcctagacaatctgtgtgtgaataggcagagggaccaagttaaaaggtactactcagtggtgtatccgggttggcctatttatccaaggaatagatacacctcactctttttgatcgttaactcggttattctgatactgtccgtcatcatcacaattctcgtgcaacacaaataccccaacttggtattgctggactag

SEQ ID NO: 224565 - DNA, 429 bp, Artificial Sequence
  Description of Artificial Sequence: Synthetic coding sequence
atgtcagacagcctcgtggtgtgcgaagtcgaccccgagctcacagagaaactaaggaagttccgtttccggaaagagaccgataatgccgcaattatcatgaaagtggacaaagaccgtcagatggtggtgttagaagaagagttccagaacatttctccggaagagcttaagatggagttgcccgaaagacagcccagattcgtggtttactcttacaaatacgtccatgacgacggaagagtgtcatatcctctctgttttatcttcagctcacctgttgggtgcaaaccagaacagcagatgatgtacgcaggatcaaagaaccgcttggtgcagaccgctgaacttacaaaggttttcgagattagaaccacggatgacctgaccgaggcttggctgcaggaaaagctgtcgtttttcagatag

SEQ ID NO: 224566 - DNA, 429 bp, Artificial Sequence
  Description of Artificial Sequence: Synthetic coding sequence
atgtcagacagcctggtcgtgtgtgaggtggaccccgagttgaccgagaaactgcggaaatttcggtttcgaaaagagaccgataatgctgccatcattatgaaggtcgacaaagaccggcaaatggtagtccttgaagaagagtttcagaatatttccccagaggagctaaagatggaactgcctgagcgccagccgagattcgtggtctatagttacaagtatgtgcatgatgacgggagggtatcatatcctctgtgtttcattttctcatctcccgtgggatgcaagcccgagcagcagatgatgtatgctggctccaaaaatcgcctggtgcaaacggcagaactgactaaggtgtttgaaatcaggacaactgatgatctgacagaggcttggctgcaggagaagctgtccttctttcgttag

SEQ ID NO: 224567 - DNA, 1299 bp, Artificial Sequence
  Description of Artificial Sequence: Synthetic coding sequence
atggaacggaggcggatcacatccgcagcgagaaggtcttacgtgtcctcgggggaaatgatggtaggaggattggctcctggaagacgcttgggccctggaaccaggctgagcctggcacggatgcctccgccattaccgactcgggttgatttttcactggcgggagctttgaacgccggtttcaaagaaaccagggctagtgagcgggcagaaatgatggaacttaacgacagatttgcgagttatatcgaaaaagtccgcttcctggagcagcagaataaggccctggctgctgagctgaaccagcttagggccaaggagccaacgaaactcgccgatgtgtatcaggcagagttacgcgaactgcgactccggttggatcaactgacggcgaatagcgcaaggctcgaggttgagagggacaatctcgctcaggacctcgcaaccgtgagacagaaactccaggacgagacaaacctgcgtctggaagctgaaaacaatctggccgcttacagacaggaagctgacgaagccacactggctcgcctggaccttgagaggaaaatagaatctctggaggaagagattcggttcctgagaaagatacacgaggaggaagtccgggaactccaggaacagcttgcacgccagcaggtccacgtcgagttggatgtggccaagcctgacctgacggccgctctgaaggaaatcagaactcagtacgaagccatggcttctagcaatatgcatgaggccgaggaatggtacagaagtaagtttgccgatctgacagacgccgcagccaggaatgccgaattgctgaggcaggccaagcatgaggccaatgattataggcgacagctccagtcactgacgtgcgatctggagagcctgcgcggaaccaatgagtctctcgagcgccaaatgcgcgaacaggaagagcgccacgtccgtgaagctgccagctatcaagaggccttggcacgtctggaagaggaaggacaatcactcaaagatgaaatggctcgccacctgcaggagtatcaggatttacttaatgttaaattggccttggatatcgaaatagccacgtatcggaagttgctcgaaggcgaggagaacaggatcactatacccgtgcaaacttttagcaatctacagattcgcgagacttctcttgacaccaagtccgtgtctgagggacaccttaaacggaacatcgtcgtgaagactgtcgagatgagagacggcgaagtcataaaggagtccaagcaggagcacaaagacgtgatgtag

SEQ ID NO: 224568 - DNA, 540 bp, Artificial Sequence
  Description of Artificial Sequence: Synthetic coding sequence
atggaacgcagaagaattactagcgccgctagaaggtcttacgtgtccagtggcgagatgatggtggggggtctcgcccctggtagacgattgggccctggtactagactgtcacttgccagaatgccaccccctctgcccacgcgcgtcgacttctccttggccggagcgctgaatgccggattcaaagaaacgagagcatctgagcgggctgaaatgatggaactgaatgataggtttgccagttacattgaaaaggtgcggttcttggagcagcaaaataaagccctcgctgctgagctcaaccagttgcgggcaaaagagcccactaaactggctgacgtgtatcaggcagaactgagagaactgcggttaagactcgatcagctgactgccaactccgctcggcttgaggtggagcgcgacaacctggcgcaggacctcgccacggtcaggcaaaaaaagcagatgaagcctccatggcctgtgtggatatggagaggtagactgagcaggtggcgtcggagaagtggcagctag

SEQ ID NO: 224569 - DNA, 1224 bp, Artificial Sequence
  Description of Artificial Sequence: Synthetic coding sequence
atggaacgccgtagaataacctccgcgacccgcctgtcactggctcggatgccacctcctttgcctacaagggtggacttttctttggcgggtgctctaaacgccggattcaaagagaccagggcgagcgagcgtgctgaaatgatggaattgaacgaccgtttcgcttcctacatcgagaaagtgcgattcctggaacaacagaacaaagcgctggccgctgagcttaaccagttgcgggctaaggagcccacaaaactcgccgatgtgtatcaggctgagctgagagagttgaggttaaggttggaccagctgacagccaattccgctaggcttgaagtggagagggataacttggcccaagatttagccaccgtccggcagaaattacaagacgaaaccaaccttcgtctggaggctgagaataacttagcagcctatcgtcaggaggctgacgaggcaacgctggctaggctggacttggaaaggaaaatcgagagtctcgaggaggaaatcagatttctgagaaagatccatgaggaggaggtgagagaactccaggaacagcttgccagacagcaggtacacgtcgaactggatgtggcaaagcccgatttgaccgcagcactgaaggagatcagaacgcagtacgaagcaatggcctcaagtaatatgcacgaggccgaggagtggtaccgcagcaagtttgccgatcttaccgacgccgctgctcggaacgccgagctcctgcgccaggcaaagcacgaggcgaacgactataggagacagctgcagtctctgacatgcgatcttgaatcccttagggggacgaacgagtccctggagaggcaaatgcgcgagcaggaggagaggcatgtgcgggaggcagccagttaccaagaggctttggccagactcgaggaggaaggacagtccctgaaggatgagatggcacgacaccttcaggaatatcaagatcttttgaacgttaagctggccctggacatagaaatcgcaacgtataggaagcttctggaaggtgaggagaaccgcatcactatcccagttcagaccttctcaaatctgcagatccgggagacttcactggacaccaaatcagtgagtgagggtcatttgaaaaggaacattgtggtaaagacggtggagatgcgggacggagaggttatcaaagagtcaaaacaggagcataaagacgttatgtag

SEQ ID NO: 224570 - DNA, 1296 bp, Artificial Sequence
  Description of Artificial Sequence: Synthetic coding sequence
atggaacggagacgcatcaccagtgccgctagacggtcttatgtgtcctctggggagatgatggtcggaggcctcgcaccaggccgtagactgggcccaggcacaagattgtccctcgcacgcatgccccctcctctccccactcgggtggatttttccctagccggagcactaaacgcagggtttaaggagaccagagcctcagaacgcgcagaaatgatggagctgaatgacagattcgcaagctatattgagaaggtgcgtttcttggagcaacagaataaggctttagctgctgagttgaaccaactgcgcgctaaggaaccgacaaagctcgccgatgtttatcaagccgagctcagagaattgcggctccgacttgatcaactgaccgcaaattctgccaggttggaggtagagcgggataaccttgctcaggatctggcaactgtgcgtcaaaaactccaggacgagaccaacctgaggttggaggccgagaacaatctggctgcctatagacaggaagccgacgaagccactctagcccgacttgacttagagaggaagatcgaatccctggaggaggaaatacgattcctacgcaaaattcacgaggaggaggtgcgggaactccaggaacagcttgccagacagcaggtgcatgttgagctcgacgtggctaagcccgatctgaccgccgcactaaaagaaatccgcactcagtatgaagctatggctagcagcaatatgcacgaggccgaagagtggtaccgctccaagttcgccgatctgactgatgccgcagcgaggaacgctgaactgctgagacaggcgaagcacgaagcaaacgattatagaaggcagctgcagtcgctaacatgtgacttggagagcctccgaggcaccaatgaatcgctggaaaggcaaatgcgggaacaggaggaacggcatgttcgagaggccgcttcctaccaggaggcgctggccagactggaggaagagggtcagtccctaaaggacgagatggcccgacatctgcaggagtaccaggatctgctgaacgtcaaattagccttggacatagaaattgccacttatcgcaagttactggaaggggaggagaatcggatcactatcccggtacagactttctcaaacctgcagatccgagggggtaagtctaccaaagatggagaaaaccacaaagtgacgcggtacctcaagtcactgaccatcagagtcattccaattcaagcacaccaaattgtgaatggaacacctcccgcacgcggatag

SEQ ID NO: 224571 - DNA, 1317 bp, Artificial Sequence
  Description of Artificial Sequence: Synthetic coding sequence
atggagcgcagacgcataacaagtgcggctaggagatcttacgtgtcatctggagaaatgatggttggtggcctggctccaggaaggagactagggcctggaactaggttatcactcgcaaggatgccgcctcccctccctactcgagtggacttttccctggcaggagcattgaatgccggattcaaggaaaccagagcatcagaacgggcagagatgatggaattgaacgataggtttgccagctacatcgaaaaagttagatttcttgagcagcagaataaggccctcgctgctgagctgaaccaactgagagcaaaggagcctactaaactggcggacgtgtatcaggcggagctgagagaactgcgcctacggttggaccagttaacagctaattctgcgcgtctcgaggtcgagagggataatctcgcacaggatttagctacagtgcgacagaagctccaggacgagactaatctccgcctggaggccgaaaacaatttagctgcatacagacaggaagctgacgaagccacattagcccgtcttgaccttgagcggaagatagagtctctcgaagaagagattaggtttctgaggaaaattcacgaagaagaggttcgggagcttcaggagcagctggccaggcagcaggtccacgttgaactggacgtggccaagccagatctcacagccgcactaaaggaaatccgcacacagtatgaggctatggcctcctccaacatgcacgaagcagaagaatggtacagatctaagtttgccgacctgactgatgctgccgctcgcaacgctgagctactgagacaggcaaagcatgaggccaatgattaccggcgacagctccaatcgttaacctgtgatctggaatcccttagaggcacaaatgaatccttggagcgccagatgcgcgaacaggaggagcgtcacgtaagagaggctgccagctaccaggaagcgttggcccgtctggaagaagaagggcaatccctgaaagacgagatggccagacacctgcaagaatatcaggacctgctgaacgttaaactggcactggatatcgagatcgctacttataggaagttactggagggcgaagaaaatagaattacaattcctgtgcagactttctcaaatcttcagatcagggggcaatactcaagagcatcctgggaaggccattggagtccagccccatccagccgagcttgcaggttgctccaaaccggtactgaagaccagggcaagggaattcagctcagcctaggtgcgtttgtgaccctgcagcggagctag

SEQ ID NO: 224572 - DNA, 861 bp, Artificial Sequence
  Description of Artificial Sequence: Synthetic coding sequence
atggctgctagggtgctgagggcgcgtggcgctgcgtgggctgggggactcctgcagagggcagcaccttgctcgctgctccccagattgaggacatggacaagcagtagcaacagatcaagggaagacagctggcttaaatctttgtttgttcgcaaagtcgaccccagaaaagacgctcattcaaatcttctggctaaaaaggaaacctctaacctttacaagttgcaattccataacgtgaagcccgaatgtttagaagcatacaataagatctgccaggaggtcctgcccaagatccacgaggataaacactatccctgtacactcgttgggacttggaatacctggtatggtgagcaggaccaagccgtgcacctgtggcgatacgaagggggttaccctgcgctcactgaggtgatgaacaagctgagagagaacaaggaattcctcgaattcaggaaggcccgttccgacatgctgctctcccgcaagaaccagctccttctagagttcagcttttggaacgagcctgtgcctcgttctggccctaatatctacgagctgagaagttatcagcttagaccagggaccatgattgagtggggcaattattgggcgagggcaataaggttccggcaggacggaaacgaggccgtcggagggttcttctcacagataggccaactatatatggtccaccacttatgggcctatagagacttacaaacaagagaagacatccgaaatgctgcatggcataaacacggatgggaggaattagtgtactacacggtcccattgatccaagagatggaaagtagaataatgattcccctgaagacctccccactccagtag

SEQ ID NO: 224573 - DNA, 744 bp, Artificial Sequence
  Description of Artificial Sequence: Synthetic coding sequence
atggccgctagggtcttgagagctagaggagcagcatgggctggcggtttgctgcaaagagcagccccttgtagccttctccccagactccgaacctggacctcaagctctaatcgcagcagagaggacagctggttgaagtctctgttcgtgcgcaaagtggaccctcgaaaggatgcccacagcaacttactcgcaaagaaggagacttcaaacttgtacaagctccagttcaagcgttgttgtcagcgatttaccaagataaacaccactctcgtgctatggtggggtctgggcacccgcggaatggcaagcaggacaaaactggaattccttgagttccgaaaggcacggagcgatatgctgctctcccggaagaaccagcttctcctggaattctccttttggaacgagcccgtcccaagatcaggaccaaatatatatgaactgagaagctatcagttgagacccggtactatgatcgagtggggcaactactgggctagggccatcaggttccgtcaggatgggaatgaggccgttggcggatttttctcacagatcgggcaactttatatggtccatcatttatgggcctatcgagacttgcaaaccagggaggatattcggaatgcggcttggcataaacacggttgggaagagttggtatactacacagtgcccctcattcaagagatggagtccagaataatgatacctctcaagacttccccactgcagtag

SEQ ID NO: 224574 - DNA, 4683 bp, Artificial Sequence
  Description of Artificial Sequence: Synthetic coding sequence
atggatgatgaggatggcagatgtttgctcgacgtgatctgcgatccacaggcgctgaacgactttcttcacggttccgagaagctggattctgatgatctactcgacaacccaggggaggcacagtctgctttttacgagggacctggcttgcacgtccaagaggcatccgggaatcacctcaatcccgagcccaaccagcctgccccttcagtggatcttgatttcctggaggacgacattcttggttctcccgctaccggcggaggcggagggggttcaggtggagccgaccagccctgcgatatcctgcagcaaagtcttcaagaggccaatataactgagcagactttggaagctgaggcagagctggacctgggacctttccagcttcccacactccagcccgctgacggcggagcaggtccaactggggctggcggagctgctgcggtggcagctgggcctcaggccctgtttcctgggtcaacggatctcctgggtctccaagggccaccaaccgtactcactcaccaggccctcgttccaccccaggacgtagtcaataaggccttgtcagtccagccctttcttcagccagttgggctggggaacgtaaccctgcaaccaatcccaggactacaagggctaccaaatggatcgccagggggagcaacagctgccacattagggctcgcacctattcaagtggtgggtcaacccgttatggctttaaacacccccacatctcaactactcgcaaagcaagtgcctgtgagtgggtatctggcctccgctgccggacccagcgagcctgtgactcttgcatcggccggagtgtcccctcagggggctgggctggttatccagaagaatctctccgctgccgtggccacgaccctcaatggtaactcagtgttcggaggagctggggctgccagcgcacccacaggaactccctccggacagcctctcgccgtagctcctggattagggagctcccctctcgtaccggcacccaatgttattcttcaccggacccctacccctatccagcctaagcccgctggcgttctacctcctaagctgtaccagttgaccccaaaaccattcgcgccagctggcgctactctgaccatacagggcgaaccgggtgcgttaccccagcaacctaaggcaccacagaatcttacatttatggccgctgggaaggcgggacagaatgtagtgctgagcggcttccctgcaccggcactgcaagccaacgtcttcaaacagccccctgctacaaccacgggcgctgccccacctcaaccaccaggagccctgtccaagcctatgagtgtgcatcttctaaatcagggtagcagtattgtgattcctgcacagcatatgttacccggacagaaccagtttctgttgcctggtgcccctgcggtgcaacttccgcagcagctaagcgctcttcctgcgaacgtaggcggacaaattctggccgctgccgctccccacacggggggtcagctgattgcaaatcctatcttgaccaatcagaacctcgccggaccgctctctctgggtcccgtgttggctccacactccggtgcacatagcgcccacatcctgtcggccgctcccattcaagtaggacagccagcactgttccagatgccggtaagccttgccgctggaagcctgcccacacagtctcaacccgcacccgctggccctgccgctactaccgtactgcagggcgtgaccctcccaccatctgcggtagccatgctcaataccccagacggcctggtgcagcccgctacccccgctgctgccaccggagaagccgcaccagtactcaccgttcagcccgctccacaggccccaccagcagtgagcacaccattaccactagggctccagcagccccaggcccaacagccccctcaggctcccacccctcaggctgccgctcctccccaggcaaccacaccccagcctagtcccggtctggcgtcttcgcccgagaaaatcgtgctggggcagcctccttctgcaactcccacagcaatcctgacacaggactctttacaaatgttcctgccacaggaacgctctcagcagccactatctgcggagggaccacatcttagcgtcccagccagcgtcatcgtatccgccccacccccagctcaggaccccgctccagcaaccccagtggctaaaggggctgggctgggtccccaggctccagacagccaagcttctccagcccctgcgcctcagattccagccgctgccccactgaagggccctggtccctcaagcagcccaagtctcccccatcaggcacccctaggggactcccctcacctgccttctccacaccccacacgcccaccaagtaggcctccctcgaggccacagagcgttagccggcctccaagcgaacctcccttgcatccatgcccgccaccacaggctccccctacactgcccggaatcttcgtgatccagaatcagctcggggtgcctcctccagcgagtaatcccgcacccacagctccagggcctccccagccgccattgcgcccacagagccaaccccctgaaggacccttaccccctgcaccccacctacccccatccagcacaagctcagcagtagctagctcttcggaaacgtcaagccgcctgcctgccccaacacctagcgatttccagctgcagttcccgccatcccaaggccctcacaaatctcccactccaccacccacattacacctggtccccgagccagctgcccctccccctcccccacctcggacctttcagatggttacaacaccgttcccagccctgccacagcctaaggcactgctcgaacgattccaccaggtaccttccggcattatacttcagaataaagccggtggcgctcccgctgctcctcagaccagcacttccttaggaccccttaccagccccgctgcatctgttctcgtttcaggacaggccccatcagggacacccactgcgccaagtcatgcgccagcacctgcaccaatggcggctaccggtctgcctcctctgctgccagccgagaataaggcttttgctagcaatctgcccactctcaatgtggccaaggcagctagcagtggaccaggcaagcctagtggcctgcaatacgaaagcaagttgagcggcctcaaaaagcctcccactctgcagccatctaaggaggcgtgctttttggaacatttacataaacatcaaggcagtgtgcttcatcccgactacaaaacagccttcccatcattcgaagatgccctacaccgactgctgccctaccatgtctatcaaggcgctttgccctcccctagcgattatcataaagtggacgaggaatttgagactgtgagtacccagttgctcaaacggactcaggctatgttaaacaaatataggctcctgctcctcgaggaaagccgaagagtgagcccttccgcagaaatggttatgattgatcgcatgttcattcaggaggaaaagaccacactcgccctggataaacagctcgccaaggagaaaccagatgagtatgtgagttcatctcgtagtctgggtttacccatcgcggcttcatccgagggccataggctgcctgggcacggccctctctcctcatccgcacctggcgcttcaacccagcctccgcctcacttaccgacgaagctggtaatcagacatggtggagcaggaggcagcccttctgtgacgtgggcacgcgctagcagttcgctctcgtcgagtagcagctcatcctcagctgcctccagccttgatgctgatgaggacgggccaatgccgagccggaaccggcctcctatcaaaacatatgaagctcgatctcgaattgggctaaagctcaaaatcaagcaagaagccggactttctaaagtggtacataacacggcattagacccggtgcatcaaccccctccccctccggctaccctcaaggtggcagagccccctcccaggccccctccccctccaccccctacggggcagatgaacggaacggttgaccacccacccccagccgcaccagagaggaaacccctgggtaccgcaccccattgccccaggcttcctcttagaaagacttaccgggagaatgtgggaggtcctggtgcacccgaaggcacaccagccggaagggcaagggggggttcccccgctcccttgccagcaaaggtggatgaagctacttccggtcttattagggaactggccgcagtggaggacgagctgtaccagaggatgttaaagggccctcctcctgaacccgcagctagcgccgctcagggtacaggagatcccgattgggaggcccctggcctgccgcctgcgaagcggaggaaatcagagagtccagatgtggaccaggcgtctttctccagcgatagcccgcaggacgacacactgacagaacacctccaaagtgcaatcgactctatattgaacctccagcaagcgccagggaggacaccagccccttcttaccctcatgctgcatcagccggtacccccgcttctccaccccctctgcacagaccagaggcttatcccccatcctctcacaacggcggactgggtgccagaacactcacaaggtag

SEQ ID NO: 224575 - DNA, 1437 bp, Artificial Sequence
  Description of Artificial Sequence: Synthetic coding sequence
atggccgctggcggtagcggtgtcggtggaaagagatcttcaaagtctgacgcagatagtggatttttaggccttagaccgacctcagtggaccctgccctgaggcggaggcgcagaggacccaggaataagaaacggggatggagacggctagcccaggagcctcttgggttagaggtggatcaattcctggaagacgtgagactgcaagagcgcaccagcggaggcctgctgagcgaggccccaaatgagaaactgtttttcgtggatacaggtagcaaggagaaaggactgacaaagaagcggaccaaagttcagaaaaaaagcttgctcctgaaaaagccactgagagtggacttgattctcgagaacacaagcaaagtgccagctccgaaagatgtccttgcccatcaggtcccaaacgcaaaaaagctgaggaggaaggagcagttgtgggagaaactggcaaaacagggggagctccccagggaagtacgcagggcacaggccagactactgaacccatccgccacccgcgctaaaccaggccctcaagataccgtagaaagacctttttacgatctgtgggcaagcgacaaccctctggaccggccactggttggtcaggacgaatttttcctggagcaaaccaagaaaaaaggggtgaaaagacctgcacggctacatacaaagccaagccaggcaccggcagtcgaggtcgctcctgctggtgcgtcttataatcctagcttcgaggatcatcagactctgctgtccgcagctcacgaagtggagttgcagcgccagaaggaagcagaaaaactcgagcggcaactggcattgccagctaccgaacaagctgcaacccaggaaagcacctttcaggaactatgtgaggggctccttgaggagtctgatggcgaaggcgagccgggacagggtgaaggcccagaggctggggacgctgaggtctgtcccacccccgctcgattagccacaaccgaaaagaaaactgaacaacaacgccgtagagagaaggcagtccataggctccgcgtgcagcaggcggcattgcgcgctgcgagactgcgccatcaggagctttttcgactcaggggcatcaaagctcaagtagccctgcgcctcgctgaactggctagacgccagagacgacgccaggcacgtagggaggcggaagccgataaacctcgcaggcttggacggctcaaataccaggctccagacattgatgttcagctgagctctgagcttaccgactctttgcgaaccctgaagccagagggtaacatcctgagggatcgcttcaaatcatttcagcgccgtaatatgattgagcctcgagaacgggctaaattcaaacgtaaatacaaggtcaaactggtggagaagagggccttccgggaaattcagctctag

SEQ ID NO: 224576 - DNA, 1419 bp, Artificial Sequence
  Description of Artificial Sequence: Synthetic coding sequence
atggcggctggaggcagtggggttggaggtaagaggtcgagcaaatctgacgccgattcgggcttcctcggcctccgcccaacctcggtagaccccgctcttcgcagacgcaggcggggtcctcgtaacaaaaagcggggatggcgcaggctggcacaggagccactggggctggaagttgatcaatttctggaagatgttcggctgcaggagagaaccagcggcggactcctcagcgaagccccaaatgagaagctgttcttcgtggacactgggtccaaagagaagggactgacaaaaaagcggaccaaagtgcagaaaaagtcccttctcttgaagaaaccattgagagtggacttgatcctcgagaacaccagtaaagtgcccgctccaaaggacgtgctggcccatcaagttccaaacgctaaaaagttgaggaggaaggaacagctgtgggagaagcttgccaaacagggcgaactacctcgtgaggtgcgtagggctcaagccaggctcctcaacccctccgctacgagggcgaaacctggaccacaagacactgtggaaaggcccttttatgacctgtgggcgagtgataaccccctggaccgtcctctcgtggggcaggacgagttctttctggagcaaaccaagaagaaaggagtcaaaaggcccgcaagactgcacaccaagccctctcaggcacctgccgttgaggttgccccagcaggtgcgagctacaatccctcatttgaggatcatcagaccttgttaagcgccgctcatgaagtggaactccagcgccagaaagaagccgaaaagcttgagcgacaactggcattgccagcaactgaacaggctgccacacaggagagtacatttcaggagctgtgtgaggggttgcttgaggagagtgacggagaaggggagccgggacagggagaagggccagaagcaggtgatgccgaagtgtgtccaacacccgctcggcaccacagggaagaggatggcgcagcagcagccaggcgtctgtgtaccggatgtggctatagccgacctaggtgtggaccaccgggaagcggtactagatcttgtagtggatgcgccggatcgcctggcggacccgaggcaggaggagcccgtagacagcggagacgccaggctcgtcgcgaggccgaggccgataagcccaggaggttgggaagactcaaatatcaggcccctgacatcgacgtacagctgagtagcgagctgaccgattcgctgcgcacattaaagcctgaaggcaatattctaagggatcggtttaagtcatttcaaaggagaaacatgatcgaaccacgggaacgagcaaaattcaaaagaaagtacaaggtcaagcttgttgagaaacgagccttcagagagattcaactgtag

SEQ ID NO: 224577 - DNA, 792 bp, Artificial Sequence
  Description of Artificial Sequence: Synthetic coding sequence
atggctgctgggggatccggagtagggggaaagcgtagcagtaagtcggatgccgactccgggtttctgggcctccggccaacaagcgttgatcctgccctaagacgcagaagaaggggtccacgtaataagaaacggggatggcggaggctcgcacaggagcccctgggtctggaagtggaccagttcctagaggatgtgaggctgcaggagcgcacatcgggaggtctccttagcgaagcacctaatgaaaaactgttttttgtcgatactggctccaaggagaagggcctcaccaaaaagcgcacgaaggtgcagaagaagtcactactgctaaagaagccccttagggtcgatttaattctcgaaaacacctcgaaagtgcctgcaccaaaagatgtgttggcccaccaggtgcccaatgcaaagaaactgcgacgcaaggaacaactatgggcaagcgacaatccccttgatcgtcccttagtgggacaggatgagttctttttggaacagaccaaaaaaaaaggcgtgaaaagaagggaagccgaggcagataagccaaggcgcctgggccgattgaagtatcaagctccagatattgacgtgcaactatcttctgagctgacggacagtttacgcacactgaagccggaggggaacatcctgcgcgacagatttaaaagttttcagagacgcaacatgatcgagcctcgggaaagagccaagttcaaacggaagtacaaagtcaagctcgtggagaagcgcgcatttagagagatccagctgtag

SEQ ID NO: 224578 - DNA, 1656 bp, Artificial Sequence
  Description of Artificial Sequence: Synthetic coding sequence
atggcacgcggtgcggagggcggtaggggtgatgccggatggggactgcgcggagcactggctgccgttgctttgctcagcgccttaaatgcagctggcaccgtattcgccctgtgccaatggcgtgggttatcatcagctttgagagccctagaagctcaaaggggtagggagcaacgggaggattcggcgctgaggagtttcctcgccgaactgtctcgggctcctcgcggagcctccgcccctccccaggaccctgcgtcctcggcaagaaacaaaagatcgcattctggagagccagcgccacacataagagcggaatcccatgacatgttgatgatgatgacttattccatggtcccaataagagtcatggtggacctctgcaactcaaccaaagggatctgcctaactggtccctcgggaccaccgggtcctcccggtgccggaggtctgcctggccacaacggcctggacgggcagccgggtccacagggtcctaaaggggagaaaggagctaacggtaaacgtgggaagatgggtattccaggcgcagcgggtaatccaggtgagagaggagaaaagggagaccatggggagctggggctgcagggcaacgagggcccacctggacaaaaaggcgagaagggtgacaaaggtgatgtctccaacgacgttctcctggctggagccaagggtgaccagggaccccctggccctccagggcctccgggaccccctggtcccccaggacccccaggttcaagacgggcaaaaggaccaagacagccatctatgtttaatggacagtgtccgggagagacatgcgcaatacccaacgatgacaccttagtcggaaaagccgacgagaaggctagtgaacaccactcccctcaggctgagagcatgatcaccagcatcggtaatcctgtgcaggtgctgaaggttactgaaacattcggcacttggattcgggaaagcgctaacaaatctgatgacaggatctgggtcactgaacatttttcaggcattatggtgaaggaattcaaggaccagccatctctgcttaacggcagttacacgtttatccaccttccttattactttcatggctgcggtcatgtggtttacaacaactcactatattaccacaaggggggatctaacacgctggttcgatttgagtttggccaggaaacatctcagaccctgaaactcgaaaatgccctctatttcgatcggaagtatctgttcgcaaactctaaaacttacttcaacctggctgtggacgaaaaggggctatggataatctatgcctcgtctgtggacggcagctccattcttgttgctcaattggatgagcgtaccttcagtgtggtgcagcacgttaacacgacatatcctaaaagcaaggccggtaacgccttcattgcacgtgggattctgtatgtgaccgatacgaaggatatgcgcgtgactttcgccttcgacctgctcggaggcaagcagattaacgctaacttcgacctacggacttcccaaagcgtccttgcgatgctcgcctacaatatgagagatcagcatctatattcgtgggaagatggccatctgatgttgtaccccgtccagtttctcagtacaaccctgaatcaatag

SEQ ID NO: 224579 - DNA, 1284 bp, Artificial Sequence
  Description of Artificial Sequence: Synthetic coding sequence
atggtcgacctgtgtaactccacaaaggggatttgtctcactggacccagtggtccaccaggccctccgggagcgggtgggttgccaggccacaacgggttggacggtcagcctgggccacaaggacctaaaggagagaaaggcgcaaatggcaagagagggaagatgggcattcccggagcagctgggaaccccggtgaacgcggagagaagggagaccatggagagctgggcctgcagggtaacgaaggccctcctggacaaaaaggggagaagggtgataagggggacgtgtctaacgacgtgttactagcaggggcaaagggcgaccaggggcctcccggaccgccaggcccaccaggtccgccaggaccgcctggccctcccggatctaggcgagctaagggccctagacagccatccatgttcaacggtcagtgccccggagaaacatgtgcaatccccaacgacgataccctggtggggaaagcagatgagaaagccagcgagcaccactctcctcaggcagagtcaatgattactagtatagggaatcctgtgcaggtcttgaaagttacagagacatttgggacttggattagggagtctgctaataaatccgacgaccgcatctgggtcacggaacatttttcagggataatggtgaaagagtttaaagatcagccgtcgctacttaacggtagctatacgtttatccacctgccttactactttcacggatgtgggcacgtggtgtacaataactctctgtattaccataagggtggctcgaacactctggtgagatttgagttcggccaggaaactagccagacactgaagctggaaaacgcactttacttcgataggaaatatttattcgccaactctaagacttacttcaatctggccgtcgacgagaaaggactgtggatcatctatgccagcagcgtcgacggatcatctatactggtggcccagctcgacgaaaggaccttctctgtggtccagcatgttaacacaacctacccaaagtccaaagccggtaacgcctttatcgccaggggtatcctgtacgttaccgatacgaaagacatgagggtgactttcgcatttgacctgcttggtgggaagcaaattaacgctaactttgacttgcgcacatcccagtcagtgctcgctatgttggcatataacatgagagaccagcacttatacagttgggaagatggtcaccttatgttatatcccgtccagtttctgagcaccaccctgaatcaatag

SEQ ID NO: 224580 - DNA, 1284 bp, Artificial Sequence
  Description of Artificial Sequence: Synthetic coding sequence
atggtcgatctgtgcaattccaccaagggaatttgcctgactggccctagcgggccaccaggtccccctggcgcaggtggcctgccaggccataacgggctggatggccagccgggaccccagggtcccaaaggagaaaaaggagccaacggcaaaagaggaaagatgggtatacctggagcagcaggcaatcctggggagcgcggagaaaagggagaccacggggagctgggactccaaggcaatgaagggccaccagggcagaagggcgagaagggcgacaagggagatgtcagtaatgacgtgttgctggccggtgccaagggcgaccagggcccaccgggaccccctgggcctccaggtccaccaggccctccagggccacccggttcacgtagggcaaaaggacctcggcagccttctatgttcaacggtcagtgtccaggggagacatgtgccattccgaacgatgacactctggtggggaaggcagacgaaaaggcttccgagcaccatagcccccaggctgaatctatgattacctccatcggtaaccctgtgcaggtgctgaaggtgaccgagacatttggtacttggattagagagtctgccaacaagagtgatgataggatctgggtgacagagcacttctctggaatcatggttaaagagtttaaggatcagccaagcctcctcaacgggtcttatactttcattcaccttccctactacttccacggttgtggacacgtcgtgtacaataactccctgtattatcataagggaggcagcaatacactggtgcggtttgaattcggacaggagacatcacaaacactaaagctcgagaacgcactgtatttcgatcggaagtatctgttcgccaattccaaaacctactttaatctggcagtggatgagaagggcctgtggattatatacgctagcagcgtggatggatccagcattcttgtggctcagttagatgaacgaacctttagtgttgtgcagcatgtcaacacaacatacccaaaaagtaaggccggtaatgcctttattgccagaggcatcctctacgtgacagataccaaagatatgagggtaacttttgcctttgacctcctcggcggaaagcagattaacgctaattttgatcttaggacatctcagtctgttcttgccatgctcgcttacaacatgcgagaccagcacctgtactcctgggaagatggtcacttgatgctctaccccgtgcagttcctgagcacgacattgaaccaatag

SEQ ID NO: 224581 - DNA, 1575 bp, Artificial Sequence
  Description of Artificial Sequence: Synthetic coding sequence
atgcactccctcgacgaacctctggatctcaagttaagtataaccaaacttagagccgctcgggagaaaagagagagaacccttggcgtcgttaggcctcgggctctccaccgggagcttgggctggtggacgattcacctaccccgggtagcccgggttctccacctagcgggtttctgctgaattcgaagtttcccgagaaggtcgaaggaagattcagcgcggcaccgcttgtggatctgagcctgtcacctcctagcggactggactccccaaatggttcgtcaagtctgagtcccgaaaggcagggcaacggagatcttcctcccgtgcctagcgcaagtgattttcaaccgctgagatatctagatggtgtgccatcgtcatttcaattcttccttcctctgggcagtggcggtgccctgcatctgcctgcctcttcattcctgactccacccaaagataagtgtttatcccctgacttaccgctccctaagcagctggtgtgccggtgggcgaagtgcaatcagctgttcgagttgctgcaagacctcgtggaccacgtgaacgactatcatgtcaagcccgagaaggacgcgggatattgctgccattgggaagggtgtgcccgtcatggacggggatttaatgcgagatacaagatgctgatacatattcggacacacacaaatgaaaaacctcaccgctgcccaacttgttcaaaaagttttagtcggcttgagaacctcaagatacacaatagaagccataccggagaaaaaccttacgtttgtccatatgaaggatgcaataagagatactctaactccagcgatcgcttcaagcacaccaggacacattacgtcgataaaccatattactgcaagatgccaggatgccataagaggtacactgatccttcatcgctgcggaagcacattaaggcccacggacacttcgtgagccacgagcagcaagagctgctgcaattgaggccaccccctaaaccccctttacccgctcccgatggcggtccttacgtgagcggggcacagataataattcccaaccccgctgcgcttttcgggggtccaggattacccggtctccctttacccttggctcctggcccactggacctgtctgcattagcatgtggaaatggaggtggttctgggggtggcggaggcatgggcccaggacttcccggtccagtgctccctcttaatctagccaaaaatcccctgctaccttctccttttggagccggaggcctgggacttcctgtggtatcattgctcgccggtgccgctggtggaaaggccgaaggcgagaaaggacgaggatcagtccctactcgggctcttgggatggaaggccacaagacccctctggaacgaaccgagtctagttgttcaaggccctcccccgacggactgcctctgctgccaggcactgtgctggacctgtccacaggtgtgaattctgcggctagcagccccgaagctctggccccaggatgggtggtaattcccccagggtccgtgctgctgaaacctgcggttgtgaactag

SEQ ID NO: 224582 - DNA, 1575 bp, Artificial Sequence
  Description of Artificial Sequence: Synthetic coding sequence
atgcacagcctggacgagcccttagacttgaagctgagcataaccaaactgcgggctgcacgagagaaacgggagcgcactctcggggtggtccgcccacgtgcactacatagagagttgggcctcgtggacgactccccaaccccaggctctcccggttctccaccatccggattcctgctcaacagcaaatttccggaaaaggtcgagggcagattctcggcagccccactggtagatctgagtttatctccgccatccggcctggattctcctaatggctcctcatctttaagtcccgagcgtcaaggcaacggggatctacctcccgtgccatctgcctccgacttccagcctctacgctacctggatggcgtcccaagttcgtttcaattcttcctaccgctaggctccggtggcgctctacatcttcccgcttcaagcttcctgacccctccaaaggacaagtgcctgtccccagacttacccctccctaagcaactcgtttgccgctgggctaagtgcaatcaattattcgagctgctgcaggatctggtcgaccatgtcaacgactaccacgtcaaaccggaaaaggacgctgggtactgctgccactgggagggatgcgccagacatgggagaggcttcaacgctcggtataagatgcttattcatatacgtacacacacgaatgagaagccccaccgctgccctacatgcagcaagagcttctctaggctcgagaatctgaagatccacaacaggtcacacactggagagaaaccctacgtctgcccctacgaagggtgcaataaacggtactcaaactcctctgatcgtttcaagcacactagaacacactatgtcgacaaaccatattactgcaagatgcctggttgtcacaaacggtacacggacccctcctccctccggaagcacataaaggcccacggccattttgtgtcccatgaacagcaggaactgttgcaactccggccacctccaaaaccccctctgcctgctccggatggcggaccatacgtgtccggagcacaaattatcatccccaatccagctgctctatttggaggtcccggactgcccggactgcccctcccactggcaccgggaccactagatctgtccgccctagcctgcgggaacggtggaggctctggtggtggaggcggtatggggcctggcctcccaggcccagtactgcctcttaatctggccaaaaatccacttctcccaagcccattcggcgctgggggtctgggtctgccagtcgtgagcctgctggcaggggctgctgggggaaaggccgagggagaaaagggtcgaggatcagtgcctacccgcgctttgggtatggaaggacataaaacacccctcgagcggactgagtcttcctgcagcaggccaagtccagatggccttcctctcctgcccggtacagtcctcgatctgagcactggtgtgaatagtgcagcttcctcccccgaagcgctggcgccaggttgggtggtgatacccccaggaagtgtactgttaaagcctgcggtggtgaattag

SEQ ID NO: 224583 - DNA, 2328 bp, Artificial Sequence
  Description of Artificial Sequence: Synthetic coding sequence
atgatggttcaacgcctgggtttgattagccccccagctagccaggtgtcaacggcatgcaatcagatctcaccctcactgcaacgtgcgatgaatgcggcaaacctgaatatcccacccagcgatacaagatcactcatctctcgcgagtccctggcaagcaccacgctgtctctgactgaaagccagagtgcatcgtccatgaagcaggaatggagccagggatatagggctctgccatcactctcaaaccatggctcccagaatggactggacctaggggatctactcagcctgcctccgggaacgagtatgtcttctaatagcgtatccaatagcttgccgtcttatctgtttggaacagagagctcccactcaccgtatccttcccctcgtcactcctcaacgcgttcacactctgctagatctaagaagagggccctcagcttgagtccactcagtgacggaatcggtatcgacttcaatactattattagaacctctcccacgagtctggtggcctatattaatggcagtcgggcatcccctgcaaacttatcaccacaaccagaggtctatgggcacttcctcggggtgaggggaagctgtatccctcagcccaggccagtccccggaagtcagaaaggagtgctggttgctccgggaggtcttgctctgccagcttatggagaagatggagccttggaacacgagcgcatgcaacagctcgaacacggtggattgcagccaggactagtgaaccatatggtggtgcaacacggacttccgggacccgactcccagagcgcaggcctcttcaaaacggagcggttggaagagtttccaggaagtactgtggatcttccccctgcaccccctcttccacccctgcctcccccaccaggccctcccccaccctaccatgctcacgcccacctccatcaccctgagctcggccctcacgctcagcagctggccttgccacaggctactctcgatgacgatggagagatggatggtatagggggtaagcactgttgcagatggatcgattgtagtgccctatacgatcagcaggaggagctcgtcagacatatcgaaaaggttcacatcgaccaaaggaaaggggaagactttacttgtttttgggcgggatgtcccagacgctacaagcccttcaatgccagatataaacttctcatccatatgagagtgcattccggcgaaaagccaaataagtgcactttcgagggatgcgaaaaggctttcagtcggctcgaaaacctgaagatccacctgaggtctcacaccggggagaagccatatctgtgccagcaccctgggtgtcagaaagctttttctaattcatcagatcgagccaaacatcaacgtactcacctggacaccaagccctacgcctgtcagataccaggctgtacaaagcgctatactgaccccagctcgctgcgtaagcacgttaaggcacattcgtctaaagagcagcaggctcgcaagaagctgagatctagcactgagcttcacccggacttgctgaccgactgcctgactgtacaatctctccagccagctaccagtccgagagacgcagctgccgagggaaccgttggcaggtccccgggtcccggtcccgacctctattctgccccaatcttcagcagcaactattcgtctagatcaggaaccgctgctggcgctgtcccgccaccccatcctgtctcgcacccgtcccccggtcacaacgtgcagggatctccccacaatccctcatcacagctgccaccacttacagccgtcgacgccggagctgagcgcttcgcgccaagtgcaccgtccccacatcatatcagccccagacgggtgccggcaccttcctcaattctgcagcggacacagcctccttatacgcaacaaccctcgggctcacacctgaaaagctaccaacctgaaactaactcctctttccaaccaaatgggattcacgtgcatggattctacggccagctccaaaaattctgcccaccccactatcccgattctcagagaattgtgcccccagtgagcagctgcagtgtcgtgcccagctttgaggattgtcttgtgcctaccagtatgggccaggcctctttcgacgtgttccatcgggctttttcaacacactctggcatcacagtctacgacctcccttcttcctccagctccctcttcggagagtcacttcgctctggcgcagaggacgccacctttctgcagatctctactgtcgacaggtgtccatctcaactttcttctgtttataccgaaggttag

SEQ ID NO: 224584 - DNA, 2793 bp, Artificial Sequence
  Description of Artificial Sequence: Synthetic coding sequence
atgaatgggaggagctgctccatgtcacttcatagaacctctggaaccccacagggtccaagaatggtctctgggcatcacatcccagccattcgtgcccattctggtactcccggtccttctccctgtggctctacaagttcacccacaatggcctccctggctaataatctgcatctaaagatgccgtcgggaggcggaatggcaccacaaaacaacgttgcagaatcaaggatacatctgcccgctctgtcacccagaaggcagatgctgacaaatggcaaaccgagattccaggtcacacaggccggaggaatgtccggaagtcataccctcaagccaaaacaacaggagttcggcagcccgtttccccctaatccaggaaagggtgctttgggcttcggcccacagtgcaaatctatcggcaagggctcctgcaacaatctggttgttacttcttcccctatgatggtacaacgcctgggccttatctccccaccagcttcccaggtgtccacggcctgcaaccagatcagcccctccttgcagagagcaatgaacgccgctaacctgaatatacccccttccgatacccgctcactgatcagccgcgaaagtctggcatccaccacgctcagcttaaccgagtcccagtctgcgagttccatgaagcaagaatggagtcaagggtacagggccctgccgagtctgtctaatcatggcagccaaaatggtcttgacctgggcgacctgctgtccctgccccctggaacgtcaatgagttccaattctgtgagtaactccttgccaagctacctctttggcaccgagtcctctcattcaccatacccctcccctcgccattccagtacccggtcccatagcgccagatcgaagaagagagcgctgtcccttagtccactctctgatggcatcggcattgacttcaacacgattatcaggacctcccccacttctttggttgcatacatcaatggtagtcgggcaagtccagctaacctgtcaccccagcccgaagtctatggccacttcttgggagtccggggatcttgcattccacaacccaggcctgtgcccggatctcagaaaggagttctggtcgcccctgggggtctcgcactgccagcttatggggaagacggagctctagagcatgaacgcatgcagcagctggagcacgggggtctccagcccggacttgtgaaccacatggtggtccagcacggactgcccggaccggactcccagagtgccggactgtttaagacagaaagacttgaagagttccccggttcgacagtcgacctgccaccagcccctcccttgcctcccttaccaccaccacccggacctccaccaccataccatgcccacgctcacttgcaccatccagagttgggcccacatgcccagcaattggcactgccacaggccacattggacgatgacggcgaaatggacggtattggtggcaagcattgctgccgttggatcgactgctcagcactgtacgaccagcaggaggagctagtaagacacatcgaaaaggtacacatcgaccagcgaaaaggggaggactttacgtgtttctgggccggttgcccaagacggtacaagcccttcaacgcaaggtacaagctgctgattcacatgagggtgcacagtggagaaaaacccaacaagtgcacctttgaagggtgcgaaaaagcattctcccgactggagaatctgaaaatccatcttagatcccacacaggggagaaaccttacctttgccaacacccagggtgccagaaggccttctctaactcttccgaccgagcaaagcaccagcgtacccacttggatacaaagccttacgcttgtcaaatccctggctgcactaagagatacacggatccttccagtctccgaaagcacgttaaagcgcatagttctaaagaacagcaagcaaggaaaaagctcagatcctccacagaactccatcccgacctgctgaccgactgcctgacagtgcaatctctgcaaccggcaaccagcccgagagacgctgcggcagagggcactgtcggacgcagtcctggtccgggacccgacctgtactccgccccaatcttctcgagtaattacagttcgcggagtggaacagccgctggggcagtcccccctccccacccagtgtctcacccttcacctggtcacaatgtgcaggggtccccacataaccctagctcccagttgccgcctttgaccgccgtcgacgcaggggcagaaaggttcgccccaagcgctccttcccctcaccacatctcaccgcgacgcgtcccagccccaagtagtatactccagcgcacccagccgccatatactcagcagccaagcggctcacacttgaaatcttaccagccagagactaatagctcctttcaaccaaatggaatacacgtgcatggattttatggccagctgcagaaattctgtcctccccattaccctgattcgcagagaatagtgcccccagtctcttcatgctctgtggtgccctcctttgaagactgcctggtgccaacgtctatgggccaggccagtttcgacgtatttcatcgtgctttctctacacacagcggtattacagtctatgacctgccatcaagcagctcatctctgtttggggaatcactcagaagtggcgctgaggatgccacttttcttcagatctcgactgttgatcgatgcccgtctcagttgtcatctgtatataccgagggttag

SEQ ID NO: 224585 - DNA, 270 bp, Artificial Sequence
  Description of Artificial Sequence: Synthetic coding sequence
atgatggtccagcgacttgggctcataagtcctcccgcatcccaggtgagcacggcgtgcaaccagatttctcctagcctgcagcgggctatgaacgccgctaacctgaacatccctccttcagatacgagatccctgatttctcgagagagtctggcctccaccaccctttcactcaccgagtcacagtctgccagctcaatgaagcaggaatggtcacaaggctatagagcgctgccatctctctctaatcatggtagtcagaactag

SEQ ID NO: 224586 - DNA, 735 bp, Artificial Sequence
  Description of Artificial Sequence: Synthetic coding sequence
atgaatgggcgatcttgctctatgagccttcatcgcaccagtgggactccacaggggcctcgcatggtgagcggacaccacattcccgctatccgagcccattctggcaccccgggtcccagcccatgcggctccacctctagcccaactatggcctccctcgccaataatctgcacctaaagatgccatcagggggaggtatggcccctcagaacaacgtggcggaaagccgcatacaccttccagcactgagtcctcgcaggcagatgctaacaaacggcaaacccagatttcaggttacgcaggccggtggcatgagtgggagccacacccttaagcccaagcagcaggagtttggatctccatttcccccaaaccctggaaagggcgcactggggtttggccctcagtgcaaatctatcggcaaaggatcttgcaacaatctggtcgtgacttcatcacctatgatggttcaaagactcgggctcattagtcccccagcctcccaggtgagcactgcgtgcaaccagatatcgccttctcttcagcgggcaatgaacgcggcaaacctcaacatccctccctccgacacgagatcactgatctccagggaatcactcgcttccacaacccttagcctaactgagtcccagagcgcttcctctatgaagcaggaatggagccaagggtatcgggctctgccatccctgtcgaatcatggcagccagaactag

SEQ ID NO: 224587 - DNA, 270 bp, Artificial Sequence
  Description of Artificial Sequence: Synthetic coding sequence
atgatggtgcagcgcttggggctgatcagtccccctgcctctcaggtgtctactgcttgcaatcagatctctccatcactgcaaagagccatgaatgcggcaaacctaaacatcccccctagcgataccagatcactgataagcagggagagcctggcgagtaccaccctctcgctgacagagtcacagtcagcctcctcaatgaaacaagagtggtcccagggctatagggccctaccctcgctgagcaatcacgggtctcagaattag

SEQ ID NO: 224588 - DNA, 270 bp, Artificial Sequence
  Description of Artificial Sequence: Synthetic coding sequence
atgatggtgcagcgattgggtttgatttccccaccagcatcacaggtgagcacagcctgcaaccagatatctccctctcttcagagggcgatgaatgcggcaaatctcaacatacctcccagcgatactcgcagcttgatttcccgtgagagcctggcctccacgactctcagcctgacagagtctcagtcagcctcaagtatgaaacaggagtggagtcaggggtacagagcgctccctagcctctccaaccacggtagtcagaattag

SEQ ID NO: 224589 - DNA, 735 bp, Artificial Sequence
  Description of Artificial Sequence: Synthetic coding sequence
atgaacggccgaagttgcagcatgtcccttcaccgcacttctggtacacctcaggggcctagaatggtatctgggcaccatataccagccatcagggcccactccgggactccaggacctagtccctgtggcagcactagcagtcctaccatggcgagcctggctaacaacctacacctgaagatgccctcaggtgggggtatggccccacaaaacaacgtggcagagtctcgtatccatctccctgcattgagcccgagacggcagatgcttactaacggaaagccgaggttccaagtgacacaagctggaggtatgtcaggtagtcatacactgaagccgaagcagcaggagtttggcagtccgtttccacctaatccagggaagggtgcactagggttcggaccccagtgtaaatccataggtaagggctcctgcaataatctggtcgtcactagttccccaatgatggtccagcgactgggtttaatctctcccccagcatcccaggtaagtaccgcttgcaaccagatttcccctagcctgcaacgcgcaatgaatgccgctaacctgaatatccccccttctgacaccagaagcctaatctctagggagagcctcgcatccacaacgctttcccttacagaatctcagagcgcgagcagtatgaagcaggaatggtctcaggggtaccgcgcactgccgagtctgtcaaaccatggctcccaaaactag

SEQ ID NO: 224590 - DNA, 219 bp, Artificial Sequence
  Description of Artificial Sequence: Synthetic coding sequence
atgcaccgccgtagactggctctgggacttggcttttgtctgcttgcaggcacgagcctcagcgtcttgtgggtgtacctcgagaactggctgccggtgagttacgtgccctactatctcccatgtccagagatccttcttgagtaccgcggtgtcatatccgcacactgtaacctgcatctgcccggttcttcgaattgtcacgcttctgccacgtag

SEQ ID NO: 224591 - DNA, 483 bp, Artificial Sequence
  Description of Artificial Sequence: Synthetic coding sequence
atgcacagacgccgactggccctcggactcggcttctgtctattggctggcaccagcctgagcgtcttgtgggtatatttagagaattggctgcccgtaagctatgtgccttactacctgccttgtcccgaaatcctaccaatgatgatggcattgtcatgcctgtgccatcagcaacacgaggcagcacttcaggagggcgaagctacacctgctcgtggcatggtcacggtgcccagcgcgcaggctgccggtgcccaagcccacactgcagcagatacacacacactggtgggcgctcacagactaaggggcaatctgcagcccagagccagtgccgctcacctgccagctacagagccagaccattggggacacggggtgtgccgcggagaggttcatagtttccatcctgttttgccgggtgtgtctaggggagtcctgcatgcatgggtgcccggtgccctgctacacctgcactag

SEQ ID NO: 224592 - DNA, 1044 bp, Artificial Sequence
  Description of Artificial Sequence: Synthetic coding sequence
atgcacagaagacgattggccctaggtctcggattctgcctgctggccggtacctcacttagcgttttgtgggtttatctggagaattggcttccagtgtcatacgtgccatactatttgccatgtcctgagatcttcaatatgaagcttcattataaacgcgaaaagcccctgcaaccggtcgtctggtcccagtatccccagcccaaattgttggagcaccggcctacccagcttctgaccttgacaccctggctggcgcctatcgtatcggaggggacatttaatcctgagctcctccagcacatctaccagccactgaacctcaccatcggagtcacagtgtttgccgttggaaaatatactcacttcattcaaagttttctggagtcagccgaggagttcttcatgcgtggttacagggtgcactattacatctttactgataaccctgccgcagttccaggagtcccgctgggccctcaccggctgctttcatccatccctatccaggggcactctcactgggaagagacctcaatgcgtagaatggaaactatcagccagcacattgccaagcgagcgcacagggaggtggattaccttttctgtctggacgtggacatggtatttaggaacccctggggcccagaaactctgggcgacctggttgccgcaattcatccatcttactacgcagtgcccaggcagcagtttccttatgagcgcagaagggtttctaccgcttttgtcgctgactcagaaggcgatttctattatggaggagccgttttcggaggccaggtcgccagagtgtacgagtttacacggggatgtcacatggctattttggccgacaaagctaacggaattatggcagcttggcgagaagagtcccacctgaatcgtcattttatctcgaataagccttctaaggtcctgtctcctgaatatctgtgggacgaccgcaagccacagccaccttccctgaaactgatccggttttcgacccttgataaagatatttcctgcctgaggtcctag

SEQ ID NO: 224593 - DNA, 885 bp, Artificial Sequence
  Description of Artificial Sequence: Synthetic coding sequence
atgcacaggcggaggctggccctcggcctgggcttctgtcttctggccggtacatccctgtctgtgctttgggtctacctggaaaactggctacccgtgtcttatgtaccttattacctgccctgtcccgaaatattcaacatgaaactccactacaaaagggagaagcccctgcagcctgtggtgtggagccagtatccccagccaaaactactggaacacaggcccacacaactgttgactctgaccccgtggcttgcacccatcgtgagcgagggcactttcaatcccgaactgctgcagcacatatatcagcctctgaacctgacgattggcgttactgtcttcgcagtgggtaatccctcgtggagccaaccacggagtagttcatgtgtggggactgggtgcactactacttcgtctctgacaaccctccaacctttccctggcagcagatgggtgccgactggctttagcgctccctcgccctctcgggtgacccctactggtagaaggcatccttgcgctgggtggagacccagtgcatcaaccctgcttagggggctcacagggaggtggaccacttcttccgctctgatgtggacctggtgcttcggcacacgtggcgcactccgcccatgggaaacctggtggctgcccttcactcaagccaccacaccttttcctgcgagcagcagtccaatgtcagccggagttttcccgcttccgctctggcagacagcaaaaggaacttctataatggtgggccagtccagcggtggaaggtggcctgggtacatgtcgctgctgggagcagcaacatggccctcttggcgaactaggcctatggcgagttggttgcccggaggtcgtaaggccacttag

SEQ ID NO: 224594 - DNA, 993 bp, Artificial Sequence
  Description of Artificial Sequence: Synthetic coding sequence
atgcatcgaagacggttagctttggggctgggattctgtttactcgccggtacctcattgtctgtcctgtgggtttatctggaaaattggctacccgtcagttacgtgccgtattacctgccttgtccggagattctgtcccagtacccacaacccaagctgctggaacacaggcccacccaacttctgactcttaccccatggcttgcacctatcgtatctgaaggcacatttaaccctgagctgctgcagcacatttatcagccacttaatctgacaattggtgtcactgtatttgcagtgggtaaatatacccatttcattcagtctttcttagagagcgcggaggagttcttcatgagaggctaccgcgtgcactattatattttcacggacaatcccgctgctgtccccggagtgccactgggacctcaccggctcctttccagcatacctattcaggggcatagccactgggaggagacttctatgagaaggatggaaacgatttcgcaacatattgcaaaaagggctcatcgcgaagtggattacctgttttgtctggacgtagacatggtgttccggaacccgtgggggccagaaacactcggcgatctcgtggccgcaatacacccctcatattatgctgtcccccgacagcagttcccctatgaacggagaagagtttccacagcatttgtggcagattccgagggcgacttttattatggcggagccgtcttcggagggcaggttgcgagagtctacgaattcaccaggggttgtcacatggcgatcctggctgataaggctaatggcatcatggctgcttggagagaggaatcacacttgaaccggcactttatctctaacaagccttccaaggtgttgtcgcctgagtacttgtgggatgatcgcaagcctcagcccccatccctgaaactgattcggtttagcacattagacaaagacattagctgtcttcgttcttag

SEQ ID NO: 224595 - DNA, 1434 bp, Artificial Sequence
  Description of Artificial Sequence: Synthetic coding sequence
atgcctccctgccagccacagcggccactgctattactcctccttctcctagcatgtcagccccaggtgcctagcgcgcaggtgatggatttcctctttgagaaatggaaactgtacggggatcagtgtcatcacaaccttagcctgctgcctcctccaactgagctcgtttgtaacagaacgtttgacaaatacagctgctggcccgacacccccgcaaatacaactgccaatatttcttgtccttggtacctgccttggcaccataaggtccagcaccgattcgtatttaagagatgcgggccagacggacaatgggtgagaggccctagggggcagccctggagggatgcctcacagtgtcaaatggatggggaggagatcgaagtccagaaagaggttgcgaagatgtatagctccttccaggtgatgtataccgttggctacagcctgtctttaggagccctgctgctggcactggccattctgggaggcctgagcaagctgcattgtactcgcaacgcgattcatgccaatctgtttgctagttttgtcttgaaggccagctctgtcctagtaatcgacggactccttaggacccggtacagtcagaaaatcggcgatgatctatcagtctctacatggctgtccgatggcgctgttgcagggtgccgggtagctgctgtattcatgcaatacggcatagtcgccaactactgttggcttctggtggagggtttatatttgcacaatctgcttggactggccacgctcccggaaaggagttttttttccctgtatctcggcatcggctggggcgctcccatgctgtttgtggtcccctgggcagtagtaaagtgtctgtttgaaaacgtgcagtgctggacgtccaatgataacatgggattttggtggattctccgcttccccgtcttcctagccatcttgataaatttcttcatcttcgtgcggattgtccagttattggtagccaaactcagagcacggcaaatgcatcacaccgattacaagtttcggttggctaagtctactctgactctgatccctctgctaggcgtacacgaggttgttttcgcgttcgttaccgacgagcacgcacaaggaaccctcaggtccgctaaactgtttttcgacctcttcctgagcagttttcagggattgctggtcgccgtcttatactgtttcctcaacaaagaggttcagtcggagctgcggaggaggtggcacagatggcgtctggggaaagtactttgggaagaacgcaacacatctaatcatcgcgctagttcttcacctggtcacggacccccttctaaggaactccagttcggacggggtggagggagtcaggattccagtgccgagacacctcttgcgggtggcctcccacgcctggccgagagccctttttag

SEQ ID NO: 224596 - DNA, 1392 bp, Artificial Sequence
  Description of Artificial Sequence: Synthetic coding sequence
atggcgggtgcccctggcccactaagactggctctactactccttggcatggtcggcagggccggacccaggcctcagggcgctacagttagtctttgggagaccgtacagaagtggagagaatatcgcaggcaatgccaaagaagcctcacggaggatcctcctcccgctacagacctcttttgtaaccgaactttcgatgaatatgcgtgctggccagacggggagcccggttccttcgtgaacgtgagctgtccgtggtatttgccctgggctagcagtgtcccccagggacatgtgtatagattttgtaccgccgaaggactttggctacagaaggataattcctcccttccttggcgtgacctctccgagtgtgaggagtctaagcgcggagagcgctcatcaccagaagagcaactcctgttcctatacatcatttacactgttggctatgccttgtcattttctgcactcgtcatagcttcagctattctgcttggatttcgtcacttgcattgtactcgcaactacatccatctgaacctgtttgcaagcttcatcctgagagccctctctgtgttcattaaagacgctgctctgaaatggatgtattctacagccgctcagcagcaccaatgggacggcctcttatcctaccaggattcactgtcttgccgcctggtatttttactcatgcagtattgtgtggccgctaattattattggctcttagtggagggcgtctatctgtatacactgttggccttctcagtgctgagtgagcagtggatcttcagactttatgtgtcaatcggttggggggtaccactgctattcgtggtaccatgggggattgtgaaatatctctatgaggacgaaggctgttggacccgcaatagtaatatgaactactggctgatcattcgcttaccgatactcttcgccattggagtgaatttcctgatcttcgtgcgagtgatttgtatagtggttagcaaactgaaagccaatctgatgtgtaagaccgacataaagtgtagactggctaagtccaccctgaccctgattccgttgttgggtactcacgaggtcatatttgctttcgtaatggacgagcacgcacgcggaaccctcaggtttattaaactgttcaccgagttgagctttacatcgttccagggtctcatggttgcaatcctttattgtttcgtcaacaacgaggtgcagctggagtttcggaagtcttgggagcggtggaggctggagcacctgcacatccaacgtgatagtagtatgaagcctctgaagtgtccaacgtcttctctctccagcggcgctacagccggtagcagtatgtacactgctacatgccaggcgtcctgttcatag

SEQ ID NO: 224597 - DNA, 1662 bp, Artificial Sequence
  Description of Artificial Sequence: Synthetic coding sequence
atgaaactcgggagttccagggctggccctggtcgcggaagtgccggattattgccgggagttcacgaactaccaatgggaattccagccccatggggtacctcacctctatcattccacaggaagtgcagcctttgggcacccggacgtccttttctcactcttgtgctgctcgtctccatcaagcaggttacaggttcactgctggaggaaacaaccagaaaatgggcacagtacaaacaagcgtgcctgagggacttgctgaaagaaccctctggcatcttctgcaatgggacttttgaccagtacgtgtgctggccacacagcagccctggcaatgtctcagttccctgcccttcctacctaccctggtggtcagaagaaagctccgggcgagcatatcgtcattgcttggcccaaggaacttggcagacaatcgagaacgccaccgacatttggcaggatgactcagagtgttctgaaaaccatagttttaagcagaatgttgaccgttatgccttgctctcgactttgcagctaatgtatactgttggatacagcttttccctaatatcgctgttcctcgctttgaccctgctgctgttcctgcgcaaactgcactgcactcggaattatatccatatgaatttgtttgctagtttcattctgagaaccctggctgtgttggtaaaggacgtggttttttataactcctattcaaagcggcctgacaatgaaaacggctggatgtcgtatttgtcggaaatgtcaacgtcctgcaggagcgtgcaggtgctgctgcattattttgtgggcgctaactacctctggctgctcgtagaagggctttatctccacacgttgttggaaccaaccgttcttccggagaggaggctctggccgcgttacttactgctgggatgggccttccctgtgcttttcgttgtgccatggggatttgcccgagcgcaccttgagaacaccggctgctggactaccaacgggaataaaaagatctggtggataatcagaggcccaatgatgctgtgtgtgaccgtcaacttcttcatattcttgaagattctgaagctcctgatctctaagctcaaggcgcaccagatgtgcttccgcgattacaagtatcgtctcgcaaagagtactcttgttttaatacccctactgggcgtccacgagatcctcttcagtttcattaccgacgaccaggtggagggctttgccaagctgatccgcctttttatccagctaaccctatcctccttccacggctttttagtggcactgcaatacgggtttgccaacggggaagttaaagctgagctgagaaagtactgggtgagattcttgctagcacggcactccggatgccgcgcatgtgtcctgggcaaggacttccgctttttaggtaagtgtccaaagaagttatccgaaggtgacggagctgagaagctgcgcaagctccagccaagtttgaactcaggccgattgctccacctggccatgcgagggctgggggaactcggagcccagccccagcaagaccacgcaagatggcctcggggtagcagtcttagcgaatgcagtgagggcgatgtgactatggcgaacacaatggaggaaatcctcgaggagtcagaaatctag

SEQ ID NO: 224598 - DNA, 1053 bp, Artificial Sequence
  Description of Artificial Sequence: Synthetic coding sequence
atgggcattcccgctccgtggggcacctctcctctatcctttcatagaaagtgtagtctatgggcgcctggtcgcccatttctgacgctcgtactactagtttcaataaagcaagtgacagggtctctgctggaggaaaccacccgcaagtgggcccagtataaacaggcttgcctgagggacttactcaaagagccaagtgggatcttctgcaacggcacctttgaccagtacgtctgttggccacactccagtccaggaaatgtgtcagtgccatgtccgtcatatctgccatggtggtctgaagaaagttcgggacgggcttaccggcattgcttagcccagggaacttggcagactatcgagaatgcgacggatatttggcaagacgactcagaatgcagtgagaatcacagctttaaacagaatgtggacagatacgcgctcctttctacactacagctgatgtatactgttggttactctttctctctgatttctctattcttagcactaacactactgctgttcttgcgcaagctgcactgcacaagaaattacattcacatgaatcttttcgcctcatttatccttcgaaccttagccgtcctggtgaaggacgtagttttctataacagttattctaagaggcccgataatgaaaacggctggatgtcttatctgagcgagatgtctacgagttgcagatcagtccaggtgctgctccattattttgtcggtgctaactacctttggcttctggtcgagggcctgtacctccatactctcctcgaacccaccgtgctgcccgagcggcgtctgtggccacggtatctcctcctgggatgggcgttccccgtgttgtttgtggtgccttggggatttgccagggcccaccttgagaatacagggtgttggacgaccaacggtaacaaaaagatttggtggatcatccgcggacctatgatgttgtgcgtgaccgctctcggtctggaggagacaggccttaagcggaatgggagcatcccatttgggcataaggaagacatctag

SEQ ID NO: 224599 - DNA, 1665 bp, Artificial Sequence
  Description of Artificial Sequence: Synthetic coding sequence
atgaaactcggctcatcaagagctggtccaggtcgcggaagtgccggtttgttacccggagtccacgaactacctatggggatcccagctccgtggggtacgtcccccctcagcttccaccggaaatgctcactgtgggcgcctggcagaccctttctcaccctggtgctacttgtgagcattaagcaggttactggttcactgctggaggagacgactcgtaagtgggctcaatataaacaagcctgcctgagagacctcttaaaagaaccatcaggcatcttttgtaacggaaccttcgaccagtacgtgtgctggccacactcaagccccggtaatgtgtctgtcccctgtccctcttacctgccctggtggtccgaagagtcttccgggcgagcttaccggcattgtctggctcagggaacttggcaaacaattgagaatgccacggacatatggcaggacgattcagaatgtagtgagaaccacagcttcaagcagaacgtggatcgctacgcgctcctgagtacgctccagttaatgtacaccgttggatactccttttcacttatctcccttttcctggcgctgactctgttactgttcctccggaaactgcactgtaccagaaattatatccacatgaatctgtttgcgagtttcattctccgtacactcgccgttctggtcaaagatgtggtcttctataacagctattctaaacgtcccgacaacgagaatggctggatgagttatctctctgaaatgagcacgtcatgccggtctgttcaggtgttgctgcattacttcgttggagcaaattatctgtggctgcttgtggagggactgtaccttcacacattgctggagcctacggttcttcccgaacgacgcttgtggccccgttacttgcttttgggatgggcctttcccgtcttgtttgtagtgccttgggggtttgcgagggcccacctcgagaataccgggtgctggacaaccaacggaaacaagaagatctggtggatcatacggggacctatgatgttgtgcgtaactgtgaatttttttatctttctcaagattcttaagctgcttatatccaagcttaaggcccaccagatgtgtttccgggactacaaatatcggctggcaaaatctacccttgtgcttatcccattgttgggcgtgcatgagatccttttcagcttcataactgacgatcaggtggagggcttcgccaaactcatcagactgtttatccaactcaccctttcatcttttcatggcttcctggtcgcactccagtatggattcgctaatggcgaagtcaaagctgagctccgtaaatactgggtgaggtttttgttggcccgacacagtgggtgccgagcgtgcgtgcttggaaaagacttcaggttcctaggaaagtgccccaaaaagctgtccgagggcgatggagcagaaaagctacggaagctccaaccgagcctaaatagcggacgcctgctgcatttggccatgagagggctgggcgagctgggagcacagccacaacaggaccacgcccgatggcctcgtggatcttcccttagtgaatgttctgaaggggacgtgaccatggctaacaccatggaggaaattctggaggaaaaacgtagtcaatag

SEQ ID NO: 224600 - DNA, 687 bp, Artificial Sequence
  Description of Artificial Sequence: Synthetic coding sequence
taagccaccgacatctggcaggacgactccgagtgtagtgagaatcacagttttaaacagaacgtcgaccgctatgccttactcagcaccctacaacttatgtataccgtgggctattctttttccctgatttccttgtttttggcactaacacttttgttgttccttcgcaaactccattgtaccaggaattatatccacatgaatctgttcgcctctttcatcctgcggactctggcagttttagtcaaagacgttgtgttctacaattcttattctaaacgcccagataacgaaaacgggtggatgagttatctgtctgaaatgagtacgagctgtcgctctgtgcaggtgctcctccactactttgtgggtgcaaactatctgtggctgttggtggaaggcctctatttgcacactctgcttgagcctaccgtgttgcctgagcgccgtttgtggccccgttatctgcttctgggctgggcgtttccggtactgtttgtcgtgccatggggatttgccagagcgcacctcgagaacacaggctgttggaccacaaacggtaacaaaaagatctggtggataattagaggccctatgatgttatgtgtcacagccctgggactggaggaaacaggattgaagaggaacggaagtattccatttgggcacaaggaagacatttag

SEQ ID NO: 224601 - DNA, 1725 bp, Artificial Sequence
  Description of Artificial Sequence: Synthetic coding sequence
atggagccaaccgaaaatccctgccagggcccattggggcagaaggctggagagaagcccttagcagctggacctggtgaagaagaactgctccgcggatcggcgcctcacgctcaagacactcagagcgaggaactgcccccttcttgcaccattagtggtgaaaaaaaacctcccgcagtgagtggtgaagccaccggagcagatgctggaagactgtgccccccaccaagatccagggctccgcataaggataggacactggccagatcacgaccccaaacccagggggaagactgcagtttaccagttggcgaggtgaagattggtaagaggtcttactccccagccccaggcaagcagaaaaaacccaatgcaatggggctggccccaactagcagtccaggtgcccctaacagcgcaagggctacacacaaccccgtcccttgtggctctgggcgaggcccttgccacctggccaacttactgtcgactctggcccaatccaaccagaatagagaccataaacaggggcctcctgaggtgacgtgtcagatccgaaagaaaactcgcaccttgtatcgatccgaccagctggaggagctggagaagatatttcaagaggaccactaccccgattcagacaagcgaagggaaatagcacaaactgtgggcgttacgccccaaagaattatggtgtggtttcagaatcgcagggcaaagtggcggaagatggagaaacttaatggcaaggagtccaaggacaacccagccgcacctggacctgctagttcccagtgcagcagcgccgctgaaattctgccggcagtccccatggaaccaaagcccgatccattcccccaggagtccccactggatacatttcctgaacctccaatgctgctgacttcagatcagaccttggcacccacccagccgtctgagggtgctcagcgtgtggttactcctccccttttttcccctccgccagtcagacgagcagatctgccctttcctctggggccagtccatactccccaactcatgcctctgctgatggacgtggccggatctgatagcagccataaggatggaccctgtggatcatggggtacctccattactctcccaccgccatgctcgtatctggaagaacttgaaccccaggattaccagcagagtaaccagcctggaccctttcagtttagtcaggcacctcagccccctctcttccagtcaccacagccaaagctgccgtacctccctaccttccccttcagcatgcctagttcactgaccttgcctcccccagaagatagcctgttcatgttcccatgtgggccatctggaggcacatctcagggctactgcccaggtgcatcttccggacagatactgatgcaaccaccagcagggaatatcggcacagcctcctggagtgacccttgcctgccagagctcccattcccgggtcccttctgtcctcaggctctgggccacccccctgggggagatggctattttcccgaccttttcccaactccgtgccctcaggcccttggccgacagccatcaagtgcattatcttggatgcctgaaggcgcaaggcccggtaccggccctttactgtctaaagctaaggaagaacccccagccgcttcacttgaccagccatctgcgttggaggaagccagaggggatgataagaatagccatgtaccgtag

SEQ ID NO: 224602 - DNA, 1722 bp, Artificial Sequence
  Description of Artificial Sequence: Synthetic coding sequence
atggctaacgccgaagtgtctgttcccgtgggcgatgtggttgttgtcccgaccgaggggaacgaaggcgagaaccccgaagacacaaaaacgcaggtgatactgcagcttcagccagtgcagcagggattgttcattgatgggcacttctataaccggatctacgaagccggtagtgagaataatactgcagtggttgcagtcgagactcacacaatccacaaaatcgaagaaggtatcgataccggcaccattgaggctaatgaggatatggagatagcctaccccataacatgtggggaaagtaaggccatccttctttggaagaagtttgtctgtcccggaataaacgtcaaatgcgttaaattcaacgaccagttgataagccctaagcacttcgtacatctagctgggaaatcgactctgaaggattggaagagagccatccgattgggaggaatcatgttacgaaagatgatggacagcgggcagattgacttctatcagcatgataaagtttgttcgaatacctgtagatccactaagtttgacctcctgatcagctcagcacgggcacccgtgcctggtcagcagaccagtgtcgtccagacccccactagcgccgacgggagtatcactcagattgctatcagtgaagaatccatggaggaagctggactcgaatggaattccgctctgaccgcggcagtgacgatggctaccgaggagggcgtgaagaaagactctgaggagatcagcgaggacacattgatgttctggaaaggaattgctgatgtcggccttatggaagaagtggtctgtaacattcagaaagagatcgaggaactgttacgtggcgtacagcagcggctcatccaggcaccgttccaggtgacagacgcagccgtattaaataatgtggcgcacacattcggattgatggatacagtgaagaaagtcctcgacaaccgtcgaaatcaggtggagcaaggggaagagcagttcctgtacactctgactgatctcgagcgccaactggaggaacagaaaaagcagggacaggatcatcgcctaaaatcccaaacagtacaaaatgtggtgctgatgcccgtgtctactcccaaaccccctaaaaggccacgactccagcggcctgcatccacaacagtgctttcaccttctcccccagtgcagcagccacagtttacggtgatatctcctatcacaataacccccgtcggacagagtttctctatggggaacattccagtggcaactctgagtcaggggagctcacctgtgaccgtgcatacactgccttctggaccacagctattcaggtacgccactgttgtttcatccgcaaagtcatcaagcccggacactgtcaccattcacccgagctcctctctggcactactcagctcaactgctatgcaggatggatcgacgctggggaacatgaccaccatggtctctccggtggagctggttgcaatggaatcagggctgacttctgcaatccaggccgtcgagtcaacctccgaagacggccagacaatcattgagattgatcctgccccagacccagaggctgaagatacagagggcaaggcggtgatattagagacagaactgcgcaccgaggaaaaagtggtcgcagagatggaggaacaccaacaccaggtccacaatgtggagatagtggtcctggaggactag

SEQ ID NO: 224603 - DNA, 1692 bp, Artificial Sequence
  Description of Artificial Sequence: Synthetic coding sequence
atggcgaatgctgaggtatcggtccccgtgggtgatgtggtggttgtgccaactgagggcaatgagggcgagaatccagaggacaccaaaactcaagtcatcctacaactccagccggtgcagcaaggcatctatgaggcaggctcagaaaacaatacagctgtcgtggcagttgagacccacacgatccacaagattgaggagggcattgatacaggaacaatcgaagcgaacgaagatatggagatcgcctaccccatcacatgtggcgagagcaaggctattcttttatggaagaagtttgtttgtccaggaatcaacgtgaaatgcgttaagttcaacgaccagcttatcagtcccaaacacttcgtgcatctggctggaaagtctactctcaaagactggaaaagggctattagactcggaggcattatgctacgtaagatgatggactccggccaaatagatttttatcagcacgataaggtgtgttccaatacttgcaggagcacaaagtttgacctgcttatcagtagcgctagggcgcctgtccctgggcagcagacttcggtcgtgcagacccccaccagtgcagatggcagcattacgcaaattgcaatcagtgaggaaagtatggaagaggcagggctcgaatggaacagcgctttaacagcagctgtgactatggcgacagaagagggggtcaagaaagatagcgaggaaattagcgaggacaccttaatgttttggaagggcatcgctgacgtcggtctcatggaagaggtggtgtgtaatatacagaaagaaattgaggagctgctgcgcggtgtacagcagcggctcattcaggcaccatttcaggtcaccgatgcagcggtactgaacaatgtggcccatacattcggcttgatggatacagttaaaaaggtactggataatcgaagaaatcaggtggaacagggggaagaacagttcctgtacaccctgacagacctggaacgccaactggaagagcagaaaaaacaaggccaggatcaccggctgaagagccagacagtccagaatgtggtgctgatgcccgtttcgacccctaagcccccaaagaggcccagacttcaacgccctgcaagcactaccgtcctcagcccgagccctccagttcagcagccccagttcacagtgatctcacccatcactatcacccctgtgggccaatccttttcaatgggaaacattcctgtggctacgctgtcccagggctccagcccagtaacagtgcatacgcttccgtccggcccacagttgttccgctatgcaacagttgtaagcagtgctaagtccagcagccccgacactgtgaccatccaccctagttcatctctcgctctgctgtcgtccacggcaatgcaggacggctccactctcgggaacatgacaaccatggtgagtccagtggaactcgttgcaatggagtcaggattgacgagtgccattcaggctgtggagtctacaagcgaagacggccagacaattattgagattgatcccgcacccgatcctgaggccgaagacaccgaggggaaagcagtgattttagaaactgagctccgaactgaagaaaaagtcgtagcggaaatggaagaacatcagcaccaggttcacaacgtcgaaatcgtcgtgctggaggactag

SEQ ID NO: 224604 - DNA, 1692 bp, Artificial Sequence
  Description of Artificial Sequence: Synthetic coding sequence
atggcaaatgccgaagtctccgtgcctgtcggcgacgttgtggtggtacctacagaggggaacgaaggtgaaaatcctgaggatacgaagactcaagtaatccttcagctgcagccggtgcagcaagggatatatgaggctggctcagagaacaataccgccgtagtggcagttgaaacgcacaccatccacaagatcgaggaaggaatcgacactggaactattgaagccaatgaggatatggagatcgcgtacccgattacctgcggagagtccaaagctatattgctatggaagaaatttgtttgccccggaattaacgtgaaatgcgtgaaatttaatgatcagctcattagccctaagcatttcgtccacctggccggtaagtcaaccctcaaggactggaagcgggctatccggctcgggggaattatgctaagaaagatgatggatagcggccagatcgatttctatcagcatgataaggtctgttccaacacctgtcgttctacaaaatttgatctcctgatttctagtgcacgtgcaccggtccctggccagcagacctccgtggttcaaacacctaccagcgcagacggctctattacacagatagccatctcagaggaaagtatggaggaagcaggcttagaatggaattctgccctcactgctgctgttacaatggccacagaggaaggcgtgaagaaagactccgaagaaatatccgaagacaccctgatgttttggaaaggcatcgccgacgtcggcctcatggaggaggtcgtctgtaatatccagaaggagatagaagagctgctgcgaggcgttcaacagcgcctgattcaggcaccatttcaggttaccgatgccgctgtgcttaacaacgtcgcccataccttcggcctcatggacaccgtgaagaaagtattagacaatcgcagaaaccaggttgagcagggagaggagcagttcttgtacaccctgacagatcttgagaggcagctggaggagcagaagaagcaaggtcaggaccatcgtctaaaaagccagacagtacagaatgtagttctcatgcctgtaagcaccccaaagcccccaaaaaggcctcgactgcagaggccagcaagcactacagtcctctctccttccccgccagtgcagcaaccccagttcaccgtgatctcaccaatcacaataacacccgtcggacaaagttttagtatgggcaatattcccgttgctaccttatcccagggatcaagcccagttaccgtacacaccctgccaagtggccctcagctgttcaggtatgcaactgtggtgtccagtgctaaatcatcttcacctgacaccgtaactatccacccatcttcaagcctggccctcttgtcttcaaccgccatgcaggatggctcaacattgggaaacatgactacaatggtgtctccagtggagttagtggcaatggagtcgggacttacgagcgccattcaggccgtcgaatctaccagcgaggatggtcagaccattatcgaaattgacccagcccctgatcccgaggccgaagataccgaagggaaagccgtgatcttggagacggagcttagaaccgaggaaaaggtggtcgccgagatggaagagcaccagcatcaggtgcacaacgttgagattgttgtgttggaagattag

SEQ ID NO: 224605 - DNA, 1083 bp, Artificial Sequence
  Description of Artificial Sequence: Synthetic coding sequence
atgttacgcagactgccagctctggcagcaagaagacctccagccagaaggagaaggatttacgaggctggatccgaaaataacaccgctgtggtcgccgtagaaactcatacaatccacaagattgaagagggaatcgatacggggaccattgaagccaatgaagatatggagatcgcctatcctattacttgcggtgagagcaaggccatacttctctggaagaagttcgtttgccccggaatcaatgtgaaatgcgtgaaatttaacgatcaactgataagccccaaacatttcgtgcacctcgccggaaagtctaccctcaaagactggaaaagggccattagattggggggtatcatgctgaggaagatgatggacagtggtcaaattgatttctaccaacatgacaaagtttgttccaatacgtgcaggtccactaagtttgaccttctgatctcttctgcgagagctcctgtgccaggccaacaaacatccgtggtccagacccctacctccgcagacgggagcatcacacagatcgcgataagcgaggaatcaatggaggaggcgggactggagtggaattccgcgttaacagctgctgtaaccatggccaccgaagagggtgttaagaaggattctgaggaaatcagtgaggatacgctgatgttctggaaggggatcgccgacgtcggccttatggaggaagtggtctgtaatatccagaaagagattgaagaactgcttaggggcgttcaacagaggctgatccaggccccttttcaagtgacagacgcagcagtattaaataatgtggcgcatacctttgggttaatggacactgtgaaaaaggtactcgacaaccggcgaaatcaagtcgagcagggagaagaacagtttctgtatactctgacagatcttgaaaggcagctggaagaacagaaaaagcagggccaggaccataggctcaaaagtcaaacagttcaaaatgttgttctcatgcctgtcagcacccccaaaccgcctaagcgtccccgactgcagaggcctgcaagtacgactgtgttgtcgccgagctag

SEQ ID NO: 224606 - DNA, 1593 bp, Artificial Sequence
  Description of Artificial Sequence: Synthetic coding sequence
atggcaacacctgacgtgagcgtacacatggaggaggtggtagtggttaccacaccagacacagccgttgacggttctggggtggagggcgtgaagacagttctcgtgactaccaatttagccccacacgggggtgaccttactgaggacaatatggagacagagaatgcagctgcggctgcagctgctgccttcaccgctagcagccagctgaaggaggccgtgctggtgaagatggcggaggaaggagagaatctggaggctgaaatcgtttacccgatcacttgtggagactctcgagcaaatctgatctggcgcaagttcgtctgtccaggtatcaacgtgaaatgcgtgcagtacgatgagcatgttatctccccgaaggaattcgtgcacttggcagggaagtccaccctcaaagattggaaaagagcaatccgcatgaatggaataatgctacggaaaattatggactcaggggagcttgacttctatcagcacgataaggtgtgctccaacacatgtagatccacaaaaatcgatctctccggggcacgagtttctctctcttcccctacatcagctgagtatattcctctcacccctgccgcagccgatgttaatggtagcccagccacaatcaccatcgagacatgcgaagacccgggagattggactgccgcaattggcgacgacacctttactttctggagggggctcaaagatgctgggctcttggatgaggtgattcaggaatttcatcaggagttggtcgaaacaatgcggggtctgcagcaacgggtgcaggaccctcctctgcagctccgggacgcggttcttctgaacaatatcgtgcagaatttcggaatgctggacctggttaaaaaagtgctcgcctctcacaaatgtcagatggacaggtcacgcgaacaatacgccagggatctggctgcactcgagcaacagtgcgatgagcatagacgtagggccaaagagttgaaacacaaaagtcagcacttatcaaatgtcctgatgacgctcacccctgtgagcttgcctccccctgtcaagcgaccacgtctggcacgcgctacatccggcccagctgcaatggcgtcccaggtgctcacacagagcgcgcagcttgcactcggtccaggcgtgccggttccccagcttactagtgtgcctctgggtaaggtcgtatctacactgccaagcactgtactgggtaaggggagcctccaagcccctcctgcctcctctcctgcctctcccttgctgggtggatacaccgtccttgcttccagcggctccacctatccaagcactgtcgagatccatccggacgcttcatcactaactgtcctttcaacagcagctgtgcaggatgggtctaccgtcttcaaggtggtgagcccactgcagctgttgacccttccaggacttggccctaccctgcagaacgtggcccaggctagcccgggatcatcaacgattgttacagtccctgctggtgccgctcccggacctgaggagcacacggccaccatcgaggtcgccgcaatggcggaggatcatgagagaaagtag

SEQ ID NO: 224607 - DNA, 1440 bp, Artificial Sequence
  Description of Artificial Sequence: Synthetic coding sequence
atggaaactgaaaatgccgcagcagccgctgctgccgcttttaccgcttcatcacagctgaaggaagcggtactcgttaagatggccgaagagggcgagaacctggaagcagagatagtgtatccgatcacttgcggcgattcccgagctaacctgatctggcgtaagtttgtgtgtccaggtatcaacgtgaagtgcgtgcaatatgacgagcatgtgatatcccctaaggaattcgtgcacttggctggaaagagcacattaaaagattggaagcgcgctattagaatgaatgggatcatgcttcggaagatcatggactccggtgaacttgatttttaccagcatgacaaggtctgttctaatacttgccgcagtacaaaaatcgatctctccggtgcccgtgtgtccctatcgtcaccaacttctgccgagtatatccccctcactcccgcagctgccgatgtcaatggctctcctgccacgatcacgatagaaacctgtgaggacccaggggactggacggccgcaataggcgacgacaccttcactttctggcgcggactgaaagacgccggtttattagacgaagtgatccaggaattccaccaagaactcgttgagactatgagggggctgcagcagagggttcaggaccccccactccaacttcgggacgctgtgcttctcaataatatcgtccagaattttggaatgctggatctggtgaaaaaagtgttggctagtcataagtgccagatggacagatccagagagcaatacgccagagatctggcagcccttgaacagcagtgtgatgaacaccggaggagggcgaaagagctgaagcacaagagtcagcacctctctaatgtgctcatgactctaacgcccgtgtcactgccaccacctgttaagcgtccacgcctcgccagggcaacctcaggtcccgctgctatggcttcccaggtgctgacacagtccgcccagttggccttaggaccaggggtgcccgtaccgcaactgacctccgttccgctgggcaaagttgttagtaccctgccaagcaccgttcttgggaagggaagccttcaggctccccctgccagctcccctgcttcaccactgctcggcggttatacagttcttgcatcatctgggtccacttacccgagcaccgtagaaatccaccccgatgcgtcttcccttacagtgctgagcacggctgccgtgcaagatggtagcacggtctttaaagtagtgtctcccctgcagctgttaacattacccggtctaggtcccactttgcagaatgtggcgcaggcatcccctggatcaagcactatcgtgacggttcctgccggagcagccccaggccctgaggaacataccgcgaccattgaggtcgcagcgatggccgaggatcatgagcgcaagtag

SEQ ID NO: 224608 - DNA, 1593 bp, Artificial Sequence
  Description of Artificial Sequence: Synthetic coding sequence
atggccacacctgatgtgtcggtccacatggaggaggtcgtcgttgtgactacccctgataccgccgtcgatggctccggagtagagggagtgaagacggttctggtgacaacgaatctggcgcctcacgggggtgacttaacagaagataatatggaaactgagaatgcagcagcagcagcggcagccgcattcaccgctagctctcagctgaaggaagccgtgctggtcaagatggcagaggaaggggaaaacctggaggctgaaatcgtctaccctatcacctgcggcgattctcgtgccaatttaatctggagaaagttcgtgtgccccggtatcaacgtgaaatgtgtgcaatatgatgaacacgtcattagtccgaaagaattcgttcatctggcagggaagtcgacactgaaagactggaagagggcaatcaggatgaacggaattatgctgagaaaaattatggacagcggcgaactggatttttaccagcacgacaaggtttgctctaacacctgcagaagcaccaaaattgatctgagcggcgcacgcgtgtcactgtccagcccaacatctgccgaatacatccctctaacccctgcggctgctgacgtcaacggctcccccgcaacgattaccattgaaacgtgcgaagacccaggggattggactgcggcaattggggatgacacatttacattctggcgaggtctcaaggatgctggtctgctagacgaggtcattcaggagtttcaccaggaattagtcgagacaatgaggggcctgcagcagcgtgtccaggatccacccctgcagcttcgggatgcagtcctgctaaataacatcgtgcagaatttcggcatgctggacttagttaagaaggtcctcgcaagccataagtgccagatggacagaagccgagaacagtatgcgagagacctggcagcactagagcagcaatgcgacgagcatagacgccgtgccaaggaattgaagcacaagagccagcacctgagtaatgttcttatgacattaacacctgttagcttacctcccccagtgaagcgccctaggctagcccgagctactagcggacctgcagctatggcctctcaagtgctaacccagagcgcccagttagctctagggcctggcgtgcctgtgcctcagctcaccagcgtccctttaggcaaagtcgtgtccacacttccgtccacggtgctagggaagggctcactgcaggctcccccagcaagttccccggcatctcctcttttgggcggttacaccgtgctggcgagctccggctcgacatatccgagtactgtggagatacatcccgacgcgagcagcttgaccgtgctgagcactgcggctgtccaggacggctcaaccgtgttcaaagtagtgagccctctgcagcttcttacactgccaggcctgggtcctactcttcaaaacgtggctcaggcaagtcccggtagcagtacaatcgtcacggtccctgccggtgccgctcctggccctgaggaacacacagcaaccatcgaggtcgccgcaatggccgaggaccatgagcggaagtag

SEQ ID NO: 224609 - DNA, 1401 bp, Artificial Sequence
  Description of Artificial Sequence: Synthetic coding sequence
atggctatggatgtaactagaagccaggcacagaccgccctcacgctcgtagaacagatcctggctgaatttcagctgcaggaggaggaccttaaaaaggtcatgaggaggatgcagaaagaaatggaccgaggcctccgactggaaacccatgaagaggcaagcgtaaagatgctaccgacctacgtcagatccacccccgagggttccgaggtaggcgactttctttcccttgacctgggcggtactaactttcgggtgatgctagtgaaggtgggagaaggggaggaaggtcagtggtcagtgaagaccaagcaccaaatgtactccatccccgaggatgcaatgaccgggaccgctgagatgctctttgactacataagcgaatgtatttccgattttttagacaagcaccagatgaaacataaaaagctgccgctggggtttaccttttccttccctgttcgccatgaagacattgacaagggtatcctgctgaactggacaaaaggctttaaggccagcggcgcagagggcaataacgttgtcggactcctgcgggacgccatcaaacgtcgcggtgacttcgaaatggatgtcgtcgcgatggttaacgacacggtggcaaccatgatttcatgctattatgaagaccatcagtgcgaggttggcatgattgtcggtacaggttgcaacgcctgttatatggaggaaatgcaaaacgttgagctcgtggagggggacgaaggcagaatgtgcgtgaacactgaatggggcgcattcggggacagcggagagctcgatgagtttttgttggaatacgacaggctcgtggacgaatcctccgccaatccaggacaacagctgtacgagaagctaatcggcggaaagtacatgggcgagttggtgaggctcgtcctgttacgcttggtcgacgaaaatctcctgtttcatggcgaggctagtgagcagttacgcacaaggggggctttcgagacccgctttgtctcacaggtggagtctgacaccggtgaccggaaacaaatttacaacatactgtctactttaggtttgcgcccatctaccacagattgcgatatcgtaaggcgagcgtgtgaaagtgtcagcacacgggcagcccacatgtgcagtgctgggctcgctggcgtgatcaacaggatgcgggagtcccgttcggaggacgtgatgagaatcacggtcggtgttgacggtagtgtgtataagctgcaccccagtttcaaggaacgattccacgccagtgtcagaagacttactccctcctgcgagatcacctttatcgaatcagaagaggggagcggcagaggagctgccctggtgagtgccgtggcttgcaaaaaggcatgcatgttaggccagtag

SEQ ID NO: 224610 - DNA, 1395 bp, Artificial Sequence
  Description of Artificial Sequence: Synthetic coding sequence
atgccacgaccaagaagtcagctgccccaaccaaacagccaagtggaacagatcctggctgagtttcagctgcaggaggaggatttaaagaaagtcatgaggagaatgcaaaaagaaatggaccggggactgcggctcgaaacacatgaagaggccagtgtaaaaatgctcccaacctacgtaaggagtaccccggaggggagtgaggtgggagactttctcagcctggatctgggcggaacaaattttagagttatgctggtcaaagtcggcgagggtgaagagggccagtggtccgttaaaaccaagcatcaaatgtactctatacctgaggatgctatgactggaaccgctgagatgctgttcgactatattagcgagtgtataagtgattttctggacaagcaccagatgaagcacaagaagcttcccctcggattcaccttttccttcccagtacgccacgaggacattgacaaagggatcttgctcaactggaccaagggatttaaagcgtccggtgcagaaggaaataacgtggtaggcctgttacgcgacgcgattaaacgacgaggggatttcgaaatggacgtagtggcaatggtgaatgacactgtggcgacgatgatatcttgctattacgaggatcatcagtgtgaagttgggatgatcgttggcactggctgcaatgcttgctacatggaagaaatgcaaaacgtggaactggttgaaggtgatgaaggaagaatgtgtgtgaacaccgaatggggggcttttggtgacagtggggagttagacgagttccttcttgaatatgataggcttgtggacgagtcctccgcaaatcccggtcagcaactctacgagaaactgattggagggaaatacatgggagagctcgtgaggctggttctcttgcggttggtggatgaaaacttgctctttcatggagaggcctcggagcagctgcggaccaggggggcatttgaaacccgcttcgtgagtcaggttgagagtgatacgggtgacaggaaacagatctacaatatcctgtccaccctgggactgagaccgagcacaactgactgcgacattgtgaggagagcctgcgaatccgtgagcacccgtgcagcccatatgtgcagcgctggcctcgctggcgtgataaatagaatgcgtgagtctagatccgaggacgtgatgaggatcacagtgggggtcgacggctctgtgtacaaacttcacccatccttcaaagaacggtttcatgcctccgtccgaagactgacccccagttgtgaaataacgttcatagagtcagaggaaggatctggcagaggggcagccctggtttcggctgtcgcctgcaagaaagcttgtatgctgggccaatag

SEQ ID NO: 224611 - DNA, 1398 bp, Artificial Sequence
  Description of Artificial Sequence: Synthetic coding sequence
atgctggatgatcgagcacgcatggaggcggctaagaaggagaaagttgagcagatcttagccgagttccagctccaggaggaggatctgaagaaagtgatgagacgcatgcagaaagagatggacagggggctgcgcctggagacacatgaagaggcgtccgtgaaaatgctgcctacatatgtgagaagtacccctgagggttccgaggtgggggattttctgtcgctcgacttagggggtacaaattttagggttatgctggtcaaggtcggggagggtgaagaagggcaatggtctgttaagacaaagcatcagatgtactccatccccgaggacgcgatgactgggaccgccgagatgttgttcgactacatttccgagtgtatcagcgactttctagataagcatcagatgaagcacaagaagttgcctctcggctttactttttccttccctgtgcggcacgaggatatcgacaagggtatcttgttaaattggaccaagggcttcaaagctagcggggcagaagggaacaacgtggtcggcttgttgcgggatgccatcaagaggagaggagactttgagatggatgtggtcgctatggttaatgataccgtggcgacgatgatctcttgttactatgaggaccaccagtgtgaagtcggcatgatagtgggcaccggctgcaacgcttgttacatggaggaaatgcagaacgtagagctcgtggaaggggacgaagggcgaatgtgtgtgaacacagagtggggcgcttttggcgacagcggggaattagacgaattcctcctggaatacgacagactggttgatgagtcatcagcaaatccaggccagcagctctacgagaaactaattgggggaaagtatatgggagagctcgtccggcttgtactgttgcgcctggtcgatgagaacctccttttccatggcgaagccagcgaacaactgagaacccggggagccttcgaaacacgattcgtatctcaggtggaatcagatacaggggatcgcaagcagatctataacattctcagcaccctgggcctcaggccctcaaccacagattgcgatatcgtgcgtagggcctgcgaatctgtgtctacacgggctgcccacatgtgctccgccggactggctggggtgattaatagaatgagggaatcacggtcagaagacgttatgagaattaccgtgggagtcgacgggagtgtgtacaagctccatccatccttcaaggagcggttccatgcatcagtacgccgactgactccttcctgtgagattacatttattgagtcggaagagggaagtgggaggggagccgctttagttagtgctgtcgcttgcaagaaagcttgtatgttgggccagtag

SEQ ID NO: 224612 - DNA, 1878 bp, Artificial Sequence
  Description of Artificial Sequence: Synthetic coding sequence
atgcctggcacaaagcgattccagcatgtgatcgaaacccccgagcctggaaaatgggagcttagtggctacgaagctgccgtgccaattaccgagaaatcaaacccactcactcaagacctggacaaagcagacgccgagaacatcgtcaggctcctgggccagtgtgacgctgaaatcttccaagaggagggacaagctctttctacatatcagcgcctgtatagcgaatcgatactgacaaccatggttcaagtcgcaggtaaagttcaagaggtcttaaaagagccagacgggggtttggtcgtgctgagtggaggtggcacttcgggacgaatggcatttctgatgagcgtgagtttcaaccaattaatgaaaggtctcggccagaagccattgtatacatatctgattgctggaggggacagatctgtcgtggccagccgcgagggcacagaggactcagccctgcacggcatcgaggaactgaagaaggtggctgcagggaaaaagcgcgttatcgtcattgggatctcagtcggactgtcggcacccttcgtagcaggacagatggattgttgtatgaacaatacggctgtgtttctgcctgtcctggtcgggttcaaccccgtgtccatggcgagaaatgatcccatcgaagactggagttccacgtttagacaagtcgcagagcggatgcagaagatgcaagaaaaacaaaaagccttcgtgctgaatcccgcaatcggaccagaaggactgtctggaagctctagaatgaaggggggtagcgccaccaaaatcttgctagagacgttgctcctggccgcacacaagacggtggatcagggcatagccgctagccagagatgcttgctggagatcctgcgcacctttgaaagagcccatcaggtaacatacagccaaagccctaagatcgccaccttaatgaagagcgtcagcacctctctggaaaaaaaaggccatgtttacttggttggctggcaaacgctggggatcatagccatcatggatggggtcgagtgcattcacaccttcggcgcagacttcagggacgtgagggggttccttataggcgaccacagcgacatgttcaaccaaaaagccgaacttactaatcagggtccccagttcacattttcccaagaggatttcctgacgagcatcctgccttcactgacagaaatcgacaccgtcgtatttatctttacgctggacgacaatctgacagaggtgcagacaatagtcgagcaggtcaaagaaaaaacgaatcacattcaggctttggcccatagcacggtgggacagaccctgctcatacccctgaagaaacttttcccaagtataatttctatcacctggccgctccttttcttcgagtatgagggtaatttcattcagaaattccaacgagagctttctaccaagtgggtgctcaatactgtcagtaccggcgctcacgtgctcctgggaaagatcctgcagaatcacatgctggacctccgtatctctaattccaagctattttggagggcactggcaatgctccagcgtttttccggccagtccaaagcaaggtgcatagaaagcctgctccgcgctatccattttcctcagcccctgagcgatgacatccgcgctgcaccaatctcttgccacgtccaggtggcacatgagaaagagcaagttatccccattgcacttctgagtctcctgttcaggtgttccatcacggaagctcaggcacacttagctgcggctccgtccgtttgtgaagctgtgcggtcggccctcgcaggtccgggtcagaagcgcacagctgacccactggagatcctcgagcccgatgtccagtag

SEQ ID NO: 224613 - DNA, 1308 bp, Artificial Sequence
  Description of Artificial Sequence: Synthetic coding sequence
atggattgctgtatgaataataccgcggtttttctccccgtgttggtaggtttcaatcccgtgagcatggccagaaatgatcctatcgaagattggtcatccacgttcaggcaggtcgcagagcgcatgcagaaaatgcaggagaagcagaaggccttcgtgctaaaccctgcaatcggacctgagggtttgtctgggagtagcaggatgaagggtggatctgccacaaagattttattggagaccttgctgttggccgcacacaagactgtcgaccaaggcattgcggcaagccagagatgcctcctggaaatcctacgcaccttcgaaagagcgcatcaggtgacctattcacaatcaccaaaaatcgcgacgctaatgaagagtgtgtccacttccctggagaaaaaaggtcatgtttatctggtcggatggcaaaccctggggattattgcaatcatggacggggtcgaatgtattcacactttcggcgcagattttagagacgtccggggtttcctgattggagatcattccgatatgtttaatcagaaggccgagctgactaaccagggccctcagttcacgttctcgcaggaggattttctcacttcaattcttccaagcctcaccgagattgatactgtggtcttcatctttacactcgatgataacctgaccgaagtgcaaaccatcgtggaacaggtgaaagaaaagacgaaccacattcaggccctagcacattccactgtagggcagaccttgctgatccctctgaagaaactgtttcctagtatcatcagcattacatggccgctgctgttctttgagtatgagggtaacttcattcagaaattccagcgcgagttgtccactaaatgggtcctaaacacagtatcgacgggggcacacgtgctgctcggaaaaattctgcagaatcatatgctcgatctcaggataagcaacagcaagttattctggagggccctggccatgcttcagaggttttctggtcagtctaaggccaggtgtatagagtccctgctgcgcgctattcactttccccaacccctgagtgatgacattcgcgcagcccctatctcatgtcacgtgcaggtggcccacgagaaggaacaggttattcccatagcccttctctccctcctctttcgctgcagcatcaccgaggcccaggcccaccttgcggctgctcccagtgtatgcgaggccgtgagatccgccttggcaggcccagggcagaaacgcaccgccgatccactggagatcctagaaccggacgtccagtag

SEQ ID NO: 224614 - DNA, 1659 bp, Artificial Sequence
  Description of Artificial Sequence: Synthetic coding sequence
atgaggctgctgccgcttgcaccgggacgcctcaggcggggttctcctcgacatctcccatcttgctctccagcactccttctgttggttctcggtgggtgcctgggcgtgtttggagtcgcggcaggaactcggaggccaaacgtagtgctcctgctgacagacgatcaggacgaggttctgggcggaatgactccactcaagaagacaaaggccttaataggagaaatgggcatgactttttcctccgcctatgttccaagtgctctttgctgcccatctcgggcttcaatattgacaggtaagtatcctcacaatcatcatgtggttaacaacacattagaaggaaactgttcatccaagtcctggcaaaaaattcaggagccgaatacatttcctgcaatcttgcgctctatgtgtggctaccagacatttttcgcgggaaagtacctcaacgaatatggggcacctgacgctggaggattggagcatgtgccccttgggtggtcgtactggtatgctttagagaagaattctaaatactacaactacacactgtcaatcaatggcaaagccaggaaacatggggagaactactctgtggactacttgaccgatgtgctggccaacgtatctttagatttcctcgattacaagagtaattttgaaccattttttatgatgatcgcaacgcccgcacctcatagcccatggaccgctgctccccagtatcagaaagcttttcagaacgtgttcgctcctcgtaataagaattttaacattcatggaacaaataagcattggttgataagacaggctaagaccccaatgactaattcctcgatccaattcctggacaatgcttttcggaagaggtggcagacactgttgtcagtggatgacttagtagagaaactcgttaaaagactcgagtttaccggagagcttaacaacacctatatcttctatacctcggataacgggtatcacactggccagttttccctcccaatcgacaaacgacagctatatgaattcgatatcaaggtcccactcctggtgcgtgggccaggtattaagcccaatcagacatccaaaatgctagtagcaaatatcgatctgggcccaaccatcctcgatatagctgggtacgacctcaacaaaacacaaatggacggaatgtcccttctgccaattctgcgtggtgcatctaatctgacttggcgatctgatgttctggtcgagtaccagggcgaaggacggaacgtgacagacccaacctgcccaagcctctcacccggagtctctcagtgcttccctgattgcgtgtgtgaagacgcctacaataacacttacgcgtgcgtaagaactatgtccgctctgtggaacctgcagtactgcgagttcgatgatcaggaggtgttcgtggaggtttacaaccttactgccgatccggatcaaatcacaaacatcgccaagacaatcgaccccgagctcctcggcaagatgaactatcgtctgatgatgcttcagtcttgcagcggccctacttgtagaacccctggggttttcgacccaggctaccgcttcgacccaagattgatgttcagcaacaggggcagcgttcgcactcgacgcttttccaagcacctgctatag

SEQ ID NO: 224615 - DNA, 1410 bp, Artificial Sequence
  Description of Artificial Sequence: Synthetic coding sequence
atgtacgtgccttcagccctctgctgtcccagtcgcgcaagcatcctcaccgggaagtatcctcacaaccaccacgttgtgaataatactcttgagggcaactgctcctctaaatcatggcagaaaattcaggagcctaatacatttcccgctattcttaggtcaatgtgtgggtaccagacgttttttgccggtaagtacctgaatgagtacggagcacccgatgcagggggactggagcacgtgccactggggtggagctactggtatgctctcgagaaaaatagtaaatattacaattatacattgtccatcaatggcaaggcacgcaagcacggcgaaaactatagcgtggactatttaacagatgtactggctaatgtgtccctggactttctggactacaagagcaattttgagcccttttttatgatgattgccacccccgcacctcacagcccctggacggccgcacctcaatatcagaaggcgttccaaaacgtgtttgctcctcgcaataaaaattttaatatccatggcactaataaacactggctgatccgtcaggccaagacaccaatgacgaatagttccattcagttcctggacaatgcctttagaaaacgctggcagacactcctgagcgtagatgacctggtcgagaaattggtgaaaaggctagaattcacaggggaattgaacaatacctacattttttacacttctgacaacggttaccatactggacagtttagtctgcccattgataaacggcagctgtatgagtttgacatcaaagtccccttgctagtcaggggcccaggtatcaaacccaaccaaacttccaaaatgctggtggcaaatatcgatctggggcctacaatactggatatagcgggttatgacctaaacaagacccaaatggatggtatgtctttgctcccaatccttcgcggagccagtaacctgacgtggaggtctgatgtcctggtggagtaccaaggcgaaggccgtaatgtcacagaccccacctgccccagcttatctccaggggtttctcaatgttttcctgactgtgtgtgcgaggatgcttataataacacatacgcctgcgtgaggacaatgagcgccctctggaacctgcaatactgcgaattcgatgaccaggaagttttcgttgaggtgtacaacctcactgccgatcctgaccaaatcacaaacatcgccaagaccatcgaccccgaacttctgggaaagatgaactaccggctgatgatgttgcagtcctgctctgggcctacctgccggacaccgggagtgtttgatcccggataccggttcgaccccagactaatgttctcgaatagaggcagcgttcgaacccgtcggttttcgaagcacttactatag

SEQ ID NO: 224616 - DNA, 1599 bp, Artificial Sequence
  Description of Artificial Sequence: Synthetic coding sequence
atgcggttactcccgctagcccctggcagactccgtcgcggatcacctcgccacttaccgtcatgtagcccagcattattactgttggtgctgggtgggtgcttaggggtatttggcgttgccgcaggcactaggaggcccaacgtcgtgctgctgctcaccgacgatcaggacgaagtcctgggtgggatgtacgtaccatcagcattatgttgccctagccgagcgagcattcttaccggcaaatacccccataatcaccatgtggtgaataatactcttgagggcaattgttcttcgaagagttggcagaagatacaggaacccaatacgtttccagccattttgcgatcaatgtgtgggtatcagacttttttcgcagggaagtatctcaacgagtatggtgctcctgacgcaggtgggctagaacatgtgccccttggctggtcttactggtacgccctggagaagaattctaaatactacaattacacgctcagcatcaatggcaaagcaagaaagcatggcgaaaattatagcgtcgattacctcactgatgttctggccaacgtctctctggatttcctggactacaagagcaacttcgagcccttcttcatgatgatcgcaacccccgctccccacagcccatggactgcggcacctcagtaccagaaagcgtttcaaaacgtgttcgcgcctagaaataagaacttcaatatccatggtaccaacaagcactggctcattagacaagctaagacacccatgaccaattcatccatacagtttttggacaatgcttttcggaagcggtggcagaccttgctatccgttgatgacctggttgaaaaattggtgaagcgactggaattcaccggcgaacttaataacacatatatattctatacttccgataacggatatcacactggccaattcagcttgccaattgataagcggcagctctacgaatttgacatcaaggtccccctcctggtacggggaccaggaatcaagccaaaccagacttccaagatgctagtggcaaatatcgacttggggcctaccatcctcgatattgctggatacgatctgaataaaactcaaatggacgggatgtccttgctcccgatccttcgtggagcctcaaatctaacttggcgttccgacgtgctggtcgaataccagggcgagggacggaatgtgacagatcctacctgtccgtccctttcaccaggcgtctcacaatgtttcccagactgtgtgtgcgaggatgcatacaacaacacctatgcttgcgtcaggacaatgtcggccctgtggaacctgcagtactgtgagttcgatgatcaagaggttttcgtggaagtgtacaacctcacagcagaccccgatcagattaccaacatcgctaaaacgatcgacccagagttgctggggaagatgaattataggctgatgatgttgcagagctgtagcggcccaacttgccgcacccctggggtcttcgatccaggataccgctttgacccccgactgatgttcagtaatcgcggatccgtcaggaccagacgcttttctaagcatttgctgtag

SEQ ID NO: 224617 - DNA, 2154 bp, Artificial Sequence
  Description of Artificial Sequence: Synthetic coding sequence
atgcccatcggcgactgctcagtcgcagctaaacccagaaaacagctgctttgcagccttttccagaccacactggggtacagggctcgagcctccggatggaagccaatggtaatttgtcggggatcacatgcctttaaagatttgatcaacacatacaggatgatcgagcaggacgacttcgacatcaatacccgtctccataccatagtgcgcggtgaggatgaagcagcaatggttgagtccgtgggactggccttagttaagctaccggacgtattgaatcgcctgaaaccagacataatgatcgtgcacggggataggttcgatgccctggctttagccacttccgctgccctcatgaatattaggatcctccacatcgaggggggtgaagtatccggcaccatagatgactctatacgacatgctataactaagttggcacattaccacgtctgttgcacacgctcagctgaacaacacttaatcagcatgtgcgaagatcatgataggatcctcctggccggttgtccaagttatgacaaactgctatctgccaaaaataaagattatatgtctataatccgtatgtggctgggtgatgacgttaagtccaaagattacatcgtcgcacttcagcaccccgtgacaaccgacatcaagcattctattaagatgttcgagctcacactggacgccctgatttctttcaataaacgcacccttgtgcttttcccaaacatcgacgccggtagcaaagagatggtccgagttatgaggaagaagggaattgagcaccatcccaacttcagagctgtgaagcacgtcccttttgatcagtttatccagttagtggcccacgctgggtgtatgattggtaattcctcgtgtggtgtccgcgaggtaggtgccttcgggacccccgttatcaacctgggcacacggcagattggcagggaaactggggaaaatgtgctgcatgtacgtgacgctgatacccaggacaaaatcctccaggctctccatctccagtttggcaaacagtatccgtgcagcaagatttacggcgatggcaatgccgtgcccaggatactcaagtttctgaagagtatcgatctgcaggagccgctccaaaagaagttttgtttccccccagtgaaggagaatattagtcaggatatagatcacatactcgagaccctatctgcactcgcggtggacctcggagggaccaacctgcgggtggctatcgttagtatgaaaggggaaattgtgaagaaatacacccagtttaatcctaagacttacgaggagcgtataaatctgattctgcagatgtgtgtggaagccgcagcagaagccgtcaaactaaattgtcggatcctcggggtgggcatcagtacggggggaagggtcaatccgagagaaggaattgtgctgcacagcacaaaattgattcaggagtggaatagtgtcgaccttcgcacccccctgtctgataccctacacctcccagtctgggtggataatgacggaaattgtgccgctctggctgagcgtaagttcgggcagggcaaaggactggagaatttcgtaacactgattacagggacaggaattggtgggggtataattcaccaacatgaactgattcacggaagcagcttttgtgcggcagagcttggacatctggtggtgagtttagacggcccagactgctcttgtgggagtcatgggtgcatcgaagcctacgccagtgggatggctctgcagcgggaggctaagaagttgcatgacgaggacttattactggttgagggcatgtccgttcccaaggacgaagccgttggcgctcttcaccttatccaagcagcaaaactggggaatgcaaaagcacagtccatcttgcgaaccgcagggactgctctaggcctcggggtcgtgaacatactccacactatgaacccgagtctggtgatcctgagtggcgtgttggcaagccattatatccacatagtgaaggatgtgatccgtcagcaagcgctgagctctgtgcaggacgtggatgtggtggtgtccgatctagtggaccctgcactccttggcgcagccagcatggtcctggactacaccacgcggaggatatactag

SEQ ID NO: 224618 - DNA, 2169 bp, Artificial Sequence
  Description of Artificial Sequence: Synthetic coding sequence
atggagaagaatgggaataataggaagctgcgtgtttgtgtggcaacatgcaatagggcggattactccaagctggccccaattatgttcggaatcaagactgagcccgaattcttcgaattggacgtcgtggtccttggcagccacctgatcgatgattacgggaacacttatcgtatgatcgaacaggatgattttgacatcaacactagactgcacacgatcgttaggggggaggacgaagcagctatggtggagtctgtcggtttagccttagtcaaacttcccgatgtcctgaaccgcctgaaacccgatattatgatcgtgcacggtgaccgatttgacgcacttgcgttggctacatccgcagctctgatgaatatcaggattctgcatatcgaaggcggagaagtctccggaaccatcgatgactccatacggcatgccatcaccaagctcgctcattatcacgtatgttgcacccgcagtgccgaacagcatctgatttccatgtgtgaagatcacgaccggatcttgctcgcaggctgtccttcttatgataaattgctttcagccaagaacaaggactatatgtccatcatacgtatgtggctcggagacgatgtcaagtccaaagattacatagttgcgctgcagcaccctgtgaccactgacattaagcactccattaagatgtttgagctgaccttagacgccctcatatcatttaataagagaaccctcgtgttattccctaatatcgacgcagggtctaaggaaatggttagagttatgagaaaaaaggggatcgaacaccatccaaattttagagctgtgaaacacgtcccatttgaccagtttattcagcttgtggctcatgccggttgtatgatcggtaactcctcctgtggggtcagggaggtgggagcattcgggaccccggtgattaacttggggacgcggcaaattggacgtgaaactggggaaaacgtgctgcacgtgcgggatgctgacacccaggacaagatccttcaggctctccacctacagttcggtaaacagtatccctgcagtaagatttatggcgacggaaacgcagttccacggattttgaagtttttaaagtctattgaccttcaggagcccctccagaagaaattctgcttcccgccagttaaggagaacatctcacaggatatcgatcacattttagaaacactctccgccctggcagttgacctgggaggaacaaacctgagagtggctattgtgagcatgaagggtgaaattgtgaagaagtatactcagttcaacccaaaaacatacgaggagagaatcaacctaatactacagatgtgcgtggaagcggctgccgaagcagtgaaactgaattgcaggatcctgggggtgggaatcagcacgggaggcagagtgaatccacgagagggcatcgtgctgcatagtacaaaactgatccaggagtggaattctgtcgatcttagaaccccactctccgacactttacacctcccagtctgggtggataacgatggcaactgcgccgcactagccgaaaggaagttcggccagggtaaaggtctggagaattttgttactcttatcactgggacaggcatcggcggagggattattcatcagcacgagctgatccatggctcgagcttctgtgctgctgaattaggccacttggtggtttcactggatggacctgactgttcttgcggctcacatggctgtattgaagcttacgcctctgggatggctctccaacgcgaggctaagaaactgcacgatgaggaccttctcctggttgagggaatgtccgtccctaaggacgaggcagtaggcgctctgcatctgattcaggccgcaaaactgggaaatgcaaaagcccaatccatactccggacagccggaacagccctgggacttggcgtggtgaatattctgcacaccatgaatccatcactcgttatactttcaggagtgttggcctcacactacatccacattgtgaaggacgttatcaggcaacaagccctatcgtcggttcaggacgtagacgtcgtggtgtctgatctggtggatcctgccctgctgggcgcagcatctatggtgcttgattacactacccgccgaatctactag

SEQ ID NO: 224619 - DNA, 2262 bp, Artificial Sequence
  Description of Artificial Sequence: Synthetic coding sequence
atggagacctatggctacctgcagagggaatcatgtttccagggaccccacgagctgtacttcaagaatcttagcaagcgcaacaaacagattatggaaaagaatggaaacaaccgcaaactgcgagtttgcgttgcaacctgtaaccgtgctgattatagtaagctagcgcctatcatgtttgggatcaagactgagccagagttctttgagttggatgtagtcgtattggggtctcacctcatcgacgattatgggaacacttatcggatgatagagcaagacgatttcgacatcaataccagattacatactatcgtgagaggagaggacgaggcggctatggtagagtctgttggccttgcgctggtcaagcttcctgatgtgctgaataggttgaagccggacattatgatagtccatggggacaggttcgatgctctcgctcttgctacctctgcagcacttatgaacatccgtatactgcatatcgagggaggggaagtctctggaactatcgacgattccatacggcatgcaatcacaaagctggcccactatcacgtttgttgcactcgaagcgctgaacagcatttgatctcaatgtgcgaggatcatgatcgcatactccttgcaggctgcccttcgtatgataagctcctcagcgctaaaaacaaggattacatgtccatcatcagaatgtggctcggggacgatgtaaaatcaaaggactatatcgtagccctgcaacaccccgtgactactgatataaagcattccatcaaaatgtttgagctaactctggatgccctcatttccttcaacaagcgcaccctggtgttattcccgaacatcgatgccggatccaaggaaatggtccgcgtaatgagaaaaaaagggatagaacaccatcccaattttcgcgcagtgaagcacgtccctttcgatcagttcattcagttggttgctcatgcaggatgcatgataggcaattcctcctgtggagtgcgagaggttggggcttttggcacgccagtcataaacctcggaactagacaaattggcagggagacaggtgagaatgtactccatgtaagagatgccgatacacaggataagatcctgcaggccctccacctacagtttgggaagcaatacccctgctctaagatctatggtgatggaaacgctgtcccacgtattcttaagtttttgaaatctatcgatctccaggagcccttacagaaaaagttttgtttccccccagttaaggaaaacatctctcaggacattgaccacatcctcgagacactgtccgccctcgccgtggacctgggtggaacaaatctgagggttgcgatagtatctatgaaaggagagatcgtgaagaaatacacacagtttaaccccaaaacctatgaggagaggatcaatctcatcctgcagatgtgcgtggaggcagccgcagaagctgtgaagctgaactgcagaatcctaggggtggggatttctactggtggacgtgtcaacccgagagagggaatagtgttacacagcactaaactgatccaggagtggaattcggtggacctcagaactccattaagtgataccctgcatctgccagtgtgggtggataacgatggcaactgcgccgctctggccgagcgcaagtttggacaggggaaaggattagaaaactttgtgacactgatcacagggacagggataggaggcggtatcatacaccagcatgagctgatacatggctcttccttctgtgccgcagaacttgggcacctggttgtgtcccttgatggtcctgactgttcttgtggctcgcatggttgcattgaggcctacgcatccggcatggccctccagcgggaagctaagaaattgcacgacgaagatctgctgttggttgaaggtatgagcgtaccaaaagacgaggctgtcggagcgctgcatttgattcaggccgcaaagttggggaacgctaaggcgcagtctatactgagaaccgccggaacagccctgggactgggcgttgtcaacatcctacacaccatgaatccatccctggtcatactgtctggggtactagcatcacactacatacacatcgtgaaggacgtaatccgacagcaggccctgtcgtctgtgcaggacgtcgacgtcgtggtgtcggaccttgtggatcctgccctgttaggagctgcttccatggttcttgattacactacacgtaggatctattag

SEQ ID NO: 224620 - DNA, 399 bp, Artificial Sequence
  Description of Artificial Sequence: Synthetic coding sequence
atgttcgagttgactctcgacgctcttatcagcttcaataagaggacccttgtgcttttccccaacatagacgccggttcgaaggagatggtgcgtgtgatgagaaagaaaggcatcgaacaccaccctaacttcagagctgtgaagcatgtgcccttcgaccagttcatccagctcgtggcccacgcaggatgcatgatcggaaactcaagctgtggtgtgcgagaggtcggggctctgacgaggctgtacacatacgtgagttgctataaacacacacatacacacacccacacccatccttcttcctctaatcccaaacttcgcagtcagaaagtgatccaatccgaaaaccgcggtaaatcttatcaagagggtctgaaatacaccttcttctag

SEQ ID NO: 224621 - DNA, 2169 bp, Artificial Sequence
  Description of Artificial Sequence: Synthetic coding sequence
atggaaaagaatgggaataatcggaagctacgtgtttgtgttgccacctgcaaccgtgcagactacagcaaactggcccctatcatgtttggcatcaagactgagcctgaattttttgagctggacgtcgtcgtgctcggctcccacctcattgatgattacgggaacacataccgaatgattgaacaggatgactttgacatcaacacacgcttgcacactattgtccggggagaagatgaggctgcaatggtggaatctgtggggctcgcactggtgaagcttccagacgtgcttaacaggctgaagccagatatcatgatcgtgcacggcgacaggttcgatgcactcgctctggctacatcagcagctttgatgaacattagaatactccatatcgaaggcggtgaagtgagcggtaccattgacgatagtattagacatgccataacaaaactggcacactatcatgtgtgctgtactcggtcagccgaacaacacctcatttcaatgtgtgaagaccatgatagaatacttttggccggatgcccaagttatgacaagctgctgagcgcaaagaataaggattacatgtccatcattcgtatgtggctgggcgacgatgtgaagtctaaggactacatcgtcgccctgcagcaccccgtgaccactgacatcaagcacagtataaaaatgttcgaactcacgctcgacgccctgatctcatttaataagcgcactttggtccttttccctaacatcgacgccggttcaaaggagatggtgagagtgatgcggaaaaagggaatcgagcatcaccccaacttccgagcggtgaaacacgtgccattcgatcagttcatccagctagtagcccatgccggatgtatgatcggcaactcttcttgtggggtgcgggaagtgggagctttcgggacgccggtgattaatctgggaactcggcaaattggtagggaaacaggagagaatgtcctccacgtccgtgatgccgacacacaggacaaaatattgcaagcgctacatctgcagtttggaaaacaatacccgtgtagtaagatctatggagacggaaacgcagttccacggatacttaagttccttaagtctatagatctccaggaacctctgcagaagaagttctgcttcccccctgtaaaggagaacatctcacaagatatagaccacattttggagacactgtcagcactcgccgtcgacttgggcggaacaaatcttcgtgtcgccattgttagtatgaaaggggaaatcgtgaagaagtatacccagttcaaccctaaaacgtatgaggagcgaattaaccttatcctgcagatgtgcgtggaagccgcagctgaggctgtcaagctgaattgcagaattctaggcgtcgggatatcaactggcggacgggtaaacccccgtgagggtattgtactgcattcaacaaagttgattcaggaatggaattctgtcgacctgcgcactcctctgtccgacacattgcacctcccagtctgggtggacaatgacggcaactgtgccgcactggccgagaggaaattcgggcaaggaaagggcctggaaaactttgtgaccctcattacaggcacaggtataggcggaggtattattcatcagcatgaactcatacatggatcatccttttgtgccgcagagctgggccacttagtcgtcagcttggacggaccagattgcagctgtggatcgcacggatgcattgaagcttacgcctctgggatggcactacagcgggaagcaaagaagctgcacgatgaggacctccttttagtggagggtatgtcagtccctaaagatgaagcagtgggcgctctgcacctcatccaggcagccaaactcggtaacgccaaggcacaaagcatcctgaggacagccggaaccgccttgggcctcggggtagtcaacatattgcacacgatgaacccttcattagtgatcctctctggggtgttggcgtcccattacatccacattgtaaaagacgtgatccgacaacaagctctttcctctgtgcaagacgtcgacgtcgtcgtcagcgacctggtcgatcctgccctgctcggagcagcctctatggtgctggattatactacacgcagaatctattag

SEQ ID NO: 224622 - DNA, 1947 bp, Artificial Sequence
  Description of Artificial Sequence: Synthetic coding sequence
atggaaaagaatggaaataatagaaagctccgcgtctgcgtggccacctgtaaccgagccgattacagcaaactcgctccaataatgttcggaattaaaactgaacccgaattcttcgagctcgacgtggtggtcctgggctctcatcttattgatgattatggcaacacctaccgcatgatcgaacaggatgacttcgatatcaacacacggttacacaccatcgtgcgtggggaggacgaggcagctatggtggaaagcgtcgggctggctctggttaagctgcccgacgtgctaaaccgtcttaaaccagatataatgattgtgcatggtgaccgctttgacgccctcgcactcgcaacaagcgctgctctgatgaacattcggattctgcatatcgagggcggagaggtgtccggtactatcgacgactccatccgtcacgccatcaccaagctcgcacactatcatgtttgctgcacccggagcgccgaacagcatctgatctcaatgtgcgaggatcatgaccggatcctgctcgccggatgcccctcttatgataagctcctgagtgctaagaataaggactacatgagtatcatccgcatgtggctcggtgatgacgtgaagtccaaagattatatcgttgcactgcagcatcctgtcactaccgacataaagcatagtatcaagatgttcgaactgaccctcgatgcattgatttcgtttaacaagcgaacgctggtgctctttccaaatattgacgcgggatcgaaggagatggtgagggttatgcgaaagaaaggaatagagcatcaccccaactttcgtgctgttaagcatgtgccattcgaccaattcatccagttggtggcccacgccggatgcatgattggcaacagctcatgtggagtgcgggaggtcggcgctttcggaactcccgtgattaatctgggaacgcgacagataggaagagagaccggggagaatgtcttgcacgtaagggacgcggacacccaggacaagatcctacaggccctgcatttgcagttcggaaagcagtacccttgctctaagatctatggagacggcaatgctgttccaaggattctcaagtttctcaagagtattgatctgcaggagccattacagaaaaagttctgcttcccacccgtgaaagagaacatttcccaagatatcgaccacatcctcgaaaccttaagcgcactggccgtcgaccttggtggcactaacctacgagttgccatagtttccatgaagggcgagatcgtcaagaaatacacccagttcaaccctaaaacatatgaagaaaggattaacctcatattacagatgtgcgttgaagccgctgctgaggccgttaagctcaactgcagaattttaggcgtcggtattggcggagggatcattcatcagcatgaattgatacacggctctagtttctgcgcggctgaacttgggcatttagtagtgagcctggatgggcctgactgctcttgtggtagccacggctgcattgaggcctatgcttccggtatggccctacagcgggaagctaagaaactgcacgatgaggatcttttgctggtggagggcatgagcgtgccgaaagacgaggcagtaggcgcactgcacctgatccaggccgctaaattggggaatgctaaggcacagagtattcttagaaccgccggaacagccctaggcctgggggtagtgaacatcctccacactatgaacccctccctagtgattttgagtggggtgttggcttcacattatatccatattgtgaaagacgtcatcaggcagcaagccttgtccagcgttcaggacgtcgacgtcgtcgtgagtgacctagttgatcctgcattgttaggcgctgcctccatggtcctcgactacaccactagacggatttactag

SEQ ID NO: 224623 - DNA, 1839 bp, Artificial Sequence
  Description of Artificial Sequence: Synthetic coding sequence
atgattgagcaagacgactttgacatcaacacccgcctgcataccatcgtccgaggagaggacgaggctgccatggtagaatcagtggggctggccctggtgaaactcccggatgtcttgaataggctgaaacccgatatcatgatcgtgcatggggaccgcttcgacgccctggctctggcaacatcagctgcccttatgaatattagaattctgcacatcgagggaggcgaggtgtccggcactatcgatgacagcatcaggcacgccatcacaaaactagctcactaccacgtctgctgtaccagatctgccgaacaacatctgatctcaatgtgtgaggatcatgaccggattctactcgcgggatgccccagttacgacaaactgttaagtgcgaaaaataaggattacatgtcaattatcagaatgtggctgggttctaaggagatggtgagagtcatgcgcaagaagggcatcgaacatcatccgaatttccgggctgttaagcacgtccccttcgatcaatttatccagctcgtggcccatgccggatgcatgatagggaactctagctgtggcgtgagagaggtgggcgcatttggtacgcccgtaataaacctcggaacaaggcagatcgggagggagaccggcgaaaacgtgctccacgtcagggatgccgatacacaggacaaaatcctccaggcacttcacctacaatttggcaaacagtacccctgcagcaaaatttacggagatggtaatgccgttccgcgtatactaaagtttctgaaaagcatagatcttcaagaacctcttcagaaaaagttctgtttcccccctgtgaaggaaaacattagtcaggacatcgaccacatcctggaaacactgagcgccttagcagttgatcttggcggtactaacctaagggtggcaatcgtgagcatgaaaggtgagatcgttaaaaaatatactcaattcaaccctaaaacatatgaagagaggataaacctgatccttcagatgtgcgtggaggccgcagctgaggctgttaagctcaattgtcgcatactcggggtgggcatttccaccggcggaagagtgaatccgagggaaggtatagttctgcactccactaagctgatacaggagtggaatagtgtcgacttaagaacgccattgagcgacactctccacctaccggtgtgggtggacaatgacggaaactgcgccgcactggcggagcggaagttcggacaagggaaaggcctggaaaatttcgtcactctcatcacggggacgggcattgggggagggatcatacatcagcatgagttaatacacggaagctctttctgtgccgctgaactgggtcatctcgtggtatcactggacgggccagactgctcttgcgggagccatgggtgcatcgaagcttatgccagtggcatggccctgcagagggaggccaagaagttgcatgacgaggacctcctgctagtggaagggatgagcgtgcctaaagacgaagccgttggcgctctccatttaattcaagctgccaagctgggaaatgccaaggctcaatccatcctgcgcaccgctggcactgctctgggattgggtgtggtaaacattctgcacaccatgaacccttccctggtgatactctcaggtgtgctggccagccattacattcatattgtgaaagacgtgatacgccagcaagccctgtcctccgtgcaagatgtcgatgtcgtcgtctccgatcttgtggaccccgcattactgggggctgccagcatggtgcttgattacactactcgtaggatctactag

SEQ ID NO: 224624 - DNA, 870 bp, Artificial Sequence
  Description of Artificial Sequence: Synthetic coding sequence
atgaagctgataattcttgagcattactcccaggccagtgaatgggcggcaaagtacatccggaacaggattatccagttcaaccctggccctgaaaaatattttacgctcgggctgcccactggctctacgccacttggctgttacaaaaagctgatcgagtactacaagaatggcgacttaagtttcaagtatgtgaagacatttaacatggacgaatacgttggtctccccagggaccaccccgagagctatcactctttcatgtggaacaactttttcaagcatatcgacatacacccggaaaacacccatatactggacggcaacgcggtcgacttgcaagctgagtgtgatgcattcgaggagaagattaaagcggcaggcggaatcgaactcttcgttgggggtatcggcccagatggccacattgccttcaacgagccaggctcttcactggtgtcgaggacccgagttaaaaccctggccatggacactattctcgccaatgcgaggttcttcgacggagagctcacgaaagttccaacaatggcattgacagtgggcgttggcaccgtgatggacgccagggaggtaatgattctgattactggcgcacataaagcttttgccctgtacaaggcaatcgaggagggagtgaaccatatgtggaccgtctcagcctttcagcagcatcctaggactgtgttcgtttgcgacgaggatgccactttagagttgaaggttaagactgttaaatattttaaaggattgatgctggtgcacaacaaactagtggatccactgtactcgatcaaagaaaaagagacagagaaaagccagtctagcaaaaaaccttattccgactag

SEQ ID NO: 224625 - DNA, 768 bp, Artificial Sequence
  Description of Artificial Sequence: Synthetic coding sequence
atgaaacttattatcctggaacattacagtcaggcgtccgaatgggctgcaaagtatattcgcaaccggatcattcagttcaacccaggtccagaaaaatattttaccctgggcttgcctacaggtctgccgagggaccaccctgagtcctaccatagcttcatgtggaacaactttttcaagcacattgacatccaccccgaaaatacccacattttggatgggaacgccgtagacctgcaagcggaatgtgacgccttcgaagaaaagatcaaagccgcagggggaatcgagttgtttgtgggaggtatcggccctgacggccatattgcctttaacgagccaggttcttcacttgtgagcaggactagggtcaagacattggccatggatacaatccttgccaatgccagattctttgatggggaattgaccaaggtaccaacaatggctctgacagtgggcgtgggcaccgtcatggacgctcgcgaggttatgattctaatcaccggagctcacaaagcgttcgccctgtataaagccattgaggagggagtgaaccacatgtggaccgtctctgctttccagcagcatccaagaactgtctttgtgtgtgatgaagacgcaactctcgagctgaaagtcaagacagttaagtactttaagggtctgatgctggtgcacaataagcttgttgatccactgtactccatcaaagagaaagaaacggagaagtcacaatctagcaagaaaccgtattccgactag

SEQ ID NO: 224626 - DNA, 870 bp, Artificial Sequence
  Description of Artificial Sequence: Synthetic coding sequence
atgaagctcatcattctcgaacactattcacaggcttcagagtgggccgcaaagtacatcagaaataggataattcagtttaatcctggccctgagaaatatttcactctcggtctgccgactggatctacccctctgggttgctacaagaaactgatagagtactataagaatggagatctttctttcaagtatgtgaaaaccttcaatatggatgaatatgttggactcccacgagaccatcccgagtcctatcactcatttatgtggaataattttttcaagcacattgatattcatcccgagaatacccacatactcgacgggaatgcggtagacctacaagcggagtgtgatgcgtttgaagaaaaaattaaggcagcgggagggatcgaactctttgttggaggaatcggtcctgacggccatatcgcctttaatgaacctgggtccagtcttgtgtctcggactcgggtgaaaacacttgccatggacaccatcctggccaacgcgaggttcttcgacggagagctaaccaaagtgcctactatggccctgaccgtcggtgttggtaccgtgatggacgctagagaagtgatgatactgatcacgggcgcacacaaggccttcgctctttacaaagccatcgaggagggcgtcaatcacatgtggaccgtatcagcattccagcagcacccacgcacagtgtttgtatgcgatgaggacgcaacacttgagctcaaggttaagaccgttaagtatttcaagggcctaatgctggtgcacaacaaattagtggatccgctctacagcattaaggaaaaggaaacggagaaatctcagagtagcaagaaaccatactcagattag

SEQ ID NO: 224627 - DNA, 417 bp, Artificial Sequence
  Description of Artificial Sequence: Synthetic coding sequence
atgaaattaattatcttggagcactactctcaagcaagtgaatgggctgcaaagtatattcgcaatcgtattatccagttcaaccccggacccgaaaagtacttcactctgggcttgcctactggctccactcctctgggatgctacaaaaagctgattgaatactacaaaaatggcgacctgagcttcaagtacgtcaaaaccttcaatatggatgaatacgtgggcctgcccagggaccatcccgagtcctaccattcattcatgtggaataactttttcaaacacatcgacattcaccctgagaacacacatatcctggatgggaacgctgtggatctgcaagccgagtgtgacgccttcgaggagaagattaaagccgctggagggattgaactcttcgtgggtgggatctag

SEQ ID NO: 224628 - DNA, 870 bp, Artificial Sequence
  Description of Artificial Sequence: Synthetic coding sequence
atgaagctcattatcttggagcattactcccaagccagcgagtgggccgctaagtacattagaaaccgcattattcaattcaatcctggcccagagaaatacttcactttgggactccccacgggctctacccctctgggctgctataaaaaactgatcgagtactataagaatggagatctctccttcaagtacgtcaaaaccttcaatatggatgaatatgtggggctccctagagatcacccagagtcctaccatagtttcatgtggaataatttctttaaacacattgacatccatcccgagaatacccatatcctggatggtaacgcagtggatctgcaggctgagtgtgacgccttcgaggaaaaaataaaggctgcaggcggaatcgagctgtttgttggcggaattggacctgatggccatatagcctttaacgagcccggttcttctcttgtatccagaacacgggtcaagaccctcgctatggataccatcctcgcgaacgccaggtttttcgatggcgaattaactaaggtccctacgatggccttgactgtgggtgtgggcactgttatggatgctagagaggtgatgatcctcataacaggcgcacataaagccttcgcactgtataaggcaatagaggaaggtgtcaatcatatgtggactgtgtccgcatttcagcagcacccccgtactgtgtttgtgtgcgacgaggacgccaccttagaactgaaggtcaaaacggtcaaatatttcaagggcctgatgttggttcacaacaagctcgtggaccctctgtattccatcaaagaaaaagagactgaaaagtcacagtcaagcaagaagccttacagcgactag

SEQ ID NO: 224629 - DNA, 90 bp, Artificial Sequence
  Description of Artificial Sequence: Synthetic coding sequence
atgaagctaatcatcctcgagcattatagtcaggccagcgagtgggctgccaaatatatccggaatcgcataatccagttcaacccatag

SEQ ID NO: 224630 - DNA, 870 bp, Artificial Sequence
  Description of Artificial Sequence: Synthetic coding sequence
atgaagttgatcatcctggagcactattcccaggcctccgagtgggctgcaaaatacatcaggaatcgaattattcaattcaatccagggccagagaagtacttcaccctagggctgcccacaggaagcacacctctcggctgttacaaaaaattgatcgagtactataaaaacggtgatctctccttcaaatatgttaaaaccttcaatatggacgagtatgtcggcctacccagggatcaccctgagtcttatcactccttcatgtggaataatttctttaagcatattgacatccatccagaaaacacgcacatattagacgggaacgcggtcgacctgcaggccgagtgcgacgcctttgaggaaaaaataaaggcagctggtggcatcgaacttttcgtggggggtattggaccagatggccatatcgccttcaatgaaccaggttcttcgctggtctcaagaaccagggtcaaaactctcgctatggacaccatcctggccaacgccaggttcttcgacggagagctgacgaaagtccctactatggcactcactgtaggagtggggacagtgatggatgcacgagaggtgatgattctgatcaccggagcgcataaggccttcgctctctacaaggctattgaggaaggggtgaatcacatgtggaccgtcagtgcgttccagcaacacccacgcaccgtatttgtttgcgacgaagacgccacactggagctcaaggtaaagacggttaagtacttcaaaggcttgatgttggttcacaacaagttagttgaccctctttatagcatcaaagagaaggaaaccgagaagtcccagtcctccaagaagccatacagtgactag

SEQ ID NO: 224631 - DNA, 486 bp, Artificial Sequence
  Description of Artificial Sequence: Synthetic coding sequence
atgaagctgattatcctggagcactactctcaagctagcgagtgggctgccaaatatattcgaaataggataatccagtttaatcccggtccagagaaatatttcacactcgggttacccaccggctccacgcccctgggctgctataaaaagcttattgaatattataaaaacggcgatctgtccttcaagtatgtcaaaacctttaatatggacgaatacgtaggtcttcccagagatcatccagagagctaccacagctttatgtggaataacttcttcaaacatatcgacattcatcctgagaatacccacatcctcgacggcaatgccgtggatctgcaggcagaatgcgacgctttcgaggaaaagatcaaggccgcaggaggtattgagctgttcgtgggaggaattggtcccgatgggcacatcgcatttaatgagcctggtagcagccttgtgtcccgcaccagggtcaagacctag

SEQ ID NO: 224632 - DNA, 639 bp, Artificial Sequence
  Description of Artificial Sequence: Synthetic coding sequence
atgaagctcattatcctggaacactattctcaggccagcgaatgggcagcaaagtacattcgcaacagaataatacagtttaaccctggccctgagaaatacttcacgctggggctcccgaccggatcaaccccactcggatgctataagaaattgattgaatactacaagaacggagacctcagctttaaatacgtaaaaacgtttaacgaacccggaagctctctcgtatctcgcacacgcgtgaagacattggcgatggacaccatcctggcaaatgcgcgtttcttcgacggagagttaaccaaggtgccaacaatggccctaactgtaggggtgggcaccgttatggatgcaagagaggttatgatactgattactggcgcacataaggcttttgcactatataaggctatcgaagaaggcgtgaatcacatgtggaccgtgagcgcgtttcagcagcaccctcggaccgtcttcgtctgcgatgaagacgccactttagaacttaaagtcaagacagttaagtatttcaaaggactgatgcttgtacataacaaactcgtcgatcctctgtattctattaaagagaaagagacggaaaagtctcagagcagcaagaagccttactctgactag

SEQ ID NO: 224633 - DNA, 831 bp, Artificial Sequence
  Description of Artificial Sequence: Synthetic coding sequence
atgagactcgtgatcctggacaattacgatctggccagcgaatgggctgctaaatacatttgcaatcggataatccaattcaagcctgggcaggaccggtactttactcttgggctgcctacaggcagtaccccgctcgggtgttataagaagttgattgaataccacaaaaatgggcacctctcatttaaatatgtcaagacttttaatatggatgagtacgtgggcctgcctaggaaccaccctgagagctaccattcatatatgtggaacaacttttttaaacatattgacatagatcctaacaatgcacacattctggatgggaacgcggcagatttacaggctgagtgtgacgctttcgagaataaaattaaggaagctggcggtatcgacctgttcgtgggaggtatcgggccagacggacatattgcattcaacgagcccggttcctcactggtcagccggaccagattgaaaaccctcgctatggatacaatccttgcgaatgctaagtactttgatggcgacctgtcgaaggtgcccacgatggcccttacagtgggcgtgggcacggtgatggatgctcgcgaggtaatgattctgattaccggagcacacaaagcgttcgctctgtataaggccattgaggaaggcgtgaaccatatgtggaccgtctccgcttttcagcagcacccgagaaccatcttcgtctgtgacgaggatgcaacactggaactacgggttaaaaccgttaaatactttaagggccttatgcacgtacataataagctggtcgatccactcttttcaatgaaagacggaaactag

SEQ ID NO: 224634 - DNA, 780 bp, Artificial Sequence
  Description of Artificial Sequence: Synthetic coding sequence
atgcggctcgtgatccttgataactacgacctcgcttctgagtgggccgcaaagtatatctgtaatcggatcatccaatttaagcccggacaggaccggtactttacgctgggcttaccaactgggtccacaccgctgggatgttataagaagctcatcgaataccacaagaatggccacctgtccttcaagtacgtcaagaccttcaatatggatgagtacgttgggttgcccagaaatcacccagagagctaccacagttacatgtggaataattttttcaagcatatcgacattgacccaaataacgcccacatactggacggcaatgctgcagatctacaagcagagtgtgacgctttcgaaaataagatcaaagaagctggcggtatagatttgttcgttggcggtattgggccagacgggcacattgcatttaatgaaccgggatcgagtctggtttctcggaccaggctgaagactttggctatggacaccatcctggccaacgccaagtacttcgatggtgatctgtcaaaggtgccaactatggctctaaccgtcggagtgggaacagtgatggatgccagggaggtgatgattttgataactggagcgcataaggcctttgccttatacaaggccatagaagaaggcgtcaaccatatgtggacagtgtcagcttttcagcagcatccaagaaccatattcgtatgcgacgaggacgctaccttggagctgagggtgaaaactgtgaagtatttcaaaggcgaacactag

SEQ ID NO: 224635 - DNA, 729 bp, Artificial Sequence
  Description of Artificial Sequence: Synthetic coding sequence
atgcgactggtaatccttgataactatgatcttgcaagcgagtgggctgcgaagtacatatgcaataggataatccagtttaaaccaggccaggataggtactttactttgggcctaccaacaggactccctcggaaccaccccgaaagctaccacagctacatgtggaataatttttttaagcatattgacattgatccaaataatgctcatattttggatgggaatgctgccgatctacaggcagagtgtgatgccttcgaaaacaagatcaaggaggctggtggtatcgacctgtttgtggggggtattggccctgacgggcacatagcgttcaatgaacctggttcaagcctcgtatctcgaacccggctgaagaccctggcgatggatacaattcttgccaacgccaaatatttcgatggagacctgtccaaggtccccacaatggcacttaccgtgggcgtcggcacagtgatggacgcacgggaagtcatgattctgataaccggggcacataaggcttttgcactgtataaggccattgaggagggcgtaaaccacatgtggactgtgtccgccttccagcagcaccctcgaaccatatttgtctgtgatgaggacgctacgcttgaactgcgcgtaaaaacagtaaagtatttcaaagggttaatgcacgtgcacaataagctggtcgatcccctgtttagtatgaaagacggtaattag

SEQ ID NO: 224636 - DNA, 1287 bp, Artificial Sequence
  Description of Artificial Sequence: Synthetic coding sequence
atgctgagaacactcctccgacgaaggcttttctcctacccaaccaagtactatttcatggtactcgtgctttccctcattacgttctctgtattgcggatccatcagaagccagagtttgtgtctgttagacatctggagctggcaggcgaaaatccatccagtgatataaattgcactaaggtgttgcagggggatgttaatgaaatccagaaggttaagctggagatactcacggtgaagttcaagaaacgccctcgatggaccccggacgactacatcaatatgacctccgactgctcatccttcatcaagaggaggaagtacattgtggaacctctgtcaaaagaagaagcggagtttcccatcgcttatagtattgtggtccaccataaaatcgagatgctggatcggcttctgagagccatctacatgccccagaatttttattgcatccatgttgataccaaatctgaggacagctacctagctgctgtgatgggtatcgccagttgtttttcgaacgtatttgtcgcctcgagattagaatccgtagtgtatgcaagctggagtagagtccaggctgacttaaactgcatgaaagacctgtacgccatgtccgctaattggaagtatctgatcaacctttgtggtatggatttccccattaagacaaacctggaaatagtgaggaagctcaagcttcttatgggcgagaataatctcgaaactgagagaatgccctctcacaaagaggagcgatggaagaagcgttacgaggtcgtgaatgggaagctaaccaatacgggaacagtgaagatgctgcccccactggagacccccctattctctggaagcgcatacttcgtggtctcccgggagtatgtgggatacgttttacaaaatgagaagatccagaaactaatggagtgggctcaggacacgtattcacctgatgaatatttgtgggccacaattcagcgcatcccagaggtccctggaagcttgcccgcttcacataaatacgacctctccgatatgcaggcggttgccagattcgttaagtggcaatactttgaaggggatgtatccaagggcgctccgtaccctccctgcgatggggtgcatgttagaagtgtctgcatctttggggctggagacctaaattggatgctcaggaaacaccacctgtttgctaacaagttcgatgtcgacgtggacctcttcgcgattcagtgcctggacgagcacctaagacacaaagcccttgagactctaaagcattag

SEQ ID NO: 224637 - DNA, 1287 bp, Artificial Sequence
  Description of Artificial Sequence: Synthetic coding sequence
atgttgcggactttgctcaggcgaagactgttcagttaccctacaaaatattacttcatggtgctggtgctgtcgctgattaccttttctgtgctccgaatccatcagaagccagagttcgtctccgtccggcacttagagttggccggagagaatccaagcagtgatataaattgcactaaagtcttgcaaggtgatgtcaacgagatccagaaggttaagctcgaaatcttgaccgtgaaatttaaaaagagacctaggtggactcccgatgactacatcaatatgaccagcgattgctccagttttattaaaagacgcaagtacatcgtggagccacttagcaaagaagaggcagagttcccaatagcctattccatcgtggtccatcacaagatcgaaatgctcgatcgtttgcttcgcgctatatatatgccacagaatttttattgtatccatgttgacaccaaatctgaagactcctacctggcagcagttatgggcatagcctcctgtttctctaacgtgtttgtagccagcagactcgaatcagtcgtatatgcgtcatggagtcgggttcaggcagacctgaattgcatgaaggacctttatgcaatgagcgccaactggaaatatctgatcaatttatgcggcatggacttcccaataaaaacgaatttggaaatcgtccggaaactcaagctcttgatgggcgaaaacaacctcgaaactgagaggatgccatcccacaaggaggagaggtggaaaaaaagatatgaggtggtcaatgggaaactcaccaacaccggcactgttaaaatgctgcctccgctcgagaccccgctattctccggatccgcctattttgtggtttccagagagtacgtggggtacgttctgcagaacgagaaaatccaaaagctcatggagtgggcacaagacacctactcccctgacgagtacctctgggctaccatccaaaggatcccggaggtccctgggtcactccccgcatcgcacaagtatgacctgagcgacatgcaggcagttgcgaggttcgtgaagtggcagtattttgagggggatgtgtcgaagggcgcaccatacccaccgtgtgacggcgtgcacgtgcggtcagtgtgcatatttggtgcaggcgatttgaattggatgcttaggaagcatcatctgtttgcaaacaaattcgatgttgacgtcgatttgttcgcgattcagtgcctggatgaacatctgcgtcacaaggccctcgaaacactgaaacactag

SEQ ID NO: 224638 - DNA, 1287 bp, Artificial Sequence
  Description of Artificial Sequence: Synthetic coding sequence
atgctgcgaacgctgctcaggcggaggcttttctcgtatcctaccaagtactattttatggtcctggtcctgtccctgatcactttcagcgtattgcgcatccaccagaaacccgagtttgtatccgtgcgtcatttagaactagccggtgagaatcccagcagcgatataaattgtaccaaggttctgcagggggacgtcaatgaaatccagaaggttaagctggaaatacttaccgtgaagttcaagaagcgaccacggtggaccccagacgactatattaatatgacgtccgattgttccagctttataaaacgcagaaaatacatagtcgagcccctaagtaaggaggaagccgaatttcctatcgcctatagcatcgtggtccaccacaaaatcgagatgctcgacaggctgctgcgtgcgatctacatgccccagaacttctattgtatacacgtcgatacaaaaagtgaggatagctacctggccgcagtgatgggtatcgcctcctgtttctctaatgttttcgtggcctcccgattagagtctgttgtctacgccagttggagtcgcgtccaggctgacttgaattgtatgaaggatctgtatgcaatgagcgcaaactggaaatacctcatcaacctgtgcggaatggatttcccaattaaaacaaatttggagatcgtaagaaagctgaagttgctgatgggtgagaacaatttggagactgaaaggatgccatctcacaaggaggaaagatggaagaaacgctatgaggtggttaacggaaaactcactaatacgggcactgtaaaaatgctcccccctttggaaactcccctgttcagcgggtcagcgtatttcgtggtatctcgggagtatgttggatacgtactgcagaacgagaagatacagaagctgatggagtgggcccaggatacctactctccagacgagtatttatgggccaccattcaaaggattcccgaggtaccagggtcactgccagctagccacaagtatgatctgtcagacatgcaagccgttgcaaggttcgtaaagtggcagtattttgaaggagacgtctccaagggggcaccctaccccccatgcgatggcgtgcatgttcgttcagtgtgtatctttggcgcaggcgaccttaactggatgctcaggaaacaccacttgtttgcgaacaaatttgatgttgatgtggatctatttgctattcagtgtctggatgagcatctcaggcataaggcccttgaaaccttgaagcactag

SEQ ID NO: 224639 - DNA, 1287 bp, Artificial Sequence
  Description of Artificial Sequence: Synthetic coding sequence
atgctgcgcacactattacgcagacgactcttctcgtaccctacaaagtattatttcatggtcctggtcctgtccctgatcaccttctccgtcttgcgcatccatcagaagcccgaattcgtgtctgtgagacatttagagttggctggcgagaacccctcctcagatatcaattgtaccaaggtgctacagggggatgttaatgagatccaaaaagtaaaattagaaatcttaaccgtgaagttcaagaagcgtccgaggtggacccctgacgactacattaatatgacgagcgactgcagtagttttatcaagcgacggaagtacatcgtggagcctttatctaaggaagaggccgaatttcctatcgcctacagcatagtggtgcatcataagatcgagatgctagatcgcctactgcgagctatttacatgcctcagaacttttactgcatccatgttgataccaaaagcgaagacagctacctcgctgcagtgatgggcatcgcctcctgcttttccaatgtctttgttgcctcccgcctcgagagtgtcgtgtacgcttcctggagcagggttcaagctgacttgaattgcatgaaggatctgtacgcaatgtccgccaattggaaatatttgatcaatctctgtgggatggacttcccgattaaaactaacctggaaatcgtgaggaagctaaaactgctcatgggtgagaataaccttgagacagaacgcatgcccagccataaggaggaaaggtggaaaaagcggtatgaagtcgtgaacgggaagttgacaaacacagggaccgtgaagatgctccctcctttagaaacgcccctgttctcaggtagtgcctactttgtagttagccgggaatacgtgggttatgtgttacagaatgaaaagattcagaaactcatggagtgggcacaggatacatactctcctgacgagtacttgtgggctacgattcagcgcatacccgaggtgcctgggtctctgccagccagccataagtatgatctctcagatatgcaggcggtagcccgattcgttaaatggcagtatttcgagggagatgtatctaagggagctccttatcccccatgtgatggtgtgcacgtgcgtagcgtgtgcatctttggagccggagacctgaattggatgctccgaaaacatcatctgttcgctaataaatttgacgtggacgtggatctctttgctattcagtgcctcgatgaacacctaaggcacaaggctttagagaccctaaaacactag

SEQ ID NO: 224640 - DNA, 1209 bp, Artificial Sequence
  Description of Artificial Sequence: Synthetic coding sequence
atgaacttctggaggtactgcttttttgctttcacgctgctgagcgtggttatctttgtgagattttatagctcccagcttagcccaccgaaatcctacgagaagctgaactcttctagtgagcggtactttcggaagaccgcatgtaatcacgctctggagaaaatgcccgtttttttgtgggagaatattttaccaagcccacttagatcggtgccttgtaaggattaccttacccagaatcattatatcacctccccactgagcgaggaggaggctgcattccccctagcctacgtcatggttatccacaaggattttgatacatttgaacggcttttccgcgctatttatatgccacaaaatgtctactgtgtgcacgtagatgagaaggctcctgcagagtacaaagagtccgtacgacagctgctcagctgttttcagaacgcgtttatcgcaagtaaaacagagagtgttgtgtacgcaggcattagccgactccaggctgacttaaattgtttaaaggatttagtcgcgtcggaagtcccttggaaatacgtgattaacacatgcggacaagatttccctttaaagacaaaccgtgaaatagtccagcacctgaaaggctttaaagggaagaacattacccctggtgtactgccgcctgatcacgccattaaaagaactaaatacgtccaccaggaacacaccgacaaaggaggtttctttgtgaagaatacaaatatccttaagacatctccacctcaccaattgaccatttattttgggacggcctacgtggcccttactagggatttcgttgatttcgtcttaagagaccagcgtgcgattgatctcctgcagtggtccaaagatacgtattcccctgacgagcacttctgggtgacgctcaaccgcgtgagcggcgtccctggaagcatgcctaacgctagttggaccggtaatttgcgcgcaatcaagtggagcgacatggaggacagacatgggggttgccacggccactacgtgcacggtatatgcatctacggtaacggcgatttaaagtggctcgtaaattcaccaagcctctttgcgaataagtttgagctcaatacatatccactcacagtggaatgcctagagctcagacatagggagcgaacccttaatcaaagcgagaccgctatccagccaagctggtacttttag

SEQ ID NO: 224641 - DNA, 1203 bp, Artificial Sequence
  Description of Artificial Sequence: Synthetic coding sequence
atgcctttatctatgcgatatttgttcataatcagtgtgtcatccgtcattatctttatcgtcttctctgtttttaattttgggggagacccgagctttcaacgcttaaatatttctgatccactgaggctgactcaggtttgtacctcattcattaatggcaagacacgtttcctctggaagaataagctaatgatacacgaaaaaagcagctgcaaagagtacctgacccaaagccactacatcacagcgcctctgtccaaggaagaggccgacttccctcttgcctacataatggtgatccatcaccattttgatacattcgccaggttatttcgagccatctacatgccacagaatatatattgcgtgcacgtggacgaaaaagccaccactgagttcaaggacgcagtggaacagctgctgtcctgttttccaaatgccttcctggcctccaagatggagccagtggtttacggcggaatctctcgcttgcaggcagacctgaactgtatccgagatctcagcgcttttgaagtcagctggaagtacgtaattaacacgtgcggacaggatttccctctgaagacaaataaggagattgtgcaatacctaaaaggctttaaaggtaaaaatatcaccccaggcgttctcccgcctgcccacgctataggcagaaccaagtacgtacaccaggagcaccttggcaaggagttaagctacgttatccgcaccaccgctctgaaaccgcctccaccacacaacctcaccatttacttcggatcagcttacgtcgccctgtctcgcgaatttgcaaatttcgtcctgcacgatccccgtgctgtggatttgctgcagtggtctaaggacacctttagcccggatgagcatttttgggtcaccctcaataggataccgggagtcccgggaagcatgccaaacgcgagctggaccggtaacctgcgcgcaattaaatggtcagatatggaagaccgccacggaggctgccacggccactacgtgcatggtatttgtatttatggcaatggcgacttgaaatggcttgtgaattcgccgtccctctttgctaacaagtttgagctgaacacttacccccttacggtggagtgtttggagctgaggcatcgagaacggactctgaaccagagcgaaactgctattcaaccctcttggtacttctag

SEQ ID NO: 224642 - DNA, 1209 bp, Artificial Sequence
  Description of Artificial Sequence: Synthetic coding sequence
atgatgggatcctggaagcattgtttatttagcgcgtcattgatcagtgccctcatatttgtgttcgtgtacaatactgagctgtgggaaaataaaagatttttgagagctgctctgagcaacgcttccttgctggctgaggcctgccaccaaattttcgaaggcaaggtcttttacccaacggagaacgcactcaagacgaccttagatgaagccacgtgctatgaatatatggtccgcagccactatgtcacggaaaccctgtctgaagaagaggccggattccctctggcttatactgtgacaatccacaaagactttggtacatttgagaggctgtttagagcaatctacatgccacagaacgtctactgcgttcatctagatcaaaaggctaccgatgccttcaagggcgctgtgaagcagctcttgtcttgttttcctaatgcgtttctggcctctaaaaaagagagcgtggtttacggagggattagtcgccttcaagccgatctgaattgtttagaggaccttgtggccagtgaggtgccttggaagtacgtaatcaatacttgcggtcaagatttccctttaaaaactaaccgcgaaatagtccagtacctcaaggggttcaaagggaagaatatcacaccgggagtgttgcccccagaccacgccgtgggtagaactaagtacgtccatcaagaactgctgaaccataaaaactcatacgttatcaaaaccacgaaactgaaaaccccccctccccacgacatggtcatttatttcggaaccgcatatgtcgcgttgacacgagacttcgccaactttgtgctgcaagaccaacttgcattagatctgctgtcttggagtaaagacacatactctcccgacgaacatttctgggtcaccctgaataggattccaggtgtgccagggtctatgccaaacgcctcctggaccgggaacttacgggctatcaaatggagcgacatggaggataggcatggaggctgtcatggtcactacgttcatggcatctgtatttacgggaacggagacctgaaatggctggtgaactctccctcactgttcgctaacaagttcgagttgaatacatacccccttacagtagagtgtctggagttaaggcatcgggagcgaaccttaaatcaatcagaaactgcaatccagccgtcgtggtatttctag

SEQ ID NO: 224643 - DNA, 1209 bp, Artificial Sequence
  Description of Artificial Sequence: Synthetic coding sequence
atgatgggctcatggaaacactgcctctttagtgcatccttaatctccgcccttatatttgtgttcgtgtataataccgaattgtgggaaaacaaaaggtttttacgcgctgctcttagcaatgccagtctacttgctgaagcctgccatcagatatttgagggtaaggtgttttatccaacagagaacgctctcaaaactaccctggacgaggccacctgctatgaatacatggtcaggtcccactacgtgacagagacgcttagcgaagaggaggcaggcttcccactggcctacaccgtgacaatccacaaagacttcgggactttcgaacgactcttccgagccatttacatgccccagaatgtttattgcgtgcatctggatcagaaagccaccgacgcattcaagggagccgtcaaacagcttctgagttgttttcccaatgcctttctggccagcaaaaaggagtctgtagtgtacggaggcatctccagattgcaggcagatctgaattgtctagaagatctcgtggcgtcggaggtgccttggaaatacgtgattaatacatgtggacaggactttccgctgaagacaaacagagagatcgtgcaatatctcaaaggattcaagggaaaaaacatcactcccggagtcctgccccctgatcacgccgtcggtagaaccaagtacgtgcaccaggaacttctaaatcacaaaaactcatacgtgattaagactactaagttgaaaacacctcccccacacgatatggtgatctacttcggcacagcatacgtggcgcttactcgggattttgctaacttcgtgctccaggaccagctggcgttagatctcctgagctggtcaaaggatacgtactctcctgatgagcatttttgggtaactttgaatagaattcctggagttcctggctcgatgcccaacgcctcttggacggggaatcttcgggctatcaagtggtcagatatggaagatcgtcacgggggatgccacggacattacgttcacggtatttgtatctacggaaacggagatcttaagtggctggtgaatagcccctctctgttcgcaaataaattcgaattgaatacctacccactgaccgtagagtgcctggagcttcggcatagggagcggactctaaaccagtccgaaacagcaatacaaccatcctggtatttctag

SEQ ID NO: 224644 - DNA, 1317 bp, Artificial Sequence
  Description of Artificial Sequence: Synthetic coding sequence
atggtccagtggaagcgcctatgtcaattgcactacctctgggccctcggatgctacatgctcctcgcaaccgtcgcgcttaagctgtcatttcgcctgaagtgtgattcggaccacctcgggctcgaaagccgggagtcccagagccagtattgtcgcaatatcttatataattttctcaagttgcctgccaagaggtccattaattgcagcggcgtaacacgaggggatcaggaagctgtccttcaagcgatcctgaataatctggaggtcaagaaaaagagggaaccattcaccgatacacactatctctctttgacacgagactgcgaacatttcaaagcagagagaaaattcattcagttccctttgtctaaggaggaggtagagttccctatcgcctattcaatggtgatccacgagaaaatcgagaattttgaaaggctactcagagccgtctacgcaccccagaacatctactgcgtccacgtagacgagaaatcaccagagacttttaaggaagccgtgaaagctatcatctcctgctttccaaatgtgtttatcgcaagtaagctcgtgcgcgtggtgtacgcaagttggagcagggtgcaggccgacctgaattgtatggaggacctgctccaaagcagcgtgccttggaagtacttcttgaacacctgtgggactgatttccctattaaaagtaacgcggagatggtgcaggccctcaaaatgctgaacggccgaaactccatggagtctgaggtgcccccaaagcataaggagacaaggtggaagtatcactttgaggtcgtgagggatacactgcacctgacaaataagaagaaagacccaccaccttacaatttgaccatgttcaccggcaatgcatacattgttgccagtagagacttcgtacagcacgtgctgaaaaacccaaagagtcagcagcttatagaatgggtgaaggatacctactcccccgatgaacacctttgggctaccctccagcgggctaggtggatgcccggatctgttccaaaccacccgaaatatgacatttccgatatgacgagtatcgctcgattagttaaatggcaggggcacgagggagatatcgacaaaggtgccccttacgctccgtgttccggcatccatcagagagcaatctgtgtctatggagcaggtgacttaaattggatgctccagaatcatcacctgctggcaaataagttcgaccccaaggtcgacgacaatgctttgcaatgtctggaagagtatttgcggtacaaagccatctacgggacagagttatag

SEQ ID NO: 224645 - DNA, 264 bp, Artificial Sequence
  Description of Artificial Sequence: Synthetic coding sequence
atggtgcagtggaaaagactctgtcagcttcactacctgtgggctctcggctgctatatgctactcgctactgtagcattaaagctgagttttcggctcaagtgcgattccgatcatttaggtcttgagtcacgcgagtctcagagccagtactgtagaaacatcctgtacaattttttaaagctccccgctaagaggtctattaactgctctggggtaacccgcggtgatcaggaagccgttcttcaggccatcctcaattag

SEQ ID NO: 224646 - DNA, 462 bp, Artificial Sequence
  Description of Artificial Sequence: Synthetic coding sequence
atggtgcagtggaagagactctgtcagttgcattacctatgggctttgggttgttatatgctgctggcaacggtggctttaaaacttagcttccgtctcaagtgcgattctgatcacctgggattagagagtcgggagtctcaatcgcagtactgtcggaatattctatacaactttctcaagctccctgcaaagcgtagtattaactgctccggggttacaaggggagatcaggaggcagtccttcaggccatactgaataacctggaggtgaaaaagaagcgggagccatttactgatacacattatctcagcttaacacgagactgtgagcattttaaggcagagcggaagttcatccagttccctctttccaaggaggaggtggaatttcctatcgcatattcaatggtcatccatgaaaagattgaaaacttcgagcgcttactgagagccgtttag

SEQ ID NO: 224647 - DNA, 162 bp, Artificial Sequence
  Description of Artificial Sequence: Synthetic coding sequence
atggtgcagtggaagaggctgtgccaactccactatctgtgggcccttggatgttatatgctcctcgcaaccgtggccctgaagctgagttttcgcctaaaatgcgactccgatcatttaggccttgagagtagggagtcccagtcacagtactgccgttag

SEQ ID NO: 224648 - DNA, 1317 bp, Artificial Sequence
  Description of Artificial Sequence: Synthetic coding sequence
atggttcaatggaagcggttgtgccagcttcattacctctgggctctgggctgctatatgctcctcgccaccgtggcgttgaaactgagctttagactgaagtgtgacagtgaccacctcggcctggaaagcagggagagccaaagccagtattgtaggaatatattatacaattttctgaagttacccgcaaagaggagcattaactgttctggcgtcacccggggtgaccaggaagcagttctccaggcgatcctgaacaatcttgaggtgaaaaaaaagcgcgaacccttcacagatactcactacttgagcctgacacgcgactgcgaacatttcaaggctgaaaggaagtttatacaattcccgctcagtaaagaggaggtggagtttcctatcgcctactctatggtaatccatgagaagatcgagaattttgagagattgctgcgcgcagtctatgccccacagaatatatactgtgtgcatgtcgatgagaagtcccctgagactttcaaagaagcagtaaaggctatcatctcatgctttccaaacgtcttcatcgctagcaaactggttcgcgtggtctatgcatcttggtcccgggttcaagcagatctaaattgtatggaagatctgctgcagagttctgtgccctggaagtattttctgaacacatgcgggaccgatttccccataaagtcaaacgccgaaatggttcaggccttgaagatgttgaatggcaggaattccatggagtcagaagtgccgcctaagcataaggaaacacggtggaagtatcacttcgaagtcgtccgcgatactttgcatctcactaacaagaagaaggacccacccccttacaacctgacaatgtttaccgggaatgcctatattgtggccagtagagacttcgttcaacatgtcctcaagaatccaaaatctcagcagctgattgaatgggtcaaagacacgtactctccggacgaacacctatgggccacactgcagcgtgcacggtggatgccgggttctgttcctaaccacccaaagtacgatatctctgatatgacctctatagcaagactcgtaaagtggcaaggacacgaaggcgacatagataagggagctccatatgcaccttgtagcggcatccaccagcgagctatttgtgtttatggagcgggagatctaaactggatgctgcaaaatcatcacctgctagctaataagtttgatccaaaggtcgacgataatgccctccagtgtctagaggagtatctaaggtacaaggccatttatggaaccgagctatag

SEQ ID NO: 224649 - DNA, 1041 bp, Artificial Sequence
  Description of Artificial Sequence: Synthetic coding sequence
atggagtcgaccctaggggcaggcatcgtaattgctgaggctctgcagaaccagctggcctggcttgagaacgtgtggctgtggataacctttctcggagaccccaagattctgtttctcttctacttccccgcagcctactatgcctccaggagggtgggtattgccgtgctgtggattagcctgatcacagaatggctgaacctgatctttaaatggtttctgttcggagacagacccttttggtgggtccatgaatccggctactatagccaggcacctgcgcaagtccaccagttcccatcctcttgtgaaactggacccggatccccaagcggccattgcatgatcaccggggcagcgctctggcccataatgacagccctgagttcccaggtcgccaccagagcaaggtctcgatgggtgagagtgatgccctctctagcctactgtacttttctgctggccgtgggactgtcccggatttttatccttgcccattttccccaccaagtcctggccggtctgataaccggagccgttctcggttggctcatgacgccgagggttccaatggagagggagctttccttctacggccttactgccctcgccttgatgcttgggacttccctcatttactggaccctcttcacattgggactcgacctatcctggagtataagtcttgcctttaagtggtgtgaaagaccggagtggattcacgtggattcacggcctttcgcgagcctttcgcgtgatagcggcgcagccctcggattaggtatcgctctccactctccatgctatgcccaagtcaggcgcgctcaacttgggaacggccagaaaatcgcatgtctggtattggccatgggcctgctgggccctctagactggctgggccacccacctcagatcagtctgttctatatttttaattttctaaaatacacactgtggccctgcctggtgttggctcttgtcccttgggcagtgcatatgttttccgcgcaggaagcaccacctatccattctagctag

SEQ ID NO: 224650 - DNA, 465 bp, Artificial Sequence
  Description of Artificial Sequence: Synthetic coding sequence
atggatttcctgcataggaacggcgtgctgatcatccaacacctgcagaaagactatcgggcatattacacctttctgaactttatgtctaacgtcggggatccacgcaatatctttttcatttactttccactgtgctttcagttcaaccaaacagttggcaccaaaatgatttgggtggccgttatcggggattggctgaacctgattttcaagtggatactcttcggacatcgcccatattggtgggttcaggagacacagatatatccaaatcattccagcccgtgtttagaacagttccccactacctgtgagacgggtccgggtagccccagcggccacgcgatgggcgctagttgtgtctggtatgttatggtgacggccgctcttagccacactgtctgtggaatggataaatttagcatcactctgcaccgccacgcgggaggtcggggactctag

SEQ ID NO: 224651 - DNA, 1068 bp, Artificial Sequence
  Description of Artificial Sequence: Synthetic coding sequence
atggactttcttcatcgcaatggtgttttgatcattcaacacctgcaaaaggattatagggcctactacacatttctgaacttcatgtctaacgttggagatcccagaaacatcttcttcatctacttccccttgtgctttcagtttaaccaaaccgtggggaccaagatgatttgggtggcagttataggagactggctgaacctgatctttaaatggatcctctttgggcatcgaccttattggtgggttcaagagacccagatctatccaaatcactcatccccttgtctggagcagttcccgacgacttgtgagactggacctggctctcctagcggacacgccatgggagctagctgtgtgtggtacgtcatggtgacggctgccctcagccacacagtgtgtggaatggataaattcagtatcacactccatagactgacttggagctttctgtggagtgtcttctggcttattcagatcagcgtctgtatttcccgagtgtttatcgcgacacactttccgcatcaagtaatcctcggtgtaataggtggcatgctggtggctgaggcattcgaacacactcccggtatccagaccgcctctttgggaacatacttgaagacaaacttgtttctgtttctgttcgccgtaggtttctaccttctcctgcgcgttctcaatattgacctgctctggagcgtgccaatcgcaaagaaatggtgcgccaaccccgactggatccatattgatacgacacccttcgcaggcttggttagaaacttaggagtgctctttgggcttggttttgcaatcaattctgaaatgttcctgctgtcatgtcggggtggcaataactatactctttcctttcggctcctgtgtgcgcttacaagccttactattctccagttgtaccacttcctgcagattcctacgcacgaggaacacctattctacgtattatcattttgtaagtcagcatcaatccctctgacagtcgtggcatttattccctactccgtacacatgttgatgaagcagtctgggaaaaagagccaatag

SEQ ID NO: 224652 - DNA, 1677 bp, Artificial Sequence
  Description of Artificial Sequence: Synthetic coding sequence
atggctgccctgacccgagatccccaatttcaaaagctccagcagtggtacagagagcatagatccgaattgaatctccgcaggctctttgacgcaaataaggatcgctttaatcacttctctctaaccctcaatactaaccacggacacatcctagttgattactccaagaacctcgtgacagaggatgtgatgcggatgctcgtcgacctcgcaaagagccggggagttgaagctgcacgggagcgcatgttcaacggggagaagatcaactatacagagggcagggcagtattgcatgttgcattacgcaaccgcagcaacacgccaatacttgtggacggcaaggacgtgatgcccgaggttaacaaggtgctagataaaatgaagagcttctgccaacgggtgcgatctggcgattggaaagggtatactgggaagactatcaccgacgtcatcaacattggcataggcggatctgacttgggccctctgatggtcactgaggcgttgaagccatactcgtccggaggccctcgcgtatggtacgtttccaatatcgatggtacccatatcgccaagaccctagcacagctgaaccccgaaagttcgctgtttattatagcctctaaaacctttactacacaagagactatcaccaatgccgaaacagccaaagagtggtttttacaggcagccaaagatccatctgcggttgccaagcatttcgtcgccctttctaccaacactacaaaggtgaaagagtttggaatcgacccacagaatatgttcgagttttgggattgggtggggggacgctactccctctggagcgcgatcggtctgagtattgctctgcacgtgggcttcgacaacttcgagcaactcttgtctggcgctcattggatggatcagcatttcaggacaacaccccttgagaaaaatgctcccgtacttctcgcgctgctgggcatctggtacatcaattgcttcggctgcgagactcatgctatgttaccctatgaccagtatctccataggtttgctgcctatttccagcagggagatatggaaagcaatggcaaatacatcactaagtcgggaactcgggtagatcaccaaactggacccattgtgtggggggaaccaggcactaacggtcagcacgccttttaccagctcatacaccaaggcacgaagatgatcccatgcgactttctaatcccagtgcaaacccagcacccaattagaaaggggctccaccacaagattctactggctaatttcctcgcacaaaccgaagcactgatgcggggaaaaagcacagaagaggctcgcaaggagctgcaggccgcaggcaaaagccctgaggacctcgaacgccttctcccacacaaggtatttgaggggaatcgccctacaaactccattgtgtttactaagctgactccgtttatgctgggagccctcgtcgccatgtatgagcataaaattttcgtccagggaattatttgggatattaatagctttgatcagtggggtgtagaattgggaaagcagctggccaagaagattgagccagaactcgatggcagcgcacaggttacaagccacgatgcttccaccaacggcttgataaattttatcaagcagcaacgcgaagcaagagtccaatag

SEQ ID NO: 224653 - DNA, 1563 bp, Artificial Sequence
  Description of Artificial Sequence: Synthetic coding sequence
tctaggcacggcaggtcacatccgggtccaccggtcccagaggctgccgctatggtgccacgcgcacccctccgcgctgagcctgcccctcctcttcgctgtcaacaaggacccctgcaaccgctgcaggttcgagccggtcggaggaggggcctgcctcgggcagcccctggcaccggacatgcaggacttggatctggcggtggtgggtccggggcaagaggccctcaatcccccacaagtcgccctcgcacgggggcacaagccgagtctgccctccgaccatggtccttgctgggcgttagaagttggggcctcgcagcttctcccggagtttctgctcccggattgttaagatacgaggaaaaacgggcacccccatggggacacttccccagttcctcaccatgtagcagtggacatcttagtaggggaagcttcaggtcttgtgaagaacggccttggctcactcagcaagccggaaagggctgcccttttccatccgcgcctggtcatatgtcgctcggcgctagcgccggtcgcgcagctagagctggcgtcttcgagggtgcaggatggaaggatggcgacgtgggccgtgattcatgtagacgccatctatgcactactggcaagtgggagggcgtgttcgaacagatcatgggcggttcagccgcaaaaggagctctcataaccgatacaggagggggaggagggggtgagagattgtggctccgcgctcgccgacctgatggccacccgtgtcatctggatggttgcctttccaacttgcgccaaaaggtcgaagctctcggtcgtggaggtccacccctccaatccgggttgctgatccagggtctgccagcttcgaccgtatgcgaggatggatttttcctatgggcagctgttgcggaccatcctgggggaccagcaggggataggcaccatcattgcgccggatggcctcggcctctttggggagtgggccagggaggttgcttcttctgggaacagcttctcctcagggcctggctgcccgctagagagactagggtgtggtccgctgcctccccgtccttctgttcactgacactgaacacaaaccatggacacatcttggtggattacagcaaaaatctggtcactgaagatgttatgaggatgctcgtggacctagcaaaatcgcgcggagtggaagctgctcgcgagcggatgtttaacggcgagaaaattaactatacagaagttagccgtccacacatcccatccggggcaagttttttaccgtttggcgtgtacttaacggtaagcagaataaccctgtgtctgcacccgttttcttgggcgatgctgctgttaaacgaagggcctgagggcctgttccccccagcatgctctcgggctctgggctgcgcgttccataagataggactggtgtcctcgcttgaatggttccccgtgtccgcttgggaggagcatatttcctatccacagggggaattcctgaaagccgatatttttttggaaaaattaacactcatctacccccagtgtaagttttag

SEQ ID NO: 224654 - DNA, 1710 bp, Artificial Sequence
  Description of Artificial Sequence: Synthetic coding sequence
atggtggccttatgcagtctccaacacttaggcagctccgacccgagggctctgcccacgctaccaaccgcgacaagtggccagagacctgctaagaggcggagaaagagtccggcaatggccgcactgactcgcgacccgcagttccagaagctccaacagtggtatagagagcaccggagtgaattgaacctgcgcaggctcttcgacgctaacaaggacaggttcaaccatttttccctcactctgaataccaatcacggtcatatcctggtggactatagtaagaacctagttaccgaggacgttatgaggatgctggtcgacctggctaagtccaggggggtggaggctgcgagagagagaatgtttaacggagaaaaaattaattatactgagggtagggcggtgctgcacgtcgcattaaggaacagatccaacactcctatcttggtggacggcaaagacgtgatgcccgaggtgaacaaggtgttggacaagatgaaatccttttgccaaggtccgctgatggtaacagaagccttaaagccctactccagtggaggacctagagtttggtacgtttctaatatcgatgggacccatatcgctaagacgttggctcagctgaatcctgaatctagccttttcattatagcttccaagacctttaccacgcaggagaccatcacaaatgcagagactgcaaaggaatggttcctgcaggccgctaaggaccctagcgcagttgccaaacacttcgtggccctgtccacaaatacaaccaaagttaaggagttcgggattgaccctcagaacatgttcgagttctgggattgggtcgggggtaggtattctctctggtccgcaataggcctctctatcgctctccacgtgggattcgacaactttgagcagctactgtctggcgcacattggatggatcagcatttcaggaccaccccactcgagaagaatgccccagtgctcctggctctgctggggatctggtacataaattgcttcggttgcgaaacacacgccatgttgccatacgaccaataccttcaccgatttgccgcatatttccaacagggcgacatggagtctaacggcaagtacatcacaaagagcggaacaagagtcgaccatcagacgggccctatcgtttggggcgagcctgggaccaatggccaacacgctttctaccaactcatccaccaaggtacaaagatgattccctgcgatttccttattcctgtgcagactcagcaccccattcgcaagggcttacatcacaagatcctgttggccaacttcctcgcccaaacagaagccctgatgagggggaagagcaccgaggaggcacggaaggaattgcaggcagccggtaaaagcccggaggatctggagagactcttaccccacaaagtctttgaggggaatcgtcctactaattcaatcgtgttcaccaagctcaccccattcatgcttggggcactggtggctatgtatgaacacaagattttcgtgcagggaataatctgggacattaacagttttgatcagtggggcgtcgaattagggaaacaactggccaagaagatcgagcccgagttagacggttcggcacaggtcaccagccacgatgcgagcaccaatggccttatcaacttcattaagcagcagagggaagctagagttcagtag

SEQ ID NO: 224655 - DNA, 2901 bp, Artificial Sequence
  Description of Artificial Sequence: Synthetic coding sequence
atggctgccgtggccgcagtggccgctagacggaggagatcatgggccagcctggtcctagctttcctaggagtctgcttagggatcaccctggcagttgataggagcaacttcaagacttgtgaagaatcatcattttgtaaaagacagaggagcattcggcctggtctgtctccataccgggctctcctagatagcttgcagttgggtcctgactctctgactgttcatctgattcacgaggtgaccaaagtattgctggtgctggaactccagggcctgcagaaaaacatgacgaggttccgaatcgatgagctggaacctaggcgcccaaggtatcgcgtgcccgacgtactggtggcagatccaccaatcgcaagacttagcgtgtcgggccgagatgaaaactcagtcgagctgacaatggcggagggaccttacaagatcatcctcaccgcacgcccttttcgcctggatcttttggaagatcggagtttactcctctctgtcaacgcccgtgggctgctggaatttgaacatcagcgtgcccctagggtctcattctctgacaaagtcaatcttacgctgggatccatttgggataagatcaagaatctcttttccaggcagggctcaaaggacccggcagagggagatggcgcacagcctgaagaaacgccccgagacggggacaaacctgaggagactcaaggcaaagcagagaaggatgagccaggagcctgggaggagaccttcaaaactcatagcgattcaaagccttatggaccgatgtcagtggggctggactttagcctgcctggaatggaacatgtgtacgggatccccgagcacgccgacaatcttcgcttgaaggtcacagagggcggagaaccttaccgcctgtacaaccttgacgttttccagtacgagctgtataaccccatggctctatatggctccgtgccagtgctcctggcccacaatccacatcgtgacctgggcatattttggctgaacgctgccgaaacctgggtggatatctcctccaacacagccggaaaaactctgtttggcaaaatgatggactacctgcaaggctcaggagaaacaccccagaccgacgtaaggtggatgtctgaaaccgggattatcgacgtattcctgctgcttggaccaagcatttctgatgtgttcaggcagtacgcctcacttaccggaactcaggccctgcctcccctgtttagcctcgggtaccatcagtcccgctggaattatcgggacgaagcagatgtgttggaggtggatcagggcttcgacgaccacaatctcccttgtgacgtcatctggttggacatcgagcacgccgacgggaaaaggtactttacatgggacccaagtagattcccccaaccgagaacgatgttagagaggcttgcttctaaacggcgaaaactggttgcaatcgtggatccacacattaaagtcgactctggttaccgcgtccacgaggagctgcgtaaccttggactttatgtgaagacgagggatggtagcgactatgagggatggtgctggccgggtagtgcaggctatcctgactttaccaatcctacaatgagggcctggtgggccaacatgttcagctatgacaactacgagggaagcgccccaaatctgttcgtgtggaatgatatgaatgagccatcagtcttcaacggtccagaagttacaatgcttaaagatgcccagcattatggaggatgggagcatcgagacgtgcataatatatacggcttgtatgtccatatggccacagccgacgggctcagacaaaggtctggcggtatggaaagacctttcgtgctggcgagggccttctttgcgggatcacagcgcttcggagccgtctggacgggggacaatactgctgagtgggaccatttgaaaatctccatccccatgtgtttaagcctgggtcttgtagggctgtcattctgcggcgctgacgtcggaggtttcttcaagaatcctgagcctgagcttttagttcgctggtatcagatgggcgcataccagccattcttccgggcacatgctcacctggacactggcagacgtgagccttggttattgccttcccaacacaatgatattatcagagatgccctcggccaacgatatagtctcctgcctttttggtatactctgctgtaccaggcacaccgtgaagggatccccgtgatgcgtcccttgtgggtacaataccctcaggatgtgacaaccttcaatattgacgaccagtacctgcttggagatgccctgttggtccaccctgtgagcgatagtggtgcacacggagtgcaggtctatctacctgggcaaggggaggtttggtacgacatccagtcttatcagaagcatcacggccctcaaacattgtatcttcctgtcacgctctccagtattccggtgtttcagagggggggaactatcgtgccgaggtggatgcgcgtgagaaggtccagtgaatgtatgaaagacgacccaatcaccttatttgtagctctctctccacagggcacagctcagggcgagctgtttctggatgatggacacacttttaattaccagacacggcaggagttcttactacgccgtttctcattctcaggtaataccctggtttcatccagtgcagaccctgaggggcattttgagacaccgatttggatcgaaagggtggtcattattggggcaggtaaaccagccgctgtggtccttcagacgaagggcagcccagaatcccgcctgtcatttcagcacgatccagaaactagtgtactcgtgctgcgaaagccgggaataaacgttgctagcgactggtctatacacttgagatag

SEQ ID NO: 224656 - DNA, 2835 bp, Artificial Sequence
  Description of Artificial Sequence: Synthetic coding sequence
atggctgccgtcgcagcagtagccgcacgcaggagacgatcatgggcgagtctggtgctcgctttccttggagtgtgcttagggattactctcgcagtcgaccggtcaaatttcaagacctgtgaagaatcctccttctgtaagcggcagagatctattcgaccagggctgagtccctaccgggcactcctcgattccctgcaactgggtcctgattccttgactgtccatctgatccacgaggttaccaaagtgctgcttgtgcttgagcttcagggtttgcagaagaatatgacaagatttagaattgacgagctggagccgcgacgtcctcgatacagggtcccagatgtgcttgtcgcggacccaccaatagcgcgattaagcgttagcggaagagacgagaattcagtggaactcacaatggcagaaggaccctacaaaataatacttaccgcacgaccttttagactggatctgctggaagatcgttctctgctgctgagcgtgaatgccaggggtttgctggagttcgaacaccagcgagctccacgcgtttcacagggctccaaggatcccgctgagggggacggtgcccagccagaggagacccccagggacggagacaaacccgaagaaactcagggcaaggcggagaaggatgagcccggtgcctgggaggagacgttcaagacccactcagacagcaaaccctatggccctatgtctgtagggcttgattttagtctgcctgggatggaacatgtctacggaatcccagaacatgccgacaacctcagactgaaagtaacagaggggggagagccctaccggctgtataatctcgatgtgttccagtacgaactgtacaatcccatggcactctacggcagtgtgccggtgctgttggcacacaaccctcaccgggatcttggtatcttttggttgaacgccgctgagacatgggtcgatatttcttcaaacaccgcaggcaagaccctgttcggcaagatgatggattacctgcagggctcaggtgagaccccccagaccgatgtgcggtggatgagtgagacaggaataattgacgtatttttgctgctgggacctagcatcagcgacgtgttccgccagtacgcctccttgacgggcacacaagctctgccacccttgttctcgttaggataccatcaatctaggtggaattatcgcgatgaggcggatgtgctcgaagtggaccaaggattcgatgaccacaacctgccttgtgacgtaatatggcttgacatcgagcatgcagacggaaagcgctatttcacctgggacccttctcgattcccgcagcctagaaccatgctggaaagactcgcttccaaacggcgtaagcttgtggctatcgttgacccacatattaaagtggacagtggatacagagtacatgaggagttaagaaatctcggactttacgtcaagacgcgggacggaagcgattacgaaggatggtgctggcccggaagcgccggatatcctgattttaccaatcccacaatgagagcttggtgggccaatatgttttcatacgacaattatgagggtagcgcgccaaacctgtttgtgtggaatgacatgaacgagcctagtgtttttaatgggccagaggtcacaatgttgaaagatgcccagcactatggcggatgggaacaccgcgacgtgcacaatatctacgggctttacgtgcacatggccaccgccgacggcctccgtcaacgtagcggcggaatggaacgtccctttgtcctcgcacgggcttttttcgctggttcacagaggttcggcgctgtttggacaggcgacaatacagctgagtgggaccacctgaagatcagcatccccatgtgtctttcactggggttggtcggattgagcttctgtggagccgacgttggaggattttttaagaaccccgaaccagagctcttggtgaggtggtatcaaatgggggcttaccagccatttttcagagcacatgcccacctagataccggtcgcagggagccatggctgcttccatctcagcacaacgatatcatcagagacgctctgggtcaacggtattccctgttgcccttttggtataccctgctctaccaggcacaccgtgaaggaatcccagtcatgaggcctctgtgggtccaatatccacaagacgtgactacatttaacattgatgatcaatatcttctgggggacgctctgctggtgcatcccgtatcggactctggagctcacggcgttcaagtctatttgcctggtcagggcgaagtttggtatgatattcaatcatatcagaaacatcacggaccccagactctttacctgcccgtaacactgtctagcattcctgtctttcagcgaggcggtacaatagtccctcgttggatgagggtgcggagatctagcgagtgtatgaaagatgaccccattaccctgtttgtggctctgagcccgcagggcacggctcagggtgagctgtttctagatgacggccacacctttaattaccagaccaggcaggagttcctgctgcgacgatttagttttagcggcaataccttggtcagctcctctgctgacccagagggccactttgagacaccaatttggatcgagagagtggttattattggtgctggaaagcccgcagcagtggtgctccagaccaagggctcccccgagagtaggctgagcttccagcacgatccagaaaccagcgtgctggtccttcgtaagccgggtatcaatgtggccagcgattggtcgatccacctgcgctag

SEQ ID NO: 224657 - DNA, 2544 bp, Artificial Sequence
  Description of Artificial Sequence: Synthetic coding sequence
atgacgaggtttcgcattgatgagctcgagcctcggagaccaagatatcgtgtaccagacgtgctcgtggccgacccacccatcgcgcgacttagtgtctccggacgcgatgagaatagtgtggaactcacgatggcagaaggtccgtacaaaattatcttaaccgctcggccattcagactggacctgctcgaggatagaagcctgctgctgtctgtgaacgcccgagggcttctggaattcgagcaccaaagggccccacgcgtctcacagggaagcaaggatccggctgaaggtgatggcgctcaaccagaagagaccccaagagacggcgataagcccgaagagacacaggggaaagctgaaaaagacgagcctggggcttgggaagagactttcaagacgcacagcgacagcaaaccatatggccctatgtcggtgggcttggacttctccctacccggtatggagcacgtgtatggcatccccgagcacgccgataacctgagacttaaggtgaccgaggggggtgagccatatcgactctataatttagacgtctttcagtacgaactgtataaccctatggccctctacggctcagttcccgtgttgcttgcacacaatccacacagagacctgggaatcttctggctgaatgctgctgaaacatgggttgacatctcctcgaataccgccggaaaaacactgttcggaaagatgatggattacttgcaagggtccggagagacaccacagacagatgttaggtggatgagtgagaccggtattattgatgtctttcttctgctagggcctagcatttctgacgttttccggcagtatgccagcctgaccggaacccaggcactgccccctctgttttccttggggtatcatcagagcaggtggaactacagggacgaagctgatgtgctcgaggtggatcaggggttcgacgaccacaacctgccttgcgacgtaatctggctggacatagaacatgcagatggcaagcgatactttacgtgggatccctcgagatttccgcagccgaggaccatgcttgagcgcctggcctccaagcgcaggaagctggtcgctatcgtcgatccgcacataaaggtggattccggttatcgggtacatgaggagctgaggaacttaggcctgtatgtcaagaccagggacggctcagactatgagggttggtgttggcccggatcagcgggatacccggactttactaatcctacaatgagagcctggtgggctaatatgttcagttatgataactatgaagggagtgcaccgaatctatttgtttggaacgatatgaacgaaccaagcgtcttcaatgggcctgaggtgactatgcttaaagatgcgcagcattacggtggctgggagcaccgcgacgttcacaatatttatggtctctatgtgcatatggcgacggcggatggactgcgccaaagatcaggcggtatggaacgacccttcgtgctggcaagagccttctttgctggctcacagcgctttggcgctgtgtggaccggggataataccgcagagtgggaccacctgaagatttccatacccatgtgcctgtctttagggctggtcggcctgtcattttgtggcgctgacgtcggaggtttttttaagaacccggagcccgaattgttagtgcgatggtaccagatgggagcatatcagccattttttagagctcacgcccacctagacaccggacggcgagagccttggctgctaccgtcgcaacacaacgacatcatacgagatgccctgggccaacggtacagtctgctcccattttggtacaccttgctgtatcaggcccaccgggaaggaattcccgtcatgagacccctgtgggtgcaatacccccaggacgtgaccacattcaacatcgatgatcagtaccttttaggcgatgctctgcttgtgcaccccgtgagcgatagcggggctcacggcgttcaagtgtatttacccggacagggggaggtttggtacgatattcagtcctatcagaaacatcacgggccacaaactttgtacctccccgtaaccctgagctcaatccctgtgttccaacgtggtggcaccatcgtgcccaggtggatgagggtcagaagaagtagcgagtgcatgaaagacgacccaatcacactgttcgtggcactgtcaccccagggcaccgcccaaggtgaactgtttctcgatgacggacatactttcaactatcagaccaggcaggagtttttgctgcgcaggtttagcttcagcgggaataccttagtgtccagttctgctgacccagaaggtcactttgagacgcccatctggatcgagcgtgttgtcattataggagccggaaagccggcagctgtggtactgcaaactaagggatcaccagagtcccgcttgtccttccaacacgatcctgaaacctctgtacttgtcttgcggaaacccggaataaacgtcgcatcagattggagtattcacctgagatag

SEQ ID NO: 224658 - DNA, 2745 bp, Artificial Sequence
  Description of Artificial Sequence: Synthetic coding sequence
atggaggcggctgtgaaggaggagatatctctagaggacgaagccgttgacaagaacatctttagagattgtaacaaaattgccttctaccggaggcagaaacagtggctttcaaagaagagtacatatcaggctctgctggattccgtcacgacagatgaagatagtactagattccagatcatcaacgaggcctctaaggtaccgctgctggctgagatttacgggatcgaagggaacatcttcagactgaaaatcaacgaagagacccctttaaagcctaggtttgaagtacctgacgtgctgacaagcaagccttcaacagtccgcttgatctcatgcagtggagataccggtagcctgattttagcagatggtaagggtgaccttaaatgtcacattactgccaacccttttaaggtggacctcgtgtcagaagaagaagtggtaatctccatcaacagcctcggacagttgtacttcgagcacctgcagattctgcacaagcaacgcgctgccaaagagaacgaagaggaaacttcagtagatactagccaggaaaaccaagaagacttggggctgtgggaggagaaattcggtaagttcgtggacataaaagctaacggtccttcttccattggactggacttttcactgcacggctttgaacacctgtacggcatcccacagcatgcagaatctcaccaattgaaaaatacaggtgacggcgacgcttacaggctctacaacttagacgtctatggatatcagatctacgataagatgggaatttacgggtcagtaccatatttgcttgcgcataagctgggcaggaccataggaattttttggctgaatgcaagcgagaccttggtggagatcaacaccgagcccgctgtcgaatacaccctgactcagatggggcctgtggcagctaagcagaaagttagaagccgtacacacgtccactggatgagcgagagcggaataattgatgtgttcctgcttacagggccaacaccctccgatgtcttcaaacagtattcacatttgactggaactcaggccatgcctcctctgttctctctgggctaccaccagtgccggtggaactatgaagacgaacaagacgtcaaagcagtggacgccggatttgatgaacacgatattccttacgacgccatgtggctcgacatagaacacaccgaggggaaacgctacttcacatgggacaaaaacaggttcccaaatcctaaacggatgcaggagttgttaaggagtaagaaacgcaagcttgtggtgatttcagacccacatatcaaaatcgatccagattatagtgtgtatgtcaaagctaaggatcagggctttttcgtgaagaaccaggagggagaggactttgagggtgtctgctggcccggattgtccagctatctggattttacaaacccaaaagtccgagagtggtacagctcgctgtttgccttccctgtgtaccagggctccaccgatattctgttcttgtggaacgatatgaacgagccatccgtgtttagggggcctgagcagacaatgcaaaagaacgcgatccaccacggaaattgggagcatcgcgaactgcacaatatctacgggttctaccatcaaatggccaccgccgagggtctaataaagaggtccaaaggtaaagagcgacccttcgttctcacgcgctccttcttcgcaggctcgcagaaatacggggcagtgtggaccggggataacacggcagagtggagcaacctgaagatctctatccccatgttgctgaccctgtctattaccggcatttctttctgcggcgctgatatcgggggtttcattggtaatccggagaccgaactcctcgttaggtggtaccaagctggagcgtaccaacctttttttcgaggccacgctaccatgaatacgaagcgcagagagccgtggcttttcggcgaggagcacacccgcctaatccgcgaagccatccgggaaagatatgggctgttgccttactggtactccctcttctaccatgcgcacgtggcttcacaacctgtcatgcgtcctctttgggtggagtttcccgacgagctgaaaaccttcgatatggaagacgagtacatgctgggctctgcattattagtgcaccctgttactgagcctaaggcaaccactgtggatgtatttctgccaggcagtaacgaggtctggtacgactataaaacatttgcccattgggaagggggatgcacagttaagattcccgtggcgctggataccatccctgtcttccagagaggaggtagcgtcatccctataaaaactactgtcgggaagagtactgggtggatgaccgagagttcctacggcctcagagtcgccctgtccacgaaggggtcatcagtgggggagctctacttggacgacggccattctttccagtaccttcaccaaaagcagttcttacatcgcaagttctccttctgttccagcgttctgatcaattcgtttgcagaccagcggggacactacccgagcaaatgtgtggtcgagaagatactggtgcttggcttcaggaaggaaccatccagcgttactacccacagctcagacggtaaagaccagcctgtagcgtttacctactgcgctaaaacctctatcttgtctttggaaaaactcagcttgaacatcgcaaccgactgggaggtgcgtataatttag

SEQ ID NO: 224659 - DNA, 849 bp, Artificial Sequence
  Description of Artificial Sequence: Synthetic coding sequence
atggaggcggctgtcaaggaggagatctccctcgaagatgaagccgtcgataaaaacatatttagagactgcaacaaaattgcgttctaccgacggcagaagcagtggctctccaagaaatccacctaccaggccctactggattccgttacaacagacgaagattcaactcgcttccagatcatcaacgaggcatctaaagtgcggtgtcaagaccaatccccgaccacgctggatgccttcaaaggtaaggagactactgtgcaggaggaaacgcaggacttgtccacgaggcagcacctcgcacagaaggaggccgaagaacccgataagcaaggccagattacgtgggacatcagcaacgtggcccctaagaccgagaatttcgaggacctgttggagcagacaccctgcagcgcttgcctccaggggtttaccagagataacacaagttcctcctttagtgaagacgctggcatttccttatccacttcagtgaagcttcctctcgcaagctcaagcaagcccaacgagaacgaggctctgcctaatcagccaccatcccaacagattcgccacaattatagactgcttgcctctaccgtctcggcagaaatggcacgaaatagacagctcatttgggagctggccagacagagcgaagcacaccttgatagaccagtggtcctgggagagcaggcgagcgcacagagggaggtggcctcaattctgtgccgaaagtcagtattagctatcaatcagcttgccgctaccgttgagggaacgatttctgttctgcagcaatttaacgagctgctggatcaccccttggacccagggaggagctag

SEQ ID NO: 224660 - DNA, 1230 bp, Artificial Sequence
  Description of Artificial Sequence: Synthetic coding sequence
atgagacgatacctccgagtggtagtgctgtgtgtggcctgtggtttttgtagtctcctgtacgccttcagccaactggctgtttcccttgaggaagggacagggggtggtggaggaaagccacaggcagcagtggcctcatggctggctgggggagggcgtggtgctgtccgaggtgccggagtggccggaccggctgcccatcctggggttagtgatagatactcccttaaaatccagccagtcgaaaaaatgcatctggccgttgtggcctgtggcgaaagactggaggaaactatgactatgctgaaatctgccataatcttttccattaagccccttcaatttcacatcttcgcagaagatcagctgcaccattcctttaaaggacgcctcgataattggtccttcttacagacttttaattatactctttacccaatcaccttcccatcagagaatgccgcagagtggaagaagctgttcaagccttgcgcaagtcagcggttattcttgcctctgattctgaaggaagtcgatagcctgctttatgtcgatactgacatcctgttcctgaggcccgtggatgacatttggtcactgcttaagaagtttaactccacacagattgccgctatggcaccagagcacgaagaacctagaattggctggtacaaccgcttcgccagacatccgtactatggaaaaactggggtgaactccggcgtcatgctgatgaatatgacgcgcatgaggagaaagtactttaagaacgacatgaccaccgtgaggctacaatggggtgacatcctgatgcctctcctcaaaaagtataaactcaacatcacatggggagaccaggatctcctaaacatcgtgttctttcacaatccagagagcctattcgttttcccatgtcagtggaattataggcccgatcattgtatttacggatcaaattgtcaggaggctgaagaagggggaatcttcatcttacatggcaacaggggggtctatcacgacgacaaacagcccgcattccgagccgtctatgaagctctccgtaactgttctttcgaagacgataatatccgtagtttacttaagccacttgaactcgagctccagaagacagtgcatacgtactgcgggaaaatttacaagatattcattaagcagctcgccaagtccgtgagagataggtatgccaggtctcctaaagagaagtag

SEQ ID NO: 224661 - DNA, 1323 bp, Artificial Sequence
  Description of Artificial Sequence: Synthetic coding sequence
atgagaagatacttacgcgtggtggtgttatgtgttgcctgtggtttctgctcactgctgtacgccttctctcagttagccgtttctctggaggagggcaccggcggtggcggtggaaagccgcaggcagccgtcgcctcctggctcgccggaggcggtcgtggagctgttaggggcgctggggttgccggaccagccgctcaccccggagtttcagatcgatgcaaggacttcagcctctgttattggaacccatactggatgctgccttctgacgtttgtggcatgaactgtttctgggaagctgcgttcaggtactcccttaaaattcagcccgtggaaaaaatgcaccttgctgtggtggcatgcggagagcgcctagaggagactatgactatgctcaaaagcgccattatcttctctatcaaaccacttcagttccatatcttcgctgaggatcaactccatcactcctttaaaggacgactggataactggagcttccttcaaacctttaattatacactctacccaatcacattccccagcgaaaatgctgccgaatggaagaagcttttcaaaccctgtgccagtcagcgactctttctgcccctgatcctgaaagaggtggactctctcttatacgttgacaccgatatcctcttcctcaggcctgttgacgacatctggtccctgctgaaaaaattcaatagtacccagattgcagctatggctcctgagcatgaggaacccagaatcgggtggtacaacagatttgctaggcacccttattatgggaaaacgggtgtgaactctggagtaatgctgatgaatatgacccgaatgcgaagaaagtactttaagaatgatatgaccacagtccgcctccagtggggggatatcttaatgccactgttgaagaaatacaaattaaatatcacctggggtgaccaagacctcctcaacatcgttttcttccataaccctgagtcactgtttgtctttccgtgccaatggaattaccgcccagatcattgtatttacggctcgaactgtcaggaagcggaagaaggaggcatttttatcctccacggtaacaggggcgtgtaccacgatgacaagcaaccagcttttagagccgtgtacgaggccctgaggaactgttcttttgaagatgacaatatccgctccctgctaaaacctctcgagctagagcttcagaaaaccgttcacacttactgcggcaaaatctataaaattttcatcaagcagctggcgaagagcgtgcgcgatcgatacgcaagatcccccaaggagaagtag

SEQ ID NO: 224662 - DNA, 1332 bp, Artificial Sequence
  Description of Artificial Sequence: Synthetic coding sequence
atgaaattgcggtcaaaagcagcagctctgctcctattagctctggcagcccttctgcttgctcttctctcactacgggctggaagagccgagccaccggcactgcctgcgagaccagcaagcgcccctcagcgacaccccgcacccgtgccagcaaggtggcctggccctggcgcactgccgggagcctcccccggagtcaggcgaagacggccacctcgtcctaggcctcgcgctgggcgacggggtgccgctcgattggagaagctggcacgacgcccaggcgaacctcgaagctttcaagcagtgctgccacctgaactatggatccatctggccgtggtggcgtgcggcaataggctagaggagacactcgtcatgttgaaatccgctgtactgttttcccaccgcaagatccagtttcacatttttactgaagatagcctcaaaccagagttcgacaagcagttgcggcagtggccagattcttacactaagaagtttgagcaccgcatttatcctatcacctttagtgtagggaatcctcaagaatggaaaaaattattcaagccatgcgctgctcagcgcctttttcttcccgtgatcctaaaagacgtggatagtctgctgtatgtagatactgatgtgttgtttctgagaccagtagatgacatttggaagttactgcgcctgtttaactctactcaactagcagcgatggcccctgaacacgagatcccaaaaatcgggtggtatagccggttcgccagacaccccttctatgggtctgccggtgtaaactcaggggtaatgttgatgaatctgacacgcatccgatcaactcagttcaagaactccatgatcccaactggactggcatgggaggatatgctgtacccactctaccaaaaatataagaatgccataacctggggtgatcaagatctgctaaatataatcttttacttcaatcctgaatgtttgtacgtgttcccttgtcagtggaactatcgtcccgaccactgcatgtacggatccaactgtcgcgaggccgagcatgagggcgtaagtgtgctgcacgggaatcgtggcgtttaccatgacgacaagcagcccactttcagagcgctttacgaagctattagggattttccctttcaggacaatctcttccagtctatgtactatcctctccaactgaaattcctggaaaccgtgcacactttatgtggtagaatcccccaagtgttcttgaagcagatcgagaaaactatgaagcgggcttacgagaaacacgtaattattcatgtcggccctaaccaaatgcactag

SEQ ID NO: 224663 - DNA, 1854 bp, Artificial Sequence
  Description of Artificial Sequence: Synthetic coding sequence
atgagatgcctggcagccagagtaaattataaaacgttgatcataatctgtgcattgtttacgctggttacagtgctactgtggaacaagtgctcaagcgacaaagccatacaatttccgagacggtcaagcagtggcttccgggtagacggcttcgagaaacgggcagctgcaagcgagagcaataactatatgaaccacgtagctaaacagcagtccgaggaggcttttcctcaggaacaacagaaagctccaccagtcgtgggcggttttaattccaatgttggttctaaggtgctggggcttaagtacgaggaaattgactgtctcattaatgatgagcacacaatcaaaggacggagggagggtaacgaggtttttctacctttcacatgggtggaaaaatacttcgatgtctacggaaaggtagtgcagtacgatgggtacgaccggttcgaattctcgcacagctactcaaaggtgtatgctcagagagctccataccatcccgacggggttttcatgtcattcgaagggtataatgtggaagttagggatagggtgaagtgtataagcggcgtagagggggtgcctctgtctacacagtggggccctcaggggtatttttacccaatacaaatcgcccaatatggattgtcgcactactctaaaaatctcaccgagaagcctcctcatatagaagtgtacgaaacagccgaggatcgcgacaaaaacaagcctaacgactggaccgtgcccaaaggatgcttcatggccaatgtcgcggacaaatcccgtttcacaaacgtcaaacagtttatcgcccctgaaactagcgaaggcgtgtcacttcagcttggtaacaccaaagactttatcatctctttcgacctgaagttccttacgaacggttccgtatctgttgttctcgagacgacggagaagaatcagctgtttactattcactatgtgagtaatgctcagctgattgctttcaaggaacgggatatttattatgggataggacccaggacgtcttggtctacagtgaccagggatcttgtaaccgatctgaggaaaggggttggcttgtccaacactaaagcggttaagcccacgaaaattatgcccaaaaaagtcgtcagactcatcgctaaggggaaaggctttttggataatattacaatctctaccaccgcccatatggccgcattctttgccgctagtgattggcttgttaggaatcaggacgaaaaaggtgggtggccaattatggtcacaaggaaactgggagaggggttcaaatccctggaacccggatggtattccgcaatggcccagggacaggccattagtactcttgtgcgggcttatttactgaccaaggaccatatctttctgaatagcgctctccgggctaccgcaccgtataagtttctttcggagcagcacggagtgaaggcagttttcatgaacaaacacgactggtacgaggagtaccctaccactcctagctcatttgtactaaatggattcatgtactcactgatcggtctctatgatctgaaggagaccgcaggggagaagctgggcaaggaagccaggtcactttacgagcgtggcatggaatcgttgaaggccatgctgcctttatacgacacagggtccggcactatttacgacctgcgacacttcatgcttgggatcgctcccaacctggcacgctgggactaccatactacccacatcaaccagctgcaacttttgtccaccattgatgagtctcctgtgttcaaagagtttgttaagcggtggaaaagttacctaaaaggctcccgagcaaagcacaactag

SEQ ID NO: 224664 - DNA, 1662 bp, Artificial Sequence
  Description of Artificial Sequence: Synthetic coding sequence
atgaatcacgtcgccaagcaacaatccgaggaagccttcccacaagagcagcagaaagcccctcctgtggttgggggttttaacagtaacgtcggctctaaggtgttagggttgaagtacgaggagatcgattgccttattaatgatgagcataccattaaaggcagacgggaggggaatgaagtgttcctccccttcacctgggtagagaaatatttcgatgtgtacggaaaggtggtacaatacgatggctacgaccgtttcgagttctcacactcctacagcaaggtctatgctcagagggcaccgtaccacccggatggtgtgtttatgtcctttgaaggatataacgtggaggtgagagacagagtcaagtgcatctcgggtgtcgaaggtgtcccccttagtacgcaatggggccctcaaggatacttctacccgatacagattgcccaatacggtctctctcactattccaaaaatcttaccgagaagcccccacacattgaagtttacgagaccgctgaggaccgagataagaacaagcctaatgactggacagtgccaaagggatgtttcatggccaatgtggcagacaagagtcggtttacaaacgtgaaacaatttattgccccagaaacctcagaaggagtctccctacagctgggcaatacaaaagactttattatctctttcgaccttaagttcctcactaacggtagcgtctctgtggtgctcgaaaccacagagaagaaccaattgttcactatccactatgtttcaaacgctcagctcattgcctttaaggagagggatatctactacggcataggacctcgtaccagttggtcaactgtcactagagacctggttaccgacctccgaaagggggtggggttaagcaacaccaaggctgttaagccgactaagatcatgccaaaaaaagtggttcggctgatcgcaaaaggcaaggggttcctggacaatatcactataagcactacagctcacatggctgccttcttcgctgcgtcagactggctggtgaggaaccaggacgagaaagggggttggcctatcatggtgacgcggaagctcggagaggggtttaaaagcctcgagccgggatggtattcggcaatggcgcaaggacaggccatctctacattggtgagagcctatcttctgaccaaagaccatatttttctgaactctgcactgagggccacagcaccctataaatttctcagcgaacaacatggcgtgaaagcagtattcatgaataaacacgactggtacgaggagtacccgacaaccccctctagtttcgtactcaacgggtttatgtattccctgatcggactgtacgatctcaaggaaactgctggcgagaagctgggcaaggaggctcgttcattgtacgaaagggggatggagagcttaaaggcgatgctacccttatacgatactggcagcggaaccatttacgacctccggcacttcatgcttggcatcgcacccaacctggctaggtgggattatcacacaacccatatcaaccaactacagcttctaagtaccatagacgagagtcctgtgttcaaggaatttgtaaaacggtggaagtcttacctgaagggttcacgcgcaaagcacaactag

SEQ ID NO: 224665 - DNA, 1956 bp, Artificial Sequence
  Description of Artificial Sequence: Synthetic coding sequence
atggccaggggctcagccgtcgcatgggctgctctgggacctctgctctgggggtgcgcgctgggcctccaggggggaatgctttatcctcaggagagcccctcaagggagtgtaaggagcttgacggcctctggtcattcagggccgacttttcagacaatagacgacggggattcgaagaacagtggtaccggcgtcctctgtgggaaagcggcccaacagtagatatgccagtgcctagtagctttaatgacattagtcaggattggcgccttcggcactttgtgggttgggtctggtatgagagggaagtgattctccctgagcgttggacccaggacctgcgcacacgagttgtcctgcggatcggctccgcacattcatatgctattgtctgggttaatggagttgatacactggaacatgagggcggatacctgcctttcgaagctgacatctccaatctcgtccaggttggcccacttcccagccgactgcgaatcactatcgctataaacaacacccttactcctaccactcttcctcccggaacgatacaatatttgacggatacatctaagtatcctaaaggatactttgtgcaaaatacttattttgacttcttcaactatgccggactccagcggagcgtgctcctgtataccacaccgaccacctacatcgacgacattaccgttaccaccagtgtggagcaggacagtgggcttgtcaactaccaaataagtgtgaagggttcgaacctgtttaagttggaggtgcgattgctggatgccgaaaataaggtagtggctaacggtactggaacccagggccaactcaaggtcccaggggtgagcctttggtggccctatctgatgcacgagagacctgcttacttgtactccctggaggttcagctgactgcacagacatccctggggccagttagcgacttttacacgctgccagtgggaattcgcaccgtcgcagtgacgaaaagtcaatttttgataaatgggaaaccattctacttccacggcgttaataaacatgaagacgctgacattagaggaaaggggttcgactggccactgctggttaaagactttaaccttttgaggtggttaggcgcaaatgctttccgaacatcacactatccctatgcagaggaggttatgcagatgtgtgaccggtacgggattgtagtaatagatgaatgtccaggtgttggacttgcgctgccacagttcttcaataatgtgagtctccaccatcatatgcaggtgatggaggaagtagtccgccgagacaaaaatcatcctgccgtcgtgatgtggtccgtcgccaacgagcccgcaagccacttagagtccgctgggtattacctcaaaatggtaatagcacatacaaaatcgctggaccccagtcggccagtaactttcgtgtcaaatagcaattatgctgccgacaaaggtgccccttatgtggatgtgatatgtctcaactcatactattcttggtaccatgactatgggcacttggagctgatccagctccagctcgccactcagtttgagaactggtacaaaaagtaccagaaaccgatcattcagagtgaatacggggcagaaacaatcgccggtttccaccaggatccccctctgatgtttacagaggaataccaaaagagtctgctggaacagtaccacctgggcctggatcagaagaggaggaaatacgttgtgggtgagctgatctggaacttcgcagatttcatgaccgaacagagtcccacccgggtccttgggaataagaagggcatattcactagacagcggcagccaaagagcgctgcgtttttactgagagagagatactggaaaatagcaaacgagacaagataccctcatagcgtggctaaatcccaatgtctagagaattctctgttcacatag

SEQ ID NO: 224666 - DNA, 1803 bp, Artificial Sequence
  Description of Artificial Sequence: Synthetic coding sequence
atggctaggggatcagccgtcgcttgggcggctctgggacccctgttatggggctgtgcactgggcctccagggtggtatgctgtatcctcaagagtctcctagtcgcgagtgtaaagaactcgatgggctatggtctttccgagccgacttcagtgacaatcgccgacgcggatttgaagagcagtggtaccggcgacctctctgggaatctggtccaacagtggacatgccagtgccttctagtttcaacgatatttctcaggattggcgtctcagacacttcgtaggttgggtctggtacgagagggaggttattttgcccgagcggtggactcaggacttacgcacaagggtagtgttgcgcatcggatccgcgcatagctacgccattgtgtgggtgaacggagtggatactcttgaacacgaaggtggctatctgcctttcgaggctgatattagtaaccttgtgcaggtggggcctctgccaagtcgcttgagaatcaccattgctatcaacaacacactgactccgacgactctccccccaggtacgattcagtatctaaccgacaccagcaagtatccaaagggatactttgtccagaatacttacttcgatttcttcaactatgccggtctacagcggagtgtcctcctctacaccactccaacaacatacatcgacgacattacagtcactacctctgtggaacaggatagtggcctcgtcaattaccagatttccgtcaagggctcaaacctctttaaactggaggtgaggctcctggacgccgagaacaaggtggtcgcaaatgggacaggtacacagggacaactgaaggtgcctggtgtttccttgtggtggccctacctgatgcacgagcgcccagcctatctgtacagcctggaaattagagggaaaggctttgattggcccttactcgtcaaggactttaatctcctgaggtggctcggcgctaacgcctttcgtacgtctcactatccctatgctgaggaggtgatgcagatgtgcgatcggtacggtattgttgtaatagacgagtgtcccggagtcgggctagcactgccccagttctttaataacgtctctctgcatcatcatatgcaagttatggaagaggtggttagacgagataaaaatcatcccgctgttgtcatgtggagcgtggccaatgagcccgcatctcaccttgagtctgcaggatactacctcaaaatggtgatcgcccacacaaagagccttgacccctcacgccctgtcaccttcgtctctaatagcaattatgccgcagataagggtgcaccctatgtggacgtgatctgcctgaatagctactattcttggtatcacgattacggtcatttggaacttatacagttacagctggcaacgcagtttgagaactggtataaaaaatatcagaagccaatcatacaaagcgagtacggtgctgagaccattgcaggcttccaccaggatccaccattaatgtttaccgaagaataccaaaagtctctgttggagcaatatcaccttggattagaccagaaacgacgaaaatatgttgtcggcgaactgatatggaattttgctgactttatgacggagcagtcccccacacgggttctgggcaacaaaaaggggatctttacaaggcagagacagccaaagagcgcagcctttctgttgcgggagcggtactggaaaattgcaaacgagactagatacccacactcggtagcaaagagccaatgcctggagaactccctctttacttag

SEQ ID NO: 224667 - DNA, 675 bp, Artificial Sequence
  Description of Artificial Sequence: Synthetic coding sequence
atggcatccagtactccatcgtcatctgctacttcttccaatgctggtgcggaccctaatacaacaaatttaaggccaacaacatacgacacttggtgtggagtggcacacggctgtacacgtaagctcggactgaagatttgtggtttcttgcagcgaacgaactccctggaggagaagagtcgcctggtctcagcctttaaagagcgtcaatcatcaaaaaatctgctgtcttgcgaaaactccgacagagatgcccgtttcagacggactgaaacagatttctctaatttattcgcgagggacctgcttcctgctaaaaatggagaggagcagacggtgcagtttctcctggaggtagtcgatatcctgctcaattatgtgcgcaaaacgtttgacaggagtacaaaagtccttgactttcatcatccccatcagctactggaaggaatggagggttttaaccttgaactgagtgaccatcctgagagcctggagcaaatcctcgtggactgccgtgacaccttgaaatatggagtacggacagggcacccccgattctttaaccagctctccaccggcctggacatcatcggcttagcaggcgaatggttgacgtccacagctaataccaacatgccttctgatatgcgcgagtgctggttgttgcggtag

SEQ ID NO: 224668 - DNA, 1785 bp, Artificial Sequence
  Description of Artificial Sequence: Synthetic coding sequence
atggcgagctccaccccttcatcaagtgccacctccagcaacgcaggcgctgatccgaataccacaaacctacggccaacaacgtacgacacctggtgtggggtcgcccacgggtgtacccgaaaacttggactgaaaatatgtggcttcctccagaggaccaattcactggaagaaaaaagccgcctagtttccgcctttaaggagagacagtctagcaagaacctcttgtcatgtgagaatagtgacagagatgccagatttcgaaggacagagactgatttctctaatctgttcgctagagatcttcttcccgctaagaacggagaagagcaaactgtgcagtttctgctggaagtagttgacattctactgaactatgtgcgtaaaaccttcgaccgctctactaaagtgctcgacttccatcacccacatcagctcctggagggaatggaggggttcaacctggagctgtccgaccacccagagagtctggaacagatcctcgtggactgtagagataccctaaagtatggcgtcagaaccggccaccccagattttttaaccaactgtcgaccggactcgatatcattggcctggctggcgagtggcttacatccaccgcaaataccaatatgtttacgtacgagatcgcacctgtctttgtcctcatggagcagattacactgaaaaagatgcgggagatcgtgggttggtcatcgaaggacggcgatgggatatttagccctggaggggcaatcagtaacatgtatagtatcatggcagctcgctacaaatatttcccagaggtgaagactaagggcatggcagccgttccgaagctagtgctgttcacctctgaacagagccattatagcatcaagaaggccggtgcagcactaggctttggcaccgataacgtcatcttgatcaagtgtaacgagagagggaagatcataccagctgactttgaagccaaaattctggaagctaagcaaaaaggatatgttcccttctatgttaatgcgactgccggaacgacagtgtacggcgctttcgaccccattcaggaaatcgcagacatctgcgaaaagtataacctgtggttacatgtggacgcggcttggggagggggattattgatgagcagaaagcatcggcacaaactgaatggaattgaacgggctaactctgtcacatggaatcctcataagatgatgggggtcttgctgcaatgctctgccatcctggtcaaagaaaaggggatacttcagggttgcaaccagatgtgtgctggctacctctttcagccagacaagcagtacgatgtctcatatgatacaggtgacaaggctattcagtgtggcaggcatgtcgacatcttcaagttttggcttatgtggaaagctaagggcactgtgggattcgagaaccagatcaataagtgtctggaattggccgagtacctatatgccaagattaaaaatcgtgaagagtttgagatggtgttcaatggcgaacctgaacacactaacgtgtgcttttggtacatccctcagagcctgagaggagtgcccgatagcccacagcgtagagaaaaactccacaaggttgccccaaaaatcaaagctctaatgatggagtccggcaccactatggttggctatcaaccccagggcgacaaggccaacttttttcgtatggtcattagcaacccagccgcaactcagtccgatatcgacttcctgatcgaggagatcgagcgtctaggtcaggatctgtag

SEQ ID NO: 224669 - DNA, 675 bp, Artificial Sequence
  Description of Artificial Sequence: Synthetic coding sequence
atggcatcgagcacgccctcctcttctgcaacttcttccaatgccggagctgaccctaatacaactaacctgagacctacaacgtatgatacgtggtgtggagtcgcccatgggtgtactcgtaagctgggcctgaagatttgcggcttcctccagaggaccaatagcctggaggagaagagtcgactggtttccgcctttaaggaaaggcagtcatcaaagaacctgctgagttgcgagaatagcgatagggatgccagattccgccgaactgagacggatttctcaaatctcttcgcgcgtgatctactcccagccaagaatggagaggagcagactgttcagtttttgctggaagtggtggatatccttttgaactacgtgaggaaaactttcgataggagcactaaggtgctcgatttccaccatccgcatcagctgttggagggtatggagggttttaacctagaacttagcgatcaccctgaaagcctggaacagattttggtggactgcagggatactctgaagtatggtgtaagaactggccatccacgctttttcaaccagctgtctaccgggctggacataattggccttgcaggggaatggttgacctccacggcgaataccaatatgccatctgatatgagagaatgttggctgctgcgctag

SEQ ID NO: 224670 - DNA, 114 bp, Artificial Sequence
  Description of Artificial Sequence: Synthetic coding sequence
atggcctcgtcaaccccgtcgagtagtgccacctcctcaaacgctggagcggaccccaatacgactaaccttagaccgacaacttacgacacttggtgcggtgtcgcccattag

SEQ ID NO: 224671 - DNA, 258 bp, Artificial Sequence
  Description of Artificial Sequence: Synthetic coding sequence
atggcaagctctacccctagctcatcagctacgtcgtccaacgctggggctgatcccaacacaacaaacctgaggcctactacctacgatacgtggtgcggcgtcgcacatggttgcacccggaagctcggccttaagatatgcggatttctgcagagaacaaactcgcttgaagagaagtcaagactcgtgtcagcatttaaggaacgacaaagctccaagaacttgctttcttgtgaaaacagcgacagagattag

SEQ ID NO: 224672 - DNA, 348 bp, Artificial Sequence
  Description of Artificial Sequence: Synthetic coding sequence
atggcctcaagcaccccatccagcagcgctactagctccaatgccggagcagacccgaacacgaccaaccttcggccaactacatacgatacctggtgtggcgtggcccacggttgcacaagaaagctgggccttaaaatctgcggcttcctgcagagaactaacagcctggaggagaaatctagactggtatctgcttttaaggagagacagagcagcaaaaacctcctctcttgcgaaaatagtgaccgcgacgcccgattcaggaggacagagacggatttttctaacctatttgccagagacctgcttccggcaaagaatggggaggagcaaactgtgcaatag

SEQ ID NO: 224673 - DNA, 366 bp, Artificial Sequence
  Description of Artificial Sequence: Synthetic coding sequence
atggcttcttccacgcccagtagctcagcgacaagtagtaatgccggagcagacccgaataccactaatttgcggcctaccacttatgacacgtggtgcggcgtggcacacggatgtacccgcaaactcgggctgaaaatttgtgggtttcttcagcgcacaaactccttggaggagaagtctaggctcgtttcggcgtttaaggaaaggcaaagtagcaagaacttgctgtcctgcgagaacagcgatcgagatgccaggtttcggaggactgaaactgattttagtaatctgtttgcccgtgatctgctgccagccaagaacggtgaagaacagaccgtgcagttcctgctggaagtggtctag

SEQ ID NO: 224674 - DNA, 1758 bp, Artificial Sequence
  Description of Artificial Sequence: Synthetic coding sequence
atggccagccctggcagcgggttttggagttttggatcagaggatggttccggagacagtgagaaccccggaaccgctcgcgcatggtgtcaggtggcacagaagttcacaggagggattggaaacaagttatgcgcgctcttgtacggggacgctgaaaagcctgccgagtctgggggaagccagcctccaagagccgcagcaagaaaagccgcttgcgcttgcgaccagaaaccctgttcctgctctaaggtggacgtgaactacgccttcttgcacgcaaccgatctgttacccgcatgcgacggggaacggcctaccttagcattcttgcaggatgttatgaacatcttgctgcagtacgttgttaagagcttcgatagatccactaaggttatagactttcattacccaaacgaactgttgcaggagtataactgggagttagccgatcagccccaaaacctggaagaaattctgatgcattgtcagactacactgaaatatgcaattaaaaccgggcaccctcgatattttaatcaattgtccactggcctggacatggtcgggctggccgcagattggctgacttcgactgccaatacgaacatgtttacttacgagattgcaccagtctttgtgctgctcgaatacgtgacactgaagaagatgcgggagatcatcggctggccagggggatcaggggatggtatttttagcccagggggtgctatctccaacatgtatgccatgatgatagctaggtttaaaatgttccctgaggttaaagaaaaaggcatggccgctctccctcgacttatcgcttttacgtccgagcattcacactttagccttaagaagggagccgctgcactcggaattggcaccgacagtgtaatcctaataaaatgcgacgagcggggtaaaatgatcccctcagacctggaaagacgtatcctcgaagctaagcagaaggggttcgttcctttcctggtgagtgcaaccgcgggaactacagtgtacggcgcttttgatcctttgctggctgtagccgatatctgtaaaaagtacaaaatttggatgcatgtggatgccgcttgggggggtgggctactgatgtctaggaagcacaaatggaaactgtcaggtgtggaacgtgctaacagtgttacctggaacccacacaagatgatgggcgttccactgcagtgcagtgcccttctcgtgagggaggaaggcttaatgcaaaattgcaaccagatgcatgcatcatacctgtttcagcaagacaaacactatgatctgagctacgataccggagataaggcgctccagtgtggccgtcatgtggatgttttcaagctgtggttaatgtggagggccaagggcacaacgggatttgaagcccacgtggataaatgcttggagctcgccgagtacctgtacaacatcattaagaaccgcgaaggctacgaaatggtctttgacgggaagcctcagcacacaaacgtgtgcttttggtatattccaccatcccttagaacgttggaggacaacgaggagagaatgtcaagactgtccaaagttgcccctgtgataaaggcgcgaatgatggagtatggcactacaatggttagttaccagcccctgggagacaaagtaaacttcttcagaatggtgatttcaaacccagccgcaacccatcaggacatcgacttcttaattgaggagattgagcgtctcggacaagacttatag

SEQ ID NO: 224675 - DNA, 390 bp, Artificial Sequence
  Description of Artificial Sequence: Synthetic coding sequence
atgaacatactgctacaatacgtggtgaaatctttcgatcgcagtaccaaagtcattgactttcactacccgaatgagctgctgcaggaatacaattgggaacttgctgatcagccacagaacctagaagaaattttgatgcactgccagacaacgctaaagtacgcaatcaaaactgggcatcctcgctacttcaatcagctctcaaccggactggacatggtcgggttagcggcagactggctgacatccactgccaacacaaatatgtttacttacgaaattgccccagtgtttgttctgctggaatacgtgactctaaagaaaatgcgggaaatcatcggctggcccggtggtagtggcgatggcattttcagccccggtacctag

SEQ ID NO: 224676 - DNA, 1758 bp, Artificial Sequence
  Description of Artificial Sequence: Synthetic coding sequence
atggccagcccaggctccgggttctggtcgttcggctcggaggatggctcgggggactcagaaaatcccggaaccgcgagagcatggtgccaagtcgctcagaagttcactgggggaatagggaacaaattgtgtgccttgttgtatggggacgcagagaagccagccgagtcgggagggtcccaaccaccacgagctgcggctcggaaagcagcttgtgcatgcgatcagaagccctgtagctgctcgaaggtagacgtcaattatgcattccttcacgctactgacttattgccagcttgtgacggagagcgccctacattagcgttcttgcaagacgtgatgaacatcctgctgcagtacgtggtcaagtcttttgaccgctccactaaagtcatcgattttcactaccccaacgaactcctacaagaatataactgggaactggctgaccagccccaaaacctggaagaaatcttgatgcactgtcaaacaactctcaagtatgctattaaaacaggtcaccctagatacttcaaccagctgtccacaggattagatatggtcgggttggcagcagactggcttacttctaccgcgaacaccaacatgttcacttatgaaattgcccctgtatttgtcctgctggagtacgtgacgttaaagaaaatgcgagagatcatcggctggcccggagggtctggagacggaatctttagccccggaggcgctatcagtaacatgtatgcgatgatgattgccagatttaagatgttccccgaagtcaaggaaaaagggatggccgctttacccaggttaattgcttttaccagcgaacattcacacttctcgctcaaaaaaggggcagccgcactcggtattggcactgattctgtaattttaataaaatgcgacgagaggggtaagatgataccctccgatcttgaacgtaggatccttgaagcaaaacagaaaggctttgtaccttttctggtctctgccaccgccggaaccactgtgtacggagcctttgatccactgctggccgtggccgacatctgcaagaaatacaagatctggatgcatgtggatgctgcctggggcggaggcctcctgatgagtagaaaacacaaatggaagctgtcgggagttgagagagcgaatagtgtaacctggaatccccacaaaatgatgggtgtgcccctccaatgcagcgccttgctagtcagagaagagggacttatgcagaattgcaaccagatgcacgcatcgtatctctttcagcaggataaacactacgacctgtcctacgacaccggggacaaagccctgcagtgtggaagacacgtggatgtcttcaagctgtggttaatgtggcgggctaagggaactacaggatttgaggcccatgtagacaagtgcctggagttagctgagtatctctataatatcataaaaaatcgggagggctacgaaatggttttcgatgggaagccgcaacacacgaatgtttgtttctggtacatccctccttctctgcgcacacttgaagacaacgaggagcgcatgtctcgtctgtccaaggttgcccctgtgattaaagcccgtatgatggagtatggcactactatggtgtcctaccagcccctcggagacaaggtaaattttttccgtatggtgatcagcaaccctgcagccacacaccaagacatcgatttcctcattgaggagatagagcgcctgggacaagatctgtag

SEQ ID NO: 224677 - DNA, 567 bp, Artificial Sequence
  Description of Artificial Sequence: Synthetic coding sequence
atggcctctcccggttctggtttctggagctttggttcagaagatggatccggtgattccgaaaacccaggtacagcccgtgcttggtgtcaggtcgctcagaaattcacagggggtattggaaacaagttgtgcgccctcctgtatggagacgccgagaagccagccgagagcgggggatcccagcccccaagggcagctgcaagaaaggccgcatgcgcctgtgaccagaagccctgctcgtgttctaaggtggacgtgaactacgcattccttcatgctaccgacctgttgccagcctgtgatggggaacggccaacactggcgttcttgcaggatgttatgaatattctgttgcagtacgtggttaaaagctttgataggagcacgaaagtcatcgatttccattaccctaatgaacttttacaggaatacaactgggagctggccgaccagccgcagaatcttgaggagatccttatgcattgccaaaccaccttgaagtacgcaattaagacagggatcgtctcctcgaagatcattaaattattcttcagactccagtag

SEQ ID NO: 224678 - DNA, 1677 bp, Artificial Sequence
  Description of Artificial Sequence: Synthetic coding sequence
atgtaccgataccttggcgaagctcttctcttatcccgggctggcccagcggcattgggatctgcgtcagccgactccgctgccttactggggtgggccagggggcagccagctgctgcccctcaacccggactggcccttgccgcaaggaggcactactccgaggcggtggccgatagagaagacgatccgaacttctttaagatggtcgaagggttctttgataggggagcgtctattgtagaagataagctggttgaagacctgaggactagagaaagcgaagagcagaaacgaaacagggttagggggattcttcggatcatcaagccatgtaaccacgtgctgtcactgtcgttccctataaggagagacgatgggtcatgggaggttattgagggatacagggcacagcattcccagcaccgcaccccttgtaagggcggtattcgctattcaactgatgtttcagtagatgaagtcaaggccctggcatcattaatgacatataagtgtgccgttgtggatgtgccatttggtggagccaaggctggcgtcaaaatcaatcccaagaattacacggacaacgaattagagaagatcacaagaaggttcactatggaactggccaaaaaaggcttcatcggcccaggcatcgacgtacccgcaccagacatgtctacgggggagcgggaaatgagctggatcgccgacacatatgcatcaaccatcgggcactatgatatcaacgcccatgcctgtgtaactggtaaacccatcagccagggcggaattcatggtaggatctccgctactgggagaggagtgttccacgggatcgaaaacttcattaatgaggcatcatacatgagcattctcggcatgactcctggattcggcgacaagacttttgtcgtccagggtttcggcaatgtaggactccatagcatgagatacctgcacagatttggggcaaagtgcatagctgtcggagagtccgacggatccatttggaacccagacggaatcgaccctaaggagctggaggactttaaattgcagcatggatccattctagggttccccaaggccaagccgtacgaggggtccatcctcgaggcagactgtgacatcctaatccctgctgccagcgagaagcagcttacgaagagtaacgcccctagagtgaaagccaagatcatcgcggagggcgcaaatggacccacaaccccagaagccgataagatcttcttggagcgcaacatcatggtcatacctgatttatacctgaacgcgggaggcgttaccgtgtcatatttcgagtggctgaaaaacctgaatcatgtgagttacggccgactcaccttcaaatatgagagagacagcaactatcacctgctgatgtctgtgcaggaatccctggagcgtaagttcggtaagcacgggggaactattccgatagtgcctactgctgagtttcaggatcgaatcagcggcgctagtgagaaagacattgtccactccgggttggcgtacacgatggagagatccgctagacagatcatgagaacagcaatgaaatataatcttggccttgatctgaggactgccgcttacgtgaacgcaatcgagaaggtgtttaaggtttacaacgaggccggtgtgacttttacgtag

SEQ ID NO: 224679 - DNA, 1548 bp, Artificial Sequence
  Description of Artificial Sequence: Synthetic coding sequence
atgtacaggtatctgggccctgggactgcaagacgcagacctgccgcaggggctggtattggaagaccggcacccctccagcggggaggtggaagacccagaggcagacctcaactgctccaggacggcggtggcctgctaaggagccggagacagcaccgtggtggacaggcaggaggaggccctgaggatcccggtgaaagaggcgctgaggcagaaccgggtgcacggcacccagcagatcaccaggctctgcaaccgtgtgcggagagcctccttcctcaacatagtcagcatcgaactccttgcaagggcggtattcgttattccaccgatgtctccgtcgacgaggttaaagcactggccagcctaatgacttataagtgtgcagttgtcgacgtcccatttgggggagcaaaagctggcgtaaaaatcaatcccaaaaactacaccgacaatgaactggaaaaaatcactagacggttcaccatggagctggcgaagaagggcttcatcggaccaggcattgacgtacccgcacctgacatgtctacgggggagcgggaaatgagttggatcgccgacacctacgcttctactatagggcattatgacatcaacgcgcacgcttgtgtgaccgggaagccaatatcacaaggcggaattcacgggaggatcagtgccaccggtaggggagtatttcatggcatcgagaatttcataaatgaggcctcctacatgtctattcttgggatgacaccaggttttggtgataaaacttttgtagtgcagggcttcggtaatgttggtctgcactccatgcgatatctgcacaggttcggagcaaagtgtatcgccgttggcgagtcagatggatctatctggaatcccgatggcattgacccaaaagagttagaagatttcaagttacagcacggcagcatccttggctttcctaaggccaaaccctatgaagggagtattttggaggccgattgcgacattctaatcccagccgctagcgaaaagcagcttaccaaaagcaacgcaccacgggtaaaagccaaaatcatagcggaaggagcaaatggcccaaccacacccgaggctgacaagatttttcttgaacgcaacatcatggtgataccggacttatacctgaatgccggaggcgtgacagtgtcatatttcgagtggctaaagaatttaaatcacgtttcctacggaagactgaccttcaagtacgaacgggacagcaattaccatctgctgatgtccgtccaggagagccttgagaggaagtttggaaagcacgggggtaccatacccattgtgcctacagccgaattccaggatagaatcagcggagccagtgaaaaggatattgttcattcaggactggcttacacaatggaacggtcggccaggcaaatcatgcggacggcaatgaaatataacctcggcctagatctgcgcacagccgcatatgtgaacgccatcgaaaaggtgttcaaagtctataacgaggctggtgtcacctttacctag

SEQ ID NO: 224680 - DNA, 1473 bp, Artificial Sequence
  Description of Artificial Sequence: Synthetic coding sequence
atggttgagggattcttcgaccggggagcctccatcgtggaggacaagttagtggaagatttgagaacccgggagtctgaggaacagaaacgaaatcgtgtccgaggcattcttagaataattaagccttgcaaccacgtcctgtcgttatcttttcccattaggcgcgacgatgggtcctgggaagtcatcgaagggtaccgagcccagcacagtcagcatagaacgccctgtaaaggtggaatccggtacagtacagatgtgtccgtcgacgaggtaaaggcacttgcctccctcatgacttataaatgtgcagtcgtggacgtgccttttggcggagccaaggctggcgtcaagattaatccgaagaattatactgacaacgagttagagaaaatcaccagacgctttaccatggaactggccaaaaagggattcatcgggcctggaattgacgttcccgctccagacatgagtaccggcgagcgagaaatgtcatggatagccgacacctacgcgagcaccatcggccactatgatatcaacgctcacgcttgcgtaacaggtaagcccatatctcagggaggcattcatggcaggatcagcgccacaggcaggggtgtttttcacggaattgagaattttataaacgaagcgtcttacatgagcattctgggaatgactcctggattcggtgacaagacgtttgtggtccaggggttcgggaacgtgggcttacactctatgcgctatctccatagattcggagcaaagtgcatcgccgtcggagagagtgatggctccatctggaatccagatggcattgaccccaaggaattggaggattttaagctgcagcacgggtccatcctcggatttcccaaagccaaaccttatgagggttccattctggaggcggattgtgatatattgataccagcagcctctgagaaacagctaacgaagtctaatgctcctagggttaaagcaaaaattattgctgagggagccaatggcccaaccacccctgaggcagataaaatcttccttgaacgcaatattatggtgatccctgacttgtatcttaatgcagggggagtcaccgtgagctactttgaatggctcaagaaccttaaccatgtttcttacgggagactaacattcaagtacgagagggactctaactatcatctgctgatgtctgtgcaggagtcattggaacgcaagtttggaaagcatggagggacgattccaatcgttccaactgctgagtttcaagatcgcatttccggggcaagcgaaaaagacattgttcactcaggtctggcgtatacaatggaacgttcagctcggcagataatgcgaacagctatgaagtacaatctagggctcgacttgcgaactgccgcatacgtgaatgccattgaaaaggttttcaaggtgtataacgaggccggtgtgacttttacctag

SEQ ID NO: 224681 - DNA, 774 bp, Artificial Sequence
  Description of Artificial Sequence: Synthetic coding sequence
gagaacttcattgtggagggattcgggaacgtggggctgcattcaatgaggtatctgcaccgcttcggagccaaatgtatcgccgttggcgagagcgacggaagcatttggaatcccgacggaattgacccgaaagagttagaggacttcaagctccagcatggttctatactgggttttccgaaggcgaaaccctatgagggaagcattttggaagctgattgcgacattctaatacccgctgccagcgaaaaacagttgacaaaaagtaatgcgcctagggtaaaagctaagatcatagcggaaggggcaaacgggcctacgacgccggaggccgacaaaattttcttggaacgaaacattatggtgatcccagacctttacctcaatgccggtggcgtgaccgtctcatattttgagtggctcaagaatctgaatcacgtcagctacgggcgtctgacctttaaatacgagagggactctaattatcatttgctgatgtctgtgcaagagtctcttgagcggaagttcggaaagcacggcggaactattcctatcgtcccaaccgcggaattccaggaccggatttccggggcaagtgaaaaagacattgtgcatagtggcctcgcctacactatggagcgctccgcgaggcagattatgagaaccgctatgaagtacaacttaggccttgacttaaggacagctgcttacgttaacgcgattgagaaagttttcaaggtctataacgaggctggcgtcacttttacttag

SEQ ID NO: 224682 - DNA, 1176 bp, Artificial Sequence
  Description of Artificial Sequence: Synthetic coding sequence
atgacctacaagtgtgccgttgttgatgtccccttcggcggagctaaagctggcgtgaagattaacccgaagaattacaccgacaatgagcttgaaaaaataacccggaggtttacaatggaactggctaagaagggcttcatcgggcctggaatagacgtgccagcccctgacatgtcaacaggagagcgagagatgtcctggatcgcagatacctacgccagcaccatcgggcactatgacataaacgcccacgcttgtgtgacaggaaagcccattagccaaggagggatacatggcagaataagtgctacagggcgaggcgtgttccacggcatcgaaaattttatcaatgaggctagctacatgtcaatcctgggcatgacccctggtttcggagacaaaacttttgtggtgcaaggattcgggaatgtgggcttgcactcaatgagatacctccaccggttcggtgcaaaatgtatcgcagtgggggaaagtgacggatctatatggaatcccgatggtatcgatccgaaagaactggaagatttcaaactgcagcacggatctatcctgggctttcccaaggcaaaaccctacgaggggtctatcctggaagccgactgcgacatccttattccggctgcttctgagaagcagctaactaaatccaatgcccctagggtgaaggccaagatcatcgccgaaggagccaacggacctacaactccagaagccgacaagatcttcctggagcgcaacattatggtcattcccgacttatacctgaatgccggaggcgtgactgttagctacttcgaatggctcaagaatttaaatcatgtgtcatacgggcgtctaaccttcaaatatgagagagactcaaattatcacctcctgatgtccgtgcaggaaagcctagagcgaaagttcggaaagcatggaggaaccattcctatagtgcctaccgcagagttccaggaccgcatctcaggcgcatccgagaaggatattgtgcattcgggattagcttataccatggaaagatcagccagacaaataatgaggacagccatgaaatataacctcggactggacctaagaacagctgcctacgtgaacgccatcgaaaaggtgtttaaggtttacaacgaggctggagtgaccttcacttag

SEQ ID NO: 224683 - DNA, 1278 bp, Artificial Sequence
  Description of Artificial Sequence: Synthetic coding sequence
atgacatgcccctgcgataacgcaagttccgtattccttggattctgcatcagatacagcacggatgtctctgtggacgaagttaaggctctggcatctctgatgacctataagtgcgccgtggtcgatgtcccctttggcggtgccaaggcaggagtgaagatcaaccctaaaaattatacagataatgagcttgagaagattacgcggaggttcactatggagcttgccaagaagggcttcatcggacccggtattgacgtgccggctcccgacatgtctactggggagcgagagatgtcctggatagctgacacctatgccagtactatcgggcattacgacataaacgcacacgcttgtgtgactggaaaacctatctcacagggtggcatccacgggaggatcagcgctacagggagaggcgtgttccatggcatcgagaattttattaatgaggcgtcctacatgtccatcctgggcatgacgccaggttttggtgacaaaacattcgtggtgcaaggctttggcaacgtggggcttcacagtatgagatacttacaccgttttggggctaagtgcatagcagttggcgaatctgacggcagcatttggaacccggatggcattgacccaaaggagctcgaggattttaagctacaacacggttccatactgggttttccaaaggcaaaaccctacgaagggtcgatactagaggcagactgtgacatcctgattcccgcagcctcggaaaagcagctgacaaaatccaatgctccccgagtaaaggccaaaattatcgctgagggggctaacggccctaccacccccgaggccgataagatctttctggaaaggaacattatggtcatccctgacctgtatctaaacgccggaggtgtcactgtcagttacttcgagtggctgaagaacctcaaccatgtaagctatggacggttgacctttaaatatgagcgagatagtaattatcacctgctgatgtctgtccaggagtcgctagagcgtaagttcggtaagcacggcggaaccattcctatcgtccccacggctgagtttcaagatcgtatcagcggggcttcggagaaagacatcgtgcactccggactggcgtacacaatggagaggtctgctagacaaatcatgaggaccgctatgaagtacaatctaggtctggatctcaggactgcggcttatgttaacgccattgaaaaagtgttcaaagtttataacgaagctggagtgacatttacctag

SEQ ID NO: 224684 - DNA, 1677 bp, Artificial Sequence
  Description of Artificial Sequence: Synthetic coding sequence
atgtatagatatctcgccaaggccctgcttccttcccgcgcaggccctgccgcactgggcagtgcagctaatcattctgcggctttgctgggtcggggtcggggtcagcccgctgccgcatctcagcccggactggcactggctgcacgcagacattactctgagctagtggccgaccgggaagacgaccctaatttcttcaaaatggtggagggttttttcgaccgcggagcaagcatcgtggaggataaattggttaaggatcttagaacccaggaatccgaggagcagaaaagaaatagggttagaggcattcttcgcattatcaagccttgtaatcacgtgctgagcctttcttttccgatacggagagacgatgggtcttgggaggtaattgagggatatagggctcagcattcacaacatcgcaccccctgtaagggcggaattcgctattccaccgacgtgagtgtggatgaggttaaggccctagccagtctgatgacctacaaatgcgcggtggtggatgtgcctttcggcggagctaaggccggagtgaaaataaatcccaagaactatacagagaacgagttggaaaaaattactaggcgattcacaatggagctggcaaagaagggttttatagggccaggcgtggacgtacctgccccagatatgaacacaggcgagcgagagatgtcctggatcgccgatacatatgcatcaacaatcggccattatgacatcaacgcccacgcatgtgtgacgggaaaaccaatctctcagggcggaattcatggcagaattagcgccaccggcagaggggtctttcacgggatagaaaactttatcaatgaggcctcttacatgagtatccttgggatgaccccaggatttcgggacaagacattcgtggtgcagggttttgggaacgtgggccttcactcaatgagatacttgcaccgattcggggctaagtgcatagctgtgggcgagtctgacggctccatttggaatcccgatgggatcgaccctaaagagcttgaggactttaagttacagcacggtagcattctggggttccccaaggctaagccctatgaagggagtatactggaagttgactgcgacattcttatccctgcggctaccgagaagcaactgactaaatccaatgcgccacgcgtgaaagcaaaaatcattgccgagggtgctaatggccctactacacccgaagctgacaaaatttttctcgagaggaatatcctcgtaatacctgatctttacctgaacgcgggaggtgtgaccgtctcttattttgaatggctcaagaatttgaatcacgtgagttatggtcggcttacctttaaatacgaaagagattccaattaccatctacttttgagcgtgcaggaatcactggagcgaaaatttggaaaacatggagggaccatccccattgtgcccaccgcagagttccaagactcaatctctggcgcatctgaaaaagacatcgtgcattcagcattagcatatactatggagaggagcgccagacagataatgcacactgccatgaagtacaatctggggctggatctgcggacagctgcttatgtgaacgccatcgagaaggtgttcaaagtttacagcgaagccggagtaacattcacatag

SEQ ID NO: 224685 - DNA, 3342 bp, Artificial Sequence
  Description of Artificial Sequence: Synthetic coding sequence
atgattgccgtatctttcaaatgtcggtgtcagattctgcggaggctgaccaaagacgagtcaccttatactaaaagcgcaagtcagacaaaacctcctgatggggcactcgcagtgcggcgtcaatctatccccgaagaatttaaagggtcgacagtggtcgaactcatgaagaaggagggtaccacattgggtctgaccgtgagcggtggaatagataaagacggaaagccaagggtgtcgaacttgcgtcaggggggaatagccgctcgctcagatcagctcgatgtgggagactatataaaagcagtgaacggcattaatctggcgaagttccgacatgacgagataattagcctcttaaaaaatgtaggagagagagtagtcttagaggtggagtacgaactccctccagtgagtgtacagggcagctctgtgatatttcgcacggtggaggtaaccttgcacaaggaagggaacacatttggttttgtgataagaggcggagcacacgacgacagaaacaagtccaggcctgttgttatcacctgtgtgcgaccaggtggtcccgctgaccgcgagggtaccatcaagccgggagaccgacttctgtcagtggacggcataaggctgctaggcactacacacgccgaggccatgtcgatcctcaagcaatgtggacaggaagcggctctcctgattgagtacgatgtttccgtgatggatagcgtagcaaccgcctccggaccgttgcttgtggaggttgccaagaccccgggtgctagtctgggcgtggcattgaccacttctatgtgctgtaacaagcaagtgattgttattgataagattaagtccgccagcatcgctgacagatgcggggctctgcatgtaggcgatcacatactgtcaatcgatggtacatctatggagtactgcaccctagctgaggctacgcagtttctggcaaatacaactgatcaagtaaagctggagatattgccccaccatcagacacgcctcgcactgaaaggacccgaccacgtgaaaattcagcgctcagacaggcaactaacttgggacagctgggccagcaatcatagttcgctccacacaaaccatcactacaatacctaccatcccgatcattgccgtgttcctgcccttacgttcccgaaggctcccccacctaattccccccctgccctggtgagctcgtcgttttcccccactagcatgagtgcttacagcttgtcttctctgaatatggggactttgcccaggagtctgtattcaaccagccccaggggtaccatgatgaggcgtaggctgaagaaaaaagactttaaatcctcccttagcttagcctcaagtacggtgggccttgcaggccaggtggtgcacaccgaaacgaccgaggtagtactcactgccgatcctgtaaccggattcgggattcagctccagggaagcgtgtttgccacagaaaccttatccagccccccattaattagctatatagaagcagacagtcccgctgaaagatgcggggtgttacagatcggcgacagggtgatggccatcaatggcattccaactgaagacagtacattcgaagaagcctcacagctgttgcgagactcctccataacaagcaaagtgactcttgaaattgagttcgacgtagctgagagtgtaattccaagttccggtacctttcacgtgaagcttccaaagaagcataacgtcgaactaggtatcaccatctcgagccccagctcaaggaaacctggggacccattagtaatctccgacattaagaagggttctgtggctcaccggaccggcacactggaactgggcgataagctgctcgccatcgacaacattcgcctggacaactgttccatggaagatgcagtacagattttacaacagtgtgaagatttagtgaaacttaagatacggaaggatgaagataactccgacgagcaggaaagtagcggggcaataatttacaccgtcgaactaaaacggtacggtggacccttaggcattaccatatctggaacggaggagcctttcgatcccatcataatcagcagcttaaccaaaggtgggttggcagaacgtaccggcgctatccacattggagaccgcattctggctatcaactcttcgagcttgaaaggtaaacccctgagcgaagccatacatcttttacaaatggccggtgagacggtcacacttaagattaagaaacagacggacgcccaatctgctagtagcccaaagaagttccccattagcagccacctatccgatctgggagatgttgaggaagactccagccccgcacagaaaccaggcaaactcagcgacatgtacccaagcaccgtgccttctgtcgattcagccgtagattcatgggatggctctgctattgacacaagttatgggactcagggcaccagcttccaagcctctggatataatttcaatacatatgattggaggagccctaaacagagagggtccctgtcccctgtaaccaagcctcggagccagacctaccccgacgtgggtctgtcttatgaggattgggaccggtccacggcatcaggcttcgccggagccgctgattccgcagaaacagaacaggaggagaacttctggagccaagccctcgaggatttagagacatgcggacagtcaggaatactacgggagcttgaggcgactataatgagtgggtccaccatgagcttaaatcatgaagctcctaccccccgtagccagctgggtcgccaggcatcgttccaggagcgcagctcctctcgcccacactattcacagacaactcggagcaatacccttccctcagacgtcgggcgaaaatctgtgaccctccgcaagatgaaacaggaaatcaaggaaataatgtctccgacccccgtcgagttgcacaaagtcacactgtacaaggacagcgacatggaggattttggtttttcggtggccgatggcctgttggaaaaaggtgtgtacgtgaagaatatccgacccgctgggcctggagaccttggaggtctcaaaccatacgatcgcctgctccaggttaatcatgtgaggactcgagattttgactgctgcctcgtcgttcctctcatagccgaatctggaaataagctcgacctcgtgatctctcgtaaccccctggcatcccaaaagagcattgaccaacagagtcttcctggcgactggtctgagcagaatagcgccttcttccagcaaccttctcacgggggaaacttggaaactagagagcccacaaacactctctag

SEQ ID NO: 224686 - DNA, 3387 bp, Artificial Sequence
  Description of Artificial Sequence: Synthetic coding sequence
atgatcgccgttagcttcaaatgtcgatgtcagattctgcgcaggctgactaaggatgaatctccctacaccaagagcgcatcccagaccaagcccccagatggggctctggcagtgaggcgtcagtccatcccagaagaattcaagggctcaaccgtggtcgagctgatgaaaaaggaagggaccactctggggttgacagtgtccggcggaatcgacaaagacggcaaaccccgtgtatctaacttgcgccagggaggcatcgccgcacgaagtgatcagctcgacgtcggagactacatcaaggctgtaaatggtatcaacttggcaaagttccgccatgacgaaattatcagccttctgaaaaatgtcggagaaagagtggtgctcgaggtggagtacgagcttcctcctgtctcagttcaaggcagctccgtcatcttcagaacggtggaagtcacattgcataaggagggcaacaccttcggatttgtgatcaggggcggagcgcacgatgaccgaaataagtcacggccagtggtgatcacttgcgtgcgccctgggggacctgctgaccgggagggcacaattaagccaggtgatagactcctgagtgtcgacgggatcagactcctgggtactacccacgccgaagctatgtcaattctgaagcagtgtggacaggaggcggctctcttaatcgaatacgacgtctctgtgatggatagcgtggccaccgctagtggccctctgttagtcgaagttgcaaagaccccaggggcttcattgggcgtggcactcactacaagcatgtgctgcaacaagcaggtaatcgtcattgataagatcaagtctgctagcattgccgatcggtgcggtgctttgcatgtgggtgatcacatactcagtattgatggtacaagtatggaatattgcacactcgcagaagctactcagtttctggctaataccactgaccaggtcaagctcgaaattctgcctcatcaccagaccagactggctctgaaaggtccagatcatgtgaaaatacagcgctctgatcggcaattgacatgggacagttgggcctccaaccatagttccctgcataccaatcatcactataatacctaccatccagaccactgtagggttcctgccctgacctttccgaaggcacctccccctaatagccccccagccctcgtgagctcatccttctcgcctaccagcatgtcagcctatagtctctcatccctgaacatgggcacgctccccaggtctctgtatagcacctcacccaggggcacgatgatgaggcgacggcttaagaagaaagattttaaatcatctctctctctggcaagctcaactgttggcctcgccggtcaggtcgtccacaccgagactacggaggtcgtgctgaccgcggaccccgtcactggctttggcatccagctgcaggggagtgtgtttgcgaccgaaaccctctcatctccccctctcatctcttacatcgaggcggactcccccgctgagaggtgcggcgtcctgcagatcggagatcgggtaatggcaatcaacggaatccccaccgaggactccacgtttgaggaagcatcccagctgctgcgcgatagctccattacgagcaaggtcaccctggagatcgaattcgacgtcgctgagagcgtgatccccagtagcggcacattccacgtcaagctccctaaaaaacacaacgtggaactaggcatcacgatcagctcaccttccagtaggaaacccggtgaccctttggtgatcagtgacatcaagaagggcagcgtggctcaccggaccggcacactggagctgggcgacaagttgctggcgatcgacaacatccgcctggataactgttccatggaagacgccgtgcagatcttgcaacagtgcgaggaccttgtcaagctcaagatccgcaaagacgaggataatagcgatgaacaggagtcaagtggagccatcatttacaccgtggagctcaagagatatggcggtcccctcgggataacgatcagtggcaccgaagaaccctttgaccctatcatcatttcatcattaactaagggcggactcgccgagcggacgggggctattcatatcggcgataggatcctcgctattaacagtagctcccttaaaggcaaaccccttagcgaagccatccacctgttacagatggctggtgagactgtcacattaaagatcaaaaagcagacagacgctcaatcagcgagctctccaaaaaaattccccatatccagtcacctgtcagatcttggggacgtggaagaggactccagcccagctcagaagccaggaaaattaagcgatatgtacccttccaccgtgcccagcgtagattcagccgtcgatagctgggacggctctgccatcgacacatcctacggaacccagggaacctcctttcaagcctctggctataactttaacacctacgattggagatcgcccaaacagcggggatcactctcaccggtcacaaagccgagatctcagacttatcctgacgtggggctgtcatacgaggattgggatcgctcgacagcatcaggtttcgctggcgctgccgatagcgcagaaactgaacaagaggagaacttctggagccaggcactggaggatctggaaacctgtgggcaaagcggcatcctgagggagctcgaagagaaggctgacagaagagtatcactgaggaatatgacgttgttagctactatcatgtcaggcagcacgatgagcctcaatcatgaggctccaacacctcggtcacagctgggaagacaagcctcctttcaggaaagatcctcctcccggcctcactattcccagactacgcggtccaacactctgccatccgacgtcggaagaaagagcgttaccttgagaaagatgaagcaggagattaaagagataatgtccccaacccccgtggaactacataaggtaacattatacaaggactctgacatggaagacttcgggtttagcgtggcagacggcctgctcgagaagggcgtttacgttaaaaatattaggcctgcgggtcccggtgatctcggcggtctcaagccttatgacaggttgctgcaggtgaatcatgtccgcactagggactttgattgttgtttggtcgtcccgttgattgcagaaagcggaaataaactggatttagtcatcagccgcaatccgctggctagccagaaatccatagaccaacaaagtctgccgggagactggtctgagcagaatagcgccttttttcaacaaccatcacatggaggaaacttggaaactagagagcccaccaacacactgtag

SEQ ID NO: 224687 - DNA, 3231 bp, Artificial Sequence
  Description of Artificial Sequence: Synthetic coding sequence
atgatagctgtgtcattcaaatgtagatgccagatcttgaggcgcctcaccaaggacgaatccccttatacaaaaagcgcatctcaaacgaagcctcctgacggcgctctggcagtccgaagacagtctatcccagaggagtttaaaggctccaccgtggttgagctgatgaagaaagaagggaccacacttgggctgacagtgagcggcggtatagataaggatgggaagccgagagtgtcaaatctccggcagggtgggattgccgcaaggagtgatcaactggacgtgggagattatattaaggctgtcaatggcataaatctggccaagtttcgacatgatgagatcatttcattgctgaagaacgtcggagagcgcgtggttttggaagttgaatacgaactcccacctgtgagcgtgcaggggtcttccgtaatttttcgtacagtagaagtgactctgcacaaggagggaaacacattcgggtttgtgattcggggtggggctcatgacgaccgaaacaagtcgcgtccagtcgtgattacttgcgtgagaccaggcggtcccgcagatcgggagggcaccataaaaccaggagacagactgctctcggtggacggaatccggctgttgggcaccacccatgcagaagccatgagcatcctgaaacagtgtggacaggaagcagccctactcatcgaatatgatgtgagtgtcatggacagcgtcgcgaccgcctcggggccactgttagtcgaggtcgccaagacccctggcgcatccctgggcgtcgcactgactacaagtatgtgctgcaataagcaggtgatagtgattgacaagattaagtcggcatccatcgccgataggtgtggcgctctgcacgtgggggaccatatcttgtctatcgatggaacctccatggagtattgtaccctcgctgaggccacccaattcctcgctaacaccacagatcaggtcaagctcgagatcctaccgcaccatcagacacgcctcgctttaaagggcccagatcacgcagccctcgtctcctcctccttttcccctaccagcatgagcgcctacagcctgagcagtttaaatatgggcacgttgcctagaagcttgtattcaacatctcccaggggcaccatgatgcgacggagacttaaaaaaaaagatttcaaatctagtctcagcctggcgtcctcaacggtgggtttggctggtcaggttgtgcatacagaaacgacagaggtcgtgctgactgctgacccagttaccggcttcggcattcagcttcaagggtccgtgtttgcaactgagacccttagcagcccaccgctaatcagctatatcgaagctgactcacctgcggaacgatgcggggtgctgcaaatcggcgatcgcgtgatggccataaacggcatccctactgaagactccactttcgaggaggcctcacagttactccgagacagtagcatcactagtaaagtaacccttgagatagagttcgacgtcgccgaatccgttatacccagttctggaacatttcacgtcaagctgcccaaaaagcacaacgtagaacttggtattactatatccagcccatctagtcgtaagccaggtgacccattagttatctccgatattaagaaggggagtgtcgcacatcggacaggcacccttgagctcggagacaaactcttagccatcgacaacatccgactggacaactgttcaatggaagacgccgtgcagattctgcagcaatgtgaggatttggtgaagctcaaaattaggaaggacgaagataactctgatgagcaggaatctagtggggcaatcatttatacggtcgagttgaagaggtatggcggacctctgggaatcaccatttctggaactgaggaaccctttgaccctatcatcatctctagtctaaccaaggggggtctggcagagaggacgggtgcgatacacatcggggacaggatcctcgccattaactcgagctcactgaagggcaagcccttgtccgaggccatccatctgctccaaatggctggcgaaaccgtgacattgaagatcaagaagcaaaccgacgctcaatcagcttccagccccaagaaatttcccatcagttcccatctgtcagacttgggtgacgtcgaggaggactcctccccagcacagaagcctgggaagctgagtgatatgtacccctccacagttccatccgtggatagtgcggttgacagctgggatggttcagccatagatacttcttatgggactcagggtacctcattccaggcgagcggctacaacttcaatacctacgattggagatctcctaagcagcggggaagtttgtctcctgtgaccaaacccaggtctcagacttatcctgacgtgggacttagttatgaggattgggaccgctctacggcctccggatttgcaggggctgctgattctgccgaaaccgaacaagaggagaacttctggagccaagccttggaggacctggagacttgtggacagtccgggattctacgagagcttgaggaaaaagctgatagacgggtcagtctccgaaatatgacactcctggccaccataatgtcgggatcgaccatgagtctcaaccacgaggcaccaaccccaaggtcacagttgggccgtcaggcttcctttcaggaaaggtcatcctcaagacctcactactctcaaaccactcgatccaataccttgccaagcgacgttggacgtaagtccgtgacgcttaggaagatgaagcaggaaataaaggagattatgtcccctacccccgtcgagttacataaagtgacgctgtataaggactctgacatggaggacttcggtttttctgtcgcagacggcctgctggagaaaggcgtctatgttaagaacatacggccagctggacctggtgacctggggggtcttaaaccatatgaccgattactgcaggtcaatcacgtgagaactcgagacttcgattgttgtcttgtggttccccttatcgctgagagtggtaataagcttgatttggtgattagtcggaacccactggcctcacagaagtctatcgaccaacagagtctacctggtgattggagcgaacaaaactcagctttcttccaacagcccagtcatggaggcaacctggaaacccgggaacctactaatacgctctag

SEQ ID NO: 224688 - DNA, 2511 bp, Artificial Sequence
  Description of Artificial Sequence: Synthetic coding sequence
atggtccagttcagtacctcagaattccgattgactccccacattgacaatttggaggttgccaattccttcgcagtgacgaacgccttctgctcacagttcagccggggagtctatgccattttcggcttctatgacaagaagtccgtgaacactatcacttccttttgtggaacactccacgtgagtttcattacccctagttttcccaccgatgggacgcacccgttcgttatacagatgagacctgacctcaaaggtgccttgctgagcctgattgagtactaccagtgggacaagttcgcatacctgtatgattcagataggggtctgagtacactgcaagcagttctggatagtgctgccgaaaaaaagtggcaggtgacagcaataaatgtggggaatataaataatgataagaaggacgagatgtaccggagcttatttcaggaccttgagctgaagaaggagcgcagagtgattctggattgtgaacgggataaagtcaacgatatcgtcgaccaggtcataacaatcggaaagcacgttaagggttatcactatattatcgcgaacttggggtttaccgacggcgatctgttgaaaatccaatttggcggtgccaatgtgtccggcttccagattgtcgattacgacgacagtctggttagtaagttcattgagcgttggagcactctcgaggaaaaggagtatcctggtgcccataccacaacgatcaaatacacaagcgccctgacctacgatgccgtgcaggttatgaccgaggcgtttcgcaacctgcggaaacagaggatcgagatcagtcgtcgaggcaacgccggagattgtctggcgaaccctgcagtgccttggggccagggtgttgagattgagagagcactgaaacaagttcaggtggaggggctgtctggcaatatcaagtttgaccagaacgggaaaaggatcaactataccatcaatatcatggagctcaaaactaatggtcccagaaagatcgggtattggtctgaggtggacaagatggtggtaacgctgaccgagctgccatccggtaacgacacctctgggctggaaaacaagacagtggtggtgacaacaatactggaaagtccgtacgttatgatgaagaagaatcatgaaatgttagaaggtaatgagagatatgaaggttactgtgtggacttggctgcggagatcgcaaaacactgtggctttaagtacaaactgacaatagtcggagatgggaagtacggggcaagagatgccgataccaagatttggaatggtatggtaggtgaacttgtttacgggaaggccgacatagcgatcgctcctctgacaataacccttgtaagggaggaagttatcgacttctctaagcccttcatgagcctggggattagcatcatgatcaaaaaaccgcagaagagtaaacccggtgttttcagcttccttgatccgctagcttacgaaatttggatgtgcatagtgttcgcatatattggcgtctccgtcgtccttttccttgtgagcagattctccccctacgaatggcacaccgaggagttcgaagatggtagggagactcagagttccgagtctacgaacgagttcggcattttcaattccctatggttctcactgggagcctttatgcagcagggctgtgacattagtccgcgttcgctgtctggacgtattgttggaggcgtctggtggttctttacgctgatcatcatcagctcctacacggctaatctggctgcctttctcacagtcgagagaatggtgagcccaattgaatcagccgaggacctgtcaaagcagactgaaatcgcatatggcaccttagattctgggtcgactaaagaattcttccgcaggtcgaaaatcgccgttttcgacaaaatgtggacctatatgaggtccgctgaaccatccgtttttgtccgaaccaccgcagagggtgtggccagggtcagaaagagcaaggggaaatatgcatatttgctggagtctacgatgaatgagtacattgagcagcgcaagccgtgtgacacaatgaaagtgggtggtaatctcgacagtaagggatatgggatagcaacccccaaaggttcgtctctccgcacccccgtaaacttggccgtgctgaaactcagtgagcaaggcgtcctcgataaattgaaaaataagtggtggtatgacaagggggagtgcggtgccaaagacagtgggtccaaggagaagacatccgccttgagcctatctaacgtggcaggcgtgttctacatcctggtgggcggactgggtcttgccatgctcgtggctctcatcgagttctgttacaagagccgagccgaagcaaaacggatgaaagtggccaagaacgctcaaaacatcaacccaagctcgtcacagaactcccagaacttcgcaacttacaaagaaggttacaacgtctacggcatcgagtctgtgaaaatatag

SEQ ID NO: 224689 - DNA, 2706 bp, Artificial Sequence
  Description of Artificial Sequence: Synthetic coding sequence
atgtctacaatgcggctgttgaccctggcacttctattttcatgcagcgttgcgagagctgcctgcgatcccaagattgtgaatatcggagctgtgctatctactaggaaacacgaacaaatgtttcgagaggcggtgaatcaggcgaacaaacgacacggatcctggaaaattcagttgaatgcaacgtccgtgacacataagcccaatgcgatccagatggctctgtctgtctgcgaagatctcataagtagtcaagtctatgcaattctggtgagccatccccctactcccaatgatcatttcactccaacacccgtgtcctacaccgcagggttttacagaatacctgttctcggactgaccacgcggatgtctatctattctgataaaagcatccacctgtcctttctccgaacagtcccgccatatagccatcaatctagcgtctggttcgagatgatgagggtgtactcttggaaccatatcatcctgcttgtttccgatgatcacgaagggcgagctgcccagaagcgtttagaaaccctgttagaggagcgcgagagcaaggctgaaaaggtcctccagttcgatcccggtactaagaatgtaaccgccctgctgatggaggccaaggaactggaggcccgagtgatcatattaagcgcgtctgaggatgacgcagccacagtgtaccgcgcagcggcaatgctgaatatgacagggagcggttacgtttggctggtgggagagcgcgaaattagtggaaacgccctccgctacgcccctgacggcatcctgggcctccagctaatcaatggcaagaatgaatccgctcacatcagcgacgctgtgggagtggtagcccaggcggtccacgagctactagagaaggagaatatcacagatccgcctaggggatgcgtcggtaatacaaatatttggaagactggcccactattcaaacgtgtcctgatgtcttccaagtatgctgacggagtgacaggccgagtggagttcaatgaggatggggacaggaagtttgccaactatagcattatgaacctccagaaccggaaattggtccaggtgggaatctacaatggtacacatgtaatccccaatgacagaaaaataatctggcccggtggcgaaactgagaagccacgcggataccagatgagtacacggttgaagattgtgacaatacatcaggaacctttcgtctatgtgaaaccaaccctttccgacggtacttgtaaggaggagtttacggtaaacggcgacccagtgaagaaagtgatctgtacaggacccaacgacactagtcccggtagtccacgtcacaccgtcccgcagtgctgttacggtttctgtatcgatctcctaattaagctggcacggacaatgaactttacctacgaggttcatctcgtggccgacggcaagtttgggactcaggaacgtgtcaataatagcaataagaaggagtggaacggcatgatgggggaactgctaagcggacaagctgatatgatagtggctcccctgaccatcaacaatgaaagggcacagtacattgaatttagcaaacccttcaaataccaaggactgactatcttggttaaaaaggaaatcccgaggagcacgctggactcttttatgcagcctttccagtccacactgtggctgctggtgggcctttccgttcatgtggtggcagtgatgctgtacctgctcgatcggttttccccttttgggcgattcaaagttaatagcgaggaggaagaggaggacgcacttaccctctcctccgcaatgtggttctcatggggcgtcctgctcaattcaggcataggagaaggggctccccgatctttttccgctcggatccttggaatggtgtgggccggattcgcgatgattattgtagcttcctacacagctaacttggccgcattcttggtgttagatcgaccagaagagaggattacaggaataaatgatcctaggctgaggaacccaagcgacaagtttatctacgctacagtgaaacagtcatccgtagatatttatttccggagacaggtggagttgtcaaccatgtatcgacatatggaaaagcacaactatgagtccgctgccgaggccattcaggcagtgagagacaacaagctacacgcctttatctgggattccgcggtcctggagttcgaagcaagccaaaaatgtgatctcgttaccaccggagagctgttctttcgctctggttttggcatagggatgaggaaggattccccttggaagcaaaacgtctccctaagtatcttaaagagccacgagaatgggtttatggaagatctggataagacatgggttaggtatcaggagtgcgattcacggtccaatgctcccgcaacattaacttttgagaatatggctggcgtgttcatgctcgtggcaggtggaatcgtggccggtatctttctgatcttcatagaaatagcttacaagcgccacaaagacgcgagaagaaagcagatgcaacttgcgttcgcagcagtgaacgtctggcggaaaaatctgcaaagtacagggggaggaaggggcgctttgcagaaccagaaagatacggtgttgcctcgccgagccatagagagagaggagggccagctccagctatgcagccggcatagggagtcttag

SEQ ID NO: 224690 - DNA, 2658 bp, Artificial Sequence
  Description of Artificial Sequence: Synthetic coding sequence
atgtctacaatgcgtctgcttacccttgcactgttattcagctgctctgtggcacgagcggcttgcgatcccaaaattgtgaacatcggggctgtactttcaacacgcaagcacgagcagatgttcagagaggcggtgaaccaagctaacaaacgccatggaagttggaagatccagctgaatgcaacttccgtgacccacaagcccaacgctattcagatggcgctgtccgtgtgcgaggaccttattagttctcaagtttacgccattttagtgagtcatcctcccacccccaacgatcacttcacccctacccccgtaagctacaccgctgggttctatcgtatcccggtgctcggcctgaccacaaggatgagcatttattccgacaagtctatccacctgtccttcctaaggaccgtgccaccgtattcacaccagtcttctgtttggtttgagatgatgagggtatactcatggaaccatattattttgttggtgagtgacgatcacgaagggagagcagcgcagaaaagattggagaccctgctcgaagagcgagagagtaaggcagaaaaggtgctacagttcgatcctggtacaaagaatgtaactgcccttttaatggaagccaaggaactggaggcacgtgtgattatactcagcgctagcgaggacgacgctgcgaccgtgtaccgcgcagccgcaatgctcaacatgaccggcagcggatatgtatggctagtgggcgaacgagagatttcaggcaacgccctgaggtatgcccctgatgggattctcggcttacagttgatcaatgggaagaatgaatctgctcacatcagtgacgccgtcggcgttgtggcgcaggcagtccacgaactgttggaaaaggagaacataacggatccacccaggggatgtgtgggaaacacaaacatttggaagaccggtcctttattcaaaagggtgctgatgtccagtaaatatgctgatggcgtcacaggcagggtagagttcaacgaagacggggatcggaagttcgctaattactcaataatgaatctacagaatcggaaactagtgcaggtgggaatctacaacgggacccacgtaatccctaacgaccggaaaatcatttggcccggaggtgagacagaaaagccacgcggatatcaaatgtctacaaggctgaagattgttacgatccaccaggagccatttgtatatgttaagcccacgctttctgacggcacctgcaaagaggagttcacagtgaatggagatcctgtcaagaaggttatttgtaccggccctaatgacacttcgcccggaagcccgagacacaccgtgcctcagtgttgttatgggttctgcattgacctgctaattaaactggccagaacgatgaatttcacctacgaagtgcacctggtggctgacggcaaatttggcactcaggagagggtcaacaacagcaacaaaaaagagtggaacggcatgatgggtgagttattaagtgggcaggccgatatgattgtggcacctctaacgatcaacaacgagagggcacagtatatagagtttagcaagccattcaagtaccagggcctcacaatattggtcaagaaggaaattcctcgcagcactctcgatagcttcatgcagcctttccagagcaccctgtggcttttagtgggcctgagcgtccatgtggtggcagtgatgctgtacctcctggaccgtttctctccatttggaaggtttaaggtcaattcagaagaggaggaagaggatgctctgacactctcctccgccatgtggttctcatggggtgttcttctcaatagcgggattggcgaaggggctcccaggagcttcagtgcaagaatcctgggcatggtgtgggccggtttcgccatgataattgtggcaagttatacagccaatctggctgcgtttctggtcctggaccggccagaggaaaggattactggcattaacgatcccagacttaggaacccgagcgacaagttcatctacgcaacagtgaagcagtcttctgttgacatatacttccgaagacaggtggagctttcgaccatgtacagacacatggaaaaacacaattatgaaagcgctgctgaggccatacaagccgtcagagacaacaaacttcatgcgtttatttgggatagtgctgtcctggaattcgaggcctcacagaaatgtgacttggtgactacaggcgagttatttttccggagcggttttgggatcgggatgaggaaggacagcccctggaagcagaatgtaagtctgagcatcctgaaaagtcacgagaatggatttatggaagatctggacaagacttgggtgagataccaggagtgcgatagtcgaagtaacgctccggctaccctgacgttcgaaaacatggctggcgtctttatgcttgttgccggaggcatagtcgctgggatctttctcattttcatagagattgcctacaagcgtcacaaggacgcaagacgcaaacaaatgcaacttgcgttcgccgctgtgaatgtgtggcgcaagaacctgcagcagtaccatccaactgacatcacaggtcccttaaatttgtctgacccatccgttagtactgtggtttag

SEQ ID NO: 224691 - DNA, 2769 bp, Artificial Sequence
  Description of Artificial Sequence: Synthetic coding sequence
atggttcagttgcgaaaacttcttagagtcttaacactcatgaaatttccgtgctgtgtactggaagtgctcttgtgcgcacttgcagccgctgctaggggtcaggagatgtacgctcctcactcaatacgcatcgaaggcgacgtcaccctgggaggactgttcccagtacatgctaaagggccatcaggcgtgccctgcggggacatcaaacgcgaaaacggcattcacaggctggaggccatgctttacgctttggatcagatcaactccgatcctaatctcttacctaacgtgaccttaggtgctaggatcctagacacgtgctctagagacacctacgcattggagcagtccctgactttcgttcaagccctcatccagaaggacacttcagatgtcaggtgtacaaacggagaacccccagtgttcgtcaaacccgaaaaggttgtgggagtgatcggggctagcggttcctcagtgtctattatggtcgccaatatcttacgcttgttccagatcccccagatttcttacgcatcaaccgcccctgagctctcagacgacaggaggtatgatttcttcagccgggtcgtccctcccgattcttttcaagcacaggccatggtcgacattgtgaaggccctcggctggaattacgtgtcgacactggccagtgaaggaagttacggggaaaaaggtgttgaatcattcacacagataagcaaagaggccggaggtctgtgcattgcccagtctgtgcgaatcccccaggaacggaaagacaggacgatcgacttcgacaggataatcaaacagctgctggacacccccaattctagagccgtggtcattttcgccaatgacgaagacatcaaacagattctggcggctgccaaaagggccgaccaggtaggtcattttctttgggtggggtcggattcttggggatctaagattaatcccctgcaccagcacgaggatattgcagaaggtgcgattactatccaacccaaacgagcaacagtggagggcttcgatgcttacttcacatccagaactctcgaaaataatagacggaacgtctggttcgccgagtattgggaagaaaatttcaactgcaaattgacaatatcaggatccaaaaaagaagacacagacaggaaatgcactggccaggagcggattggcaaggactctaactatgagcaggaaggtaaagtccagttcgtcatagacgcagtgtacgctatggcccacgccctccaccatatgaataaagacttgtgcgccgactacaggggagtgtgcccggaaatggagcaagcaggagggaaaaaactgctgaagtatattaggaacgtaaactttaatggctccgcgggtactcctgtgatgttcaacaaaaatggcgatgcccctggtcggtacgacatttttcagtatcagaccactaatactagtaaccccggatacaggctcatcggccagtggactgatgagctgcagctcaacatcgaggatatgcagtgggggaaaggtgtgagagaaatcccagcctccgtatgcacgctgccctgcaaaccaggacaacgaaaaaagactcaaaaggggacgccttgctgttggacatgtgagccctgtgatggctaccagtatcaatttgacgagatgacatgtcagcactgcccgtacgatcagcgtcctaatgagaacaggaccggatgccaggatattcctatcatcaaactcgagtggcacagtccttgggccgtcatcccagtattcctggcgatgcttgggatcatagctaccattttcgtgatggcaaccttcatccggtacaatgatacacccatcgttagagcttccggaagagagctgtcatacgtgctcttaaccggaatatttctgtgttacattattactttcctgatgatagcgaaaccagatgtggcggtttgcagcttccggagggtgtttcttggcctgggcatgtgcatttcctatgccgctctcttgacaaagacaaatcgaatctatagaattttcgagcagggaaaaaagtctgtaactgccccaaggcttatttcaccaacctcacaactcgccattacctctagcctcatctccgttcagcttctgggtgtgttcatatggtttggcgttgatccccctaatatcattatcgattacgatgaacacaaaacgatgaaccctgagcaggcgcgtggcgtcctcaagtgcgacatcacggacctgcaaatcatctgcagcctgggatatagtattctactcatggttacatgtacggtatatgctattaagacccgcggtgtaccagagaattttaatgaggccaagcccataggattcacgatgtatactacttgcattgtgtggctggctttcattcccatctttttcggtacagcacagagcgccgagaagctctacatccaaactacaacgctgaccatctcaatgaacctgagcgcttctgtcgcattaggtatgctgtacatgcctaaggtgtatatcatcattttccaccccgagctcaacgtgcagaagcgtaaaagatctttcaaggctgttgtgactgcagccacgatgagttccagactgtcccacaaaccatcagacaggcctaacggggaagctaagaccgagttgtgtgaaaatgtggaccctaacaattgtatcccgccagtaaggaagtccgttcagaaatccgttacatggtacacgatcccccctactgtgtag

SEQ ID NO: 224692 - DNA, 2685 bp, Artificial Sequence
  Description of Artificial Sequence: Synthetic coding sequence
atggctaggcagaagaaaatgggccaatccgtactccgagccgttttttttctggtactggggctgctcggtcattctcacgggggttttccaaatactataagtattggaggtctgttcatgcggaacacggtgcaggaacatagtgcattccggtttgcagttcagctgtacaacactaaccagaacacgaccgaaaaacccttccacttgaattaccatgttgatcacttagacagctctaacagtttctcagtgacaaatgcgttctgcagtcagttctcacggggagtttacgccatttttgggttttatgatcaaatgtccatgaacaccttaaccagcttttgcggcgctctgcacacctcatttgtcacaccctcttttccgaccgacgccgacgtccagttcgtgatccagatgagacctgcactgaagggcgcaattttgtccctcctaggacattacaagtgggagaagttcgtctatctgtacgacacagagagaggattctccatcctgcaagctatcatggaagctgccgtacaaaataactggcaggtcacagcacgcagcgtgggcaatattaaggacgttcaggagttcaggcgcataatcgaggaaatggacaggcggcaggagaaacgctacctgatagactgtgaagttgagcgtattaatactattctcgagcaggttgtgatactcggtaaacacagccgagggtatcactacatgctagccaacctgggattcacggacatcctcctggaaagagtcatgcatgggggagcaaacatcacgggattccaaattgttaacaacgaaaaccctatggtgcagcagttcatccagcgatgggtgaggctggacgaaagagaatttccagaggctaaaaatgcccctttgaaatacactagtgccttgacacacgacgcaatcctggtcatcgcggaggccttcagatacttaaggcgccagcgggtggatgtttcacggaggggtagtgccggagactgcctggccaaccctgcagtgccttggagccagggaattgacatcgaaagagccttaaaaatggtacaagtccagggcatgaccgggaacatacagtttgatacctacggcagaagaacgaattatacaatagatgtctacgagatgaaagtgagcggaagtaggaaggccggatattggaatgagtacgagcgctttgttcccttttctgaccagcaaatctccaacgatagtgcttcctccgaaaacagaacaatcgttgtgactacaatcttagaaagtccatacgtaatgtacaagaagaatcacgagcaactggaggggaatgaaaggtatgagggctattgcgtcgaccttgcttacgagatcgctaagcatgtccgtatcaagtataagcttagtatcgtgggagacggaaagtacggagcacgcgatcctgagaccaagatttggaacgggatggtgggcgagctggtttacggcagagctgacatagctgtagctccactgaccataacattagtccgtgaggaggtcatcgactttagtaaaccattcatgagcctgggaatcagcattatgatcaaaaagcctcagaaatcgaaaccgggtgtgttttccttcctggaccctcttgcctacgagatttggatgtgtattgtgtttgcttacatcggagtgtcggtggtgctgttcctggtctcccggttctcaccatatgagtggcatctggaggacaataatgaggaacctcgagatccacagtcgccaccagaccccccaaacgaattcggtatttttaattcattatggttttccctgggcgcattcatgcagcagggttgcgatatctcacctcggagcctgtctggtcggatcgtcgggggagtctggtggttctttaccttaataattatcagctcctatacagctaatctggcagcattcctcaccgtggagaggatggtcagccctattgagtctgcggaagacctggctaagcaaaccgaaatcgcgtacgggacgctggatagcggcagtactaaagagttctttcgcagatctaaaattgccgtttacgagaagatgtggtcctatatgaagtcagctgaaccatccgtgttcactaagaccacggccgatggcgtggcgcgagttaggaaatctaaaggaaagttcgcattcttgctggaatctaccatgaatgagtatatagaacagagaaaaccatgcgatacaatgaaagtcggcggtaatctcgacagtaagggctacggggtggccacaccgaaagggtccgccctgagaaacgcggtgaatctagctgtcctgaagctgaatgagcagggcttgctggataaactgaaaaacaaatggtggtatgacaagggtgaatgcgggagcggaggaggagactctaaagataaaaccagtgcgctctcactcagtaacgtggctggcgtattttatattctggtgggagggcttggcttggccatgatggttgctttaatcgaattctgctacaagtcacgtgccgaatcaaagcggatgaaactgacgaaaaacacgcagaacttcaagcccgctcccgctactaacacacagaactacgccacttatcgagaggggtacaatgtgtatggcacagagtctgtgaagatctag

SEQ ID NO: 224693 - DNA, 432 bp, Artificial Sequence
  Description of Artificial Sequence: Synthetic coding sequence
atggcccgacagaagaaaatggggcagagtgtgctgagagcggttttctttctggtcctgggattacttggccacagccatggcggatttcctaatacgatttccattgggggactgtttatgcgcaatacagttcaggagcattctgcctttcgcttcgccgtccagctttataataccaatcaaaacaccacagagaagccttttcacctcaactaccacgtggaccatctggactcatctaactctttttcagtgacaaatgcatgccccgcagagcgtgattatctaccttggccagggagcatccgcgaaaataactggacggcccttccatgttgcaaagaccacggcctgcttcacttgaagtgctcccctggtggacgccagaactgggcctactgtatatggggggttactggcgaattatag

SEQ ID NO: 224694 - DNA, 2685 bp, Artificial Sequence
  Description of Artificial Sequence: Synthetic coding sequence
atggctcgccaaaagaagatggggcaatctgtgttgagggcagtcttctttttagtcctcgggctgctgggccactcgcatggtggcttccccaatacgatttccatcggaggcctgttcatgagaaataccgtgcaggaacactccgcgttcaggtttgctgtgcagttgtataacaccaatcagaatacaacagaaaagccttttcatctgaattatcacgtcgaccacctcgatagcagtaattccttctccgtcaccaacgccttctgtagtcagttctcaagaggggtttatgctatctttgggttctacgatcaaatgtcgatgaacactctcacctccttctgtggagctcttcatactagtttcgtgactccctcattccccacagacgccgacgtgcagttcgtgattcaaatgcgaccagccttaaagggagcaattctgagcctgctaggacattataagtgggagaagtttgtgtatctgtacgatacagaacgcggattttccatcctgcaggccatcatggaggctgccgtgcagaataattggcaggtgacggctcgatccgttggaaacatcaaggatgttcaggagttccggagaattatcgaagaaatggatagacgccaagagaagcgctatctcattgattgtgaggtggagcgcataaacacaattttggaacaggtggtgatcctcggcaagcacagtcgcggataccactatatgctagcaaatctgggctttacagacattctgctggaacgtgttatgcatggcggagccaatatcactggattccaaatagttaacaatgaaaaccctatggtgcagcagttcatccaacggtgggtgaggctggatgagagggaattccctgaggccaaaaatgcaccactgaaatatacttcggctttgactcatgacgcaattctcgtgattgctgaggcatttcggtacctccggcgacaacgggttgatgtatctaggcgcggaagcgcaggcgactgcttagccaatccagcggtgccatggtcccagggcattgacattgagagggccctaaagatggttcaggttcaagggatgacgggcaacattcagttcgatacctatggccgacggacaaactacacaattgatgtttacgaaatgaaggtctctggatctcgtaaagcaggatactggaatgagtatgagagatttgttccgttttcagatcagcagattagcaacgatagtgctagctccgagaaccggaccattgtggtgacaaccatcctcgaaagcccatacgtcatgtacaagaaaaatcatgagcagttagaggggaacgaaagatacgaaggttattgcgtagacctcgcttatgaaatagctaagcatgtgcgcattaaatacaagctctccatagttggcgatgggaaatacggagctcgcgatccggagacgaagatctggaacggcatggtcggcgagctggtctacggccgtgccgatatagccgtggctccactaactattactcttgtccgggaagaggtgatcgacttctctaagcctttcatgagtctcggcatcagtattatgataaagaagcctcagaagtctaaacctggcgtcttctccttcctcgacccactggcttatgagatctggatgtgcatagtgtttgcatatattggcgtcagtgtggtcctgttcctggtatctcggttctcaccatatgaatggcatttggaggataacaatgaagaaccaagagaccctcaaagtccaccggatcctcccaatgagtttggaattttcaattctctttggttttctctgggcgcttttatgcaacagggctgtgatatctccccacggagtttatccggacgaattgtaggtggggtttggtggttctttacgctgatcataatctcctcatataccgccaatctggccgcatttctgactgtggagcgtatggtgtcacccattgagagcgcagaggacctggccaagcagaccgagattgcctatgggacactggacagtggaagtaccaaggagttctttcgcaggagtaagatcgccgtgtacgagaaaatgtggtcatatatgaagagcgccgagcccagcgtgtttacaaaaacaactgcagatggagtggctagagtccgtaaaagcaaggggaagttcgccttcttactcgagtcgacaatgaatgagtacatcgaacagcgtaagccctgcgatactatgaaagttggcggaaacctggactccaagggatacggggtcgccactcccaaaggttcggcgctacggaatgcggtgaatctggccgtgttgaagctgaacgagcaaggattacttgataaattgaagaataagtggtggtacgacaagggggaatgcgggtctggtggtggggattctaaagacaagacaagtgcgctgtccttatccaatgtagcaggcgtgttctacatactggtagggggattggggctcgctatgatggtcgcccttattgagttttgttataagtcccgggcagaatccaagagaatgaaactgaccaaaaacacccagaactttaagcccgctcctgccactaatacacagaattacgcaacttaccgggagggatacaatgtctacggtacagagtccgtcaaaatatag

SEQ ID NO: 224695 - DNA, 2685 bp, Artificial Sequence
  Description of Artificial Sequence: Synthetic coding sequence
atggccaggcagaaaaagatgggccagtcggtgctgcgcgcagtgttttttctcgtgttgggacttctaggccatagccacggcggattcccaaacaccattagtatcgggggtctgttcatgcgtaacaccgtccaggaacattccgcttttcggtttgctgtacagctgtacaacaccaatcagaataccaccgagaagccattccacttgaactatcacgtggaccatctcgactccagcaacagttttagcgtcacgaatgccttctgctcgcagttctctcgcggtgtgtatgccatatttgggttctatgatcagatgtctatgaacacacttacttcgttctgtggcgctttacataccagtttcgtaacaccaagttttccaacggatgctgatgtgcaattcgtcattcagatgaggccagctctcaagggagctatcctctcattgcttgggcattacaaatgggagaaattcgtctacttgtatgacacagaacggggattttcaatcctgcaagccattatggaggcagctgttcagaataattggcaggtgactgccagaagcgtcgggaacatcaaagacgtccaggaattccggagaatcattgaagagatggatcggagacaggagaaacgttatctgattgactgtgaggtcgagagaattaacaccatcctggaacaggtggtcatcttgggcaaacactcaaggggatatcactatatgctggctaacctcggctttacggatatcctgctggaaagggtgatgcacgggggagccaacattacagggttccagattgtgaacaatgaaaatcctatggtccagcagttcatacagcgctgggttcgcttggatgaacgagaatttcccgaagccaaaaatgcaccactgaagtacacgtctgcactcacacatgacgcaatacttgtcatcgccgaggcgttcaggtacctgcggaggcaacgcgtcgacgttagcaggcgcggaagcgcaggcgactgcctcgcaaatccagcggttccctggtcacagggcattgacatcgagagagccttgaagatggtccaagtacaggggatgactgggaatatacagttcgacacatacggacggagaaccaactacacaatcgacgtatatgaaatgaaagtctccggcagtagaaaagcaggatactggaatgaatacgagaggttcgtgccattcagcgaccagcaaatctcgaacgactctgcttccagcgagaacaggacaattgtggtgacaactattctggaatctccatacgtcatgtataaaaagaatcacgagcagctggagggaaatgaaaggtatgaaggatattgcgtggatttggcctacgaaattgctaagcacgtcaggataaaatataaattgagcattgtgggtgatggaaagtatggcgctcgcgatccagaaactaagatatggaacggaatggtcggcgagctggtctacggaagagcagacatcgccgtcgccccactcaccatcactctggtcagagaggaagtgatagacttttctaaaccattcatgtcgctcggaatctccatcatgattaagaagcctcagaagtccaaaccaggagtgttcagtttcctcgatccccttgcctacgaaatctggatgtgtattgtcttcgcctacattggagtttccgtcgtcctcttcctcgtctctagattctccccatacgaatggcatctggaggacaacaatgaagagccccgtgaccctcagagtccccctgaccccccaaacgagttcggtatcttcaattccctgtggttttccctgggagccttcatgcagcaggggtgtgacattagccccagaagcctgagcggtaggatcgtgggcggagtatggtggttcttcaccctgatcatcatctcctcctacaccgcaaatcttgccgcattcctgacagtggagaggatggtaagtccaatagaaagcgctgaggacctagccaagcaaacagagatcgcttacggaacattagactctggctccacaaaggagtttttccggagaagtaagatcgcagtttacgagaaaatgtggtcttatatgaaatcagcagaaccctctgtcttcaccaaaaccaccgcagatggggtagcccgagtgcgcaagtctaagggcaagtttgccttcttgctggaatcaactatgaatgaatacattgagcaacggaaaccgtgcgacacaatgaaagtggggggaaacttagattccaaggggtacggagtggccactcccaaggggtcggccttaagaacgcctgtaaacctggcagttcttaagctctccgaacagggaatattagataagctcaaaaacaagtggtggtatgacaagggcgagtgtggggctaaagattcagggtctaaagataagacatcggctttgagcctctccaacgtcgcaggtgtcttctacatactggtcggcggattgggcctcgccatgatggttgcactgatcgaattctgctacaagagtcgcgcagagagcaaacggatgaaactgaccaagaacactcaaaacttcaagccagccccagctaccaatactcagaattacgccacataccgggagggctacaatgtgtatgggacagaatcagtcaaaatctag

SEQ ID NO: 224696 - DNA, 495 bp, Artificial Sequence
  Description of Artificial Sequence: Synthetic coding sequence
atggcacgtcaaaagaagatgggacagtctgttcttcgcgctgtcttttttttggtgctggggctgcttgggcacagccacggaggcttcccgaacaccatcagcatcggcggactttttatgaggaatactgtccaggagcacagcgcgttcagatttgccgtccagctgtacaacaccaaccaaaacactacagagaaaccattccacctaaattatcatgtcgatcacctcgactcttcgaactcattcagtgttactaacgcctgcccagccgaaagggactatttgccttggccgggttccatccgcgagaacaactggactgcgttgccttgttgtaaagaccatggtctgctgcacctgaaatgttctcccggaggacccgctaagacgggtcccattgtgagcggggctctgcaggtgaattgcaaaatgcgaactagatcacaggtgagcaccaccagtagcctgctcgagttttctactgaatag

SEQ ID NO: 224697 - DNA, 495 bp, Artificial Sequence
  Description of Artificial Sequence: Synthetic coding sequence
atggctcggcagaaaaagatgggtcagtctgtcctgcgggcagtcttcttcctggtgttgggactgctgggccattctcatggcggtttccccaacactatatcgatcggaggcctgttcatgaggaataccgttcaagagcattcagccttcaggtttgccgtgcaactgtataacaccaatcaaaatactaccgaaaaacccttccacctgaattaccatgtggaccatctggatagctctaatagtttttctgtcacaaacgcatgtccagctgagcgggattatctgccgtggccgggaagcattcgcgagaataattggaccgctctcccttgctgtaaagaccatggactgctgcacctcaaatgctctccgggagggcctgctaaaaccggccctatcgtatctggggcactacaggtgaactgtaaaatgaggactcggagccaagtgagcacgaccagctccctcctggaatttagcacagagtag

SEQ ID NO: 224698 - DNA, 1989 bp, Artificial Sequence
  Description of Artificial Sequence: Synthetic coding sequence
atgcttcagggaggggaagagagtcgactgtttgggtcactcttatggaccctcccatggcgtggtttattcatgcgcaataccgtacaggagcattctgcattcagatttgctgtccagctgtacaataccaatcagaatacaaccgagaagcctttccatttgaactatcacgtggatcacctggacagcagcaatagcttttccgtgacaaacgccttttgtagccagttctctagaggcgtgtacgcgatctttggattttatgatcagatgtctatgaatacacttacctcattctgtggtgccctccataccagtttcgtaacaccctctttccctaccgatgccgacgtgcagttcgtgatccagatgaggccagcgttgaagggcgctattttgtcgcttctgggccattacaaatgggagaagtttgtgtacctgtatgacaccgagcgaggcttttctatactgcaggctattatggaagccgctgtacagaataactggcaggttaccgctagatccgttggcaacataaaggatgtgcaggagtttcggaggataatcgaagaaatggatagaagacaggaaaagcggtacctaattgactgcgaggttgaaagaatcaatacaattcttgagcaggtggtcatcttaggaaagcacagccgtggataccactacatgctggcgaacttggggtttacagacatcctgctggagcgggtgatgcatggaggggctaatattactgggttccagatcgtcaataacgaaaacccgatggtgcagcagtttatccagaggtgggttaggctggacgaacgtgagttccccgaggcaaaaaacgcccctctcaagtacacgtctgctctaacccatgatgctatactggtgatcgccgaggcattccggtatttacgcagacaacgagtagatgtgtcacggaggggcagcgccggtgattgcttggcaaacccggcagtgccctggtcccagggcatcgacatcgaacgtgccctcaagatggttcaggtccaagggatgacaggaaatatacagttcgatacctatggacgacggaccaactatacgatcgacgtgtatgagatgaaggtatccggatcacgcaaggctggatactggaacgaatacgaaaggtttgtgcccttctccgaccagcagatctcaaacgatagcgcgagcagcgaaaacagaactattgtggttaccaccatcctggagtctccctatgttatgtataaaaagaaccatgagcagctggaagggaacgagaggtacgagggttactgtgtcgatctggcctacgagatagctaaacatgtacgcataaagtataagctctcaatcgttggcgatggaaagtatggtgctcgggatcccgagacaaaaatctggaatggcatggtcggcgaactggtctacggcagggccgatatcgcggtcgccccattaaccatcactcttgtccgcgaggaggtcattgacttcagtaagccttttatgagcctcgggatcagcatcatgatcaagaaacctcagaaatcaaagcctggcgttttctctttcctagaccctctcgcatacgagatatggatgtgcattgtgttcgcttatattggcgtctctgtggtgttgttcctggtatctaggttctcaccctacgaatggcacctggaggacaacaacgaagaacccagggacccccaatccccaccagatcctcctaacgaattcggtatttttaattcactttggttttcactcggagctttcatgcaacagggatgcgacatttctccccgtttcgtgttcgtcgcctactcaatgccgcattgcattctgtggtcatattctatacacgtgcatatggtgttcatacacctgaactcgcgatttttctcctttaacattccttcaaacgatcgcctgagcagtagccactgcgtctgcctgtgcccttag

SEQ ID NO: 224699 - DNA, 2475 bp, Artificial Sequence
  Description of Artificial Sequence: Synthetic coding sequence
atggcacgacagaaaaagatggggcagagcgtactgagagcagtttttttccttgttctgggcctgctggggcactctcatggtggttttccaaacaccattagtatcgggggattattcatgaggaataccgtgcaggagcactcagcttttagatttgccgtgcaactatataacactaatcagaacactaccgaaaaaccttttcatctgaattatcatgtcgaccatctagacagttctaattctttcagcgttactaatgctttctgcagtcaattttcgagaggcgtctacgcgatatttgggttttacgaccagatgagtatgaacacactgacgtcattttgtggtgctctccacacatcattcgtcacgcctagttttccgacagacgctgacgtccagttcgtcattcaaatgaggcctgctctgaaaggggcaattctttcgcttctgggtcactataaatgggagaagttcgtgtatctatatgataccgaacggggattctctattttgcaggctataatggaagcagccgtgcaaaacaactggcaggtcactgcacgtagcgtgggtaatataaaagatgttcaagagtttcgcaggattatcgaagagatggaccggagacaggagaaacgctacctcatagactgtgaagtggagcgaattaacacgatcctcgaacaagtggtgatcctagggaaacactcccggggttaccattatatgctggctaatctcggatttaccgacattctgctggaacgagtcatgcacggcggagctaacatcactggctttcagatcgtaaacaatgagaaccctatggtgcagcagttcatccaaaggtgggtgcggctggacgagcgcgaatttcctgaggccaaaaatgctccactgaagtacaccagcgctctaacccatgacgccattctcgtcatcgctgaggcattcagatatcttcggagacagagagtggacgtatccaggcgagggtccgcaggtgactgtctggcaaaccccgcagtaccctggagtcagggcatcgacatcgaaagagcacttaaaatggtgcaggtgcaaggcatgaccggcaacatccaattcgacacctatggcaggcgaaccaactacaccatcgacgtgtatgaaatgaaggtgagcgggagcagaaaggcagggtactggaacgaatacgaacggtttgttccattttccgaccagcaaattagtaacgattcagcctcatccgagaatcgaacaatagtcgttaccacaatcctcgaatcgccttatgttatgtacaagaagaatcatgagcagcttgaaggaaacgagcgctatgagggctattgtgtggatctggcttatgagatagccaaacacgtcaggatcaagtacaaactcagcatagtgggcgacgggaaatacggcgctcgggatcctgaaaccaagatctggaacgggatggtgggcgaactggtctatggacgggctgatatcgctgtggcccctctgaccatcactttggtacgggaggaagttatcgatttttctaagccattcatgtctttgggaatttcaatcatgattaaaaaaccccaaaagtccaaaccaggcgtgtttagtttcctggaccctctcgcgtacgagatctggatgtgtatcgtcttcgcttatatcggtgtatctgtcgtcctttttctcgtatcccgattctccccctatgagtggcacctggaagacaataatgaggaacccagggacccccagtctccccctgaccctcccaacgaattcgggatctttaactccctgtggttttccttaggcgctttcatgcagcaggggtgcgatatctccccccgtagtctgagtggcagaattgtgggaggggtgtggtggttcttcaccctgataattatttcttcatacacagccaatctggcagcattccttacagtggaacgcatggtcagtcccatcgagtctgctgaggatctggccaagcagactgaaatagcctacggcacgctcgatagtgggagcaccaaggagttttttagacggagcaaaatcgccgtgtacgaaaagatgtggtcatacatgaaaagtgccgaaccttctgtattcacaaaaaccacagcagacggggtggcgcgagtaaggaaaagcaaaggcaaatttgcattcctccttgagtccacaatgaacgaatatatcgagcagagaaagccgtgcgacactatgaaagtggggggtaaccttgatagcaagggttacggagttgccacgcctaagggatctgctctcagaaacgcagtgaacctggcggtgctcaagttaaatgagcaaggccttcttgacaagcttaaaaataaatggtggtacgacaagggcgaatgcggatctgggggtggcgattctaaaaacgcgtgtaaaccttgttctattgagacccaatag

SEQ ID NO: 224700 - DNA, 2709 bp, Artificial Sequence
  Description of Artificial Sequence: Synthetic coding sequence
atgcgcataatttcccgacagatcgtcctcctgttcagtggtttttggggcctcgccatgggggcattcccctccagtgtccagattggtggcctgttcatcaggaacactgaccaagaatacactgcatttaggttggctatttttctccataataccagtcctaacgccagcgaggccccatttaacttggtccctcacgtggacaacatcgagacagcaaacagcttcgccgtcaccaacgcgttttgttctcagtacagtcggggtgtgttcgcgatatttgggctgtacgataaacggagtgtgcatacactcacaagcttctgtagtgccttacacatttccctgattactccttcgttccccaccgagggcgagagccagttcgtgcttcagctgaggccctctttacgaggagctctgctttcacttctggaccactatgagtggaattgctttgtgtttctgtatgacacagacaggggttactctatcctccaggcaatcatggagaaggcaggccagaacggatggcatgtgtcagcaatctgcgtggaaaacttcaacgacgtgagttatcgacaattgctggaagagctcgaccggagacaggaaaaaaagttcgtgatcgactgtgagatcgagcggctgcagaatatcctggaacagattgtgtcagtgggcaaacatgtgaaaggataccattatatcatagctaacttaggatttaaggatatcagtctcgagagatttatccacggaggcgcaaacgtaactggctttcagttggtcgacttcaatacaccaatggttatcaaactgatggatcgctggaaaaaactggaccaacgcgagtatcctgggtcagagactcccccaaagtacacctccgctctgacctatgacggcgttctggtgatggcagagacctttcggagtctcaggagacagaaaatcgatatctctagacgcggaaacgcaggcgactgtttagcaaatccagccgctccctggggccagggtatagacatggagaggacgctcaagcaggtcaggatccaggggttgacagggaacgttcaatttgaccactacggacgcagagtgaattatactatggatgtgttcgagctgaaatccacaggaccaagaaaggtcggctattggaatgatatggacaagctggtcctcatccaggatgtgcccactttaggaaatgacacggccgcaattgaaaacagaacagtggtcgttactacaatcatggaatccccatacgtcatgtataaaaagaaccacgagatgtttgaaggcaacgacaagtatgaaggctactgcgttgatctggcaagtgagatcgccaagcatataggaatcaagtataagattgctatcgtgcctgatgggaaatatggagccagggatgcagatacaaagatatggaacgggatggtgggtgagctggtctacggaaaggctgagatagcaattgcgccacttaccatcaccctggttcgagaggaggtgattgacttttctaaacctttcatgtcactgggcatttcaatcatgatcaagaaacctcagaagagtaaacccggtgtgttctcctttctcgaccctctcgcttacgaaatctggatgtgcattgtcttcgcttacatcggggtgagtgtggtgttatttctcgtgtcgcgattctccccttacgagtggcatacggaggagcctgaggatggaaaggagggcccatcggatcagcccccaaacgaattcggaatattcaattctctgtggttttcactgggcgcatttatgcaacaagggtgcgacatttcaccgaggtctttgagtgggcgaattgttggcggagtctggtggtttttcactctcataattatctcatcctacactgcaaacttggctgcgttcttaacagttgaaaggatggtgagccccattgagtcagccgaggaccttgccaagcagactgagattgcatatggaactctggattctggaagtactaaagagttctttcggagatccaagatcgcagtttacgaaaagatgtggacttacatgaggtcagcagaaccctctgtgtttacacgcaccacagctgaaggcgttgcacgggtgcggaagtccaaggggaagttcgccttccttctggagtcaacaatgaacgaatatattgagcagcggaagccttgtgacacaatgaaagtgggaggtaacctggacagcaaaggctatggagttgccactcccaaaggctcgtctttacggactcccgtgaatctggcagtgctaaagctctctgaagctggcgtgctagataaacttaagaataagtggtggtacgacaaaggcgaatgcgggcctaaggattctggttccaaagacaaaaccagcgccctgtccctctccaacgtggctggcgtcttctacatcttagtgggcggactagggctggccatgcttgttgccctcatcgagttctgctataaatcacgcgctgaagcgaaaagaatgaaactgacctttagtgaggcgatcagaaacaaggccagacttagtatcacagggagcgtaggagagaatgggcgagtcctgacacctgactgcccaaaggccgtgcatacaggaacggctattcgccagagttctggcttagcggtcatagcatccgacctgccctag

SEQ ID NO: 224701 - DNA, 1302 bp, Artificial Sequence
  Description of Artificial Sequence: Synthetic coding sequence
atgcggatcatttccagacagattgtgctgcttttctcaggattctggggtctcgctatgggggctttcccctcttccgttcagattggaggtctcttcatcagaaacacagatcaggagtatactgctttcaggctggctattttcttgcacaatacctcgcctaacgccagcgaagcccctttcaatttagtgcctcacgtggacaacatagagaccgccaactccttcgcagtgacaaatgccttctgcagccaatattccagaggtgtgttcgcgatattcggtctgtatgataagcgatccgtccataccctcacaagcttctgttctgcactccacatttctctgatcacaccaagcttccccacagaaggagagagccagttcgtgctgcagttacggccatcattgcgcggagcgttgctctctttgctggaccactatgaatggaattgcttcgttttcttgtatgacaccgatcggggatattctattctgcaggccataatggagaaggcaggccagaacggctggcatgtctcggcaatctgcgtagagaacttcaacgacgtcagttaccggcagctactcgaagaactggatagaaggcaggaaaaaaaatttgttatcgattgcgaaatcgagcgactgcagaatattctggagcagatagtttccgttggtaagcatgtgaagggatatcactacattatagccaacctgggattcaaggatatatcactggagcggttcatacacggcggagccaacgtgacaggatttcagctggtcgactttaacacccccatggttatcaagctgatggacaggtggaagaaactggaccagcgtgaataccccggatcagaaaccccacccaagtatacaagtgctctgacttacgacggggtcctcgtgatggccgagactttccgatccttgcgcaggcagaaaatagatatctccaggagaggcaatgccggagattgtctcgctaaccccgcagctccttggggacagggtatcgacatggagcggacactgaagcaggtcaggatccagggattaacagggaatgtgcagttcgaccattacggacgcagggtaaactatacaatggacgtgttcgagctcaagtctactggccctcgcaaggtaggctactggaacgatatggataagttagtgctcattcaagatgtcccaacgcttgggaatgacacagccgctatcgagaaccgcactgttgtggtaacaaccatcatgcccctgatgaagaaccccattctccggaattag

SEQ ID NO: 224702 - DNA, 2655 bp, Artificial Sequence
  Description of Artificial Sequence: Synthetic coding sequence
atgcgcattatctcgcgtcagatcgtgctgttatttagcggcttctggggcctggctatgggagccttcccctcaagcgtgcagatcggaggattgtttattagaaacactgaccaggagtacacagcctttaggctcgcaatcttcttgcataacacatcgcccaacgcgagcgaagcacccttcaacctggtgcctcacgtagataatatagagaccgccaattcgttcgcggtgaccaatgcattctgttcccagtactctagaggagtgttcgccatctttggactctatgataagcgttcagtacacacactgaccagtttctgtagtgctttgcacatttccctcattactcctagcttccccacggagggagagagtcagttcgtcttgcagttgcgaccaagcttgcggggagccctgctgtccctgcttgaccattatgaatggaactgttttgtgttcctgtatgataccgacagaggatattccatactgcaagccatcatggagaaggccggtcagaatggatggcacgtgagtgccatttgcgttgaaaacttcaatgatgtttcttatcggcaactgctggaggagcttgacagacgacaagagaagaaattcgttatagactgtgagatagagagactgcagaacatcctcgagcagatcgtgtccgtcggaaagcatgttaagggctatcactatatcatagcaaacctgggctttaaagacatcagcctggaaaggtttatccacggcggtgccaatgtgacagggtttcagctagtggatttcaacacacctatggtcattaagctgatggaccggtggaagaagctcgatcagcgtgagtacccaggctccgaaacaccacccaaatacacttcggccttgacatacgacggcgttctggtgatggccgaaacctttcggtcactgaggagacagaaaatcgatatctcaagacgcggaaatgccggagactgtttggccaatcccgctgctccctggggccagggcatcgatatggagaggacactgaagcaggtgaggattcaggggctcactggaaatgtgcagttcgaccactatgggagaagggtaaattacactatggacgtattcgagttaaaatctaccggcccacgcaaagtggggtactggaacgacatggataagcttgtgctgatccaggatgtgccaacattgggaaatgacaccgcagccattgaaaatcggaccgtagtggtcaccactattatggaatcaccatacgtcatgtacaagaaaaatcacgaaatgttcgagggcaatgacaagtatgaaggttactgtgtagatttggcatccgagatcgcgaagcacattgggatcaaatataagattgctatcgttcccgatggaaaatacggcgctcgcgatgccgataccaagatttggaacgggatggtcggagaattggtctacggcaaagctgagattgcaatagcccctctgacgatcacattggtgcgtgaggaagtcattgactttagtaaaccgttcatgtctctggggatatctatcatgattaaaaagccacagaaaagtaagccaggtgtattctcatttttagaccctctagcttatgagatttggatgtgcatcgtcttcgcttacatcggagtgtcagtagttctgttcctggtcagcagatttagtccgtatgaatggcatacagaggagccagaggatggcaaagaaggcccatctgatcagccccctaacgaattcggcattttcaattccctgtggttctccctgggagcttttatgcagcagggatgcgatatttcccccagaagcctcagtggacggatcgtcggcggagtctggtggttcttcaccctcattattatcagttcatatacggcaaacctggccgctttcctaactgtggaacgtatggtgtcaccaattgagtccgcagaagatctcgcgaagcagaccgagatcgcatacggaaccctcgacagcggctctacaaaagagttttttcggagaagcaagatcgccgtatatgagaagatgtggacctatatgagatctgctgaaccatcggtgttcaccagaactactgcagaaggcgtggcgcgagtgcggaagtccaagggaaaatttgcatttctgttggaatccaccatgaacgagtatattgaacagagaaagccgtgcgataccatgaaggtcggcggtaatttggacagcaaagggtatggagtggccacacctaaaggaagcagcctccggaacgctgtgaacctagctgtgctcaagctcaatgaacaaggcttacttgataaacttaaaaacaaatggtggtatgataagggcgaatgtggaagtggaggtggtgattccaaagacaaaacatccgccctgtccctgagcaacgtggccggagtcttttacatcctggtaggcggactggggttggctatgctggtggccctgatcgaattctgctataaatctcgggctgaggccaaacgcatgaaagtcgcaaagtccgcccagacgttcaatccgactagctcacagaatacccagaacctggcgacctacagggaagggtacaacgtctacggaaccgagtccattaagatctag

SEQ ID NO: 224703 - DNA, 1302 bp, Artificial Sequence
  Description of Artificial Sequence: Synthetic coding sequence
atgcggattatcagccgccagatcgtactgctgtttagcggattttggggcctcgccatgggcgcttttccctcctccgtgcagattggtggactgttcatacgcaacacagatcaggaatacaccgctttccgtttggcaatttttctgcataatacttcccccaatgcatccgaggctccatttaacctggttccccatgtggacaacatagagacagcaaatagcttcgcagtgacgaacgccttttgctctcaatactctaggggtgtgttcgccatctttggactgtacgacaagcggagtgtgcacacacttacctctttctgttccgcactacacatcagtctgatcactccaagcttccccacagagggcgagagtcagtttgtactgcagctgcgaccatccctcaggggagccctcctgtccctgttggaccactacgagtggaactgctttgtgtttctttatgataccgaccgcggatacagcatccttcaggcaatcatggagaaggctggtcagaatggctggcatgtaagcgcgatatgcgtcgaaaatttcaatgacgtgagctacaggcaactgctggaagagctggaccgcaggcaggaaaagaagttcgttatcgactgcgagatcgagagactacagaacatcctggagcagatcgtgtctgtcgggaaacacgtgaagggttatcattacataattgccaatctcgggttcaaagatattagcctggaacgatttatccatggcggagcaaacgtgacgggctttcagctggtggatttcaatacaccaatggtaatcaagctcatggaccgctggaagaaactggaccagcgcgaatatccaggatccgagacacctcctaagtacacatcagcactgacatacgacggtgtgctcgtcatggccgagacattcagatcccttcgccgtcagaaaattgatatatccagacgcggaaatgctggcgattgcttggccaaccctgccgctccctgggggcagggtatagacatggagcggaccctgaaacaggttagaattcagggcttaaccggtaacgtgcaatttgaccactacggcaggcgggtcaactacaccatggacgttttcgaacttaagtctaccggccctcggaaggtgggctactggaatgacatggataaactggttctgattcaggatgtgccgacgttgggaaacgacactgccgcaattgaaaatcgtaccgtagtcgttactacgataatgcccctaatgaagaaccctattcttcgcaactag

SEQ ID NO: 224704 - DNA, 2655 bp, Artificial Sequence
  Description of Artificial Sequence: Synthetic coding sequence
atgaggattattagccgtcaaatagttttgttattttcagggttctggggtctggccatgggcgcatttccctcatcagtgcagattggcggtctttttatccgaaacaccgatcaggaatatacggcatttagactcgcaattttcttacataatacatcacccaacgcgagcgaggctccctttaatctcgtgccccacgtggacaacattgagacagcaaatagctttgcagttaccaatgctttttgtagccagtattcccgcggtgtgtttgcaatctttggattgtacgataaacgctccgtgcacacgctcacctctttctgctctgcactccacatctctcttattaccccttcgttcccgaccgagggggagtcccaattcgtgttgcagttaagaccctctctaaggggggcactcttatctctgctggaccattatgagtggaattgcttcgttttcctgtacgataccgatcggggatactctatccttcaagccatcatggaaaaagctggccagaatggatggcacgtcagcgccatttgcgtagagaattttaatgatgtcagttacagacagctgcttgaagaactggataggaggcaggaaaaaaaatttgtaattgattgcgagatagagagattgcagaacatcctggaacagatagtcagcgtgggaaagcacgtgaaaggctaccactatattatcgcaaaccttgggtttaaagacatctctctcgaaaggttcattcacggaggagcaaatgtgacaggattccagctcgtggatttcaacactccaatggtaattaaactgatggacagatggaagaagctcgatcagcgcgagtatccgggttcagaaacgccacctaagtatacctctgctctgacctacgatggcgtactcgtgatggctgagacttttcggagcttgagaaggcagaagattgacatcagcaggcgtgggaatgcaggagactgcctggctaatccagctgccccttggggccagggcattgatatggaacgcacactcaagcaagtgcggatccaggggcttaccggcaacgtccaatttgaccactatggaaggcgggttaactatacgatggatgtttttgagctgaagtccactggtcctcgcaaggtcggctactggaatgatatggacaagctagtgctcatacaggacgttcccacactggggaatgatactgcagcaatcgagaaccgaacagtggtagtgaccactatcatggaatctccttacgttatgtataaaaagaatcacgagatgttcgaagggaacgacaagtacgaggggtactgcgtggacctcgcgtcagaaattgccaagcatatcggaatcaagtataagatagcgattgtgccggatggaaagtacggcgcacgggacgccgataccaagatatggaatgggatggtgggcgagttagtctacggaaaagcagagattgcaatcgctcccctcacgatcaccctggtcagagaggaagtaatcgacttttcaaagccatttatgtccctcggtatttccattatgattaagaagccacaaaaaagtaaacccggagtgttcagcttccttgatccactggcttatgagatatggatgtgtatagtgttcgcatacattggggtgtcagtggtgctgtttctggtgtcccgattcagcccatacgagtggcacacagaagagccggaagacggaaaggaaggcccttctgaccagcctcccaacgagttcgggattttcaatagtttatggttctccctgggggcttttatgcaacaggggtgcgatatatcaccccgttctctgagcggcaggatcgttggcggagtgtggtggttttttacacttatcatcatctctagctatacagctaatctcgctgccttcttaaccgtggaacgaatggtgagtccaatcgagtccgcagaggatctggcgaagcagacagagatcgcttatggcaccttagattccggaagcaccaaggaattcttcaggcgaagtaagatagccgtgtacgaaaaaatgtggacttacatgagatctgctgagccctctgtctttacacgaacaaccgcagaaggcgtggcgagggtacggaaatcgaagggtaagttcgctttcttgcttgagagtaccatgaacgagtacattgaacagcgcaagccctgcgatactatgaaggtgggcggaaatctcgatagtaaaggttacggcgtcgcaactccaaaagggtcaagccttaggaacgcggtgaatctggccgtgttgaagctgaacgagcaaggcctgttggacaaactaaagaacaaatggtggtatgacaagggcgagtgtgggagcggaggcggtgattctaaggataagacttcagccctttctctgtctaatgtggccggagtcttttacatcctggtgggcggtctcggcctggcaatgctcgtggcgttgatagagttctgttacaagtcacgggctgaagccaaacggatgaaagttgcaaaaagcgctcagacctttaatcctactagctctcagaatacccagaacttggctacataccgcgagggctataatgtgtatgggacagagtcaattaagatttag

SEQ ID NO: 224705 - DNA, 249 bp, Artificial Sequence
  Description of Artificial Sequence: Synthetic coding sequence
atgaggattatcagccgacagatcgtcttactgtttagtgggttctgggggctagccatgggcgctttccccagttccgtccaaatcgggggattgttcatccgcaacacagaccaggagtacactgcgttcaggcttgcaatcttcctgcacaacacaagccctaacgcttctgaagccccattcaatctcgtaccacatgtcgacaatatcgagactgctaactctttcgcagtgaccaacgcgtag

SEQ ID NO: 224706 - DNA, 249 bp, Artificial Sequence
  Description of Artificial Sequence: Synthetic coding sequence
atgaggatcatctcacgtcagatagtccttcttttttcaggcttctggggtctcgcaatgggagcctttccaagcagcgttcagattgggggattatttatcagaaatacggaccaggagtacactgcatttcgacttgctatatttttgcataacaccagtccaaatgcgagcgaagctcctttcaacctcgttccacatgtggataatatcgaaacagccaactcttttgccgtgactaatgcctag

SEQ ID NO: 224707 - DNA, 2709 bp, Artificial Sequence
  Description of Artificial Sequence: Synthetic coding sequence
atgcgtataatctcccgccagatcgtcctgttgttctctgggttttggggcctggctatgggagccttcccaagctcagtgcaaatcggcggtctctttattcggaatacggatcaagagtatacagcctttcgcctggctatctttttacacaacacaagccccaacgcttctgaagctccatttaacctggtgcctcatgtcgacaacatcgaaactgccaatagttttgccgtaaccaatgccttctgcagtcagtactcaagaggagtgttcgcgatcttcggactttacgacaaaaggtctgtccatacactgacctccttctgtagcgccctgcatattagtttgatcaccccctcatttcccaccgaaggcgaatctcagtttgttctgcagctcagacctagtctcagaggcgctttactgagcctcttggaccactatgagtggaactgcttcgtgttcctctacgatacagatagaggatacagcatccttcaggcaatcatggagaaagctggccagaacggctggcacgtgagcgcaatatgtgtggagaatttcaatgatgtgtcataccggcagcttctggaggagctcgacagaaggcaggagaagaagttcgtgattgactgcgaaatagaacgcctgcagaatattctagagcaaatagtcagcgttggaaaacatgtgaaaggataccattacatcatagcgaacctcgggttcaaagatatttctctggagcgcttcatacatggtggggctaatgtgaccgggtttcagcttgtggatttcaacactccgatggtcatcaagttaatggatcggtggaagaaactggaccagcgggagtaccctggtagtgagactccccctaagtataccagtgctctgacctacgacggggtgctggtcatggcggaaacctttcgcagcttgagaagacaaaagattgatatctctagacgaggtaatgcaggagactgtctggccaatcccgctgcaccctggggacagggaattgacatggaaagaaccctgaagcaggtccgcatccagggactgacaggaaacgtgcagttcgaccattacgggcgacgtgttaattatacaatggacgtgttcgaattaaaatcaacgggaccaaggaaagtggggtattggaatgatatggataagcttgtcctcatacaggatgtccccaccttaggcaatgatactgcggctatcgaaaaccgcaccgtggtggtgactaccattatggagtccccttacgtgatgtataagaaaaaccacgagatgttcgagggaaatgacaaatacgaaggatattgcgtggatctggcctccgaaatagcaaaacatatcggcattaagtacaaaatcgccattgtccccgatggtaagtatggggcaagggatgccgacacaaaaatctggaatggaatggtcggtgagctcgtgtacggtaaagctgaaattgcaatagccccactgactataactctcgtcagagaggaggtgatcgactttagcaagcccttcatgagcctcggaatttccatcatgatcaaaaaaccacagaaatctaagcctggagtcttttcttttttggaccctttagcttacgagatttggatgtgtatcgtgtttgcttatatcggtgtcagcgtcgttctgttcctagtgagtagattctccccttacgaatggcacaccgaggagcccgaggacggcaaggaaggccctagtgatcagcccccaaatgagttcggtatcttcaatagcctgtggttctctcttggcgctttcatgcagcagggctgtgatattagcccccgatcattgtccgggagaatcgtgggaggggtttggtggtttttcaccctgataatcatctcctcatacaccgccaacctcgcagccttcctgacagtggaaaggatggtttctccaatcgaatctgccgaagacctggcaaagcagacagagatagcctatggcacgctcgacagtggaagtacgaaggaatttttccggcgtagcaaaattgctgtctatgaaaagatgtggacctacatgagaagcgccgagccgagcgtttttacgaggacaactgccgagggggttgccagggtccgtaagagcaagggcaaattcgccttcttgttagagtcgaccatgaacgagtacatcgaacaaaggaaaccctgcgacaccatgaaagtagggggaaatctggattccaaaggctacggcgtagccacaccaaaaggctctagcctgcgaacccccgttaacctggcagtcctgaaattgtcggaggccggtgtgctggacaagttgaaaaataagtggtggtatgataagggagagtgcggccctaaggactccggcagtaaggataagaccagtgcgctatcactctctaacgtagccggagttttctacattctggtgggtggcctgggactggcgatgctggtcgccctcatcgaattttgttacaagtcacgcgctgaagccaagcgcatgaagctgacctttagcgaggctattcgcaacaaggccaggctctccatcacgggctcggtcggcgaaaacggaagagtgttgacgccagattgccccaaagccgtgcacaccggaacagctattcgccaatccagcggccttgccgtgattgcgtcagacctgccctag

SEQ ID NO: 224708 - DNA, 360 bp, Artificial Sequence
  Description of Artificial Sequence: Synthetic coding sequence
atgcggagcgctgagccttcagtgtttacccggacaaccgctgagggggttgctcgggtgcgcaaaagtaaaggtaagttcgcctttctgttggagagtacgatgaatgagtacatcgaacaaaggaagccctgcgatacgatgaaagtcggcggtaacctggattctaaagggtacggcgtggctacacccaaggggagctccttacgaaatgcagttaacctggccgtactaaaactgaatgaacaggggcttttggataagctgaagaacaaatggtggtacgacaagggagagtgcggtagcggcggaggcgacagtaagaactcttgcaagccttgtcggttcgagacgcaatag

SEQ ID NO: 224709 - DNA, 2721 bp, Artificial Sequence
  Description of Artificial Sequence: Synthetic coding sequence
atgcagcacattttcgcattcttttgcaccgggttcctgggtgccgtcgtgggggctaattttccaaataatattcagatcgggggtctcttccctaatcaacagtcccaggagcacgcagcttttaggttcgctctgagccaactaactgagcccccaaaacttctgcctcagattgacatcgtaaacatttctgattctttcgagatgacctaccgcttctgctcccagttctccaaaggggtgtacgctatctttggattctatgaaagaagaactgtgaatatgctcacctccttctgtggagccctgcacgtttgtttcataaccccttcctttccggtagacaccagcaatcagtttgtcctccagttgcgcccagagctgcaggatgcattaatttccattatcgatcattacaaatggcaaaaatttgtgtatatctacgatgctgatagaggtctgtcagtcctgcaaaaggtactggataccgcagctgagaagaactggcaagtcacagccgtgaacatcctgactacaacggaagagggataccggatgctatttcaggacttagagaaaaagaaggagaggctggtggtggttgactgcgaatcggaacgactgaatgcaatcctcgggcagataatcaaacttgagaagaacggaattggataccactatatcctggcaaatctggggtttatggatattgatctgaataaattcaaagaaagcggtgcaaacgtcaccggatttcaattggtgaactacactgataccatccccgctaaaatcatgcaacagtggaaaaattctgacgcaagggaccacaccagggtcgattggaagaggcccaaatacacaagcgcgcttacatatgacggagttaaagtgatggctgaggctttccagtctttacgcagacaaaggatagatatatcgaggcggggaaacgcaggcgattgcctggccaacccagcggtcccatgggggcagggtatcgatattcagagagcactgcaacaagtgagatttgaagggttgactggaaacgtccagtttaatgaaaagggcaggcggaccaactacaccctgcacgtgattgaaatgaaacatgacgggatccgtaagatagggtattggaacgaggatgacaagtttgtgccagctgccactgatgctcaggccggaggtgacaattcatccgtacagaatcggacatatatcgtgacgaccatcctcgaagatccttacgtgatgctcaagaagaacgccaaccagttcgaaggtaatgatcggtatgaaggatattgtgtggagctagctgccgagatagccaaacacgttgggtactcctatcggctcgagatcgtgtccgacggaaaatatggggctcgtgatcctgacacaaaggcttggaacggtatggttggggagctagtttacggtagggcagacgtggccgttgcacctctcacaatcaccttggtccgcgaggaggtgattgacttctctaaaccttttatgtctcttggcatttctatcatgattaaaaaacctcagaaatcaaaacctggagtcttctctttccttgatcctttggcgtatgagatttggatgtgtatcgtatttgcatatatcggggtatcagtggttctgtttcttgtttcacggtttagtccgtacgagtggcacagcgaagagtttgaggaaggaagggaccaaacaactagcgaccagtccaacgagttcggaatttttaactccctttggttctctctgggtgcattcatgcagcagggatgtgatatctcgcccaggagtctgagcggcagaatcgtcgggggagtgtggtggttctttaccctgatcattatctccagttatacagccaatctcgccgcattcctgaccgttgaacgaatggtatcaccaatcgagagcgccgaagacttggcaaaacagacggagatagcatacggaacattagaagcagggtctaccaaggaattctttcgcagatctaaaatcgccgtgtttgaaaaaatgtggacctacatgaagtccgctgagcccagtgtctttgtaaggacaactgaggaaggcatgatcagggttaggaaatctaagggtaaatacgcctatctccttgagtcaacaatgaacgaatacattgaacagcggaaaccatgcgatacaatgaaggtgggagggaacctagatagtaagggttatggtattgccacccccaaaggatccgctcttaggaatcctgtcaatcttgcggttctgaaattgaatgaacagggcttactcgacaagttgaaaaataagtggtggtacgacaagggagaatgtggatctggaggtggagactctaaggataagacctctgccttatctctgagtaacgtggcaggtgtcttctatatcctgatcggaggactcgggctggcaatgttggtcgcgctgatcgagttttgctacaaatcccgaagcgagtctaagaggatgaagggcttttgcctcatacctcagcagtcaatcaatgaggcgatcaggacaagcactctaccaagaaactctggagccggtgctagcagtggtggcagcggtgaaaatggccgtgttgtttcgcatgacttccctaagagtatgcaaagtattccgtgtatgtcccactccagtggcatgcccttgggggcaaccggtttgtag

SEQ ID NO: 224710 - DNA, 2721 bp, Artificial Sequence
  Description of Artificial Sequence: Synthetic coding sequence
atgcaacatattttcgcattcttctgtaccggttttcttggggctgtggtaggcgctaatttcccaaataacatacagattggaggcctgttccctaatcaacagtcccaggaacatgcagcattcaggttcgctttatctcagctgacagagccccctaaactgctacctcagatcgacattgtgaatattagtgacagtttcgaaatgacctacaggttttgctctcagtttagcaagggggtgtacgccatatttggcttctacgaacggcgtacggttaatatgttaaccagtttctgtggagccctgcacgtatgttttattaccccatcttttcctgtagacacgtctaatcagttcgtgcttcagctgaggcctgagttgcaggacgcgctgataagcatcattgaccactataaatggcagaagtttgtgtatatctatgatgccgaccggggtctatcagttctgcaaaaagttctggacaccgccgctgagaagaactggcaggtaacagcagtaaatatcctcactactacagaagaaggttataggatgctcttccaggatctcgagaagaagaaagagcgtctggtcgtcgttgattgtgaatcggagaggctcaatgccattctggggcaaattatcaagctggagaagaatgggatcggttaccattatatactcgctaacctgggctttatggatatcgaccttaacaagttcaaggaaagcggcgcaaatgttacgggctttcagctggtgaattacacggatacaattcctgccaagatcatgcagcagtggaagaattctgacgccagggaccacaccagggtggactggaaaagaccaaagtacacttccgcccttacatacgatggggtgaaggtcatggccgaggcttttcagagcctacgcaggcaacgaattgacatctccaggcggggaaacgcaggggattgcttagcaaacccggcagtgccttggggccagggaatcgatattcagcgggcactacagcaggtgaggttcgaaggcctgactggcaacgttcagtttaacgaaaagggcaggaggactaactacaccctgcatgttatcgaaatgaagcatgacggaatccgcaagatcggatattggaatgaggatgataagtttgttcccgctgccactgacgctcaggctggaggagataattctagcgtgcaaaataggacctatatagttactacaatactggaggacccctacgtgatgctgaaaaaaaacgcaaatcagttcgaggggaacgatcgttacgagggctactgcgtggagctcgcagcggaaatcgctaaacacgtgggctatagctaccgcctagagattgtgtccgatggtaagtatggagcccgagaccccgacaccaaagcctggaatggcatggtgggtgaattagtatacggtagagccgatgtggccgttgctcctcttaccattaccctggttcgggaagaggtcatcgatttttcaaaaccattcatgtctctgggaattagcatcatgattaagaaacctcagaagtctaagccgggagtgttcagctttctggacccgctggcttatgaaatctggatgtgtatagtgtttgcatacatcggcgtgagcgtggtactattcttggtctctcggttcagcccttatgagtggcactccgaggagttcgaggagggcagggatcagactaccagcgatcagagcaatgagtttgggatttttaatagtctctggttctcgctgggggcttttatgcagcaagggtgtgacatttccccgcgatcattaagtgggaggattgttggcggagtgtggtggttcttcacgctgatcatcatatctagttacacagccaacctagccgcatttctgacagtggagaggatggtgtcgcccattgaaagtgctgaggatttagcaaagcagaccgaaatcgcgtacgggacgctggaggcaggaagcacgaaagaattcttccgtcggagtaagattgccgtatttgagaagatgtggacatatatgaagagcgctgaacccagtgttttcgtcagaactacagaggaggggatgatacgtgtgcgcaagagcaagggtaaatatgcctatctgcttgaaagcacaatgaacgagtacattgagcagcgcaaaccatgcgacaccatgaaagtgggcggaaacctcgacagcaaaggctacggcatcgcgacgcctaagggatcagcactcaggggccctgtgaatttggccgtgctgaagctgagtgaacagggggtgctggacaagctgaagtcaaagtggtggtacgacaaaggtgaatgtgggtctaaggactcagggagcaaggacaagacctcagctctctctctgtctaatgtggccggagtgttctatatccttattggcggactgggactggccatgcttgtggccctgatcgagttctgttacaagagcaggtctgaatccaagaggatgaagggcttttgccttatcccgcagcagtccatcaacgaggccataaggactagcactcttccgcgaaacagcggtgccggagcctcatcagggggaagtggggaaaatggtagagttgtgagccatgatttcccaaagtctatgcagtctatcccgtgcatgtcccactccagtgggatgcctcttggtgccaccggtctttag

SEQ ID NO: 224711 - DNA, 2751 bp, Artificial Sequence
  Description of Artificial Sequence: Synthetic coding sequence
atgtgctgctctacccacctgttccaacctctccaactagctggagggttggaatggccctggagcaatctgctgtgcttcctcacccccgtgaaattgcaccccgaagtctggggcctttttcctaaccagcaatcccaagagcatgcggcattccgttttgctctgagccagctgaccgagccaccaaagttacttcctcagatcgacatcgtgaacatctccgatagttttgaaatgacctacaggttttgctctcagttttctaaaggtgtgtacgcaatcttcggtttttacgagcggaggactgtgaacatgctgacatctttctgcggggctctccatgtttgcttcataaccccctctttcccagtggatacctccaatcagtttgtgctgcagcttcgcccagagctgcaggacgccttgatctccatcattgaccactacaaatggcagaaatttgtgtatatatatgacgctgaccgtggcctgtctgtgcttcagaaggtgctcgacactgccgctgagaagaactggcaggttacagctgtcaacattttaacgaccacggaggaggggtatcgcatgttgtttcaggatctggaaaagaagaaagagaggctggtggtagtggattgtgagtcagagcggcttaatgctatactcggtcagattattaagttggagaagaatgggatcggttaccattacatcctggctaacctgggcttcatggacattgacttaaacaaatttaaggagagcggagctaatgtaacaggctttcagctggtgaactacactgatactattcccgctaagattatgcagcagtggaaaaactcagatgcacgcgaccacacgagggtagattggaaaagacccaaatacacgtctgctctgacctacgatggcgtgaaggtgatggcagaggcctttcagtctctgagaagacagcgcatcgatatttcacgtcgcggtaacgcgggtgactgtctcgccaatcctgcagtcccatgggggcaggggatagacattcagagggccctgcagcaggtgaggtttgagggtttaacaggcaatgtgcagtttaacgaaaaaggacgcagaacgaattacacgttgcacgtgatcgaaatgaaacacgacggaatccggaagatagggtattggaacgaagacgataagttcgtccctgccgcaacagacgcccaggccggaggcgataattcctcagtgcagaatcgtacatatatagtgacaaccatcctggaggatccatacgtgatgttgaagaaaaacgccaatcagtttgaaggcaatgatcgctatgaaggatattgcgtggaattagccgcagaaatcgccaaacacgtcgggtactcttacagactggaaattgtgtctgacggaaaatatggcgctcgggaccccgatactaaagcatggaacggaatggtcggggagctggtctatggtcgtgcggacgtggcagtcgctcctctcactatcactctggtgagggaagaagttatcgatttctcaaaaccgttcatgtccctgggaatctctatcatgataaaaaaaccacagaagagcaaaccgggtgtgttttcttttctggatccgttggcctacgagatctggatgtgtattgtttttgcctatatcggggtttccgtcgttctgtttttggtatcccggttctctccttacgagtggcacagcgaggagttcgaagaaggcagagaccagaccacctctgaccagtcgaatgagttcggcattttcaacagcctgtggttctcactcggagcatttatgcagcagggctgcgacataagtcccagaagcctgagcggacgcatagtgggaggggtgtggtggttcttcacccttatcatcatctcctcatataccgctaacctagcggctttcttgaccgtggaacgcatggtgtctccaatcgaatctgcagaagatttggccaaacagaccgaaatagcttatgggacgttagaggccggaagtacgaaggagttttttcgcaggagcaagattgccgtttttgaaaagatgtggacctacatgaagtctgctgaaccctcggtctttgttaggacgacagaggagggaatgattagagttagaaaaagtaaaggtaaatatgcctaccttctggagtccactatgaatgaatacattgagcagcggaaaccctgcgatactatgaaggtcggcggaaacctggacagcaaagggtacggcatcgctaccccaaaagggagtgccctgagagggcctgtgaatctggccgtgctcaaactgtccgagcaaggagtactggacaagctgaaatcaaagtggtggtatgacaagggcgaatgcggatctaaggactctggttcaaaggacaaaaccagtgccttgtccctgtccaatgtggcaggggtcttttatattctgatcggaggactgggcttagcgatgctggtagcacttattgagttctgctacaagagtagatccgaatcaaagcgaatgaagggattctgtctgatcccacagcagtctatcaacgaggccatccggacctcgaccttgcccaggaatagtggggctggcgcatccagtgggggaagcggggaaaacgggcgagtggtgtcacacgacttccccaagtcaatgcagagcataccctgtatgagccactctagcggaatgcccctgggggctacaggtctttag

SEQ ID NO: 224712 - DNA, 2481 bp, Artificial Sequence
  Description of Artificial Sequence: Synthetic coding sequence
atgcagcacattttcgcttttttctgtacaggcttcctgggtgcagttgtaggggcaaactttcccaacaacattcagattggaggtctgttcccaaatcagcagagccaggaacacgctgcttttcggttcgccctctcacaactcacggagccccctaagttgctgccccagattgacatcgtcaatatctctgatagctttgagatgacataccgatgtctgtccgtacttcaaaaagtgctggacacagcggcagaaaaaaactggcaggtgacggccgtcaatattctgacaaccactgaggagggctatcgcatgctgttccaggacctggagaaaaagaaggagcgactggtggtggtagattgcgagagtgagcgactgaatgccatactagggcaaatcattaaattggagaagaatggcatcgggtatcactatattctggcaaatctggggtttatggacatagatctgaataagtttaaggaatccggagccaacgttaccggcttccagctggtgaattacacagacacgatccccgcaaagattatgcagcagtggaaaaacagtgatgccagggaccacacccgggtggactggaagcgcccaaagtatacttctgccctgacgtacgatggcgttaaggtgatggcagaagcgtttcagagtttgcggagacagcgtatcgatatctcaagacgcggtaatgctggcgattgcctggctaaccctgccgtgccgtggggacagggaatcgatattcagcgagccttgcagcaggtgcggtttgaaggcctgaccggtaacgtacagtttaatgaaaaggggagaaggactaactacaccctgcatgtcattgagatgaaacatgacggcatccgcaagattggctactggaatgaggacgataagttcgtaccggctgcgaccgacgctcaggccggaggtgacaattcatcagtgcagaataggacatatatcgttactacgattctcgaggatccttacgtgatgctgaagaaaaacgcaaaccagttcgagggcaacgatcgctacgagggatattgtgtggaattggcggctgaaatcgctaaacacgtaggttactcgtatcggctggagattgtgtccgacgggaaatacggggctagagaccccgacactaaagcctggaacgggatggttggcgaactggtgtatggcagggccgacgtggctgtggctccactaactatcaccctggtcagagaggaggtgatcgacttctccaaaccttttatgagcctgggcatctctatcatgataaagaagccacagaagtcaaaacccggagttttcagctttctggacccactggcatacgaaatttggatgtgtattgtgtttgcatacatcggcgtgtccgtcgtactcttcctggtgtctagattcagcccctacgagtggcattctgaagagtttgaggagggtagggatcaaacaacgagcgaccagtccaatgaatttggcatcttcaatagcctgtggtttagtttgggcgcattcatgcaacaggggtgtgatatctcccctagatcgctctctgggagaattgttggaggtgtctggtggttcttcaccctaattattatttcttcttatacagcaaatctcgccgcatttctcaccgtggagagaatggtgagcccaattgagtccgccgaggacctggccaaacagaccgagatcgcgtatgggactcttgaggctggttccaccaaagaattttttcgcagaagtaagatcgccgtgtttgagaagatgtggacatacatgaaatctgcagagccgtccgtattcgtgcgcaccacggaagaagggatgatccgggtgaggaagagtaagggaaaatatgcttacctgctggagagcaccatgaacgagtacatcgagcagagaaagccatgcgatacaatgaaagtgggcggtaatctggactcaaaaggatatggtatcgccactcccaagggttctgccctgaggaatccagtgaacttagccgtcctaaaactgaatgagcagggcctgttagacaaactcaagaataagtggtggtacgataagggagaatgtgggtcaggcggaggcgactccaaagataagacctcggccctgagtttaagtaatgtggccggtgtgttttacatactgatcggcggactggggctcgctatgttggttgcattgatcgaattttgctataaatcccgctctgagtccaaaaggatgaaaggcttctgcctgatcccgcaacagtcaattaacgaggccatcaggacaagcaccctccccagaaattccggtgcgggagctagttcaggtggatcaggagagaatggacgcgtggtttcgcacgactttccaaaaagcatgcaaagcatcccttgtatgtcgcatagttctggcatgccgctcggggctaccggtctgtag

SEQ ID NO: 224713 - DNA, 2751 bp, Artificial Sequence
  Description of Artificial Sequence: Synthetic coding sequence
atgtgctgcagcacacacctctttcagccattgcagttggcagggggtctggaatggccgtggtctaatctgctgtgtttcttgacgcccgttaaattacatcccgaggtgtgggggctgttcccgaatcagcagtctcaagagcatgcagccttccggtttgctctgtcccagctgaccgagccacctaagttactgcctcagatcgacatcgtcaatatatcagactctttcgaaatgacttacagattttgctcccagttttccaagggtgtttatgccatatttggtttttatgagagaagaaccgtcaacatgctaactagtttctgcggtgccctccatgtttgttttatcacaccatctttcccggtagatactagtaatcagtttgtactgcaattgagacccgagctgcaagatgcactgatctctatcattgaccactataagtggcaaaagtttgtgtatatctatgatgctgaccgcggacttagcgtgctgcaaaaggttctggacacagccgcagaaaagaattggcaggtcacggcagtcaatatcctcacaaccaccgaggaggggtatcgaatgttattccaagatcttgaaaaaaaaaaagagagactggtcgtggttgactgcgagagcgagaggctaaacgccatcttgggccagatcataaaacttgagaagaatgggattggctaccattatatcctggctaacctgggattcatggacatcgacctgaataagttcaaagaatccggggcaaatgtgacaggattccagctcgttaattataccgacaccatcccagccaagataatgcaacaatggaaaaattcggatgccagggaccacacccgcgtggattggaagaggcctaagtacacaagtgcacttacatacgacggcgtgaaggtaatggctgaagccttccagagccttcgtcgtcaacgtatagacatctcccgacggggtaatgctggcgactgccttgccaatccagccgtgccatgggggcagggcatagatattcagcgggctctccaacaggttcgattcgagggcctgacaggaaatgtgcagttcaatgagaaaggacgtcgcaccaactacactttacacgtgattgaaatgaagcacgatggaatcagaaagatcggttattggaatgaggatgataaatttgtccctgccgctaccgatgctcaagcaggtggggacaacagttctgtgcagaacaggacatacattgttaccactatccttgaggacccttacgtgatgcttaagaagaatgcaaaccagtttgaaggtaatgatcggtacgaagggtactgtgtggaattagctgcggagatcgcaaagcacgtcggttatagctacagattagagatcgtctctgacgggaagtacggagctcgggaccccgacaccaaggcatggaatggaatggtgggcgagctagtgtacgggcgagcggatgtcgccgttgcacccttgacaatcacactggtccgcgaagaggtgatagacttttcaaagccctttatgtctttgggtatctcaatcatgattaaaaaaccacagaaaagtaaacccggtgtgttctctttccttgacccactggcctatgagatctggatgtgcattgtgtttgcttacataggggtgagcgtcgtgctgtttctggtctctagattctcaccctatgaatggcacagtgaggagtttgaagagggtagagaccagacaacctccgaccagagcaacgagttcggcatcttcaatagcctttggtttagcctaggagcatttatgcagcagggatgcgacatcagccccaggtcactgagcggccgtattgtgggaggagtctggtggttctttacactgatcattattagcagctacactgctaatcttgccgcatttctgaccgtcgaacgtatggtgagccctatcgagtccgctgaggatctggccaaacagacagagatcgcctatggcacactggaagctggtagcactaaagagtttttccgacgctcaaagatcgcagttttcgaaaaaatgtggacttatatgaaatctgcggagccatcagtcttcgtaagaactaccgaggagggcatgatccgggtcaggaagagtaaaggtaagtatgcctatcttttagagagcaccatgaatgagtacatcgagcagcgaaaaccatgcgacaccatgaaggtgggaggcaatctggactccaagggatatggcatcgcgactcctaagggcagtgctctccgtaaccctgtgaacttggccgtgctcaaactaaatgagcaggggctgctggataaactgaagaacaaatggtggtatgacaaaggagagtgtgggtccgggggtggcgattccaaggataagacttcagccctgtcgctgtcaaacgtggcgggtgtattctacattttgattggcggactgggtctcgcgatgctcgtagcactgatcgagttctgctacaagtctcgcagcgagtccaaacggatgaaggggttctgtctaattcctcagcaatccataaacgaggctattaggacctccactctgcctcgcaacagcggcgcaggtgccagttcaggtggtagcggtgagaacgggagagtcgtgagtcacgattttcccaagtctatgcaatccattccctgtatgtcccactcctccggtatgccgttaggcgctactggcctctag

SEQ ID NO: 224714 - DNA, 2151 bp, Artificial Sequence
  Description of Artificial Sequence: Synthetic coding sequence
atgcagcacatcttcgcttttttctgcacagggtttcttggcgcagtggtgggcgcaaacttccctaacaacatacagatagtatgttctcaattcagtaagggtgtttacgccatcttcgggttttatgagaggaggaccgtcaatatgctgacttctttttgtggcgctctccatgtgtgtttcattacaccctcattccccgtggatacatccaaccagtttgtactgcagcttagacccgagcttcaggatgccctcattagtattattgaccattataaatggcagaagttcgtgtatatttatgatgctgacagggggctttcagtcctgcaaaaagtgcttgatacggcagcagagaaaaattggcaggttacggccgtcaatatactcacaaccacagaagaaggttacaggatgctgtttcaggatttggagaagaaaaaggagaggctggtcgtggtggattgtgaaagcgagcgcctgaatgccattctcggtcagatcattaagttggaaaagaatggaattggatatcactatattcttgccaacctgggatttatggatattgatttgaataaatttaaggagagcggtgctaatgtgacgggctttcagctggtcaattacaccgacacaataccagcgaagattatgcagcagtggaagaactcagacgccagggatcacaccagggtggactggaagagacccaagtacactagcgccctgacctatgatggggtaaaggtgatggccgaggccttccaaagtctgcggagacaacgcattgatatttcgcgaagggggaacgccggtgattgtcttgcaaacccggcagttccctggggccagggaattgacatccaacgggcactgcagcaggttagattcgagggtcttaccgggaatgtccagtttaatgagaagggtaggcgcactaactataccttgcatgtaatagagatgaagcatgacggtatacgaaaaattggatactggaacgaggacgataaatttgtgcccgcagccaccgatgcccaggccggaggtgacaatagcagcgtgcaaaacaggacgtacattgtgacgacaatcttggaggacccttatgttatgcttaagaagaacgcgaaccagtttgagggtaatgatcgctacgagggttactgtgttgaactggctgccgagatcgctaaacatgttggttattcatataggcttgagatcgtgtcagacggcaagtatggagcacgcgaccctgataccaaggcgtggaacggtatggtgggcgagctcgtttatggccgtgctgatgtggcagtcgccccactcacgattactttggtccgagaggaagtgatcgacttttcaaagccattcatgagcttaggcatcagcatcatgataaagaagccgcaaaagtcaaaaccaggcgtgttctccttcctggatcccctggcctacgaaatctggatgtgtatagtcttcgcttacatcggggtctctgtggttttattccttgtttccaggtttagtccctacgaatggcacagtgaggaattcgaggaggggagagaccagaccaccagtgaccaatctaacgagtttggtatattcaattccctgtggttttcacttggcgctttcatgcagcagggctgcgatattagccccaggtcactatcaggcagaatagttggcggagtttggtggttttttaccctaatcatcatatcgtcatacacagctaacctcgcagctttcctcactgtagagcggatggtttcaccaatcgaaagcgcagaggacctggccaaacagaccgagatcgcttacggtaccctggaggcaggctccacaaaggaattcttccgcaggtctaaaatcgctgtatttgagaagatgtggacatacatgaagtccgcagagccctctgtcttcgtgcgtacaacagaagagggcatgatacgggtgcgtaaatcaaagggcaaatatgcttatcttctcgaatccacaatgaatgaatacatcgagcaacgcaaaccttgcgataccatgaaggtggggggaaatctggattccaaggggtacgggatcgctacaccaaaaggttccgccctgcgtaccagacaggcgttgtag

SEQ ID NO: 224715 - DNA, 2721 bp, Artificial Sequence
  Description of Artificial Sequence: Synthetic coding sequence
atgcaacatatattcgctttcttttgcaccggatttctgggcgcagtggtaggggctaattttcctaataatatccaaatagggggactgttcccgaaccagcagagccaagaacatgccgcattccggtttgcactgagccagttgacagaaccccctaagctacttccgcaaattgacattgttaatattagtgattccttcgaaatgacatatcgcttctgctctcagttctccaaaggggtttatgctattttcggcttctatgagagacgcaccgtcaatatgctaacctctttttgtggtgcactgcacgtgtgttttattaccccatccttccctgtggatacatctaatcagttcgtcctgcagctccgccctgaactgcaagacgccctgatttcgattattgaccattacaagtggcaaaagttcgtatacatctacgatgccgacagagggctgtccgtccttcagaaggttctcgacaccgctgccgaaaaaaactggcaggtgacagcagtcaatatcctgaccactactgaggaggggtatcggatgttgtttcaagatctggagaaaaagaaggagcgcctggtggtggttgactgcgagtccgaacgcttgaacgccatcctgggacaaataattaagctggaaaagaatggaatcgggtatcactacattctagcaaatttaggattcatggacatcgatctaaacaagtttaaggaaagtggcgctaatgtgacaggatttcaactcgttaattatactgacactattcctgccaaaattatgcaacaatggaagaattcggacgcccgagaccatactcgtgtcgactggaagcgtcctaagtacacatccgcccttacatacgacggggtcaaggtgatggccgaagccttccagtccctcagacggcaaagaatcgatatcagccgcagaggtaacgccggagattgcctcgccaatcccgcagtgccatgggggcaggggatcgatatccagcgtgccctgcagcaggtccgttttgaaggcctcactggcaacgtgcagttcaatgagaaaggccgacgcactaattacactctccacgttatcgagatgaagcacgacggaataaggaaaatagggtactggaacgaagacgataagtttgtaccggctgccactgatgctcaagctggcggagacaactcatccgtgcagaatagaacatacatcgtaacgaccatcctggaagatccttatgtaatgctgaagaaaaacgcaaaccagttcgagggaaatgacagatacgagggatactgtgtggagctagccgctgagattgccaagcacgtgggatactcatataggctggaaatcgtgagcgatggaaaatacggcgcacgcgaccccgacacaaaggcgtggaacgggatggtcggagagctcgtgtacgggagagcagatgtggccgttgcgccactcaccatcactcttgtcagagaggaggttatagacttctccaaaccctttatgtccctcggaattagtattatgattaaaaagccacagaaatcaaagccaggcgtgttttccttcttggatccactggcgtacgagatctggatgtgcattgtgttcgcatacattggcgtctccgtggttctttttctcgtgagcagattttctccatatgaatggcattcagaagaattcgaggaaggccgagaccagactacgagcgaccagtctaacgagtttgggatattcaattccctttggttttctctcggtgcctttatgcagcaaggatgtgatatcagcccccgatccctaagcggacgcattgtaggaggtgtttggtggttcttcaccctgattatcatctcctcatacactgccaatcttgccgctttcctcaccgtggagagaatggtttcccccattgaaagtgccgaagacctagctaagcagactgaaattgcctatggcaccctcgaggccggttcaaccaaagaattctttcgaaggagcaagatagccgtgtttgagaagatgtggacatacatgaagtctgccgagccatcagtgttcgtgcgtacaactgaggagggtatgattcgggtgaggaagagtaaaggcaaatatgcttacctgctggagtccactatgaatgaatatatcgagcagcgaaaaccttgcgataccatgaaggtgggcggtaacctcgattccaaaggctacgggatcgccacacctaaaggttcagctctcagagggccagtgaatctggcagtcctgaagctctccgagcagggtgtccttgacaaactcaagagtaagtggtggtacgacaaaggggaatgcggatccaaggacagcggtagcaaggataagaccagcgcactcagcttatcaaacgtggccggtgtgttctacattctaattggagggttgggcctggccatgctagtagccctcatagaattttgttacaagtcacgatccgagtcgaaaaggatgaagggcttctgcttaatcccccagcaatcaatcaacgaggccatccggacttcaacactccctcgaaactctggagccggtgccagctctggaggctcaggcgaaaatggcagggttgtttctcacgatttccccaagtcgatgcaaagcattccttgtatgtcacattcttccgggatgcccctgggcgcaacgggtctgtag

SEQ ID NO: 224716 - DNA, 2514 bp, Artificial Sequence
  Description of Artificial Sequence: Synthetic coding sequence
atgacataccgattttgttcccagttctctaaaggcgtctacgcaatattcggattttatgagagacgaaccgttaacatgttgacctcattctgcggtgcgctgcatgtctgctttattacccccagctttcccgtggacacctccaaccaattcgtcctacagctgcgaccagagctgcaagatgcattgatttcaattatagaccattacaagtggcagaaatttgtctacatctacgacgccgatagaggactctccgtcctgcagaaagtcctggacaccgcagctgagaagaattggcaggttacagccgtcaacatacttactaccactgaggagggatacaggatgcttttccaggacctcgaaaaaaagaaggagagactggtagtggtagattgtgaaagtgagcgacttaacgctattctgggacagattattaagcttgagaagaacggcattggttaccattacattctcgcaaatctgggttttatggatattgacctcaacaagttcaaagagtctggcgctaacgtcaccggatttcaactcgtgaactataccgatactattccggctaagattatgcaacaatggaaaaacagtgatgccagggaccacacacgagtggattggaagaggccgaaatatacttccgccttaacctacgacggagttaaagtgatggccgaggcctttcagtccctgcgcagacagcggatcgacatcagccggaggggaaatgctggtgactgtctcgcgaaccctgcagtcccatggggacagggcatagacattcaaagagctttgcagcaagtgaggtttgaagggctcactggtaatgttcagttcaatgaaaagggcagacgaactaactacaccctgcacgtgattgagatgaaacatgacgggatcagaaagatagggtactggaatgaagacgataagttcgtacccgctgcgacggacgcacaggcagggggtgataactcgtcagtgcagaaccggacttacattgtaactaccattcttgaggatccctacgtcatgctgaaaaagaacgcgaaccagtttgaggggaatgatcgctatgagggttattgtgtcgagttggctgctgaaattgcaaagcacgtcggctattcgtaccgcctcgagatcgttagtgacgggaaatatggagcgagggacccagacaccaaggcctggaacgggatggtgggcgaactcgtctatggcagggccgacgtggccgtggcacctctcacaatcacactcgtgcgggaagaagtgattgacttcagtaaaccatttatgtctcttggcattagtattatgataaagaagcctcagaaatcaaagcctggtgtgttctcttttctcgatcccctagcttacgagatttggatgtgcattgtctttgcgtatatcggggtatcagtggtacttttcctggtaagcagatttagcccttatgagtggcattcagaagaatttgaagagggaagggatcagacaacaagcgatcaatctaacgagtttggaatcttcaatagcctgtggttcagcctgggtgcattcatgcagcaaggttgcgacatcagcccccgttcacttagcggcagaatagtcggaggggtgtggtggttttttaccctaataataatctccagctatactgctaacctggcggctttcctgactgtggagagaatggtgtcccctattgaaagcgccgaggatcttgctaagcagactgagatcgcatatggaactctggaagcaggttcgactaaggaatttttccggcgttctaagattgccgtgttcgagaagatgtggacctacatgaaaagtgctgagccctctgtcttcgtcagaacaaccgaagaaggtatgatacgggtcagaaagagcaagggaaaatacgcctacctgttggagtccaccatgaatgaatatatcgaacaaagaaagccctgcgatacaatgaaagtgggaggcaacctagacagcaagggatatggcatagccacacccaaaggcagtgcactccgtaatccggtcaatctggcagtgctcaaactgaatgaacaagggctgttggataagctcaagaacaaatggtggtacgataagggagaatgcggcagcgggggaggggacagcaaagacaaaacctctgccttatccctctctaatgtggccggagtattttacatcctgattgggggactgggactcgcaatgctagttgctctgatagagttctgctataagagtcgatctgaaagtaagaggatgaagggcttctgccttataccccagcaatctatcaacgaggcaattagaacctctaccctgcctcggaactctggggctggagcgtcatccggagggagcggggaaaacggcagagtggtgagtcatgacttcccgaagagtatgcagtcaatcccatgcatgtcccactcaagcggaatgcccctgggcgctacaggcctgtag

SEQ ID NO: 224717 - DNA, 2652 bp, Artificial Sequence
  Description of Artificial Sequence: Synthetic coding sequence
atgcagaaaataatgcatatcagcgtactcctttcacctgtactctggggactcattttcggcgtttcctcaaattccattcaaattggaggcctcttccctcgcggtgccgatcaggaatatagcgcatttcgcgtcgggatggttcaattttcaacttcagagtttcgtctcacccctcatattgataacttagaggtggccaatagctttgctgtcaccaacgcgttctgctctcagttctccagaggggtgtacgcgatctttggcttttacgacaagaaatcagtgaatactatcacctcattctgcggtaccttgcacgtgagctttatcacaccgtcctttcccactgacggtacccatcccttcgtgatccagatgaggcccgacctgaagggcgcactgttgagcctcatagaatattaccagtgggacaaattcgcctacttgtacgacagcgatcgaggtctgtctaccttgcaggccgtcctggacagtgcagcagagaaaaaatggcaggtcacagcaatcaacgttgggaacatcaacaacgataaaaaggatgaaatgtacaggagcctgttccaggacttggagttgaaaaaggagagaagggttattctcgattgtgaacgggacaaggttaacgacattgtggaccaggttattaccatcggtaaacatgtcaaaggctaccattacataatcgccaatctcgggtttaccgacggcgatctgctgaaaatccaattcggcggtgccaatgtctccggattccagatcgtggactacgatgacagcctcgtgtccaagtttattgagaggtggtctaccctggaagaaaaggagtatccaggcgctcacactaccaccattaaatacacctctgcactgacctatgatgcggttcaggtcatgactgaggctttccgcaatttacgcaaacagcggatcgagatcagccgcaggggcaacgcgggtgactgcctagcaaacccagctgtaccctggggacagggcgtggagattgagcgtgccctgaagcaggtgcaggtggagggcctgtctggcaacatcaagttcgatcaaaatgggaagagaataaactatactattaacatcatggagcttaaaaccaatggacctcggaaaataggctattggtcagaggtggataagatggtggtcacattgaccgagttgccaagcggtaacgatacaagtgggctcgagaataaaactgttgttgtaaccacgatcctggagagcccttatgtgatgatgaagaagaatcatgagatgctcgagggcaatgaaaggtatgaaggctactgcgtagatctggccgcagagatagctaagcactgcggcttcaaatacaagctgacaatcgtaggcgacggcaagtatggtgctagggatgccgacaccaaaatctggaacggcatggtgggggagctggtgtacgggaaagccgatattgcaattgctccactcaccatcacgctcgtgagagaggaggtcattgacttctccaaaccctttatgagtctaggcatctctataatgattaaaaagccgcagaaatccaaacctggagtgtttagttttctcgaccccctagcttacgaaatttggatgtgtatcgtttttgcttacataggggtttcagtggttctatttttagtgtccagattcagcccatatgaatggcatactgaggagttcgaggacggtagagaaacacagtcatcagaaagtaccaatgagttcggtattttcaattctctatggttctctctcggggcattcatgcagcagggctgtgatatctctcctcggtcactctctgggagaatcgtgggcggtgtgtggtggttctttacgttaataatcatttcaagttacaccgccaatctggctgctttcctcaccgttgagagaatggtttcccccatcgagagtgccgaagatttgtcgaagcagaccgaaatcgcctacgggaccctggattctgggagcacaaaagaattcttccggaggagcaagatcgccgtgttcgacaaaatgtggacgtacatgcggtctgcggagcccagcgtgttcgtcaggacaacggctgagggtgtggctagagtgcgcaagagcaagggaaagtacgcttatctactagaatccacaatgaacgaatatatcgagcaacggaaaccctgtgacacgatgaaggtgggcggaaacctagactcaaagggttacggcatcgcaacacccaaaggaagctcccttagaaatgccgtcaatctggcagtgctgaagctcaacgaacagggattactggacaagttaaaaaacaaatggtggtacgataaaggggagtgcgggtctgggggaggggattctaaagagaagacgagcgccctatctctgtctaatgtggccggtgttttttacatcctcgtggggggactcggtctggccatgttagtggccctgatcgaattttgctataaatcccgcgctgaagctaagcggatgaaggtggctaagaacgcccagaacattaacccttcaagcagtcaaaattcacaaaatttcgccacgtacaaggaaggatacaatgtttacggcattgagtctgtaaaaatctag

SEQ ID NO: 224718 - DNA, 2652 bp, Artificial Sequence
  Description of Artificial Sequence: Synthetic coding sequence
atgcagaagatcatgcacatatccgtgctgttgagtccggtattatgggggctcatcttcggcgtgtccagtaactccatacagattggcggactgttccccagaggtgctgaccaggaatactctgcgtttcgagtgggtatggtccaattcagtactagtgaattcagattaacgcctcatatcgacaatctggaggtagccaacagtttcgccgtgaccaacgcattttgtagccaattttcaagaggtgtctacgcaattttcggattttacgacaagaagtctgtgaacacaattacatccttttgcgggacgttgcacgtgagcttcattacaccctccttccctaccgacggtacacatcccttcgtaatccagatgcgtcctgatctcaagggagcgctcctgtccctgatcgagtactaccagtgggacaagtttgcttacttatatgactctgatcgagggctgtccaccctgcaggccgtgttggattccgctgccgaaaaaaagtggcaagtgaccgccataaacgtgggaaatatcaataatgataagaaagatgagatgtaccggagcttatttcaggatctagaactgaaaaaagagagaagagtgattctagactgcgaacgagacaaggtgaatgacattgtggaccaggtgattactattgggaagcatgtgaaggggtaccattacattatcgcaaatttgggattcacagatggggacctgctgaagattcagttcgggggagcaaacgtctccggattccagatcgtcgactatgacgatagtttggtgtctaagttcattgaacggtggtcgaccctggaggaaaaggaataccctggcgcacataccacaactatcaagtacaccagcgctctcacctatgatgccgtgcaggtgatgacagaagcttttcgcaaccttagaaagcaaaggatcgaaattagtaggagaggcaatgccggtgactgtctcgcgaatccggcagtcccctggggccaaggggtggagattgaacgagctctgaagcaagtgcaggtggaggggctgtcaggaaacattaaattcgaccaaaacggcaagcgcatcaactataccattaatatcatggagctcaagacaaatgggcctcgtaagataggttattggtccgaggttgataaaatggttgtgacgctgaccgaactgccatcaggtaacgacacatcaggtcttgagaataagaccgttgtggttactacaatcctggagtccccttatgtgatgatgaagaaaaaccacgagatgctggaaggcaacgaacgctacgagggttactgtgtcgacctcgctgctgagattgcaaaacactgcggcttcaagtacaagctgacaatcgtgggagatggaaagtatggggctcgtgatgctgacaccaaaatatggaacggtatggttggagagttggtatatggcaaggccgacatcgccattgctcccttgaccattacgttagtgagagaagaggttattgatttctctaagcctttcatgagtctgggcatctccattatgatcaagaaaccacaaaagtcgaagcccggtgttttcagttttctggatccgctcgcgtatgagatctggatgtgcatcgtattcgcatacataggtgtctccgtcgtcttatttctggtctctaggtttagtccatacgagtggcacaccgaggagtttgaggacgggagagaaactcaaagctcagagtccactaacgagttcggtatcttcaactcgttgtggtttagcttaggcgcattcatgcagcagggctgtgatatcagcccacgttctttgagcggccgaatcgttggcggtgtatggtggttcttcacattgatcatcatttcatcatatacggcgaatctcgcagctttcctcacagtagaacggatggtgagtccaattgaaagcgccgaggatcttagtaaacagacagagattgcctacggcaccctcgactcgggaagcactaaagagtttttccggagaagcaaaatagcagtgtttgacaaaatgtggacctacatgcgaagtgcagagccgagcgtatttgtgcggactacagctgaaggcgtggcacgagtgaggaagtccaagggaaagtatgcttatctgctggaaagtacaatgaatgaatatatcgagcagcgaaagccttgtgataccatgaaagtgggcggtaacttggatagtaagggttacggaatagccacaccaaaaggctccagtctgagaacacccgtcaacctcgctgtgctgaaactttccgaacagggtgtcctcgataagcttaagaacaagtggtggtacgataaaggcgagtgcggcgcaaaagactcgggaagcaaagaaaaaacatctgccttgagcctctccaatgtggccggagtgttctacatcctcgtggggggactgggcttagccatgctcgtggctctgatcgagttttgttataagagtagggcggaggctaaaagaatgaaagtggcaaagaatgctcaaaatatcaatccctcctctagccagaattctcaaaacttcgcaacctacaaagaaggatacaacgtatatggcatagagtcagtgaaaatatag

SEQ ID NO: 224719 - DNA, 2193 bp, Artificial Sequence
  Description of Artificial Sequence: Synthetic coding sequence
atggtgcaattttcaaccagcgagtttcgactaaccccccacatcgataatctggaagtcgccaactccttcgccgtcactaatgctttttgctctcagttttcccgcggtgtgtacgctatcttcggtttctatgacaaaaagtccgtgaataccattacgagcttttgcggcacacttcacgtgagctttattactcccagtttccccacagacggtacacatccctttgttattcagatgagacccgatctgaagggcgctttgctgagcctgattgagtactaccagtgggacaaatttgcatatctctatgactccgataggggactcagtacccttcaggccgtcctggatagcgccgctgagaagaagtggcaggttaccgcgatcaatgtgggcaacattaacaacgataagaaagacgaaatgtataggagcctcttccaggatttggagttaaagaaagagcggagagtgatcctggattgtgaacgcgacaaggtcaatgacattgtagatcaggtgatcactatcgggaagcacgtaaaaggataccattacattatcgccaacctcgggtttactgacggtgacctgctcaagatacagtttggaggggcaaatgtgtctggcttccagattgtcgactatgacgattccttggtgagtaagttcatcgagaggtggtccacattggaagagaaagagtatccaggagctcacacgaccaccatcaagtacacatctgccctgacttacgacgcagtgcaggttatgaccgaggcatttagaaatctcagaaagcaaagaatcgagattagtcgccgaggcaacgctggggattgcctggctaacccagccgtaccctggggtcagggggtggaaatagagcgggctctcaaacaggtccaggtggaagggttgtccggcaacatcaaatttgaccaaaacggtaaaaggatcaattacactattaacatcatggaactgaaaacaaacggccctcggaaaatcgggtactggtcagaggtagacaagatggttgttacactgacagagttgccatctggtaatgatacaagcggccttgagaataaaacagtggtagttactaccattcttgaatccccttacgtaatgatgaaaaagaatcatgaaatgctcgagggcaacgaaaggtacgagggatactgtgttgacctggctgccgaaatcgccaagcactgcggatttaaatacaagctcaccatcgtgggggacggaaagtatggcgctcgcgatgcggacacaaagatttggaacgggatggtcggggaactcgtttatggaaaagcagatatcgcaatagcccctctgaccatcacactcgtcagggaagaagtcatcgatttcagtaaacccttcatgtccttagggatttcaattatgattaaaaagccgcagaagagcaagccgggagtgttctcctttctagaccctctggcctacgagatttggatgtgtattgtattcgcatatatcggcgtaagcgtagtgttgtttctcgtgagcaggtttagcccctacgagtggcatacagaagagtttgaggatggcagggaaacacagtcttccgaaagcacaaatgagttcgggattttcaatagcctgtggtttagcctgggagcgttcatgcaacagggctgcgatatatccccaaggtcactcagtggtcgaatcgttgggggagtctggtggttcttcaccttgatcattatttcttcatatacagctaatctggcagctttcctgactgtggagcgcatggtgtcaccaatcgaaagcgccgaagatctgtcaaagcagaccgaaatcgcttatggaacactggacagcggaagtacgaaagagttcttccggagatcaaagatcgcggtgttcgacaaaatgtggacatatatgcgcagcgctgagccatcagtgtttgtccggaccaccgccgagggtgtggcacgcgtgaggaagtcgaagggcaagtatgcttatctgctagaaagtaccatgaacgaatacattgagcagcggaagccttgtgacactatgaaagttggagggaatctagacagtaagggctatggaatcgcgacacctaagggctcctcgctgtcgggcgtgactttcaagaccctgctatttgtctgttgtggttag

SEQ ID NO: 224720 - DNA, 297 bp, Artificial Sequence
  Description of Artificial Sequence: Synthetic coding sequence
atgaacgaatatatcgaacagaggaagccctgcgatacgatgaaagtgggcggtaatttggattccaaagggtacgggattgctacacccaaaggatccagcttgagtggcgtcacatttaagacactgatctgtctgctctggattaacgcagtgaatctcgctgtactgaaactgaatgagcagggtcttctggataagctgaaaaataaatggtggtacgataagggagaatgtggcagcgggggaggtgatagcaaaaaccccagtaaatcatgtagcatcgagacccagtag

SEQ ID NO: 224721 - DNA, 2511 bp, Artificial Sequence
  Description of Artificial Sequence: Synthetic coding sequence
atggtacaatttagcactagtgaattcagactcacaccccatatcgacaacttagaagtggccaacagctttgccgtgacgaacgcattctgttcccaattcagtcgcggagtttatgccatctttggcttctacgataagaagtccgttaatacaatcacaagtttctgcggcaccctccatgtgtcttttatcactccatcgtttccaaccgacggcacgcatccttttgtgattcagatgagacctgacctgaaaggagccttgctgtccttgatcgaatactatcaatgggacaagtttgcctacctttacgacagcgacaggggcctcagtactctgcaggccgtcctggactcagccgcagagaaaaaatggcaggtcactgctatcaacgttgggaacatcaataatgataagaaagatgagatgtaccgttcactcttccaagaccttgagctgaaaaaggaaagaagagtgatcctggattgtgagcgtgataaagtaaacgatatcgttgaccaggtcatcaccatagggaagcacgtgaaaggctaccactacataatagcaaacttagggttcaccgacggggatctgctgaagatccagtttgggggtgctaacgtgtccggctttcagatcgtcgactacgatgacagtttggtgtcgaaattcatcgaacgttggtctactcttgaggagaaagagtacccgggagcacatactaccacaatcaagtacacctctgcgttgacctacgatgccgtgcaggtgatgaccgaggcgttcaggaaccttagaaaacagcgcatcgaaataagcaggaggggcaatgctggcgactgtctcgctaaccccgctgtgccatggggccagggggtcgagatcgagagggcacttaagcaggtacaggtcgagggactgagtggcaacatcaagtttgaccagaatggaaagcggataaactacaccattaatatcatggagttgaaaaccaacgggcctcgtaagattggttactggtctgaggtcgacaagatggttgtcacactcaccgaactgccctctgggaacgacactagcggactggagaacaaaacagtggtcgttacaactatactggagagcccttatgtgatgatgaaaaagaatcacgagatgttagagggaaacgaacgctatgaagggtattgtgtggacctcgctgctgagattgccaaacattgcggatttaagtataagttgacaattgtaggggacggcaagtacggcgctcgggacgccgatacaaaaatctggaatggtatggtcggtgaactggtctatggcaaggccgacatcgctatcgctcccctgacgatcactctggtgcgagaagaggtaattgatttctccaagcccttcatgagcctaggaatctccataatgattaaaaaaccgcaaaagagcaaacctggagttttctcattcctcgatccattggcttacgaaatttggatgtgcatcgtatttgcatatattggtgtatctgtggtactgtttctggtttctcggttttccccctacgagtggcatactgaagagtttgaggacgggcgagaaacccaaagctcagagtccactaacgaattcggcatttttaattccctctggttcagtcttggggctttcatgcagcagggctgcgatattagcccccgaagtctctcggggcgtatcgtgggaggagtttggtggttttttactctgatcattataagttcttataccgctaacttggcagcttttctgacagtcgaacgcatggtctcacccatcgagagtgcagaggacctgtcaaaacaaacagagattgcgtatggaacattggacagtggttctaccaaagaatttttccgccgaagtaaaatcgcagtgttcgacaagatgtggacctacatgaggagtgcggagccttctgtgttcgtgagaacgacagccgagggagttgcaagagtgagaaaaagcaaaggcaagtacgcctatctgctggaaagcaccatgaacgaatacatcgagcagcgcaaaccttgtgatacaatgaaagtgggcggaaatctcgatagtaaagggtatggaatcgcgacccctaaaggcagttcactgaggacgcctgtgaacctagcggttctgaagctctccgagcagggggtgctggacaagcttaagaacaagtggtggtatgataaaggcgagtgcggagcaaaagatagcggcagcaaagagaaaacgtccgccctctctctaagcaacgtggcaggcgtgttttacatcctggtaggcggtctgggattggctatgctggtggcgctcatcgagttttgttataaatctcgcgctgaggctaagcgtatgaaggtggcaaaaaatgcacagaacattaacccatcctcttcccagaacagccaaaacttcgcaacctataaagagggctacaatgtttacgggatcgaaagtgtgaagatatag

SEQ ID NO: 224722 - DNA, 438 bp, Artificial Sequence
  Description of Artificial Sequence: Synthetic coding sequence
atggtccagtttagcacctcagagtttagactgacaccacacatcgacaatctggaagttgcgaactcatttgccgtgacaaatgccttctgtagtcaattctcgaggggagtgtacgctatcttcggtttctacgataagaagagcgtgaatacgattacaagtttctgtgggaccctccacgtctcatttatcacaccctcctttcctacagatggaacgcaccctttcgtgatccagatgaggcccgacttgaaaggagctctgctgtctttgatcgagtactatcaatgggacaagtttgcttatttatatgattccgaccgcggactcagcactctacaagctgtgctcgattccgccgcagagaaaaagtggcaggtgaccgctatcaatgtcggcaatattaataatgataaaaaagacgagatgtactag

SEQ ID NO: 224723 - DNA, 174 bp, Artificial Sequence
  Description of Artificial Sequence: Synthetic coding sequence
atggtccaattttcaacatccgaatttaggttgaccccgcacatagataatctggaagtggccaatagctttgcagtcactaacgctttttgcagccaattttctagaggcgtctatgcgatcttcggcttctatgataaaaaatccgtgaacacaataacaagtttttgctag

SEQ ID NO: 224724 - DNA, 2511 bp, Artificial Sequence
  Description of Artificial Sequence: Synthetic coding sequence
atggttcagttttccaccagtgaattcaggttgactccccacattgataatctggaggtcgctaactctttcgccgtcactaacgccttctgttctcagttttccaggggggtgtacgcaatttttgggttctacgataaaaagtctgtgaataccatcactagtttttgtggcactctgcacgtgagttttattactccgtcctttcccacagatggcacacaccccttcgtcattcagatgcggccagatctgaagggagcccttctgtcccttatcgagtactaccagtgggacaagttcgcatacttatacgactctgatcggggattgtccacccttcaggcagtgctggactctgctgccgaaaaaaaatggcaggtgactgctatcaatgtgggaaacattaataatgataagaaggacgagatgtatcgatcccttttccaggacttagaactaaagaaagagcgcagagttattctcgattgcgaaagagataaagtgaatgacatagtggaccaggtcataactattggcaagcatgtaaagggctaccattacattatagcgaatcttggcttcactgacggcgacctgcttaaaatacagtttggaggtgccaatgtgtcggggtttcagatcgtggactatgacgattcactggtatcaaaattcatagagcgctggtctactctggaggagaaagagtaccctggggcacacacaaccacaatcaagtataccagcgctctgacatatgacgctgtgcaggtgatgactgaggcctttaggaatcttaggaaacagcgcatcgagatttcaaggagaggaaacgccggtgactgcctggcaaatcctgccgttccttggggacagggtgtagagattgaaagagctctcaagcaggtccaggtggaaggcctgtctgggaacatcaagtttgaccagaatgggaagagaatcaattacactattaatataatggaactgaagactaatggccctcggaaaataggttactggtctgaggtggataagatggtagtaacactcacagagcttcccagcggtaacgacactagcggtctggagaataagacagttgtggtgactaccattctcgaatccccttacgtgatgatgaaaaaaaaccacgagatgcttgaaggtaacgagcgatacgagggatattgcgtcgacctcgctgcagagattgccaagcactgcgggttcaagtacaaactcactatcgtgggcgacggaaagtacggcgcaagggacgctgataccaaaatttggaacgggatggtcggcgagctggtttatggcaaagccgacatcgcaatagctcccctgaccatcactttagtgcgggaggaggtgattgacttttcgaaacccttcatgagcctgggaatttctattatgattaaaaaaccccagaaaagcaagcctggcgtattctccttcctagaccccctcgcgtacgagatttggatgtgtatagtgttcgcatacattggggtcagcgtcgtactcttcctggtctcccggtttagtccatatgaatggcacactgaggagttcgaggacggcagggaaactcaatcaagcgaatcgacaaatgagtttgggatcttcaactcattgtggtttagcctgggcgcttttatgcagcaaggctgtgacataagcccaaggagcctgagtggaaggatcgtgggaggcgtgtggtggtttttcactctcattattatctcatcgtacactgctaatctggccgcatttctcacagtcgaacgtatggtctcaccaattgagtcggccgaggacctaagtaaacagaccgagattgcatacgggaccctcgactccggttccacaaaggagttctttagacgttcaaagatagccgtgtttgataagatgtggacttacatgagatcagctgaaccctctgtgttcgtccggacgacagccgagggggtcgctcgcgtgaggaaatccaaaggaaagtacgcgtacctgctggaatccactatgaatgaatatatcgagcagaggaagccgtgtgatactatgaaggtgggtggaaatttagatagcaagggatacggaatcgcaacacccaagggctcctccctacgaacacccgttaacctcgcagtgcttaagctatccgagcagggagtactggataaactgaaaaataagtggtggtatgataagggcgaatgcggggcaaaagattcaggaagtaaagagaaaactagcgctctgagcctgtctaacgtcgccggagttttttacatcctggtcgggggtctgggactggctatgctggtcgctctcattgagttttgttacaaatctagagctgaggccaagagaatgaaggttgccaaaaacgctcagaatatcaatccctcatcatcccagaacagtcaaaactttgccacctataaggagggatacaacgtctacggcattgaatcagtcaagatttag

SEQ ID NO: 224725 - DNA, 378 bp, Artificial Sequence
  Description of Artificial Sequence: Synthetic coding sequence
atgcagaagatcatgcatatatctgtgttgctgagtcctgtgctctggggccttatcttcggcgtaagctccaactctatccaaatcgggggtctgttccctcgcggagccgatcaagagtattcagcctttagggttggaatggtccaattcagtacctcagagtttcgcctcactcctcacattgacaatcttgaggtcgcaaactcattcgcagtcactaacgccttttgttcccagttcagcagaggtgtctatgccatctttggcttctacgataagaagtccgtaaacacaattacctcgttctgtggtacactccacgtgagttttatcaccccaagtttccccaccgatgggactcacccatttgtctag

SEQ ID NO: 224726 - DNA, 147 bp, Artificial Sequence
  Description of Artificial Sequence: Synthetic coding sequence
atgcagaagatcatgcatatctcagtcctgctgagcccggtgctctggggcctaatttttggcgtttcttccaatagcatccagattggcggtctgtttcctaggggcgctgatcaggagtactccgccttccgcgtgggcatgtag

SEQ ID NO: 224727 - DNA, 3030 bp, Artificial Sequence
  Description of Artificial Sequence: Synthetic coding sequence
atggaagcactcaccctttggctgctgccctggatttgtcagtgtgtgtctgtgagggccgactccatcattcacatcggggcaattttcgaggagaacgccgcaaaagacgaccgtgttttccaactggctgtgagcgatctttccttaaacgacgacatcctccaatctgaaaagatcacgtatagcatcaaggtcatcgaggctaataacccttttcaggccgtgcaggaagcatgtgatctgatgacacagggtattttggcactcgtcactagtacaggctgcgctagtgccaacgcgctgcagtcacttacagatgcaatgcatattccgcatttatttgttcagagaaacccaggcggatccccccgaactgcttgtcatcttaatccttctcctgacggggaagcatacactttagctagcagacctcccgtgagacttaacgatgtcatgctcaggttagtgactgaactgcggtggcagaaatttgtgatgttttacgactcagaatacgatattcgaggcctgcagtcattcctcgatcaagcgagccggctcggcctcgatgtcagtctgcagaaggtggacaaaaatatctctcacgtgttcacctccctcttcactactatgaagactgaggagctcaacagataccgcgatacattgcgtcgcgctatccttctcttgagtccccaaggtgcccattcattcataaacgaggccgttgaaactaatcttgcgagtaaagattctcactgggtgttcgttaacgaagagatcagcgatcccgagatcctggatctggtccacagcgctttgggacgtatgacagtggtgcgacaaatctttccttctgccaaggacaaccagaagtgcacgaggaataatcatcggatatcttccctgctgtgcgatccccaggaaggttatctccagatgttgcagattagtaacctgtacctgtatgatagcgtcctcatgttggccaacgccttccatcgaaagttggaagataggaagtggcactcaatggccagcctgaattgtatcagaaagtccactaagccgtggaatggcggacgcagcatgctggacacaattaagaaagggcatataacaggcctgaccggagttatggagtttcgtgaggattcgagtaacccatatgttcagttcgaaattctcgggacgacttactcagagactttcgggaaggacatgcgcaagctcgccacatgggacagcgagaagggtttaaatggatcccttcaggagcgccctatgggcagccgacttcaaggcctgacgcttaaagtggttacagtcctagaggaacccttcgtcatggtggcagagaacattctgggacagccgaagagatataaaggattcagcatcgacgtgctggacgcactcgccaaagcccttggattcaagtacgaaatctaccaagcaccagacggcaggtacgggcatcagctccataacacctcttggaacggcatgattggcgaacttatttccaagagggccgatctggccatctctgcaattacgatcactccagagcgcgaaagtgtcgtggacttctctaagcgctatatggattactccgtcgggatcctaattaaaaagcctgaggagaaaatctcaatcttttccctgtttgccccatttgacttcgccgtgtgggcatgtattgcagcagccatccccgtggtgggagtgctgatattcgtgcttaataggatccaggcggtgagagcccaaagcgcagcccagccacgacccagtgcttccgcaacattgcactctgccatctggatcgtgtacggagcattcgtacagcaagggggtgagtcttccgtaaactccatggctatgaggatagttatgggcagttggtggctatttaccctgatcgtgtgttcttcctacacagccaatctcgcggcttttctcacagtgtccaggatggataaccctatccgaaccttccaggacttaagtaaacaggtcgagatgtcctacggtaccgtgcgggactcggccgtctacgaatattttcgtgccaagggaaccaacccactggagcaagatagtacattcgccgagctgtggagaacaatatcaaagaatggaggggctgataattgcgtgagcagcccaagcgagggaataagaaaggctaagaaggggaactacgctttcttgtgggacgttgctgtcgtcgaatacgcagctttgaccgacgacgactgcagcgtgaccgtcattgggaactctattagctctaagggatatggcatcgcattacagcacggctctccatacagagacctcttctcccagagaattctcgagctccaagacactggtgatctcgacgtactgaagcagaagtggtggccgcacatggggcgatgtgacttgactagccatgcctcggctcaagccgatgggaagagcttgaagttgcacagctttgcaggtgtcttctgtattctggctattggcttattactggcttgtcttgtggccgcactggagctctggtggaactcgaatagatgccaccaggagacccccaaggaagacaaagaagtgaatcttgagcaggtgcatcgaagaatgaatagcctgatggacgaagatatcgcacataagcagatcagtcccgcatctatagagttatccgccttggagatggggggactcgcacccacacaaacactcgagccgacccgcgagtaccaaaatactcagttgtccgtaagtacattcctccctgagcaatctagccacggcacaagtaggactttgtctagtggaccttcctccaacttgcccctgcccctcagcagcagcgctactatgcccagtatgcagtgcaaacataggtcccccaacggcggtctgttccggcagagccccgtgaagactcctattccaatgtcattccagcccgtgcccggaggcgtgctgccggaggccttagacacatcccacggcacttctatttag

SEQ ID NO: 224728 - DNA, 1743 bp, Artificial Sequence
  Description of Artificial Sequence: Synthetic coding sequence
atgggttctcggctgcaagggcttactctcaaggtggtgaccgttctagaagagccgtttgtgatggtggccgagaacattcttggacagccaaaacggtataagggattctcaatcgacgtcttagatgcactggcgaaagcattagggtttaagtacgaaatatatcaggccccagacgggagatacggacatcaactccataatacctcatggaacggaatgattggggaactgatttcaaaaagggccgatctcgccatatcggcgattactattacacctgagagggagtccgtagtagatttctcaaaacgctacatggattacagcgtaggaattctcattaaaaagccagaggagaaaatctctatcttctccctgttcgcccctttcgactttgccgtgtgggcctgtatcgcagccgctataccagtggttggcgtgctgatttttgtattaaatcgcatccaagctgtgcgcgctcagagcgctgcccagccaagaccgagtgcttctgccacccttcactccgccatttggattgtgtatggagcattcgtacaacaggggggagagtcttcggttaatagcatggccatgaggatcgtgatggggtcatggtggctatttaccttgattgtatgcagcagctacaccgcaaacttggccgcattcctgaccgtatcacggatggataacccaatacgcaccttccaggacctttcaaaacaggtggaaatgtcctacggaaccgtgagagattccgccgtctatgaatattttcgggcaaagggcacaaatcctttggagcaggacagcacgtttgcagagctctggcgcaccattagtaagaacggtggggctgataactgcgtcagcagtccaagcgaaggaatcaggaaggctaaaaagggaaactatgctttcttatgggacgtggctgtggtcgaatatgcagcattaaccgacgatgactgttccgtaacagtgattggaaatagcatctcttctaaagggtatggaatcgcactccaacacggcagtccttatcgcgacctcttttcacagaggatcttggagctccaggacaccggtgacttggacgttctgaaacaaaaatggtggccacacatggggaggtgcgaccttacaagccatgcttcagctcaggctgacggaaagagtcttaaactgcattcctttgcgggagtcttttgcatcttagccatcgggctcctgttagcatgcctggtcgcagccctcgaactgtggtggaatagcaaccgctgtcaccaggaaacacccaaagaggacaaggaggttaacttggaacaggtgcaccgcagaatgaactcactcatggatgaggatatcgcgcataaacagatctccccagcctccattgagttaagtgcacttgagatgggagggttagctcccacccagactcttgaaccgacacgggagtatcaaaatacccagttatccgtgtccacgttccttccagagcagtcatcccacgggacatccaggactctctctagcggcccatccagcaatctgccactgccactatctagtagcgctactatgcctagcatgcagtgcaaacacaggtccccgaatgggggattatttagacagagccccgtcaagacacctatccccatgagcttccagccggtacccggaggcgtactcccagaggcacttgacacatcacatggcactagcatctag

SEQ ID NO: 224729 - DNA, 3024 bp, Artificial Sequence
  Description of Artificial Sequence: Synthetic coding sequence
atggaagtgttcccattcttgctagtacttagcgtatggtggtcccgaacgtgggattccgccaacgctgattccattattcatatcggagcaatcttcgacgaatcagccaaaaaagacgacgaggtgttccgaacagccgtgggggacctgaaccagaatgaggaaattctgcagaccgagaagatcaccttctccgtgacttttgtggatggaaacaatccctttcaggcagtacaagaggcttgtgaactgatgaatcaggggatcctggctttggtgagttctataggctgcacctccgcgggatcactgcagagtcttgcagatgctatgcacattcctcatttgttcatacaaagaagcacggccggaaccccaaggtccggctgtggacttactcggtcaaaccgcaatgacgactatacgctgagtgttagaccacccgtctatctccacgacgtgattctgcgagttgttacggaatacgcttggcagaaattcattatcttctacgacagtgagtacgatatccgaggcatacaagagtttctcgacaaagtaagtcaacaaggtatggatgtcgcgctgcagaaggttgagaacaacattaataaaatgataacaacactgtttgacacaatgcggatcgaggagctcaatagatatcgggacactttgagaagggcaatcctggtcatgaaccccgcaaccgcgaagtctttcatcaccgaggtagtcgaaacaaatctggtcgccttcgattgccactggattatcattaatgaggaaatcaacgatgtggacgttcaggagctagttcgtcgcagcatcggacggcttaccatcatcaggcaaacctttccggtgccacagaatattagccagagatgctttagaggtaatcacagaatcagtagtactctgtgcgaccccaaagatcctttcgcccagaacatggaaatcagtaacctctacatctacgatactgtcttgcttcttgccaatgcatttcacaagaaacttgaggaccgcaagtggcacagtatggccagcctctcctgtatcagaaagaacagcaagccatggcagggaggccgttccatgcttgagacgattaaaaaggggggagtgagcgggctcacaggcgaactcgagtttggcgagaacggtggaaatccgaatgttcattttgaaattcttggcacaaactacggggaggaactgggcaggggcgtgaggaagctcggctgctggaacccagtaacagggctaaatggctctctgactgacaagaaactggagaataacatgagaggcgtggtgctgcgagtcgttaccgtgcttgaggaacctttcgtgatggtgtctgaaaacgtcctcgggaagcccaaaaagtatcagggcttttccatcgacgtgctggacgccctctctaactacctcgggtttaactacgaaatttacgtagcacccgatcacaagtatggatcaccacaggaagatgggacctggaacggcttagtcggcgaattagtgtttaaaagagccgacattggtatctccgccctgaccattacccccgatcgcgaaaacgttgtggacttcaccactagatacatggattactctgtaggggtgctgctgaggagagcagagaagacagttgacatgttcgcctgcctggctccttttgacctctctctctgggcttgtattgcgggaactgtcctcttggtgggcctcctggtgtacctactgaactggcttaaccctcccagacttcagatgggatcgatgacatcaaccaccctctacaattccatgtggtttgtatacggtagttttgtccagcagggtggggaggttccctacactaccctagccactaggatgatgatgggtgcatggtggttgttcgccctgatcgtgatctcatcatatacagccaaccttgccgcttttctgactatcactcgaatcgaaagtagtatccagagtcttcaagatctttcgaagcagacagaaatcccttatgggaccgtactggactccgcagtctatgagcacgtgcgcatgaagggcctgaaccccttcgagcgggactccatgtactcccagatgtggcggatgatcaataggtcaaacggcagcgagaataacgtcttggaatctcaggcaggcatccagaaggtgaaatatggcaactacgcctttgtgtgggatgccgcagtattggaatacgtggctattaacgacccggattgctctttctatacaataggtaacacagtagccgatcggggttatggcattgcattacagcatgggtccccctatcgggatgttttttcccagaggatcctggagctgcagcagaatggcgatatggacatcctcaagcacaaatggtggccaaagaatgggcagtgcgacctctactcttccgtagacactaaacagaagggtggagcgctggatatcaagtccttcgctggcgtgttctgcatcctggccgctggcatcgtgctttcatgcttcatcgctatgctggagacgtggtggaataaacgcaagggctcacgagtgccttccaaagaggatgataaggagattgacctcgaacatttgcacaggcgtgtgaacagtctgtgtacagacgacgacagcccacataaacaattctctaccagctccattgacttgactcccctggatatagacaccctgccgactaggcaggccttggagcagatctctgacttccggaatacacatatcaccactaccacctttatcccagaacaaatccaaaccctgtcgcggactctcagcgctaaggcagcatcaggcttcaccttcggaaacgtacccgagcacagaacagggccatttcggcatagagcccctaacgggggtttcttccggtcaccaattaagacaatgtcgagtataccttaccagccaacacccaccttggggcttaatcttggtaatgatccggataggggcacatccatatag

SEQ ID NO: 224730 - DNA, 2739 bp, Artificial Sequence
  Description of Artificial Sequence: Synthetic coding sequence
atggaagttttcccatttctgctcgtgttatcagtgtggtggtcccggacatgggattcggctaacgcagactccatcatccatataggggctattttcgacgagtctgctaagaaagacgacgaggtttttagaacagccgttggcgacctcaaccagaacgaagaaatcctgcagactgaaaagataactttcagcgtcacattcgtcgatggaaataatccattccaagcagtacaagaagacatcagagggattcaagagttcctcgataaggtatcccagcagggaatggatgttgcactccaaaaagttgagaacaacattaataaaatgatcacaactctcttcgacacaatgaggattgaggagctgaatcggtaccgagatacattgcggagagccatccttgtgatgaatcccgctactgcaaagtcttttatcactgaagtggtggaaaccaatctcgttgcctttgattgtcattggattattattaatgaagaaattaatgacgttgacgtgcaagaactggtgcgcagatcaataggcaggcttaccataatccggcagactttcccagtgcctcagaatatttcgcagcgctgcttcaggggcaatcaccgtatcagttcaactctgtgcgatcccaaagacccgttcgcccagaatatggaaatcagcaacctgtatatttatgacacagtcctgttactggccaacgctttccataagaagttagaagacagaaagtggcacagtatggcctccctctcatgcattaggaaaaatagcaagccctggcaagggggaagatctatgttggaaaccatcaagaaggggggtgtctccggtctaacgggagaactcgagtttggagaaaacggaggaaacccgaacgtccattttgaaattctaggtacaaactatggggaagaactcggacgcggtgtgagaaaattaggatgctggaatccagtgactgggctcaatggaagtctcaccgataagaaacttgaaaacaacatgcgcggagtggtcctcagagtcgtcacggtcttggaggaaccattcgtgatggtatccgagaatgtcctaggcaaacctaagaagtatcaaggattcagtatcgacgtgcttgatgccctctctaactacctgggcttcaactacgaaatctatgtggcacccgatcataaatacgggtctcctcaggaggatggtacttggaacgggcttgttggtgagttagttttcaagagggctgatatcggtatctccgcactcacaatcacacctgacagagagaatgtcgtggactttacgacccgatacatggattactccgttggggtgttgttacgcagggccgagaaaacagtggatatgtttgcctgcctcgcccctttcgatttgtctctttgggcgtgcatcgcaggcactgttctcctcgtcggacttctggtgtatttgctgaactggctgaatccccctaggctgcagatggggagtatgacatctacgacactgtacaattctatgtggttcgtttatgggtcatttgtccagcaaggcggtgaggtaccctatacaacactagctacccgtatgatgatgggagcgtggtggctcttcgctctgattgtcatttcatcctataccgccaatttggccgcatttcttacaatcactcgcatcgaatctagtattcagagcctccaggatctgtccaagcagacagaaatcccgtacggtactgtgcttgatagcgcggtgtatgaacacgtccgtatgaagggactgaatccctttgaacgcgactcaatgtactcacagatgtggaggatgatcaacagaagtaatggaagcgagaataatgttctggaaagccaggctgggatccagaaagtgaagtacgggaattacgcattcgtgtgggacgccgctgtgctggaatatgtggccattaatgaccccgattgttccttttacacaatcgggaatacagtagcggatcgcggatacggtattgccctgcagcatggctctccctacagggatgtgttttcccagcgaatcctcgagctgcagcagaatggtgatatggatattctgaaacataaatggtggcccaaaaatggacagtgcgatctctattcctctgtggacactaaacagaaggggggtgcgctagacattaagagtttcgccggtgttttctgcatcctcgcggcaggaatcgtcctaagctgctttatcgccatgcttgaaacctggtggaataagcggaaaggctcaagagtgcccagcaaggaggacgacaaggagatagatctggagcatttgcacagacgagtgaactctctgtgcacagacgacgacagcccgcacaagcagtttagtacatcatccattgatctgacccctctggatatcgataccctgcccaccagacaagctctagaacagatttcagattttaggaatacccatataactacaacaacgtttatccccgaacagatccagactcttagtagaacactttcagcgaaggccgcttctggcttcacctttgggaacgtgcctgagcaccgcacaggcccttttcggcatagggcacccaatggcggattttttcgctcccccatcaaaacaatgagctcaattccgtaccaacccacaccaacacttgggttgaacctgggtaatgaccctgatagagggacatccatttag

SEQ ID NO: 224731 - DNA, 2763 bp, Artificial Sequence
  Description of Artificial Sequence: Synthetic coding sequence
atggagcatggaaccctgcttgcccagcccggattgtggaccagagacacttcatgggcgttgctttactttttgtgctacatcttgccccagactgccccacaagtgcttcggatcggcggaatctttgagaccgtggaaaacgaacctgtcaatgtggaagaactagcgttcaagttcgccgtgaccagcatcaacagaaatcggacgcttatgccaaacaccacactaacatacgacatccaaaggattaatctgtttgacagcttcgaggccagccgccgagcgtgcgaccagttagctttgggcgtagccgcactgtttggcccaagccactcttcctccgtgagcgccgttcagtcaatttgtaatgctttagaagtcccgcacattcagacacggtggaaacaccccagtgtcgacaacaaagacctgttttacattaacctgtacccagactatgctgcaatatctcgcgctatattggatctggtgttgtactacaactggaaaaccgtcactgtcgtttatgaagattcaacaggattgatacgcctgcaggaacttattaaggctcccagccgatataacatcaagatcaaaattcgccagctgccatccggcaacaaggacgcgaagcctttgttaaaggagatgaagaagggcaaagagttttacgtcatttttgactgtagtcacgagacagcagcagagatactcaagcagatactgtttatgggcatgatgacagagtattaccattatttcttcaccacccttgacctctttgctctggatctcgagctgtacagatactctggcgttaatatgaccggttttcggctacttaatatcgacaacccacacgtaagcagcattattgaaaagtggagcatggaacggctccaggcccctcctagacctgagactggcctgctggacgggatgatgacaacggaggctgccctgatgtatgacgctgtatatatggtagctattgcctctcatcgcgcatcccaattgacggtttcctcattgcaatgccaccggcacaaaccctggaggctgggtcctcgtttcatgaatttgatcaaagaggctaccgcccgatgggacggcctcactgggcacattacttttaataaaaccaatggcctgaggaaagacttcgacctggacatcataagtctgaaggaagaaggcacggaaaaggccgcaggcgaggtgtcgaagcacctctacaaggtctggaaaaagatcggcatttggaattctaactccggcctgaatatgactgacagcaacaaagacaaatcctcaaacatcaccgattccctggcaaaccggacactgatagtgaccactatccttgaggagccatatgtgatgtatcgcaagagtgacaaaccactgtacggcaacgatcgctttgaaggctattgtttggacctgcttaaggagctctcaaatatactgggatttatttacgatgtgaagctggtgccagatggaaagtacggtgctcagaacgataagggggagtggaacggcatggtaaaggaattgattgaccatcgagctgatctggctgtggcccctctgactattacatacgtccgcgagaaagtgatagacttcagcaagccttttatgacgttagggatttctatattgtatcgcaagcctaacggcactaatcccggtgtgtttagctttttaaaccccctgtcccccgatatctggatgtacgtcctgctggcttgcttgggcgtgagctgtgtgttatttgtcattgcccgattcacaccctatgagtggtacaatccacacccgtgtaacccggacagcgatgtcgtcgaaaacaatttcacactcctcaattcattctggttcggcgtgggagccctaatgcagcagggctccgagctgatgcccaaggctctgtcaactagaatagtggggggaatttggtggttttttactcttatcatcattagcagctatactgctaatctggctgcttttttgacagtggaaagaatggaatctccgattgacagtgcggatgatttggccaagcagaccaagattgagtacggtgctgtcagggacggaagtacaatgacattcttcaagaaatcaaagatctccacatacgaaaaaatgtgggccttcatgagttcccgacaacagactgcgttggtccgaaactccgatgaaggtattcagagagtgcttaccactgactatgccttactaatggaatcaacttccattgagtacgtgacacagcggaactgcaacttaacacagattggagggcttattgattccaagggctatggtgttggtacacctataggcagcccctatcgagacaaaatcactatagctatactgcagctgcaggaggagggcaagctgcacatgatgaaggagaagtggtggcggggtaatggatgtccggaagaagacaacaaggaagcgtctgccctgggggtggaaaacattggaggcatcttcatcgtgctcgcagccggtctggttttaagcgtatttgtcgctatcggcgaatttatttacaaaagcagaaaaaataatgacattgaacaagcattctgctttttctatggtctgcagtgcaaacagacacaccccactaatagtacttcaggtaccactctgagcacggacctcgaatgtgggaagctgattcgggaggagagagggattaggaagcagagttctgtgcacaccgtttag

SEQ ID NO: 224732 - DNA, 2850 bp, Artificial Sequence
  Description of Artificial Sequence: Synthetic coding sequence
atggagcacggaacgctgcttgcccagcccggattatggactagggatactagttgggcactgctctatttcctttgctacatcctgccccaaacagctccacaggtgctgcggattggcggtatctttgaaactgtggagaatgaacctgtgaatgtcgaggagctggcattcaagtttgccgtgacaagcattaaccgtaataggacactcatgcccaacactacccttacctatgacatccagcgcattaatctcttcgatagtttcgaggcatctaggcgggcatgcgaccagttggcgctgggagtggctgccctgtttggtccatcccactcctcctccgtctcggcagtccagagtatttgtaacgcgctcgaggttcctcatattcaaactagatggaaacaccccagtgtggacaataaagatctattttacatcaatctgtatcccgactacgcggctatttccagggcaatcctagacctggtgctttattacaactggaagaccgtgactgtcgtgtatgaggacagcacgggccttatccggcttcaagaattaatcaaggccccaagccggtataacattaagatcaaaattcggcagcttccctctggaaacaaggacgccaagcctctgttgaaggagatgaaaaagggaaaggagttttacgtgatcttcgactgctctcacgagaccgctgcagagatcctaaaacaaatcctgttcatgggcatgatgacagagtactatcactacttcttcactactctggacttgtttgcactggatctggaactgtataggtatagcggggttaacatgacgggttttcgtttgcttaatatagacaacccccatgtctccagtatcattgagaagtggtcaatggaacgcttacaagcacccccaagacctgaaacagggctgctggacggaatgatgaccaccgaagctgccctgatgtatgatgcagtgtacatggtggctattgccagccatcgcgcttcccagctcaccgtaagtagtctgcagtgtcacagacataaaccctggcggctcggtccacgtttcatgaatctgatcaaggaggcccgatgggatggtctcaccggtcacatcactttcaacaaaaccaatgggctgcggaaggacttcgatttagacatcatcagcctaaaggaggaggggaccgaaaaggcagctggcgaagtgtccaaacacttgtacaaggtgtggaagaagatagggatttggaatagcaatagcggactcaatatgaccgattctaataaagacaaatcatccaacatcacagactctcttgccaatagaaccctaatcgtaaccacgattctggaggagccttacgtgatgtaccggaagagcgataagcccctttatggaaatgatcgctttgagggttactgtttggatctcctcaaagagctctccaacatccttggattcatatacgatgttaagctggtgcctgacggcaagtatggagcgcagaacgataaaggcgaatggaatgggatggtaaaagagctgatcgaccacagggccgacctcgccgtcgcacctcttaccattacttatgtgagagagaaggtgatagacttttcaaaaccattcatgaccttaggcatttctatcctctaccgcaagcctaatggaaccaaccctggagtgttctccttccttaatccactctcacccgatatttggatgtacgtactgttagcatgcttgggtgtgtcatgcgtccttttcgtcatagcacgcttcacaccttacgagtggtataacccccatccctgtaaccctgattccgatgtagtagagaacaattttaccctgctcaactctttctggttcggcgtcggggcactgatgcagcagggatcagagcttatgcccaaggccctgagcacgcggatcgtgggcggtatctggtggttcttcaccttgataatcatcagctcttatactgctaatttagccgcttttctcactgttgaacgcatggagtcccccattgactccgccgacgatcttgctaagcagactaagattgagtatggcgctgttagggacggctctactatgactttctttaaaaaatctaaaatttctacctatgagaagatgtgggcctttatgtcctctcggcagcaaactgctctggttaggaactctgacgaggggatccagagggtcctcaccacagactatgcactcctgatggaatctactagtattgagtacgtaacacagcgcaactgcaacctgacgcaaattggaggacttattgatagtaaggggtacggcgttggcaccccaatcggatcaccataccgggataagattacaatcgcaatattgcaactgcaggaagaaggcaaactccacatgatgaaagaaaagtggtggcggggaaacggctgccctgaggaggataataaggaagccagtgccttgggcgtggagaacatcggaggcattttcatcgtcctggccgcaggactggtactttctgtcttcgtggcgatcggcgagtttatctacaaaagcagaaaaaacaacgacattgagcagaagggcaaatcctcccgcatccgcttctatttcagaaacaaggtgagattccacgggcgtaaaaagcaaagccttggtgttgagaagtgcttgagctttaatgctataatggaggagctggggatctccctcaagaaccaaaagaagattaaaaaaaagtcccgaactaagggcaaatctagcttcacaagtattctgacatgccatcagaggaggacccagcgaaaagagactgtggcatag

SEQ ID NO: 224733 - DNA, 2616 bp, Artificial Sequence
  Description of Artificial Sequence: Synthetic coding sequence
atggagcacggcacattgctggcccagcccggtctttggacacgcgatactagctgggcccttctctacttcctgtgctatattctgcctcagacggccccacaggtgctcaggatcggcggaatatttgaaactgtggagaatgagcctgtgaacgtggaggagctggccttcaaatttgccgtgacgtctataaatcggaatcgcacactgatgcctaatacgacacttacatacgatatacaacgcatcaatctctttgacagcttcgaagcaagtcgaagagcatgcgatcaactagccttgggtgtggcagccctgtttggaccaagccactcctcctccgtgagtgcagtgcagtccatctgcaatgccttagaggttccccacattcagacccgctggaagcacccctccgtagacaataaggacctcttttatattaacctgtaccccgactacgccgcaatttctcgagcaatcttggacctcgtgctgtattacaactggaagactgtgaccgttgtctacgaagattccaccggcctgatccgactgcaggagctgatcaaagccccttctcgttacaacattaagatcaagatccgccagctgcccagcggaaacaaggacgcaaagccactcctaaaggagatgaagaaaggtaaagaattttatgtgatcttcgattgctcacacgaaaccgctgcggaaatcttgaaacagattctgtttatggggatgatgacggagtattatcattacttttttacaacgctggacttatttgcactagacctcgagttgtatagatattccggagttaacatgacagggtttaggctccttaatatagacaatccacatgttagcagcataatcgaaaagtggtcaatggagcgtctccaggcgccacccagacctgaaaccggactgttggacggaatgatgacaacggaagccgcactgatgtacgatgctgtctacatggtggctatcgccagccaccgggctagccagctcaccgtctcttcactccagtgccacaggcataaaccttggcgccttggaccccgattcatgaacctgattaaggaggccagatgggatggcctgacgggtcacatcaccttcaacaaaacaaacggattgagaaaggactttgatctggatataatcagccttaaagaagagggaactgagaaagcagcaggcgaagtttccaaacatttatacaaggtgtggaagaagatcgggatttggaactccaacagcggtctgaacatgacagatagcaacaaggacaagagttcaaacattaccgactcactggccaacagaactctgatcgttacaaccattctcgaagagccctacgttatgtatcgcaaatcagataagcccctgtacggcaatgaccgcttcgagggttattgtctggatctccttaaggaactgtctaatattctgggtttcatttacgacgttaaactggtgcctgacgggaagtacggggctcagaacgacaaaggtgaatggaatgggatggtgaaagaattgattgatcacagagctgatttggcagtcgcacccctgactattacatatgtgagagagaaagtcatcgacttcagcaagccatttatgaccttggggatatcgattctgtataggaaacccaatggtacaaaccccggtgttttctcgttcctcaatcctctgagtcctgatatctggatgtatgtacttttggcatgtctcggcgtgtcgtgcgtgctgttcgtaattgccaggtttacaccatacgagtggtataatcctcacccctgcaatccagatagtgatgtggtcgagaacaacttcaccctgctaaattcattctggttcggtgtgggagctcttatgcagcagggctccgagcttatgcctaaggcgttatccactcgcattgtcggcggaatctggtggttctttaccctgattattatttctagctataccgccaatctagccgcattcctgacagttgagaggatggaaagtccaatagactctgcagatgatctggccaaacaaaccaagatcgaatatggggctgttagagatgggagtacaatgaccttttttaagaaatcgaaaattagtacatacgaaaagatgtgggcttttatgtcgagcagacagcagaccgcgttagtgaggaatagcgatgaagggatccagcgagttctgactacagattacgcgcttctcatggagtccacgtccattgaatacgtcactcagcgcaattgtaacctaactcagattggcggactgatcgactctaaggggtatggtgtagggacccctattggctctccttacagggataagattacaattgcaattctgcagctgcaggaagaagggaagctgcacatgatgaaggagaagtggtggcgagggaacggctgcccagaggaggataacaaggaggccagcgccctgggcgttgagaacattgggggaatatttattgtgttggcagccggattggtgttgtctgtgttcgtggctatcggcgagttcatctacaaaagccgaaagaacaacgacattgagcagcattactag

SEQ ID NO: 224734 - DNA, 2718 bp, Artificial Sequence
  Description of Artificial Sequence: Synthetic coding sequence
atggagcacggaactctgttggcccagcccggtttgtggacccgagacacgtcctgggctttgctctacttcctttgctacatcttgcctcagaccgctccccaggtgcttcggattgggggtatttttgagaccgtcgaaaatgagcctgtgaacgtcgaggagttagcctttaagtttgcggttacgtccatcaatcggaacagaaccctcatgcctaacacaacacttacgtatgatattcagaggatcaaccttttcgattcgttcgaggcctctagacgagcttgcgaccaactggctctgggtgtagcagcgcttttcggaccttcccattcctcctcagtcagcgccgtgcagtccatctgtaatgccctggaagtgccacatatacagaccaggtggaagcatccaagcgtagataacaaggatctgttctatataaacctctacccggactacgctgccatcagtcgcgcaatattggacctggtgttgtattacaactggaagacagttaccgtggtctatgaagactctacgggcttgatccgtctgcaggaattaattaaggcccctagcagatacaatattaaaattaagatcaggcaactccccagtggtaacaaggatgcgaaaccacttctgaaggagatgaagaaaggtaaagagttttatgttatttttgactgtagtcatgaaactgctgccgaaatactgaaacagattctgttcatggggatgatgacagagtattatcattatttttttaccacactggatctgttcgccctggatctcgaactgtacaggtactctggcgtgaatatgacaggctttagactcctgaacatagataatccccacgtttcgagcataatagaaaagtggagcatggaacgcctgcaggctcccccacgtccagaaactggtctcctcgatggaatgatgaccacagaagccgcactcatgtatgacgcagtctacatggtggctatcgcctcacatcgagccagccagttaacggtatctagcctgcaatgtcataggcataaaccctggagactcgggccacggttcatgaacctgataaaagaggccaggtgggatgggctgaccgggcatatcacctttaacaagactaatggtctccgaaaggactttgatcttgatattatcagtttgaaagaagagggaacggagaaaatcggaatttggaattctaattcaggacttaacatgactgacagtaacaaagacaaatccagtaatattaccgattctcttgctaatcggaccctgatagtcacaacgattctggaggaaccttatgttatgtataggaagtccgacaaacccctatacgggaatgacaggttcgaaggatattgcctagatttactgaaggaactctcgaatattttgggctttatctacgatgtcaagctcgtgccagacggtaagtacggagcccagaacgataaaggggagtggaatggcatggtcaaggaactgatcgatcaccgagccgatctggctgtggcaccgttaaccattacttacgtgcgagaaaaagtcatcgatttctctaagcccttcatgacactgggcattagtatcctgtaccggaagcccaatggaacaaatccaggggtattctctttcctcaatcctttaagcccagatatctggatgtacgttctgctcgcttgtctgggcgtttcctgtgtactatttgtcatcgctaggttcaccccctacgaatggtacaacccacatccttgcaacccggatagtgatgtagtcgagaacaactttaccctcctcaacagtttttggttcggggtaggcgctttgatgcaacaaggaagcgaattaatgcccaaggcactatcaactcgaatagttgggggaatttggtggttttttacgttgatcattataagctcctataccgcaaacctggccgcttttttgaccgttgagcgtatggaaagtccaatagatagcgctgacgatctggctaagcagaccaaaatcgaatacggtgcggtgcgtgacggctcaacaatgacgtttttcaaaaagtccaagatttctacttatgagaaaatgtgggctttcatgtctagccgccagcagacggccctggtgaggaattccgacgaggggattcagagggtgctcacaaccgactacgcattgttgatggagagtacttcaatagagtatgtcactcaacgcaactgcaatctgacacagatcggcggtctgatcgattccaaaggctatggtgttggcacaccaatcggttccccctacagggacaaaataaccattgctatactacagttgcaggaggagggaaagctgcacatgatgaaagagaagtggtggcggggaaacggctgtccagaagaggataataaagaggccagcgctttaggcgtggaaaatataggaggtattttcatcgtcctagcggcaggcctggtgctctcggtgtttgtggccatcggtgagttcatctataagagcaggaaaaacaacgatatcgagcagtgtctctcttttaacgccataatggaggagcttgggatcagcctcaagaaccagaagaaaattaaaaaaaagtctcgtactaaaggcaagagctcatttaccagtatactgacgtgccaccagagaagaactcagcggaaagagactgtcgcatag

SEQ ID NO: 224735 - DNA, 2757 bp, Artificial Sequence
  Description of Artificial Sequence: Synthetic coding sequence
atggagcacggtacgctgctcgcccagccagggttgtggaccagggatacgagctgggccttgctgtactttttgtgttacatcctcccacagacagctcctcaggtgctgagaatcggcggaattttcgaaacagtagagaacgaacctgtcaacgtggaagagctggcatttaaatttgccgtgaccagcatcaaccgcaacaggaccctcatgcctaacacaacgctgacttatgacatacagaggattaatctgtttgacagcttcgaggctagccgcagagcctgtgatcagcttgccttgggagtcgccgcactgtttggcccttcacactcatcatcagtgtcggcggtccagtcgatctgtaatgccctggaggtcccccatattcaaacaagatggaagcacccgagcgtcgacaataaggacctgttttatatcaacctgtatccagactatgccgctatcagtcgcgctatactcgacttggtgctctactacaattggaaaaccgtcacagtagtctatgaggattctaccggcctcattaggctgcaggaactcattaaggctccttctcgatacaatattaaaataaagattagacaacttccttcgggcaataaggatgccaagcctttattgaaggagatgaagaaaggcaaagaattttacgtgatttttgactgcagccacgagacagccgctgagatcctgaaacaaatcctctttatgggcatgatgacagagtattatcactatttttttacaacgctagacctttttgccctggatctcgaactgtaccggtacagcggggttaatatgaccgggtttagacttttaaatattgataatcctcatgtgtctagcatcatcgagaagtggtcgatggagaggctgcaagcacctccccgtcccgagactggcctcctcgacggcatgatgacaacagaagcggcactgatgtacgatgcggtttacatggtcgcaatcgcttctcaccgtgcctctcaactcacagtttcctccttgcagtgtcatcgccacaaaccatggcgactggggcctagatttatgaatttaattaaggaagcccgatgggacggactaactggtcacattacattcaataaaactaatggtttgaggaaagacttcgatctggacattataagccttaaagaggagggcacagagaaagctgccggagaagtctctaagcacctgtataaagtttggaaaaaaataggaatttggaactcaaattcaggattgaatatgaccgattcaaacaaagacaagagctcaaacattactgactctctggctaatcgcacgttaatcgtgacaaccattctggaggaaccctacgtaatgtataggaagagcgacaagccactttatgggaatgaccggtttgaggggtactgtcttgacctcctgaaagaactgtctaacatcctgggttttatctacgacgttaagctcgttcccgacggcaagtacggcgcacagaatgacaagggagagtggaatggaatggtgaaggaattaatcgatcaccgggcagacttggccgtggccccactgacaatcacttacgtcagggaaaaagtcattgatttctctaagccgtttatgaccctggggatttccattctttacaggaagcccaacggcaccaaccccggtgtattttcttttctgaatccactgagtcccgacatctggatgtacgtgttgcttgcctgtctgggagtgtcttgtgtgctgttcgtaatagctcgattcacgccctacgagtggtataacccacacccttgcaacccagactctgatgttgtagagaacaacttcaccctgttaaattctttctggttcggcgtcggagctctcatgcagcagggctccgaactaatgccaaaagctttgagcactcgcattgtggggggtatttggtggttttttacacttatcatcatttcttcttacactgcaaatttagccgctttcctcaccgtagagaggatggaatcaccgatagacagtgctgatgatttggccaagcagactaagatcgagtacggcgctgtacgggacggaagcactatgactttcttcaaaaagtcgaaaatctcaacctatgaaaaaatgtgggcttttatgtcctcacggcaacagacagcccttgtgcggaatagcgacgaagggattcagcgggtccttaccactgattatgcactgctcatggaatcgacatccatcgaatacgtcacccaacgtaactgtaatctgacacagatcggaggtcttatcgacagcaagggttacggagtcggtacgccaattggctcaccctatagagacaaaattaccatagctatcctgcagcttcaggaggagggaaagctccacatgatgaaggaaaagtggtggagaggtaacggttgccctgaagaggacaataaggaggccagtgccctcggagtggaaaacattggcggaatctttatcgtattggcagcaggtctggtcctgtcggtgttcgtcgccattggcgagttcatctataaaagccggaagaataatgacattgagcaggcattctgtttcttttacggcttacagtgtaaacagacacatcccaccaactctaccagtgggacaactctctccaccgacctcgagtgcggaaaactgatcagagaggaaagagggattcgcaagcagagtagtgttcataccgtgtag

SEQ ID NO: 224736 - DNA, 2712 bp, Artificial Sequence
  Description of Artificial Sequence: Synthetic coding sequence
atggaacacggaactcttctggcccagcccggtctgtggacccgagatacttcctgggcgctcctgtacttcttgtgctacatcttacctcagactgcaccacaggtgttgcgcattggcggaatctttgagactgtcgaaaatgagcccgttaacgtagaggaactggccttcaagttcgctgttacgagcattaatagaaacagaaccctgatgccgaacaccaccctgacttatgatatccaacggatcaacctgttcgacagctttgaggcaagtcggagggcctgcgatcagctcgctctgggggtcgccgctctctttggaccctcacatagcagtagcgtgagcgccgtccagtcgatttgtaatgctcttgaagtgccccatatccagacacgctggaaacatcctagcgtggacaataaggaccttttctacatcaacctgtatcctgactacgctgccatttctcgggcaattctggacctggttctgtattataactggaagacagttaccgtggtttatgaagactccacgggcctgatcagactccaggagctcattaaggccccatcacgatacaatatcaaaattaaaatccggcaattgccatctgggaataaggatgcaaagccactcctgaaagagatgaaaaagggaaaggagttctacgtaatcttcgactgctcacacgagacagccgcagagatattgaaacaaatcctgttcatggggatgatgacagaatattatcattatttcttcaccacccttgatctgtttgcgttagaccttgagctttatcggtattcaggggtaaatatgactggattcagactgctcaatatcgacaatccacacgtgtcaagcatcattgagaagtggagcatggagcggcttcaagctccaccaaggcctgagacagggctcctggacggcatgatgaccacagaggcagccctcatgtatgacgctgtgtatatggtggcaattgcctcccatcgggcttcacagctcactgtgtcctctctccagtgccacagacacaaaccttggaggctcggcccaagatttatgaatctgatcaaggaagccagatgggacggactgaccgggcatatcacattcaataagactaacggcctgaggaaagacttcgatctggatattattagcctaaaagaggagggcacagagaaaatcggtatatggaactccaactccgggcttaatatgacagactcgaataaagacaagagttctaacatcactgattccctcgccaatcgcacactcattgttacaacgatcctggaggaaccctacgttatgtataggaagtctgacaaaccactgtatggaaacgaccggttcgagggctattgtcttgatctgctgaaggagctcagcaatatcctggggtttatatatgacgtgaagctggtacccgacggcaaatatggcgctcagaatgacaaaggggaatggaacggcatggtaaaggagctcattgatcatagggcagatctcgcagtcgctcccctcactatcacttatgtccgcgagaaggtcatcgactttagcaagccatttatgacattggggatatctatcttgtatagaaagcctaacggaaccaatcctggggtgttctcgtttctgaatcccttgtctccagacatctggatgtacgtgctgttggcctgccttggcgttagctgcgtccttttcgtgatcgcgagattcactccatacgaatggtacaacccacatccttgtaatccagactcagatgtggtagagaataattttactctactgaactctttttggtttggagttggcgcactcatgcaacaaggttcagagctgatgcctaaagccctctctacacgtatcgtgggcggaatatggtggttctttacactgatcattattagcagctatactgcgaacttagcggcatttctgacagtcgagagaatggagagtcccatcgactccgcagacgacttggctaagcagactaaaatcgaatacggcgcagtcagggacggcagcactatgaccttctttaagaaaagcaagatctcaacctatgaaaagatgtgggcatttatgagttctcgccaacagacagccctcgtcaggaatagcgacgaggggatccaacgtgtcttgactaccgattatgccctgctgatggaatctacctctatcgaatacgttacccaaaggaactgtaatctgacacagatcggcggtcttatcgactcgaagggctatggcgtcggtacgccgatcggctctccttaccgtgacaagatcaccatagcaatcctgcaactgcaggaggaaggcaagctccatatgatgaaggaaaagtggtggagaggtaacgggtgccctgaggaggataacaaagaggcgagtgcgctcggtgttgaaaacattgggggaattttcatagtgctcgccgctggcctggtgctgtccgtgtttgttgcaattggcgagtttatctacaagagtaggaagaacaatgatatcgaacaggcgttttgtttcttctacggattacaatgtaagcagacccaccccactaactccacatccggcacgacgctgtctactgatttggagtgcggcaagttgattagagaggaaagagggatacggaagcaatcgagcgtccacaccgtttag

SEQ ID NO: 224737 - DNA, 2763 bp, Artificial Sequence
  Description of Artificial Sequence: Synthetic coding sequence
atggaacacggcaccctcctcgcgcagcctggactctggacgcgcgacacatcatgggctttgctgtattttttgtgctatatcttgccgcagacagcacctcaggtccttaggatcgggggaattttcgagaccgtggaaaatgagcccgtaaacgtggaagagttagcctttaagtttgccgtcactagtataaaccgcaaccggactctgatgccgaatacaacccttacctacgatatccaaagaattaatctcttcgactctttcgaggcaagccggagggcttgtgatcagctagccctgggggttgccgcactgtttggaccctcacattcaagttctgtgtctgcagtacagagcatatgcaacgcactggaggttcctcatattcagaccagatggaaacaccctagtgtggataataaggacttgttctatattaatctatatcccgactatgcagcaatttctagagcaattctcgatttagtcctctactataactggaagaccgttactgtcgtctacgaggacagtactgggttgatacggctccaagaattgattaaagctccttcccggtacaacataaagataaagatccggcagcttcccagcgggaacaaggacgctaagccactcctaaaagaaatgaagaagggaaaggagttctacgttattttcgattgttcccacgaaacggcagcagagatcctgaaacaaatcctctttatgggaatgatgacagagtactaccactatttcttcactacactagacctgtttgctcttgatctcgagctttaccggtactcaggcgttaacatgacggggtttcgcctgttgaatatcgacaatcctcacgtcagctcaataatcgagaagtggtcgatggaaaggctccaggctccgccaagaccagaaacaggactactcgacggaatgatgaccaccgaggctgcactgatgtatgatgccgtctatatggtcgctattgcgtcccaccgtgcttcacaacttacagtgagctctctccaatgccatagacataagccttggagacttgggcctagattcatgaacttgatcaaggaagcaaggtgggacggactgactggacacattaccttcaacaagacaaacggactgcgcaaagattttgatctcgatatcattagtttgaaagaggaaggcaccgagaaggccgctggtgaggtgagcaagcatttgtataaagtctggaagaagatcgggatttggaactccaatagcggactaaacatgaccgatagtaataaggacaaaagctctaacataaccgacagcctggccaaccggaccttaattgtgacaacaatcctggaagaaccatacgtgatgtacaggaagagcgataagccattatacggaaatgaccgattcgaaggctactgtctggacttactaaaggaactctcgaacattctcgggttcatctacgacgtgaaactggtgcccgacggaaagtatggggctcagaacgacaagggcgagtggaatgggatggtgaaggagctcatagaccacagagctgatctggccgtcgcgcctctgacaattacctatgtgagagaaaaagtgatagatttttcaaagccttttatgactttgggcatctctattctgtataggaagccaaacggtacaaatcccggtgtgttttcgttcctgaaccctctttctccagatatctggatgtacgttctgttggcatgcctcggagtgtcctgcgtcctcttcgtcatcgctcgttttaccccttatgagtggtacaacccacacccatgtaaccctgattccgacgtagttgagaataacttcaccctgctgaactccttttggttcggagttggggctttgatgcagcagggcagtgagctcatgccaaaagctctaagcaccagaatagttggaggaatctggtggtttttcacattaataatcatcagttcctatactgcaaacctggctgcttttctgactgtcgagaggatggaaagcccgatcgactctgcggacgatctggcgaaacagacaaaaatagagtacggagccgtgcgcgacggctcaaccatgaccttctttaagaaatcaaagattagcacctatgagaaaatgtgggcttttatgtcctcccggcagcagaccgctctggtaagaaattccgatgaaggaattcagagggtgcttacaacagactatgcccttctgatggagagtacaagcattgagtacgtcactcaaaggaattgtaacttgacccagatagggggtctgatcgactcaaaggggtacggggttgggaccccgattgggtccccatacagagacaaaatcactatcgccatcctgcagctacaggaagagggaaagttacacatgatgaaggagaaatggtggcgtgggaatgggtgccccgaagaggacaacaaggaggcatccgccctgggcgttgagaacatcggcggaatatttatcgtccttgcggcagggctagtcctgtctgtgttcgtggctataggggagttcatttacaaatcccgaaaaaacaacgacatcgaacaatgtttgagctttaacgctattatggaggaacttggtatctctctcaaaaaccagaagaaaattaagaagaaatcacgcaccaagggaaaatcatcttttacaagcatactgacatgccaccagagacgaactcagaggaaggaaaccgtggcatag

SEQ ID NO: 224738 - DNA, 2805 bp, Artificial Sequence
  Description of Artificial Sequence: Synthetic coding sequence
atggagcatgggactctgcttgcccagcctgggttgtggacaagggacacctcctgggccttgctctatttcttgtgttacattttgccacaaacagccccacaggttctccggatcggaggtatttttgaaacagttgagaatgagccagttaatgtcgaggagctcgcgtttaaattcgcagtcacatctatcaaccgcaacagaaccctcatgcccaataccacgttaacttacgacatccagcgcatcaacttgtttgattcatttgaggccagccggagagcatgtgatcagctcgccttgggagtcgccgctttatttggtccctcacatagctcgagcgtcagcgcagtgcaatctatttgtaatgccctcgaagtacctcacattcagacacggtggaagcacccaagcgtagataataaggacctattctacatcaacctttatcccgattacgccgctatttcgcgagcaattctggacctagtcctatactacaactggaaaacagtgaccgtggtgtacgaggactctaccggcttgattaggcttcaggagttgattaaagccccaagtcgctacaacattaaaattaagatcaggcagctcccttctggtaataaagacgccaaaccacttctcaaagagatgaagaaaggcaaggagttttatgttatctttgactgctctcacgagactgccgcagagatactgaagcagatactattcatggggatgatgacagaatactaccactatttttttacaacgcttgacttgtttgcgcttgaccttgagctgtacagatacagcggtgtcaatatgacaggcttccgcctgctgaacattgacaacccccacgtctctagcattattgaaaaatggtcaatggagagacttcaagctccccctcgcccagaaactgggttacttgatggtatgatgacaactgaagccgctttaatgtatgatgctgtatatatggtggccattgcatcccacagagccagtcagctgactgtgtctagtctccagtgccaccgccacaagccttggaggctgggcccaaggttcatgaatcttatcaaggaggcgaggtgggacggactgactggtcatatcacctttaataaaactaacggattgcggaaagatttcgacctggatattatcagtctgaaagaggagggcaccgaaaagattggcatctggaattctaactctggactcaacatgacagacagcaataaagacaagagcagcaacattaccgactccctggcgaatcgtacactcatcgttacgacgatactggaggagccgtacgtgatgtaccgaaagagtgacaagccattgtacgggaacgatcgattcgagggctattgcttagacttgctcaaggagctttccaacattctgggttttatctatgatgtaaagttagtgccagatggcaagtatggagcccagaatgacaaaggagagtggaatggtatggtaaaagagttgatcgaccatagggctgacctagctgtcgcccctctcaccatcacttacgtcagggagaaagtcattgactttagtaaacctttcatgacgttaggaatcagcatcctgtaccgaaagccgaatgggacgaaccccggtgttttttctttcctgaacccgctaagcccagatatctggatgtacgttcttctggcctgtctgggcgtaagctgtgttctcttcgtgatcgctcggtttaccccctacgagtggtataacccccacccctgtaatcccgactctgatgtggtggagaacaatttcaccctattaaactctttttggttcggggtgggcgctctgatgcagcaaggatctgagcttatgcctaaggctctgagcacccgaattgtgggagggatttggtggtttttcacgctcattatcatatcttcatacaccgccaacttggcagccttcctgaccgtggaaaggatggagtctccaatcgacagcgcagatgatttagctaagcagactaagattgagtatggcgcagtgagggatggatctacaatgacttttttcaagaagagcaaaatctctacctatgagaagatgtgggcttttatgtcaagccgacagcaaaccgcgctcgttaggaatagtgacgagggaatccaaagagtcctcacaactgattacgccctgctcatggagtcgacctcaattgagtacgtcacccaacgaaactgtaacttaacccagataggagggctgatcgattccaagggctacggagtcggaactcccattggcagcccgtatagggacaagattacgattgcaattctgcaactccaggaagagggaaaactccacatgatgaaggagaagtggtggagggggaatgggtgtcctgaggaagacaacaaggaggctagcgcattgggcgtcgaaaacataggaggtatatttattgttctggctgcagggctcgtgctgagcgtctttgtggcaataggcgagtttatatacaagagcagaaagaataatgatatcgagcagaaaggcaaatcctcccggatcagattctactttcgtaataaggtgcgctttcatggaaggaagaaacaatccctaggtgtggagaaatgcctcagcttcaatgctatcatggaagaactaggaatctccctgaagaatcagaagaagatcaaaaaaaagagccggacaaagggtaagtcctcttttacttcaatactcacttgtcaccagcgaaggacacagcgcaaggaaactgtggcttag

SEQ ID NO: 224739 - DNA, 2769 bp, Artificial Sequence
  Description of Artificial Sequence: Synthetic coding sequence
atggaacacggcacgttgcttgcccagccaggtctgtggactcgggacacatcctgggccctgctctatttcctctgttacattcttccccagacggctccacaagtcctcaggatcggcggaattttcgagacggttgaaaatgaaccagttaacgtagaggagttggctttcaagtttgcggtgacaagcattaaccgcaatcggactctcatgccaaataccactcttacatatgatatccaacggatcaacctattcgattcttttgaagcctccaggagggcctgcgatcaattggccctgggagtggctgccctctttggacctagccatagtagtagtgttagcgcggtgcaatccatctgcaatgcactggaggtgccacacattcaaaccaggtggaagcacccatccgtagacaacaaggaccttttttacattaacctgtacccagattacgccgctatatcacgggctatattggatctcgtgctatactacaattggaaaacagtcaccgtggtatatgaggattcaaccggactcataagattgcaagaattgattaaagctccatcccgctacaatatcaaaattaaaataagacagctgccctccggtaacaaggacgccaagccactgctgaaggagatgaagaagggaaaggagttctatgttatcttcgactgtagccatgagacagctgccgaaatcctaaagcaaatcctctttatgggcatgatgaccgagtactaccattacttcttcacaacgttagacctcttcgcgctcgacctggaactttatagatatagtggggtcaatatgaccggcttcaggctccttaatatcgacaaccctcatgtctcatcaatcatagagaagtggagtatggaacggctgcaggcaccccctaggcctgagactggccttctggatgggatgatgacaaccgaggccgctctcatgtacgatgccgtgtacatggtggctatcgcttcccaccgagcctcccagctaactgttagtagtctccagtgccaccggcataaaccttggcgtctgggacctagattcatgaacttaatcaaggaagctacggccaggtgggacggcttgaccgggcacattacattcaacaagactaatggactgcgcaaagattttgatctcgatataattagcctgaaggaggaaggaacagagaaggcggcaggcgaggtctccaagcatttgtataaggtgtggaagaaaatcggtatatggaatagcaatagcgggctcaacatgacggacagcaacaaagacaaaagttccaacattacagattcactcgccaaccgcacactaatcgttacgactatcctagaggagccatacgtgatgtatcggaaatcagacaagcctttgtatggtaacgacagatttgaaggctactgcttggacctactgaaggaactgtcaaatattctcggttttatatacgatgtaaaattagttcccgacggcaagtatggtgctcagaacgacaagggcgagtggaatgggatggtcaaggagctcattgaccacagagctgacctggctgtggcccctttgacgatcacctatgtgagagagaaagtaatagactttagcaagccatttatgaccctcggcatctctatcctgtaccgcaaacctaatgggaccaaccctggtgtcttcagtttcctcaacccactttccccggatatatggatgtatgtgttattggcctgcctgggggtgagttgcgttctatttgtaattgctcggttcacaccatacgaatggtacaacccccacccttgtaaccctgatagcgacgtggtggagaataactttaccctgcttaattcattttggttcggtgtgggcgctctcatgcaacaaggctccgagcttatgcctaaggccctatctacgcgaatagtgggcggaatctggtggttcttcacgctcataataatttcgagctataccgccaacttagcagccttcttgactgtagagcgtatggagagtccaatcgacagcgctgatgaccttgccaagcagaccaaaatcgagtatggagccgtcagggacggcagcactatgacgttctttaagaaatcaaagatctccacgtatgaaaagatgtgggcctttatgagcagtcgccaacagacagcgctggtgcggaactcagacgaggggatccaaagagtacttacgactgattacgccttgctcatggagtccacttctatcgagtatgtcacacagaggaattgtaatctaacccagatcgggggactgatagactcaaagggctatggggtgggaacacctatcggctcaccttacagggacaaaattaccatcgccattctccagctgcaagaggaaggaaagctccacatgatgaaggagaaatggtggcggggtaatgggtgccccgaagaagataacaaggaagcctctgctttaggcgttgagaacatcggaggcatcttcattgtcctggcagccggattggtcttgagtgttttcgtggccatcggggagtttatttacaaatcccgcaaaaataacgatattgagcagtgcctgtcatttaacgccataatggaagagctggggatcagcttgaagaaccagaaaaaaataaaaaagaaaagtcggacaaaggggaagtcctcttttacatccatcctgacctgtcaccagcgcaggacccagcgcaaagaaacggtggcatag

SEQ ID NO: 224740 - DNA, 2247 bp, Artificial Sequence
  Description of Artificial Sequence: Synthetic coding sequence
atggagcacggtactctgctggctcaacccggtctgtggacgcgtgacaccagctgggccctgctctacttcttgtgttacatactgccccaaactgcgccacaggtgctgcgcatcgcttgtgaccagctggctctgggagtagcagcacttttcggcccttctcacagcagctctgtgtctgcggttcagagtatttgcaatgccctcgaggtgccacacattcagaccaggtggaagcatccttctgttgacaacaaggacttgttctatataaacctgtatcctgattacgcagccatctctagggctatcctggacctggtattgtattacaattggaagacagtgaccgttgtgtacgaggactccacaggtctgatcaggttgcaggaacttattaaggcgccatctagatacaacattaaaataaaaatacgccagctcccttctgggaataaagacgcgaagccactactgaaggaaatgaaaaaaggcaaagaattctacgtcatcttcgactgctctcacgagacagccgctgagatcctcaaacagattctattcatgggtatgatgacggagtactaccattacttctttacaactctggatttattcgcccttgatctagagctgtaccggtattccggcgtaaacatgacggggttccgactgctgaatatcgacaatccccacgtgagttctatcatcgaaaagtggagtatggaaagactgcaggcacctccgagaccggaaaccggattactggacggtatgatgactaccgaggccgctctgatgtacgatgcggtgtacatggtagcaattgcctcccacagggcaagccagcttaccgtttcatctcttcagtgtcaccgacataaaccatggcggctgggcccacggtttatgaaccttatcaaggaggccagatgggacggactgacagggcacattacctttaataagaccaacgggcttcgaaaagactttgatctagatataattagccttaaagaagaaggaactgaaaagattggaatctggaactcgaactccgggctcaacatgacagacagcaataaagataagagctctaatattactgatagcctcgctaatcgcacccttattgtgaccacaatcctgcgggcagatcttgcagttgctcccctgaccattacctatgttagagagaaggtaattgacttctcaaagcccttcatgaccctcgggatcagcattctgtatagaaagccgaatgggactaatcctggcgtcttctcatttctgaacccactatcacctgacatctggatgtatgttctgttggcctgtctgggcgtgtcttgcgtgctgttcgtcatcgccaggttcaccccatatgaatggtataacccacacccctgcaacccagacagtgatgtggtggaaaacaacttcactttgctgaacagtttttggttcggagtcggagcactgatgcagcaggggtccgaactcatgccaaaggctctgagcacgagaatagtggggggaatatggtggttttttaccctgataattatctcgtcatacacggcaaaccttgctgccttcctcaccgtcgaaaggatggaaagcccaattgatagcgcagatgacctggccaagcagaccaagatcgaatatggcgctgtgcgcgatggaagtactatgacgttctttaagaaatctaaaatctccacatatgagaaaatgtgggccttcatgagttctcgccagcaaacagccttggtccgcaattcggacgagggtattcagcgcgtactcacaactgactacgccctgctcatggagagtactagcattgagtacgtgacacagagaaactgtaacctgacccagattgggggactgattgatagtaaaggctatggcgtggggactccgatagggtccccctatagggacaagatcactattgcaattcttcaactacaggaagagggcaaattgcacatgatgaaggagaagtggtggcggggtaatgggtgccccgaagaggacaacaaggaagcatccgccctcggcgtggagaacatcggcggaatattcatagtactggcagcaggtctcgtgctgtctgtattcgttgctatcggggagtttatctacaaaagtaggaagaacaacgacatagaacagtgtctgagctttaacgcaatcatggaagaactcggaatttcgctgaagaatcaatag

SEQ ID NO: 224741 - DNA, 2610 bp, Artificial Sequence
  Description of Artificial Sequence: Synthetic coding sequence
atgaaaatcatttttcccatcctaagtaacccagtcttccgtcgaaccgttaaactgctcctctgcctcctctggataggttattcacaaggcacgacccacgtcttaaggtttggcggaattttcgagtatgttgaaagcggaccgatgggcgctgaagagttggcgttccgctttgcagtgaatacgattaacaggaaccggacgctgctgccgaacaccactctaacttatgatacccagaagatcaatctctacgactcgtttgaagcctcaaagaaggcgtgcgatcaactgtcactgggggtggccgcaattttcggcccaagtcactcctcaagcgctaatgccgtgcagagcatctgcaacgctctgggagtaccccatatccagacaaggtggaaacaccaagtgagtgacaataaggatagtttctatgtaagtctctaccctgactttagcagcctgtcccgcgcaatactggatctcgttcaattcttcaagtggaagactgtgacagtggtgtatgacgattcgaccgggctcatcaggcttcaggagctgatcaaggcaccatctcgatataacctgagattgaagatccgacaactgcccgctgataccaaggacgcaaagccactgctgaaagaaatgaaaaggggtaaagagtttcacgtgatcttcgactgttcccatgagatggctgcagggattttgaagcaagccttagcaatgggtatgatgacagagtattatcactacatattcacaactctggaccttttcgctcttgacgtggagccatatagatattccggggtcaatatgactggattcagaatcctcaacaccgagaacacacaggtcagcagtataatagagaagtggtcgatggagagactgcaagccccacctaagccagattcgggtcttctcgatgggttcatgaccaccgatgccgctttgatgtatgatgccgtccacgtggtgagcgtggcagtgcagcagttccctcagatgacagtctcctctctgcagtgtaatcgtcacaagccctggcgtttcggtacccggttcatgtcgctcataaaggaagctcactgggaaggcctaacagggaggattacatttaataagactaacgggctcagaacggattttgatttggacgtgatcagcctaaaggaagaaggccttgagaagattgggacgtgggatcccgcatccggcttgaacatgaccgagtcccaaaagggtaagcccgctaatataacggatagcctgtctaaccgaagcctgattgtgacgacaatcctggaagaaccttatgtactttttaagaagagtgacaagcctctgtatggaaacgacaggtttgaggggtactgcattgatcttttaagggagctctccactattttaggttttacatacgagatccgcttggtcgaggacggtaagtatggcgcacaggacgacgccaatggccagtggaatggcatggtgagggaactaattgatcacaaagcagacctcgccgttgccccattggcaatcacatacgtgcgcgagaaggtgatcgatttctccaaacccttcatgactttgggcataagcattttgtacagaaaacctaatggcacaaatccaggtgtgttcagttttcttaaccccctatctccagatatctggatgtatattctgttagcttacctgggggtctcctgtgtgctattcgtgatcgcacgtttctcaccctacgagtggtataatcctcacccttgcaatcccgatagcgacgtagtggaaaacaacttcacactgttgaatagtttctggttcggcgtgggggcactaatgcagcagggttctgagctgatgcccaaggcactttcaaccaggatagtcgggggtatctggtggttcttcaccttgatcataatttcttcctacactgccaatctggcagcttttctgactgtggaaaggatggagtcacccattgattccgcagatgatttggcaaaacaaaccaagattgaatatggtgccgtcgaggatggggctacaatgacattttttaagaagtctaagatctccacatatgataagatgtgggccttcatgagtagtcgtaggcagtctgtcttggtaaagagcaacgaggagggaattcagagggtcctgacatctgattacgcatttctcatggagtcaacaactattgaattcgtcacccagcgaaattgtaacctgacacaaattggcggactcatagattctaagggctacggcgtcggcacacccatgggatctccctaccgagacaaaattaccattgcgattttgcaattacaggaagagggtaaactgcacatgatgaaggagaagtggtggcgcggtaacggatgcccggaggaagagtcaaaagaggcctctgcattgggcgtacagaatatcggcggaattttcatcgtactggccgcagggttggtcctgagcgtgtttgtcgctgtcggtgagttcctgtataagagcaagaaaaacgcccaactggagaaggagagctctatctggctggtcccgccataccatccagatactgtttag

SEQ ID NO: 224742 - DNA, 2580 bp, Artificial Sequence
  Description of Artificial Sequence: Synthetic coding sequence
atgggagcggaggagttagcatttcggttcgctgtgaatactattaacaggaatagaactctgctgccgaatacgaccctgacatacgacacacagaagatcaacctctacgactctttcgaggccagtaaaaaggcttgcgatcagctctcactgggagtcgctgcaatttttgggccttctcactcttcctccgccaatgccgtgcagagtatctgcaacgcactcggggtaccccacatccagactaggtggaaacaccaggtgtccgataataaggacagtttctatgtttccctctacccagatttcagctccctgagccgtgccattctggaccttgtgcagttctttaaatggaagacagttactgtcgtatatgatgactcaacaggcctgattagacttcaggagctgattaaggcccctagcaggtacaacttgaggctgaaaatcaggcaattaccagctgatacaaaagatgccaagccacttctgaaagagatgaagcgaggcaaagagttccatgtgatctttgattgtagccacgagatggctgctgggattttgaagcaggccctggccatgggcatgatgaccgagtattatcattacatctttacaacacttgatctattcgctcttgatgttgaaccttacaggtactcaggcgtgaacatgacaggcttccgcatcttgaataccgagaatacccaggtatccagtattatagaaaagtggtccatggagcgactgcaggcaccacccaagccagattccggcctgctcgatggcttcatgacgacagacgctgcactcatgtacgatgccgttcacgtcgtgagcgtggcagtgcagcaattcccacagatgaccgtgtccagccttcagtgtaacaggcacaagccttggcgatttggcacccgctttatgagccttatcaaggaggcccattgggagggtctcaccggacgtatcaccttcaacaaaacgaatggactgcggactgacttcgatttagatgtcataagcctaaaagaggagggactggagaagattggcacttgggaccctgcgagtggcttgaacatgaccgaaagccagaagggaaagccagcaaatattactgactccctgagtaaccggagtctgatcgtgactaccatactcgaagaaccctacgttttgtttaagaaatccgacaaaccactctacggaaacgacagattcgagggatactgtatagaccttctgagggagctgagcaccatattgggtttcacgtatgagatcagattggtggaagacggtaagtacggtgcccaagatgacgcaaacgggcagtggaatggcatggttcgggagctgatcgaccacaaagccgatctagccgtagcccctcttgctatcacgtacgtcagagagaaggtcattgacttctctaagccctttatgacgctcggcatctctatcctgtaccgcaagccgaacggcaccaacccaggagttttttcatttctgaatccactgtccccggacatctggatgtatatcctgctcgcttatctcggcgtgagctgtgttctgttcgtgatagcccgatttagcccctacgagtggtacaatccccatccatgtaacccagacagcgacgtcgtggagaataattttacactgctgaacagcttttggtttggcgtaggcgctctgatgcagcaagggagtgaattaatgccgaaagcacttagcacccgcattgtgggagggatttggtggttcttcaccctgattatcattagcagctacactgccaacttggctgctttcctgacagtagaacggatggagtctcccatcgactctgcagacgacctcgccaaacaaaccaaaatcgaatacggggctgtcgaagatggggcaacaatgaccttttttaagaagagcaagatcagcacatatgacaaaatgtgggccttcatgtccagccgtcggcagtcagtgctcgtgaagagcaacgaagagggcatacagagggtgctaaccagtgattacgccttcctgatggagagcaccactatcgagtttgttacacagcgcaattgcaacttgacgcaaatcggaggcctgatcgattctaaagggtatggggtcgggacacccatgggctcaccttatcgcgataagatcaccatcgccattcttcagctgcaggaagaggggaagctgcacatgatgaaggaaaaatggtggaggggaaacggatgccctgaggaagagtcaaaggaggcctccgccttgggagtgcagaatatcggagggatcttcattgttttggccgcaggactggtcctgagtgtatttgtggcggtcggagagttcctttacaagtccaaaaagaacgcccaactggaaaaaagatccttttgttcggcaatggtagaagagctgcgaatgagcctaaagtgtcagcgtaggctaaagcacaagccacaggccccagtgatcgttaaaacagaggaggtgatcaatatgcacacattcaacgaccggaggttacccggtaaagagacaatggcctag

SEQ ID NO: 224743 - DNA, 2499 bp, Artificial Sequence
  Description of Artificial Sequence: Synthetic coding sequence
atgaagatcatattccccatcctgtctaatccagttttcagacgcactgtgaaactcctgctatgcctcctgtggatcggatattcccagggtaccactcatgtgctgcgattcggaggaatctttgaatacgtggaaagcgggccaatgggtgcggaggaactggcgttcagatttgctgtgaacaccatcaaccgtaaccggactctcctacctaatacaacccttacttacgacacgcagaagattaatctgtacgactcatttgaggcctcgaagaaggcgtgtgaccagctgtctctgggtgtggccgctatctttggtccctcacactcctcttctgccaacgctgttcagtccatatgcaacgcactgggggtgccgcatattcaaactaggtggaagcaccaggtttcagataacaaggatagcttctacgtatcactttacccagacttttcgtctttatcccgggctattttggatctcgtgcagtttttcaaatggaagacagtaacggtggtttacgacgactccacaggtcttattaggttgcaggagctgatcaaggccccttcgcgctacaatctcaggctcaaaatacggcaattgcccgcagatacaaaggacgcaaagcctctactaaaggaaatgaagcgcggtaaggaattccacgtgatcttcgattgctcacacgaaatggccgcaggaatactgaagcaagctctcgccatgggcatgatgaccgaatactaccattacatcttcacaaccctcgatctctttgccctggatgtggagccataccggtatagcggggtgaatatgactggtttcagaatactcaataccgagaacacacaggtgagttcaataattgaaaagtggtcaatggaaaggctgcaggcacccccaaaacctgactccggtctgttagacggattcatgactacagacgctgctctgatgtacgacgcagtacacgtggtgagcgttgcagtacagcagtttcctcagatgacagtgagcagcctgcagtgtaaccggcataagccttggcgttttggcacaaggttcatgagcctcataaaggaggcacactgggagggtctgactgggagaatcacgttcaataaaactaatgggctgaggaccgacttcgatctcgacgtgatctcgctcaaagaggagggcctcgagaagatcgggacctgggatcctgcttctggcttgaatatgacagagtcccaaaagggaaaacctgccaatatcacagattctctgtccaataggagcctgattgtcacgaccattctcgaagaaccgtatgttttatttaaaaaaagtgacaaacccctgtacggcaacgacaggttcgaagggtattgcattgacttactaagggagttgtccaccatcctgggcttcacttatgagatccggcttgtggaggacggcaagtacggcgcacaggatgacgctaacggtcagtggaacgggatggtgagagagctgatagatcacaaggccgacctcgccgtcgcccctttggctatcacatacgtacgtgagaaggtgattgacttcagtaagcctttcatgactcttgggattagcattttgtacaggaagcctaatggtagtgaacttatgcctaaggccctgtctacccggattgtgggtgggatttggtggtttttcactttaatcatcatatccagctacacggccaatctggctgcatttctgactgtggagaggatggagtctcctatcgatagtgccgatgatctcgccaagcagaccaagattgagtacggagctgtggaagacggggctacgatgacgttcttcaagaaatctaaaatttcaacatatgataagatgtgggccttcatgtcaagtagaaggcagtctgtattggtaaagtcaaatgaagaaggaatccaacgcgtcttaacttcagattacgctttcctgatggaatctacaactatcgagtttgtgacccagcgtaattgcaaccttacccaaatcggaggtcttatagactccaaggggtatggagtagggacaccaatgggcagtccttacagagataaaatcactatcgctattttgcagctgcaggaggaagggaagctccacatgatgaaagagaagtggtggcggggtaatgggtgcccagaggaggaaagcaaggaggcttcggccctcggcgtacaaaatattggtggtatctttatagttttggcagcaggccttgtgctgagcgtctttgtggccgttggcgaatttctctataaaagtaagaaaaacgctcagctggagaagcggtccttctgctccgccatggttgaggaactgcgaatgagtctaaaatgccaacgccgattaaaacacaagccgcaggcccctgtaatcgttaagactgaggaagtcatcaatatgcatacatttaacgatcgcaggcttcccggaaaggagacgatggcctag

SEQ ID NO: 224744 - DNA, 2679 bp, Artificial Sequence
  Description of Artificial Sequence: Synthetic coding sequence
atgaaaataatattccctattttgtccaaccctgtgtttaggcgcacagttaaactgcttctttgtctgctttggatcgggtacagccagggtacaacccacgtgttgcgattcgggggtatctttgagtatgtggagtcgggcccaatgggtgccgaggagctggcttttcgatttgccgtgaacacaattaaccggaatagaaccctcctcccaaacacaaccctcacatacgatactcagaagattaatctgtacgattcttttgaggcctccaagaaagcctgcgaccagctttccctgggcgtggcagccatattcggcccttcgcacagcagctccgctaatgccgtacaaagcatttgtaacgctcttggggtgccgcacatccagacacgctggaagcatcaggtttctgataacaaggactccttctatgttagtctctatcctgatttttctagcctctcacgtgctatcttagacctggttcagttttttaaatggaagacggtgacagtcgtctatgacgactccaccggcctcatacggcttcaagagttgataaaggccccttcaagatacaatctacggctgaagatccgacagctacctgcagacacgaaggatgccaagcccctgttaaaggaaatgaaaagaggtaaagagttccatgttatttttgattgtagccacgagatggccgcaggtattctgaagcaggccctcgccatgggcatgatgaccgaatactatcattacatctttacaacactggacctattcgccctcgatgtcgaaccctataggtacagtggtgtgaacatgacaggttttagaattttaaacacagagaacacccaagttagcagcattatcgaaaaatggtcgatggaacggttgcaggcgcctccaaagccagatagcggtctccttgacggctttatgacgaccgacgctgccctgatgtacgatgcagtgcacgtcgtaagcgtcgcagtccagcaattccctcagatgacagtgtcctctttgcagtgtaatagacataagccctggagatttggaacgcgtttcatgtccctaattaaagaggctcattgggaaggtctcaccggccgtattacctttaataaaacaaacggtctgcgcactgactttgatttggacgtgatttccctcaaggaggagggcctggagaagattggaacctgggaccccgcaagcgggctaaacatgaccgaatcacagaaaggtaaacccgctaatatcacagattcgctgtctaacaggagcctcatcgtaaccactatcctggaagaaccctacgttcttttcaaaaaaagcgacaaacctttatacggcaatgataggtttgagggctactgcatcgacctactccgggaattgagtaccattttgggttttacctacgaaatccggctggtggaggatggcaagtacggcgcacaggatgacgcgaacggacagtggaatggtatggtgagagaactcattgaccacaaggcggacctggctgtggcaccacttgccatcacctacgttagggagaaagtcatagacttctctaaaccctttatgactctggggatttccattctctacagaaagcccaacggaacgaatccaggcgtcttctcatttctgaatcccctgtctcctgatatttggatgtatatcctgttggcttacttaggggtaagctgtgtgctattcgtgattgccagatttagtccctatgagtggtataaccctcacccatgtaacccagacagtgatgttgttgaaaataacttcacattactgaatagcttctggtttggtgtgggcgcactcatgcaacaagggagtgaacttatgccaaaagccctttccacacggatagtgggcggaatctggtggtttttcacattaatcatcatttccagctacactgccaacctggccgcattccttaccgtcgagaggatggaatcgcctatagacagcgctgacgacctcgctaagcagacgaagatcgaatatggtgccgttgaggatggagccacgatgaccttcttcaaaaagagcaaaatctctacttacgataaaatgtgggcatttatgtcctcccggagacagagcgtcctggtgaaatcaaacgaggagggaattcaaagggtgctgacttccgattacgcattcttgatggagtcaacgactattgagttcgttacccaaagaaactgtaatctaacacagattggaggattgatagattctaaaggatatggggtgggtacacccatggggagtccatatcgggataagattactattgccattctgcagttacaagaggaaggcaaattacatatgatgaaagaaaaatggtggcgcggaaatggctgccctgaggaggaaagcaaggaggcgagtgcactcggcgtacagaacattggaggcattttcatcgtactggccgctggactcgtattgtcggtcttcgttgccgtgggggaatttctgtacaagtccaaaaagaatgcacagctagaaaagcgagcgaaaactaagctgcctcaagactatgtctttctgcccatcctggaaagtgtgtcaatctcaaccgttttaagctcatctcccagttcgagcagcctgtcatcatgctcctag

SEQ ID NO: 224745 - DNA, 1755 bp, Artificial Sequence
  Description of Artificial Sequence: Synthetic coding sequence
atgaagataatctttccgattctgtcaaaccccgtttttcgtcgtaccgtgaagctactgctgtgtctgctgtggataggctacagccagggaacaactcatgtgctacgattcggaggcatcttcgaatacgtggaatccggtcccatgggggcagaggaactggcgttccggtttgctgtcaataccattaaccgtaaccgtaccttgctccctaacacaactcttacgtacgacacccaaaagatcaatctgtacgattcattcgaagcctccaagaaggcctgtgaccaactatcccttggggtggccgcaatctttggccctagccattccagttccgcaaacgccgttcaaagtatctgcaacgctcttggcgttccccacattcaaacccggtggaagcaccaagtaagcgacaacaaagactccttttacgtctccctgtacccggatttcagcagcctctcgcgggcaatcctcgatttggtacaattcttcaaatggaagacagtgactgtcgtttacgatgactccaccgggctcatacgattacaggaattaatcaaagccccaagtagatacaatcttcgcctcaaaattcgccaattgccagcagacacaaaggatgctaagcccctgctgaaggaaatgaagcggggtaaagaatttcatgtgatcttcgattgcagccatgagatggctgcaggtattctcaaacaggccttagccatgggaatgatgaccgagtactaccactacattttcactaccttagatttgttcgccctggacgtcgagccgtatcggtactcaggtgtgaacatgacaggtttccggattctgaacactgagaacacacaggtatcttctattatcgagaagtggagcatggaaaggctgcaagccccacctaaacctgattccggcctgctggatggattcatgacaaccgatgccgcactcatgtacgacgctgtgcatgtggtgtccgtggccgtccaacagtttccccagatgactgtcagctcccttcagtgcaaccgtcacaaaccctggaggttcggtaccagattcatgagcctcataaaggaggcgcactgggaaggcttgaccggcagaataactttcaacaagactaacggcctccggacagacttcgacttggatgtcatctcgctgaaggaagaggggctcgaaaaaattggtacgtgggaccctgcatccggacttaatatgactgagtcacagaaggggaaacctgccaacattacagattcactgtctaaccggagcttgatcgtaaccaccatccttgaggagccttacgtgctgttcaaaaaaagcgacaagcccctgtacggcaatgaccgctttgagggctattgcatcgatctgttaagggagctcagcaccattctcggcttcacctatgagatcagactcgtggaggacgggaagtatggggctcaagacgatgcaaacggccagtggaatggaatggtgagggagttaattgatcacaaggctgaccttgccgtcgcacctctggctatcacatatgtgcgagaaaaagtcatagacttctcaaaaccctttatgactctaggaatttcaattttatacagaaagcctaatggaacaaaccctggagtgtttagctttctgaacccactctcacctgatatctggatgtatatccttctcgcctacctgggtgtttcctgtgtgttattcgtgatcgcgaggttctag

SEQ ID NO: 224746 - DNA, 2610 bp, Artificial Sequence
  Description of Artificial Sequence: Synthetic coding sequence
atgaagattatatttcccatcctctccaaccctgtgttcaggcggactgttaaactcctgctgtgccttctatggataggatattcccaaggcacgacgcacgtgctgcgctttggtggaatattcgaatatgtggaaagcgggcctatgggggctgaagaactggcatttagattcgcagtcaatacgattaatcggaatagaaccctactgcctaacacaaccctcacgtacgatacacagaagatcaacctctacgatagtttcgaggcttcaaaaaaggcatgtgaccagttgtcattaggagttgccgcaatattcggcccttctcatagcagcagcgcaaacgcggtacaatctatctgtaatgctttgggcgtgccacacatccaaaccagatggaaacaccaggtatccgataacaaagattccttctatgttagcttgtacccagacttctcttctctgtccagggcgatactggatctggtccagttttttaagtggaagacagtcacagtcgtgtatgatgattcgaccggactgataagactgcaggagttaattaaagcaccctctcggtacaatctccgcctgaagatcaggcagctaccagcggatacaaaggatgctaagcctttgttaaaggaaatgaaacgtggcaaagagttccacgttattttcgattgtagccacgaaatggccgctgggattctgaaacaagctttagctatgggtatgatgacagagtattaccactacatattcaccactctcgacctcttcgctctcgacgttgagccctacagatacagcggtgttaatatgacagggtttaggatcctgaacacagaaaatacccaggtgtccagcataatagaaaagtggtccatggaaaggctacaggcaccaccgaagcctgattcagggctgctggatgggtttatgactactgatgctgcactgatgtacgatgctgtgcacgttgtcagcgtagctgtacagcagttcccccagatgacggtgtcctccctgcaatgtaaccgtcacaaaccctggagatttggaactcgttttatgtctctgatcaaagaggcacactgggaaggtctgaccggaagaatcacctttaataagacaaacggcctgcggacggattttgatctggatgtgatttcccttaaagaggagggactggagaaaatcggaacatgggaccccgcatccggtctgaacatgactgaatcccaaaaggggaagcctgcaaacataaccgacagcttgtccaataggtcactcatcgttaccactattttagaagaaccatatgtcctgttcaaaaagtccgataagccactatacggcaatgaccgcttcgagggatactgcatagatctgcttagggagctcagcacaatcctgggctttacttatgagattagactggtggaagacggaaagtacggggctcaggacgatgccaacggtcaatggaacggcatggtgcgggagctcatcgaccataaagccgatttagccgttgccccattagctattacatatgtccgcgaaaaagtgatcgacttttccaagccatttatgacactgggtatttccatcctctatcggaagccaaatggaaccaaccccggtgtcttctcctttctcaatcctctcagtcccgacatttggatgtatatcctgcttgcatatctcggagtgagttgtgtattgtttgttatcgcacggttctccccctacgagtggtataaccctcatccttgcaatcctgactctgatgtggtggagaacaattttacccttcttaattcattttggttcggcgtaggcgctctgatgcagcaaggtagcgagctgatgcctaaggcgttgtctacaaggatagtgggaggtatctggtggttcttcacactgattataatctcttcttacactgctaacctcgcagcctttttgactgtcgagaggatggaaagcccaatagactcggctgacgacttggcaaaacagactaaaattgagtacggcgcagtggaagacggagctacaatgacgtttttcaagaagtccaagatatctacatacgataagatgtgggcttttatgagttcccgcaggcagtcagttcttgtaaagtcaaacgaggaagggattcagcgcgtcctaacaagcgactacgcctttttaatggaatcaaccacgatagaattcgtcacccagaggaattgcaaccttacacagatcggtggcctgatagattccaaaggttatggcgtgggcacccctatgggctcaccctacagggataaaatcactattgcaatccttcagctgcaggaagagggaaaacttcatatgatgaaggagaaatggtggcgagggaatggttgtcccgaggaagagagtaaggaggctagcgccctcggcgtgcagaacatcggcggaatcttcatcgtcctggccgctggcctggtgctgtcagtctttgttgccgtcggagagttcttgtataagtcgaaaaagaatgctcaactcgaaaaagagtcttctatctggctcgtgccaccttatcatcccgatactgtttag

SEQ ID NO: 224747 - DNA, 2727 bp, Artificial Sequence
  Description of Artificial Sequence: Synthetic coding sequence
atgaagatcattttcccaatcctgagtaatccagtgttccgacgaactgtgaagcttctcctgtgcttactttggatcggatactcccaggggacaacacatgtgctgcggtttgggggaatctttgaatacgtcgaatcaggcccaatgggagcggaggaactggcatttagattcgctgtgaacaccatcaatagaaacaggacccttctgcctaacacgacccttacatacgacacgcagaagatcaatctgtacgactcatttgaagcatctaagaaggcctgtgaccagctctctctcggggttgctgctatctttggaccatcgcatagcagctccgctaatgccgtgcaaagtatatgtaatgcactgggcgtgccccatatccaaacccggtggaaacatcaggtgagcgacaataaggattcattctacgtttcgttgtacccagattttagttcgctgtccagggccatcctggatcttgtgcagtttttcaagtggaagaccgtgactgtggtatatgatgattcgacagggctaatcagactgcaagagctgattaaagccccttcgcgctataatcttcgactgaaaattagacagctcccagccgacacaaaggatgctaagcctctgctgaaggagatgaagcgtgggaaagagttccatgtgatcttcgattgtagccacgagatggctgcaggaatactgaaacaagctctggcgatgggaatgatgactgaatattatcattatatcttcacaacgctcgacctgtttgcactcgatgtcgaaccatacaggtactcaggagtgaacatgaccggattccggattctcaatactgaaaacacccaggtgagctccataatagaaaagtggagcatggagagactgcaggctccaccgaagccggacagcgggctcctggacggatttatgacaactgatgccgctttgatgtacgacgccgtgcatgtggtgtctgttgccgtgcagcaattcccccaaatgactgtgtcctctcttcagtgtaatagacataagccttggagattcggaacgaggttcatgagcctgatcaaagaggcgcactgggagggcttaactgggaggattacattcaataaaaccaatgggttgcgaaccgactttgatcttgacgttatcagcctaaaggaggaggggctggagaaaatagggacatgggaccctgccagcggcctgaacatgacagaatcgcagaaaggtaaacctgccaacataactgactcactctctaacagatctctgatagtcaccactatactggaggaaccgtatgtgctgttcaagaaaagtgacaagccgctttacggtaacgacagatttgagggctactgcatcgatcttttgagagagctgtccacgatattagggtttacatatgaaatcaggctggtggaagatggaaagtacggggcacaggatgacgcaaacgggcagtggaacggtatggtccgggaattgattgaccataaagctgatctggccgttgcccctctcgccatcacctatgtgagagaaaaggttattgatttttccaaaccatttatgactctcggcatttcaattctgtaccggaagcctaacggcaccaaccctggcgtttttagctttctgaaccctttgagtcctgacatttggatgtacattttgctcgcttacctaggtgtgagctgtgtattattcgttattgcccgtttctccccatacgaatggtataatccccatccatgtaatcctgacagcgacgtcgtggaaaataacttcacgctcctcaacagtttctggtttggcgtgggtgccctgatgcagcagggctctgagctcatgcctaaagcgctgagtacccgcatcgtaggaggcatttggtggttctttacattgatcattatttccagctacactgccaaccttgccgcttttttgacagtagaaagaatggaatctcctatcgactctgctgatgacctggcaaaacaaacaaagatcgagtatggtgccgtggaagatggcgctaccatgaccttttttaaaaagagtaagatcagtacctacgataaaatgtgggcgttcatgtctagccggcgtcagagcgtgctggtgaagtccaacgaagaagggatacaacgcgttctgacctctgattacgcttttctgatggagtcaactacaatagagttcgtgacccaacggaattgcaacctcacacaaattggcggtctcatcgacagtaaggggtatggcgtgggcacccctatgggatctccctacagggacaaaattaccatcgctatcctccagctgcaggaagagggtaaactacatatgatgaaagaaaagtggtggcgcggaaacggctgccctgaggaagaatccaaggaagcttcagcgttgggagtccagaatataggcggtatcttcatagtgctggcagcagggctagtgctctctgttttcgttgcggtgggcgagtttctctacaaaagcaaaaagaatgcgcagcttgaaaaacgctcattctgttcagccatggttgaggaactcagaatgagcctcaagtgccagaggcggttaaagcataagccccaggcccctgttatcgtgaaaactgaggaagtcattaacatgcacacattcaacgaccggagacttcccggaaaagagactatggcttag

SEQ ID NO: 224748 - DNA, 1935 bp, Artificial Sequence
  Description of Artificial Sequence: Synthetic coding sequence
gggggtatcttcgagtacgtagagagcggccctatgggggctgaggagctggcctttcgcttcgctgtgaacaccattaaccggaacagaacactgctcccaaacacaactctgacctacgacacacagaagatcaacctctacgattctttcgaggccagcaaaaaggcctgcgatcaactctccctgggcgtggcagcaatcttcggaccttcccatagctcttccgccaatgccgtgcaaagcatatgcaatgccttgggagtgccccacatccagaccaggtggaagcatcaggtgtccgacaataaggattcgttctatgtttccctttatcccgattttagcagtctgtccagggcaatactcgatctcgttcagttttttaaatggaagacagtgacggtggtatatgacgactctactggcttaattagactccaagagttaatcaaggcccctagtaggtacaatctgaggctgaagattagacagctgccagccgacaccaaggatgccaaaccacttttaaaggaaatgaagagaggaaaggagtttcacgtcatctttgactgctctcatgagatggctgccggtatcctgaaacaggctctcgcaatgggtatgatgactgagtactatcactacatttttacaaccctggatttgttcgccctggatgtcgaaccatataggtatagcggcgtgaacatgacagggttccgtattctgaacacagaaaatacacaggtgtcctcaatcatagagaaatggtcaatggagcggctgcaggcacccccaaagcctgattctgggctcctcgacgggtttatgacgacagacgctgcccttatgtacgacgctgtccatgttgtgagtgtggctgtgcagcagttcccacagatgacggtgtctagtctgcagtgcaatagacacaagccttggagattcggaactagattcatgagtcttatcaaggaagcgcactgggaaggcttgacaggcaggatcaccttcaataagacgaatggacttcggacagactttgatctggacgtgatctccctgaaggaagaaggactggagaagattggcacgtgggatccggcttcaggcctgaatatgaccgaaagtcagaaaggtaaacccgcaaatattaccgatagcctatccaacaggtccttgatcgtcaccactatactcgaagaaccttacgtgctcttcaagaagtcagacaaacctttatacggcaacgatcgattcgaagggtattgcatcgacctgctgagggaactgagcacaattctcgggttcacatatgaaatccgactggtagaggacggaaaatacggggctcaagacgatgcgaatggccagtggaacggaatggtccgcgagctcattgaccacaagtcaaagatttctacctatgacaagatgtgggccttcatgtcctcaagacgccagtcagtgcttgtcaagtccaatgaggagggaatccaacgcgtgctcacgagtgactatgcttttctaatggaaagcacgactattgaattcgtgacccagaggaactgtaatctgacgcaaatagggggactcatcgactctaagggatacggtgtgggtactcccatgggctcaccttacagggataagatcactattgccatactgcagctgcaggaggagggaaagctacacatgatgaaggaaaagtggtggcggggtaacggttgtcctgaggaggagtctaaagaggcctcagccttaggcgtgcaaaatattggcggaatctttattgtcctggcagcaggacttgtcctttccgtgttcgtcgctgtgggggagttcctgtacaaaagcaagaagaatgcccagttggagaaggagtcttctatctggctcgtgcccccataccatcccgacactgtgtag

SEQ ID NO: 224749 - DNA, 2760 bp, Artificial Sequence
  Description of Artificial Sequence: Synthetic coding sequence
atgacagcaccatggcgacgactgcggtctttagtgtgggagtattgggctggcctgctcgtttgcgctttctggatccccgattctcgcggaatgccacacgttatccgaatcgggggtatctttgagtatgctgacggaccaaacgcgcaggttatgaacgccgaagaacacgcgttccgtttctctgccaatatcatcaacagaaaccggaccctcctacctaataccaccctgacatacgatatccaacgcattcacttccacgattcttttgaagctaccaaaaaggcttgcgaccagttggcactgggagtggtcgcaatttttgggcctagtcagggctcctgcactaacgccgtccagagcatctgtaatgccctggaggtgccccatatacagctccgctggaaacatcaccctttggataataaagacacgttttatgtgaacctgtatcccgattatgcaagcctgtcgcacgcaattctggatttggttcaatatctgaaatggagatctgctacagtggtgtatgacgatagcaccggtctcattcggttacaagagttaataatggcccctagccggtataatatcaggctaaagatcaggcaactgcccattgactccgacgattctaggccactgttgaaggaaatgaaacggggtagggaattccgcataatattcgactgttcccataccatggcagcccaaattttgaagcaggccatggcaatgggcatgatgaccgagtactaccattttattttcaccactctggacctttacgcccttgatctggagccctacaggtacagcggagttaacttaacaggattcaggatactgaacgtggacaatccacacgttagcgctatcgtggaaaaatggtccatggagagattacaagccgctcccaggtcagagtccggtctgctggacggcgtaatgatgaccgatgcagctcttctttacgatgccgttcacatagtgagcgtctgttatcagagagctccacagatgaccgttaactccctccagtgccaccgtcacaaggcatggcgatttggcggtcgttttatgaacttcatcaaagaggcccaatgggaagggctgacaggcagaatcgtgtttaataaaacaagcgggctacgcaccgacttcgacttagatatcatttcattgaaagaggacggacttgagaaggtcggcgtctggtctcctgcagatgggctgaacatcactgaggttgccaagggcaggggaccaaacgtaaccgatagcttgactaatcgcagccttattgtgacaactgttttggaggagccctttgtcatgttccggaaatctgaccggacactgtacggcaatgatagattcgaggggtactgtatcgacctcctgaaggagttagcacatatattgggctttagctacgaaatccgcctggtggaggatggaaagtacggagcccaagatgataaaggacaatggaatggtatggtcaaggaactcatagatcataaggccgatcttgcggtagccccactgacaattacacacgttcgtgagaaggccatagatttctcaaagccctttatgacccttggggtgtctatcctgtataggaaacccaatggtacaaatccatccgttttctcattcttaaaccctctttcaccagatatctggatgtacgtgctgctggcttatcttggggtctcgtgcgtcctatttgtcatagctagattcagtccttacgagtggtatgacgctcacccatgtaaccctggcagcgaggtggttgagaacaattttaccctgctcaacagcttttggtttgggatgggcagcctaatgcaacaaggctccgaactaatgcctaaggctttaagtacaaggatcattggcggtatctggtggttctttacactcataatcatctcttcctatacagctaatttggctgcttttctgacagttgagagaatggaaagtcccattgactcagcagacgacttggctaaacagactaagatagagtacggggctgtcaaggacggtgccactatgacattcttcaagaaatcaaagatctctacgttcgaaaagatgtgggcattcatgtcaagtaagccctcagcacttgtgaaaaacaatgaggagggaatccagcgcgcacttactgccgactacgctctcttaatggaaagtactactatagagtatgtgactcagagaaactgtaacctgacccagattggcggtctgattgactctaaggggtatgggatcgggacccctatgggctcgccttacagggacaagatcacaatagcaattcttcaactgcaggaagaagacaagctgcatatcatgaaggagaagtggtggcgtggatcaggctgtccagaagaagaaaacaaagaggcgtcggccctgggaattcagaaaattggtggaattttcatcgttctggcggctggcctcgttttgtcagtgctcgtagcagttggagagttcgtatacaagctgcggaagacggcagaaagagaacagcgcagtttctgctcaaccgtagcagacgagatcagatttagtctcacctgccagcgcagggtcaaacataagccccagcccccaatgatggtgaagaccgacgccgtcatcaacatgcacaccttcaatgacaggcgtctcccaggcaaggactctatggcctgtagcacctcactcgctcccgtcttcccatag

SEQ ID NO: 224750 - DNA, 2619 bp, Artificial Sequence
  Description of Artificial Sequence: Synthetic coding sequence
atgacggctccatggcgacgcctcaggagcctagtgtgggagtattgggcaggcctactagtgtgcgccttttggatacccgattcacgtggaatgccacacgtcatacgcatcggtggcattttcgagtatgcagatggtccaaacgcccaggtgatgaacgccgaagaacacgcatttagattttctgcaaatattatcaatcgaaatcggactctgctgccaaacactacactaacttatgacatccagcggattcacttccatgatagctttgaagcgaccaaaaaggcctgtgaccaattggccctcggcgttgtggccatattcggaccttcccaagggagttgtacgaatgcggtgcagtccatctgtaatgcactcgaagtcccacacatccagctgagatggaagcaccatcctttggataacaaggacactttctacgtaaacctgtacccagattatgctagcttgagccatgccatactggatcttgttcaatacttaaaatggcgtagtgccacagtggtgtacgacgacagcactggcctgatacgtttacaggaacttattatggccccttctagatacaatattagactcaaaatccggcaactgccaattgatagtgatgattctaggcccctgctcaaagaaatgaaaagaggcagggagttccgaatcatcttcgattgctctcacactatggccgctcagattcttaagcaggcgatggcaatgggaatgatgacagagtactaccattttatttttaccacacttgacctgtatgctctcgatctggagccctaccggtattctggagtgaacctcaccggtttccgtattttgaacgttgacaacccgcatgtgagtgcgattgtcgaaaagtggagcatggagagactgcaggcagccccacgcagcgagtcaggcctgttagatggggtgatgatgactgatgccgcattgctgtacgacgcagtgcacattgtctcagtctgttaccagcgggctcctcagatgactgttaacagtctgcagtgtcacaggcataaggcctggcggttcggaggcaggttcatgaacttcattaaggaggcacagtgggaagggctgacagggcgaattgtcttcaacaaaaccagcggtctgcgcacagattttgacttagacattattagcctcaaggaagatggtctagagaaagtaggtgtgtggtcccccgctgatggcctcaatattaccgaggtcgccaaggggagaggcccaaatgtgacagactccctgactaatcggtccttaatcgtcaccaccgtgctcgaggaaccattcgtcatgttcaggaagagcgatagaacgctgtacggcaacgatagatttgaagggtactgtatagatcttttgaaggagctcgcccatatccttggattcagctatgaaatcagattagttgaggatggcaaatatggagcccaggacgataaggggcagtggaacggtatggttaaggagttgattgaccacaaggccgatctggcggtcgccccattgacaattacacatgtgagggagaaggctattgatttctcaaaacccttcatgacgttaggcgtatcaatcctgtaccgcaaacctaacggcactaatccaagtgttttttcgtttctgaaccctctgtctcctgacatctggatgtacgtgctgctagcttatctgggagtgtcctgtgtgctttttgtgattgcaagattcagcccttacgagtggtacgatgcccacccttgcaatcctggctctgaagtcgtcgaaaacaacttcacactgctgaacagtttttggttcggaatgggtagcttgatgcagcagggcagtgagttaatgcccaaagcccttagtacacgaatcattggcggtatctggtggttcttcactctcataatcatatcgtcctacactgccaatttggccgcattccttaccgttgagcgcatggaatcaccgatcgactccgcggatgatctggcaaagcagacaaaaattgaatacggagctgttaaagatggcgcaactatgacattttttaagaagtccaagatatccaccttcgaaaaaatgtgggcatttatgtcttccaaaccttccgcgctggtgaagaacaatgaggaaggaatccagcgcgcactaaccgcagattacgccctgctcatggaatcaactaccatcgaatacgtgacccagagaaactgtaatttgacccagattggcggactaatagatagtaaaggctatgggatcggaacccctatgggctccccttacagagataagatcacaatcgctatcctgcaacttcaagaggaggataaactccatatcatgaaagaaaagtggtggagaggctctgggtgtcccgaggaggaaaacaaggaggcaagcgcattaggcatacaaaagataggcggaatcttcattgtacttgcagccggtttagtgctgtccgtacttgttgccgttggagagttcgtctacaagctgcgcaaaactgcagagcgggagcaggtgtccttgcgcgcatggtcactccataggatgggcaatggtgactccaggtag

SEQ ID NO: 224751 - DNA, 2871 bp, Artificial Sequence
  Description of Artificial Sequence: Synthetic coding sequence
atgccacgggtttccgcacctctcgtcttattgcccgcatggctggtgatggtggcatgttctccacactccctccggatcgcagctatactggatgatccaatggaatgtagtcgcggtgagagactttcaattaccctagccaagaatcgtatcaatagggcccctgagcgtttaggaaaagccaaggtggaggtggacatattcgagcttcttcgggattccgagtatgagacagcagaaaccatgtgtcagattttaccaaaaggcgtggtggccgtgctggggccttccagctcacctgccagctcatccattatcagcaatatctgtggcgagaaagaagtgccgcacttcaaggtggctcctgaagagtttgtgaagttccaattccaaaggtttacgactctcaacctgcaccccagcaatactgacatcagtgtggcagtggcgggtattctaaacttcttcaactgcaccacggcatgcctgatatgtgcaaaagcagagtgcctgctcaacctggagaaactgctgaggcaatttcttatcagcaaggacacgctcagcgtcaggatgttagatgacacccgtgacccaactcccctgttaaaagaaattagggatgacaaaaccgccactatcatcatccatgcgaacgcgagcatgtcacatactattctgctcaaagcagctgagctggggatggtgtctgcctattatacgtacatattcacgaatcttgaattctctctccaacgtatggatagcctcgtcgacgatcgagtgaatatcctcggattctccatatttaaccagagccatgcttttttccaggagttcgcccaatccctgaatcagtcgtggcaggagaattgcgaccacgtgccatttacgggcccagcactgagtagcgcactgcttttcgatgcggtttatgccgttgtcacagccgttcaggaacttaacaggtcacaagaaattggtgtgaaaccactgagctgcgggtctgcccaaatttggcagcatggcacttctcttatgaattacttaaggatggtcgaactggagggcctaacgggacacattgaattcaattctaaaggacagaggtccaattacgcactgaagatcttgcagttcacacgcaatggcttccgacaaattggtcagtggcatgttgctgagggtctcagtatggattcccatctgtacgcaagcaacatctccgatactctgttcaacactacattggtcgttactacaattctggagaacccttatctcatgctgaaagggaaccatcaggagatggagggaaacgatcgttacgaggggttttgcgtggacatgctcaaggagctggctgaaattctgaggtttaattacaagatacggctcgtcggagacggcgtgtacggtgtgcccgaagcaaatggtacctggaccgggatggtaggagaattgatcgcgcgtaaagccgacttagctgtagccggactcacgatcaccgccgagcgagagaaagtgattgactttagtaagccatttatgaccctgggaataagcatactttaccgggttcacatggggagaaagccaggatatttcagctttttggaccctttctctccaggggtctggctgttcatgctcctggcctatctggctgtgtcttgtgttctgtttttagtcgctagactgactccttacgaatggtattcccctcacccgtgcgcccaggggcgatgtaacctgcttgtgaaccaatatagtcttggtaattcattgtggttccctgttggagggtttatgcagcaaggttctaccatcgcccctagagccctgagtactcgctgcgtgagcggtgtctggtgggccttcaccctgattatcatttcttcatatacagcaaatctggcggcattcctgaccgttcagagaatggatgtgccaatcgagtccgtggacgacctggcggaccagaccgctatcgagtacggaacaatccacggcggatcctccatgaccttctttcagaattccagataccagacttaccagagaatgtggaattatatgtactcaaagcaaccgtcagtcttcgtgaagagtactgaggaggggatcgcaagagtgctgaactccaactacgcctttttgctcgaatcgacgatgaatgagtactataggcaacgaaactgtaacctgacccagattggaggtctgctggacacaaagggttacggtatcggtatgccggtcggttcagtgtttagggacgagtttgaccttgcaatcctccagctccaagagaacaaccgtctggagatactgaaacgcaagtggtgggagggaggcaagtgccccaaggaggaggaccacagagctaagggcttaggcatggaaaacattggtggaatctttgtcgtcttgatatgtgggctcatcgtcgctatctttatggctatgctcgaattcctctggactctgaggcattctgaagctaccgaagtgagcgtatgccaagaaatggtgacagaactacgtagcattattctgtgtcaggatagcatccatccacggagaaggcgcgctgccgtgccacctcctcgacctccgatacccgaggagaggaggccacggggaaccgcgaccctgtctaatgggaagctgtgcggagctggggagccggatcagctggctcagagactcgcacaagaggccgcattggtagcaagaggctgcacacatattagagtttgcccagagtgtcgacgattccaggggctccgcgcacggccttcccccgcacggagtgaggaatcattggaatgggagaagacaacaaattcatccgagcccgagtag

SEQ ID NO: 224752 - DNA, 2871 bp, Artificial Sequence
  Description of Artificial Sequence: Synthetic coding sequence
atgccgagagtgtcggctcctctagtattgctgcctgcatggctcgttatggtcgcgtgcagcccgcactcactgcggatcgcagctattctggatgaccccatggagtgttctagaggagagcgcctgtccattaccctggccaaaaaccgcataaatagggcaccagagcggcttggaaaggctaaggtggaagtcgacatttttgaactactgcgagacagtgagtatgaaacagcagagacgatgtgccagatcctgcctaaaggtgtggtggccgtgctgggcccatcatcttcaccggcaagcagctcgattatttccaatatttgcggagaaaaggaagttcctcatttcaaggtggcgccagaggaattcgtgaagttccagttccagcgcttcactacattaaaccttcatccttcaaacaccgacatcagcgtcgccgtagccggaatcctgaacttcttcaactgcacaactgcctgtctaatctgcgccaaagctgagtgtttgcttaatctcgaaaaactgctgcgacaatttctgatttctaaggataccctctcggttcggatgctagacgacaccagggaccctacgccactgctgaaagagattagagacgacaaaaccgcgaccataattattcacgccaatgcatcaatgagccacaccatcctgttgaaggcggctgagctgggcatggtgagcgcatactatacgtacatcttcactaatctagagttctctttacagcggatggactctctggtcgatgatagggtaaacatcctaggattcagtatctttaaccaatcccacgctttttttcaagagttcgcacagagcctgaatcagtcatggcaagagaactgtgaccatgtcccatttaccggtcctgcgttaagctccgccttgttgttcgacgccgtgtacgcagttgtgacagctgttcaagaactgaacaggtctcaagaaatcggcgtcaaacctctgtcttgcggctcggctcagatctggcagcacggtaccagtctgatgaattacctgcgaatggtggaacttgaggggctgactggacatatcgagtttaattccaagggacagcgttcaaattacgccttaaagatactgcagttcacaaggaatgggtttagacagataggccagtggcacgtcgctgaggggctgtccatggactcacacctttatgctagcaacatcagcgacaccctgttcaatacaacgctagtcgttaccaccattttggagaacccatatctgatgctcaaaggtaaccaccaggagatggagggtaacgacaggtatgagggattttgtgttgacatgctgaaagaactggctgaaatcctccgcttcaactataagataagactggtgggagatggcgtatatggcgtccctgaggccaatggcacatggaccggtatggtgggggaactgatcgccagaaaggccgatttggccgtggccggacttacaatcacagctgagcgtgagaaggtgatcgattttagtaagccttttatgacgctcgggatctcaatcctgtatcgtgtgcacatggggcgtaagccaggttatttttcattcttggaccccttttcacctggtgtgtggctgtttatgctgctggcatatcttgctgtcagctgtgtgctctttttggtggccagactgacaccatacgagtggtatagcccacacccctgtgcccaagggaggtgtaaccttcttgttaatcagtatagcttaggcaattcactgtggtttcccgtgggcggtttcatgcaacagggaagcactatagccccaagggccctgtcaacaaggtgtgtatccggcgtatggtgggccttcacactgatcataatttcatcctacaccgccaacctggccgcatttttgaccgtgcagcgcatggacgtgcctatcgagtcagtggatgatctcgccgatcagacagcaattgagtacgggacaattcacggtgggtcatccatgaccttcttccagaattcaaggtaccagacctaccaaaggatgtggaattacatgtattctaagcagccatctgtttttgttaagagtacagaagaagggatcgccagggtgttgaattccaactatgccttccttttggaatccactatgaacgagtattatcgtcaacgcaactgcaatctgacacagattgggggactgttggatactaagggctatggaatcggtatgcctgtgggaagtgtgtttcgtgacgaattcgatctagcgatattgcagctgcaggaaaacaaccgcctggagattctgaagcgtaaatggtgggagggcggaaaatgtccgaaggaagaggatcaccgggctaagggcctcggcatggagaacattggcggaattttcgttgttctcatttgtgggctgatcgtggcaatttttatggccatgttagagttcctgtggactttgagacattcagaggctacagaggtatccgtttgtcaggagatggtaactgagttacgtagcatcattttatgtcaggattcaatccaccctaggaggaggagggcagccgtgccaccgccacgaccacccattccagaggagcgtaggcccaggggcactgccacactcagcaacggtaaactttgcggcgctggagagcccgaccagcttgcccagagactcgcacaggaagcagccctggtggcacgagggtgcacccacatacgcgtgtgtcctgaatgcagacggtttcagggcctgcgcgcaagaccatcgcctgcgaggagtgaggaatccctcgagtgggaaaagacaacaaattcctccgaacccgaatag

SEQ ID NO: 224753 - DNA, 2943 bp, Artificial Sequence
  Description of Artificial Sequence: Synthetic coding sequence
atgccagctgagttattgctactgctcatcgtggcgttcgcatcaccgagctgccaagtgctatcgagcctacgtatggccgctattctcgacgaccagaccgtgtgtggaagaggggagcggttagcccttgccctggcaagggagcagatcaatggcataatcgaggttccagccaaagccagggtggaagtggacatcttcgaactacagcgtgattcccagtacgagacaaccgacacaatgtgtcaaattttacctaaaggcgttgtgagtgtactaggcccaagttcttcccccgcatcagcatcaacagtaagccatatttgcggagaaaaggagatacctcatatcaaggtcgggcctgaagagactccaaggttgcagtaccttcgcttcgcctcagtaagcctttacccttctaatgaagatgtcagccttgctgtaagcagaatcctaaagtctttcaattaccccagtgcctcactgatttgtgcaaaggctgagtgtctgcttcgattagaagaactcgtacgaggctttctgatcagcaaagaaaccctgtccgtgcggatgcttgacgacagccgtgatccgactcctcttctgaaggagatcagggacgataaggtttccacaatcattattgatgccaacgcgagtatctcgcatttaatccttcgcaaggcatccgaattgggcatgacctccgccttttacaagtacatcctaaccacaatggactttccgattctccacctggatggcattgttgaggactcttccaacattctcggattctccatgttcaatacatcgcaccccttttaccctgagttcgtaagaagcctgaacatgtcttggagggagaattgtgaggcttccacttacctgggacccgcactctctgctgcactgatgttcgatgcagtgcatgtggtcgtcagcgctgtgagagaactcaatcggagccaagagattggggtgaagcctttggcctgcacatccgcaaatatctggccccacgggacgagtctcatgaactatcttcgtatggtggaatatgatggactgaccgggagggtcgagtttaactccaaaggccagcgaaccaattatactctccggatactggagaagtcacgtcaaggccacagggagatcggggtatggtatagcaatcggacacttgcgatgaacgccacaacactcgacattaacctctcccagaccctcgccaataaaacacttgtagtgactaccatactggaaaacccttacgtgatgcgaagaccaaatttccaggctctcagcggcaacgagaggttcgaagggttctgcgtggatatgctccgggagctggccgaactcttaagattccggtatcgcctacggctcgtcgaagacggcttgtacggcgcacctgagcccaatgggtcttggactggcatggtaggagagctcatcaaccgcaaggctgacctggctgtggccgcatttaccattactgctgagcgggagaaggtcattgacttttctaagcccttcatgacactggggatatccattctgtaccgggttcacatgggcaggaagcctggctatttctctttcttggatccatttagccctgccgtttggctgtttatgcttctggcctacctggcagtgtcttgtgtgttattcctggctgccaggctcagcccatatgagtggtataaccctcacccctgtctacgggcaagaccccatatactggaaaatcagtacaccctgggcaattcactctggttccccgtagggggattcatgcagcaggggtcggaaattatgcccagggcccttagtactcgttgcgttagtggggtgtggtgggcttttacactcataattatttcctcctataccgcgaacttggccgctttcctaacagtacaacgaatggaggtgcccgtagaaagcgcagacgacctggcagaccagactaatatcgagtacggcacaatacacgccggaagcactatgaccttttttcagaactcaagataccagacttatcagcggatgtggaactatatgcaatccaagcagcccagtgtgttcgttaagtccaccgaagagggcattgccagagttctgaattctcgatatgcatttctccttgagagtaccatgaatgagtaccataggaggctgaattgtaacctgacccagatcggcggtttgctggacactaaaggatatgggataggcatgcccttgggttcccccttccgcgacgaaatcacattggcgattcttcagctgcaagagaacaatcgtctcgaaatcctgaagagaaagtggtgggagggaggaagatgccccaaagaggaagaccatcgcgctaaagggcttggcatggagaatatcgggggtatctttatcgtgctgatatgcggcctgattattgctgtgtttgtggcggttatggaattcatttggagcacgcggcgaagcgccgaatctgaagaggtgagcgtctgccaggagatgttacaagagctgcgtcacgcagtgtcctgtcgcaagacctccagatctaggaggcggagacgcccaggtgggccatcccgagccctgctctctttgcgggcagtgcgcgaaatgcgactgtcaaatgggaagctttattctgctggcgctggtggtgatgccggttcggcccatgggggtccacaacgtctgctggacgatccaggccctccatcaggagccagacctgccgcaccgaccccttgcactcacgtccgggtgtgtcaagaatgtcggcgtatacaggcccttcgcgcatcaggcgcaggcgctcctccgcgaggactgggagtcccagcggaggctacatcaccgcctagacctcgcccaggaccagctggcccacgcgaactcgctgagcatgagtag

SEQ ID NO: 224754 - DNA, 2946 bp, Artificial Sequence
  Description of Artificial Sequence: Synthetic coding sequence
atgcctgcagaactactgctcctgctgatagtagcctttgcctcgcccagttgccaggtcttatccagcctcagaatggccgcaatcctggacgaccagaccgtgtgtggacgcggagagcggctggccttggccctcgctagggaacagattaatggaattatcgaggttcccgcaaaggccagagtcgaggtggacatttttgaactccaacgagattctcagtacgaaacaaccgatactatgtgtcagatcctcccgaagggtgtggtgtccgtcctcggcccatcatcaagcccggcatcagcctctacagtgtcacacatctgtggggaaaaggagataccccacatcaaagtgggccctgaggagacacccagacttcagtacttgcgattcgcatccgtgtcactgtacccttccaatgaggatgtctcactggccgtgagtcgcatcctcaaaagtttcaactacccctctgccagcctgatatgtgcgaaagcagaatgcctactccgtttggaggaactggttcgcggatttcttataagcaaagagaccctgagtgtgcggatgctggatgatagtagggatcccaccccactccttaaggagatcagagacgataaagtgagtactattatcatcgatgcaaatgcgtctataagtcatctaatactcaggaaagcctccgagctcggaatgaccagcgctttttataagtatatcctcactactatggacttccccatcctccacttggacggtattgttgaggacagttccaacatattgggtttctctatgtttaatacaagccaccctttctatcccgaattcgtgcggagtctcaatatgtcctggcgggagaattgcgaggccagcacttacctgggccctgcattatcagcagctctaatgtttgatgcagtgcacgttgtggtctccgccgtccgagagctaaacaggtctcaagagattggagtcaagccactggcctgcacttcagctaatatatggccacatggaacgtcgctgatgaactacctgagaatggtggagtacgatggccttaccggcagggtcgagttcaactctaaaggccagcgtactaattacactctgaggatcttggagaagagtaggcagggacatcgggaaatcggcgtttggtattccaataggactctggccatgaatgccacaaccctcgacatcaatctttcacagactctggccaacaagactctagtcgtgacaaccattctggagaatccttacgttatgcgcaggcctaatttccaggcgttgtctgggaacgaacgcttcgaaggattttgcgtggatatgttacgagaacttgccgagttgttacgctttagatatcgactccgactggtcgaggatggactgtacggagcgcctgagccgaatggctcttggactgggatggtcggtgaactcattaacagaaaggctgacttagccgtggctgcctttacgatcactgctgagcgcgaaaaagtcatcgatttcagcaagccattcatgacccttggaatctctatcctatacagggtacacatggggagaaaaccgggatacttctcttttctggatcccttctccccagctgtctggctttttatgctcttagcctatctagctgtgtcttgcgtccttttccttgccgcaagactgtcgccctatgagtggtataacccccacccttgcctgagagcacgccctcacatactggaaaatcagtacaccctcggaaattcattgtggtttcctgtcgggggattcatgcaacaaggcagcgagatcatgccgagggccttatcaacacgctgtgtatcaggggtgtggtgggccttcacactgattatcatcagcagctacacggctaacctcgcagcttttctgactgtgcagcgaatggaggtccccgtggaatctgccgatgatcttgcagaccagactaatatcgaatatggtactattcacgctggatcaacgatgacattttttcagaactctcggtatcagacgtaccagcggatgtggaactacatgcagtcaaaacagccaagtgttttcgtcaaatccactgaagaaggcatcgcgcgtgtgctgaacagcaggtatgcgttcctgctggaatcgacaatgaacgagtatcatcgaagacttaattgcaacctgacacagatcgggggactgcttgacactaaggggtacggcatcgggatgcctcttggatcacccttcagggatgagatcaccttggcaatacttcagctacaggagaacaacaggctcgaaatcctgaagaggaagtggtgggaagggggtcgctgtcccaaggaggaggatcatcgggctaaggggctcggcatggaaaacataggaggaatcttcatcgtgttaatctgcggcctcatcattgccgtttttgtggcagtgatggaattcatttggagtacgaggcgaagcgccgagtccgaggaaaccccagccttacaccctgctgcgtgtcagtgcagtgcactcggcccacgtacaccactaaaggagccctcaatgctcctcgttaaagtgccctctaccagggtacaggtcgcgttctctaggacaagcttgaggcaggtttgcccatttcttctgcagcatcagctttcttcgctgtactggatacaggcaactaatgtgcaaatctgttgtcatttctcatctctgaagcctagcccggatcttacttttcctccttctcacagaccactgtctagtctattatttactgcgctagcagccgtcggcggactgcctgacgcctccagttttttcttcccgccaatctcgtcttgtccacctctgcagtccggcataggcccatgccacagcaccgaggcaacacttgtgacatcaaattttcatgtttag

SEQ ID NO: 224755 - DNA, 1077 bp, Artificial Sequence
  Description of Artificial Sequence: Synthetic coding sequence
tgatgggccttcaccttgataatcattagctcctacaccgccaacctcgccgctttcttaaccgtccagaggatggaagtgcccgtagagtccgctgatgaccttgcagaccagacgaacattgaatatggtactattcatgccggatctactatgacattctttcagaactcgcgctaccagacctatcaaagaatgtggaattacatgcagagcaagcaacctagcgtgttcgtgaagagcacagaagaggggattgcacgggtcttgaatagcaggtatgccttcctgctggaatcaactatgaacgagtaccatcgaaggctcaactgcaatttaacacagatcggtggactgctggacacaaagggttatggcattggaatgccactggggagccccttcagggacgagattaccctggctatcctgcaactgcaggaaaataatcgtctcgaaatcttaaaacgcaaatggtgggaggggggaagatgcccgaaggaagaagaccatcgggctaaaggtttgggaatggaaaacatcggcggtatcttcatcgtgttgatatgcgggctgatcatcgctgtatttgtggctgttatggaatttatttggtccactagacgctccgctgaaagtgaagagacacctgccctccaccctgccgcatgccagtgctccgcactggggcctagaacacccctgaaagagccaagtatgttattggtgaaggtgccctccacgcgggtgcaggtggccttctcacgcacatctcttcgccaggtgtgccccttcctgctgcagcaccagctgtcttcattgtactggatacaggccactaacgtgcagatttgttgccatttcagtagcctgaaacccagccccgacctcacctttcctccaagccaccgacctctgtcttccctactgttcactgcgctggcggctgtggggggactgcccgatgcgagtagtttttttttcccgccaatctcctcgtgcccgcctctccagagtggaattgggccttgccatagtaccgaagctactctggtgactagcaactttcatgtttag

SEQ ID NO: 224756 - DNA, 2769 bp, Artificial Sequence
  Description of Artificial Sequence: Synthetic coding sequence
atgtccacaatgaggctcttgaccctggccttactcttttcctgttctgtggcacgcgctgcctgcgatcccaaaatcgtgaacattggagcagtgctttcaactcgtaaacacgagcaaatgttccgggaggccgttaatcaggccaataaacgacatggctcctggaaaatccaactcaatgctacaagtgtcacccacaagcccaacgcaattcagatggccctgagcgtgtgcgaggatctgattagctctcaagtgtacgctatactggtgagtcatccacctacacccaacgaccacttcacccctaccccagtcagttacacagccggtttctaccggatccctgtactgggcttaaccactcgtatgtccatctattccgacaagtcaattcacctgagtttcttacgcaccgtaccaccgtattctcatcagtctagcgtctggtttgagatgatgagagtctattcttggaaccatattatcctgctggtcagtgatgaccatgagggtagggcggcacagaaaaggctggagaccttactcgaggagagagagtccaaagcggaaaaggtcttacagtttgaccctgggaccaaaaatgttacagccctgctgatggaggccaaagaactggaggcacgggtgatcatcctcagcgctagcgaagatgacgccgcaacagtgtatcgggcagcagccatgcttaatatgacgggctccgggtacgtgtggctcgtgggcgaaagagaaatcagcggcaacgccctgcgctatgcaccagatggcattcttgggctgcaactgatcaacggaaaaaacgagagcgctcatattagtgacgcagtcggggtggttgcccaagcagtccacgagcttctggaaaaggagaatattaccgaccccccacgcggatgcgttggaaatacaaatatttggaagaccggtcctctgttcaagcgagtccttatgagtagcaaatatgcagacggcgtgacaggtcgcgtggaatttaatgaggacggggaccggaaattcgcaaactactcgatcatgaatctgcagaatagaaagttggtccaagtcggtatctataacggtactcacgtgatccctaacgaccgaaagataatctggccaggcggagagacagaaaaaccccgaggatatcaaatgtccacacggcttaagatcgtcaccatacatcaagagcccttcgtttacgtgaagccgacattgtcagatggtacctgcaaggaggaattcacagtgaacggggacccagtaaaaaaggtgatttgtaccggaccaaacgatacttcgccagggtcgcctagacacactgttcctcagtgttgttacgggttttgtatagatctactcatcaaactggccagaacgatgaacttcacttacgaagtgcatttggttgcagatggtaagttcggcacgcaggagagggtgaataatagcaacaagaaagagtggaacgggatgatgggagaactgttgagcggccaggccgacatgatcgtggctcctctcacgatcaataacgaacgggctcagtatatcgaattttctaaacctttcaagtatcaggggctgactatcttagtaaagaaggagattcccagatctacacttgactcattcatgcaaccctttcagagtactctgtggctccttgtggggctgagtgtgcacgtggtggccgtaatgctttatctgctggataggtttagccccttcgggagattcaaagttaatagcgaagaagaagaagaggacgctctgacactgtcatctgcgatgtggtttagctggggggttcttttgaatagtggaattggtgaaggtgctcccagatcattcagcgcgaggattctggggatggtatgggctgggtttgcgatgataattgtagcttcatatactgccaacttggcagcgttcttagtgctggatagacctgaggaaagaatcacaggaataaatgatcctaggctcagaaatccaagcgacaagttcatctacgccaccgtgaagcaatcctccgtcgacatctacttccggaggcaagtagagctgtcaaccatgtatcgccatatggaaaaacataactacgaatctgccgcagaggcaatacaggccgtgcgagacaataaactgcacgctttcatctgggactcagcggtgttggaatttgaagcctcacagaagtgtgacttggtcactacaggggagttgttttttagaagtgggttcggcattggcatgagaaaggactcaccatggaaacagaacgtgtccctgagcattctgaagtcacacgagaacggctttatggaagatctggataagacttgggtacgctaccaagagtgtgattcacgatcaaatgcaccagctaccctgacttttgaaaacatggcaggggtgtttatgcttgtcgcaggtggcatagtcgcgggaatcttcctgatctttatcgagatcgcatacaagagacataaggatgccaggagaaagcaaatgcaactggcgttcgccgctgtgaatgtgtggcgtaagaatttgcaagaccgtaaaagcggaagagcggagcccgacccgaagaagaaagccacattccgggctattacctcaacactggccagcagcttcaaaagaaggcgcagttcaaaggatactcagtaccatcctacagatatcaccggccctctgaaccttagcgacccgtctgtgtccaccgtggtctag

SEQ ID NO: 224757 - DNA, 2730 bp, Artificial Sequence
  Description of Artificial Sequence: Synthetic coding sequence
atgagtaccatgagactcttgaccttggccctcctgtttagttgtagtgtggccagagctgcctgcgatcccaaaatcgtcaacatcggtgccgtgctcagcacacgcaaacacgagcagatgttccgcgaggcggtcaatcaagcaaacaaacggcatggctcatggaagattcagctgaatgcgaccagtgtgacacataaacccaatgcgatacagatggctttgtccgtgtgcgaagacttgatatccagtcaagtgtacgctatcttagtctcccatccgcctaccccaaacgaccatttcactcctacacccgttagttacactgcaggtttttatcggattcccgtcctaggactaacaacgcggatgtctatctatagtgacaagtctattcatctgtccttcctccgaacagtgcccccttacagccaccagtccagcgtctggttcgagatgatgcgtgtatattcatggaaccacatcatcctgcttgttagcgacgaccatgaaggtcgagctgctcagaagcgactcgagacgctcctagaagagcgcgaatccaaggcagaaaaggtgcttcagttcgatcccggaaccaaaaacgtaaccgctttgctcatggaagctaaagagctcgaagctagagtgattatcctcagtgcttccgaggacgatgctgccactgtttatagagcagccgctatgttaaacatgactgggtccggttacgtctggctggttggcgaaagggaaatatccggcaacgccctgcgctacgccccagatggaatcctgggactgcaactgattaacggtaagaatgaatccgctcatatttctgatgcagtcggtgtggtcgcccaggccgtacacgagctgctcgaaaaggagaacataactgacccacctaggggttgtgtcggcaacaccaatatctggaagacaggccctctttttaaacgggttctgatgagctccaagtatgccgacggcgtcacggggagagtggagtttaacgaggatggggatcgcaagtttgccaactattcaatcatgaatctgcagaatagaaagttagttcaggtgggtatctacaacggcactcacgtaattccaaatgaccgcaagattatctggcccggtggggagactgagaaacctagagggtatcaaatgagtaccaggctcaagatcgttactattcaccaggagccgttcgtgtatgtcaaacccaccctttctgacggcacctgcaaagaagaatttaccgttaacggagatccggtgaagaaggtgatatgtactgggccaaacgacactagcccgggaagtccacgtcacacagtgccacagtgttgttacggcttctgcatcgacctccttattaagttggctcgaactatgaacttcacatacgaagtgcatcttgtagccgatgggaagtttggaacacaggaaagagtgaataactcaaacaagaaggaatggaacggtatgatgggcgaactgctttctggacaggccgacatgattgtagcgcctcttaccatcaataacgagcgggctcaatacatcgagtttagcaagcccttcaagtaccaggggctgaccatcctggtaaaaaaagaaattccacggtccacactggacagtttcatgcaacctttccagtctaccctgtggttgctcgtggggctgagcgtgcacgtcgtggctgttatgctgtacttgctggaccgcttttcaccattcggaagatttaaagtgaatagtgaggaggaggaagaagatgccttaaccctgtccagtgcaatgtggttctcatggggagtgctgctgaacagcggaatcggggaaggagctccgcgatccttctctgccagaatcttgggtatggtctgggccggatttgctatgatcatcgtggcgtcgtacactgccaacctcgccgctttcctcgtcctcgaccgccctgaggaaagaatcaccggcataaacgatcctcggttacggaatccaagcgataaattcatttatgctaccgttaaacagagttctgttgacatctacttcagacgacaggtagagctgagcaccatgtatcgacacatggagaaacataactacgagagcgccgcagaagcaatccaggcagtcagggataacaagctgcatgctttcatctgggacagcgctgtcttagagttcgaagcttcccaaaagtgcgatttagtgacgaccggggaattattttttcgatcaggtttcggcattgggatgcgaaaggactccccctggaagcagaacgtcagcctctccattctgaagagccacgagaatggcttcatggaagatctggataagacatgggtgaggtaccaggaatgtgactctaggagtaatgccccagccacactgacattcgaaaatatggctggggtgttcatgctggtggcaggcggaatcgtggcaggaatctttctcatcttcatcgaaatcgcttataagagacataaggacgctagacgaaagcagatgcaactcgccttcgccgcagttaacgtgtggcggaagaatcttcaggttggccaagcgacattacgtggactggtccccagagcaaggcccggtcatggcccaccgccttccccaaaagccgttgccctcgcacttgcacttgttggtcgaactggtgcaagaagtcatggacagggccagtggtag

SEQ ID NO: 224758 - DNA, 2832 bp, Artificial Sequence
  Description of Artificial Sequence: Synthetic coding sequence
atgtctacaatgaggttactgacactggcacttttgttttcctgttctgtggccagggcagcgtgcgatcccaagatcgtcaacatcggtgctgtcctgtcaacacggaagcatgaacagatgtttagagaggctgtgaatcaggctaacaaacgacacgggtcctggaagatacaactcaatgctacatcggttacccacaaaccgaatgctatacagatggccctatcagtgtgtgaggatcttatatcttcacaggtctacgctatactggtctctcatccccctaccccgaacgatcattttaccccaactcccgtcagttataccgccggtttctacaggatacctgtgctaggactcactacgcgcatgagcatttacagtgacaagtccatccacttaagctttctgcggaccgtgccaccttactcccatcaatcctccgtctggttcgagatgatgagggtctacagctggaaccacattatactgttagtgagcgacgatcatgaaggaagagcagcacagaagcggctggaaaccctcctagaggagagagaaagcaagtcaaaaaagagaaactacgaaaacctggatcaactttcatacgacaacaagcgtggaccgaaggcagagaaggttctccaatttgaccctggcactaagaacgttacagcactcctgatggaggcgaaggagctcgaggccagagtgatcattctgtccgcttctgaggacgacgcagccactgtatatcgagcggctgcaatgttaaatatgaccggttccgggtacgtatggctggtaggcgaacgggagatatcagggaacgcgttaaggtacgcccctgacggcatcttaggcctgcagttaatcaatggcaagaatgagtccgcgcatatttcagatgccgtcggcgtggtggctcaggcagttcacgaactactagaaaaggaaaacattaccgaccccccaaggggctgtgttggcaacacgaatatttggaaaactggcccactcttcaaacgtgtcctcatgtcaagtaagtatgcagacggagtgaccggcagggtggagtttaatgaggacggtgacagaaaatttgcaaactactcaatcatgaatctgcagaaccgcaagctggtgcaagtaggcatttacaacggaacccacgtcatccccaacgatcggaaaattatctggcctggtggggaaacagagaagcctcgtgggtaccaaatgtctaccaggttgaagatcgtaactattcaccaggaaccgttcgtctacgtcaagccaactctgtccgatggaacatgtaaggaggagtttactgtgaacggagatcccgtgaaaaaagttatttgtactgggcctaacgatacttcacctggatcacctaggcatactgtgcctcagtgctgttacggcttttgcatcgatctcctgataaaacttgcaaggactatgaactttacctatgaagttcacctggtcgctgatggaaagttcggcactcaggaaagggtgaacaattctaacaagaaggagtggaacggtatgatgggggaactcctgtcaggacaggcagatatgatagtggctcctttgaccatcaacaatgaaagagcccagtatattgagttctctaagccctttaagtaccaggggttgacaatacttgttaaaaaggagattcccaggagcacactcgattctttcatgcaaccctttcagagtaccctttggctgctggtaggattatctgtccatgtggtcgctgttatgctctacctcctggaccgctttagcccattcggccgatttaaggtgaacagtgaggaagaggaagaggatgccttaactctgtcgtcggcaatgtggttttcctggggcgtcctgctcaacagtgggattggcgaaggcgcacccaggagcttctccgcaagaattctcggtatggtgtgggccggatttgccatgatcatagttgcctcctacaccgctaacttggctgcctttcttgtcctcgaccgacctgaggagaggattactggaatcaacgaccctaggctgcggaatccatcagacaagttcatatatgctacagttaaacagtcttccgtcgatatatactttcgccgacaagtggagctgagtaccatgtaccgtcacatggagaagcataactacgagtctgccgcagaagctattcaggccgtgcgcgataataaattacatgcgttcatttgggacagcgcggtgctcgagttcgaggcttcccagaagtgtgacttagtgactaccggggaactattttttcggtccggctttgggatcggaatgcggaaagactcaccttggaaacagaatgtaagtctgtccatcttgaaatctcacgagaacggcttcatggaggacctggataaaacctgggtccgctaccaggagtgcgatagccgctctaacgccccagccactctcacctttgaaaacatggccggagtttttatgctggtggcaggcggtatagtggcaggtatttttctcattttcatcgagatcgcgtataagcggcataaggacgccagacgcaagcagatgcagctcgcattcgccgctgtgaacgtctggcggaaaaatctacaggatcgaaagagcggacgtgccgagcccgaccctaagaaaaaagctacctttagggctattacttctaccctagcgtcatcgtttaagcgcaggcgcagctctaaagacactcagtatcaccccacagacatcaccggaccactcaacctgagtgatcccagtgtctctaccgtcgtgtag

SEQ ID NO: 224759 - DNA, 2769 bp, Artificial Sequence
  Description of Artificial Sequence: Synthetic coding sequence
atgagtaccatgagattattaactctcgctctgctcttcagctgtagtgtagccagagcggcttgcgacccgaaaatagtgaacataggggctgtcctgtctacaaggaaacacgaacaaatgttcagagaagccgtaaaccaagcgaataagcgccacgggtcctggaaaatacagctgaatgccacgagcgtgacccataaaccgaacgccatccagatggcgttgagcgtctgtgaagatctgatttcctcccaggtgtacgcaattttagttagccatcccccaacccctaatgaccattttactccaacaccggtatcatacaccgccggtttctatcggatccctgtgctggggttaaccacacgcatgtccatctacagcgataaatcgattcatttaagttttttacgaaccgttccaccatactctcatcagtcctctgtgtggttcgaaatgatgagagtatatagctggaaccatatcattctcctggtatctgatgaccacgagggacgtgctgcacagaagaggctcgagaccctattagaggaaagagaaagcaagagcaagaaaaggaattacgagaacctagatcagctgagctacgataataagagagggcctaaggcagagaaggtgctgcagttcgaccccggaactaagaacgtaaccgcccttctgatggaagcaaaggagctggaagcgagagtgatcatactaagcgcatccgaggatgacgctgctaccgtgtaccgagctgctgctatgctgaacatgaccgggagcggttatgtgtggcttgtaggagagcgggaaattagtggtaatgctcttcgttatgcgcctgatggcattctggggctccagctgatcaatggcaaaaatgagtctgcccacataagtgatgctgtgggcgtagtggcgcaggctgttcatgaactcttagagaaagaaaacattacagatccgcctaggggttgcgtcggtaacaccaatatttggaagacagggccactgttcaaaagagtgctgatgtctagtaagtacgccgacggagtgaccggcagggtcgaattcaacgaagatggagataggaaattcgccaactattcaattatgaacctccagaaccggaaattggtgcaggtaggtatctacaatggaacacacgttattcccaacgatcgtaaaataatctggccaggcggagaaaccgaaaagccacggggataccaaatgtcaactcggctaaagattgtgacaattcatcaagagcctttcgtgtacgtgaagcctacactgtcggatggcacttgtaaggaggagtttactgtcaatggagatccagtgaaaaaggtgatctgcaccggccctaacgatacttcccccggaagcccaagacatactgtgccccagtgctgctatggcttctgtattgatctgctgatcaaactggctaggacgatgaatttcacttacgaggtgcatctggtggccgacggcaagtttggcactcaggagcgagtgaacaattccaataaaaaggagtggaatggaatgatgggagagctcctctctggacaagctgacatgatcgtggcccctctgactatcaacaacgagagagcacaatacatcgagttttccaagcccttcaagtaccagggccttaccatcctggtgaaaaaagaaattccacggagcactctcgactcatttatgcagccgttccaatccaccctttggctcctggttgggcttagcgtacatgtggtggcggtgatgctctacctcctggaccggttctcaccttttggccgattcaaggtgaactctgaagaggaagaagaggacgccctgaccctaagttccgcaatgtggttcagctggggagtgttgctgaactctgggataggcgagggagcacctaggtcatttagtgcccgaatcctcgggatggtgtgggcgggtttcgctatgatcattgtagcgagttataccgcgaatctcgcagcctttcttgtactcgatcggccagaagaacgcataacagggattaacgacccacgcctacgaaatcccagtgacaagtttatatacgcaactgtaaaacaaagcagtgttgatatttacttcagacgccaagtggaattatctaccatgtacagacatatggaaaaacataattatgagtccgctgccgaggcgattcaggccgtgcgggacaataagttgcatgctttcatctgggactcagcggtactggaattcgaggcctcccagaaatgtgatctggtgaccactggcgagctgttcttcagatccgggtttggtatcggtatgcgaaaggactcaccatggaagcagaatgtgagtctgagcatcctcaaaagccatgaaaatgggttcatggaggatctcgacaagacctgggtgcgatatcaggagtgcgacagtaggtccaacgcccctgcgactcttacatttgaaaacatggcaggtgtgtttatgctggtcgctggcggaatcgtagccggaatttttctgatcttcatagagattgcttacaagaggcacaaggatgctcgcaggaaacagatgcaactggcttttgctgcagtaaatgtctggagaaagaatctacagtcgactggtggtggtcgcggagctcttcagaaccagaaggacaccgtcctgccacggagggcaatcgagagagaggaggggcaactgcaactgtgctcaagacatcgtgaatcttag

SEQ ID NO: 224760 - DNA, 2721 bp, Artificial Sequence
  Description of Artificial Sequence: Synthetic coding sequence
atgtccaccatgcgactgttaacgctcgctttgctcttttcctgctctgttgccagggcagcctgtgacccaaagatcgttaatatcggggctgtcctgtccactagaaaacacgagcagatgttccgcgaagcagtaaaccaggcgaataaacggcacggctcctggaagatccagttgaacgccacctctgtgacccacaagcccaatgcaatccagatggcactttccgtgtgtgaggatctgatttcatcacaggtttacgctatcctggtttcacacccacccactccaaatgatcacttcacccccacacctgtaagctacaccgcgggtttctacagaattcctgtgctgggactgacaacacgcatgagtatttactctgacaagagtatacatctgtctttcttgagaaccgtgcctccatattctcatcaatcctcagtttggttcgaaatgatgcgcgtgtatagctggaaccacatcatcctgcttgttagcgatgaccacgaagggagggccgcacagaagaggcttgagaccctattggaggagagggagagcaaaagcaaaaagcgtaactacgagaatttagatcagctctcatatgacaataaacgcggacccaaggcagaaaaggtactgcagtttgaccccggaacaaagaacgtaaccgccctgttgatggaagccaaggagctggaagccagagtcatcatactctcggcctccgaggatgacgcggctaccgtgtaccgcgcagcagcgatgctgaacatgactggctccggctacgtgtggctggtgggggagagggaaatctccggaaatgccctcagatacgccccagatgggattctcggacttcaattgatcaacggaaaaaacgagagcgcccacatctcagatgccgtgggagttgtggcccaggccgtgcacgagctactggaaaaggaaaacataaccgaccccccacggggttgcgtgggcaacacaaacatttggaaaaccggacccctgttcaaacgggttcttatgagctctaagtatgcagacggagtcactgggcgtgtggagttcaatgaggatggagaccggaaatttgcaaactactctatcatgaatcttcagaatagaaaactggtgcaggtaggcatctacaacgggactcacgtcatcccaaacgatagaaaaataatttggcccggaggcgaaaccgagaagccccgtggatatcaaatgagtacccggctgaagatcgttaccatccatcaggaacctttcgtctacgtcaaacccaccctaagtgacgggacctgcaaggaggaatttaccgtgaatggtgacccagtgaaaaaagtgatttgcacgggaccaaacgatactagtcccggaagtcccaggcataccgttccacagtgttgttatggattttgtattgaccttcttatcaagctagccaggactatgaacttcacatatgaagtgcatctggtggctgacgggaaatttggaacacaggaacgcgttaacaactccaacaaaaaggaatggaacggaatgatgggggagctcctcagcggtcaagccgatatgattgtggcaccactgaccattaacaacgagcgggctcagtacatcgagttcagtaaaccattcaagtaccagggcttgacaatactggtcaagaaggagattcctagatctactcttgatagcttcatgcaaccctttcagtcgactctgtggctgctcgtgggacttagcgtgcacgtggtagctgttatgctgtatctgcttgaccggttttccccattcggccgattcaaggtaaacagtgaggaagaagaggaggatgccctaacactgtcgagcgctatgtggttttcttggggcgttctgctgaacagcggcataggcgagggagcccctaggtcattctctgctcggattttgggaatggtctgggcaggattcgctatgatcatagtggcatcctatacagccaatctggcggcattcctggtactggatcggccagaagagcgaatcaccggaataaacgatccccgtctccgtaacccctcagacaagttcatttacgcgacagtgaagcagtccagtgttgatatttactttcgccgtcaggtcgagctgagtacaatgtatcgacatatggaaaagcacaattatgagagtgctgccgaggctatccaggccgttcgggataataagcttcacgcatttatctgggattcagcggtcctggagttcgaggcttctcaaaaatgtgatctggtgacaactggggaattattctttaggagcggtttcggaattggaatgagaaaggattcgccttggaaacagaacgtatccctgtccatcttgaagagtcacgagaacggcttcatggaagacttggacaaaacgtgggtgaggtaccaggaatgtgattctagaagcaatgctcccgctacgctcacgtttgagaatatggccggagtcttcatgctggttgctggcggaatcgtggctggcatcttcctgatttttatcgagatcgcctacaagaggcacaaggatgcaaggcgcaaacagatgcagctggctttcgcagctgtgaacgtgtggagaaagaacctacagcagtaccatccgactgatattacgggccctctgaatctctctgaccctagcgtgtcgactgtggtgtag

SEQ ID NO: 224761 - DNA, 2817 bp, Artificial Sequence
  Description of Artificial Sequence: Synthetic coding sequence
atgtcaaccatgaggctgcttaccctggccctgttatttagctgctccgttgcgagagccgcttgcgacccaaagatagtcaacattggcgcagtcttgagcacccgcaagcacgagcaaatgtttcgcgaagcggtcaaccaagcaaacaagcgccatggatcttggaaaatacagttaaacgctactagcgtgactcacaagcctaacgccatacagatggcattatctgtgtgtgaagatctgataagttctcaagtgtatgcaattcttgtttctcacccccctacgccgaacgaccactttacgcccacaccagtgtcctacacagccggattctatagaattcccgtgctggggctgaccacaaggatgagcatttattccgataaatctatccatctcagcttcctgcggaccgtgcccccttatagtcatcagagcagcgtgtggtttgagatgatgcgggtgtactcatggaaccacattattctgctggtgtctgacgaccacgagggcagggcggctcagaagcgacttgagacattgttggaggagagagagtccaaagccgagaaggtgctgcagttcgacccaggaaccaaaaacgtgaccgcattattgatggaggcaaaggagcttgaggctcgagtgatcatcctatccgctagcgaggacgatgccgctaccgtgtacagagcagctgccatgctgaacatgaccggcagtggctacgtgtggttggtcggcgagcgggaaatatcaggcaatgccctacggtacgcccctgacgggatcctcggactgcagttaatcaatgggaagaatgagtcagcacacatcagcgacgctgtcggtgtcgtagctcaggccgtgcacgagttgctggagaaggagaatataaccgaccctcctcgaggctgtgtgggcaataccaacatatggaagacaggaccactattcaaacgggtcctaatgtcgagcaaatacgcggacggggtgaccgggagagtagaatttaacgaggatggagatagaaagtttgctaattattccattatgaatcttcagaaccgaaaactggtccaggtgggcatttacaatggcacacatgttatccctaacgataggaagatcatctggccaggtggggagaccgagaaacctagaggttaccagatgagcacccgcctgaagattgtcaccatacatcaggagcctttcgtgtacgtaaagcccacactgagcgatggtacctgcaaagaggaatttactgtgaatggggatcctgtcaagaaagtgatttgcactggcccaaacgataccagccccggaagtccaaggcatactgttccgcagtgttgttacggcttttgtatcgacttgcttatcaagctcgccagaaccatgaacttcacctatgaagtgcatctggtagccgacgggaaattcggtacccaggagcgcgtcaacaattccaataagaaagagtggaatggcatgatgggcgaactgctatccggacaggccgatatgatcgtggctccactgaccattaacaatgagcgcgctcagtatatcgaattcagcaagccgtttaaatatcagggactgactattctcgtcaaaaaggaaatacccagatccacactcgactcttttatgcagccttttcagtcgacactgtggctgctggtgggcctcagtgtccacgtcgttgccgtcatgctctacctcctcgatcggttcagccccttcggacgttttaaagtgaactccgaagaagaagaagaggacgccctgacgttatcaagcgcaatgtggttctcttggggcgtgctcttgaattccggaattggcgagggcgctccacgatccttttctgcccgtatcctgggcatggtgtgggctggtttcgcgatgattattgtcgcgagctacacggctaatcttgcggcatttctggtgctggatcgccctgaggaacgtattacagggatcaacgatccaaggctcaggaatccgagcgacaagttcatatacgcaacagttaagcagagctcagttgatatttatttcagaaggcaggtggagctgagcacgatgtataggcatatggaaaagcacaattacgaatccgccgcagaagcgatccaggcagtgcgagataacaagctgcacgctttcatttgggattccgctgttttagaattcgaggcatctcaaaaatgtgatcttgttactacaggcgaactgttttttcgcagtgggttcggaattggcatgcggaaagactcaccctggaaacaaaatgtaagtctgtcgattttgaaatcccacgaaaatgggtttatggaagatttggacaagacctgggttagatatcaagaatgcgattctaggtctaacgcccctgcaacactgaccttcgaaaatatggccggagtcttcatgcttgtggctggcggaatagtcgcaggcatatttctgatttttatcgagattgcctacaagcgtcataaggacgcccgacggaagcagatgcaattggcctttgctgcagtgaacgtgtggcgaaaaaacctgcaagaccgtaagagcggcagagcagagcctgatccaaagaagaaggccacttttagagctatcacctcaaccctcgcgtcatctttcaagagaagacggtcctcaaaggacacctcaactggcggaggacggggagctctgcagaatcaaaaggacaccgtactccccagaagggcaattgagagagaagagggccagctgcaactgtgctcccgacaccgggaaagctag

SEQ ID NO: 224762 - DNA, 4395 bp, Artificial Sequence
  Description of Artificial Sequence: Synthetic coding sequence
atgggaagagtggggtactggactcttctcgtactccctgctttgctggtgtggcggggacccgctccctccgccgctgcagaaaagggacctccagccctcaacatcgctgtgatgctcggccacagccacgacgtgaccgaacgggaactgcggactctctggggacctgaacaagccgcagggctgcctcttgacgtcaacgtggtggccctgttaatgaacaggacggatccaaagtccctgatcactcacgtctgcgacctgatgtcaggcgcaaggattcatggtctggtgttcggggacgataccgaccaggaggctgtagcacagatgctcgacttcatttctagccatactttcgtcccaatactcgggatccatgggggagcatccatgattatggctgacaaggaccccacttcgacgtttttccagttcggggctagcatccaacagcaggctaccgtgatgctcaagataatgcaggactatgattggcatgtgttttctttggtgacgacgatcttcccagggtaccgcgagttcattagcttcgtgaagacgacagtggataatagcttcgtgggctgggacatgcagaatgttatcactctggatacctctttcgaggatgccaagacccaagtccagctgaaaaaaatccactcctcagtcattctattgtactgttctaaggacgaggcggtgctgatcctgtccgaggcacgctccctgggactgacagggtatgattttttctggatcgtgccaagcctcgtgtctggaaacacggaactaatcccgaaggagttcccttctggactcatctccgtaagctacgatgactgggactattccctcgaggccagggtgcgcgatgggatcggcatcttgactaccgctgcctccagtatgttggaaaagttttcttacatcccggaagccaaggccagttgttatggccaaatggagcgccctgaagtgcctatgcacactctgcaccccttcatggttaacgtaacatgggacggcaaggacttatcctttaccgaggaggggtaccaggtgcacccccgtctcgtcgtgatcgtgctgaataaagaccgagaatgggagaaagtgggtaagtgggagaaccatactctatcccttagacatgcggtgtggccaaggtataaatcattctcagattgcgaaccggatgacaatcacctgtccatagtaaccttggaagaagccccttttgttattgtggaggacatagaccccttaacagagacttgcgtcaggaatactgtgccctgcaggaaatttgtcaaaattaacaattccacaaatgaaggcatgaacgtcaagaagtgttgcaaggggttctgcatcgacatcctcaagaagttgagcagaactgttaagttcacttatgacctgtacttagtcactaatggcaagcacgggaagaaggtgaacaacgtgtggaatggaatgattggagaagttgtctatcagagagccgtgatggctgtggggagcttaacaattaatgaggaacgctccgaagtggttgatttctctgtaccatttgtggagaccggcattagtgttatggttagccgatctaatggcaccgtgtctccaagtgcgtttttggagccattttcggcttcagtgtgggtgatgatgtttgtcatgcttctgattgtgtcagccatcgctgtgttcgtgttcgagtattttagcccagtcggctacaatagaaatctcgcaaagggcaaagctccacatgggccttctttcacaattgggaaggctatttggctgttgtggggccttgtattcaacaacagcgtccctgtccagaacccaaaagggactaccagcaagattatggtgagcgtatgggctttttttgcagtgatttttctggcctcctatactgctaacttagctgcatttatgattcaggaggagttcgtggatcaagtcaccggcctctccgataagaagtttcagagacctcatgattactcaccaccctttcggtttgggaccgtgcctaacggctccacagaaagaaacataaggaataactatccgtacatgcaccagtacatgactaagtttaatcagaaaggcgtagaagacgccctggtctctctgaagactggaaagctagacgctttcatctacgatgctgccgtcttgaattacaaagccggacgcgatgaaggatgtaaactggtgacaataggaagcggatacatattcgccacgacagggtatgggattgccctgcagaaaggaagcccatggaaaaggcaaatcgacttggcactcctccagtttgtgggagatggcgagatggaagaactagagaccctgtggctcacaggaatctgtcataacgaaaagaatgaagtgatgagtagccaactggacattgacaatatggcgggagtgttctacatgctcgcagcagctatggccttgtccctgatcacttttatttgggaacatctgttctactggaagctccgcttctgcttcaccggagtgtgctccgatcgacctggtctgctcttctctatcagccgcggtatctattcttgcatccacggtgtacatatcgaggagaaaaagaagagccctgacttcaacttgacagggtcacagagcaacatgctgaaactgttacgcagtgcaaaaaatatctcctccatgagcaatatgaattctagtcgaatggatagccctaaaagggccgcagactttattcagagaggatccctgatcatggatatggtatccgacaagggtaacttaatgtactccgacaatagaagttttcaggggaaggagtccatttttggcgataacatgaatgagctccagacattcgtggccaacagacaaaaggataatctcaataattatgtctttcagggacagcaccccttgaccttgaacgaatcaaaccctaatactgtcgaggtcgccgtttccactgaaagcaaggcaaactcgcgcccacgacagctttggaagaaaagtgtcgattcaattcggcaggattcgctgagccagaaccccgtgtcccagagggacgaggctacagctgaaaatcgtacccactctctgaaatccccccgttatctgcccgaagaaatggcacactctgacatctcggaaacaagtaacagggctacctgccacagggagcccgacaactctaaaaatcacaaaaccaaggataattttaaaaggtccgttgccagtaaatatcctaaggactgttccgaggtggagcgtacttatttgaaaaccaagtcttcctcccccagggacaagatctatacaattgacggagaaaaagagccaggattccatctagacccaccccagtttgtcgagaatgtgactctgccagaaaatgtcgactttcccgacccctaccaagacccttctgaaaacttccgtaaaggagacagcaccctgccgatgaaccgaaatcccttacacaacgaagagggcctcagtaacaacgatcagtataaactatatagcaagcatttcactctgaaggataagggcagtcctcacagtgaaacaagcgaacgctacagacagaactccacccactgtcggtcgtgtctgtcaaatatgccaacctactcaggacacttcaccatgagatccccatttaaatgcgacgcctgtctacgcatgggcaacctatatgacatcgatgaagatcagatgctccaagagaccggaaaccccgctacaggggagcaggtgtaccagcaggactgggctcagaataacgcgctacagctgcagaagaacaagctacgtatcagccgtcagcatagttacgacaatatcgttgataagccaagggagcttgacctctcgcgcccatctcgcagtatctctttgaaagacagagaaagactccttgagggcaatttttacgggtctctcttctccgtccccagctcaaagctctcgggcaaaaagtcgtctctgttcccccagggactggaggattctaagagaagtaagtcgctgctgcccgatcatacaagtgataaccctttccttcattcccaccgggatgaccagcgtctggtgatagggcgatgccctagcgacccctacaaacacagtctgccttcacaagccgttaatgatagttatctgaggagctcacttagatccaccgcctcatactgttccagagactcccgtgggcataatgacgtgtacattagcgagcacgtgatgccctatgctgctaataaaaataacatgtatagcacccctcgcgtcttgaacagttgcagtaacaggcgagtttacaagaaaatgccatctattgaatccgacgtttag

SEQ ID NO: 224763 - DNA, 4394 bp, Artificial Sequence
  Description of Artificial Sequence: Synthetic coding sequence
atggggcgagtgggctattggacacttctggtacttccggcactcttagtgtggcggggtcctgcaccaagcgcagcagccgagaaaggccctcctgcattgaatatcgcggtaatgttgggacactcacatgatgtgacagaaagagaactccgaaccctctggggcccagagcaggctgctggtctgcctctggacgtaaatgtggtggctctgcttatgaatcggactgatccaaagagcctaattacacatgtgtgcgacctgatgagtggagccaggatccacggcctggttttcggggacgatacagaccaggaggcagtggcccaaatgctcgatttcatttcgagccatacatttgtgccaattttaggaattcacggaggcgcaagcatgatcatggctgataaggatccaactagcaccttcttccagttcggagcttccatccagcagcaggcaaccgtgatgttaaagatcatgcaagattacgattggcacgtcttctctcttgtgactaccattttccccggatatcgagaattcatctcattcgtgaaaactacagtagataacagcttcgtcgggtgggatatgcagaatgtgattaccctcgacacatcttttgaggacgccaaaacgcaagtgcaattgaagaagatccacagtagtgtaatactcctctattgcagtaaagatgaagcagtgctcatcctgtccgaggcccgttctcttggcctgacggggtacgatttcttttggattgtaccttcactcgtcagtggaaataccgaactgatccccaaggagttcccttcgggactgatatccgtgagctacgatgattgggactattcccttgaagcacgtgttagagatggcatcggcattctgaccaccgccgctagctcaatgctagagaaattcagctacatccccgaggcgaaagcctcttgctacggccagatggaaagacctgaagtgcctatgcataccctgcatccatttatggtgaacgtgacttgggatggaaaagatctgtccttcaccgaagagggctatcaggtgcatccccgtctcgtggtgatagtgctgaacaaggaccgcgaatgggaaaaggttggaaagtgggagaatcatacactgagcctgcgtcacgcagtgtggcccagatataagagcttctccgactgtgagcctgatgacaatcatctcagcatagtgacactggaggaagctccatttgtaattgtggaagacatcgacccattgacagagacatgtgtccgcaacaccgttccatgtcgcaagttcgtgaagattaataattccactaatgaaggcatgaatgtcaaaaagtgttgcaaaggattctgtattgatattctcaagaagttgtcccggaccgtgaaattcacctatgacttatatctcgtgaccaatggaaaacatgggaagaaggtgaataacgtatggaacgggatgatcggagaagttgtgtaccagagggctgttatggccgttggaagcctcactataaatgaggaaagaagcgaagtcgttgatttttccgtcccttttgtggagactggaatctcagttatggtgtcgagatccaatggcacggtaagtcccagcgccttcttggaacctttttccgccagtgtatgggtgatgatgttcgtgatgctcctcattgtatctgccatcgctgtatttgtcttcgagtattttagccccgtcggttacaaccggaacttggccaagggtaaggcaccccatggtccctcattcacaattggtaaagctatctggctactgtggggattagttttcaataattcggtgccggtgcaaaatccaaaggggacaacatccaaaatcatggtctccgtctgggcattttttgctgtcattttcctcgctagttacactgcaaacctcgctgcctttatgatacaggaagaattcgtcgatcaggtgacaggcctgtccgacaaaaagtttcagaggccccatgattattctccacccttccgcttcggtaccgtgcctaacggttccacagaacgcaatatccgcaacaactatccctacatgcaccagtatatgactaaatttaaccagaaaggagtggaagatgcgttggtatctcttaaaaccggaaagttggatgccttcatctatgatgccgctgtgctcaactacaaggcgggaagagatgagggttgcaaactggtcaccatcggttcgggctacatctttgccaccactggctacggaatcgccctgcaaaagggtagtccgtggaagaggcagatcgacttggcccttttacagttcgtgggagatggcgagatggaggagttagagacgctgtggctgactgggatttgccacaatgaaaagaacgaggtaatgtcctcacaacttgacatagataacatggctggcgtgttctacatgctggctgccgctatggctctcagtcttatcacctttatctgggaacatttattctactggaaattgcgtttttgttttactggagtctgcagcgaccgccctgggctactatttagcatatctcgaggaatctacagttgcattcacggagtgcacatcgaggagaagaaaaaaagtccagatttcaatctaactggcagccaaagcaatatgctgaagcttctgcgatcagccaaaaacatctcgtcaatgtctaatatgaactcatcacgcatggatagcccaaagcgcgctgctgactttatccaaagggggagcctaattatggatatggtaagcgataaaggcaatctcatgtatagcgacaatcggtccttccaagggaaagaaagcatctttggggataacatgaatgagcttcagactttcgtggctaatcggcaaaaagataacttgaataactacgtgtttcagggtcagcacccactgactctgaatgagagtaacccgaacactgtcgaggtcgccgtatccacagagtccaaggccaattctcgcccacgccagctgtggaagaaaagcgtggatagcatccggcaggactcactgtcccagaatcccgtgagccagcgggacgaggcgacagccgagaaccgcactcacagcctcaagagcccacgctacttgcctgaggaaatggcccatagcgacatcagcgagacttctaatcgcgcaacctgccaccgcgaacctgataacagtaagaatcacaaaactaaggacaactttaaacggagcgtcgcctctaagtaccccaaggattgctccgaagtggaacggacatacctcaagactaagtcatctagccctcgcgacaaaatctacacaattgacggcgagaaagaaccaggctttcacttggatccaccgcaatttgtggagaatgtgacattgcctgaaaacgtcgactttcccgatccttaccaagacccaagcgaaaactttcgcaagggtgattctaccctgccgatgaaccgcaatcccttacacaacgaggaggggctcagcaacaatgatcaatataagttatattctaaacatttcacactaaaggacaagggcagtccccactctgaaacctccgagagatatcgccagaattcaacccactgtagatcgtgtctaagtaatatgcccacatattccggtcactttaccatgcggtccccttttaagtgcgacgcatgcctccgcatgggcaatctgtatgacattgatgaggatcaaatgctgcaagaaactggcaatcccgcaactggagaacaggtataccagcaagactgggcccagaacaacgccctacagttgcaaaaaaacaagttacggatatctcggcagcattcctatgacaatattgtggataaacctcgggaactcgacctcagccgtccatctagatctatctctctgaaggacagggaaaggctactggaagggaatttctatgggtccctgttcagcgtaccttctagcaagctgtccggcaaaaagagttcactttttccgcagggactcgaggatagtaagcgcagtaaatctctgttgcctgaccacacctctgacaatcctttccttcactcccatcgagacgaccagagactagtcattggaaggtgtcctagcgatccttacaagcacagcctgcctagccaggctgtgaatgattcctacttaaggtcaagtctccggagcaccgcctcctattgttcaagagacagcaggggacacaacgatgtatacatttcagagcatgtgatgccctacgctgcaaacaaaaataatatgtactctacgccacgcgttctcaattcctgctctaataggcgcgtgtacaagaaaatgccttccattgaaagtgacgtcta

SEQ ID NO: 224764 - DNA, 4395 bp, Artificial Sequence
  Description of Artificial Sequence: Synthetic coding sequence
atgggacgggtgggatactggaccctgctcgtgctaccagccctgctggtctggcggggtccagccccaagcgccgcagctgagaagggccctccagccctcaacattgccgtgatgttgggccacagccacgatgttaccgaaagggagttaaggaccctgtggggaccggagcaggccgcagggctgcccctggacgtcaatgtcgtcgcactgcttatgaaccggacagatccgaagagtcttattacccacgtctgtgatcttatgagcggggcacggatccatggactcgtatttggcgacgacactgaccaggaggcagtcgctcagatgctcgactttatcagcagccacacattcgtgcccatccttgggattcatgggggagccagtatgatcatggctgacaaagaccctacttccactttctttcaatttggtgcatcgattcagcagcaggccaccgtgatgttgaagattatgcaagactatgactggcacgtgttttctctggtcaccactatttttccaggctatagggagtttatctcctttgtgaagaccactgttgacaattccttcgtgggttgggacatgcagaacgttatcacgcttgataccagcttcgaggatgccaaaacccaagtgcagttgaagaaaatccactcgtcggtcatattgctatactgcagcaaggacgaggccgtcttgatcttaagcgaagcacggagccttggcctaacgggctatgactttttttggatcgtcccatccttagtgagcgggaacacagagttgatccctaaagagtttccttccggccttatctccgtctcgtacgatgactgggactattctcttgaagcgagagtgagagacggtatcggcattctcactactgccgcatccagcatgctggaaaaattttcgtacattccagaggccaaagccagctgctatgggcagatggaacgaccagaagtccctatgcacactcttcaccccttcatggtcaatgttacctgggacgggaaagatttgagtttcaccgaagagggataccaagtccatcctcgtctggtcgtgattgtgttaaacaaggatcgcgagtgggagaaagttggaaaatgggagaatcataccctgagtctgagacacgccgtgtggccaaggtacaaaagcttcagtgattgtgagcccgatgacaaccacctgtctatagtcaccctggaggaagcacctttcgtcatcgttgaggacattgacccgctgaccgagacatgtgtgcggaacaccgttccttgtaggaagtttgtgaaaattaacaatagtactaatgaagggatgaatgtgaagaagtgctgtaaggggttctgtatcgatattttaaagaaattgagcaggacggtcaaattcacatacgacctgtatctggtgaccaacggcaaacacgggaagaaggttaacaacgtatggaatggaatgattggcgaagtcgtgtaccagagagctgtgatggccgttgggagcttaaccattaacgaggaacgatccgaggtcgtggacttttcggtcccctttgtggagacgggcatctctgttatggtctccagaagcaatggcacagtttccccttccgccttcttggaaccattcagtgctagcgtctgggtgatgatgttcgttatgctcctgatagtctctgctatcgccgtgtttgtcttcgaatacttctctcctgtgggatacaataggaaccttgcaaagggaaaagcccctcacggcccatccttcaccatcggcaaggccatctggcttctgtggggactggtgtttaacaacagtgttccggtgcagaatcctaaaggtacgacgtccaaaatcatggtatctgtatgggcatttttcgcggtgatctttctcgcatcatatacagccaatcttgccgctttcatgatacaggaggaatttgttgaccaggtgacaggcctgtccgacaaaaagttccagcgacctcacgactactcccccccattcagatttggtaccgttcccaacggatcaaccgagaggaacatcaggaacaattacccttatatgcatcaatatatgacaaaattcaaccagaaaggcgtggaggacgcccttgttagtctcaaaaccgggaagctggacgcgttcatctacgacgcagctgttctgaattataaagcgggaagggacgagggatgtaaattagttacaatagggtctggctacatctttgcaactactggctacggcattgcactacagaagggctctccttggaagcggcagatcgacctggcattgctccagtttgtgggagacggggagatggaggaacttgagacattgtggcttaccggcatttgtcacaatgagaagaacgaggtgatgtcttctcagctggacatcgacaacatggcgggtgtattctacatgttagccgcagctatggcactgtcactaatcactttcatttgggaacacttattctattggaagctgaggttttgttttacaggtgtgtgcagcgatcgcccaggactcctttttagtattagtcgcggtatttactcatgcatccacggggtgcacattgaggagaagaaaaagagccctgatttcaatctgactgggtcccagtcaaacatgctcaaactgctccgatccgctaagaacatttcatctatgagcaatatgaattcatcgagaatggactcaccaaaacgtgcagccgactttattcaaagggggtcactgattatggacatggtctcggacaaaggcaatttgatgtattcagataaccgcagtttccaagggaaagagtcaatatttggcgacaacatgaatgagctgcagacatttgttgccaaccggcaaaaggacaatctcaacaattatgtcttccagggccagcacccattaactctgaacgaatcaaatcctaacactgtggaagtcgccgtgtctaccgagtccaaggctaactccaggccaaggcagctgtggaaaaaaagcgtcgactctatcaggcaagactccctgagccagaaccccgtgagccagagggacgaggccaccgctgaaaataggacacattcactgaaaagtccccgatacctgcccgaagaaatggcccactctgacatcagcgaaacttcaaaccgtgctacctgtcacagggaaccggataacagcaaaaatcacaagaccaaggataatttcaaacgcagtgtggcctccaagtaccctaaagattgctctgaggtggagcgaacatacctaaaaacgaagtcctcaagcccccgagacaagatatacacgatcgatggtgagaaggagcccggattccacctcgatccccctcaattcgtggaaaatgttactctgccagagaacgtagatttcccagatccgtatcaagatcccagtgaaaactttcggaagggcgattccactctgcccatgaatcgaaaccccctccacaacgaggagggcctgagcaacaacgatcagtacaagttatatagtaagcactttacactcaaagataaagggtcgccacactctgaaaccagtgagcggtacagacagaattccacccattgcaggtcttgtctcagcaacatgcccacctatagcggtcactttaccatgcgcagcccttttaagtgcgacgcctgcctccgaatgggaaatctttacgacattgatgaagatcagatgctccaggaaaccggaaaccccgctactggtgaacaagtgtatcagcaagactgggctcagaataatgctctccagctacaaaagaataagttaagaatatctcggcagcattcctatgataacatagtcgataagccacgagaattggatctgagtcgaccttctcgctccataagcctgaaggatagggagaggctgctcgagggaaatttctatggaagcctgttttcagtgccttcttccaagctgtctgggaagaagagctccctctttccacagggactggaggacagcaagaggtcaaaatccctactccctgatcacactagtgataatccgtttctgcacagtcatcgagacgaccaaaggttggtcattggaaggtgtccgagcgacccctacaaacacagtctgccatcacaggccgttaacgacagttacctgaggagcagcctcagatctacggccagttattgtagccgggattctagggggcacaacgatgtctatattagcgaacatgtcatgccttacgccgcaaacaagaataatatgtactcaacgcctcgcgtgctgaatagctgttctaaccgcagggtttataaaaaaatgccaagcattgagagcgatgtgtag

SEQ ID NO: 224765 - DNA, 3846 bp, Artificial Sequence
  Description of Artificial Sequence: Synthetic coding sequence
atgggtcgtgttggatactggaccttgcttgtgctacccgctctcctggtgtggagagggcctgcgccttcagccgctgccgaaaaaggtcccccagctctcaatatcgccgtgatgctgggtcacagccacgatgttaccgagcgggagctgcgcacgctgtggggaccagagcaagccgctgggttgccactggatgttaacgtggttgcactgctgatgaaccgaaccgaccccaaaagcctcataacccacgtttgcgacctgatgagcggcgctagaatccacggcctcgtgttcggcgatgacacggaccaggaggcagtagcgcaaatgctggatttcatttcttcccatacctttgtccccatcctcggcatacacggcggagcctcgatgattatggctgacaaggatcctaccagtacattttttcagttcggagcttcaatccagcagcaagcgacggtgatgcttaaaatcatgcaggattatgattggcacgttttcagcctggttactacaatctttccaggttacagggagttcataagttttgtcaagacgacagtcgataacagttttgtggggtgggatatgcagaacgttatcacgctggacacaagcttcgaggacgccaaaacccaggtgcagctgaaaaaaattcattcaagcgttattttactctactgctccaaagatgaggcggtgctgattctgtctgaggctcggagtctaggcctgacagggtatgattttttctggattgtccccagcctcgtttctggtaacacggaactgatcccaaaggagttcccctctggacttatatccgtgagctacgacgattgggactactccctggaagccagggttagagacggcatcggcatactcacgactgcagcctcctccatgctggaaaagttctcatacattccggaggctaaagcttcctgctacggccaaatggaacgccctgaagtacccatgcacaccctgcatcctttcatggttaacgttacttgggatggaaaggacttatcctttaccgaagaaggctaccaggttcatccgaggctggttgtcatcgtgttgaacaaggacagagaatgggaaaaggtggggaaatgggaaaaccacaccctgagcttgcggcacgccgtgtggcctcgctataaaagcttcagcgattgcgaacccgatgacaatcacctgagtatcgtgacgctggaggaggcccctttcgtgatcgtggaggacatcgacccactgacagagacgtgtgtccgtaataccgtgccatgtcgtaaatttgtcaagattaataattcaaccaacgaaggcatgaacgtaaagaaatgttgcaaaggattttgcattgacattctgaagaagctgagtaggaccgtcaagtttacctatgacttgtacttagtaaccaatggtaagcacggcaaaaaggtcaataatgtgtggaacggcatgattggcgaagttgtctatcagcgcgcagtcatggctgtgggctccttgaccatcaacgaggagcgctcggaggtcgttgatttttccgttcctttcgtcgaaactgggatttccgtaatggtatcgcgtagtaacgggactgtgtcccctagtgcgttcctggagcccttctccgcgagcgtttgggtgatgatgttcgtgatgctcctaattgtatctgcaattgcagttttcgtttttgagtacttctcccctgtgggttataaccggaacctggcaaaggggaaggcgccacacggcccatctttcacaattggtaaagctatatggttgctttggggattagtgtttaacaactctgtgcccgtgcagaacccaaagggaacaacgagtaaaatcatggtcagcgtgtgggcctttttcgccgtcatatttctggcctcttataccgcaaacctggcagcttttatgatccaagaagagtttgtggaccaggtcaccggcctatccgataaaaaattccagaggcctcacgattacagccccccattcaggttcgggacagtgcctaatgggtcaacagagaggaacattagaaacaattatccttacatgcaccagtacatgacaaagttcaaccagaagggagtggaagacgccctggttagcctgaagacaggcaaactcgacgcattcatttatgacgcagcggtcctcaattataaggcaggcagagatgagggatgcaagttagtgacaatcgggtccgggtacattttcgctacaaccggatacgggattgcactgcagaaaggctcaccatggaaaaggcaaattgacctcgcccttctacaattcgtaggagacggcgagatggaggagctggaaaccctgtggctcacagggatttgtcacaatgagaaaaacgaggtgatgtcctcgcagctcgatattgataacatggccggagtattttacatgctggccgcagctatggctttgtcgctgattactttcatttgggagcaccttttttattggaaattgagattttgtttcactggagtatgtagtgatcggcctgggttgctgttcagtattagtcgcggaatctacagctgtatccacggcgtgcacatcgaggagaaaaaaaagtcaccggacttcaacctgacaggctcccaatctaacatgcttaagttgttacgcagcgccaagaatatcagcagtatgagcaacatgaatagtagccgtatggattcaccgaaaagagcggctgatttcatccagcggggtagtctgatcatggacatggtgagcgataaaggaaatctcatgtactccgataatcgcagtttccagggaaaggagagtatcttcggagataatatgaatgaattgcagacctttgtcgccaaccgccagaaagacaacctgaacaattatgtcttccagggtcagcaccctctgaccctaaatgagagcaatcccaataccgtagaagttgccgtgtccacagagtccaaagccaatagccggccacggcagctctggaaaaagtctgtcgacagcatccggcaggattcgttgtctcagaacccagtttctcagcgggacgaggccacagctgaaaacagaacacattcactgaagtctccgcgatacctgccagaagagatggcgcatagcgacatctctgaaactagcaatcgcgctacatgccacagagagcccgataacagcaaaaaccacaaaacgaaggacaactttaaacgaagcgtggctagcaaataccccaaagactgctcagaggtggagagaacatatctaaagaccaagtcctccagcccacgtgacaaaatctacaccatcgacggcgagaaagaacccggattccaccttgatcccccacaatttgtcgagaatgtaacacttcctgagaacgtggactttccagacccctatcaagatcctagcgagaactttcgtaagggtgactccactctgccgatgaaccgcaatcctctgcataacgaagaggggctatctaataacgaccagtataagttgtatagcaaacatttcactctgaaagacaaaggttccccccatagcgagacctctgagcggtacaggcaaaatagtactcattgtagatcgtgcctgagtaacatgccgacctactcaggacactttaccatgagatctcctttcaagtgcgacgcctgcctgagaatgggcaacctctatgacatagatgaggaccaaatgctgcaagaaactggaatgacaaacgcttggctgctcggcgatgctccgagaaccctgactaatacaagatgccaccctaggcggtag

SEQ ID NO: 224766 - DNA, 3375 bp, Artificial Sequence
  Description of Artificial Sequence: Synthetic coding sequence
atgctaaagattatgcaggactacgattggcacgtatttagcctcgtgacgacaatattccctggctacagggaatttatcagttttgtgaaaactacagtggacaattcctttgtgggctgggatatgcagaacgtcatcactctcgatacctctttcgaagacgccaaaacccaagtgcaactaaagaagattcattcctccgtgatccttctctactgttcaaaggacgaggccgtcctgatcctcagcgaggcccgtagcctgggcctcactgggtatgactttttttggattgtgccttcgctggtgtctggcaatacagaattgattccaaaagaattcccatccggactcataagtgtttcctatgacgactgggattactctctcgaggcaagggtcagagacgggatcgggatcctgaccaccgctgcttcgtctatgctggaaaaattttcctatattcccgaggcaaaagcatcctgttatggccaaatggagaggcccgaggtgccaatgcataccctgcatccatttatggtgaatgtgacctgggacggtaaagatttgtcctttacagaagagggctatcaggtccacccaaggctggttgtcattgtgctgaataaggaccgcgaatgggaaaaagtgggcaaatgggagaaccataccttgtctctgcggcacgctgtctggccgagatacaaaagctttagcgactgtgagcccgacgataaccatctgtcaatcgtgactctagaggaagctccattcgtaattgttgaggacattgatcccctgacagaaacatgcgttcggaacaccgtaccctgcagaaagtttgtcaagatcaacaactctaccaatgagggtatgaacgtgaaaaagtgctgcaagggattctgtattgatattctgaagaagttatccagaactgtcaagttcacttatgacttgtatctggtgacaaacggcaaacacggcaagaaggtcaataatgtgtggaatggtatgatcggtgaggtcgtataccagcgagcagttatggcggtgggtagcttgaccataaatgaggagagatctgaagtcgtggacttctcagtgccctttgtcgagaccgggatatcagtgatggtttcccgcagtaacggaacagtctccccctccgccttcttggaaccctttagtgcgagcgtttgggtgatgatgttcgtgatgctgctcatcgtgagcgcgatcgccgtgttcgttttcgaatactttagccccgtcggttataatcgtaatctggccaaaggtaaagcacctcacggtccatcttttacgattgggaaggcaatttggcttttatggggtcttgtatttaacaactccgtgcctgtgcagaatcctaagggcaccacaagtaagataatggtcagtgtgtgggcattctttgcggtcatatttctggcttcatataccgcaaacctggccgcatttatgattcaggaagagtttgtagaccaggtgactgggctgagcgacaaaaagttccagcgtccccatgactacagccctccctttagattcggaacggtgcctaacggatcaacagagcggaacattcggaacaactatccatacatgcaccagtacatgacaaagtttaatcaaaagggggtggaggatgcgctcgtgtctcttaagactggtaaactggatgccttcatctacgatgcagctgtgctcaattacaaggctgggcgtgacgaaggttgtaagcttgttactatcgggagcggttatatattcgccaccactggatatggaatagcactccaaaagggcagtccttggaaaagacagatcgacctcgccctgctccagttcgtgggggacggagaaatggaagagttggagacactatggctaacaggtatctgtcataacgagaaaaatgaggtcatgtcttctcagcttgatattgacaacatggccggagtcttctatatgctcgcagctgctatggctctcagcttgattacatttatctgggaacatctattttattggaagttgcgcttctgctttactggggtgtgcagtgaccggccaggactgctcttctctattagtcgaggtatatacagctgtattcacggagtgcacatagaggaaaaaaaaaaaagccctgattttaacctcactggaagccagtccaatatgctgaaattgcttcgctctgccaagaacatttcctcaatgtctaatatgaactcctcacgaatggattcccctaagcgcgctgccgacttcattcagaggggcagtctcattatggatatggtctctgataagggcaatctgatgtatagcgacaaccgtagtttccagggtaaggagtctatcttcggcgacaatatgaacgaacttcagacattcgtggcaaataggcagaaagacaacttaaataattacgtttttcaaggtcagcaccctctgaccttgaatgagtccaaccctaatactgttgaagtcgccgtcagcacggagtcaaaggccaacagccgaccgagacaactctggaagaagtcggttgatagcatccgtcaggatagcctttcacagaacccagtgagtcagcgcgacgaggctacggccgagaaccgtacacatagtctcaaatccccgaggtacttgcccgaagagatggctcactcagacatcagcgaaacctccaaccgcgcaacatgccatcgggaacctgacaatagcaagaaccacaaaacgaaggataacttcaagcgcagcgttgccagcaaatatcctaaggactgttctgaagttgagagaacttacctgaaaactaaaagcagcagccccagagacaagatttatacaattgacggagaaaaagaacccggattccatttagatccccctcagttcgtagaaaatgtcaccctgccagagaatgtggattttcctgacccttatcaggatccgtcggagaacttcagaaagggtgatagtacactccccatgaaccgcaacccacttcataacgaagaggggctctctaacaacgatcaatataaactgtatagcaaacactttacactgaaagacaagggctctcctcactctgaaacgtccgaacgttaccgccagaactccacacactgcaggtcttgtctctctaatatgccaacttactctggtcattttacgatgcgatctcctttcaaatgtgatgcctgcttgaggatgggaaatttgtacgacattgacgaagaccagatgcttcaagaaaccggcatgaccaatgcttggttattaggagacgctccaagaacccttaccaatactcggtgccaccctcgtaggtag

SEQ ID NO: 224767 - DNA, 4455 bp, Artificial Sequence
  Description of Artificial Sequence: Synthetic coding sequence
atgaaaccaagggcagaatgttgttctcccaaattttggctggtgctggcggttctggccgtgtccggaagcagggcaaggagccagaagagtcctcccagcattggtatagcagtcatactggttggcacaagcgacgaggtggcaatcaaagacgcccatgagaaagatgacttccaccatctgagcgtggtccctagggtagagctggtggccatgaacgaaaccgaccctaagagtatcattacaagaatctgtgacttgatgtctgataggaaaatccagggagtcgtgtttgccgacgacacagaccaagaggctatcgcgcaaattcttgatttcatatccgcccagactctgacgccaatactgggaattcacggcggatcaagtatgataatggccgacaaagacgagtcttctatgttttttcagttcggcccaagcattgaacagcaggcatccgtcatgctgaatataatggaggaatatgactggtatatattctccatcgtgaccacctatttcccgggataccaagattttgtgaacaaaattcggagtaccatcgaaaattccttcgttggatgggagctcgaggaggtgctcctgttggacatgagccttgacgacggggattctaaaatacagaatcagctcaagaaacttcagtctcctatcatactcctatattgcacaaaggaggaagcaacctatatatttgaagtggctaattcagtcgggcttaccggttacggctatacatggattgtgccatcactcgtcgccggagatactgacacggttcctgctgagttccctaccggactaattagcgtcagctatgatgagtgggattatggcctgcccgctagagtcagggacggtatcgctattatcacaacagcggcttctgatatgctttccgaacacagcttcataccggagccaaagagttcgtgttacaacacacatgaaaagaggatctatcaaagcaacatgctgaaccggtatctgattaatgttaccttcgagggcaggaacctcagtttcagcgaagacggctatcaaatgcacccaaaactggtcattattctgttaaataaagaacggaagtgggaaagagttggaaagtggaaagacaagtcccttcagatgaagtactatgtttggcctcgcatgtgtccagagactgaagaacaggaagacgatcacctgagtattgtgacactcgaagaggccccattcgtcatcgtggagtccgtcgatcccctttcaggtacatgcatgcggaatactgtcccctgtcagaagcgaatcgtaacggagaataagactgacgaagagccagggtatattaaaaaatgctgcaaaggcttctgcatcgacatacttaagaaaatctctaaatctgtcaaatttacttacgacctgtacctggtgacaaacggcaagcatggcaagaagataaacggaacttggaacgggatgattggcgaagttgttatgaaacgagcgtatatggccgtgggatctctcactatcaacgaggagagaagcgaggtcgtggattttagtgtgccttttattgagacgggcatcagtgtgatggttagtcgctccaacggtacagtttcaccatccgcttttctcgagccattcagtgctgacgtctgggtgatgatgtttgtaatgctgttaattgtcagtgcagttgccgtgtttgttttcgagtacttctcacccgtgggctataatagatgtctggccgacggcagggaacccggaggtccatcattcacaattggaaaggcaatctggctcctttgggggcttgtgttcaataatagcgtaccagtgcagaatcctaaaggcactacatctaagatcatggtctcagtctgggcgttcttcgcagttattttcctggcatcctacaccgctaatctggcagcctttatgatccaggaagaatatgtagatcaggtgtctggtttgagcgataagaaattccagcgccctaacgacttcagtcccccttttagatttgggaccgtccctaatggcagtaccgagagaaacattcgaaataattacgctgaaatgcacgcgtatatgggtaagtttaatcaacgcggagtcgacgatgccttgctgtccctgaagacaggaaaactcgatgctttcatctacgacgccgctgtgctgaattacatggcaggcagggacgagggctgcaaactggtgacaattgggtcggggaaagtttttgccagcactggctacggaatcgccattcaaaaggatagcggctggaaaagacaagtggatttggcaatactgcagctcttcggcgatggtgagatggaagaactcgaggcactgtggctcacaggaatctgtcataatgaaaaaaacgaagtgatgtcaagccagctggatatcgataatatggctggcgtcttctatatgctgggagcagctatggctctgtccttgattacattcatctgcgagcatttattttattggcagtttagacactgttttatgggcgtctgctccgggaaaccagggatggtgtttagtatctcacgcggaatatattcctgcatccacggcgtagctatcgaggagaggcagtctgtcatgaattcgcctacagctactatgaacaacactcactccaacatcctgcgcctgctacggaccgctaaaaatatggctaatctatccggggtgaatggaagccctcaaagcgccttggactttatccgcagagaaagctctgtctacgacatcagcgaacacaggcgcagcttcactcattcggattgtaagagttataataaccctccatgcgaggaaaaccttttttccgattatatatctgaggtggagagaacttttggcaatcttcagctgaaagatagcaatgtgtatcaggaccattaccaccaccaccaccgtcctcattctatcggttcagcgtcctcaatcgatggattatacgactgcgacaatcctccttttacaacacagtctagatcaatatcaaagaaaccgctagatatagggctgccctcttcgaagcattcacagctctccgacctctacggcaagttctcttttaaatctgatcgatatagtggacacgacgatcttatccgcagcgacgtgtctgatatttcgacccacaccgtcacatacgggaacatcgaagggaatgctgccaagcggcgaaagcagcagtacaaggacagcctcaagaagcggccagcatctgccaagtcccgcagagaatttgatgagattgagttagcgtatagacgacgacccccaaggagcccagatcacaaaaggtatttccgagacaaggaagggctcagggacttctacttggaccagtttcggacaaaagagaactctcctcactgggagcacgtcgacttaacagatatatacaaggagcgctctgatgatttcaagcgggattcggtgagcgggggtggcccttgcaccaacagatcccacataaaacacgggacaggggataaacacggcgtagtttccggcgtacctgccccttgggaaaagaacctgacaaatgtagaatgggaagaccgctcaggcggtaatttctgcaggagttgcccatctaagttacacaattactcaacgaccgtgaccggccagaactccggcaggcaagcctgtatccgttgcgaggcctgtaaaaaggccggaaacttgtacgacatcagtgaggataactctctgcaagagcttgaccagcccgcagctcctgtggctgtcacttctaatgccagtactactaagtacccccagagcccgactaacagcaaggcccagaagaaaaatcgcaataagctgcgcagacagcatagctacgacaccttcgtcgatttgcagaaggaagaggctgctctggccccacgaagcgttagcctcaaggacaaaggacggttcatggatggcagcccttatgcgcatatgtttgaaatgagcgcaggcgagagcacgttcgcaaacaataaatctagcgtgccaacagccggacatcatcatcataacaaccctggcggaggctacatgctttctaaatctctgtaccctgaccgggtgacccagaatccgtttataccaacctttggcgatgaccagtgtctcctccatggcagcaagagttactttttcaggcagccgacggtcgccggagctagcaaggctcggccagacttcagggctctcgtgaccaacaagccggttgtctccgccctgcacggcgctgtacctgccaggtttcagaaagatatctgtataggcaaccaatcgaacccctgcgttcctaataataagaaccccagggcatttaacggctcaagcaacggccatgtctacgaaaaactgagttctattgagagcgacgtgtag

SEQ ID NO: 224768 - DNA, 3702 bp, Artificial Sequence
  Description of Artificial Sequence: Synthetic coding sequence
atggggggagccttaggcccagccttgttgcttaccagcctcttcggagcctgggcaggactggggcctggacagggcgagcaggggatgacagtggccgtagtgttttcctccagcggtcctccccaagctcagttccgggctcgcctgacacctcagtcgttcttagacctgcccctcgaaatccagcccctgacagtgggagtcaacacaactaatccaagctccctcctgacccaaatatgcggcctgctgggagccgctcatgtgcatgggatcgtatttgaggataacgtggatactgaagccgtggcacagatcctcgattttatctcgtctcaaactcatgtccccattttatctatttcaggaggctccgctgttgtgttgacaccgaaggagcctggatcggctttcctccagctcggcgtgagcctggagcagcagttacaggtactttttaaagtgctggaggagtatgactggtctgcatttgctgtgattacgtcactgcacccagggcatgccttgttcctcgaaggcgtccgggcagttgccgatgccagtcacgtttcatggcgcctgttagatgtagtgactctagaactcggcccagggggaccgcgagctcgaacgcagaggctgttgaggcagctcgatgctcccgtcttcgtggcttactgtagccgggaagaggctgaggtgttgttcgccgaagctgcccaagcaggactcgtcggcccaggccatgtgtggttggttcctaatctggcacttggttctactgatgcccctcccgcaacattccctgttgggcttatctcagtggtcacagagagttggagactcagcttgcggcagaaggtgcgtgacggtgtcgcaatattggctctcggagctcatagctattggcgacagcatgggaccctgccagctccggctggcgattgcagagtgcatccgggtcctgtgtcaccagcgagggaggccttctatcgccatctgctgaacgtcacctgggagggtcgggacttttctttcagccccggaggctacctggtccagcccaccatggtggtgatcgcccttaatcgtcaccgcctctgggaaatggtgggtcgatgggagcacggggtgttatacatgaaatatcccgtctggcctaggtattcagccagcctacagcctgtcgtcgacagccgccatctcacggtcgcgacattagaagaaaggccgtttgtcatcgttgagtctccagacccgggaaccggcggttgcgtgccaaacactgtgccatgtcgcagacagtctaatcacacgttctcgtcaggggacgtcgctccctacacaaaactttgctgcaaggggttctgtattgacatactcaaaaagctggcccgagtcgtgaaattttcatacgacctgtaccttgtaactaacggtaagcacggcaagagagtgagaggggtttggaacggaatgattggcgaggtgtattataaacgggctgacatggccattggaagcttgactattaatgaagaacggtctgaaattgtagacttcagcgtccctttcgtcgaaactgggatatccgtcatggtggccaggtctaatgggacagtcagtccttcagcattcttagaaccatactctcctgccgtttgggtaatgatgttcgtgatgtgtctgaccgtggtcgctataacggtgtttatgttcgagtacttttccccggtgtcttataaccagaatctcacaaggggcaaaaagtcggggggaccggcatttactatagggaagagcgtatggctgttgtgggcccttgtgttcaataattcggtgcccatcgagaatcctaggggcaccacatctaaaattatggtgctggtctgggctttttttgcggtgatctttctggccagctataccgcaaaccttgcagcttttatgatccaagaacaatacattgatacagtgtcagggttgtctgacaagaagttccaaaggccccaggaccagtaccccccatttcggtttggcaccgtaccaaatggcagtactgagcggaacattaggtctaattatcgagatatgcacacacatatggtgaagttcaaccagcggtcggtggaagacgccttgacttccttgaaaatgggaaaactggatgccttcatttatgatgctgcagtcctaaactatatggctggtaaagacgaaggctgcaagttagtaaccattggctctggtaaggtcttcgccacaactggatatggcatcgcaatgcagaaagactctcactggaagagggccatcgaccttgcccttctgcagttcctaggtgatggtgaaactcagaagttagagaccgtctggctaagcggcatctgccaaaatgagaagaatgaggtcatgtcctccaagttggacattgataatatggctggagtgttctacatgttgctagtagctatgggcctggcgctcctggtgtttgcgtgggagcatcttgtgtattggaagctgcgccacagcgttccgaatagcagccagctggacttcttgctggcttttagccgtggaatttactcatgcttcagcggcgttcagtccctggcaagcccaccccgacaggcttcgcccgacctcactgcatcaagcgcccaggctagcgtgctgaaaatgttacaggctgcacgggatatggtgaccaccgccggagtgtcatcctcactcgacagggccactcgtacgattgagaattggggaggagggaggcgagcccctccgcctagcccatgtccgacgccgaggagcgggcctagcccgtgtctgccaacccctgatcctccgccagaaccttcacctactggctggggtccacccgacggaggcagggcagccctcgtgcgccgtgccccacagcctcctggtaggcctcctacacctggccctcctctatccgacgtgtcacgcgtgtcccggagacccgcttgggaagccaggtggcctgtgagaaccggccattgtggccgacatttgagtgcctccgagagacctttgtctcccgcaaggtgtcattattcatcttttccccgagccgacaggagtgggcgtccattcttgccactgtttccagagctggaagatctgccactgctcggccctgagcagcttgccaggcgggaggccctgctgcacgctgcctgggccaggggttctcggccacgccacgcttctctgccatcaagcgtcgcagaggcctttgccagaccctccagccttcccgctggctgtacgggtcctgcatgtgcgagaccggatgggcacagcgcatgcaggcgtctagctcaggcacaaagtatgtgcctgcctatctacagggaggcgtgccaagaaggagagcaggccggagcccctgcctggcagcaccggcagcatgtttgtctgcacgctcacgcacatctgcctttctgttggggggcagtatgtccccacctcccaccgtgcgcctcccatgggtcttggctatccggagcctggggaccattgggacatcgcggacgcacgctgggcctgggcacgggttatcgcgactccggcggactagatgagatttcccgggtggcaagaggaacgcagggatttccaggtccatgtacttggcggagaatcagttcactcgagagtgaggtgtag

SEQ ID NO: 224769 - DNA, 2724 bp, Artificial Sequence
  Description of Artificial Sequence: Synthetic coding sequence
agaggtcagggcggagatacccgctccaaggggacccgccagcccgagccacctggtgcatcgcgagacccggctagaagttgttgggaccctccagttgacatggggggagcactgggacctgccttgctcctcacaagcttatttggagcttgggctgggttaggtcctggacagggggaacaaggcatgactgtcgcagtggtattttctagcagcggcccaccccaggcccagttcagagctcgcttaaccccccagtcttttctggacctgcccctcgaaatccaaccgttgactgtaggcgtgaacaccacaaacccctcctccctgctcacccagatttgtggactcttgggagctgcacacgtgcacggcatcgtgtttgaggacaacgtagacactgaggctgttgcccaaatactcgatttcatttcgtcccagactcacgtccccatcctgagcattagtggaggtagcgcagttgtgctcacaccgaaggaaccaggtagcgctttcttgcagctgggtgtctctctcgagcaacagctgcaggtgttgtttaaagtgctggaggaatacgattggtctgcatttgccgttattacctccttgcatccgggacatgccctgttcctggaaggtgtcagggctgtggcggacgcatctcatgtcagctggcggctgctggacgtcgtgactctcgagttgggccctggaggcccacgcgctcgtacccagcgtcttctgaggcagcttgatgccccagtgttcgtcgcctattgcagccgcgaggaagccgaggtgctgtttgcggaagctgcccaggcaggcttggtgggcccaggtcacgtgtggcttgtgccaaatttggcattgggatccaccgacgcccctcccgcaaccttccccgttggactgatttccgtcgtcactgagtcctggcggcttagtcttcgacaaaaagtgagagacggagttgcaatcttagcgttgggtgcccatagttactggcggcagcacggaacgctgccagccccagcaggcgactgcagagtccatccaggcccagtctctcccgcaagggaggcgttctacaggcatctgctcaacgtgacgtgggagggcagggacttttctttctcacccggaggatacctggtacagcctactatggtcgtgattgcactgaaccgccatcgtctgtgggaaatggtgggcagatgggaacatggagtcctatacatgaagtaccccgtgtggccccgatattcagcatctctccagcctgtcgtggattcccggcacctgaccgtagccacactcgaagaaaggcctttcgtgatagtggaatctcccgacccgggaacaggcggttgtgtaccgaacacagtaccatgccgtcgccagtctaatcacacattcagctcgggcgacgtggcaccctacaccaagttgtgttgcaagggattttgcatcgatattctgaagaaactggcacgggtggtgaagtttagctatgacttatacctagtcacaaatggcaagcacggtaagcgggtgcgcggtgtttggaacggaatgataggcgaggtgtactacaaacgagcagacatggccatcgggagtctcactattaatgaagagaggtcggagattgtcgatttctctgtgcctttcgtggagactgggatatctgtcatggttgctcgtagtaacggaaccgtttctccctcagcattcctggagccctactcccccgctgtgtgggttatgatgtttgtgatgtgcttgacagtggtggctataactgtgtttatgtttgaatacttttctcccgtatcatacaaccagaacctcactagaggaaaaaagagcggtgggcctgcctttactataggaaagtcagtgtggttgctctgggctttggtatttaataatagcgtgccgatcgagaacccaagaggcacgactagtaagattatggtgttagtgtgggctttctttgcagtgatattcctcgcaagctacacagctaatctcgccgcattcatgatccaagagcagtatattgatacagtgtccgggctatcagacaaaaagttccagcggcctcaagaccagtacccccctttccgttttggcaccgtccctaatggctcaaccgagaggaacattagaagtaactacagagatatgcacacgcacatggtaaagttcaatcagcgtagcgttgaggatgcactgacatcactcaaaatgggcaaactggacgcatttatatacgatgctgcggttctgaactacatggccggaaaggacgaaggttgtaaactcgttaccatcggaagcggcaaggtgttcgccacaacaggatatggcattgcgatgcagaaggactctcattggaaaagagctatcgacctggccctgcttcagtttctaggggacggcgagactcaaaaactggaaacggtctggctgagcggcatttgtcagaacgagaagaatgaggtgatgtcctctaaattggatattgacaacatggccggtgtgttctacatgttattggtggcgatgggcctcgctctgctggtgtttgcctgggaacacctggtctattggaaactgcgccatagtgtgcccaatagctcccaattagacttccttctggccttctcacgggtgggggcacatccctctccccaccggcctaagttctag

SEQ ID NO: 224770 - DNA, 4011 bp, Artificial Sequence
  Description of Artificial Sequence: Synthetic coding sequence
atgaggggggcagggggacccaggggtccgcgagggccagcgaagatgctgctcctcctcgcccttgcttgtgcctctcccttccccgaggaggcacctggtcccggtggtgccggaggtcctggagggggtctaggcggtgcacgcccactgaatgtggccctagtcttctcagggccagcttacgcagccgaagctgccagattggggccagccgtcgcggcagccgtcaggtcccccggactcgacgtgcgaccagtggcactggtgcttaacgggtcagacccaaggtccctcgtgctgcagctgtgcgatctgctgagcggcctacgcgtgcacggagtcgtgtttgaagatgactccagagcacctgcagtggccccaattctggacttcctatcggctcagacatcacttcctattgtcgcagttcacggcggagccgcactcgtactgacgccaaaggaaaagggatcgacattcctgcagctgggctcgtctactgagcagcagctccaggtgatcttcgaggttttagaagagtacgactggacctcctttgtagccgtgaccactcgagcgccaggtcacagagccttcttgagctacattgaggtgctgaccgatggctctctcgtgggctgggagcacagaggcgcattgaccctcgacccgggagcaggagaagctgtcctctccgctcagctgagatccgtctcagcccagatcaggctcctgttctgtgccagagaagaggccgaaccagttttccgcgctgcggaagaagccggactaactggctctggatacgtctggtttatggtgggtcctcagctagcaggaggcggtggaagtggcgctccgggtgagcccccactgctccccggtggcgcaccgcttcctgccggtctctttgccgtgcgctccgctgggtggcgcgatgacttggccaggcgggttgctgcaggggtggctgtagtggctaggggcgcacaagcactgctacgagactacggattccttcctgagctggggcatgactgccgggctcaaaacagaacccacaggggcgaaagcctgcaccgctactttatgaatattacatgggataacagggactatagctttaacgaggatgggttcctcgtgaacccttctctggtcgtaatttcactcactcgggatcgaacatgggaggttgttggctcttgggagcagcaaaccctccgcttgaaataccccctatggtctcggtatggccgattccttcagccagttgacgacacccagcatctaaccgtagcgactcttgaggaacgcccatttgttatcgtggaacccgcagatcccataagtggtacctgtatccgggactctgtgccttgccggtcgcagctgaatcggactcacagcccccctccggacgcccctagacccgagaaacgctgctgtaagggattctgcatcgatatcctcaaaaggctagcccacacaattggcttctcttatgacctttacctagtgaccaacggcaaacacggcaaaaaaatagacggcgtctggaatggaatgataggggaggtcttctaccagcgggcagacatggcgatcggctcactgactattaatgaggaacgctccgagatcgtggatttctctgtgccatttgtggaaactgggatatctgttatggtggccagaagcaacggaacggtgtcccccagtgcattcctcgagccatattcccctgccgtgtgggtcatgatgttcgtgatgtgcctgaccgtcgtagccgttacagtgtttattttcgaatacctgtcccctgtaggttataaccggagcttagccacaggcaagcggccaggcggatctacgttcacaatcgggaagtccatctggttgctctgggcccttgtctttaataactccgttcccgttgagaatcctcgtggaaccacatcaaaaattatggtgctggtgtgggcttttttcgcagtgattttcctggccagctatacagccaacttagccgctttcatgatccaggaggagtatgtcgataccgtatcgggcctaagtgaccgaaaattccagagaccgcaagaacaatatcctccactgaagtttggtaccgtccctaacggtagtacagagaagaatataagaagcaactatcccgacatgcattcttacatggtgcgctacaatcagccaagagtggaagaagccctcactcagctgaaggccggtaagctggacgcttttatatatgatgctgctgtactcaattacatggcacgcaaggatgaagggtgcaagctggttaccatcggctcgggaaaggtcttcgcgacgactggctacggaattgcccttcataaaggcagcagatggaaacgcccaatagacctggccctgctgcagtttctgggtgacgatgagatcgagatgctggagaggctttggctgagtgggatttgccataacgataaaatagaggtgatgagcagtaagttggacatcgacaatatggctggcgttttttacatgctactcgtggcaatggggctgtccttactggtgttcgcatgggagcacctggtttattggagactccgacattgcttggggcctacacatcgcatggattttcttctcgctttcagccgcggtatgtacagctgctgctcggctgaagccgcaccgccaccggcaaagccaccacctccaccacagcccctgccctcacccgcttatcctgctcctaggcccgcaccaggccctgccccattcgtgccgcgtgaacgagcctcagtggaccggtggcgtcgaactaagggtgctggcccacctggaggggctgggctggccgacggcttccacagatattacgggcctatcgaaccccagggtttaggcctgggcctaggggaggcaagggccgctccgagaggtgccgcagggagacccctgagcccacctgccgcacagcctcctcagaagccacccccttcatatttcgctattgttcgggacaaagaaccagccgagcccccagctggtgcttttcccggtttcccatccccgccagctcctcctgcggcagccgcaaccgcagttggccctccgctttgccgcctggctttcgaggatgaaagccctcccgctcccgctcgatggcccaggagcgaccctgagtctcagcccctgctgggacccggagcaggcggagccggaggcaccggcggagccggtggaggcgctcctgcggcacctccaccctgccgcgctgcaccacccccttgtccatatctggaccttgaaccatcccctagtgacagtgaggactccgagagtttgggcggagcctctttaggcggactggaaccgtggtggtttgcggacttcccatacccttatgccgagcgactgggtcccccacccggtaggtactggtctgttgacaaattaggcggatggagggcgggatcatgggattacctgccacctcgctcaggtcccgctgcttggcactgtagacattgcgccagcctcgaactactgcctccacctcggcatttaagctgttctcatgacgggctcgacggcggatggtgggccccacccccacctccatgggctgccggtcctctgcctcgccgtagggcgagatgcggctgccctcgctcccatcctcaccgaccgagagcatctcatcgaacccccgctgccgctgctccccaccaccacaggcaccgcagggcggctggaggatgggatctgcctccccctgctccaactagtcgatcactggaagatttatcctcttgcccgagggctgcgccagctaggcgtttaactggaccatccaggcacgcacggaggtgtcctcacgctgcccattgggggcctcctttgcctactgcctcacacagaagacatcgcggaggggacctgggcactagacgagggtctgctcatttttcctcattggaaagtgaggtgtag

SEQ ID NO: 224771 - DNA, 1116 bp, Artificial Sequence
  Description of Artificial Sequence: Synthetic coding sequence
atgagtcatgaaaagagtttcctagtgtccggcgacaactatcccccaccaaatccaggctatccaggagggccacaaccacccatgccaccctacgctcagcctccctacccaggcgcaccatatccacaaccccctttccagccctcaccttacggacagcctggctatcctcatggtccctcaccatacccacagggtggctacccccagggcccttaccctcagggaggctatccgcaaggaccctatcctcaagagggatatccacagggcccataccctcagggtggatatcctcaagggccttacccacagtcacccttccctcccaacccgtacggccagcctcaagtgtttccgggacaggaccctgacagcccccagcacgggaactaccaggaggaaggccctccctcgtattatgacaaccaagattttccagctaccaactgggatgacaagtcaatacggcaggcgtttatcagaaaggtgttccttgtgcttacacttcagctgtcagtgacactgtctaccgtcagcgtgtttaccttcgtcgcagaagtgaagggatttgtgcgcgaaaacgtttggacatattatgtaagctacgcagtgttcttcataagtcttatcgtgttgagttgctgcggcgattttcgccgaaagcatccctggaatctcgtagctctatcagtactgaccgcatctctttcgtatatggtgggtatgattgcatctttttacaacaccgaggccgttataatggccgttggaatcactaccgcagtctgttttaccgtggtcattttttccatgcaaactagatatgactttaccagttgcatgggcgtgctgcttgtgtcgatggttgtactttttatttttgcaatcttgtgcatattcattcgcaatcgcatcttggaaatcgtctatgcgagccttggtgctctgctctttacctgtttcctggccgtcgatacacagctgctgctcggcaacaagcagctgtccctgtctcccgaagagtatgtttttgccgctttgaatctgtacactgacatcatcaacatcttcctttacattctgaccattatagggcgagcgaaggagtag

SEQ ID NO: 224772 - DNA, 1116 bp, Artificial Sequence
  Description of Artificial Sequence: Synthetic coding sequence
atgtctcacgaaaagagtttcctggtcagtggcgacaattatccaccgccaaatccaggctatcctgggggtccccaaccgcctatgcctccgtatgcacagcccccataccctggagcgccttaccctcaaccccctttccagccctcaccctacgggcagcctggatacccccacgggccttcaccctacccccagggtggttacccccagggcccatatccacagggagggtatccacagggaccttacccccaggagggctatccgcagggtccatatccccagggtggctacccccagggcccatatccacagagcccattccctcctaatccctatgggcagccgcaggtgtttccagggcaggatcctgacagtcctcaacacggaaattatcaggaggagggccctccatcttactacgacaaccaggacttccccgctacgaactgggacgataagtcgattcgtcaggccttcatcagaaaagtcttccttgttctgactctccagctgagcgtgactctcagcaccgtgtcagtttttacttttgtggctgaggtgaagggtttcgtgagagagaatgtttggacctactacgtttcgtatgccgtgttcttcattagtttaatcgttcttagttgttgcggcgactttcgcagaaaacatccctggaacctggtggctctatccgtgctgactgctagtctgtcatacatggtgggaatgatcgctagcttctacaacacggaagccgtcatcatggctgtgggaatcactaccgccgtctgtttcaccgttgttattttttcaatgcagacccggtatgacttcacttcttgtatgggcgtcttgctggtaagtatggtcgtactgttcatatttgcaattctctgcattttcatcaggaatcggatcttggagatagtctacgcttccctgggcgctcttctttttacgtgctttttagcagtcgatacacaattgttgttagggaataagcagctgtccctctcccccgaagaatacgtgtttgctgctttaaatctctacacagatatcattaatattttcctgtacatccttaccatcattggcagggccaaggaatag

SEQ ID NO: 224773 - DNA, 825 bp, Artificial Sequence
  Description of Artificial Sequence: Synthetic coding sequence
atgtctcatgagaagagtttcttggtgagcggagacaattaccccccacctaaccctgggtatccaggcggaccacagccccctatgcctccatacgcacaacctccataccctggtgcaccatatccacaacccccattccaacccagtccgtacggacagccagggtatccgcacggcccatccccataccctcaaggcggatacccacagggcccttacccccagggcggttatccgcaggggccttatccacaggagggatacccccagggaccctatccgcaggggggttatccacaggggccttatccccagagccctttcccgccaaatccgtacggccaaccacaggtgtttcccggacaagatccagacagcccacagcacgggaattatcaggaagaaggccctccttcttactatgacaatcaagacttcccagctactaattgggatgataagtccatccggcaggcttttattagaaaggtgttcctggtcttgactctgcaactgtccgtgacattgtcaaccgtgagtgtgttcaccttcgtcgctgaggtcaagggctttgtgagagaaaacgtctggacttactatgtgagctatgccgtattctttatctctctgattgtactgtcctgctgcggggattttcggaggaagcacccttggaacctggtggctttgtcggtattgactgcaagtctgtcctacatggtcggcatgatcgcgagtttctacaacaccgaggccgtcattatggcggtggggatcaccaccgccgtctgcttcaccgtcgttatcttctccatgcagtag

SEQ ID NO: 224774 - DNA, 306 bp, Artificial Sequence
  Description of Artificial Sequence: Synthetic coding sequence
atgtctcacgagaaatctttcctggtctcgggtgacaactaccctccgcctaaccccggatacccaggtggaccacagccacctatgcctccatatgcccagcccccttatccaggagccccttaccctcagccaccctttcagccgtccccttacggtcaacctggttaccctcacggaccatctccatatccacagggaggatatcctcaggggccttatcctcagggcggatatccccagggcccttatccccaagagggatatccccaggggccttacccgcagggagggtatccacaatag

SEQ ID NO: 224775 - DNA, 1059 bp, Artificial Sequence
  Description of Artificial Sequence: Synthetic coding sequence
atgtcacacgaaaaaagctttcttgtgagtggagataattacccccctccatatccaggcgctccctacccacaacctccattccagcccagtccgtatgggcagcccggttatccgcacggtcccagcccttatccacaaggagggtacccgcaagggccttatccacagggcggataccctcagggcccatacccacaggaggggtaccctcaaggaccgtacccgcagggaggctacccccagggaccgtaccctcaaagcccatttcccccaaatccctatggacagccccaggtgttccccggacaggatccagacagtccccagcatgggaactaccaggaggaagggcctccttcttactatgacaatcaggacttcccagcgaccaactgggacgataagtcaatccgtcaggcgttcatccgcaaggttttcttagtgctgaccttacagttaagcgtcacactaagcactgtctccgtgtttacttttgtcgccgaggtcaagggctttgtccgcgagaacgtgtggacatactacgtgtcctacgccgtattttttatctccctcattgttcttagctgctgcggcgatttccgcaggaaacatccttggaatctggtggccctaagtgttctgacagcttcgttgtcctatatggttgggatgatcgcgtccttctacaataccgaagccgtcatcatggccgttggcatcacgacagcagtgtgcttcaccgtcgtgatcttttcaatgcagacgaggtatgactttaccagctgcatgggcgtgctgctggttagcatggtcgttctcttcattttcgcaattttgtgcattttcatccggaatcgcatcctcgagatagtctacgcctctctgggggcattgctcttcacgtgttttttggctgtggacacacagctgctgctgggaaacaaacagttgtcactatcgcccgaagaatatgtattcgccgctcttaacctgtatacagatatcatcaacatcttcctttatatactcacgatcataggcagggccaaagaatag

SEQ ID NO: 224776 - DNA, 3348 bp, Artificial Sequence
  Description of Artificial Sequence: Synthetic coding sequence
atgagacgcctctcactctggtggctactctcgcgagtatgcctcctcctgccccctccttgtgcgctcgtgctggctggggttccttcctcctcttcccatccacaaccctgccaaatactgaaacggatcggacacgcagttcgcgtgggagcagtccacctccagccatggaccaccgcccctcgcgcagcctcccgtgcacccgatgattcccgggctggtgcacagagggacgaacctgaacccggtacccggagaagtcctgctccctccccaggggcaagatggcttgggtctacactacatggcagaggtcccccaggcagtaggaaacctggagaaggcgctcgggctgaagccctgtggccaagggacgccctgctgtttgccgtggataaccttaatcgagtggaggggctactgccttataacctgtctctggaggtcgtcatggccatcgaggctggactcggtgatctgcccctgctgcccttcagttccccttcgtcaccgtggtcgagtgatccatttagttttctgcagtcagtttgccacaccgtggtggtgcaaggcgtctctgcactccttgcgttcccacagagccagggagagatgatggaattggatcttgtaagtctcgtgctacatatccccgtgatttcaattgtcagacacgaattcccgagagagagccaaaatccattgcacctgcaattatctcttgaaaattccctaagctcagatgcagatgtgacagtgagtatactgacaatgaataattggtataacttcagcctgcttctttgtcaagaggactggaatattacagattttctgctactaactcagaacaattctaaattccacctggggtcgattattaatatcaccgccaacctgcccagtactcaagatctgttatcgttcctgcagatccagctggaaagcattaagaattccacgccgacggtcgttatgtttggatgtgacatggagagcataaggagaatttttgagatcactactcagtttggggtcatgccacccgagctgaggtgggtccttggagactcacaaaatgtcgaggagctgcggaccgagggcctgcccctggggctgattgctcatgggaagacgactcagagtgtatttgaacattacgtacaggatgccatggagttggtggctcgcgcagtcgccacggcgaccatgattcagcctgaattggcccttattccatcgacaatgaattgtatggaggtggaaactacaaacctgacctccggacagtatctgagccgcttcctcgccaacacaacctttagaggattgagcggctccatcagggtcaaaggcagcaccatcgtgtcttcggaaaataatttctttatctggaaccttcaacacgatcccatggggaaacccatgtggactagactgggctcctggcagggcggaaagatcgtgatggattacggaatctggcctgaacaggcgcaacggcacaaaacccacttccagcatccttccaaattacatttgcgcgtggtaactctcattgagcaccccttcgttttcactagagaggtagacgacgaggggttgtgtcctgctggccagttgtgcctggatccaatgaccaacgactccagcacactcgattcactcttcagctccctgcattcgagcaatgacaccgtaccaattaagttcaaaaagtgttgctacgggtactgcattgaccttctggagaagatagccgaggacatgaacttcgattttgatctgtacatcgtcggggacggcaaatatggcgcatggaaaaatgggcactggacaggcctggtgggggatctgcttaggggaactgcccacatggcagttacgagtttctctatcaacaccgcccgatctcaagttattgattttaccagtccctttttttccacttcactcggaattcttgtgcgcacacgcgacaccgccgcacctattggagcattcatgtggcctctgcattggaccatgtggttagggatcttcgtggccctccatattaccgccgtgttcctgacgttgtatgaatggaaatcaccattcggtctgacacctaaagggaggaaccgcagcaaggtgtttagcttcagcagtgccctgaacatttgttacgctctgctattcggcagaacagttgcaatcaagcctccaaaatgctggaccggtcggttccttatgaacttatgggctattttttgtatgttttgtctgagcacatataccgcaaatttagctgctgtgatggtgggagagaagatctacgaagagctgtccggcattcatgatcctaagctgcatcacccctcgcagggatttaggttcgggacagtgagggagtcgtcagctgaagactatgtgcgtcagtcttttccggagatgcacgagtacatgagaaggtacaatgtgcccgctacccctgacggcgtcgagtatctaaagaacgacccagagaaactagatgcatttatcatggataaggcacttctggattacgaagtttctatcgacgcagattgtaagctacttacagtgggcaagcccttcgcaatcgagggatatgggatcgggctccctcccaactccccactcaccgccaatatctctgagcttataagccagtacaaaagccatggattcatggacatgctccacgataagtggtatcgggtcgtaccttgcggtaaacgcagcttcgctgtgaccgaaaccctgcagatgggtatcaaacacttctccggcctattcgttctgttatgtatcggttttggactgtccatcctgactactatcggcgagcacatcgtgtacaggctgctactacccaggattaagaacaagagcaagctgcagtattggctccacacctcccagcggctgcacagagccattaacaccagctttattgaagagaagcagcaacactttaagaccaaacgagtggaaaagcgaagcaatgttggccctcgacagcttactgtatggaacacaagcaacctgtcccatgacaacagaagaaagtacattttcagcgacgaggagggacaaaaccaactgggcattagaattcatcaggacatcccacttccccctaggcgtcgagaactgcctgcccttcgcaccacaaacggtaaggcagactccctgaatgtatctcgcaacagtgtgatgcaggaactctccgaattggagaaacagattcaggtaattcggcaggagttgcagctggcagtgagcaggaagacagagcttgaagaataccagcgcacttcccgaacatgcgagtcttag

SEQ ID NO: 224777 - DNA, 3585 bp, Artificial Sequence
  Description of Artificial Sequence: Synthetic coding sequence
atggtgggcttattgctcttcttctttcctgcaatattcctggaggtaagcctgctgccccgtagtcctggccgtaaggtgctacttgctggcgcatcaagccaacgaagcgtggccaggatggacggcgacgtgatcatcggggctcttttctctgttcaccaccagcccccagcagagaaagtgcccgagaggaaatgcggggagatcagagagcagtacggcatacaacgagtggaagcgatgttccacaccttggataaaatcaacgcagatccagtgttacttccaaatattaccttaggctccgagattcgtgattcgtgctggcattcctccgtcgcattagagcagtccatagaatttattcgggactctcttatctcgatcagagatgagaaggacgggatcaataggtgcctgcctgatggccagagtctgcccccaggcagaaccaaaaaaccgatcgcgggagtcattgggcctggaagttcatctgttgccatccaggttcaaaatcttttgcaactgttcgatattccccaaattgcttactctgcaacatccatcgacctgtcagacaaaactctttataagtatttccttcgagtggtgccttccgacacattgcaggcaagggcgatgttggacatcgtgaaaagatataactggacatatgtctctgccgtgcataccgaaggtaactacggtgaaagtggaatggacgcattcaaagagttagcggcacaggaaggattgtgtatagctcactccgacaagatctacagcaatgccggagagaagtctttcgatcggctgctgcgcaagttgagagagcggctgccaaaggctcgagtagtggtttgtttttgtgaaggcatgacagtgagaggactgctcagtgctatgcgcaggctgggggttgtcggagagttttccctgattggcagtgatggctgggccgatagagatgaagtaatcgaagggtatgaggtggaggcaaacggaggcatcacaataaagctacagagccccgaggtgcgctcatttgacgattacttcctgaaactaaggctcgacactaatactagaaatccctggttccccgagttctggcagcaccgctttcagtgcagactgccaggtcacctgctggaaaaccctaacttcaaaagaatctgcactggaaacgagtcactggaggaaaattacgtacaggatagcaagatggggttcgtcatcaacgctatatacgccatggctcacgggctgcaaaatatgcatcatgcactctgtccaggccatgtgggtttgtgcgacgcaatgaaacccatcgacggctctaagctcctggattttctcattaagtcttcttttataggggtgtcgggcgaggaggtctggtttgacgagaaaggcgacgctcccggtaggtacgatatcatgaacctgcaatacacagaggccaaccgttatgactacgtgcatgtgggaacctggcacgagggtgtgctgaatatcgatgattataagatccagatgaataaatcgggagtcgttcgttcagtctgtagtgaaccctgcttgaaaggacagattaaagtcattaggaagggagaagtctcatgctgttggatctgcaccgcctgcaaggagaacgagtatgtacaggacgagttcacatgcaaagcctgtgacctcggctggtggcccaacgctgatctgacaggctgtgaaccaattccggtaaggtacctggaatggagtaacatcgagtcaattatcgcgatcgcgttctcatgcttggggattctggtgactctgttcgtcactctgatcttcgtgctttaccgggacacaccggtagtaaaatcctccagccgggaactttgctatataattttggctggcatattccttggatacgtctgtcccttcacgctgatcgcgaaaccgacaacaaccagctgctatctgcagagactgctggtaggcctgagttccgccatgtgttactccgcactggtgacaaagactaaccggattgctcgtatcctggctgggtccaagaaaaaaatttgcaccagaaagcctcgcttcatgtccgcctgggcccaagtgatcatcgcaagtatcctgatcagtgtccagttgactctggtcgtgactctcattattatggaaccacccatgcccattctctcctatcccagcataaaggaggtgtacctcatctgtaacactagcaatctaggagtggtggctccactgggttataatggcctgctgattatgtcctgtacgtactatgccttcaaaactcgaaacgtcccggcaaacttcaacgaggccaaatatattgcctttaccatgtacaccacttgcattatttggttggcctttgtccctatctacttcggatctaactataagatcattacaacatgttttgctgtctcactatcagtgactgtggcactgggctgcatgttcacacccaaaatgtatatcataattgccaagcctgagagaaacgtaagatccgcttttactacttcagatgtcgttcgcatgcatgtaggcgatgggaaattgccctgccgctccaacacatttctgaacatcttccgacgtaagaaagctggagccggtaatgccaattcaaacgggaagagtgtcagctggagcgagcctggtggcggacaggtgcctaaagggcagcacatgtggcatcgtctgtccgtccacgtgaagacaaacgagacagcttgtaatcaaaccgctgtcatcaaacccctgactaagtcttatcaaggttcaggaaaatccctcactttttccgatacttctaccaagacactttataatgtcgaggaagaggaggacgcacagcctatcaggttctctccacccggatcccctagtatggttgtacaccgccgtgtcccctcggccgcaaccactccaccactgcccagccacctcaccgccgaggagacacccttgttcttagcagaacccgctcttccgaagggactgccaccccctcttcaacagcaacaacaacctccaccacagcagaagtcccttatggaccaactccagggagtcgtctctaacttttccacagcgatacctgatttccatgccgtccttgcgggacccggtgggcctggcaatggtctcaggagtctctatccgccacctcctcccccacagcacctacaaatgttaccgctccagctgagtacctttggggaagagctagtttctccccctgctgatgacgatgatgatagcgaacggtttaaactgttacaagaatacgtttacgagcacgagagagaggggaacaccgaagaggacgagctagaggaggaagaagaggacttacaagccgcaagcaagcttacgcctgacgattctcccgctctgacgccaccgtctccgtttcgtgacagcgtagcctcgggaagctccgtgccaagtagccctgtgagcgagtccgtcttgtgcacccccccaaatgtttcttatgccagcgtaattcttcgcgattacaagcagagttcctccaccctgtag

SEQ ID NO: 224778 - DNA, 3585 bp, Artificial Sequence
  Description of Artificial Sequence: Synthetic coding sequence
atggtcggcctcctcttgtttttcttcccggcaatcttcctggaagtgagtctgttgccaagatccccaggcaggaaagtcctcctcgctggcgcttcgtcccagcgctcagtggcacgcatggacggggacgttattatcggtgccctattcagcgttcatcatcagccccctgcggaaaaggtgccagagaggaaatgcggagaaatcagagaacagtacggaatccaacgagttgaagctatgttccataccctcgataaaattaatgctgatcccgttctcctccccaacatcacactgggcagtgagattagagactcatgttggcactcttcagtggcactcgagcagtccatagagtttatacgggacagccttatcagtatccgagatgagaaggacggcattaataggtgcctgcctgatggccagagcttgccccctggccgtacaaagaagcccatcgcaggcgtgatcggacctggaagttctagcgttgctatccaggtgcaaaatcttcttcagctgtttgacatcccccaaatcgcctactcagcaacaagtatagatctctcagacaagacactctacaagtacttccttcgtgtcgtgccctcggatacactgcaggcccgtgcgatgttggatattgtaaaaagatataactggacctacgtatccgccgtgcataccgaaggcaactacggagagtctggaatggacgcgtttaaggagttagcagcacaggagggtttgtgtatcgcccactccgacaagatttactccaatgcgggtgaaaaaagcttcgatcggctactgagaaaactgagagaacggctgccaaaggccagggtggttgtatgcttctgtgaaggcatgaccgtccgcggactgctgagtgctatgaggcggttaggagtcgttggtgagttttcattgataggttctgatggatgggccgaccgcgacgaagtgatcgagggatatgaagttgaggctaatggtggcattaccatcaaactccagtctcctgaggtgaggagtttcgacgattattttttgaagctccgattggacaccaacacaaggaacccatggtttcccgaattttggcagcaccgattccaatgccgcctgccgggtcacttgctggaaaaccccaactttaagagaatttgtaccggaaacgagtctttggaggagaattatgtgcaagatagtaagatgggattcgtcatcaatgccatttacgctatggcccacggacttcagaatatgcatcacgccttatgccccggtcatgtgggactgtgcgatgctatgaaacccatcgacggaagcaaactgcttgactttctcatcaagagttcattcattggagtctccggcgaagaagtttggttcgatgaaaaaggggacgccccaggaagatacgacatcatgaacctgcagtacaccgaagccaataggtacgactacgtgcacgtcggcacctggcacgagggtgtgctgaacatcgatgactataagattcagatgaataaatcgggggtggttcgttccgtgtgttccgagccctgcctgaaaggtcaaattaaggttatacggaagggcgaagtctcctgctgctggatctgcacagcttgtaaggaaaacgagtacgtccaggatgaatttacgtgcaaagcttgcgatctcggttggtggccgaacgccgacctcacaggctgtgaaccgatccccgtccgctatcttgagtggtccaacatcgaatccatcatagccattgctttctcctgtcttggtatattagtcaccttgttcgtgactctcatttttgtcctctatagggacacgcccgtcgtgaagtcctcctcgagggagctgtgttacataatactggccggtatctttctcgggtatgtttgcccattcacacttatcgcaaagccaactacaacaagttgctatctccagcgcctccttgtggggctgtcatcagcgatgtgctattcggccctcgtcactaagacaaatcggattgcacgcattctcgctgggtcgaagaaaaagatttgtacccgaaaaccaagatttatgtcagcctgggctcaggtcataatagcctctatccttatcagcgtccagctgacacttgtggtgacactgatcatcatggagccacctatgcccattttgagctatccctccattaaagaagtgtacctgatctgcaataccagcaatcttggtgtggtcgcccctctgggctacaacggtcttctaatcatgtcttgtacatattatgcgtttaaaacccgcaatgtgcccgctaactttaacgaagctaagtacatcgctttcacaatgtacaccacttgcatcatctggcttgctttcgtccctatttatttcgggagcaattacaaaattatcaccacatgcttcgctgtaagcttatcagtgacagtggctttaggatgcatgttcacccctaagatgtatattatcatcgccaagccagagcggaacgttaggtcagcgttcactacttcagacgtagttaggatgcacgtcggcgatggtaagctgccttgccggagcaataccttcctaaatatcttcagacgtaaaaaggctggggctgggaacgcaaactccaacggaaagtctgtctcttggtcagagccagggggtggacaggtgccaaagggccaacacatgtggcatcgcctctcagtacatgtgaagaccaacgaaaccgcttgcaatcagaccgccgtcatcaaacccttaaccaaatcttaccaggggagtggtaaatccctgactttttcagatacgtcaacaaagacactgtacaacgttgaggaagaggaggacgctcagccaatccgctttagtccacctggctcaccatcgatggttgtgcaccgtcgcgtcccaagtgctgccacaaccccgccactgccatcccacttaaccgctgaggagaccccgctcttccttgccgaacctgctttgccaaagggattgcccccaccactccaacaacagcagcaacctccaccccagcagaagagtctgatggatcagctgcagggcgtagtgtctaacttctccaccgctattcctgacttccacgcagtcctggctggcccaggagggccaggtaatggccttagatctttgtatccacccccacccccacctcagcatctgcagatgctacctctgcagctgtccacgttcggagaagagcttgtctcccctcctgctgacgacgacgacgattcagagcgcttcaagctgttgcaggaatatgtttacgaacacgagagagagggcaacactgaggaagacgagttagaggaggaggaggaagaccttcaggctgccagtaagttaacacctgatgactcaccggcactcactccgccatcacctttccgcgattcagtggcctcaggctcaagcgttccttcgtcccccgtctcggagtctgtgttgtgtacaccacccaatgtaagctacgccagcgtaattttgcgagactacaagcaatcaagctccacgctatag

SEQ ID NO: 224779 - DNA, 2721 bp, Artificial Sequence
  Description of Artificial Sequence: Synthetic coding sequence
atggttggtttgctgctgttttttttcccagccatctttttggaagtctcactgctgccacggtcacccggaaggaaagttcttttggccggagctagtagccagcgctccgtcgcgaggatggatggcgacgttataatcggcgctctgttttccgtacaccaccagcccccagccgagaaagtacctgaaaggaagtgcggtgaaatccgtgagcaatatggaatacaaagggtcgaggccatgttccatacccttgacaagataaatgcagaccctgtattgctacccaatattaccctgggctccgagattagggactcatgttggcactcctccgtagctctggagcagtccatagagttcattagagacagtctgatctctattcgggatgagaaggacgggataaatcggtgtttaccggatggacagagcctgcctcctggcaggacgaagaaaccaattgcaggagtgataggcccaggtagcagcagcgtggctattcaggttcagaacctgctgcagttgtttgacatcccacaaatagcttacagtgctacttccattgacttgagcgacaaaaccctgtacaaatattttctgcgggtcgtgccttcagatactttgcaggccagagccatgctggacattgtgaaaagatataattggacctatgtctccgctgtgcatacggaagggaactacggcgagtccggaatggatgcattcaaggaactagcagcacaagaaggactgtgcattgcccattcagacaagatctactctaatgccggtgagaagtctttcgacagattgttgcgaaagctcagggagagactgcccaaggcgagggtagtggtgtgcttctgcgaaggaatgactgtccgtggcctgttgagcgcgatgcgtcgcctcggcgtggtcggcgagtttagccttatcggcagtgatggctgggccgatagggatgaggtaatagaagggtatgaagtggaagccaacgggggaattactatcaagctgcaaagtcccgaggtgagatctttcgacgattatttcctgaagctgagactcgacacaaacactagaaacccgtggttccctgagttttggcagcacagatttcagtgtaggctacccggtcacctacttgagaaccctaattttaaaaggatttgtactggcaatgagtctctggaagagaattacgtacaagacagtaagatgggatttgtcatcaacgccatttacgcaatggcacacggtctgcagaacatgcatcatgctctttgtcccggacacgtgggcctgtgcgatgcaatgaaacctatcgatggctcaaaactgcttgactttctgattaaatcttccttcattggtgtctcgggcgaggaagtgtggttcgatgaaaaaggcgacgcccctggccgatatgatatcatgaacctgcagtatactgaggcgaatcgctatgattacgtacacgtgggtacatggcacgagggagtgctgaatatcgacgactacaagatacagatgaacaagtcaggggtagtgcgatctgtgtgcagcgagccatgtctcaagggccagatcaaagtgatacgaaaaggcgaggtgtcatgttgctggatttgcactgcgtgtaaggagaacgagtatgtgcaggatgaatttacttgtaaagcgtgtgacctcggttggtggcctaacgccgatctcacaggatgtgagcctattccggtcaggtaccttgagtggagcaatatcgagtctatcatagctatcgcattcagttgtctcggcatactcgtgacgttgtttgtaacactgatctttgttttgtatagagatacacctgttgtgaaatcgtcatcccgcgagttgtgctacatcattctggctggaatttttcttgggtacgtttgcccgtttaccctgatagccaagcccacaactacgagttgctatctccagaggttactggtgggactctcatccgccatgtgctactcggctctggtcaccaaaacaaataggattgccaggatcctggcgggatctaagaagaagatatgcaccaggaaaccaaggttcatgtcagcatgggcccaagtcattattgcatctattttaatcagtgtacaactgaccctggtggttaccctcatcattatggagccgcctatgcccatcctctcttatccatctattaaggaggtatacctcatctgcaacactagcaatcttggagtggtggccccactcggctataatggattgctgatcatgtcttgtacttactacgccttcaaaacacgcaacgtaccagcaaacttcaacgaggctaagtacattgcctttactatgtacaccacttgcattatttggctggcattcgtgccaatttatttcggctctaactataaaatcattacgacatgctttgcagtgagcctgtccgtcactgtagcgctggggtgtatgttcaccccaaagatgtatataataatcgctaagccagaacggaatgttaggagcgcttttaccactagcgacgtggtacggatgcacgttggcgacggaaagttgccttgcagaagtaatactttccttaacatctttcggcgtaaaaaagccggtgctggcaacgccaagaaaagacagcctgagttctcccccactagtcagtgtccaagcgcccatgtgcagctgtag

SEQ ID NO: 224780 - DNA, 2721 bp, Artificial Sequence
  Description of Artificial Sequence: Synthetic coding sequence
atggtaggattgctgctttttttcttccccgctatctttctggaggtgtctctactccccagatctcctggacgtaaggtgctgctggcaggagctagctctcagcgatcagttgctcggatggacggcgatgtaatcatcggggcattattctctgtgcatcatcagccccctgccgagaaggttcccgagaggaagtgcggcgagattagagagcagtacgggatacagcgagtggaggcaatgttccacacattggacaagattaacgctgatccagtgctgctacccaacataactctcggttctgagatcagagactcttgttggcacagtagtgtggccctggagcagagcatcgagttcattagagattcacttattagcatccgtgatgaaaaggacggaattaaccgatgcctgccagatggccaaagtcttcccccaggcaggaccaaaaagcccatagccggagtgattgggcctgggagtagctcggtcgcaatacaagttcaaaacctgctgcagttgttcgacataccacagatagcatactccgctacatctatcgatctgtcagacaaaaccctctataagtacttcctcagggtggtacctagcgacaccttacaggccagggcgatgcttgacatcgttaagaggtataactggacttatgtgagcgcagtgcacacagagggcaactacggtgaatcaggcatggatgcttttaaagagttggcggctcaggagggtctgtgtatcgcccattcagataaaatctacagcaacgcaggcgaaaaaagctttgatagactattgcggaaactgcgcgagaggctccccaaagcgcgtgtagtcgtgtgtttttgtgaggggatgaccgttcgcggactgctgtccgctatgcgtaggctgggagtcgtaggcgagtttagtttgatcggttctgatgggtgggccgatcgtgacgaggtgatcgagggatacgaagtagaagctaacggcggaatcaccattaagctgcagtcgccagaggtgaggtcatttgatgattattttctgaagttacggctggacactaacacccggaacccttggttcccggaattctggcaacaccggttccagtgtaggctaccagggcatcttctggaaaatccaaacttcaaacggatctgcacaggtaacgagtcactagaagagaactacgtgcaggatagcaagatgggatttgtcatcaacgctatttacgcaatggcccacggcctgcagaatatgcatcacgcactctgcccgggtcatgttggactgtgcgatgcaatgaaaccaatcgacggatctaaattgctggatttcctgatcaagtcgtcttttattggtgtgagcggcgaggaggtctggttcgatgaaaaaggagacgcacccggacggtacgatatcatgaacctgcagtacacagaggctaatcggtacgattatgtacacgtgggaacctggcatgagggtgtactaaacatagatgactataagatccaaatgaacaaaagcggcgttgtgagatctgtgtgctcagagccatgtcttaaaggacagatcaaggtcattaggaaaggcgaggtcagctgttgttggatttgcactgcctgtaaagagaacgagtacgttcaagatgaatttacatgcaaggcctgcgatctcgggtggtggcctaacgccgatctgactgggtgcgagccaatcccagtgaggtatcttgaatggagcaacatcgagagtataatagctatcgcgttttcatgcctgggcattctggttacccttttcgtaacccttatcttcgtgctctaccgtgacacccctgtggtgaagagtagtagtcgcgagctgtgttacatcattcttgccggaatattcctgggatatgtctgccccttcaccttaattgctaagcccacgaccacttcctgctatttgcagaggctgctagtgggtctgtcttctgcgatgtgttacagcgcattagtgaccaaaacgaatcgtatagctcgtattctggccggttctaagaagaaaatctgcacacgcaaaccacggttcatgtccgcatgggcccaggttatcatcgcgagtatcctcatttccgtgcagttgacattggttgtgaccttgattatcatggaacccccaatgccaatcctcagctacccatctatcaaagaagtgtacctcatttgcaatacgagcaatcttggtgtggttgccccactgggctacaacgggcttttgatcatgtcctgtacctattacgctttcaaaacacgcaacgttcccgctaatttcaatgaggcaaagtatattgctttcacaatgtatactacctgcatcatctggctggcttttgtgcctatatatttcggcagtaactataagatcatcacaacatgctttgcagtgtccttgagcgtcaccgtcgctctcgggtgtatgttcacccccaagatgtacattatcatagctaagccggagagaaatgtccggagtgctttcaccacaagcgatgtcgtgaggatgcatgtgggagacgggaaattgccgtgtcgatcaaacacttttctgaacatctttagacggaagaaagcgggtgctggcaatgccaaaaagcgtcagcctgaattctcaccaacatctcagtgcccttctgcacacgtgcagctgtag

SEQ ID NO: 224781 - DNA, 2721 bp, Artificial Sequence
  Description of Artificial Sequence: Synthetic coding sequence
atggttggcctcctgctgttcttttttccagctatttttttggaggtatctctgctccctcgctccccgggaaggaaggtcctgctcgctggagcatcctctcagcgctcggtggctcgcatggatggagacgttatcatcggagcacttttttccgtgcaccatcagccccctgcagagaaagtaccagaaaggaagtgcggagagatccgagagcagtacgggatccaacgggttgaggccatgtttcacacactggataaaattaatgcggatccagtcctgctgccaaacatcacactgggcagcgaaatccgagattcctgctggcattcctctgtggccctggaacaatctatcgaattcatcagggactccttaatcagcattagagacgagaaagacggaataaatcgttgtctcccagatggacagagtctgccccctggcagaaccaaaaagcccatcgccggtgtgattggcccaggttcatctagtgtggctatccaagtgcaaaaccttctgcaactgtttgatattccccagatcgcctactccgctacatcaattgacctctccgataaaactttatataagtattttttacgggttgttccgtcagacacacttcaagccagagccatgctggatatcgtgaagagatataactggacctacgtgagcgcagtccataccgagggcaactacggagagagcgggatggacgccttcaaagagctggccgcacaagaagggctgtgcattgcgcattctgataaaatatatagcaatgccggagaaaagtcattcgaccggctcctgaggaaactgcgtgaacggctacccaaagcaagagtggttgtatgcttctgtgagggaatgacggtgagaggattgctctctgccatgagacggcttggggtggtgggcgagttcagtctgatcggatctgacgggtgggcagaccgagacgaagtcatagaagggtatgaggttgaagcgaacggaggtatcacaatcaagttgcagagccctgaagttaggagcttcgatgattatttcctgaaactccgcttggatactaacaccaggaacccatggttccccgaattttggcaacacaggttccagtgtcggctccctggacacctgttggaaaatccaaattttaagagaatctgcaccggcaatgagtctctcgaggagaattacgtacaggattccaagatgggctttgtcattaacgcaatatacgctatggcgcacggactgcagaatatgcaccatgctttgtgccctggccacgtcggtttgtgcgacgccatgaagccaatagacggcagcaagctcctggactttctcatcaagagtagcttcatcggggtctccggagaggaggtgtggttcgatgagaagggcgacgcaccaggaaggtatgatatcatgaacttacagtacaccgaggcaaacagatacgattacgttcacgtggggacatggcatgagggcgtcttaaacattgacgattacaaaatacagatgaacaagtcaggagtggtgaggtccgtgtgctctgagccatgcttaaagggccagattaaggtgatacggaagggcgaagtaagctgctgttggatttgtaccgcttgtaaggaaaacgagtatgtgcaagatgagtttacatgcaaggcttgcgaccttggctggtggccaaacgccgacctcacaggctgtgagcccatccccgtgcggtacctggaatggagcaacatagaaagcattatagccattgccttttcttgcctcggcatcctcgttaccctgttcgtgacactgatcttcgtgctttatagggacaccccggtagtcaaatccagcagtcgggaactatgctatatcatactcgccggaatttttcttggctatgtgtgcccctttactctgattgctaaaccgaccaccacctcgtgttacctgcagcggttactggtcggtctctcatccgccatgtgttatagtgccctcgttacgaagaccaacagaattgccaggattctggccggatccaaaaaaaagatctgcacaaggaaacccaggtttatgagtgcttgggcgcaggtgattattgccagcatcctgattagcgtgcagctcactttagtcgtgaccctgattattatggaaccgccaatgcctatcctcagctatccaagtatcaaagaagtgtacttgatttgcaacaccagtaatctgggggtcgtggctcctctggggtacaatggcctgcttatcatgagttgtacgtactacgccttcaagacccgtaatgtccctgccaacttcaacgaagccaagtacattgcttttactatgtataccacatgtatcatttggcttgccttcgtaccaatttactttggatcaaattacaaaatcattactacttgctttgccgtcagcctttcagtcaccgttgcgctgggttgtatgttcacccccaagatgtacatcatcattgccaagcctgagcggaacgtgcgaagcgcattcaccacaagtgacgtggtgagaatgcacgtcggagatggcaagctgccatgtagaagtaacacattcttaaatattttccgccgtaagaaggcgggtgccggaaatgctaaaaagcggcagcctgaattctcaccaacctcacagtgtccgagtgcacacgtccagctgtag

SEQ ID NO: 224782 - DNA, 2619 bp, Artificial Sequence
  Description of Artificial Sequence: Synthetic coding sequence
atgggatctctgctggcccttctagctctgttgctactttggggcgctgtggctgagggaccagcaaaaaaggtgctcactctcgagggggacctggtcttggggggactgtttccagtgcatcagaaaggcggacctgccgaagattgcggcccagtaaacgagcacaggggaattcagcgcctcgaggctatgttgtttgccttagaccgtattaatagggacccccatctcctgcctggcgttcgcctgggagcacatatactggatagctgttcaaaggacactcatgccctcgaacaggccctggatttcgttagagcttctctgtcacgaggcgctgatggcagcagacatatctgtccagatggatcgtacgccacccacggggacgctcctaccgccatcaccggggtcataggtgggtcgtactcagatgtatccattcaagtggcaaatctgctgaggctgtttcaaattcctcagatttcttacgcaagtaccagtgccaagctctctgataagtctaggtatgactactttgctcgcacagtcccacccgacttctttcaggccaaggcaatggccgagattctcaggttcttcaactggacatacgtgtcaaccgtggcttctgaaggcgattacggagagactggtattgaagcttttgagttggaagcaagagcgcgaaatatttgtgtggccacttctgagaaggtgggcagggccatgagcagggcagccttcgaaggagtggtgcgggctctccttcagaaaccctcagcccgagtagccgtcctcttcactaggtccgaggatgcacgagagttgctagctgcttcccagagacttaatgcgagcttcacctgggttgccagcgatgggtggggggctttggaatctgtggttgccggatctgaaggcgcagctgagggggcaataaccatagaacttgctagctatcctatcagtgatttcgcctcttactttcagagtttggatccctggaacaattccagaaacccatggtttcgcgagttttgggagcaacggtttagatgctcttttcgacagagggactgcgcagcacactccttacgagctgtgccattcgaacaggaaagcaaaatcatgtttgtagttaacgccgtgtatgcaatggcccatgccttgcacaacatgcacagggcactatgccctaataccacccggttgtgcgatgctatgcgcccagtgaacggcaggcggctgtacaaagactttgtgctgaacgttaagtttgatgccccttttcgccctgcagatacccataatgaggtgaggtttgaccgctttggcgacggaatcggaagatataacatttttacgtatctgcgggctgggtcagggagataccggtaccagaaagtaggatactgggcagaaggcctaaccttagacacctccctcatcccttgggcgtcgccaagtgccggaccgctgcccgcttctcggtgtagcgaaccatgcttgcagaacgaagtgaaatcagtacagccaggcgaagtctgttgctggttgtgcataccttgccagccatatgaatataggctggatgaattcacttgcgcagattgcgggctgggttactggcccaatgcttccctgacaggatgtttcgagctgcctcaagagtacatccggtggggagatgcatgggccgtggggccagtcactatcgcctgcctgggcgcactagcaactcttttcgtcttgggcgtgtttgtgagacacaatgccacgcctgttgtaaaggcaagcgggagggagctctgctacatcctccttggaggggtgttcctctgttattgtatgacattcatcttcatcgccaagccttcaactgccgtgtgcaccctgagaagactaggactgggcacagctttctccgtttgctattcagccttgttgacaaagactaatagaatcgcaaggatcttcgggggagctagggaaggagcacagcgccctaggtttataagtcctgcctcgcaggttgcaatttgtcttgccctgatctcaggccagctattgattgtggttgcctggcttgtggtggaggcccctggtacaggcaaggagacagccccagagaggagagaagtggtgactcttagatgtaatcaccgcgacgccagcatgctgggctctctggcttacaacgtcttgttaatcgcactgtgcactctctatgcttttaaaactcgcaagtgccccgagaattttaacgaagccaaatttataggcttcacaatgtacactacctgtatcatttggctggccttcctgccgatcttctacgtaactagttcagattatagggtgcaaactacaacgatgtgcgtatcggtgtccttgtcgggctccgtcgtgctgggctgtctcttcgcacctaaactacacatcatcctcttccagcctcagaagaacgtcgtatcacacagggcacccacatcaaggttcggaagtgcagccgctcgagccagtagtagcctgggtcaggggtccggatcccagttcgttcctacagtctgtaacggcagagaggtggttgacagcaccacaagctctctgtag

SEQ ID NO: 224783 - DNA, 213 bp, Artificial Sequence
  Description of Artificial Sequence: Synthetic coding sequence
atggggtccctgttggcacttttggcactgctgctcttatggggtgctgttgctgagggtccagctaagaaggtcctcacccttgagggtgatctcgtcctggggggattatttcccgtccatcagaaaggtggccctgccgaggattgtgggcctgtgaacgagcataggggaattcagcggctggaggctatgttattcgcactggactag

SEQ ID NO: 224784 - DNA, 2640 bp, Artificial Sequence
  Description of Artificial Sequence: Synthetic coding sequence
atgaagatgctgaccaggctgcaggttctcacgctggcattattctcgaaggggttcctgttaagtctcggcgatcacaatttcctgcgacgcgaaattaagattgagggcgatcttgtcttgggtggcctgttcccaatcaatgagaagggcaccggcaccgaagagtgtgggcgaattaacgaagaccgcggaatacaaaggttagaggcgatgctgtttgcgatcgatgagatcaataaggacgactacctgctgcccggagtaaaacttggcgttcacatcctggatacgtgttctagagacacttacgcgctggagcagagcttagagtttgttagagcctcgctgactaaggtagatgaggctgaatacatgtgcccagatggatcttacgccattcaggaaaacattcctttactgatcgctggtgtgataggaggctcctacagtagcgtcagtatccaggtcgcaaatctcctccgcctgtttcagatacctcagataagctatgcctccactagcgcaaaattaagcgataaatctcgctatgattattttgcaagaacggtgcccccagacttctaccaggcaaaagccatggccgagatccttcgattcttcaactggacatacgtcagtaccgtggcttccgagggcgactacggcgagaccggaattgaggcatttgagcaggaagctcgcctgcgaaacatatgcattgcaaccgccgaaaaggtgggcaggtctaacattcgcaagagttacgacagtgtaatcagggaattattgcagaagcccaacgcgagagtagtagtcctgtttatgaggtctgatgattcccgcgaactgattgccgctgcctcgagggccaatgcatcctttacctgggtggctagtgatggatggggggcacaagaaagcatcataaagggtagcgagcatgtggcatatggagcaataacgctggagctcgccagtcagccagtgcgccagtttgacagatactttcagagtctgaacccgtacaataatcaccgcaacccctggttcagggatttttgggagcaaaaattccagtgcagcttgcagaataaacgcaaccaccggagggtctgcgataagcatctggccatcgattccagcaattacgaacaagagtctaaaatcatgttcgtcgtgaatgccgtgtatgccatggcccatgccctgcacaaaatgcagcgcacgttgtgtcccaatacaacaaagctatgcgacgccatgaaaatactggacggaaagaaactgtataaagactacttgttgaagattaattttaccgcgccatttaacccaaacaaagacgcagacagtatcgtcaaattcgacacctttggggatggcatggggagatacaacgtattcaatttccagaacgtcggtggcaagtactcatacctgaaggtcgggcactgggcagaaacactgtctctggatgttaacagtatacattggagccggaacagcgtccctacttctcagtgtagtgacccctgcgcaccgaatgagatgaaaaatatgcagcccggagatgtgtgctgctggatttgcatcccatgcgaaccctacgaatacctggccgacgagtttacctgcatggactgtgggtctgggcaatggcccactgctgacctcacagggtgttatgacttgcctgaggattacatccggtgggaagacgcatgggccatcggacccgtgaccatcgcttgcctgggcttcatgtgtacctgcatggttgtgacagtgttcatcaaacacaataataccccgctcgtaaaggcctccggtagagagttgtgctacattctgttatttggggttgggttgagctattgcatgacttttttcttcatcgccaagccctccccagtcatctgcgccctgcgtagactgggactgggatcatcattcgctatttgctacagcgcactccttacaaagaccaactgcatagctagaatctttgacggggtgaaaaacggcgctcagcgtcctaagttcatctcaccttccagccaagtttttatctgtctgggcttaattctagtccaaatcgtgatggtgagtgtttggctcattctggaggctccgggtacacggaggtacacccttgcggagaagagggagacagtgatcctgaaatgtaacgttaaagacagcagtatgctgatctctttaacttatgatgtaatcttagttatactatgtaccgtgtatgcgttcaaaacccggaaatgccccgaaaactttaacgaggcaaagtttatagggtttaccatgtacacgacatgtatcatctggttagcctttctgccaattttctacgtgacgagcagcgattatagggtacagaccacgacaatgtgtatctctgtttccctctcaggttttgttgttctggggtgcctgttcgcacccaaagtgcacatcatactgtttcaacctcagaaaaacgtcgtcactcaccggctgcacctgaatagattttccgtgagtggaacaggaaccacgtactcccagagcagtgcaagcacctacgttcccactgtatgcaacggcagggaagtgttggattccaccacctcatctctgtag

SEQ ID NO: 224785 - DNA, 1608 bp, Artificial Sequence
  Description of Artificial Sequence: Synthetic coding sequence
atgctgaccagactccaagtgctgacactcgccctgtttagcaagggatttcttttaagtctgggggaccataacttcctccggcgagaaattaagatagaaggtgacctcgtgcttggaggccttttccccatcaacgagaaggggactggaacagaagagtgcgggaggatcaatgaggatagggggatccagcgtctggaggctatgctgtttgctatagacgaaattaataaagacgattaccttcttccaggcgtgaaactcggtgtgcatattcttgacacttgttccagagatacatacgccctcgagcagtcgcttgagtttgtaagggccagtttaacaaaagtggatgaagcagagtatatgtgccctgatggatcatacgcaatacaggaaaatatcccattactgatagctggggtgattggaggctcctattcaagtgtttccattcaggtcgccaacttgttgaggctttttcaaatcccgcagatctcgtacgcatcaacttctgccaaactgtctgataagagtaggtatgattatttcgccaggaccgtgccacctgatttctaccaggcaaaggcgatggctgagatactaagattcttcaactggacctacgtctctactgtggcttctgaaggagactatggagaaactggaatagaagcctttgaacaggaggctaggttgagaaacatttgcatcgctaccgctgagaaggtgggaagaagcaacatccgaaagagttatgactcagttattagagagctgctgcaaaagcctaacgccagagtggtggttttattcatgcggtccgacgactccagagagctcattgccgctgcttcaagggcaaacgcttcattcacgtgggtggcctctgacggatggggggctcaggagtccatcattaagggctccgaacacgttgcttatggggctataaccttggagctggccagtcagccagtgcgacagttcgatcggtacttccagtcactcaacccatataacaaccacaggaatccgtggtttcgcgacttctgggagcagaaatttcagtgctccttgcagaataaaaggaatcatcgccgagtgtgcgacaagcatctcgccattgacagtagcaattacgaacaggaatccaagattatgttcgtggtgaacgctgtctacgccatggcacacgcgctccacaagatgcagaggactttgtgcccaaacaccaccaagttgtgcgacgctatgaagatcttggatggaaaaaagctttataaagattatctgttaaagattaatttcactggcgctgatgacaaccatgttcacctgtgccagccagagtggctgtgcggactcgggttattcgtttgtacccaggggagtcatcatcccgtttctacccccgaggagtgttgccatacacagacggcaccgcagcaggtgcagtgccagtggaactgggaccatatcctgtctgttctgtgtaagcacgtatgcgccaatggagtgcagtgggctggaagtcccagattgcaccatctaatctctgttatagtgaattgtagtagcgtgctggtcttcttggattgctag

SEQ ID NO: 224786 - DNA, 264 bp, Artificial Sequence
  Description of Artificial Sequence: Synthetic coding sequence
atgaagatgttgactagactgcaagttcttactctggccctgttcagcaagggctttttgctcagcttgggagatcataatttcttaaggagggagataaagatcgaaggcgacttggttctggggggtctctttccgattaacgagaagggcactggtactgaagagtgcgggcgtattaatgaggaccgcggaattcaacgactcgaggctatgcttttcgccatagacgaaataaataaagatgactacctcctcccttag

SEQ ID NO: 224787 - DNA, 1614 bp, Artificial Sequence
  Description of Artificial Sequence: Synthetic coding sequence
atgaagatgctgaccaggctccaggtcctcactttagcgctgttcagtaaaggctttttgctttctcttggtgatcacaattttctgcggagagaaatcaagatcgaaggtgatctggtcctggggggtcttttccccattaatgaaaaaggtacaggtacagaagagtgcggtcggataaatgaggaccgcggaatccagcgcctggaagccatgctgttcgcaattgatgagatcaataaagacgactacttactgcctggggtaaagttgggcgtgcacatcctagatacctgtagccgggatacctacgctctggagcagtcattggaatttgtgagggcgtcgctgactaaggtggatgaagcggaatacatgtgccccgacgggagttacgcaattcaagagaacattcccttgctcatcgccggagtgatcggaggctcttactcttccgtttccatccaagtggcgaacctgctgagactgtttcaaatcccacagatcagctacgcatcaaccagtgccaaattgtccgataagtctaggtacgactacttcgctcgcacagttccaccagatttttatcaggccaaggctatggctgagatactgcgcttcttcaactggacttatgtcagtacagtggccagcgagggtgactacggagagaccggcattgaggcttttgagcaggaggctaggctgcgtaatatctgtattgctaccgccgaaaaagtagggcgatccaacatccggaagtcctacgattccgtgattcgggagctgctgcagaagcctaatgccagagtggttgtgttattcatgcgctctgacgactccagagagcttatagctgctgcaagcagggctaatgcatccttcacttgggtagcatccgacggctggggggcacaagaatcaatcatcaaaggcagcgaacacgtggcatatggcgcaatcacactggagctggcctcgcagccggttcgtcagtttgaccgatactttcagtcattgaacccgtacaataaccacagaaacccctggttccgagatttctgggagcagaaatttcagtgttccttgcaaaataaaagaaaccaccggcgtgtgtgtgacaaacatctggcaatcgactcttcaaactacgagcaagagtcaaaaattatgtttgttgtgaacgccgtgtatgcaatggcccacgccttgcataaaatgcagaggacattgtgtccaaatactacaaaactctgcgacgcaatgaaaatcctagacggtaagaaactgtataaagactacctgttgaagattaattttacaggggctgatgacaatcacgtgcatctgtgtcagcctgaatggctgtgtgggttgggcctcttcgtctgtacccaaggctcccatcacccagtgtctactccggaggagtgttgtcacacccagacagccccacagcaagtacagtgccagtggaattgggaccacattctgtcggtgttgtgtaagcatgtatgtgccaatggggtgcaatgggcgggttccccgaggttgcatcatctcatctctgtgattgtcaactgtagttccgtccttgtgttcctcgattgctag

SEQ ID NO: 224788 - DNA, 246 bp, Artificial Sequence
  Description of Artificial Sequence: Synthetic coding sequence
atgaaaatgctgactagactccaggttctcactttagctttattctctaagggctttctcctgagtctgggggaccataattttctgcgccgtgagatcaagatcgagggagacttagttctggggggtctgttccccattaatgagaaggggacggggacggaggagtgtggtagaatcaacgaagatagaggtattcagaggctcgaagcgatgcttttcgcaattgacgagataaacaaatag

SEQ ID NO: 224789 - DNA, 2256 bp, Artificial Sequence
  Description of Artificial Sequence: Synthetic coding sequence
atgagccagtctcctggggcaggcagcccccctccgctgccaccaaggtctgcgccagtgccggctaggagctgcaggtgtgaagtcgcaaaccttctcaggctctttcaaatcccccagatctcatacgctagcacaagtgccaagctgtccgataagagcagatacgactactttgcaagaaccgttcccccagatttctatcaggccaaggctatggcagagatacttcgattctttaattggacttatgtctcaaccgtagcttcagaaggggattatggagagacagggattgaggctttcgagcaggaggcgagactccgcaatatttgcatcgcaactgctgagaaggtgggtcggagcaatatccgcaagtcttacgactcagtgattcgtgaattgctgcagaaacctaatgcgagggtggttgtgttatttatgaggtctgatgacagccgagaactgattgcagccgcaagtagggcgaatgcctctttcacgtgggttgctagcgacggatggggggctcaagagtcaataattaaggggtctgagcatgttgcttatggagctataaccctggagcttgcatcccagccggtgcgccagtttgatcgctatttccaaagcctgaatccctataacaatcatcgtaacccctggtttagagacttttgggagcaaaaatttcagtgctctctccagaataagaggaatcatcgccgagtgtgcgacaagcacctggccatcgatagcagtaactacgaacaggagagtaagataatgttcgtagttaacgcagtatatgctatggcccatgcattacataagatgcaaaggactctgtgccccaacactaccaaactgtgtgatgctatgaagattctcgatggaaagaaactttacaaggactacttgctcaagatcaactttactgctccttttaacccaaacaaggatgctgatagcattgtgaaattcgatacatttggcgatgggatgggcagatacaacgtgtttaattttcagaatgttggcggaaagtactcttatctcaaggtgggccattgggcagagactctctcactcgatgtgaattccatccattggagtcgaaatagtgttcccacatctcaatgcagtgacccctgtgctccaaacgaaatgaaaaacatgcagcccggagatgtgtgctgttggatctgtattccatgcgagccttacgagtacttagcggatgaattcacctgcatggactgtggctccggccagtggcccactgccgatctcacaggttgttacgacctgccggaagactatattcggtgggaagatgcatgggctattggcccagtaacgatcgcctgtctgggcttcatgtgcacttgcatggtagttactgtgttcattaagcacaataatactcctctggtaaaagcttccggccgagaactctgctacatcctgctctttggtgttggactgtcatactgtatgacttttttcttcatagcgaagcccagtcctgtcatctgcgccctccggaggctcgggttgggaagttcattcgcgatctgttactcagccctcttgaccaagaccaactgcattgctcggatattcgatggtgttaagaacggggcacagagacccaagttcattagcccttccagccaggtttttatctgcctcggcttgatcctggtacagatcgtcatggtcagtgtgtggctgattttagaggcgccaggaaccagacgctacactctggccgaaaaacgcgaaacagtgattctcaagtgcaatgttaaagactccagtatgctgatctctttgacctacgatgtgatcttggtcatactctgtaccgtgtacgcctttaaaactcgcaagtgcccagagaattttaatgaagctaagttcatcggcttcaccatgtatactacttgtattatatggttagccttcctgccaatcttctatgttacatcgtcggactatcgcgtgcagacgactacaatgtgtatcagtgtgtctctatccggctttgtcgtccttggatgtcttttcgcgccaaaggttcatatcatcttattccagccccagaagaacgttgtgacacataggctccacctgaaccgcttcagtgtttccggcactggcaccacctactcacaatcatccgcctccacatacgttcccactgtgtgcaacggacgggaggtgctggatagcactaccagttcattatag

SEQ ID NO: 224790 - DNA, 1416 bp, Artificial Sequence
  Description of Artificial Sequence: Synthetic coding sequence
atgcgacgcacaaaccacgaaccagagccgggatgtagattgacagcggctgctgcaacagcagttagcagctccagttgccaagagctgtctgtccgcgctcccttcaacccaaataaagacgccgactcgattgtgaaatttgacacattcggagacggaatggggaggtacaacgtattcaattttcaaaacgtaggcggtaagtactcatacctcaaggtcgggcactgggctgaaaccctctctctagacgtcaattcaatccattggtctcgcaattcagttccaactagccagtgcagcgacccctgtgcacccaatgagatgaagaatatgcagcccggtgacgtgtgttgctggatttgtatcccttgtgagccgtacgagtatttggccgacgaattcacatgtatggattgcggaagcggccagtggccaactgctgatctgacagggtgctacgatcttcctgaagattacatccgctgggaggacgcttgggccattgggccagtcaccatcgcctgtctcggcttcatgtgcacatgtatggttgttaccgtgttcattaaacataataacacgccactagtgaaggcatcaggtagggaattgtgctatatcctgctgttcggtgttgggctctcatattgtatgacattctttttcatcgcaaagccttctccagtgatttgcgccttgcgccgtcttggcctgggctcatctttcgcgatatgttattcagccctgctgactaagacaaactgcatagccagaatttttgatggagttaagaacggagctcagcggcctaaatttataagtccttcctcccaggtctttatatgcttaggcctgatccttgtccagatcgttatggtctctgtttggttgattttagaggcacccggtacccgaagatacaccctggccgagaagcgggagacagtgatcctaaaatgcaatgtaaaggattcctcaatgctgatctcactgacttatgatgtgatcttggtcatcctgtgcactgtttatgccttcaagactcggaaatgtccggaaaacttcaatgaagctaagttcatcggcttcaccatgtacaccacctgcataatatggctggcgtttcttccaattttttatgtaacgtcctcagactacagagtgcaaaccacaaccatgtgcatcagcgtgtccttaagtgggtttgtggtgctggggtgcctttttgcgcctaaagtgcacattatcctcttccagccacaaaagaatgtagtgacacataggctccatcttaatcggttctccgtgtccgggactggcactacatatagtcaatcctccgcctccacctacgttcccacagtatgcaatggcagggaggttcttgacagtaccacatcatctttatag

SEQ ID NO: 224791 - DNA, 2391 bp, Artificial Sequence
  Description of Artificial Sequence: Synthetic coding sequence
atgcccgcttgggagcccggagtggccgcaagctgcggatggagagcgccaccttgcagccccctgaggctctgcattgcaccccatccttgcactccgccaagctcccaccagggaaacctcacttgccggcttcctcctcggagtttcggcttttgtcggtgcgtgtgggtgaggacacggggaccatccctccctggcgagcaggtctcactggccgctcacgaaagtgagggcgcagccgctcaactcggaagctcccctgagatcgacccccgtcggcctagatgcttgctgcccgagagtgcacagattccccaaattagctacgcgtctaccgcccctgatctctccgataattcccgctacgactttttctctagggtggtacctagcgatacttatcaggcacaggcaatggtcgatatcgttagggcccttaagtggaactatgtctccaccgttgcctctgagggctcatatggagagtccggtgtggaagcttttattcagaagagtagggaggatggaggcgtttgcatcgcacagagcgtaaagattccacgggagcccaaagcaggagaattcgacaagattattcgcaggctgctagagactagtaacgccagggcagttatcattttcgctaacgaagatgacattcgtcgagtccttgaggctgcgaggagggcaaaccaaacaggccatttcttttggatgggcagtgacagttggggaagcaagattgcgcctgtacttcatctggaggaggttgccgagggagcagttactatcctgccgaaaagaatgtcggttagggatcgagagcggattggccaggacagtgcctacgagcaggaggggaaggtgcagttcgttatagacgcggtttacgcaatgggccacgccctgcacgccatgcatcgcgatttatgtcccggacgggttggactgtgtccccgaatggaccctgtggatggaactcagttgctcaaatatatcaggaacgttaacttctctgggatagctggaaatccagtgactttcaatgagaatggcgatgccccaggaagatatgacatctaccaataccagctgcgtaacgacagtgcagagtataaagtgatcggcagctggactgatcatctgcatctgcgcatcgagcggatgcattggcctgggtcaggacaacagctgcctaggagtatctgcagtttaccctgccagccgggagaaagaaagaaaactgtcaagggaatgccctgttgctggcattgtgagccctgcaccggttaccagtatcaggttgatcgctacacatgtaagacctgcccttatgatatgcggcctacagagaatcgtactggatgtcgtccgattccgattatcaaactggaatggggctccccatgggccgtgctccctctgttcttagcagttgtggggatagcagcaacacttttcgtggtcattacgttcgttcgttacaacgacacgccaatcgtaaaggctagcgggagggagctgtcctatgtgttgctagccggaatttttctatgctatgcaacaacattcttaatgatcgccgagccggacctgggaacctgctcgctgcggaggatttttctcgggctcggtatgagcatctcgtatgccgctctcctcactaagacaaataggatttaccggatcttcgagcagggcaaacggagtgtgtcagccccaagattcatttctcccgcaagccagttagccattaccttttctctgatcagtcttcagctgctggggatatgcgtttggttcgtggttgatccttcccactccgtggtagattttcaagaccagcgcactcttgatcctagatttgccagaggggtgctgaaatgtgatatctctgacctctctctgatctgcctgctgggatactcaatgctccttatggttacctgtacagtctatgccattaagactagaggcgttccagaaacttttaacgaggcaaagcccatcggctttaccatgtacactacatgcatagtgtggctggcatttataccaatcttcttcggaacttcccagtctgccgacaaactttatatccagacgactacacttactgtgtccgtatccttatccgcatccgtgagcctggggatgctgtatatgccaaaggtgtatattatcctatttcaccccgaacaaaatgtaccaaagcgcaaacggagcctcaaagctgtggttacagcagccacaatgtccaataaattcacgcagaaaggaaatttccggcctaatggcgaagccaaatcagagttgtgtgaaaaccttgaggctcctgcgttggctacaaagcagacctacgtgacatatacaaaccacgctatctag

SEQ ID NO: 224792 - DNA, 2739 bp, Artificial Sequence
  Description of Artificial Sequence: Synthetic coding sequence
atgcccggaaaacgaggcctcgggtggtggtgggcacggcttcccctttgcctcctgctatcactgtacggcccatggatgccttcatcactaggaaaaccaaaagggcatcctcatatgaactctatcagaatcgatggcgacatcactctgggaggcctgtttcccgttcatggccgtggcagcgagggaaaaccttgtggcgagctgaaaaaggagaaaggaatacatcggttggaggccatgctatttgccctggacaggataaataacgacccagacctattacccaacataactttgggagctaggatcctcgacacttgctctagggacacccatgccctggaacaaagcctgacatttgtacaggctctaatagaaaaggacggtactgaggtgaggtgcggtagcggtggccctcccatcatcaccaagcccgaacgggtcgttggggtgattggcgcatcagggagctcagttagcatcatggtcgcgaacattttaaggctattcaaaatccctcagatttcttacgcatcaaccgcccctgatctttccgataatagccggtacgactttttttcgagggtggttccttcagacacgtaccaagctcaggccatggtggacattgtccgcgctctgaagtggaattatgtgtctacagtcgcctcggaaggatcatacggggagtccggagtggaggcatttatccaaaaaagccgggaagatggtggtgtttgtatcgcccagtcggtcaaaattccacgcgaaccaaaggccggagagtttgataagatcattagacgtctgctggaaactagcaacgccagagcagtcattatcttcgcaaacgaagatgacattagaagggtcttggaagctgcgagacgcgcaaaccaaaccggccacttcttctggatgggctcagacagctggggctccaaaatcgcacccgtgctgcacctggaagaggtcgctgagggagccgttaccatactaccgaaaaggatgagtgttcgcggtttcgatcggtatttttccagtcgtaccttagataataacaggaggaacatctggtttgccgaattctgggaggacaactttcactgcaagttgagccggcacgctctaaaaaagggaagccatgtgaagaaatgcactaatcgagagaggataggacaggactcagcgtacgagcaggagggaaaggtgcagtttgtcatcgatgcagtttacgctatgggacacgcgctgcacgctatgcatagagatttgtgccccggacgggtcgggctatgtcccagaatggacccggtggacgggacccagctcctgaagtacatacgcaacgtgaacttctctggcatcgctggaaaccctgtcacattcaatgaaaatggcgatgctcctggtcggtacgatatctatcagtaccagctgagaaatgatagcgccgagtataaagttatcggatcttggaccgatcatctgcacctccgaatcgaaagaatgcactggcccggttccggacagcagctgccccgttctatttgtagtctaccttgccagcccggagagaggaaaaagactgtgaaggggatgccttgttgctggcattgtgagccatgtaccggttaccagtatcaggtggacagatacacgtgtaaaacgtgcccatacgacatgcgtcccaccgagaatagaactggctgccgacccataccgattatcaaactggagtggggcagcccatgggcggttctaccattattcctcgctgtcgtcggtattgcagccaccctgtttgtagtcattacctttgtgagatataatgatacacctattgtgaaagcaagcggccgagaactgagctatgtcctcctggccggaatttttttgtgttatgccacaacctttctcatgatagcagaacctgacctcgggacgtgttcactgcgccgtatctttcttggtttgggcatgtccatcagctacgccgctctcctgactaaaactaatcgcatctatagaatatttgagcagggcaaacgttctgtatctgcccctagattcatctcgcctgcttcccaactagctattaccttttcccttatctcactacagctcctggggatctgcgtgtggtttgtggtcgatccaagccacagcgtggtagatttccaggatcagagaacgttggatcctagatttgcacgtggtgtgctcaagtgcgacatatccgatttgagcctcatttgcctgctcggctatagcatgctgcttatggtgacttgtacggtgtatgccattaaaaccaggggggttccggagacctttaatgaggccaagcctattggtttcacgatgtatacgacttgtattgtgtggctggctttcataccaattttctttgggacgtcgcagtccgccgacaagctctatatccagacaacaaccctaacagtgagtgtgtctctgtctgcttcagtatcccttgggatgctgtacatgcctaaggtgtatatcattttatttcaccccgagcagaacgttccgaagagaaagcggagcctgaaagccgtcgtgaccgcggcaactatgtccaacaaatttactcagaaaggcaattttcgcccaaacggagaagccaagtctgaattgtgcgagaatttagaagcccctgcactggccaccaagcagacctacgtgacctatacgaatcacgccatctag

SEQ ID NO: 224793 - DNA, 2319 bp, Artificial Sequence
  Description of Artificial Sequence: Synthetic coding sequence
atggtgcagactctgccaaagctcttcccgcacgatggcgctaagcggaagaagcgaacgcttcggacgagcgggccttgtttcggtgggggtggccaaatcccacagattagctacgcctctacagcccctgacttgtctgataattcaaggtacgacttcttcagccgggtggtcccctcagacacgtatcaggctcaggccatggtggatattgtccgtgccctgaaatggaactatgtctctaccgtcgcgtctgagggatcatacggagagtccggagtcgaagcatttattcagaaaagccgcgaggatggcggagtgtgtattgctcagagtgtcaaaatcccgagggaacccaaagccggagaattcgacaagatcatcaggcgattactggaaacatctaacgcccgagccgtgatcatttttgcaaatgaagacgacatacgcagagtgctcgaggccgctcgacgtgctaatcagacaggacactttttctggatgggaagcgacagttggggctctaagattgcccctgtcttacatctggaagaagtggctgaaggagcagtgacgatcctgccaaagagaatgagtgtccggggttttgaccgctatttcagctctcgcactttagacaacaaccggaggaacatttggtttgcagagttttgggaagataactttcattgcaagctgagtagacacgccctgaagaagggaagtcacgtcaagaagtgtacaaaccgagaacggataggtcaggattccgcctatgagcaggagggcaaagtccagttcgtgattgatgccgtttatgcaatgggccatgcactgcacgctatgcatagggatctgtgtcccggaagggtgggactgtgcccacgcatggaccccgtggatggcactcagctgctgaaatatattcgcaacgttaacttcagcggaatcgccggtaatccagtcacattcaatgaaaatggggacgcccctggcaggtacgacatatatcagtatcagctgagaaatgactctgccgaatacaaggtcatcggttcgtggacggaccatctgcacttgcgaatcgagcggatgcactggcccggaagtgggcagcaactgccgaggtccatttgctcactaccttgccagcctggcgaacgcaaaaagactgtgaagggcatgccctgctgttggcattgcgagccttgtaccggttaccagtatcaagtagatcgttacacttgcaaaacatgcccatacgatatgcgaccaactgaaaataggactggctgcagacctattccaattattaagcttgagtggggaagcccgtgggcggttttgcctttgttccttgccgtggtcggtattgcagccacattgttcgtagttattacatttgtgagatacaacgatacccctattgtgaaggcctctggcagggaattaagctacgtgttactcgccggtatttttctgtgttacgcaactacctttctgatgatcgctgaacccgatctgggaacatgctccttgagacgcatattcctgggcctcggcatgtccatctcctacgctgccctcctgacaaagaccaacagaatctatagaatctttgaacaaggaaagcggtccgtgtctgcccctcggttcatctccccggctagccagctggccattactttttctctcatttccctgcagttgttggggatatgcgtgtggtttgtcgtggacccttcccacagcgtggttgatttccaagaccagaggacacttgatcctcggttcgctcgcggtgtactgaaatgtgacatcagcgatctttctctaatatgtctgttagggtatagtatgcttctgatggtcacctgcacagtgtacgcaatcaagacccgaggagttccagagacattcaatgaggctaaaccaattgggtttactatgtacaccacatgtatcgtgtggctggccttcatcccaatattctttggcacaagccaatcggcagacaagctctacatacaaacgacaacccttacagtgtccgtcagtttgtctgcatctgtcagtttaggaatgttgtatatgccgaaagtttacattatcttgtttcaccctgaacaaaatgtgcccaaacggaaaagatcactgaaggctgtagtgactgcggcaacaatgtccaataaatttactcagaaggggaactttcggccaaatggagaagcgaagagcgagctttgcgaaaacctagaggccccagcattggcgactaaacagacgtacgtgacttacaccaatcacgccatctag

SEQ ID NO: 224794 - DNA, 2340 bp, Artificial Sequence
  Description of Artificial Sequence: Synthetic coding sequence
atggcagtcccactgggtgccccatgctgggccagcgcattgccagcatgggcaccacctggcctgccacacagaagtctgctgacaaggctccttagccagcacgtgaagcctgcaaaaattccccagataagctatgccagtaccgcccctgaccttagtgacaactctaggtacgatttcttctctagggtagtgccttccgacacctatcaggcccaggccatggtggatatagtacgagcccttaagtggaactacgtatccaccgtcgcctccgaaggaagttatggcgaaagtggagtggaggcctttatacagaagtctcgggaagacgggggtgtgtgtatcgcccagtccgtgaagatacctcgggagccgaaagctggggagtttgacaaaattatacgaagacttctggagaccagtaatgcacgcgcagtgatcatctttgccaacgaagacgacataagacgcgtcctagaggctgctagaagggcaaaccagaccggccactttttttggatggggtccgactcctgggggtctaaaattgcccctgtgctgcacctggaggaagtggccgagggcgctgtcaccatcctacctaaaaggatgagcgtgcggggattcgaccgatacttttcgagcaggacactggataacaaccggcgtaacatctggttcgctgagttctgggaggataactttcattgtaaactgtctaggcatgctctgaaaaaaggttcacacgtcaagaaatgtaccaatagagaacggatcgggcaagactcggcatacgagcaggagggaaaagtacagtttgtgattgacgcagtgtatgccatggggcatgctttacatgctatgcacagggacctttgcccagggcgagtgggtctctgccccagaatggaccctgtggacggtacccagctattaaagtacatccgaaacgtcaattttagcggtatcgctgggaaccccgtgacatttaacgagaacggcgacgcaccaggcaggtatgacatctatcagtaccagttgcgcaatgacagcgctgagtacaaggtcatcggttcttggaccgatcatttacacctccgcattgagaggatgcattggcccggatcaggacaacagctccctcggtcaatatgctccttgccttgccagcctggggaacgcaagaaaacagtgaaggggatgccctgctgttggcactgtgagccgtgcacgggctaccagtaccaggtggatcgctacacctgcaagacttgtccttatgatatgcgacctactgaaaacagaaccggctgccggcctatccccatcattaaactggaatgggggtccccctgggcggtattaccactctttctcgccgtagtggggatcgccgctaccctgttcgtcgtcatcacgttcgtccgctacaatgatactcctatagtgaaggcctccggcagggagctgagctatgttcttctcgccggtatattcttatgttatgcgacaacatttctgatgattgccgagcccgatctgggaacatgcagcctccggagaatatttctcgggctgggaatgtccatctcatacgctgcgctgttaaccaagactaaccgcatttaccgcatttttgagcagggcaagcgctccgtatccgccccacggttcatatctcctgcttcccaactcgctattaccttttccttaattagcctgcaactgctgggaatatgcgtttggtttgttgtggatccctcgcactctgtggtggactttcaggatcagcggaccctcgacccgagattcgctagaggggtgctgaaatgtgacatttctgacctatccttgatttgcctcctcgggtactctatgttgctgatggtgacctgcaccgtctacgctatcaaaactcgaggtgtaccggagacgttcaatgaagccaagcccatcgggttcacgatgtatacaacctgtatagtgtggttggcatttattccgattttctttggcacatcccagagtgcagataaactgtatatccaaaccaccacccttaccgtgagcgtgtctctgtccgcgagtgtgtctctggggatgttgtatatgcctaaggtctacatcattttgttccacccggagcagaatgtccccaagcgcaaacggtctcttaaggctgtggttacagcggctactatgagtaacaagtttacccagaagggaaacttccgccctaacggcgaagctaaatcagaactctgcgaaaacctcgaggccccagcgcttgccactaagcaaacatatgtcacctacacaaatcacgctatttag

SEQ ID NO: 224795 - DNA, 2739 bp, Artificial Sequence
  Description of Artificial Sequence: Synthetic coding sequence
atgccaggaaagcgtgggctgggctggtggtgggcacgactgccattgtgtctcctgctgagtctatacggaccctggatgccaagcagcctgggtaagcccaaaggacacccgcacatgaattctatcaggatagatggcgatatcacgctcgggggtttgttccccgtacacggaaggggctccgaaggcaaaccctgtggtgaattgaagaaagaaaagggtattcatcgactagaggctatgctcttcgccctcgacagaataaacaacgatcctgatcttttacctaacatcaccctgggagcccgtattttagacacttgctcaagggacacacacgcacttgagcagtcactgacttttgtccaagctcttattgagaaggacggtactgaagtgcgctgcggctccggcggacccccaatcatcacgaagcctgaacgagttgtgggcgtcattggagccagtggatcatccgtttcaataatggtcgccaatatcttgcgactttttaagatccctcagatctcttatgcctctaccgctcctgacttgagtgataactctcggtacgacttctttagccgagtagtaccaagtgacacatatcaggcccaagccatggtcgacatcgtcagggcattaaaatggaattacgtctcgaccgtggctagtgagggctcatatggggaatccggcgtggaggcctttatccaaaaatcacgcgaagatggtggagtgtgcattgcccagagtgtgaagattcccagggagcccaaggcaggggagtttgataagatcatccgcagattgcttgagacttctaatgccagggctgtgataatttttgcaaacgaggacgacatcaggagagtgctggaagcagccaggcgcgcaaaccagaccggccacttcttctggatgggatcagacagctgggggtcaaagattgcccctgttcttcatttggaggaagtggccgaaggcgctgttaccatactgccaaagcgaatgagcgtaagaggttttgatagatatttttccagtcggacactggataataacagacggaacatctggttcgctgaattttgggaagacaactttcattgcaagctatccagacacgcattgaaaaaaggatcccatgtcaagaagtgtactaaccgagagagaattgggcaggactccgcatacgagcaggagggtaaggtgcagtttgtgatcgatgccgtgtatgccatggggcacgccctccatgccatgcatagagatttatgccccggacgcgtgggattgtgtccaagaatggatcctgttgatggcacgcagttgctgaagtatatccgtaacgtgaatttcagtggtattgctggcaaccctgtgacttttaatgaaaatggggatgccccaggccgttatgatatctaccaataccaactgcgaaacgacagcgccgaatacaaagtgataggctcttggactgaccacctgcaccttcggatcgagcgtatgcactggccaggcagtgggcagcaattacctagatctatctgctcactgccctgccagccgggagaacgcaaaaagactgtgaaggggatgccctgctgctggcactgtgagccatgtacagggtaccagtatcaggttgacaggtatacttgtaagacttgtccttatgatatgaggcccaccgagaacaggaccggatgtcgccctattccaatcatcaagctggaatggggaagtccctgggctgtgttaccccttttcctcgccgtcgtaggtatcgctgccacgctgttcgttgtcataacatttgtgcggtacaacgatactccgatagtgaaagcatccggcagagagctgtcctacgtgctcctggcaggaattttcctgtgctacgccactacctttctcatgatcgcagaaccagacctggggacctgctctctgcggaggatctttctcggcctcgggatgtctataagctatgcagcactgcttactaaaaccaatcggatatatcggatctttgagcagggcaaacgctccgtctccgcccctcggttcatctctccggcaagccaactggccatcaccttttctctgattagcctgcagttgctagggatttgtgtctggtttgtggtagatccaagccattcagttgtggacttccaggaccaacgtaccctggatccacgcttcgcgcgtggggtgttgaagtgtgatattagtgacctttctctgatctgtctcctaggctatagcatgctccttatggtaacctgcaccgtgtatgccattaaaacgcgtggtgtgcccgaaacatttaatgaggccaagcccattggtttcactatgtatactacctgcatagtgtggcttgcctttattcccatttttttcgggacctcacagtctgccgacaagctatacatccagactacgaccctgacagtgtccgtgtcactctctgcgagtgtgtctctgggcatgttatacatgcccaaagtctatatcattctgttccatcctgaacaaaatgtccctaagcgtaagaggtcactcaaagctgttgtgaccgcagccactatgtcaaataagtttacacagaaaggcaactttcgacctaacggcgaagctaaatcagagctgtgcgagaacctcgaggcgcctgcactagctacaaaacagacgtatgttacgtacacaaatcacgcgatttag

SEQ ID NO: 224796 - DNA, 2232 bp, Artificial Sequence
  Description of Artificial Sequence: Synthetic coding sequence
atgtcctgcaaaatacctcagatctcatatgcctcgacagccccagatctttccgacaactccaggtacgattttttctctcgggtggtcccatcggacacataccaagcccaggctatggtggatattgtccgagctcttaaatggaattacgtctctactgtggcatccgaaggttcctatggcgaatcgggggtcgaagctttcatccagaagagccgcgaagacggcggagtttgtatcgctcagtccgtgaagattccacgggagcccaaggcaggcgagttcgacaaaattatccgcagactgctggagacctcaaacgcgagagcagtgataatattcgcgaatgaagatgacatacggagggtcctcgaggccgctagaagggccaaccaaacaggtcacttcttttggatgggttctgatagctggggctccaagatcgctccagtcttgcacttggaagaggtagccgagggagctgttacaatcttgccgaaacgtatgagcgttcggggattcgatcgctatttttcatcaaggaccttagataataaccgtcgcaatatttggttcgccgaattttgggaggacaacttccattgcaagctgtcacggcatgccctgaaaaaggggtcccacgtgaagaaatgtactaatagggaacggatcggccaagatagtgcttatgagcaagaagggaaggtccagttcgtgatcgacgcggtttacgctatggggcacgccttgcacgcaatgcaccgcgacctctgtcctggccgagtcggtctgtgccccagaatggaccccgttgatgggacccagctgctcaagtacatacggaatgttaatttctctggtatagcaggaaacccagtcacttttaacgagaatggagatgctccaggcagatacgatatctatcagtatcagttaagaaatgatagcgccgagtacaaggttataggttcctggactgatcacctgcatttgcggatcgagagaatgcattggcctgggtccgggcaacagctccccagatctatttgcagcctcccctgccagcccggtgaacggaagaagacagtcaagggcatgccctgctgttggcattgtgaaccctgcacgggctaccagtaccaggtcgatcggtacacatgtaaaacttgtccctatgatatgcggccaaccgagaaccgaacaggctgccgtcccatccccatcatcaagctggagtggggatctccctgggccgtcttaccactgtttctagccgtggtgggaatcgcggcaacactgttcgtggtgatcacattcgtacggtacaatgacactcctatagtgaaagccagcggaagggagctaagttacgtgttgctcgccggaatatttctctgctacgccacaacgttcttgatgatcgccgaaccggacctgggcacctgtagcctcagacgcattttcctcggtctcggaatgagcatatcttatgccgctctgcttacgaagactaacaggatttaccgcatattcgagcagggaaaacgttcagtgtctgctccaagatttatctcaccagcaagccagctcgctataacttttagcctcatctcactacagctcctgggtatctgcgtgtggtttgtcgttgaccctagccactcggtggtggatttccaggatcagcgaaccctcgatccgaggttcgctaggggtgttctgaaatgtgatatcagcgatctttctctgatctgcctgctgggttacagtatgcttctgatggttacttgcacggtgtatgccattaaaactcgtggagtccctgagacttttaacgaggctaagccaatcggattcactatgtatactacgtgcattgtgtggttggcctttatacccattttctttggcacctcgcaaagcgcagacaaactgtacatccagacgactacgctgactgtgagcgtaagtctgtccgctagcgtcagtcttggtatgctttatatgcccaaggtttacattatcctgttccatcccgaacaaaacgttccgaaaaggaagaggtccctaaaggctgtggtcacagcggcaactatgtcaaataagtttacgcaaaagggtaattttcgcccaaatggagaggctaaaagcgagttatgtgaaaacctggaagccccagccctcgccaccaagcagacctatgttacttacacaaaccatgccatctag

SEQ ID NO: 224797 - DNA, 1776 bp, Artificial Sequence
  Description of Artificial Sequence: Synthetic coding sequence
atgggatctgacagctggggatcgaagattgctcccgtgctgcatctggaggaggtggctgagggagctgtgaccatcctccccaagcgcatgtccgttcggggattcgatcgctatttctctagccggacccttgataataaccggaggaacatctggtttgccgaattctgggaagacaatttccactgtaaactgagtcgacacgccctgaaaaaaggtagtcacgtgaaaaagtgtactaatagggaacgcataggccaggactcagcgtacgaacaggagggtaaagtgcagttcgtcattgatgccgtctatgccatgggacatgctctgcacgctatgcatcgggatctttgccccggtcgtgttggactatgccccagaatggatcctgtagatggtactcagcttctcaagtatattagaaacgtaaacttcagcgggattgcaggtaaccccgtgacctttaatgaaaatggcgatgctcccggtagatatgacatctaccagtaccagctgagaaacgactcagccgagtataaggtgattggcagctggaccgaccatttgcacttgcggattgaacgcatgcattggcccggatctggacagcagcttcctagatcaatttgctcgcttccctgccagcctggggaaaggaagaaaaccgtgaagggcatgccttgctgctggcactgtgagccatgtacggggtaccagtaccaggtcgatcgctatacgtgcaaaacatgcccttatgatatgagacctactgagaaccggacagggtgtcgaccaatccctattataaagttggaatggggctcgccttgggctgtgttaccattgttcctggcagtcgtcggcattgctgcaaccctgttcgtggtgatcacatttgtccgctacaatgacactccaatagtcaaggccagcggccgtgaattgtcgtacgtgctcttggctgggatcttcctgtgttatgcaactacttttctcatgattgcagagccagatctaggcacatgctcactgaggcgcatcttcctcggcctggggatgagtatctcttatgccgcattgttaaccaaaaccaataggatctaccggattttcgaacagggcaagcgtagcgtgtctgcaccccgattcatctcaccagccagccaacttgctatcacgttcagcctaatctccctccagctcttaggcatatgtgtgtggtttgttgtagacccctcccattcagttgttgactttcaggatcagcggacactggaccccaggttcgccagaggagtgcttaaatgtgacatctctgacctgagcttaatttgccttttgggctactccatgcttctgatggtgacgtgcactgtgtatgctatcaaaacccggggagtccctgagacatttaatgaggctaaaccaatcggattcaccatgtatactacgtgcatcgtgtggctggccttcatcccaatattcttcggcactagtcagtcagctgacaaactgtacatccagactactacactgactgtgagtgtcagcctcagtgccagtgtgagtttaggcatgttgtatatgcctaaggtgtacatcatcttgtttcatcctgagcaaaatgtgcccaagaggaagcggagcctgaaggcggtcgtgacagccgctactatgtcaaacaaatttacccagaaaggaaatttccgccctaacggcgaggccaagtcggagctttgcgagaaccttgaagccccaggttcctcctag

SEQ ID NO: 224798 - DNA, 2364 bp, Artificial Sequence
  Description of Artificial Sequence: Synthetic coding sequence
atggagcccgcaggagagcggtttcctgagcagcgacaggtgctgatccttctgctgctgctcgaagttacactggcaggctgggaaccgaggagatacagtgtgatggaagaaaccgaacgcggtagctttgtagcaaatcttgccaacgatttaggactgggcgtgggcgagcttgcagagaggggagcacgcgtcgtgtcagaggacaatgaacaaggtctccagcttgacctgcaaaccggacagttgatcttgaatgaaaagctcgatagagagaaactgtgcggtcccacagagccttgcattatgcacttccaagttctcctcaagaaacctctggaggtttttagagctgagctcttggtgactgacataaatgaccactctcccgagttcccggaacgcgagatgactttgaagatcccggagacttcaagcctggggaccgtgttcccattgaaaaaagctcgcgatctggacgttggctccaacaacgtccagaactataacatctctcccaatagccatttccacgtgagcacccgcacccgaggggatggtcgaaagtatccagaattggtcctcgacaccgagttagaccgcgaggagcaagcagaacttagacttacgctgactgcagtcgatggtggcagccccccaaggtccggaacggtccagattctaattctggtgctggacgccaacgataatgctccagaattcgtgcaggctctgtatgaagttcaggtccccgaaaatagccccgtagggagtctggtggttaaggtgagcgcgagagatcttgacaccggcaccaacggcgagatctcttacagcctgtactattcttctcaggagatcgacaaaccttttgaacttagttctctgtctggagagatccgcctcattaagaaactggacttcgagaccatgtcgagctacgacctggacatagaggccagcgatgggggtggtctgagcggcaagtgcagcgtgtctgtgaaagttctggacgttaacgacaattttcctgagctctcaatatcttccctcacctcccccatccctgagaactccccggagaccgaggtagccctgttccgaattagagatagagattcaggagagaatgggaagatgatttgctctatccaagatgacgtcccctttaaacttaagcctagcgtggagaacttctatagattggtgaccgaaggtgcactcgatcgggagacccgcgctgagtataacatcaccatcaccattaccgacctggggacacccagactgaagactgagcaatcaatcaccgttcttgtttccgatgtaaatgacaacgcaccagcgttcacgcaaaccagctacaccctatttgtaagggagaacaatagtccggcactgcacatagggtcagtgagcgctacagacagggattcgggcaccaatgcgcaggtcacatattccctgcttcctcccagggacccccaccttcccctgactagtctggtctctataaacaccgacaacggtcacctctttgcgctccaaagcctggattatgaggctctgcaggccttcgagtttcgagttggggcaactgacagggggttccccgcattgagtagcgaggctctggtacgagtgcttgtgctcgacgctaatgataacagcccctttgtgttgtaccccctccagaacggctccgcaccatgcacagaactggtgcctcgggcagcggagcccggatacctggtaacaaaggttgtggccgtcgacggagatagcggacaaaacgcctggctcagctaccagctgctgaaagccactgagcctggcctttttggagtgtgggcccataacggggaggttcgcactgcacggctcttgtccgagcgtgacgtggcgaagcaccgtttagtggtgcttgtcaaggataacggagaaccgccacggtccgccactgcgacccttcaagtcctcctggtggatggatttagccaaccttacctgccactgccagaagctgccccagcacaagctcaggctgatagtcttactgtgtacttggttgttgctctggcttccgttagctcactgtttctgtttagcgtgtttctgtttgtcgctgtccgactctgccgaaggtcccgtgcggcttctgtcgggcgatgctcagttcccgaaggccctttccccggacacctggtagatgtgagcggaaccggtaccttatcacaatcctaccaatacgaggtgtgcctgactggcggatcagagtcgaatgattttaagtttctgaaacccatcttccccaatattgtttctcaggatagcagacgaaaaagcgagttcttagagtag

SEQ ID NO: 224799 - DNA, 3276 bp, Artificial Sequence
  Description of Artificial Sequence: Synthetic coding sequence
atgcagcttgatggactgcaagcgctttgttggggctcactgttcaggacgcagctggttccagtgtacgtggctgtgctgccttctcctcaaccttgtattccgccaacctgcacggcgttcaccgagttctctggcccactcgctaagcaccattcgtttcagccttttcaagtcgctgctcccgcagggcctcgttcccctccacagccattccacctgccctctgtctctcaggtgcatgcgacccacctgctatgtcccgtgagagtgctcggaccaccatatccgccttcactggagctgctgacatcaattcatagccccgctgtcctaccagcaccccagatcccccagattagctacgcaagcacagcacccgaactaagcgacagcaccaggtatgatttcttttcacgagttgtgccacccgatagctaccaagctcaggctatggtggatattgtgagggccctaggctggaactatgtgagcaccctagcatccgagggcaactatggcgaaagtggagtggaagccttcgtccagatcagcagagaagcaggggaactcggtgcccctcgccatcaaggtgtgtacatcgtgtgggctagaggcccacagctgggtcaaaagcagaaggacgggggaccgagaagcatgcttggccgtggttgcctggctggcgcaccttgtggccgtgacctgttcgttcttgacgattcagccctgcctcaggcctggcgacgggtgcaggctcggctccacccctgccgcccttttagccagcctactcagagttccgccgcagtggctaggtggtccattaagatacctcgggagccaaaacctggcgagtttagtaaggttatccggcgattgatggaaacccccaacgcgaggggcattatcatttttgcaaacgaagatgacattagtccagcccctactaggcgtgtgttggaagctgccagacaagccaatcttaccgggcactttctttgggtggggtccgacagttggggtgcgaaaacatcccctatcttatcccttgaggacgtggccgtgggggcaataaccatcttgcccaagagggccagcatcgatggatttgatcagtactttatgacccgcagcttggagaacaaccgtcggaacatttggttcgctgagttttgggaggagaactttaattgtaaactcacctcaagcggcacccagagcgacgactccacacgcaagtgtactggagagagctgcccaggctggacgggcgaggagcgcattggaagggacagcacatatgagcaagagggcaaggtgcaattcgtcattgacgccgtctacgctatcgcccatgccctgcatagtatgcatcaggcgctgtgtccaggccacactgggctctgccccgctatggagcccacagatggtaggatgctactccaatatattagatgtcccttacagtggttgaataggataccattgtgtgaatggccaaggagggtccggcctttcttctgccagtggacacttgggttactctcttcttgcggctatgtgaataacgccgctgtaaatgtggctgtccaggcgttcctggctacactgctgtcgagtctgtcttccatctatccaggggtcgagctgctcgggcatgtcttcaatctgttgcgcagactgcataccgtgttttgttccggctgttccttattccccccaacggtgcataagggcagtgccggaacacctgtgatgttcaatgagaacggggacgcacccggaagatacgacatattccagtaccaagccaccaatggttccgcgtcgagcggtggttaccaagcagtcggccaatgggccgaaacactgcgacttgacgtcagtgtgcaaactgaaccccaggttggcatgggccctggatcgcgtaggcaaacaccacaacccgtgttctgtgcctctcaggtggaagcgctgcagtggtccggggatccacacgaagtgccgtccagcctttgtagcctcccttgcggcccaggagaaagaaagaagatggtgaagggagtgccgtgctgctggcattgtgaggcgtgcgacggctacagattccaggtcgacgagttcacttgtgaagcgtgccccggtgacatgagacccacgccaaatcacacaggatgtagaccaactcctgtcgtccgtctaagttggtcttccccctgggccgcaccacccttgctgctagctgtgttgggcattgtagccaccaccaccgtggttgcaaccttcgtaaggtacaacaacactcctatcgtcagggcctccggccgagagctctcgtacgtgctcctgactggaatcttcctgatatacgccattacgttcctgatggtggcagaaccaggcgctgccgtgtgcgccgctagacgcctgttcttaggcctgggcaccactctgagctacagtgctttactcacaaagactaatcggatctatcgaattttcgaacaagggaagcgttcagtcacgccacctccctttatctccccgacgagccagctcgttatcacgtttagcctgacatctttacagataaacgccgtattcagagtgaccctgttttacttcggctcccttcaatggcactacctctcctccctccaggcactgccaagtggcgacctcagcgtgcagcatctgtctgcctcagtgtcactcgggatgttatatagtaagtcaaaaacccctgtggatctggaggtcggctccgagccatggggttacctaggcgatggtgttcttcaggccgagcattggggtgaaggaaggggcgattggccccacgtgaaggtcatggtcgtagtgtaccagtctagcctggtgtattatatgaagcaggcccaagccggtagggtgaagacagagctgttaaaagtagctcaccatcaggtcgccaagtcagtccccgaagagtctcagatcgtggtgctgcatttggtgaccgcaggctatgtggacatggccatccgcacaaccagggcctccctgcatttgatgcccctaactctcgtacctggtgctgcagccgaagttaatgaaactcaggttgcggcacgtcttggtcctggctccactgtgggaacctaccaggtcgtcgttgtcctaatgaggtcattacagatagataagaccaccaatcaattgtctcttgaaacctgttttagcgggattcaaggcttcctcgccagcgtaaacagcctcgtgatggataagtag

SEQ ID NO: 224800 - DNA, 2634 bp, Artificial Sequence
  Description of Artificial Sequence: Synthetic coding sequence
atggcacgcccacggcgagccagggagccacttctcgtcgccctcttacccctggcctggctggcccaggcaggactagccagggcagccggatctgtgcgcctggctggagggttgaccttgggcggtctgtttcccgtacatgcccgaggcgctgccggacgcgcatgcgggcaactcaaaaaagaacagggcgtccaccgcctggaggcaatgttgtacgctcttgaccgggtcaacgccgatccggagctgctccccggagtgaggctgggggctcgcctgctggacacctgctcccgggatacttacgccctggaacaagccctaagttttgtgcaggcccttatcagaggccgaggtgacggcgatgaagtcggcgtgcgttgtcccggaggggtccctccccttcgaccagcccctccagaaagggtggtcgccgtggtgggagcttccgcatcctccgtatctataatggtggctaacgtgctccgcctgtttgctatcccgcaaatttcttacgcaagcacagccccagaattgtcagatagtacccggtacgacttttttagccgagtggtccccccagactcctaccaggctcaggccatggttgacatagtgcgggcactgggctggaattacgtgtccacacttgcgtccgaaggaaactatggagaaagcggagtagaggccttcgtccaaatctccagagaggcaggaggggtgtgtattgcccaatccatcaaaattccgagagaacccaaacccggtgagtttagcaaggtgatacggagactgatggaaacccccaacgccaggggcattatcattttcgccaatgaggatgacattaggcgagtccttgaagctgccagacaggcgaacctgactggccacttcctatgggttggctccgactcgtggggggctaaaaccagccccatccttagtctggaggatgtggccgtaggagcaatcacgatactccctaagagggcaagcatcgatggtttcgaccagtacttcatgactcgcagcctggagaataatagaagaaatatctggtttgccgaattttgggaggaaaattttaattgcaagctgaccagctcagggacgcaatctgacgatagcacgagaaagtgtaccggcgaagaacggattggcagggattcaacatatgaacaagaaggtaaggtgcagttcgtgattgatgcagtgtacgccattgcacacgctctgcactccatgcaccaggcgctctgcccagggcatacaggactgtgcccagcgatggagcctacagatggacgaatgctcttacaatatataagggccgtgaggtttaatggcagtgctgggacgccagttatgttcaatgagaacggtgatgcgccaggacgatacgacatatttcaatatcaggctacgaacggatccgctagctctggaggctatcaggccgtgggtcagtgggcggagacccttcgtctggacgtcgaagctttgcagtggagcggtgacccccatgaagttccgagcagtttatgcagcctgccatgcggcccaggggagagaaaaaaaatggtgaagggagtcccgtgttgctggcactgcgaagcctgcgacggatataggtttcaggtcgatgaatttacctgtgaggcctgtcccggagatatgcgacccacccctaaccatacgggttgtaggccaacacccgtggtcaggttgtcttggagttcgccctgggctgcccctcctctacttttggctgtcttgggcattgttgctacgacaaccgtggtagccacatttgtaaggtacaataatactcccattgtcagagcttcaggcagagaactctcttacgttctgctcacaggtatctttcttatttacgcaattacttttttgatggtggccgaaccgggtgccgctgtctgcgccgcacgcagactttttctagggcttgggacaacgttgtcctatagcgcactactgacgaaaacaaatcgcatctaccgcatttttgaacagggcaagcgtagcgtgacgcccccacccttcatcagccccactagtcagttagttataactttttctttaaccagcttgcaggttgttggaatgatcgcgtggctcggcgctcgacccccacacagcgtgattgactatgaagaacagaggacggttgaccccgagcaagccaggggagtgctcaagtgcgacatgtcagatctgtcactgatcggctgtcttggctactccctgttattaatggtgacgtgcactgtctatgctattaaagcgcgtggtgttcccgaaacgttcaatgaggcaaagccaattggcttcacgatgtacaccacctgcatcatttggttggcattcgtgcctattttcttcggcaccgctcaatcagccgaaaaaatatatattcagactacaacgctgaccgttagccttagcttgtcagccagtgtcagtctgggcatgctatatgtcccgaagacttatgtgatcctcttccatccagagcagaatgtgcagaagagaaaacgcagtctgaaagctacctcaactgtcgcggcacctcctaagggcgaagacgccgaagcacataaatag

SEQ ID NO: 224801 - DNA, 2748 bp, Artificial Sequence
  Description of Artificial Sequence: Synthetic coding sequence
atggtgcaactcaggaagcttctcagagtactaacgttgatgaaattcccgtgttgcgtgctggaggtactgttatgcgctctggctgctgctgcacgcggacaggagatgtacgcccctcattctataagaattgagggcgacgtgacattgggaggactgttcccagtccacgccaagggtccatcaggcgtgccttgtggagatataaaaagagagaatggtatacaccggctggaagctatgctctatgcccttgaccagattaacagcgacccgaatttattacctaatgtgacattaggggctcggatactcgacacctgctcgcgtgacacgtatgcactggagcaatccttgacctttgtgcaggccctgatccaaaaagatacctccgacgtgagatgtacaaatggagagcccccagtgtttgtgaaacctgaaaaagttgtcggagtgattggagcctccggttctagcgtgtctatcatggtggccaatatcctgcggctgttccaaatcccccagatctcctacgcatcaacagccccagagctgtccgatgacagacggtacgattttttttccagggtcgtcccgcctgacagcttccaggctcaggccatggtcgatattgtgaaggccctcggatggaattacgtttctaccctggcctcagaagggagctacggggaaaagggtgtggaatcttttacccagatctcaaaagaggccggaggcctctgtatcgctcagtcagtaaggattccccaggaacgaaaggatcgcactatcgattttgaccgcattatcaagcagctgctggacacacctaacagtcgcgcagtagtcatcttcgccaatgacgaagacattaaacagattcttgccgctgcaaagcgggcagatcaagtaggccactttctttgggtcggttccgattcttggggctctaaaatcaacccactccaccagcacgaggacatcgctgagggcgctatcaccatccagccaaaaagggccaccgttgaaggcttcgatgcttatttcacctcccgaactctcgaaaataaccggcgtaacgtgtggtttgcagagtattgggaggagaacttcaattgtaaactaacaatttctgggagcaagaaggaagatacggaccgcaagtgcaccgggcaagagcggatcgggaaggactcaaattacgagcaggaaggcaaggtgcagttcgtcattgatgctgtttacgcgatggctcacgctttgcaccatatgaacaaagacctttgtgccgactatcgaggggtgtgccccgagatggagcaggcaggaggcaagaagctgctgaagtacatcaggaatgtcaatttcaatggtagtgctggtacccctgtgatgtttaataagaacggcgatgcacccggtaggtacgatatcttccaatatcagacaaccaataccagcaatccaggctaccgcctgatcgggcagtggaccgacgaactgcagctgaatatcgaggatatgcaatggggtaagggcgtgcgggagattccagctagtgtgtgcactttgccttgtaagcctgggcagcgcaagaagacccaaaagggcacaccttgttgctggacctgcgaaccttgcgatggctaccagtatcagtttgatgaaatgacgtgtcagcactgcccgtatgatcagagacctaatgagaacagaaccggctgccaggacattcccatcataaaattagaatggcactctccatgggcagtgatccctgtgtttctggccatgcttggcatcatcgccaccatttttgtcatggccacctttatccgctacaacgacacccctatagtgcgcgcatcagggcgtgagttatcttacgtactactaacagggattttcctttgctacatcatcacttttttgatgatcgccaaaccggatgtggcagtgtgttctttccgaagggttttcctaggccttggaatgtgtatctcatatgctgccctgctgacaaagacgaaccgaatttatagaatcttcgagcaggggaaaaagagcgttaccgcacccaggctgatttcccccacttcccagttggctatcacgtcaagcctgattagcgtacagctcttgggcgtgttcatatggttcggggtagatcctcctaacatcatcatcgactatgacgaacataagacgatgaatcccgaacaggccagaggggtgttaaagtgtgatatcactgaccttcagataatctgtagtcttggctattcaatcctgctgatggttacatgtacggtttatgccattaaaacaagaggggtgcctgagaattttaacgaggccaaacctatcgggttcactatgtacactacatgcattgtttggctggcctttattcctatcttcttcggaacagcccaaagtgccgagaaactgtatatccagacaacaaccctgactattagcatgaacctgtccgcctccgtggcattaggcatgctgtatatgcccaaggtttacatcattatctttcatccagaactgaatgtccagaagaggaagaggagctttaaagccgtcgtgacagcagctacaatgtcctccagactctctcacaagccaagcgaccggccaaatggagaggctaaaaccgaactctgtgagaacgtggatccgaattccccggcagccaagaagaaatacgtcagttacaataacctggtgatctag

SEQ ID NO: 224802 - DNA, 2721 bp, Artificial Sequence
  Description of Artificial Sequence: Synthetic coding sequence
atggtccagctgagaaaactcctgcgcgttctcacccttatgaagttcccttgttgtgttttggaagtgctgctgtgtgcgttggcagccgctgccagaggccaggagatgtatgcccctcacagtataagaatcgaaggagatgtgactctggggggtctgtttccagtccacgccaagggcccttctggggtgccttgtggggacatcaagcgggaaaatggtattcacaggctcgaagcaatgctgtatgctcttgaccagatcaattccgatcccaatctgctgcccaatgtcactttgggcgcacggattctggacacttgttctcgagatacttacgcattggagcagagtttaacctttgtgcaggcgctgatccaaaaagacacatctgacgtccggtgtacaaacggtgagccgcctgtattcgtgaagccagaaaaggttgtcggggtgatcggggcaagtggcagctcggtcagtatcatggtggctaatatcctgaggctgtttcaaattccccagatcagttatgcctctaccgcgccagaattgtctgatgacaggaggtacgatttttttagcagagtggtcccacctgactcattccaggcccaggctatggtggatatcgtgaaggcactgggttggaattacgtaagcacattagcgtctgagggatcatatggtgagaagggagtggagtctttcacacagatctctaaggaggcaggcggactgtgcatcgctcagtcagtccgaatccctcaggagcgcaaggataggaccatcgacttcgatagaataatcaagcagctgctagatactcctaattctcgggctgttgtcatctttgctaatgatgaggacataaagcaaattttggccgctgccaagcgggctgaccaggtggggcattttttatgggtgggcagtgattcctggggctccaaaattaacccactgcatcaacacgaggacatagcggagggagctatcaccatacagccaaaaagagctaccgtagaaggcttcgatgcatactttacctcaaggacactggagaataaccggagaaacgtctggttcgctgagtactgggaggagaatttcaattgcaaactcaccattagcggatctaagaaggaggacacggatcgcaagtgtacaggccaggagaggatcgggaaggattcaaattacgaacaggagggcaaagttcagtttgttatcgacgctgtctatgctatggcccacgcgcttcaccacatgaacaaggacctttgtgccgattatcgaggcgtatgccctgagatggaacaggcgggagggaagaaactgctcaaatatattaggaacgtgaactttaatggctctgctggcaccccagttatgttcaacaagaatggggacgccccaggccgttacgacattttccagtatcagactacaaacacgagtaacccagggtacaggctgatcggacagtggaccgatgaactacagttgaatatagaagatatgcaatggggcaagggtgttagggagattcctgccagcgtgtgcaccctgccatgcaaaccgggtcaaagaaagaagacccagaaaggaaccccatgctgttggacttgtgaaccgtgcgacggataccagtaccagtttgacgaaatgacctgccagcactgcccatatgaccagcgacctaatgagaaccgtacgggatgtcaggatatacctataattaagctggagtggcattccccatgggcagtcatccccgtcttcctggctatgcttggcatcatcgccacgatcttcgtgatggccacattcattagatacaacgatactccaatcgtccgagcatctggtcgggaactctcctacgtgctgcttaccggtatcttcctttgttatatcatcaccttccttatgattgcaaagccagacgtggcggtgtgcagcttccgcagagtctttctgggtctcggaatgtgtatcagctatgccgcactgctgactaaaaccaatcggatctaccggattttcgaacaggggaaaaaaagcgtgaccgctccaaggcttatctcccctacatcccagctggctattacttcctcgctgatttctgtgcagcttctcggcgtgttcatctggttcggtgtcgaccccccaaacattatcatcgattacgatgagcacaaaacaatgaaccctgagcaagcacgcggagtgctgaagtgcgacattactgatctccagattatttgttctctcggttactccattttgctcatggtcacatgtacggtgtatgcaataaaaacgagaggtgtgcctgaaaacttcaatgaggccaaacctatcgggttcaccatgtacaccacgtgcatcgtttggctggcatttataccaattttctttggcactgcccagagtgctgaaaagttgtatattcagactacgacccttaccatctcgatgaacctctctgcctcagtggctttgggcatgctttatatgcccaaagtgtatatcattattttccaccccgagctcaacgtccagaagaggaagcgcagctttaaagctgtcgtgaccgcagcaacaatgtcaagcaggctttcgcataaaccctccgacaggccaaacggggaggccaagacagaactgtgtgagaacgtggatcccaattccgaaaagtgtaattgttattag

SEQ ID NO: 224803 - DNA, 2769 bp, Artificial Sequence
  Description of Artificial Sequence: Synthetic coding sequence
atggttcagctgcgtaaactgctaagggtgttgaccctcatgaagtttccctgctgcgtgctcgaggttctgttgtgcgcattggcggctgccgctagaggtcaggagatgtacgcaccccattctatcaggatcgaaggcgatgttacgcttggagggctgttccccgtgcacgccaagggccctagtggcgtgccatgcggggacatcaaaagagagaatggcattcatcggctggaggctatgctttatgccttagaccagatcaatagcgacccaaacctattgccgaatgtgactctgggggcacgcatcctggatacatgctctcgcgacacatatgccctcgagcaaagtctcacattcgtgcaggctctgatccaaaaggacacaagcgatgttagatgcactaacggtgaacctcccgtttttgtcaaaccggaaaaagtggtgggagtcatcggcgcaagtggctcttcagtttccataatggtggcaaacatcctgcgcttatttcagattccacagatatcttatgccagcactgccccagaactgtcagacgacaggcggtatgattttttctctcgggtcgtgcctccagactctttccaagcacaggcgatggtggacattgtgaaggccctgggatggaactacgtgagcactctggcctccgagggcagctacggtgaaaagggggttgaaagtttcacacagatcagtaaggaggctgggggtctgtgtatagctcagagcgtcaggattccgcaggagcgcaaggacagaacaatcgatttcgaccggatcataaagcagctgctggacacccctaactcgagagccgtggtcattttcgcaaatgatgaggatattaagcaaattctggcagccgctaagagggccgaccaggtggggcattttctctgggtagggagcgacagctgggggagcaagatcaaccctctacaccagcatgaagatattgcggaaggagcaatcacgattcagccaaaacgggctacagtcgaaggcttcgatgcctactttacatctcggaccctggagaacaatcgcagaaacgtttggtttgcggaatattgggaagagaactttaattgtaagctcaccattagtggctccaaaaaagaagatacggaccggaagtgtaccggccaggaacggattgggaaggacagcaactacgagcaggaagggaaggttcagttcgtaatcgatgcggtctacgcaatggcccacgcccttcaccatatgaacaaggacctgtgcgccgattacaggggtgtttgccctgaaatggaacaagccggtggtaaaaagctgttaaagtatattcgcaatgtcaatttcaacggcagcgctgggacccccgttatgttcaacaaaaacggagacgctcccggacggtacgatatctttcagtatcagaccacaaacacttcaaacccgggttaccgccttatcggacaatggacagacgagctgcagctgaatatcgaagacatgcagtgggggaaaggcgtcagagagatacccgcatctgtctgtacactgccatgtaaacctgggcagaggaagaaaacccagaaagggacaccgtgctgttggacttgtgaaccttgtgatggttaccagtatcagttcgacgagatgacatgtcagcattgcccatatgatcaacgcccaaacgaaaatagaactggctgccaagacatccccattatcaagctggaatggcattctccatgggccgttatcccagtcttcctcgccatgctgggcataatcgccaccatctttgtgatggcgacgtttataaggtacaatgacacccccatcgttagagcaagcggcagggagttgagttacgtcctgttgactggcatctttctgtgctacattattaccttcttaatgattgctaagccagatgtggccgtctgcagttttagacgggtgtttctgggcttggggatgtgcatttcctacgccgcactccttacgaagaccaatcgtatctaccggatttttgaacagggcaaaaagtcagtcactgctcccagactgattagcccgacatcccagctggccattacctcaagtctgatctctgtccagttgctgggcgttttcatttggtttggagttgacccacctaatatcattatcgattatgatgaacataaaacgatgaatccggaacaagcccgaggcgtgctgaagtgcgacatcaccgatcttcagatcatctgctctctggggtattctatactcttaatggtcacctgtaccgtttacgccatcaaaacacgtggcgtgccagagaacttcaatgaagcgaagcctattggttttaccatgtacactacgtgtatcgtgtggttagcctttattcccatatttttcggtactgcccagtccgcggaaaagctgtacattcagacgacaacacttaccatctccatgaacctctctgcaagcgttgcccttggcatgctgtacatgcctaaggtctatataattatctttcaccccgaactgaacgtgcagaagagaaaaagaagcttcaaagcagtggtaacagctgctactatgtcaagccgcctgagccacaaaccttcagatcggcctaacggagaagccaagacagagttgtgcgagaatgtcgatccaaataactgtatccctcctgtgcggaagagtgtgcagaagtcggttacatggtataccataccccctacagtgtag

SEQ ID NO: 224804 - DNA, 2736 bp, Artificial Sequence
  Description of Artificial Sequence: Synthetic coding sequence
atggtccagctgcgcaagttactccgtgttcttaccttgatgaagttcccatgttgcgttttggaagtgctgttgtgcgcactggcggctgctgcccgtggacaggagatgtacgctccccattcaatcaggatcgagggggacgtaacgttgggcggactgttccctgtacacgctaaaggaccaagtggtgtcccctgtggggatattaagagagagaacggcatccatcggctagaggccatgctgtatgcactggatcagattaatagcgacccgaaccttctccccaatgtaaccttgggagcgcgaatcctggacacttgctcccgggatacatatgctttagaacaaagcttgacgttcgtgcaagcactaatccagaaggataccagtgatgttcgctgcaccaatggggaaccccctgtgttcgtcaaacctgagaaggtcgtcggggttatcggagcctcaggctcctccgtgagcattatggtggctaacattctgaggctcttccagattcctcaaataagctatgcctccactgcgcctgagttgtccgacgatcgacgatacgactttttttccagggtcgtaccgcctgactcttttcaggcccaggccatggtggacatcgtaaaggccttgggctggaactatgtttccactctggctagcgagggctcatatggcgagaagggcgtggaatccttcacccaaatatcgaaggaagccggaggtctgtgtattgcccaatccgtccggataccccaagaacggaaggatagaacgattgacttcgatagaatcatcaaacaactcttggacacgcctaacagccgcgcagtggttatcttcgcgaatgacgaggacatcaaacagattctagcggcagccaagagagccgatcaggtgggacattttctatgggtagggagcgattcttggggcagtaagataaatcctctacatcagcatgaagacattgctgaaggcgcaatcaccattcagcccaagagagctacagttgagggttttgacgcctacttcaccagccgcacactcgagaacaaccggaggaatgtgtggtttgccgagtattgggaggaaaacttcaactgtaagctgacgatctctggaagcaagaaagaggataccgaccgaaaatgtacaggccaggagagaattgggaaggacagcaactatgagcaggaggggaaggtgcagttcgtcatcgacgcggtgtacgcgatggctcacgcactgcaccatatgaataaagatttgtgtgccgattacagaggggtgtgccccgagatggagcaggctggtggaaagaaactgctcaagtacatcagaaacgtgaactttaacggaagtgccggtactcccgtaatgtttaacaagaatggagacgccccagggcgatacgatatctttcagtaccagactactaatacctctaatccagggtacaggcttatcgggcagtggacggatgagctgcaacttaatattgaggacatgcagtggggcaaaggggtacgggagatacccgcatctgtgtgtactctcccttgtaaacccggtcagcggaaaaagacacagaaaggtaccccatgttgctggacctgcgagccatgcgacggctaccaataccaattcgacgaaatgacatgtcagcactgtccctacgaccaaagacccaacgagaataggaccggctgccaagacatccctattattaagttagagtggcattctccatgggccgtaatcccagtctttctggccatgcttggtatcattgccacaatctttgtgatggcaacttttatccgatacaatgacaccccaattgttcgtgcttccgggcgtgagttgagttacgttctgcttaccggcatttttctgtgttacataataacctttctgatgatagccaaaccagacgtcgctgtttgtagtttccgccgtgtgtttctgggccttggaatgtgtattagctatgcagcattgttgaccaaaaccaatcgcatctatagaatttttgagcagggtaaaaaaagtgtgacagcccctcgtctgatcagccctaccagccagctggcaatcacctcctctttaatttccgtccaacttctaggcgtgttcatttggtttggtgtggatccccctaacatcatcatcgactacgacgagcacaagaccatgaatcctgaacaggctcggggtgtactgaaatgtgacattacagacctccagattatttgtagtttaggttatagtattctacttatggttacctgtacggtgtacgccatcaaaacgcgcggagtgcccgaaaattttaacgaagccaagcccatagggttcaccatgtacacaacctgcattgtctggttggcgttcatacccatttttttcggaacagcccagtctgcagaaaaattatatatccagaccacaaccctgactatctccatgaatctatctgcctcggtcgcgctgggcatgctgtacatgccaaaggtttatatcataatcttccaccccgagctgaatgtgcagaagcgaaagcgctcattcaaggccgtggtcaccgccgctactatgtcctccaggctcagccacaagcccagcgaccgaccgaacggggaagccaagacagagctctgcgagaacgtcgaccccaacattacctcggaggacctgagcctgcataaagaggactag

SEQ ID NO: 224805 - DNA, 2475 bp, Artificial Sequence
  Description of Artificial Sequence: Synthetic coding sequence
atggtccagctaagaaaattattgcgagtgctgacacttatgaaatttccctgttgtgttctggaggtgctcctctgcgccttggccgctgcagcccgagggcaagagatgtacgcgcctcacagcatccgcatcgagggggatgtgacccttggcggactgttccctgtacacgccaagggcccaagcggggtgccatgtggagatattaagagagaaaacggaatccaccggttagaagccatgttgtacgccctggatcaaatcaatagtgaccctaaccttttgccgaacgtcaccctcggggcaaggatactggatacttgctctcgcgacacttacgccctggagcagtcgctgacgtttgtgcaggccctgattcaaaaggatacctccgacgtccggtgcaccaatggcgagccacctgtgtttgttaagccagagaaagtggtcggcgtgatcggggcttccgggtctagtgtaagtattatggtggccaatattctgagactgttccaaatccctcagatctcctatgccagcacggcaccggaactgtctgacgacaggagatatgattttttttccagagtcgtcccacccgatagcttccaggcccaggctatggttgacatcgtgaaagcactggggtggaattatgtttcaactctggcctctgagggaagctacggtgaaaagggagtggagtcttttacccagataagcaaggaggccggtggtttgtgtattgcacagagcgtgcgcattcctcaggaaagaaaggatcgaactatcgactttgatcgtattatcaaacagctcctggatacccctaatagcagagccgtggtgattttcgcgaatgatgaggatattaagcagattctggcggcagcgaagagggctgatcaagtcggccacttcctgtgggtcggctcagactcctggggaagtaaaatcaaccctttacatcagcacgaagatatcgcagaaggcgcaatcactatccagccgaagcgagcgaccgtggaaggttttgacgcttactttacaagcagaaccctggagaataaccgcaggaacgtctggttcgcagagtattgggaagagaacttcaattgtaaactgactatcagcgggtccaagaaggaagacacagaccgcaagtgtaccggtcaggagcggattggtaaagattctaactatgagcaggagggtaaggtccagtttgtgattgacgctgtctacgccatggcccacgcgctacatcacatgaacaaggatctttgcgcggattatcggggtgtatgcccagaaatggaacaggccggaggcaagaagctgctcaagtacattcgaaacgtgaacttcaatggggacgccggtacccccgtgatgtttaataagaacggcgatgcgcctggaaggtacgatatctttcagtatcaaaccacgaacacatcaaaccccggatatagactcatcggacaatggaccgacgagcttcagctcaacattgaagatatgcagtggggcaagggcgtccgtgaaatccctgcttcggtgtgtactctgccttgcaaacccggtcagcgaaagaagacccaaaaaggaaccccctgctgttggacctgtgaaccatgcgacggctatcaatatcagtttgacgaaatgacctgccagcactgcccctacgaccagcggcctaatgaaaacagaaccggatgccaggacatccctataatcaagctcgaatggcactctccgtgggcggtgattccagtttttcttgctatgttaggcattattgccacaatcttcgtcatggccacttttatcagatataacgacacccctatcgtgcgagctagcgggagagaactaagctatgtgctgctgacaggcatctttttgtgttacatcataacgttcctgatgatcgcaaaacccgatgtggccgtgtgttcatttaggcgggtgtttttgggactgggtatgtgtatctcgtatgcagcactgttaacgaagacaaatcgtatataccgcatttttgaacaaggtaagaaatccgtgacagcgcctcgcctgattagtcccacctcacagctggcaattacatctagtttgatcagtgtccagttgctaggcgtgtttatctggtttggggtggatcccccaaatataattatcgattacgacgagcataaaaccatgaacccagaacaagccagaggagtactgaagtgcgacattaccgatctgcaaataatctgttcgttaggctacagtatcctactcatggtcacctgcaccgtatacgctatcaagaccaggggcgtccccgagaatttcaatgaggcaaaacctatcgggttcaccatgtacactacttgcattgtctggctggcctttattccaatctttttcggaacagctcaatccgccgagaaagtgatcttgtgctgcatctcttag

SEQ ID NO: 224806 - DNA, 2775 bp, Artificial Sequence
  Description of Artificial Sequence: Synthetic coding sequence
atggtgcagttgagaaagttgctcagagttctgacactgatgaagtttccatgttgtgttctggaggtgctgctgtgtgcccttgccgctgccgcaaggggacaagagatgtacgcaccgcacagtatccgaattgaaggagatgtcactctgggcggactgttccccgtgcatgctaaaggcccatcaggggttccatgcggcgacatcaagagagagaatggcattcaccgtctggaagcaatgctctacgccctggaccaaataaactctgaccccaacctactgccaaatgtgacactgggggcaaggattctggatacctgtagcagggatacctatgcactggaacagagtcttactttcgtccaagctcttatccagaaggacacatccgacgtccgctgcaccaacggggaaccccctgtgttcgtcaaacctgaaaaagtcgtcggagtgataggagcctcgggctcctcagtgtctataatggtggccaatatcttgaggttattccagatccctcaaatctcttatgcttctacagctccagagctgagtgacgataggcggtatgatttcttcagtagggtcgtccctcccgattcctttcaagcacaggcgatggtggatattgtgaaagcattgggctggaactacgtgtctacgctcgctagcgaaggaagctacggcgagaagggggtggaatctttcacccagatatcgaaagaggccggtggtctgtgtatcgctcagagtgtcaggatcccacaggaaagaaaggacaggaccatcgatttcgacagaattatcaaacagctgctagacactcctaatagcagagccgtagtcatctttgcgaatgacgaagatattaagcagattctcgccgctgcgaaacgggcagaccaagtcggacattttctgtgggttggctcagacagctggggttctaagatcaatccgctgcaccagcacgaagatatagctgaaggggcaatcacaatccagcctaagagagcaaccgtggagggatttgacgcctacttcactagccgaactctggagaataatcggagaaatgtctggtttgccgaatactgggaggagaatttcaattgcaagctgactatctcaggctctaagaaagaggatacagacagaaaatgtacaggccaggaacgaattgggaaggattccaactacgagcaggaaggcaaggtgcagtttgtgatcgatgccgtgtacgccatggcgcacgccttgcatcatatgaataaagacttatgtgccgactatcggggagtctgcccagaaatggaacaggccggtgggaagaagctgcttaaatacatcagaaatgtcaactttaatgggagtgccggaaccccggtgatgttcaacaaaaatggtgacgcccctggaagatatgatatttttcagtatcagaccaccaatacctctaaccctgggtatagattgattggccaatggaccgatgagctccagttgaatatcgaggacatgcagtggggaaaaggggtgagggaaattcctgcatcagtgtgcactttgccctgtaaaccaggccagaggaagaagacccagaagggtaccccttgctgctggacttgcgaaccttgcgacgggtaccagtatcagtttgacgagatgacctgtcagcactgcccctatgatcagcgtcccaatgaaaatcgtaccggctgtcaggacatccccattatcaagctggagtggcattctccctgggccgtgatcccggtgttcctggcaatgctgggaattatagccacaatctttgtgatggcaacgttcattcggtataatgacactcctatcgttcgcgctagcggacgagagctttcctacgtcctgttgaccggtatcttcctgtgctatatcattacctttttaatgatagccaaacccgacgtagctgtttgctcattccgcagagtcttcctgggcctaggaatgtgcatatcatacgcagcgttattgacaaagacaaaccgtatttacaggatcttcgagcaaggaaagaagtccgtcacagcccctagactaatttcaccaacctcccagctggcaatcacgtccagtttaatctctgttcaactgctaggcgtgtttatttggtttggtgttgatcccccaaatattatcatcgactacgacgagcacaagacaatgaatcccgagcaggcacgcggtgtcctgaagtgtgatatcacggatctccagattatctgtagtctcggatactcgatccttcttatggtaacttgcaccgtatatgctatcaaaacccgcggtgtcccggaaaacttcaacgaggctaagccaataggattcactatgtacacaacatgtattgtatggttggccttcatccctatcttcttcggcaccgcccagtctgccgaaaaactctatattcagaccaccaccctaaccatcagtatgaatctgagtgcctctgttgccctgggaatgttatacatgcctaaagtgtacattattatcttccacccagaacttaacgtgcagaagagaaaaaggtcatttaaggctgtggtgaccgcagccaccatgtcttctcgactgagccacaaaccatctgaccgcccaaatggagaggctaagacggaattgtgcgaaaacgttgacccaaacattttttttttcgggtgtactgttgagctcggcctgcactttaagctgacctttagccggaaccagtccaacctgtag

SEQ ID NO: 224807 - DNA, 2727 bp, Artificial Sequence
  Description of Artificial Sequence: Synthetic coding sequence
atggtgtgcgaaggaaaaaggtcggcgagctgtccttgtttcttcttactaactgctaaattttattggattctgacgatgatgcagaggacacacagccaggagtacgctcactcaatcagggtggatggtgacatcatactcggcggtttgttcccggtgcacgccaagggggaaaggggcgtgccctgcggagagcttaagaaggagaaagggatccacagactagaggctatgttatacgctattgaccagattaataaagatcctgatctcctgtctaacattactctgggagtgcgcattctggacacatgcagccgcgatacatacgcattggagcagagtttgacatttgtgcaagcactgatcgaaaaagacgcatccgatgtgaaatgcgcgaacggtgacccgccaatatttacgaagcccgacaagatatcaggggtcatcggagccgctgcaagcagtgtgtcaattatggtcgctaatatattgcggctctttaagataccccagatcagttacgcgtcaaccgcccctgagctcagcgataacacaaggtacgacttcttcagccgtgtagtccccccagattcctatcaggctcaggccatggtggacattgtcaccgcgttaggctggaattatgtgtcaacactggccagcgaaggcaattacggagaatctggtgtagaggctttcacccaaatctcccgcgagattgggggagtttgcattgctcagagccagaagattccgcgagaacccagacccggagagtttgagaagatcatcaagaggctgcttgaaactccaaacgcgcgagcggtgatcatgttcgccaacgaggacgatatacgcaggatcttggaagctgcaaaaaaactgaaccagagcggccatttcttatggatcgggagtgattcatgggggtctaaaatcgcacctgtctatcagcaggaggagatagcagagggagccgtcacaattctccctaaacgggcttccatagatgggtttgatagatattttagatctcgcacactggccaacaacaggaggaacgtctggttcgctgaattctgggaggaaaatttcggttgtaagcttgggagccatggaaaacggaactcccacattaaaaagtgcacagggcttgagcgcatagctcgtgactcaagctacgagcaagaaggcaaggtgcagtttgtgatcgacgccgtttattctatggcctatgctctgcacaacatgcataaagatctgtgccccggatatatcgggctttgccctaggatgtcaacaatcgatggcaaagagttgctcggttacatccgcgcagtcaattttaatggctccgcaggcactcctgtgaccttcaacgaaaatggagacgccccaggaagatacgacatcttccagtatcagataacaaacaagtctaccgagtataaagtgattggtcattggaccaatcagctccacttaaaggttgaagatatgcagtgggcgcatagggagcatacacaccccgctagtgtatgctccctgccttgtaaacccggtgagagaaagaagacggtcaagggagtaccatgttgttggcactgtgaacgctgtgagggttacaactatcaggtagatgaactttcctgtgagctgtgccctttagatcagagaccaaacatgaaccgtaccggatgccagcttatccctatcattaaattagaatggcattcgccttgggccgtcgttcctgtgttcgtggcaatcctgggaatcatcgccactaccttcgttattgtcacatttgtgcgctacaacgacacaccaatcgtaagagctagcggcagagaactttcgtacgtcctgctaaccggcatatttctatgctattccattacctttctaatgatcgcggctcctgataccattatctgttcttttaggagggtatttctcggtctgggtatgtgcttctcatatgcggctctgttgaccaagaccaatcgaatccaccgcatctttgaacagggcaagaaaagtgtcacagcccctaaattcattagtccagccagccaacttgtaataacattcagcctgatttccgtgcagctgcttggcgtgtttgtatggtttgtggtggacccgcctcacatcatcatcgattacggagaacaaagaacgctggacccagagaaagcaaggggcgtgctcaagtgtgacattagcgacctttccctgatctgcagtctggggtacagtatcttgcttatggtcacctgcacagtgtacgccataaagactcgcggagtgcctgaaactttcaatgaggccaagccaatcggtttcaccatgtataccacgtgtataatatggctcgcctttatccctatattcttcgggacagcacaatccgccgaaaagatgtacatccagaccaccaccctcaccgtttcaatgtccttatcagcctccgtttctctcggcatgctctacatgccaaaagtatacattataatctttcaccctgagcagaatgtgcagaaaaggaagcgttcttttaaggctgttgtgaccgcagccactatgcaaagcaaactcatacagaagggcaatgatcggcctaatggggaggtcaaatccgaactctgcgaatcactggagaccaacacctcctctactaaaactacttacatcagttattccaaccacagtatctag

SEQ ID NO: 224808 - DNA, 2727 bp, Artificial Sequence
  Description of Artificial Sequence: Synthetic coding sequence
atggtctgcgaaggaaagcgctctgcctcatgcccatgcttttttcttcttaccgctaagttctattggatcctcaccatgatgcagcgaacacactcccaggaatacgctcactctattagggtggacggggatataattcttggcggactgtttccggtgcatgcaaagggcgagcgtggtgtgccatgcggcgaactgaaaaaagagaagggaatacacagactagaagccatgctgtacgcaatcgaccagattaataaggacccagaccttttgagtaatattacactgggagtgcgcattcttgacacctgttctcgggacacttatgctctggagcaaagcctcaccttcgtccaggcactgatcgaaaaagatgcctctgacgtcaagtgtgcgaatggcgatccccctatttttaccaaacccgacaagatatccggcgtgatcggcgcagcagccagctcggtctccatcatggttgcaaatatattgcgcctgtttaaaattccgcaaatttcctacgcttctaccgcccctgagctgtccgacaatactcgttacgattttttctcccgggtggtcccccctgattcttatcaggctcaagccatggtagatattgtgacagccttaggatggaactacgttagcactctcgcctcagagggcaattatggggagtcaggtgtcgaagcctttacgcagatatctcgagagattgggggtgtgtgcatagctcagtcccagaagataccacgagagccacgccctggtgagttcgaaaaaatcatcaagcgactgctggagactcctaacgccagagccgtcattatgtttgccaacgaggatgacatcagacggatccttgaagctgcaaagaaactaaaccagagtggccacttcctgtggatagggagcgactcgtggggatctaaaattgctcccgtataccagcaggaggagattgcagagggtgccgttacaattctgccaaagagagcctcaatcgacggtttcgataggtatttcagaagcaggacacttgctaataacaggagaaatgtgtggttcgcggagttttgggaagagaatttcggctgtaagctcggttcacatggcaaacggaatagccacataaaaaagtgtacgggactggagagaatcgctcgcgactcatcctatgaacaggagggaaaggtccagttcgtgattgatgccgtctattcaatggcctacgcactgcacaacatgcataaagacttgtgtcctggctatattggactgtgcccacgaatgagcactatcgatgggaaggagttactggggtacattagagcggtgaattttaatggctctgccggaactccagtgacctttaacgagaatggggatgccccagggaggtacgacatctttcaataccagattaccaataaatccacagaatataaagtaatcggccactggaccaatcagctgcatcttaaagtggaagacatgcaatgggctcaccgcgaacatactcatcccgcatccgtgtgcagtttaccatgcaagccaggcgaacggaagaagaccgtcaaaggtgttccgtgttgctggcactgcgagcgctgcgaaggatacaattatcaagtagacgagctgagctgcgaactctgtcctttagatcagcgacccaatatgaacaggactgggtgccaactcatcccaatcatcaaactggaatggcactccccctgggccgtcgtgcctgtgttcgtagcaatcctcggaattatagcaacgactttcgtgattgtcacttttgtgcgctacaacgacactcccatcgtgcgggctagcgggagggaactgtcatacgtgcttttgaccggtattttcctgtgttattcgatcacgtttttaatgatcgcagcaccagataccatcatttgcagctttcgtcgcgtatttctgggactagggatgtgcttttcttacgcagccctgcttaccaaaactaaccggatccaccggattttcgagcaggggaaaaagtccgtgacggcccctaagttcatttcaccagcttcccagctggtgatcaccttctctctgatctcagttcagcttcttggagttttcgtttggtttgtagtggacccgcctcatatcataatagattacggggagcaaagaaccctggaccccgaaaaggccagaggggttctgaagtgtgatatttctgatctttcactgatctgctcactgggttacagcatacttttgatggtgacctgcacagtgtacgccattaagacacgtggagtgcccgagacttttaacgaggccaaaccaatcggtttcaccatgtacaccacctgtatcatctggctggcgttcatccccatctttttcgggacagctcagtccgctgagaagatgtacatccagaccacaactctgaccgtgagtatgtccctaagcgctagcgtatccctggggatgttgtacatgcccaaagtgtatataattatcttccacccggagcagaatgtgcaaaaacgcaagcgatccttcaaggctgttgtaactgcagccactatgcagagcaagctcatacagaagggtaacgaccgtccaaacggtgaggtgaaatccgagttatgcgagagtttagaaaccaattcgaagagctcagtcgaattccccatggtgaaatccggttctacatcttag

SEQ ID NO: 224809 - DNA, 1506 bp, Artificial Sequence
  Description of Artificial Sequence: Synthetic coding sequence
atggtgtgtgaaggcaagcggtctgcatcttgtccctgcttctttcttttaacagccaagttttattggatactaacaatgatgcaaagaacgcactctcaagagtatgctcattccataagggttgacggtgatataattctggggggtctgtttcccgtgcacgcgaagggtgagcgtggagtgccttgcggggaactcaaaaaagagaagggcatccataggttagaggccatgttgtatgcaattgaccagatcaacaaagatccggacctcctaagcaacattacccttggcgttcgtatcctggacacgtgttcacgcgatacttacgcattggaacagtcccttacctttgttcaggcgctgatcgagaaagacgccagtgacgtcaagtgcgcaaacggtgatcctcccatttttactaagcctgacaaaattagcggcgtcattggagccgcagcaagtagcgtaagtatcatggtggctaacatcctccgtctattcaaaattcctcagatttcctacgcaagcacagctcctgaactgtctgacaatacacgctacgactttttcagtcgagtggtacctccagattcctaccaagcccaggccatggtggacatcgttactgctctcggatggaactatgtctcgacactagctagtgaaggtaattatggtgagtctggcgtggaggcgttcacacaaatctctagggagattggaggcgtctgcattgctcagtcacaaaaaatccccagagagcccagacccggtgaatttgaaaaaatcataaagcgactcctagaaacacctaatgccagagccgttatcatgttcgccaatgaggatgatattcgaaggatcttggaagctgccaaaaaactgaatcagagcgggcattttctttggataggcagtgacagttgggggtctaagattgcaccagtgtaccaacaggaggagatcgccgagggggctgtgacaatccttccaaagcgcgctagtattgacggattcgataggtactttagaagccgcacactggccaacaaccgcagaaatgtttggttcgcggagttctgggaagaaaactttgggtgtaaactcggctcccatgggaagaggaactctcatataaagaagtgcaccggactcgaacgaattgcacgagattccagttatgagcaggaaggtaaagtgcaatttgtgatcgacgcagtttacagtatggcctacgccctacataacatgcacaaggatctgtgccccggttatatcgggctctgcccgaggatgagtacaatcgatggcaaggagctgttgggttatataagagcggttaacttcaacggctgtcgtcgcggtattcaaatgagccttccttggcccaccttattcacacccagttttagcagtagctgggccgtactggccctgttgtccctgctgatgaaaacagagatgctcctggacgtaatgatttcctcatcaatcaaatag

SEQ ID NO: 224810 - DNA, 63 bp, Artificial Sequence
  Description of Artificial Sequence: Synthetic coding sequence
atggtatgcgagggtaaaagaagcgcgagttgcccttgcttcttcctgctgacagccaagtag

SEQ ID NO: 224811 - DNA, 2727 bp, Artificial Sequence
  Description of Artificial Sequence: Synthetic coding sequence
atggtgtgcgaaggaaagcggagtgcctcatgtccttgcttctttttgctgacggccaaattttattggatcctgactatgatgcagcgcacacatagtcaggaatatgcccatagcatccgcgtcgacggggatataattctggggggactgtttcccgttcacgccaagggagagcggggagtaccctgtggagagttgaaaaaagaaaaagggatccaccgattggaggctatgttgtatgcgatcgaccaaataaataaggaccctgatcttctgtctaatatcactctcggagtgcgaatcctagacacttgttctcgagacacctatgcactagagcagtcactgaccttcgttcaggccctgatcgagaaagacgcatcggatgttaagtgcgccaacggtgacccccctatcttcactaagcctgataaaatcagcggagtgatcggagcagccgctagctctgtttcaattatggtggcaaacatcctccggttatttaaaatcccccagatttcctatgccagtactgcgcctgagctcagcgacaatacaaggtacgactttttcagtcgcgttgtgccaccagactcatatcaggcccaggcaatggtggacattgttactgcccttggttggaattatgtcagcaccctcgcctcagagggtaattacggcgagtcaggcgtcgaagctttcacccagatctctagggaaatcgggggtgtgtgtatagcacaaagtcagaagatccctagagaacccaggcctggcgagttcgagaaaataatcaaacgtcttttagaaactcccaatgccagggcagtcattatgtttgcaaacgaagatgatataaggcgtatactggaggcagccaaaaaactgaaccaatcagggcactttttatggattgggtcagactcatggggaagcaagattgccccagtctatcagcaagaggagattgccgaaggcgcagtgactatccttcccaaaagagcctcaattgatggatttgatcggtacttcagatcgagaactttggccaacaaccgaaggaatgtctggttcgctgaattttgggaagaaaacttcggatgcaaacttggctcacatggtaagcgcaactctcatatcaaaaagtgtactgggttagaacgcatcgcacgagattccagctacgaacaggaaggcaaagttcagttcgtcatagacgccgtttattccatggcttacgcactgcacaacatgcacaaggatctgtgtccaggatatataggcctctgcccacgcatgtcaacaattgatggcaaagaactcctggggtatattcgggctgttaacttcaacggatctgcaggcacccccgttaccttcaatgaaaacggcgatgctccaggccgttacgacatcttccagtaccagattacgaacaaaagcacggaatacaaggttatcggacactggacgaatcaattacacctgaaggtagaagacatgcagtgggcccatcgggaacacactcaccctgcctccgtatgttccctaccctgcaaaccgggtgagcgcaaaaaaaccgtgaagggcgtgccctgttgctggcactgcgaaaggtgcgaggggtacaattaccaggtggacgagctgagttgcgagttatgtccactggaccagagaccaaacatgaatcggaccggttgccagctgatccctataatcaaactcgagtggcacagtccctgggccgttgtccccgtattcgtggctattttgggaattattgccaccacattcgtgatcgtcacttttgtgcggtataacgatacccccatcgttagggctagcggtagggagctctcttatgttctcctcacagggatctttctttgctacagtatcactttcctgatgatcgcggctcctgacaccatcatctgctcatttagacgggtgtttcttggattgggaatgtgttttagttacgctgctctccttaccaaaacgaaccgaatacaccgtatattcgagcagggaaaaaagtctgttaccgctcctaaatttatttcaccagccagccagctcgttataacattcagtttgatttcagtccagctgctgggcgtgttcgtttggttcgtggtcgatcctccacacatcattatcgactacggagaacagcgaacccttgacccagagaaggctaggggagttctgaagtgcgacatctccgacctgagtttaatttgcagccttggttactcgatcttattgatggtaacctgcactgtgtatgctattaaaacccgaggagttccagaaacgtttaacgaggcgaagcccatcggattcacaatgtacactacatgcattatatggctggcatttatccctatctttttcgggacggcccagtcggctgagaagatgtatattcagactaccaccctgacagtaagtatgtcacttagtgccagtgtgtccctcgggatgctgtacatgcccaaagtttatatcatcattttccatccagagcaaaatgtgcagaagcgtaaaagatcttttaaggcagttgtgactgccgctacaatgcagagtaagctcatacaaaagggtaacgaccgtcctaacggagaggtgaagagtgaactgtgcgaatcactggagaccaacacctcctccaccaagactacctacatttcttattccaatcactcgatctag

SEQ ID NO: 224812 - DNA, 885 bp, Artificial Sequence
  Description of Artificial Sequence: Synthetic coding sequence
atggtttgcgaaggaaaaaggagcgcctcatgtccttgcttctttttgctgacagcaaagttttattggatccttacaatgatgcaaagaacccactcacaggagtatgctcatagcatacgagtagacggtgacataattctggggggactgtttcctgtgcatgctaagggagagcgcggagtcccatgcggcgaactgaagaaggagaaagggattcacagacttgaggccatgctgtacgcgattgaccagattaataaagaccccgatttgctttctaatattactctgggagtgagaatcttagacacctgctctagggacacttatgccttagagcagtctcttacttttgttcaggcgctcattgagaaggacgcctcagacgtcaaatgcgcaaacggggatccgcctatctttacaaaacccgacaaaatttccggcgtgatcggcgcagcagcaagtagcgtctctattatggtggccaatatcctgcggcttttcaaaatacctcagattagttatgcatcaacagccccagaactatcagataacaccaggtatgacttcttctctagagtggtgccaccagacagctatcaagcccaggctatggtagacattgtgactgccctagggtggaattacgtgtctacactcgcctctgaaggaaattacggtgaatctggtgtagaggcatttacccagatctctcgtgagatagggggagtctgtatcgctcaatcccagaagatcccacgagagcctaggccaggtgaatttgagaagatcattaagcgcttgctcgagacaccaaatgcacgtgccgtcattatgttcgctaatgaagacgacataaggcggattttagaggccgcttag

SEQ ID NO: 224813 - DNA, 1122 bp, Artificial Sequence
  Description of Artificial Sequence: Synthetic coding sequence
atgacaacctccgcatcaagtcacctaaacaagggaataaaacaagtgtacatgtccctgccgcaaggtgaaaaggtgcaggccatgtacatctggattgatggaacgggggaaggacttaggtgcaaaactagaacactggatagcgaaccaaagtgcgtagaagaactcccggagtggaatttcgacggctcctcaacactccaatctgaggggtcaaatagcgacatgtacttagttcccgcagccatgttcagggatccttttcgtaaagatcccaacaagctggtgctgtgtgaggttttcaaatacaatcggcgtccagccgagaccaatctcagacacacatgcaaacgaatcatggatatggtgtccaatcagcatccatggtttggaatggagcaagagtacaccttaatgggcaccgatggtcacccctttggctggccctccaacggtttcccgggtccacaggggccttactattgtggcgtcggagctgatagagcatatgggagggatatagtggaggcccactatcgggcatgcctgtatgccggagttaagatcgccggaacaaatgccgaagtcatgccggcacagtgggagttccagatcgggccatgcgagggaatcagcatgggcgaccacctgtgggtcgcgaggtttatcctgcatagagtctgtgaagatttcggggtaatcgcgacatttgatcctaaacccattcctggcaattggaatggcgcaggctgccacactaacttctccaccaaggcgatgagggaggaaaacgggctgaagtacattgaggaagcaatcgaaaaactgtctaaaagacaccagtaccacattcgcgcatacgatcccaaagggggtctcgataatgccaggaggcttactggcttccacgaaacttcaaatattaacgacttctccgccggagtggccaaccggtcagcctcaatcaggataccgagaaccgtcggacaggagaaaaagggctatttcgaggacagaaggcctagcgccaactgtgatcccttctcagttacagaggccttgatacggacttgtttgctcaacgaaactggcgatgagccatttcagtataagaactag

SEQ ID NO: 224814 - DNA, 1122 bp, Artificial Sequence
  Description of Artificial Sequence: Synthetic coding sequence
atgaccacgtcagcgagttcccacttaaataaaggcatcaaacaggtgtatatgagcttgccacagggcgaaaaagttcaagctatgtatatatggatcgacggcaccggcgaaggcctccggtgcaagacccgaacactcgacagcgagcccaaatgcgtggaggagctgcccgaatggaactttgacggatcgtccaccctgcagagcgagggttctaattcggacatgtacctggtgcccgctgctatgtttagagatcctttccggaaggatccgaataaactcgtgctgtgcgaagtgtttaaatacaatcgcaggcccgctgaaacgaaccttaggcacacatgcaagcgcataatggacatggtgtctaatcagcatccctggttcggcatggaacaggagtatacgctaatgggtacagatggacacccattcgggtggccttccaacggattccctggaccccaggggccatactactgcggtgtcggggcagatagggcttacggcagagacattgtggaagcacattacagggcgtgtttatacgccggagttaagatcgccggtacaaacgctgaggtaatgcctgcccagtgggaattccagatcggcccatgtgaagggatcagcatgggcgaccatctgtgggtggccaggtttatcctccacagggtgtgtgaggatttcggggtgattgcaacgttcgatcccaagcccatcccgggaaattggaacggcgcagggtgtcatacaaatttctcaactaaggccatgcgcgaagaaaatggcctgaagtacatcgaggaagcgattgaaaagttatctaagagacaccagtatcacatacgcgcatacgatcctaaaggaggcctagacaatgcaagacgcctcaccggcttccacgagacatctaatataaatgacttcagcgctggcgtcgcaaacaggagcgcgagcatacgcataccaagaactgtcggtcaggagaagaaaggatacttcgaagaccggagaccatccgctaattgtgacccctttagcgttaccgaagcactcattaggacctgtctactaaatgagaccggcgatgagccatttcagtataagaattag

SEQ ID NO: 224815 - DNA, 1122 bp, Artificial Sequence
  Description of Artificial Sequence: Synthetic coding sequence
atgaccacttctgccagctcccatctgaacaagggcataaaacaagtctacatgagtttaccccagggagagaaggtgcaagccatgtacatctggatcgacggcaccggggagggactgcgatgcaagacacggacactggacagcgaaccaaaatgcgtggaggaattgcctgagtggaattttgatgggagtagtaccttgcagagtgagggaagcaattcggacatgtatctagtccctgcagcgatgtttagggatcctttcaggaaggatccaaacaaactggtcctatgtgaggtttttaagtacaatcggcgtcccgcagaaaccaatctgagacacacgtgtaagaggattatggacatggtgagcaatcaacacccctggttcggaatggagcaagaatacactctcatggggacagacggacacccattcggctggccttcaaatgggtttcctggccctcagggtccttactactgcggagttggggcagatcgtgcctacggacgcgatattgtggaggcgcactaccgcgcttgcctatacgcgggagtaaagatcgccggaaccaacgccgaggtgatgcctgcgcagtgggagtttcagattggcccatgtgaagggatttctatgggagaccatctgtgggtggcccgtttcatccttcaccgtgtgtgcgaagattttggagttatcgccacctttgatcccaagccaataccgggtaactggaacggcgcagggtgtcataccaacttcagcaccaaggccatgcgagaagagaacggtctgaaatatatagaggaagccattgagaaactctcaaagcgccaccagtaccacattcgcgcatatgaccctaaaggaggactcgataacgccaggcgtttgaccggtttccatgaaacttccaatatcaacgatttctcagctggcgttgctaatagatcagccagcatccgtattccaaggaccgtgggccaagaaaaaaaagggtacttcgaggatagaagacctagtgccaactgtgacccattttccgttaccgaggctctgattcggacatgtctgctcaatgagaccggtgatgaacccttccaatacaagaactag

SEQ ID NO: 224816 - DNA, 1122 bp, Artificial Sequence
  Description of Artificial Sequence: Synthetic coding sequence
atgacgacctctgctagtagccatctgaacaaaggaatcaagcaagtgtacatgtccttgcctcagggtgagaaagtccaagcaatgtacatctggatcgatgggaccggcgagggacttaggtgtaagacaagaacattggacagcgagcccaagtgcgtggaagaattgcccgaatggaattttgatggatctagcaccctgcagtcagaggggagtaacagtgatatgtacctggttcctgccgctatgtttcgggatccgtttcgtaaggatcccaacaagttagtcttatgcgaggttttcaagtacaaccgacgccctgccgaaactaacctccggcacacatgtaaaaggatcatggacatggttagtaatcagcacccatggttcggaatggaacaggagtacactctaatgggcaccgacgggcatccattcggttggccatctaacggtttccctggacctcagggaccttactactgtggtgtgggcgctgatcgtgcatacggcagggatatcgtggaagctcactatcgtgcatgcttgtatgccggagtgaagatcgctgggactaacgccgaggtcatgcctgctcaatgggagtttcaaatcggcccttgtgagggtatcagcatgggcgatcatctttgggttgcgagatttatcctccaccgcgtgtgtgaggactttggcgttatagcaacttttgaccctaagcctattccaggtaactggaacggggctggctgtcacacaaacttcagcaccaaggccatgcgggaggagaatggcctcaagtacatagaggaggcaattgaaaagctgtctaaacgacaccagtaccacattagagcctacgatcccaaggggggattggacaatgctcgaaggctgaccggctttcacgagactagtaacatcaatgattttagcgcaggcgtggccaatcgctcagccagcattcggattccacggacggttggccaggaaaagaagggatacttcgaggataggcgaccctccgccaattgcgaccctttctccgttacggaagccctgatccgcacctgcttacttaacgaaacaggcgatgagcccttccaatacaagaattag

SEQ ID NO: 224817 - DNA, 702 bp, Artificial Sequence
  Description of Artificial Sequence: Synthetic coding sequence
atgacaacctccgcaagttcccatctcaacaaagggatcaaacaagtatacatgtccttaccacagggcgaaaaggtgcaggccatgtacatctggatagatgggactggggaaggcttacgctgcaagactaggactcttgattcagagccaaagtgcgttgaagagctgcctgagtggaactttgacggatcaagcacactacagtctgagggcagtaattcagatatgtatctcgtgccggctgctatgttccgtgatcctttcagaaaggaccctaataaactggtgctctgtgaggtcttcaagtataacagacgacctgcggaaacaaacctgagacacacgtgtaagagaataatggacatggtaagtaatcagcatccatggttcggaatggagcaggagtatacactcatgggcaccgatggacatccctttggctggcccagtaacggtttccagggcccaagagtgcatatcaccgtcgtttgggaacagacagagccaatggccggaaccagctggcgaccaattactggacccgcttgcatgctagagagtagactcagagggctgatgccccgttcctgtctcccatctgggaactttcggctcgacctggtcaaggagtccgcatgggagatcatatcagggtggccggtaagctcttgtatcgtctgcgtcaagactctcgagtag

SEQ ID NO: 224818 - DNA, 678 bp, Artificial Sequence
  Description of Artificial Sequence: Synthetic coding sequence
atggaccagcaagcgatctatgcagagttgaacttaccaacagatagtgggcctgaatctagttcaccaagctcactccctagggacgtgtgccaggggtccccatggcatcagtttgcactgaagctcagctgcgccggaatcatcctcctggttcttgtggttacaggtctttctgttagcgttactagcctaattcagaagtcgtctatagaaaaatgctctgtggacatccagcagtcaagaaataagacgaccgaaagaccgggtctccttaactgcccgatctactggcagcagctgcgggagaaatgcttattgttctctcacactgtgaatccttggaataacagtctcgctgactgttctacaaaggaatccagcctgctcctaattcgtgacaaggacgaattgattcacacgcaaaacctgattcgagacaaagctatcctgttttggatcggcttaaatttctctctctctgaaaaaaactggaagtggattaatgggtcattcctcaattctaatgatctggagattcggggagatgcaaaggagaattcctgcatttccatctcccaaacttcagtgtactctgaatactgttccactgaaattcggtggatctgccagaaggagctgacccctgtccgcaataaggtgtaccctgattcgtag

SEQ ID NO: 224819 - DNA, 825 bp, Artificial Sequence
  Description of Artificial Sequence: Synthetic coding sequence
atggggaccgacagtcgtgcagcgaaagccctgctcgcaagagctcgaaccttacatctgcagaccggaaacctgctgaactggggcagactaagaaaaaaatgtcccagcacacactcagaagagctccatgactgtattcagaagacactgaacgaatggtcatcccagatcaaccctgacctggtgagagaattccctgacgtactcgaatgtacagtctcacacgctgtcgaaaagattaacccggatgaaagagaggagatgaaggttagcgcaaaactcttcatcgttgaatcaaattctagctcatccacccgctctgcagtggatatggcttgcagtgtgctcggtgtcgcccagctcgactcagtaataatcgccagtcctccaatagaggatggtgtcaatctctcgctcgaacacctgcagccgtactgggaggaactggaaaacttagtgcagtctaaaaaaattgtggcgattggcacttctgatctggacaagactcagctggaacagctttatcaatgggcccaagtcaaacctaatagtaaccaggtcaaccttgcatcctgttgcgtgatgcccccagacctcacagctttcgcaaagcagttcgacatccagctgctgacacacaatgatcccaaggagctcctctccgaagcctcgttccaggaggcactccaagagtcaattcctgacatccaggcacatgaatgggtcccactgtggttactccggtatagcgtcatcgtaaaatcgcgcggaattatcaaaagtaagggatacatcctccaggctaagagaagaggctcatag

SEQ ID NO: 224820 - DNA, 1341 bp, Artificial Sequence
  Description of Artificial Sequence: Synthetic coding sequence
atggctgccaggaagggaagacgacggacctgcgaaaccggagagccaatggaggcagagagtggcgatacctcatccgagggtcctgcacaagtgtaccttcctggcaggggcccacctctgcgggagggcgaggaacttgtgatggatgaggaagcttatgtgctgtaccatagagcacaaacaggcgctccctgtctgagctttgatatcgtcagggatcatttaggagacaacagaacagagcttccattaacactatacctgtgcgcagggacccaggccgaatcagcgcaaagtaatcgtttgatgatgctcagaatgcacaatctccatggtacgaaaccacccccaagtgaaggctcagacgaggaggaagaggaagaggacgaagaggatgaggaggaacgcaagccccaactggagctggctatggtcccgcattacggaggaatcaatcgagtgagggtatcctggcttggagaggagcctgtcgcaggcgtgtggtcagaaaagggacaggtcgaggtgttcgctctgagaagactgcttcaggtggttgaggagccccaggccctcgctgctttccttcgggacgaacaggcccagatgaaacccatcttcagctttgcaggacacatgggagaaggctttgccctggattggtcccccagggtcaccgggagactcctgacaggtgactgccagaaaaacattcacttatggacccctaccgacggtggctcatggcacgtagatcagagaccttttgtgggccacacccgttctgttgaagacctgcagtggagccccaccgaaaacaccgtctttgctagctgcagtgctgacgcctcaattcggatttgggacattcgagccgcaccgtcaaaggcgtgcatgctgactacagctactgcgcatgacggcgatgtgaatgtcatctcatggtcccgcagggagcctttcctgttgtccgggggtgatgacggtgcactcaagatctgggacctacgccagttcaagtccgggtcacctgtggccactttcaagcaacacgtggcccctgtgaccagcgtcgagtggcacccccaagactccggagtgtttgctgcatccggggcagaccatcagatcactcagtgggacctggccgtggaacgagacccagaggccggagatgttgaagccgatcccggtcttgccgatctcccccagcagctcctcttcgttcatcagggcgaaacagaactgaaggagttgcactggcatccccagtgccccggactgctggtttcaacggccttaagtggcttcactatctttaggactattagtgtttag

SEQ ID NO: 224821 - DNA, 1572 bp, Artificial Sequence
  Description of Artificial Sequence: Synthetic coding sequence
atgcaaagagcagccgctctggtacgcagagggtgcgggcctagaacccccagctcatggggaaggtcccagtcaagtgcagccgctgaagcctccgccgtgttaaaagtccggccagaacgatcccgccgtgaacggattctcaccttggaaagtatgaacccccaggttaaggccgtagaatatgccgtcagaggaccaatcgtgcttaaagcaggggagatcgaacttgagctgcagcggggaatcaagaagcccttcacagaagtcatccgggcaaatatcggcgacgcccaggctatgggacagcagcctattacgttcctgcggcaggtcatggccctatgtacctatccaaatctgctggacagcccttcattccccgaggacgccaagaaaagagcacgaagaattctgcaagcctgcggtggcaattccctggggtcctactctgctagccagggagtaaactgcataagagaggacgtggctgcatacattacccggcgagatggcggagtcccggcagatccagataatatctaccttactaccggagcatcggacgggattagcacaattcttaaaatactggtttcaggcggaggaaagagtcggaccggggttatgatcccgattcctcagtaccctctctattccgcggtcataagcgaacttgacgcgattcaggttaattactatctggacgaagaaaattgctgggccttgaacgtcaacgaactcagaagagccgtacaggaggccaaggaccattgcgatcctaaggtgttgtgtatcataaatcctgggaacccgactggtcaggtgcagagcaggaagtgtatcgaagacgtcatccacttcgcatgggaggagaagttattcctgctggctgacgaggtttatcaagacaatgtatactctccagattgtagatttcatagcttcaaaaaggtgctgtatgaaatgggaccggaatacagctctaatgtggaacttgctagcttccattctacctccaaaggctacatgggagagtgtggctaccgcggtggctatatggaagtgataaacctccacccagagatcaaggggcagctcgttaaacttttgtccgttaggctctgccccccagtgtcaggccaggctgcaatggacatagttgtgaaccctccggtggcaggcgaggagagtttcgagcaattttcccgagaaaaagagtctgtgctcggtaatttggctaagaaagctaagctaactgaagacctgttcaatcaggttcccggaatccactgtaacccactacagggagcgatgtatgctttccctcgaatctttattcccgctaaggcggttgaggcggcacaggctcaccagatggcgcctgacatgttttattgcatgaaactacttgaagagaccggcatctgtgtggtaccgggtagtgggttcggacagcgagaagggacttatcatttcagaatgacgatcttgccaccagtcgagaaactgaaaacagtattacagaaagtgaaggacttccacattaattttctcgagaagtatgcctag

SEQ ID NO: 224822 - DNA, 1272 bp, Artificial Sequence
  Description of Artificial Sequence: Synthetic coding sequence
atgggccaacaaccgatcactttcctgagacaggtaatggcgctgtgtacttaccctaacctcctggattccccatcgttcccagaggacgctaaaaaaagggccaggcggattctccaggcttgcggaggcaacagtctcggttcttatagcgcgtcacagggggtgaactgtattagggaggacgtcgctgcttatatcacccgtcgcgatggcggagtgcctgcagaccctgataacatatatcttacaaccggggctagtgacggtatctcaacaattttaaaaatccttgtgtcagggggaggcaaaagcaggaccggggtgatgattccaatcccccagtacccactgtattccgctgtaatctccgagttggacgctatccaggtgaactactacctggacgaggagaactgctgggccttaaatgtcaacgagctgcgcagagccgtgcaagaggccaaagatcactgcgatccaaaagtgttatgtatcattaaccccggtaacccgaccggccaggttcaatcccgcaaatgcatcgaagatgtcatccatttcgcctgggaagaaaagcttttccttttggccgatgaggtctaccaggataatgtgtactcgccggattgccggtttcacagcttcaaaaaggtgctctatgagatgggccctgaatatagttcaaacgtagagttagcctcctttcacagtacttctaaagggtacatgggggagtgcggttatcggggagggtatatggaggtcatcaacctgcatccagagatcaaggggcagttggtgaagcttctgtcggtgcgactttgcccaccagtgtctggacaggctgccatggacattgtggtgaatccccctgtggccggtgaggaaagttttgagcagtttagtcgcgaaaaggagtcggtcctgggcaatctcgccaagaaagcaaaactaactgaagatttattcaatcaggtgcctggcatacactgtaaccctctacagggtgcaatgtacgccttcccacggatcttcataccagctaaagccgtggaggccgctcaggcgcatcagatggcaccagatatgttttattgtatgaagctcctggaggaaactgggatatgtgtagtgcccggtagtgggttcggccagagggaaggcacatatcacttccgaatgactatcctgccccctgttgaaaaactgaaaactgtgctgcagaaagtgaaagatttccacatcaattttctagaaaaatacgcatag

SEQ ID NO: 224823 - DNA, 1242 bp, Artificial Sequence
  Description of Artificial Sequence: Synthetic coding sequence
atggccccaccttcagtgtttgctgaggtgcctcaggcgcagccggtgctggtattcaagctcactgcggattttagggaggaccctgatcctaggaaagtcaatctcggagtgggggcatacaggactgacgattgccacccgtgggtcctgcctgtggttaaaaaggtggaacagaaaatcgctaacgataattctctgaaccacgagtacctccccatccttggcctcgccgagtttagatcttgtgccagccggctagccctcggtgatgacagtccagctttaaaggaaaaacgagtcggaggggtccagtctctcggtggcactggagccttgagaatcggagctgacttcctggccagatggtacaatggtacgaataacaagaatacacctgtgtacgtgtcatcacctacctgggagaatcacaatgccgtcttctccgccgctggctttaaagatatccgctcctatagatactgggacgctgaaaagcgtggcctggatctgcagggattcctgaatgacttagaaaatgcccctgaattttctattgtggtcctccatgcatgtgcccataaccccacgggaatcgatcccacccctgagcagtggaagcaaatcgcctctgtgatgaagcatcgcttcttgttcccgttcttcgatagcgcctaccagggatttgcatccggaaatctggaaagggacgcgtgggcgataaggtatttcgtgagcgaggggtttgaatttttttgcgcacaaagcttctccaagaacttcgggctgtataacgagagagttgggaatctgaccgtggttgggaaggaaccagagagcatccttcaggtactgagtcaaatggagaaaatcgttagaatcacatggtccaatcctcctgctcagggcgctagaatcgtggcgtccacattaagtaatcctgaactgttcgaagaatggaccgggaacgttaaaaccatggccgatcgcatcctcaccatgaggagtgagctcagggcacggctggaagcattgaagacgcccggaacatggaatcacatcaccgatcagatcgggatgttttctttcaccggactcaacccaaaacaggtcgaatacctcgtgaacgagaagcatatctacctgcttccttccggcagaatcaatgtctctgggctgacaacaaagaacttagactatgttgcgacatctatacatgaggctgtaacaaaaatccagtag

SEQ ID NO: 224824 - DNA, 1101 bp, Artificial Sequence
  Description of Artificial Sequence: Synthetic coding sequence
atggcgcctcctagtgtcttcgctgaggttccccaggctcaacccgtgctggtgtttaagcttacggcggactttcgcgaggatcctgatccaagaaaagtgaatcttggggttggtgcttacaggacagatgattctcctgcccttaaggagaagcgggtggggggagtgcaaagcctgggcggtaccggcgctcttcgcatcggggctgattttctggcacgctggtataatggcaccaacaataaaaacactcccgtttacgtaagctcccctacctgggagaatcacaacgctgtttttagcgccgcaggcttcaaggatattcgttcatatcgctactgggacgccgaaaagcgtggccttgatttgcaaggttttctgaacgatctcgaaaacgcaccagagttcagtatagtagttttacacgcctgcgcccacaatccaaccggaattgatccaacccccgagcagtggaagcagattgcgtctgtgatgaaacaccgattcctgttcccattcttcgactctgcctatcagggattcgcttctggaaacctggagagagatgcctgggccattaggtatttcgtaagtgaaggtttcgaatttttttgcgcccagtccttcagcaaaaactttggcctctacaatgagcgggtgggcaacctcaccgtggtgggtaaggaacccgaatctatactgcaggtgctgtcccagatggagaagattgtacgcatcacttggtctaacccacccgctcagggcgctcggattgtcgctagcacactcagtaacccggagctatttgaggagtggaccggtaatgtcaaaacaatggcggataggattctcactatgcgctctgagctgagagccaggctcgaagccctcaagaccccaggaacttggaaccatattactgaccagataggcatgttttcttttaccggcctaaatcccaaacaggtcgaatacctggttaatgaaaaacacatttaccttctcccatccggtaggattaatgtgtccggactgactaccaagaatctcgattacgtggcaacatcaattcatgaagcagttaccaagatccagtag

SEQ ID NO: 224825 - DNA, 1179 bp, Artificial Sequence
  Description of Artificial Sequence: Synthetic coding sequence
atgcaggtctggtccccctggaagggggcaatgtgtccacgaccacataaaccagcctatcgcactgacgactgtcatccatgggtgctgcccgtggttaagaaagtcgaacaaaagatcgctaatgataacagcctcaatcacgagtacttgccaatcctgggcttagctgagtttcgctcctgtgcgtcacgcctggccctgggagacgatagtccagcactcaaagaaaagcgcgtcggcggagtacagagcctcggcggaacaggcgcacttcggattggagccgacttcctcgccagatggtacaacggcaccaataataaaaacacgcctgtgtatgtgagcagcccgacgtgggagaatcataacgccgtgtttagcgcggcaggctttaaggacatccggagctataggtactgggacgctgaaaaaaggggcctcgacctgcaaggatttttgaatgatctcgaaaatgccccagagttctcgattgtcgtgctgcacgcatgtgcacataatcctaccggcattgaccccacacccgagcagtggaaacagatcgcttctgttatgaaacatcgctttctgtttcctttctttgactcagcctatcagggattcgcttcgggcaatctggagcgggacgcttgggctatccggtacttcgtttctgagggcttcgagttcttctgcgcccagtcgttctccaagaattttggcctgtataacgagagagtcgggaatctgaccgtcgtgggcaaggaaccagaaagcatcctccaggtgctctcgcagatggaaaaaatcgtcagaataacgtggagcaatcctcccgctcaaggcgcaagaatcgtagcgtccaccctgagcaatccagagctgttcgaggagtggacaggaaacgtgaaaactatggcagacagaatcctcacaatgcgatcggagctgcgcgctcgactcgaggccttgaagactccaggcacctggaatcacatcacagaccagattggtatgttctcctttaccggcctgaacccgaaacaggtagagtacctggtcaatgagaagcacatatacctgctgcctagtgggagaatcaatgtgtctggactgaccacaaaaaaccttgactacgtggctaccagcatccacgaggcagtgactaaaatccagtag

SEQ ID NO: 224826 - DNA, 1293 bp, Artificial Sequence
  Description of Artificial Sequence: Synthetic coding sequence
atggctctactacactcgggacgggttttgcccggtatcgcagctgccttccacccaggactcgctgcagctgcttccgctcgggcttcttcctggtggacccacgtcgagatggggccacccgacccaatcctgggagttacagaagctttcaaaagagatactaatagcaaaaaaatgaaccttggggtaggcgcttatcgagatgacaatggcaagccctatgttttgccaagcgtcagaaaggccgaggctcagattgccgctaagaatctggacaaggaatacttgccgattggaggacttgccgagttctgtaaagcctctgccgagctggcgctgggggaaaacagtgaggttctaaaatcgggcaggttcgtgacagttcagaccatttcggggaccggtgcactgcgtatcggggctagcttcctgcagcggtttttcaagtttagccgcgacgttttcctgccaaaacccacatgggggaatcacacacccatttttcgagatgccggtatgcaactgcagggctacaggtactacgacccgaaaacatgcgggtttgatttcactggagctgtggaggatatttcaaaaattccggaacagagtgtcctcctcctacatgcctgcgctcataacccaacaggtgtggacccccgacccgaacagtggaaagagatcgctactgtggtgaagaaaaggaacctcttcgccttttttgatatggcctaccaagggtttgcctccggggacggcgacaaagatgcttgggccgtcaggcacttcatagaacaaggtatcaatgtgtgtctgtgtcagtcttatgctaagaacatggggttgtatggcgaacgagtaggcgctttcactatggtttgcaaggacgccgatgaggccaagcgtgtcgagtctcagttaaaaatactgatccggccaatgtattcgaaccctcccttgaacggggcacgaatagctgcggctatactgaacactccggatctgcgaaaacaatggctccaggaggttaaggtaatggccgaccgaatcatcgggatgcggactcaactcgtaagtaatttaaagaaagaaggttctactcataattggcagcacatcacggaccagattgggatgttctgctttaccggccttaaacctgagcaggtagaacgcctgattaaagaattttcgatctatatgactaaagatggccgaatctccgtggctggagtcacaagttccaatgtcgggtacctggcccacgctatccatcaggttactaaatag

SEQ ID NO: 224827 - DNA, 570 bp, Artificial Sequence
  Description of Artificial Sequence: Synthetic coding sequence
atggcgctcctgcacagcgggcgagtgctgcctggtatcgcggctgctttccacccgggactcgccgctgccgcaagtgctagggcctcctcctggtggacgcacgtagagatgggccctcccgacccaatactcggggtcacggaagcctttaagagggatacaaattctaagaaaatgaatctaggagttggagcatatagagatgataacggcaaaccatacgtgttgcccagcgtcaggaaggcagaagcacagatcgcggctaagaacttggacaaggaatatctgccaattgggggtttggccgagttctgcaaggacttcctctccagtgcagagatgagtttctgtcccaaccagcccggtgagacaacccacccatcctctggcatgctggcctgctcctacaaagtcatcggaattatgacaccgaggctggccgtgctgactagtcaggccctttggaggattttccaaaagtatcaatcacgcgtctttttcttttgtatgccagcccctactattcctcgcgagtggacgagagttaggaatagcggccgaaagtag

SEQ ID NO: 224828 - DNA, 1164 bp, Artificial Sequence
  Description of Artificial Sequence: Synthetic coding sequence
atggccttactccattcgggcagagtgcttccaggaattgctgctgcttttcatcctgggctggctgccgcagctagcgcacgggcatcctcttggtggactcatgtggaaatgggacctccagatcctattttaggggtaactgaagctttcaaacgggacaccaacagcaagaagatgaacttgggcgtgggagcctaccgcgacgacaatgggaagccctacgtgttacccagcgtccggaagttcgtgacagtgcagacaatatctgggaccggagccctcagaattggagccagcttccttcaaaggtttttcaagtttagcagggacgtgtttctgcctaagccaacctggggaaaccataccccaatttttagagatgccggtatgcagctgcagggctaccgttactacgacccaaagacatgcggattcgacttcacaggcgcagttgaagacatctcaaagatccctgagcaatcagtgctgctgcttcacgcgtgcgcacataaccccactggagtcgatccaaggcctgagcagtggaaagaaatcgccacagtggtgaagaagagaaatctgtttgccttttttgacatggcatatcagggcttcgcctccggcgacggagataaagacgcgtgggccgtgcgacactttattgagcaagggatcaatgtatgcctttgccaatcgtacgctaaaaacatggggttatacggcgagagagtgggggcttttacaatggtctgcaaggacgcagacgaagcaaagcgcgttgagtcgcagcttaaaatattaatcagacctatgtactccaaccctcctctgaacggtgccaggatagctgctgctatcctgaatacaccagatctgagaaagcagtggttgcaagaggtgaaagtcatggccgacagaattatcggcatgcgaacccaattggtgtcaaaccttaagaaggaaggctccacgcataattggcaacatattacagatcagattgggatgttctgctttacagggctcaagccagagcaggtggaaaggctgatcaaagaatttagtatctacatgacaaaagacggtagaatctctgttgctggcgtcacttcatctaacgtgggctacctggctcacgccattcatcaggtaactaaatag

SEQ ID NO: 224829 - DNA, 1491 bp, Artificial Sequence
  Description of Artificial Sequence: Synthetic coding sequence
atggccagcagcaccggcgaccgatcacaagccgtgagacacggattgcgagccaaagtgctcactcttgatggaatgaatccgagagtgcgcagagtggaatacgcggtccggggaccgattgtgcaacgggctctcgaactagaacaggaacttcgacagggtgtgaagaaaccctttacagaagtgatcagagcgaatatcggtgacgctcaagctatgggtcagcgccctatcacctttctacgccaggttttagcactctgcgtgaacccagatcttctgtcctcgccaaatttcccagatgacgctaaaaagcgcgctgaaaggattctgcaagcctgtggcggacattctcttggtgcctattctgtgagcagtgggatccaacttatccgggaggatgtagcaaggtatatagagaggagggatggtggaatccctgccgacccgaataacgtctttctcagcacaggggctagcgatgccatcgtcacggtgcttaaactgctggttgctggtgagggccacacaaggaccggtgtgctcatacctattccccaatatccgttatattcggcaacactggctgagctaggcgctgtgcaggtggattattatttagacgaagagcgcgcttgggctttggatgtcgcagaactgcaccgagctctgggccaagccagagatcattgcagaccgagggccctgtgcgtcatcaatcccggaaatcccactgggcaggtacagactagagagtgtattgaggcggttatcaggttcgcattcgaggaacgcctgtttttactagccgatgaggtatatcaggataatgtctatgcagccggatcccagttccactcttttaagaaagtgctgatggaaatgggaccaccctatgcgggacagcaagagctagcaagtttccattccacctcgaaaggttatatgggtgaatgtgggttcagggggggatatgtggaagtggttaacatggatgccgctgtgcagcaacaaatgctgaaattgatgtcagttcgactgtgtcctccagtgcccggtcaggctctgctcgacctcgtggtgagtcccccagctccgactgacccctccttcgcccaatttcaggcagagaagcaagccgttcttgcagaactcgcagctaaagccaagctgaccgagcaagtattcaatgaggccccaggcatcagctgcaatccagttcagggagctatgtactcctttccccgtgtgcagttgccaccccgagcagttgaacgggcacaggagctgggtctggctcccgatatgttcttttgcctgaggcttctcgaggagacaggcatatgcgtcgtgcccggttctggttttggtcagagagaaggcacgtaccatttccgcatgactatactccctcccctggagaaactgcggctcctactggagaaacttagccgttttcacgcaaagttcaccttagagtattcctag

SEQ ID NO: 224830 - DNA, 1491 bp, Artificial Sequence
  Description of Artificial Sequence: Synthetic coding sequence
atggctagttctacaggtgatcgctcgcaggccgtaaggcacggactgagggccaaagtcctgactcttgacggcatgaaccctcgggtccggcgagtggagtacgccgtgcgcggaccgatcgtccagcgggctttagaactcgagcaagaactgaggcagggtgtaaagaagccatttacagaagtgattagggcaaatataggagacgcacaggctatggggcaaaggcccatcacatttctaagacaggtactggccctctgcgtgaatcccgacttgctgagctccccaaatttccctgatgatgccaaaaaacgggcagagcggattctacaggcgtgtggaggtcatagcctgggggcatatagcgtgtctagcggcattcagttgattcgggaagacgtcgcacgatacatcgagaggagggatggcggaatccctgccgaccctaataacgtgtttctgtctacaggtgccagcgacgcaatcgtgacggtcctcaagctgttggtggctggcgaaggccacaccaggactggggttctgattcccatccctcagtatccactgtattccgctacactggcggaactgggagctgttcaggttgactactacttagatgaagaacgggcatgggccctcgatgtggctgagctgcatagagctctgggacaagctcgggaccactgcagacctcgcgcattgtgcgtcattaatccaggtaacccaacagggcaagtacaaactcgggaatgcatcgaggccgtgatcaggttcgccttcgaagagagactctttcttcttgccgacgaggtctaccaggataacgtgtatgcggctggctctcaattccactcctttaaaaaagttctgatggaaatggggccaccgtacgcaggccagcaggagctggctagtttccactctacaagcaagggctatatgggggagtgcggcttccgcggaggctatgtggaggtggtgaatatggacgccgctgtgcaacaacagatgctgaagctgatgagtgtacgattgtgccctcccgtgccgggacaggctctgctggacctggtagtatctcctccagcgccaaccgatcccagcttcgctcagttccaggcagaaaagcaggcggtgctcgccgagctggccgcaaaggccaagttaaccgagcaggtgttcaatgaggctccgggtatttcgtgcaatcctgtgcagggtgctatgtacagcttcccccgtgtgcagctcccccctagagccgtcgagagagcccaggagcttggtcttgcccctgacatgtttttctgtctgaggcttcttgaggagacgggcatctgtgtcgtacccggaagtggctttgggcaacgcgagggaacctatcattttcggatgaccatcctaccacccttggagaagttgagactgcttctggaaaaactctcgcgattccacgccaagtttactctagaatatagctag

SEQ ID NO: 224831 - DNA, 2010 bp, Artificial Sequence
  Description of Artificial Sequence: Synthetic coding sequence
atgatgaggctgagaggctccggaatgttgcgtgaccttctcctccgatcaccagctggcgtctctgccactctacggagggcgcaacccctcgtgaccctatgtcgcagacccaggggaggtggaagacctgccgcaggccctgcagcagcagctcggctccacccatggtggggcggtgggggttggcctgctgaacctctggcaaggggcctctcttcatctccctcagagattttacaggagctcggtaaagggtcaacacacccccaacccggtgtgagtccacccgctgcccctgctgctcctggtcccaaggacggtcctggcgagacagacgcatttggcaactcagaggggaaggagctagtggccagcggagagaataaaatcaagcagggtctgctgccatcactcgaagacctcctattctacaccatcgccgagggccaggagaaaatccctgttcataaatttattacagcactcaaaagcaccggactgagaaccagcgaccccagactgaaggagtgtatggatatgcttaggctaacgctgcagacaacttcagacggagttatgctcgataaggatctgttcaagaagtgcgtgcagagtaacattgtcctcctcacccaagcatttaggagaaaatttgtgattcctgatttcatgtcctttacctcccatatcgatgaactgtacgaatccgcaaagaaacagtccggagggaaggttgcagattacattccacagttggccaaattcagccccgacctctggggtgtgagcgtatgcactgtggatgggcaacggcactcaaccggggatactaaggtgcccttctgtctgcagagttgtgtaaagcccctgaagtatgccattgcagtgaatgacctcggcaccgagtatgtccacagatatgtgggtaaggaaccctctggccttcgctttaacaaattgtttcttaacgaggatgataagccacacaacccgatggtgaacgcgggagctatcgtggtgacgagtctgatcaagcaaggggtaaataatgctgaaaagtttgattatgtcatgcagtttcttaacaaaatggcgggaaatgaatacgtgggtttctccaatgctacctttcagtcagaaagagagtccggtgaccgtaactttgctatcggctattatctgaaggaaaagaaatgtttccccgagggcaccgatatggtaggaattctggatttttacttccagctgtgtagcatcgaggtcacgtgtgagtccgccagtgtaatggccgctaccctcgctaatggtgggttttgtccaatcactggcgaacgggttctctcacccgaggccgtacgaaacacgctgagccttatgcattcttgtggtatgtatgatttttcgggccagttcgcgttccacgtcggtctgccggctaagtccggagtcgccggtggcattctcctggtggtacccaacgttatggggatgatgtgctggtctcctccactagacaagatgggaaattccgtcaaagggatccatttctgtcacgatctggtctcgttgtgcaacttccataactatgacaatcttcgtcactttgctaaaaaactggaccctcgcagggagggcggtgaccagagagttaaatctgttatcaacttgctttttgctgcttacaccggggatgtgtcagcactgcggcgatttgctctcagcgccatggacatggagcagagagactatgatagccgaacggcactgcacgttgcagccgcagagggccacgtagaagtggtgaagtttctgctcgaagcctgcaaggtaaatccatttcccaaggaccgatggaataacaccccaatggatgaagcgctgcacttcggtcaccacgatgtttttaagatcctgcaggaatatcaggtacaatatacaccacaaggggacagcgataatgggaaggagaatcagacagtacataagaatctggatggtctgctgtag

SEQ ID NO: 224832 - DNA, 1797 bp, Artificial Sequence
  Description of Artificial Sequence: Synthetic coding sequence
atgatgagattgcggggttccgggatgctgagggaccttctgttacggtctcccgcaggcgtttctgccacgctgcgtcgggctcagcccctcgtgacactgtgccgtcgcccaaggggcggagggagaccagcggctggcccagccgcagccgcaaggctgcatccatggtgggggggaggtgggtggccagctgaaccgttggccagagggctctcttcctctccgagcgagatccttcaggaactgggtaagggctcaacccaccctcagcccggagtcagcccaccagctgctcccgctgcaccaggacctaaggatggccctggggagacagatgcattcggcaactccgaggggaaggagttggtcgcaagtggagagaataagatcaaacagggactactcccgtctctcgaggaccttttattttacacaatcgctgagggacaagagaagatccccgtccacaaattcatcacagctctgaaaagtacgggactacggacgagcgatcccagactgaaagagtgtatggatatgctgcgcctgactctgcaaactacctcggacggggtaatgctggataaggacctgttcaagaagtgtgtgcaaagtaacattgtgctccttacgcaggcctttagacggaagttcgtgattccagatttcatgtctttcaccagccacattgatgaactctatgagtctgcaaaaaaacagagcggtgggaaggtggccgattacataccccagcttgctaagtttagccccgatctgtggggcgtctctgtttgtaccgtggacggccaacggcactccaccggggacactaaagtgcccttttgtttacagagttgtgtaaagcctttgaaatatgcgatagcagttaacgatcttggcactgaatacgtccacaggtacgtcgggaaggagccaagtggcttgcggttcaataaactgtttcttaatgaggatgataaaccccataaccccatggtgaatgctggtgccatagtcgtaaccagtttgattaagcagggcgtcaacaacgccgaaaaatttgattatgtgatgcagtttttgaataagatggctggcaatgagtatgtcggattcagcaacgcaacctttcaaagcgagcgcgagtcgggagataggaatttcgctatcgggtactatctcaaggagaagaagtgttttccagaggggaccgacatggtagggattctagatttttacttccagttatgctccatagaggtgacatgtgagagtgcttctgtgatggctgcaactctcgctaatggaggattttgcccaatcaccggagagcgagttctgtcacccgaagctgtgagaaacacactcagcctcatgcattcttgtgggatgtatgacttcagtggccagttcgctttccatgtggggctgcccgcaaagagtggggtcgccggtgggattctgctggtggtacccaatgtgatgggcatgatgtgttggagcccaccgcttgacaaaatgggcaattctgtgaaagggatccacttctgtcatgaccttgtttccttgtgcaacttccataattacgacaatctacgccattttgccaagaagctcgatcctcggagggaaggtggtgaccaaagacattccttcgggcctctagactatgagagtttgcagcaggagctggcactcaaagagaccgtttggaagaaggtgtcccctgaaagcaatgaggatattagtacgacagtggtgtatcggatggaatctctgggagagaagtcttag

SEQ ID NO: 224833 - DNA, 525 bp, Artificial Sequence
  Description of Artificial Sequence: Synthetic coding sequence
atgggtatgatgtgctggtctccaccccttgataagatgggtaatagcgtcaagggtatacacttttgtcatgatctagtgtccctctgcaactttcacaattatgataatttgcggcacttcgccaaaaagcttgaccccaggcgtgaggggggagaccagcgcgtgaaatccgttatcaatctgctcttcgccgcttataccggcgacgtatctgctctgagacgcttcgcactgtcggccatggatatggaacaacgtgattacgattctcggacagcactgcacgtcgccgcagccgaaggccacgtggaggtagtgaaattcttgctcgaagcttgcaaggtcaatccctttccaaaggaccggtggaacaataccccgatggatgaggctttgcactttgggcatcacgatgtttttaagatactacaagagtaccaggttcaatacacaccccagggcgactccgataacgggaaggaaaaccagacagtgcacaagaatctggacggcttgctgtag

SEQ ID NO: 224834 - DNA, 1809 bp, Artificial Sequence
  Description of Artificial Sequence: Synthetic coding sequence
atgcggagtatgaaggccttacaaaaggccctgtcgagagccggttcccactgtggaaggggtggatggggacacccgagcagatctcccctgctcggcggaggggtcaggcatcacctgtctgaagcggctgcccaggggcgagaaaccccccacagccaccagcctcagcaccaggatcatgattcgtcagaatctggaatgttgtcacggttaggggacctgctgttctataccatcgccgagggacaggagaggattcctatacataagtttacaacggccctgaaggctaccggactgcaaacctccgatcctcggttgagggattgtatgagcgaaatgcacagagtggtgcaggaatcatcaagtggcggtttattggatagggatctgttccggaagtgtgtcagtagcaatatagtgcttctgacccaggcctttcgcaagaaatttgtgatcccagattttgaagaatttactgggcatgtcgataggatcttcgaggacgtgaaagagctgaccggaggcaaggtcgcggcatacatcccgcagctcgccaaaagcaacccagatctgtggggcgtctcactttgcacggtggatgggcaacggcacagtgtaggccatacaaaaatacccttttgtcttcagtcatgcgtcaaacccctgacttacgcgattagcatttccacgctcgggacggactacgtgcataagtttgtggggaaggagcccagtggactgcggtacaataagctgtccctcaatgaagaagggatccctcataaccctatggtcaatgcaggagccatcgtcgtgtcctccctcatcaaaatggattgtaataaggctgagaagttcgacttcgtgttacaatacctcaataaaatggcagggaacgagtacatgggcttttccaacgccacattccagtcggagaaagagacaggagatagaaactatgctatcggctactatttaaaagaaaagaagtgttttccaaaaggggtggacatgatggcagcacttgatctgtattttcagctttgctccgtagaagtaacctgcgagagcgggagcgtcatggcagctactttggctaatggaggcatttgtcctattactggcgagtcagttctctctgccgaagcggtgcgcaacaccttgtccttgatgcattcttgcggaatgtacgatttctccgggcaattcgcattccatgtggggctccctgctaaatccgcagtcagcggagccatcttgctggtcgtgcctaatgttatgggaatgatgtgcttatcgcctccgctggataagctcgggaatagccacagaggcacttccttttgccaaaagctagtgtctctgttcaacttccacaactacgataaccttagacattgcgcgaggaaactggaccccaggagggagggggctgaaatccggaataagacggtcgtaaacctgctctttgcagcctatagcggcgatgtcagtgcgctgagacgcttcgccttgagtgcgatggacatggaacagaaggattatgacagcaggacagccttgcatgtcgccgcagccgagggtcacatcgaagtcgtgaagttcttgatcgaggcctgtaaagtgaatcccttcgccaaggataggtggggtaacatcccactcgatgatgccgtccagtttaatcatttggaagtcgtaaagctgctgcaagactatcaggatagctatactctctctgagactcaagccgaagctgctgccgaggccctgtcaaaagagaaccttgagagcatggtttag

SEQ ID NO: 224835 - DNA, 534 bp, Artificial Sequence
  Description of Artificial Sequence: Synthetic coding sequence
atgaggtccatgaaagcactacaaaaagccttgtcacgtgctgggtcgcactgcgggagggggggatgggggcatccaagcagatcaccgttactcgggggaggagtgcgccatcatctgtctgaggccgctgcacaggggagagagacaccgcacagtcaccagccacagcatcaggatcatgacagctccgaaagtggcatgttgtcacggcttggggatttactgttctacacaatcgctgaagggcaggaacgcatccccatccacaaatttaccactgcattgaaggcaacgggcctgcaaacgtccgatcctcggctccgcgactgcatgtcagagatgcaccgcgttgttcaggaatcaagttcggggggtctcctggatcgcgaccttttcaggaagtggcaaccaacgtcactgtcttggcctagtcaaactcagacttgtggggtgtccccgtgtgcgctgtggatggtgaatggaaccttatgggccacacaacgaagccctagcgcctgcagccccgtgtag

SEQ ID NO: 224836 - DNA, 2049 bp, Artificial Sequence
  Description of Artificial Sequence: Synthetic coding sequence
atgtgtgggatctttgcctacatgaactatcgcgtgccaagaactaggaaggaaatcttcgaaaccctgataaagggcctccagcgtctggaatacaggggatatgattccgccggagtggccatagacggcaataatcatgaggtgaaggaaagacatattcaacttgtcaaaaaacgaggaaaggtgaaggcactggacgaagaactgtataaacaagacagcatggatctgaaggtggagtttgagacccatttcggaatcgcacacaccaggtgggccactcatggtgtgccttccgcggtgaattctcacccgcaaagatccgataagggcaacgagttcgtcgtgatacataacggcatcatcaccaactataaggatctccgcaaattcttggagagtaaaggctacgaatttgagtccgagaccgatactgagaccattgccaaattgatcaaatacgtattcgataatcgagagacggaggatattacattcagcacacttgtcgaacgcgtgattcagcaactggaaggtgcttttgctctagtctttaagagcgttcattatcccggagaagctgtggctactagacgcggttctcctctgctgattggcgttaggtctaagtacaagctgtcaactgagcaaatccccatcttgtaccgtacttgtacactcgagaacgtcaaaaatatctgcaagacacggatgaaacggctggactctagtgcttgtcttcatgccgttggagataaggcagtagagttctttttcgcatccgacgccagcgccataatcgagcacacgaatagggtgatattcctggaggacgacgacatagcggctgtggccgacgggaagctgtcgattcaccgggtcaagcggagcgcatctgatgacccatccagagccatccagaccctgcagatggaactgcagcagattatgaaaggcaatttttctgcatttatgcaaaaagagattttcgaacaaccggagtccgtatttaatacaatgcgcggtagagtgaacttcgagaccaatacagtcctactgggcggacttaaggatcatctgaaggaaatccgcagatgtcggcgactgattgttataggctgcggaaccagttaccacgccgctgtcgcaactcgccaggtgcttgaagagttgacagagctgcctgttatggtggaattggcttccgatttcctcgaccggaacacacccgtttttcgagacgacgtgtgtttctttatttcacagtccggggagactgcagatacactgcttgccctgcgatactgtaaggacagaggggcacttaccgttggagtaaccaacacagtagggagcagtatctcccgggaaacagactgcggtgtacatatcaacgcgggaccggaaattggagtcgccagtacaaaagcttatacaagtcaatttatatccttagtaatgttcggactgatgatgagcgaagacaggattagtctgcagaaccggagacaggaaatcatccggggactccgaagcctgcccgaactcattaaggaggttctgtccctggaagagaaaattcacgacctggctctggaactgtatacgcagcgctcactgctggtgatggggcgagggtacaattacgccacctgcctggagggagcgctcaagataaaagagattacctatatgcatagcgaggggattctggcgggtgagctgaaacatgggcctttagcccttatcgataagcaaatgcccgtgatcatggtgattatgaaggatccatgctttgcgaaatgtcaaaatgcactgcagcaggtcacagcccgtcagggaaggcctatcatcttgtgctctaaggatgatacagagagttccaaatttgcctacaaaactatcgagctcccgcacacagtagactgcctgcagggcatcctgagcgtgatccccctgcagcttctgagctttcacctggccgttctgcgcggttatgatgtagactttccgcgtaatctcgctaaatccgtgaccgtggaatag

SEQ ID NO: 224837 - DNA, 1086 bp, Artificial Sequence
  Description of Artificial Sequence: Synthetic coding sequence
atggctggaggaagacatcgtagggtggtgggcaccctacatctcctgctgttggttgctgccttaccctgggcaagtagaggagtctcgccctccgctagtgcctggcccgaggagaaaaattaccaccagccagcaatcctgaattctagtgctcttcgacagattgctgagggcacatctatttccgagatgtggcagaacgacctccagcctctccttattgaacggtatcccggttccccgggatcctatgcagcacgccagcacatcatgcagcgaattcagcggcttcaggccgactgggtcctcgaaatcgacactttcttatcacagactccatatggctatagaagtttttccaatataatcagcactctgaatcccactgccaaaagacatcttgttcttgcctgtcactatgacagcaagtatttcagccattggaataacagagtcttcgttggcgctacggacagtgcagtgccttgcgccatgatgttggaacttgctagggcccttgacaaaaaattactgtctctgaaaacagtgtcagattcaaaacctgacttgtcactgcagctcattttttttgacggggaagaagcatttctacactggtcaccacaggactcactgtacggctcgcggcatttagccgctaaaatggcgtccacacctcacccacccggtgcgaggggaacttctcagctccatgggatggatctcctggtgctgctcgatctgatcggggcaccaaatcccaccttcccgaacttttttccgaatagtgccaggtggtttgaacggctgcaggccatcgagcacgagttgcatgagctgggtctcctgaaggatcacagcttagagggtaggtatttccagaactattcctatggcggagttatccaggatgaccacatccctttcctgcggagaggagttcctgtgttacacttgattccgtcgcccttccctgaagtctggcacaccatggatgataatgaagaaaacctcgacgaaagcaccatcgacaaccttaataagatcctgcaggtcttcgtactggagtacctgcatctgtag

SEQ ID NO: 224838 - DNA, 939 bp, Artificial Sequence
  Description of Artificial Sequence: Synthetic coding sequence
atggctggcggtcgccatagaagggtggtaggtactctacaccttctgctgttagtggctgctttaccctgggctagccgcggagtgagcccctccgccagtgcctggccggaggaaaaacacattatgcagcggatccagagattacaggcagattgggtcctggagattgacacctttctgagtcaaactccttatggctatagatcctttagtaatattattagcactcttaatccaaccgccaagcgtcacctggttttagcctgtcactacgattccaaatatttctctcattggaataatcgtgtttttgtcggagccacggatagcgccgtgccgtgtgctatgatgctcgagctcgctcgggcattggacaagaaacttctaagcctcaaaactgtttctgattcaaaaccagacctaagcttgcaactgatctttttcgacggggaggaagcattcttacattggtctccccaggactccttgtacggatctagacaccttgcagctaagatggcttcaactccccacccacccggtgccagggggacaagtcagctgcatggaatggatttgcttgttttgttggacttaataggtgctccaaatccgactttcccaaatttcttccccaacagcgcccgttggttcgagcggctgcaggccatcgaacatgagcttcatgagttagggcttttaaaggatcattcccttgaagggcgatattttcagaactactcctatggcggagtgatccaggatgaccacataccctttctcaggcggggagtccccgtcctacacctaattccatctccctttcccgaggtctggcacacaatggacgataacgaagagaatctggatgagtccaccattgacaatttaaataagatactgcaagtgttcgtattggagtacctgcatctgtag

SEQ ID NO: 224839 - DNA, 2328 bp, Artificial Sequence
  Description of Artificial Sequence: Synthetic coding sequence
atggcagcacttgatagcctgtccctgtttaccagtttgggcctgtcggaacagaaagctagggaaacgctgaagaattcagccctgagtgcgcagcttcgtgaagctgccacccaggcgcagcagacgctcggctccactattgacaaggccacagggattctcctatatggtctggcctcccgtctgagagacacccgccgactgtctttcctggtcagctacatcgctagcaaaaaaatacacacggagccacaactttcagcggcactggaatacgtgcgttctcaccctctggatccgattgacactgtggattttgaaagagaatgcggagtgggcgtcatcgtcactccagagcaaatcgaggaggccgttgaggcagccatcaaccgacaccggcctcaactactggtggaacggtaccacttcaatatgggcctgctcatgggagaggcgagggctgtgttgaagtgggctgatgggaagatgatcaagaacgaagtagacatgcaggtgctgcacctgttggggccaaagctggaggccgatttggaaaagaaattcaaggtcgcaaaagctcgcctggaggagaccgatagaaggactgctaaagatgtggtcgagaacggggagacagcagaccagacgttatccctaatggaacagctacgaggcgaggccttgaagtttcacaaaccaggggaaaactacaagacacccggatacgttgtcaccccccacacgatgaatctactgaaacagcacttggagatcaccggtggccaggtccgtacccgattcccgccagaacccaatggcattctgcatattggccacgccaaggcgattaatttcaattttggctatgcgaaggccaacaatggtatctgtttcctcaggttcgacgacaccaaccccgaaaaagaagaagccaagttcttcacagcaatctgcgacatggtggcctggctggggtatactccttacaaggtcacatacgcgtcagattatttcgaccagctgtacgcatgggccgtggaacttatccgcaggggtttggcgtacgtatgccaccagcgaggagaagagctgaagggacacaacacacttccgtctccttggagagacagaccaatggaagaatcgcttctactgttcgaggcaatgcgcaagggcaagttttccgaaggcgaagctaccctacgaatgaaactagtcatggaagatggcaaaatggacccggtcgcataccgcgttaaatacacccctcatcatcgcactggagataagtggtgtatctatcctacctatgattacacccattgtctctgcgattctattgaacatattacacatagcctctgtactaaggaatttcaggcccgacgtagctcttatttttggctttgtaatgcgctggatgtgtattgtccagtccaatgggaatatgggaggctgaaccttcattatgccgtggtaagcaaaaggaagatcctgcagctggttgctacgggcgcagttagggattgggatgatccccgactgtttaccctaactgccctccgacgtaggggtttccctccagaggctattaacaatttctgcgccagggttggggtgaccgtggctcagacgaccatggagccacatctacttgaagcttgcgttcgggacgttctgaacgacaccgccccaagggccatggcagtgcttgagtcactccgcgtgatcatcacaaattttcccgcagcgaagtccttagacattcaggtaccaaatttcccagctgacgagacaaagggcttccaccaggttccttttgcaccgattgtgtttatcgaacggacagattttaaggaggagccagagcccggtttcaaaaggctggcctgggggcaaccagtcggcctgcgccacactggatatgtgatcgagctccagcacgtcgtgaaagggccatccggctgcgttgagtcgctcgaggtcacctgccgcagagcagatgctggcgaaaagccaaaggcttttatccactgggtctctcagccccttatgtgtgaagtccggctgtacgagagactcttccaacacaaaaatccagaagatcccacagaggtgcccggaggctttctgtcagacctcaacttggccagtctgcatgtggtagatgccgctctggtggactgctctgtggccctagccaaaccatttgataaatttcagttcgaacgcttagggtacttttctgtcgaccctgactcacaccagggcaagctcgtgtttaaccgcactgtgacccttaaggaagatcccggtaaggtgtag

SEQ ID NO: 224840 - DNA, 2295 bp, Artificial Sequence
  Description of Artificial Sequence: Synthetic coding sequence
atggccgcactggatagcctcagcttgttcacatccctggggctgtctgagcagaaggcgagagagaccctgaagaacagtgccctgagcgcccaactccgtgaggcagcgacccaggcacagcagaccctagggtctaccatagacaaagctactgggatcctgctgtacgggctggcatccaggctgcgggatacccgtagattaagcttcctggtttcttacatcgcgactgccttggaatatgtgaggtcacatcctctcgacccaatcgatactgtggacttcgagagggagtgcggagtgggcgttatagtgacccccgaacaaattgaagaagcggtagaagcagccattaacaggcaccggcctcaactgcttgtggaaaggtatcatttcaacatgggtctactgatgggcgaggcccgtgctgtgctgaaatgggcggacggtaaaatgatcaagaatgaggtagacatgcaggtgttgcacctgctgggtcccaaactcgaggccgatctggagaagaaattcaaggttgccaaagccagactggaggagactgacagacgtaccgcaaaagatgtcgtcgaaaacggcgaaacggcagaccagaccctgtcattgatggagcaacttcgaggcgaggcactcaaatttcacaaaccaggcgagaactacaagacccctgggtacgttgtgacccctcacacaatgaaccttctgaaacagcacctagaaattacaggtgggcaggtacgcactcgatttcctccagagcccaatggtatcttgcacattggacatgctaaggcgataaactttaatttcggttatgctaaggctaacaatggtatttgcttcctccgcttcgacgacactaatcccgagaaggaggaggccaaatttttcaccgcgatctgtgacatggtggcctggctgggttacacaccctataaagtgacttacgctagcgactatttcgaccagctttatgcctgggctgtcgaattgattaggcggggtctggcatatgtgtgccatcaacggggagaggagctgaagggtcacaatacgcttccctctccatggcgggaccggcctatggaggagtctctcctcctatttgaggctatgagaaaggggaaattttctgagggggaagcaactctgaggatgaagctcgtcatggaagatggcaaaatggaccctgtagcctacagggtgaagtatacgccacaccaccgtaccggcgacaaatggtgcatctatccgacatacgactacactcactgtctgtgcgacagcatcgagcacatcacacacagcctgtgtacaaaggaatttcaggctaggcgaagttcatacttctggctgtgtaatgctctagatgtttactgtccggtgcagtgggagtatggcagactgaatctgcattacgccgtggtaagcaagcgaaaaatattgcagctcgtggccactggcgcagttagagattgggatgatccccgtctcttcactcttaccgctctgaggcgcagaggcttccccccagaagctattaacaacttctgtgctcgggtcggtgtgactgtggcacagacgaccatggagccacacctactggaagcatgcgtccgcgatgttttaaacgatacagctccccgtgcgatggccgtgctcgaaagcctccgagtcatcatcacgaactttccagcggcaaaaagcctcgacattcaggtaccaaactttcccgcagacgaaaccaaaggttttcaccaggtcccattcgctcccatcgtttttatcgaacggacggacttcaaggaagagccggagcccggattcaagaggctggcttgggggcagccggtcgggttgcgccatactggatatgtcattgagctccagcatgttgttaaggggcctagcggttgtgtcgagtctctggaagtcacttgccgaagggccgacgccggagaaaagccaaaagccttcattcattgggtgagccaaccccttatgtgcgaggtccggttgtacgagaggcttttccagcataaaaaccccgaggacccgaccgaagtgccgggaggctttctcagcgacctgaacctcgcgagcttgcatgtggtagatgccgcactcgtcgattgctccgtcgcccttgctaaaccgttcgacaagtttcagttcgagcgcctcggctatttctccgtcgacccagactctcaccagggcaagctagtgttcaacaggactgtgaccttgaaggaggatccaggcaaagtctag

SEQ ID NO: 224841 - DNA, 849 bp, Artificial Sequence
  Description of Artificial Sequence: Synthetic coding sequence
atgcctacctgccggctgggccctaaattccttctcgtgagcggagttagcgccatggctgcgcttgactctttgagcctatttacaagtttgggattatccgagcagaaagctcgcgagaccctgaagaatagcgccctgtccgcgcagctgcgcgaagctgccactcaggcccagcagactctgggctcaaccatcgataaagcaacagggatcctgctgtacggcttggcttcgcgcctccgggacactcgaaggctatctttcctggttagctatattgcgtccaaaaagatccataccgagccccagctgagtgcagcattagagtatgtgcgtagccatcctcttgatcctattgacacagtcgacttcgagagagagtgtggtgtgggcgtgatcgttactcccgaacaaatagaggaagcagtggaagccgcaattaaccgtcatagacctcagctgctggttgaacgctatcatttcaacatgggcctcctcatgggcgaagcccgagccgtcctgaagtgggcggatggcaagatgatcaaaaatgaagtcgacatgcaggttttgcatctcctggggccaaaactggaggcagatttagagaaaaagttcaaagtagctaaggcccgactggaggagacagatcgacgcaccgccaaggatgtagtggagaacggcgagactgccgatcaaactctctcactgatggagcagttaaggggcgaagctctgaaatttcacaagccgggaacctatcccgtacctgctcgtacccagtggaatcccgcatactggacgtgccaatcccatcagtttcagttatggctgtgtcaagtgtag

SEQ ID NO: 224842 - DNA, 2874 bp, Artificial Sequence
  Description of Artificial Sequence: Synthetic coding sequence
atgaacttcgcagaacgtgagggtagcaaacggtactgtatacagaccaagcatgtagccattctttgcgccgtagtggttggagttggcctgattgtgggactcgccgtggggctgacaagatcttgcgattcctccggggacggcggacccggtaccgcacccgcaccatcacacctgcccagttcaacagctagccccagcggacctcccgcacaggaccaggacatttgccccgcttcagaggacgagtcaggccaatggaaaaactttagactgcccgattttgtgaatccagtgcattatgatcttcatgtcaagcccttactggaggaagatacatacaccggaactgtcagtatttccatcaacctctcggcacctacgaggtacctctggctgcatctgagggagacgcggatcacacggttgcctgagcttaagcgtccctctggggaccaggtgcaggtgagaaggtgttttgaatacaaaaagcaggagtatgtcgtcgtggaggctgaagaggaacttactccctcctccggtgatggcctgtacttgcttactatggaatttgctggatggctgaacggttccctggtgggcttttaccgaacgacgtatacggaaaacggccaggtcaagagtattgtagccactgatcatgagcctaccgacgcaaggaagagcttcccttgctttgacgagcccaataaaaaggccacttacacaatttctataacccatccgaaagaatacggggcactttctaatatgcccgtggcaaaagaagagtccgtggacgacaagtggacccggactaccttcgagaagtcagtgcccatgagcacatacctggtgtgttttgcagttcatcaatttgactccgtcaagcggatctcaaactccggcaagccactcacaatttatgtccaacccgagcagaagcataccgcagagtatgccgctaacattacgaagagcgtgtttgattatttcgaagagtacttcgccatgaactacagtctgcccaagctcgacaaaatagcaattcccgattttggtacaggcgctatggagaattggggcctgattacttatagggagaccaacctcctgtatgatcccaaagagagcgctagtagtaaccagcagcgagttgccaccgtcgtggcccacgaactcgtgcatcagtggtttgggaatatagtgacaatggattggtgggaagacctctggttaaacgagggctttgcatcctttttcgagttcctcggggtaaatcacgctgaaacagattggcagatgagagatcagatgctgctagaggatgtcctgcccgttcaggaggatgactctttaatgagctcccatcctatcattgtgacagtgaccacccctgacgagatcacctcagtattcgacggtatctcctactccaaggggtcctctatcctccgtatgctggaagattggatcaagcccgagaatttccagaaaggatgtcagatgtacttggagaagtatcaatttaagaacgctaaaacatcggacttttgggcagcgctcgaggaagcgtcgagattacccgtgaaagaggtcatggacacatggacacgacagatgggatatcctgtactgaacgtgaacggggtgaagaacattactcaaaagaggtttctgctcgatccacgggcaaatccaagtcaaccaccatctgacttaggttatacctggaatattcctgtgaagtggaccgaagataatataacaagctctgtgcttttcaacagaagcgagaaggaagggatcacccttaacagcagcaacccatccggcaatgcctttctgaagatcaatccagatcacatagggttctaccgcgtcaactacgaagtggcaacatgggacagcatcgccacggccctgtctctcaatcataaaacatttagctctgctgacagggcctcccttatcgacgacgccttcgccctggcccgagcgcagctgcttgactacaaggtggccctgaacttgaccaagtacctgaaaagggaggaaaacttcttaccctggcagcgggttatctccgccgtcacatatattatatctatgttcgaggacgataaagaattgtatccgatgatcgaggagtactttcaagggcaggtaaagccaatcgcagattctcttggctggaacgatgccggagaccacgtcaccaagctgttgcgaagctctgtcttgggcttcgcctgcaagatgggcgatcgtgaggccttaaacaatgctagctctcttttcgagcagtggcttaacggaaccgtctctttgccagttaacttacgcttgttggtgtatcgttatggcatgcagaattccgggaatgagatctcttggaactacaccctagagcagtaccagaagacctccttggcccaagaaaaagagaagctcctctacgggttagcatctgtcaagaatgtgacgcttttaagccggtacctcgacctattgaaggatacaaacttaattaagacacaagatgtattcacggttattaggtacatttcatacaattcctatggcaagaacatggcctggaattggatccagcttaactgggactatttagttaaccggtacacacttaataaccggaacctggggagaatcgtgactatcgctgaaccttttaataccgagctgcagctctggcagatggaatcatttttcgcgaagtacccccaggcaggcgctggggaaaagcctagggagcaggtgctagagactgtgaaaaataacatagagtggctgaagcagcatcggaacacaatcagggaatggttcttcaatctgctcgaaagcggatag

SEQ ID NO: 224843 - DNA, 4539 bp, Artificial Sequence
  Description of Artificial Sequence: Synthetic coding sequence
atggccacactgagcctgactgttaactcgggcgacccacctctgggagccctgctcgcagtcgagcatgtcaaggacgatgtgagtatctctgtcgaagaaggaaaagaaaacatcttacatgtttctgagaacgtgatcttcaccgacgtaaatagtatactgagatatttggcacgagtcgccacaactgctggcctgtatggttcgaatttgatggagcacacggagattgaccactggctcgaattcagcgccaccaagttgagtagctgcgatagctttacatccaccataaacgagctgaaccattgtttaagccttaggacatatctggttggcaactccctgtctctggcagacctgtgcgtatgggctacattgaaggggaacgcagcgtggcaggagcagttgaagcaaaaaaaggcacctgtgcacgtgaaaagatggtttggctttctggaggctcagcaggcatttcagtcagtcgggacgaagtgggatgtctctacaacaaaagctagggtggcccctgagaagaagcaagatgtggggaaattcgtcgagctccccggtgcagagatggggaaggttacagtacggtttcccccagaagcctctggctacttgcacatagggcatgccaaggcagcactcctgaaccagcactaccaagtgaattttaagggtaagttgattatgcgattcgacgacacaaacccagagaaagaaaaggaggattttgagaaggtaatactcgaagatgtggcaatgctgcacattaagccagaccagttcacatatacaagtgaccacttcgagactattatgaaatacgccgaaaaattaatccaggaagggaaggcttatgtggatgacacacccgcagagcagatgaaggcagaacgcgagcagagaatcgactccaagcatagaaagaatcccatcgaaaaaaacttgcaaatgtgggaagagatgaagaaaggctctcagttcggacagagctgctgcctgagagctaaaattgatatgtcctccaacaatggttgcatgagggacccaactttatacagatgcaaaatccagccacatccaaggaccgggaacaagtataacgtgtatcccacttatgattttgcgtgcccaatagtggactccattgaaggggtgactcacgctttaagaacaactgagtatcatgaccgagatgagcaattctattggataatcgaagccttggggatccgcaagccctacatttgggagtatagtcgtctcaatcttaataataccgtcttgtctaagaggaagctcacttggtttgtgaatgaagggcttgtggacggttgggacgatccaagattcccaacggtgcggggtgtattgaggcgcggaatgactgtggagggactaaaacagttcatagcagctcaagggtcttcacgaagtgttgtgaacatggagtgggacaagatctgggcttttaacaaaaaggtgatagaccctgtagccccaaggtatgtggcattattgaagaaggaagtcatcccagtcaatgtccctgaagcacaggaagagatgaaagaagtggccaagcaccccaaaaacccagaggtaggccttaagcctgtgtggtactccccaaaggttttcattgagggagccgatgcagagaccttctcagaaggagagatggttaccttcatcaactgggggaacctcaatatcaccaagatccataagaacgctgacggtaagatcatcagcctggacgccaagctcaatttggaaaacaaggactacaagaagaccacaaaggtgacctggttagcagaaactacccatgcacttcctatcccagtgatttgcgtgacgtacgaacatctgattaccaaaccagtgctgggaaaagacgaggacttcaaacagtacgtgaacaaaaatagcaaacacgaggaactgatgctgggagacccatgtcttaaggatttgaagaagggagatatcattcagctgcagagacgtggattcttcatttgtgaccagccttacgagcccgtgagtccttacagttgcaaagaggcgccatgcgtcctcatctatatcccagatgggcacactaaggaaatgcctacatctggctctaaggaaaagacgaaagtggaggccacaaaaaacgagacctccgctccatttaaagagcgccctaccccctctttgaacaacaattgcaccacgagcgaggactccctcgtgctttacaacagggtggccgttcagggtgatgtggtgcgcgagttaaaagctaagaaagctcctaaagaagacgtggacgcagcagtgaagcagcttctgtctctgaaagccgaatataaggagaagacagggcaggagtacaaaccaggcaaccccccagcggaaattggccagaacattagtagtaatagttccgcctccatattggaatccaaaagtctgtatgacgaagtggccgctcagggcgaggtagtaaggaagctgaaggcagaaaagtcaccaaaggccaaaattaacgaggcagttgagtgccttctctccctaaaggcgcagtacaaggaaaaaacgggaaaggagtacataccaggacagccacccttgagccagtcaagtgattcatctcccacccgaaattccgagcctgccggtcttgagactcccgaggcaaaggttctgtttgataaagtcgcttcgcagggagaggtggtgcgcaaactgaaaaccgaaaaggctcccaaagaccaggtggacattgcggtgcaggagttactccaactcaaggcccagtacaagtctctcatcggcgtcgaatacaaacctgtgtccgcgactggtgcagaagacaaagataagaaaaaaaaagagaaagaaaataagtcagaaaagcagaacaaaccacagaaacagaatgacggccaacggaaagatccctccaagaatcagggtggcggactttccagctcaggagctggggaaggccaaggccctaagaagcagacaagactgggactcgaggctaaaaaggaggagaacttagcagattggtactcgcaggtgattactaagtctgaaatgatagaatatcacgacattagcggctgctatattctccggccttgggcctatgctatctgggaggcgattaaggattttttcgatgcagaaattaaaaaactcggtgtcgaaaactgttatttccctatgtttgtctcacagagcgcgcttgaaaaagagaagacccacgtggcagatttcgcacctgaggtcgcctgggtaactagatccgggaagaccgaattggccgagccgatcgccattaggcccacctccgaaacagtcatgtaccccgcttacgctaaatgggtccagagccacagagatttgccaatcaaactgaatcagtggtgcaacgtggtccgatgggaattcaaacacccacagccctttctccggactcgggagttcctctggcaggaaggtcatagcgcgtttgccaccatggaggaggcggcagaggaggttctccagatcctcgatttgtacgcccaagtgtacgaggagttgctggcgatccccgtggttaaagggcgaaagaccgaaaaagagaaattcgccggtggcgattacacaacaacaatcgaggcttttatttccgctagcgggcgagcaatccagggcggaaccagccaccacctgggccaaaacttcagcaagatgtttgaaatcgtcttcgaggaccccaaaattccaggcgaaaaacagttcgcttaccagaattcttggggccttactacccgcaccattggagtgatgacaatggtgcatggagacaacatgggtttggtgctccctcctagggtagcttgcgtgcaggtagttattatcccctgcggtattactaatgctctgagcgaagaggacaaggaagccctaatcgccaagtgtaacgattacaggcggagacttctgagcgttaatattcgggtgcgggctgatctccgggataactacagtcctggctggaagtttaatcattgggagttgaaaggggtcccaatccggctggaggttgggcctagagatatgaaaagctgtcagtttgtcgccgtacgacgcgacaccggagagaaactgacagtggctgagaacgaggctgaaacaaagctgcaggccattttggaggacattcaggtgacacttttcaccagggcatccgaagacttgaaaacccatatggtcgtggccaatacaatggaggactttcaaaaaatactggatagcgggaaaattgtgcagattccattctgtggggagatcgattgtgaagactggatcaagaagacaactgccagggaccaggacctcgaaccaggcgctccttcaatgggggctaagagtctgtgtattccattcaagcctctctgcgaattacagcccggagctaagtgtgtctgtggaaaaaatccagcgaagtattatactcttttcggacgaagctattag

SEQ ID NO: 224844 - DNA, 2964 bp, Artificial Sequence
  Description of Artificial Sequence: Synthetic coding sequence
atggcaacgcttagtttgactgtgaatagcggcgatccccctctgggggcactgttggcggtagaacacgtgaaggacgacgtgtccatctcagtggaagaaggaaaggaaaacatcttacacgtgtctgagaatgtgatattcaccgacgtcaactctattttacgatatctggcccgtgttgccaccaccgccggactatacggctccaacctgatggaacacactgagatagatcactggctggagttttcggctactaaacttagctcgtgcgacagcttcacatctactattaacgaattgaaccattgcctaagtctgagaacgtatctcgtaggaaatagcctgtccttagccgacctctgcgtctgggctacactgaagggaaacgcagcttggcaggaacaactcaagcagaaaaaggctcccgtgcacgtgaaacggtggtttggctttcttgaagcacagcaggcctttcagtccgtcggtactaagtgggacgtttcaaccaccaaggccagggtcgctcctgagaagaagcaagatgtcggaaagttcgtcgagctgccaggagctgagatggggaaggtcaccgtccgttttcccccagaggctagtggataccttcacatcgggcacgctaaggctgcccttctgaaccagcattatcaagtgaatttcaaaggaaagctaattatgaggttcgacgatacaaaccccgaaaaggaaaaagaagacttcgagaaagttatcaagtccgtcgtcatgacactgtgtcagaagtccatcaaggtgacaggactgcccaacacttttatggttatcctggaagatgttgccatgctgcatattaaaccagatcagtttacctatacttccgatcactttgagactataatgaaatatgccgagaaactgattcaagagggcaaggcgtacgtggatgatactccagcagaacaaatgaaggcagaacgggagcagcgcatcgactccaaacaccgaaagaatccaatagaaaagaatttacagatgtgggaagaaatgaagaagggtagtcaatttggccagagctgttgcttacgcgctaagattgacatgtcgagcaataacggctgcatgcgggatcctacgctttaccggtgcaagattcaacctcatcctagaactgggaataagtataacgtctaccccacgtatgatttcgcatgcccgattgtggacagcatagagggagttacccacgccctgaggaccaccgagtaccatgatcgggatgagcagttttattggatcatcgaggccctcggtattcgaaagccatacatatgggagtactcacggctgaatctcaataatacagtgttatccaaacgcaaactgacctggtttgtcaacgagggcctggtcgacgggtgggacgatcctcggtttccaacggtcaggggagtcctaagacgtggaatgacagtggaagggttaaagcagttcatcgccgctcaagggagcagtcgaagcgtggtcaacatggaatgggacaagatctgggcgttcaacaagaaagtgatcgatccagtggctcccagatatgtcgcactgctgaagaaagaagtaattcctgtcaacgtacctgaggcacaagaagagatgaaggaagtagctaagcatccaaagaacccggaagtcggcctgaaacccgtttggtattcaccaaaagttttcattgaaggtgccgacgccgaaacattctccgagggtgagatggttactttcatcaattggggtaacctcaacattacgaaaatccataaaaacgccgacgggaagatcatatcgctggatgcaaagctgaacctggagaacaaggactacaagaagactacgaaggtaacatggcttgctgagaccacccatgccttgccaatacccgtaatctgtgtcacatacgagcatctgattaccaagccagttttaggcaaagacgaagactttaagcagtacgttaataagaacagcaaacacgaggaactgatgctcggagatccttgtcttaaggatcttaaaaagggtgacataatccagctccagaggcgcggtttctttatttgtgaccagccatacgaaccagtctcgccctattcttgcaaggaagcaccctgtgtcctcatctatattccagatgggcacaccaaggaaatgccgacttctggtagcaaagaaaagacaaaggtggaagccacaaagaatgaaacctccgcacctttcaaggagcggccaaccccatccctgaataataattgcacgacttccgaggatagccttgtgctgtataaccgagttgcagtgcagggggacgttgttcgggaactgaaagccaagaaagcaccgaaagaggacgttgacgccgctgtgaaacagctcttgtcactgaaggcagaatacaaagaaaaaacaggccaagaatataaacccggtaaccccccagcggaaataggccaaaacatttcatcaaatagttctgcgtccatcctggagagtaaaagcctgtatgacgaggttgccgcacagggtgaggtcgttcggaagttgaaggcagagaagagccctaaggctaagatcaacgaagccgtggagtgtctcctgagcctgaaagcccagtacaaggagaagaccggaaaggagtacatccccggacagcccccactttcacagtcaagcgactccagccctaccaggaattccgaacctgcaggactggagacccctgaggctaaggtgctcttcgacaaagtcgcctcacagggcgaggtggtgcgcaaacttaaaacagaaaaagctccaaaggaccaggtggacattgccgttcaggagcttctccaactgaaggctcaatacaaatctctgataggcgtagagtacaagcccgttagcgccactggcgcagaagacaaggacaaatag

SEQ ID NO: 224845 - DNA, 2928 bp, Artificial Sequence
  Description of Artificial Sequence: Synthetic coding sequence
atggcgactctgtcgctgacagtcaatagcggagatccacctctgggcgctttgttggctgtcgagcacgtgaaggatgatgtctccatctccgtcgaagagggtaaggagaacatcctccacgtgtcggaaaacgtgatatttaccgacgtgaacagcattctgcggtaccttgccagggtggccactacggcgggtctctacggcagcaatctgatggagcatacagagatcgaccattggctggaattttccgctacgaaactatcatcatgtgactcatttaccagtaccattaacgaacttaaccactgcctgtctctaagaacttatctcgtcggcaattcactgtcattagctgacttgtgtgtgtgggcgacactgaagggcaacgcagcttggcaggagcagctcaaacaaaagaaggccccagtgcatgtgaaacgctggttcgggttcctggaagcccagcaggctttccagtctgttggaaccaagtgggacgtatccacaacaaaagcccgtgttgcccctgaaaagaagcaagacgtaggtaaattcgttgagctgccgggtgcagaaatgggaaaggtcactgttaggtttcccccagaggcaagcgggtacttgcatattggccacgcaaaggccgctctgcttaaccagcattaccaggttaacttcaaaggaaagttgatcatgcgatttgatgacactaaccccgagaaggaaaaggaggacttcgaaaaggtaatactggaagacgtcgccatgctgcacatcaagcccgatcagtttacatacaccagcgaccactttgagacaattatgaagtatgcggagaagctaattcaagagggaaaagcatatgtagatgatactcccgctgagcagatgaaggctgagagagagcagcgcattgactctaagcaccgtaagaatcccatcgagaaaaacctccagatgtgggaggagatgaaaaagggcagccagtttggtcaatcctgctgcctgcgggcaaaaatcgacatgtccagcaataacggttgcatgcgggatcctaccctttatagatgcaagattcagccacacccccgaaccggtaataaatacaatgtgtaccctacatacgattttgcgtgtccgatcgtcgattcaatcgagggggtgacacacgctctacgcactactgagtaccacgaccgagatgagcagttctactggatcattgaggcactaggcattcggaagccatacatttgggagtactccagactgaacctcaacaatacagtgctcagcaagcgcaaactgacctggttcgttaacgaggggcttgtggatggatgggacgaccctcgtttccccactgtccgcggagtactgcggcgtgggatgacagtggagggccttaagcaattcatcgccgctcagggatcgtcccgcagtgtggttaatatggagtgggataaaatctgggctttcaataagaaactgagagccttatgcaaaaaggttattgaccccgtcgctcctaggtacgtggccctgttgaagaaggaagtgattccggttaacgttcccgaagctcaggaggagatgaaagaagttgcaaagcaccctaagaaccccgaagtggggttgaagcccgtgtggtatagccctaaagtgtttattgagggagcggacgccgaaactttctccgaaggagagatggttacttttattaattggggcaatctgaacatcacgaaaatccacaaaaacgccgacggtaagattatcagtctcgacgccaagttaaacttggagaataaagactacaagaaaacaaccaaagtgacctggctggcggagactacccatgcgttgcccatccccgtgatctgcgtaacatacgaacacctaataaccaagccagtcctcggaaaagatgaagactttaagcagtacgtgaacaagaatagcaaacacgaagaattgatgctaggagatccctgtctgaaagacctgaagaaaggagacatcattcaacttcaacgacgaggattctttatctgtgaccaaccctacgagcctgtgtctccatactcctgcaaggaggcaccctgcgtgctgatctatatccccgacgggcacactaaagagatgccgaccagcgggtccaaagaaaagaccaaggtcgaagctacaaagaacgagacatctgcccctttcaaggagagacccacacccagtctgaacaataactgcaccacaagtgaggatagcctggtgctttacaatcgagttgccgtacagggtgatgtggttagagaactcaaagctaagaaggcccctaaagaagacgttgatgcagcagttaaacagctactgtccttgaaagcagaatataaagagaagactggccaggaatataaacctggcaatccaccggctgagatcgggcagaatatatctagtaattcctctgcctctatcctggagagtaaaagcctttatgacgaggtcgctgcccagggagaagtggtgcggaaacttaaagcggagaagtcaccgaaagccaagatcaatgaggcagtggagtgtctgttgtctcttaaggcgcagtataaagaaaaaactggtaaagagtatatcccgggacagcctcccctgtcccagtcatctgattcctcccctacacggaatagcgaacctgccggactggaaacacccgaagccaaagtattattcgacaaagtggctagtcagggagaggtcgtgcgcaaactcaagaccgaaaaagccccaaaggatcaggtagacatcgccgtgcaagaactacttcaactgaaagcccagtataaaagcctgataggtgtggagtataaaccagtctccgcgacaggtgcagaagataaagacaaaaagaaaaaagagaaatag

SEQ ID NO: 224846 - DNA, 1572 bp, Artificial Sequence
  Description of Artificial Sequence: Synthetic coding sequence
atggccgctctcctgaggcgcttactccagagggagaggccgagcgcagctagcggcagaccagtcggaagacgcgaggctaacctcggaaccgatgcaggtgtggccgtccgagtccgtttcgctccttctcctacagggtttcttcacttaggcggactgcgcactgctctgtataactacatctttgcgaagaagtaccagggctcctttattctgcggctagaggatactgaccaaaccagggtggtccctggtgccgctgagaatattgaagatatgctagaatgggccggaatcccgccagatgagtcaccccgacgtggagggccagcaggaccatatcaacagtcccagagactggagctgtacgcgcaggccaccgaggccctgctgaaaaccggagctgcttacccatgcttctgcagtccacagaggcttgaactgctaaagaaggaagctctgcgcaaccaccagacaccaaggtatgataaccgctgccgcaacatgtctcaggaacaggtggcccagaagctggctaaggatcctaaacccgcaataagatttcgcctggaacaggtggtcccagcgtttcaggacttagtttacggctggaataggcacgaggttgcatccgtggagggcgatcccgtaatcatgaaatcggacggtttcccaacgtaccatctggcctgtgtagtcgacgaccatcatatggggataagtcacgtgttgagaggctctgagtggctggtgtccacagccaaacatcttcttttgtatcaagccctggggtggcagcccccacattttgcccatctccctctgttactgaacagggacggcagtaagctcagcaaacggcagggagacgtcttcctggaacatttcgcagcggatgggtttctgcccgactcactacttgacataattacaaattgcggatcgggctttgcagagaatcaaatgggccgtacacttccagagctgattacacagttcaacctaacgcaggtgacctgccacagcgctctgctcgatctggaaaagctgccagagttcaatcggctgcacctgcagcggctggtttccaacgaatcccaaaggcgtcagctggtagggaagctccaagtgctggtggaggaagcctttgggtgccaactgcaaaatcgggatgtgctgaatccagtctacgtcgagcggattctgctgctccgacaggggcatatctgccgactccaggatttggtgtcccccgtctactcttacctgtggacccgccctgctgttggtcgtgcgcaactggatgctatcagtgagaaggttgatgtcatcgccaaacgtgtgctggggctgctggagcgttcctctatgtcgctcactcaggatatgctgaacggtgagctgaaaaagttgtccgaaggtctggagggcaccaaatattctaatgttatgaagttgctccggatggccctatcaggacagcagcagggtcccccagtcgcagagatgatgctggccttagggcctaaggaagtgcgcgaacgtattcagaaggtcgtgtcttcttag

SEQ ID NO: 224847 - DNA, 1572 bp, Artificial Sequence
  Description of Artificial Sequence: Synthetic coding sequence
atggccgcactgcttagacgacttttgcaacgtgaaagaccaagtgccgctagcggcagacccgtcggacgccgtgaggctaacctgggaactgacgccggtgtggccgtgagggttaggtttgcaccgtcgcctactggattcctgcacttgggaggtttgcggaccgcactgtacaactacatttttgccaagaagtatcaggggagttttatcttgcggctggaggataccgatcagaccagagtggtccccggtgctgccgagaacatagaagacatgcttgagtgggctggaatcccacctgatgaatctccacgacgcggaggacctgcagggccataccaacaaagtcaacgactggagctttatgcgcaggccaccgaggccctgctgaaaacaggagccgcttacccttgcttttgcagtcctcagcggctcgaactcctgaagaaggaggcccttaggaatcaccagacaccgagatatgacaaccgttgccgcaacatgtctcaggaacaggtggcacagaaactcgcaaaagatcctaagcccgctattcggtttagactcgaacaggttgtgcccgctttccaggacctggtgtatgggtggaaccgccacgaggtggcttctgtggagggagaccctgtgattatgaaatcagacggcttcccgacatatcatctggcctgtgttgttgatgatcatcacatgggaattagccacgtacttcggggaagcgaatggttagtctctactgctaagcacctgctactttaccaagcattgggttggcagccgccacactttgcccatctgcctctgctgcttaaccgggatggtagcaaattatcaaagcgacagggagacgtttttcttgaacattttgccgcagacggttttctcccagacagcttgcttgatattattacaaactgcggctctgggttcgcagagaatcaaatggggcgtacacttccagagctgattactcagttcaatttaacccaggtgacatgtcattcagccctgctggacctagagaaactgcctgagttcaatcggctacacttacaacgcttggtatctaatgaaagccagcgaaggcagctcgtaggaaaacttcaggtcctcgtggaagaggctttcggctgccagttacagaacagagacgtgttaaaccccgtgtatgtggagagaatcctcctgctcagacagggccatatatgtaggttgcaagatctggtttcaccagtgtacagttatctgtggactagacccgctgtggggagggcccagctcgatgctatctctgagaaagtcgatgtaattgcaaagcgggtactcgggctattagagaggagcagtatgagcctcacgcaggacatgctgaacggggagcttaagaagttgtcagaaggccttgaaggcacaaagtactctaacgtaatgaaactcctgagaatggcgctgtccggccagcagcagggccctccagtcgctgagatgatgctcgcgctggggcctaaagaggtgagggagaggattcaaaaggtggtgagctcctag

SEQ ID NO: 224848 - DNA, 321 bp, Artificial Sequence
  Description of Artificial Sequence: Synthetic coding sequence
atggctcaggaattcgtgaactgtaaaatacagcctggcaaagtggtggtgttcatcaagcctacgtgtccgtattgccgccgtgcccaagaaatactgtctcaactgcctatcaaacaggggttgctcgagtttgtcgacatcaccgccacaaatcacacaaacgaaatccaggactaccttcagcagctgacaggtgctcggactgtaccacgggttttcattggaaaggattgtattggcggatgctcagaccttgtcagtctccagcagagcggcgaattgcttaccaggttgaaacagatcggggcacttcaatag

SEQ ID NO: 224849 - DNA, 321 bp, Artificial Sequence
  Description of Artificial Sequence: Synthetic coding sequence
atggcccaggagtttgttaattgtaagatacagccaggaaaagtggtggtcttcatcaagccaacgtgtccgtattgtcggagggcccaggaaatcctgtcacagctgcccatcaagcagggcctgctggagttcgtggatatcaccgcaaccaatcatactaacgagatccaggattacctacagcagctgaccggcgctcgtacagtgcccagggtgtttattggaaaagactgtatcggcggatgctctgacctagtctctctgcagcaaagcggggagctgttgactcgcctcaagcaaattggcgcactgcaatag

SEQ ID NO: 224850 - DNA, 321 bp, Artificial Sequence
  Description of Artificial Sequence: Synthetic coding sequence
atggcccaggagttcgtcaactgtaagatccaaccagggaaggtggtggttttcattaagccaacttgcccttattgtcgcagggcccaggagattctgagccagttaccaattaagcaggggctgttggagtttgtggacatcactgcaactaaccataccaatgagattcaggactacctgcagcagctgactggagcacgcaccgtccctcgcgtgttcataggaaaagattgtattggcggttgtagcgatttggtgtcactgcaacaatccggggaactgctgactaggttaaagcagattggcgcactgcaatag

SEQ ID NO: 224851 - DNA, 321 bp, Artificial Sequence
  Description of Artificial Sequence: Synthetic coding sequence
atggctcaggagtttgttaactgtaagatccagcccggaaaggtcgtcgtgtttattaagcctacctgcccctactgtagaagagcccaggagatattgtcccagctaccaatcaagcagggactgcttgaattcgtggatattacagccactaaccatactaacgaaatacaagattatctgcagcaactgaccggagcgagaactgtacccagggtgtttattggcaaagattgtatcggcggatgtagcgacttggtgtccctgcaacagagtggagagctgttaacccgcttgaagcaaatcggcgctttgcaatag

SEQ ID NO: 224852 - DNA, 321 bp, Artificial Sequence
  Description of Artificial Sequence: Synthetic coding sequence
atggcccaggagttcgtgaattgcaaaattcagccgggtaaggtggtggtgttcatcaaacccacatgcccttactgtcgcagggctcaagagatccttagccagctccctataaaacagggattgctggagttcgtagatattactgctaccaatcacactaacgaaattcaggattacctgcagcaacttaccggggcaagaactgtcccacgagtgtttattgggaaggactgcattggtggttgctcagacttagtgtcccttcagcaaagcggcgagctgttgaccaggctgaagcagatcggggctttgcagtag

SEQ ID NO: 224853 - DNA, 495 bp, Artificial Sequence
  Description of Artificial Sequence: Synthetic coding sequence
atgatctggagaagggccgctctggcaggcactcggcttgtgtggagtcgctccggtagcgccggttggctcgaccgagcagctggggcagctggcgctgccgcagcagcagcctccggtatggagtctaacacaagcagctcattggaaaacctcgcaactgcgccagttaaccagatacaggagacaatttcagataactgcgtggtcatcttctccaagactagctgttcttactgcaccatggccaaaaaattgtttcacgatatgaatgtgaactacaaagtggtcgagctggatctcctggaatacggaaatcaattccaggacgctctgtataagatgacgggcgagcgcaccgttccaaggatttttgtcaacggtacattcatcggcggtgcaaccgatactcaccgtctccataaggaaggaaaactcctccccctagttcatcaatgctatctcaaaaagagcaagagaaaggaattccaatag

SEQ ID NO: 224854 - DNA, 498 bp, Artificial Sequence
  Description of Artificial Sequence: Synthetic coding sequence
atgaacccaagagataagcaggtcagtcgcttttcccccctgaaagacgtttatacgtgggtggccctggccggaattcagaggtcaggatcacctggacgcacccgctcagccgcacgcaggatggagagtaatacttccagcagtttagaaaaccttgccaccgcgccagtgaatcaaatccaggagactattagcgacaattgcgtggtcatcttctcaaaaactagctgcagctactgtacgatggccaagaagctatttcatgacatgaacgtgaattataaggtggtggagctggacctgctggagtatggcaaccagtttcaagacgccttgtacaagatgacgggggagcgtacagtacctagaatcttcgttaatggaacctttattggcggagcaaccgatacccacaggttgcacaaggaaggcaagctattgccattggtacatcaatgctatctcaagaaaagcaaacggaaagagttccaatag

SEQ ID NO: 224855 - DNA, 1008 bp, Artificial Sequence
  Description of Artificial Sequence: Synthetic coding sequence
atggcagctggggcagccgaggccgcagtagcagcagtagaggaagtaggcagcgcagggcagttcgaggaattgctccggttaaaggcaaaaagtctattggtggtccacttctgggccccatgggccccacagtgcgcccagatgaacgaggttatggccgaacttgcaaaagaactgcctcaggtgagctttgttaaactggaagcggagggtgtgcccgaagtctctgagaagtacgagatcagttcagtgcccacatttctcttttttaaaaattcgcagaaaatagatagactggatggcgcacacgcacccgagctgacaaaaaaagtgcagagacacgcatcatcagggtcatttctgccctccgcaaacgagcacctgaaggaggatctgaacttgcgactcaagaagctgactcacgcggctccctgcatgctgttcatgaagggcactccccaggaaccaaggtgcggcttctctaagcagatggtggagatcctgcacaagcacaatattcagttctcttcctttgatatcttctctgacgaggaggtccgccagggcctgaaagcctattccagttggccaacttatcctcaactctacgtgagtggtgagttaatcggaggactggacattattaaggaactggaggcaagcgaagagctcgacacgatctgcccgaaggctcctaagctcgaagagagattaaaagtactaacaaacaaagcctccgtgatgttgttcatgaagggcaacaaacaagaagcaaaatgcggcttttctaagcagatcctcgagatcttaaactctaccggtgttgaatacgagacatttgacatcttggaagatgaggaagttcggcagggtttgaaggcctactcaaactggcctacatatccccagctgtacgtgaaaggcgaactggtggggggtctggatatcgtcaaggaacttaaggagaacggggagctactacctatcttacgcggagagaactag

SEQ ID NO: 224856 - DNA, 1008 bp, Artificial Sequence
  Description of Artificial Sequence: Synthetic coding sequence
atggccgctggagccgctgaggctgccgttgcggcagtcgaagaagtcggctcggccggacagttcgaagagctcctgaggctgaaggctaaaagtcttcttgtcgtgcacttctgggcgccttgggcccctcagtgtgctcagatgaatgaggttatggctgaactggccaaagagctcccccaggtgtcatttgtgaagctcgaggcagaaggggtccctgaggtgagcgaaaagtatgagatatcttcagtacccacattcctgttttttaagaatagtcagaagattgataggttggatggggctcacgcgccagagttaaccaaaaaggtgcagcgccacgcctcctcaggttccttcctaccttccgctaatgagcacctgaaggaggatttgaacctacggttgaagaaactgacccatgctgccccatgtatgctgttcatgaagggcacacctcaggaacctcggtgtggtttctcaaaacagatggttgagatcctgcataagcacaatattcaattttcttctttcgacattttcagtgacgaggaggtaaggcaggggctgaaggcatactcctcctggcccacttatcctcagttgtatgttagcggcgagcttataggcggactcgacatcatcaaagagctggaggcaagcgaggaactggacactatttgcccgaaggctcccaagctggaggagagattgaaggtcctgaccaataaggcctctgtaatgctgtttatgaaaggaaacaaacaggaggccaaatgcgggttctctaagcagatcttagagatcctcaactctacaggcgtagaatatgaaacgttcgatattcttgaggatgaagaggtccggcaaggcctgaaggcgtattccaattggcccacctatcctcaactgtacgttaagggcgaactggtgggaggcctggacatcgttaaggagcttaaggaaaatggggaactcctaccgatcctgcgcggtgaaaactag

SEQ ID NO: 224857 - DNA, 1008 bp, Artificial Sequence
  Description of Artificial Sequence: Synthetic coding sequence
atggctgccggtgcagcagaggcggctgtcgctgcagtcgaagaggtgggtagcgcaggtcagttcgaagaactcttgagacttaaagccaagtccctactggtggtgcatttctgggctccatgggcgccacaatgcgcacagatgaatgaggttatggccgaacttgcgaaagaattgcctcaggttagcttcgtgaagcttgaggccgagggggttcccgaagtgtctgaaaagtatgagatatcctcggtccctacgttcctgttcttcaagaatagtcagaagatcgacaggctcgatggagcacatgccccagaattgacgaagaaggtgcaaagacacgcctcttcaggatccttcctccctagtgccaatgagcacctcaaggaggatctgaatctacggttgaaaaagttgacccacgcggcaccttgtatgttatttatgaaggggactcctcaggaacctagatgcgggtttagcaaacagatggtcgagatcctccacaaacataacatccagtttagttccttcgacatctttagcgacgaggaggtgcggcaaggcctcaaggcttatagctcctggcccacctatccacaattgtatgtgagcggggaactgatcggaggcctcgacatcattaaagagctcgaggcaagcgaggaactagataccatttgccctaaagctccaaaactggaagagcggcttaaagttctgaccaacaaggcctctgttatgctctttatgaaagggaataagcaggaggccaagtgtggattttctaagcagatcctggaaatactaaatagcaccggtgtggagtatgaaacatttgacatcctggaggatgaagaagtaaggcagggtctgaaggcctatagtaactggccgacatatccacagctgtacgtaaagggagagctggtcggcggtctagacattgtaaaggagctgaaagagaatggcgagctgctgcccatcctcagaggcgagaactag

SEQ ID NO: 224858 - DNA, 474 bp, Artificial Sequence
  Description of Artificial Sequence: Synthetic coding sequence
atgtctggttcacttggacgggctgcagctgcattgctgcgttggggccgaggcgcaggaggaggaggcctctggggcccaggtgtgagggcagccggatcgggcgcaggcggtggcggatcggccgagcaactggatgctctcgttaaaaaggacaaagtcgtggtgttcctgaaagggacgccagagcagccacagtgtggcttcagcaatgccgtggtgcaaattcttcggctccatggagtgcgtgattacgcagcctataacgtgctggatgatcccgagttacggcagggcatcaaagattattccaattggccaacgataccccaggtctatttgaacggtgagttcgtaggcggatgcgacatcctgctccaaatgcatcaaaacggggatctggtggaggagttgaagaagcttggaattcacagcgcacttttagatgagaaaaaagaccaggattcaaagtag

SEQ ID NO: 224859 - DNA, 873 bp, Artificial Sequence
  Description of Artificial Sequence: Synthetic coding sequence
atgctaaaacgagaaatgaaaccagaatcggaccgtcccagaaaagtgcgcttccgtatcgcttccagccacagcggcagggtcctgaaagaggtttatgaggacggccagccatccggcagcctcgactcggagtgtgcatcaatctgcgggattgacggcctgggcgattccgatgggcagcagaatgggcatatagaaagtgaaggagacgaaaacgaaaacgaccaggacagtctgctggtgctcgcccgagccgcttccgagaaaggattcggcactaggagggtcaacattctgtcaaaaaacggcacagtcagaggggtgaaatacaaagtatccgctggccaagcactttttaataacctcactaaagtcctacagcagccctcgactgacctcgagttcgatcgagtcgtgatatatactacttgtctccgggtagtgaggacaactttcgaacgctgtgaactagtacgcaagatcttccagaaccaccgggtgaagtttgaagagaagaacatcgcccttaacggcgaatatgggaaggagctggatgagaggtgcaggcgggtctcagaggctccctcactgcccgtcgtcttcattgatgggcactacctaggtggagctgagaaaattctcagcatgaatgagagcggcgagctccaagacatcttgacaaagattgaacgagtgcagcacccgcatgaatgccctagctgtggtggcttcggattcctgccatgttctgtgtgccacggctctaaaatgagcatgttcagaaactgctttacagacagtttcaaagcactgaagtgtaccgcttgcaatgagaatggactccagagatgtaaaaactgtgccggttag

SEQ ID NO: 224860 - DNA, 828 bp, Artificial Sequence
  Description of Artificial Sequence: Synthetic coding sequence
atgtcgcattgtagcagcagggccctgaccctgctgagcagtgtctttggcgcttgtggcctactacttgtgggcatcgctgtgagcacagactactggctctacatggaggaggggactgtactgccgcagaaccagaccaccgaggtcaagatggcactccatgctgggttgtggagagtttgtttttttgctggtcgcgaaaaagggagatgtgtggcatccgaatacttcttggagcctgaaatcaaccttgtcactgaaaataccgagaacatcctcaaaacagtaaggaccgccacccctttccccatggtgtccctgttcttggtattcacagccttcgtcatttctaatatcggtcacatccggcctcaacgtactatactggccttcgtgtccggtattttctttatcctctctggtctctctctagtggtgggactggtgttatacattagttccattaacgatgaggtgatgaatcgtcccagctcttctgaacagtatttccactatagatacggctggtcctttgccttcgcagcctccagctttctactgaaggagggtgccggagtgatgagtgtctatttgtttaccaagcgctatgcagaggaggagatgtatagacctcacccagccttttacaggcccagactctccgactgctcagattattcaggtcaatttctgcagcccgaggcctggcggaggggcagatcgcctagcgacatctcttccgacgtcagcattcagatgacccagaactacccccctgcaatcaagtatcctgaccatttgcatatatctacgagcccgtgctag

SEQ ID NO: 224861 - DNA, 987 bp, Artificial Sequence
  Description of Artificial Sequence: Synthetic coding sequence
atggcactccgaggggtttctgtgagactgctaagccgtggacccggtttacacgtgttacgtacgtgggtatccagcgctgctcagactgcctctcgaccagagtttgattggcaggaccctctcgtgcttgaagaacaattgaccacggacgagatacttattcgggatacctttaggacatactgccaggagcgtctcatgccccgaattcttctggctaaccggaatgagggttacggctgcgctggggtcagtagtgtggcctacggcctcctggctcgggaactggaacgggtggattcaggatatcgaagcgccatgagcgtccaaagcagtctggtaatgcatccaatctacgcctacggaagcgaagagcagaggcagaagtatctgccacaattggcgaagggcgaacttctgggctgttttggcctaaccgagcccaattcggggtccgaccccagctctatggagactcgggctcactacaacagctcaaataaatcatacaccctaaatggtaccaagacctggataaccaacagtccgatggcagacctttttgtggtgtgggcaagatgtgaggacgggtgcatacggggatttctgttggagaagggtatgagggggctcagcgctccacgcattcagggcaagttctcattacgagcttccgccaccggtatgatcattatggacggtgtagaggttccggaagaaaacgttctcccaggtgcgagttccctgggcggtccctttggctgccttaacaatgccaggtacggcatagcctggggagtgctgggcgcttcagaattctgcctgcatacagccaggcaatacgctctggacaggatgcaatttggtgtccctctggccagaaaccagctgattcagaagaagcttgcggatatgctcacagaaatcaccctggggctgcacgcttgtctgcagctggggaggctgaaggatcaggacaagtag

SEQ ID NO: 224862 - DNA, 1185 bp, Artificial Sequence
  Description of Artificial Sequence: Synthetic coding sequence
atgagaagcagcagcggaacgccctcggcacccaccgctcggagagacagttgcttggcctcctgttggcctatcgctaccaaatctctggcactactgccacgtctggagtgcagtggcactattctcgcccactgtaaattctgcctccctggctcctctgatagtccagcctcaacaccgttggttgcaggaatcacaggttatggttgtgctggagtgtcctccgttgcctacggactgctggcgagagagctagagagagtggattccggctacaggagtgccatgtccgtacagtccagcctcgtgatgcacccaatctatgcatatggctctgaggaacagagacagaagtatttgcctcagttggcaaagggcgaactgctgggatgcttcggactgactgagcctaattctggatcggatcctagttcgatggaaacacgggctcattataactcatctaacaaaagctacactctcaatggaactaagacctggattacgaattcccccatggcagatttattcgtagtctgggcgcgatgcgaggacggctgtattcgcggtttcctcctcgaaaagggcatgcgtggactctctgcccctcgtattcaggggaaattcagtttacgtgcaagtgctacgggcatgatcataatggacggagtggaggtgcctgaagagaatgttctgccaggggctagtagtctgggcggaccgttcggctgtctgaacaacgctaggtacggaatagcctggggcgtgcttggcgcaagcgagttttgcctgcacacagccaggcagtatgctttagaccgtatgcaatttggtgtgcccctagcccgaaatcagctgattcagaagaagctggcagacatgctgaccgagatcacactgggattacacgcctgcctgcagctgggtcggcttaaggatcaagataaggctgcccctgagatggtctcgctcctgaagcgcaacaattgtgggaaagcccttgatattgccagacaagctcgtgacatgttaggcggaaatggcatcagcgacgagtaccacgttatcagacatgccatgaacctcgaggccgtcaatacctatgagggtacccacgacatccatgcactcatcctgggcagggcaattactggcatccaggcgttcaccgcctctaagtag

SEQ ID NO: 224863 - DNA, 1287 bp, Artificial Sequence
  Description of Artificial Sequence: Synthetic coding sequence
atggccttgcgcggagtgtcggttagactcctgtctagaggcccagggctgcacgtactccgtacatgggtgagcagcgctgcccagaccgaaaaaggtgggaggactcagtctcagctcgcaaaaagctcgaggccagagtttgactggcaggacccgctagtgcttgaagaacagttgactactgatgagatcttaatcagggacacctttaggacctattgccaggagcgcctcatgcctcggattttgctggccaaccggaatgaggtcttccacagggagatcatctcagaaatgggcgaactgggggtactgggcccaactattaaggggtacggttgcgctggtgtgagctcagtcgcttacggcctgctagctcgcgaactggagagggttgactccgggtatcggagtgctatgtccgttcagtcatctctggtgatgcacccaatctacgcatatggatccgaggaacagcgccaaaaatacctgccccagttggccaagggcgaactgctgggatgcttcggcctgacggagcccaatagtgggtccgaccctagctctatggaaaccagggcccattataattcaagcaacaagagctacactttgaatggtaccaaaacatggattactaactctcccatggcggatctgtttgtggtgtgggctagatgcgaggacgggtgcataagaggatttttgttggagaaaggcatgagaggcctgagcgccccacggattcagggtaaattctctcttagggcctcggccacgggtatgatcataatggatggggtcgaggtacctgaggagaacgttctgcccggtgcaagttctctaggaggtcctttcggttgcttaaacaatgcccgatatggtattgcctggggcgttctaggtgctagcgaattttgcttgcacacagcgcgacagtacgcactggacaggatgcagtttggtgtcccattggcgaggaaccaactgatccaaaaaaagctcgcagacatgctaacagaaattaccctcgggctgcacgcttgcttacaactgggtcggcttaaagaccaagacaaagccgctcccgagatggtctccttactgaaacgcaataactgtggcaaagccttagatatcgccagacaagcccgagacatgttgggaggaaacgggattagcgacgaataccacgtaatcagacacgcaatgaatctagaagctgtaaatacatacgaagtggtccagatgtgctccctcaaacgtaggtggaactctctctag

SEQ ID NO: 224864 - DNA, 297 bp, Artificial Sequence
  Description of Artificial Sequence: Synthetic coding sequence
  Description of Combined DNA/RNA Molecule: Synthetic coding sequence
atgtgcgccgcacgcttggccgctgctgccgcagcagctcagagtgtgtatgctttctccgcccgtccgctggcgggaggtgagcctgtgtctctaggatctctgagagggaaggtgctcctgatagaaaatgttgcgagccttugaggaactacagtaagggactatacacaaatgaatgagttacagcgccgactcggcccacggggtttggtggtgctgggatttccttgcaaccagttcggacaccaggtaaggcgcgctgagagaggcggtgctggggctgatgtgcagtag

SEQ ID NO: 224865 - DNA, 612 bp, Artificial Sequence
  Description of Artificial Sequence: Synthetic coding sequence
  Description of Combined DNA/RNA Molecule: Synthetic coding sequence
atgtgtgccgctagacttgccgcagctgccgcagccgcacagagcgtctacgccttttccgccagaccactcgccggtggggagccggtatccctggggagcctgcgcggaaaggtcctactgatagagaacgtcgcatcactcugaggcactaccgtacgcgattatactcagatgaatgagctgcagaggagattgggacccagagggctcgtggtgcttggctttccatgtaaccaattcgggcatcaggaaaatgcgaaaaatgaggagatccttaactccttgaagtatgtcagaccagggggaggatttgaaccaaacttcatgctgttcgaaaagtgcgaagtgaacggagcaggggcacaccccttgtttgccttcctgagagaggccttaccagctccttctgatgatgcaacagcgctgatgactgaccccaagctgatcacatggtctcctgtgtgtaggaatgatgtggcatggaacttcgaaaaatttctggtagggccagatggcgtaccccttaggcggtacagcagacgctttcagacaatcgatatcgaaccagacatcgaggctctgctatctcagggcccaagttgcgcatag

SEQ ID NO: 224866 - DNA, 573 bp, Artificial Sequence
  Description of Artificial Sequence: Synthetic coding sequence
  Description of Combined DNA/RNA Molecule: Synthetic coding sequence
atggctttcatcgcaaagtcattttatgacctgagcgcaatcagccttgatggcgaaaaagtcgactttaatacgttccggggtcgtgcagtactgatcgagaacgtggccagtttgugaggcacaacaacccgggattttacacaattaaacgaactgcagtgtcgctttccccgacgactggtggtactcggattcccatgcaatcagtttggccaccaggagaactgccagaacgaggagatcctgaacagtctgaagtacgtgcgacccggtgggggatatcagccgacattcaccctggtacagaaatgcgaggtgaacggccagaatgagcaccctgttttcgcctacctcaaagacaagctcccttacccctatgatgatcccttttccctcatgactgatcccaagctgattatttggtccccggtcagaaggtcagacgtcgcctggaactttgagaagtttctcataggacctgaaggcgaaccgttcagacgttacagccgaacgttcccgaccatcaatatcgaacctgatattaagcggcttctgaaggtggctatttag

SEQ ID NO: 224867 - DNA, 594 bp, Artificial Sequence
  Description of Artificial Sequence: Synthetic coding sequence
  Description of Combined DNA/RNA Molecule: Synthetic coding sequence
atgtccttaggcagactctgcaggctgcttaaaccagccctgttgtgcggcgcattggctgcacctggactggctggcactatgtgtgcctcaagggacgactggagatgcgcacggagtatgcacgaattttcagcaaaggatattgacgggcacatggttaacttggacaaatataggggattcgtttgtatagtcacgaatgtggcctcacagugaggcaaaaccgaggtgaattacacacaattggtggacttgcacgccagatatgccgagtgcggactgcgcatacttgcattcccatgcaaccagttcggcaagcaagaaccaggaagcaatgaggagattaaggagttcgctgctgggtataatgtcaagtttgacatgttctccaaaatctgtgtgaacggagatgacgcccacccactgtggaaatggatgaaaattcagcctaagggcaaaggcatactaggcaatgccatcaaatggaatttcaccaaattcctaatagataagaacgggtgcgtggtcaagagatacggccctatggaggagccgctcgtcatcgagaaggacctgccacactacttttag

SEQ ID NO: 224868 - DNA, 666 bp, Artificial Sequence
  Description of Artificial Sequence: Synthetic coding sequence
atgacgacgcagctaagagtggtccacttgcttcccctgctcctggcgtgcttcgtgcagacatctcccaaacaggagaaaatgaagatggattgtcataaggacgagaagggtaccatatacgactatgaggcgatcgctctgaataaaaatgagtatgtctcctttaaacagtacgtgggcaagcacattctcttcgtgaacgtggctacctactgcggtctaactgcacagtaccccgaacttaacgccctacaggaggaactcaagccttatggccttgtcgtgttaggtttcccttgcaaccagttcgggaagcaggaaccgggtgataacaaagagattctcccaggcctgaagtatgtaaggccgggtggagggtttgtacccagttttcagctcttcgaaaagggcgatgtgaatggcgagaaggaacagaaagtgttctctttcctgaaacactcttgcccccatccgtctgaaattctggggacctttaaatctatctcttgggatccagttaaggtgcatgatattcgttggaatttcgagaaattcctagtgggtccagatggcatcccagttatgcgatggtcccacagggctacagtaagcagcgttaaaacagacattctggcgtacctgaagcagttcaagaccaaatag

SEQ ID NO: 224869 - DNA, 303 bp, Artificial Sequence
  Description of Artificial Sequence: Synthetic coding sequence
atgacgactcagttaagagtcgtccacctgctacccctgctccttgcgtgtttcgttcagacgagccccaagcaggagaagatgaagatggactgccataaagatgaaaaggggaccatatatgattatgaggcgatcgctctcaataaaaacgaatatgtgtccttcaagcaatacgttgggaaacatatcctttttgtaaacgttgcgacatattgcggcctaactgcgcagtatcctggtatgagcgtgcagggggaagatctgtacttggtgagttcctttctgcggaaggggatgtag

SEQ ID NO: 224870 - DNA, 573 bp, Artificial Sequence
  Description of Artificial Sequence: Synthetic coding sequence
atggcagaaaagacacaaaaatctgtcaagatcgcccctggagccgtggtgtgcgtggagagtgagatacgcggtgatgtcactattggcccacggaccgtgatacaccccaaagcacggatcatcgccgaagccggacctattgtgattggtgaggggaatctgattgaggagcaggccttgattatcaatgcctatcccgacaacatcaccccggacaccgaggatcctgagccaaagccaatgattattggcacaaacaacgtgtttgaggtcggctgttatagtcaggccatgaagatgggggacaacaacgtgatagaaagtaaagcctatgtgggcagaaatgttattctgacatccggatgcattattggtgcctgttgtaacctgaataccttcgaagtgatcccagagaatactgtgatttacggagctgactgcctacgaagagttcagaccgagcggcctcagccacagaccttgcagttggactttctcatgaagatcctcccaaactaccatcaccttaagaaaaccatgaagggaagctctacgcccgtcaaaaactag

SEQ ID NO: 224871 - DNA, 1440 bp, Artificial Sequence
  Description of Artificial Sequence: Synthetic coding sequence
atggcctgccggcaagagcctcagcctcaaggccctccccctgccgcaggagccgtcgcctcgtacgattacttggtcatcggaggcggatccggcggtctggcaagcgctaggcgcgcagccgagctgggagccagggcagcagtcgttgagtcgcataagttagggggaacctgtgtcaacgtgggttgtgtcccaaaaaaggtgatgtggaacaccgccgtccatagcgaattcatgcacgaccacgctgactacgggtttcccagttgtgaaggcaaattcaactggagagtaatcaaggaaaaacgtgacgcctatgtcagtcggctcaatgcaatctaccaaaataatctgactaagagtcatatcgagatcattcgcggtcacgctgcttttacgagcgatcccaaacctacgatcgaggttagcggtaagaaatacacagcgccacacatcctcatcgctaccggcggaatgccttccactccacacgagtctcagatccctggggcttcgctgggcatcacaagcgacggcttcttccagttggaggaactgcccggtaggagcgttattgtgggagccggttacatcgccgtggaaatggcgggtatccttagcgctctcggttccaagaccagcttgatgattcgacacgataaggtcctgcgatcctttgatagtatgatcagcaccaattgtaccgaggaattagagaatgctggcgtcgaagtcctgaaatttagtcaggtcaaggaggttaagaaaaccctaagcggactcgaggtgtcaatggtgacagccgtccccggacggctgccagtgatgacaatgattccagatgttgactgcctgttgtgggccatagggcgagtgcccaatacaaaggatttaagcctcaacaagctcggcattcagactgacgataaagggcacatcatagtcgacgagtttcaaaacacaaatgtgaaaggcatttacgctgtcggcgatgtctgcggcaaggccttgctcactcccgttgcgatcgctgcaggacgaaagttggcccataggctgttcgaatataaggaagactctaaactggactataacaatatacccacggtcgtcttttctcaccccccaattgggaccgtcggcctgactgaggacgaggccattcacaagtacggaatagagaacgttaagacatacagcactagctttacccctatgtaccatgcagtgaccaagaggaaaaccaagtgtgtgatgaagatggtctgtgcaaataaggaggaaaaagtagtaggaattcatatgcagggcctgggatgcgacgagatgctgcaaggttttgcagttgccgtaaagatgggagccacaaaggctgactttgacaacaccgtggccatccaccccacaagctctgaggaattggtcactctccgttag

SEQ ID NO: 224872 - DNA, 1323 bp, Artificial Sequence
  Description of Artificial Sequence: Synthetic coding sequence
atggcactacttcctcgagctctttcggcaggcgcaggtccctcatggcgaagagctgcacgggctttccgcggtttcctgctgctgctgcctgaaccggctgctctcaccagagcactgtctagagcaatggcgtgtcgacaggagccacagccccaaggccctccacccgctgccggagccgtcgcctcctacgattatctggtgatagggggtggttcaggtgggctggctagcgccaggagagccgcagagctgggagctagggctgctgtggtcgagtcacataaacttggaggcacatgcgtgaacgtgggatgtgttccaaagaaggtgatgtggaataccgctgtgcattctgagtttatgcacgaccacgcagactacggatttcctagctgtgaaggcaagttcaattggcgagtcatcaaagagaaacgggatgcctacgtatcgcggctcaacgccatctatcagaataatctaactaagtcccacattgaaattatccgagggcacgctgcgttcacctctgatccgaaacctaccatcgaggtgtcagggaagaaatacactgcccctcacattttgatcgctacgggagggatgccttccacaccccacgaatcacagatccccggagcctccctcggaattacatccgatggcttctttcagctggaagagctcccgggaaggtctgtcatcgtgggcgcagggtatatcgctgtggagatggcaggtatcctcagcgcattggggtcaaagacatcactaatgatcaggcacgacaagggcattcagaccgatgacaaaggccacataatcgtggatgagttccagaatacgaacgtcaagggtatctatgctgtaggtgacgtgtgtggcaaggccctgctgacacctgtcgccattgcagcaggcaggaagcttgcccataggctcttcgagtacaaggaggatagtaagctggactacaataacatccctaccgtcgtattttctcacccaccaatcgggacggtcggcctgacagaagatgaggctattcacaaatacggaattgaaaacgtcaaaacatactcaacttcttttacccccatgtatcacgccgttacaaaacgcaaaacgaagtgcgtcatgaagatggtgtgcgctaacaaggaggaaaaggttgtcggaattcacatgcaaggattagggtgtgacgagatgctgcaaggctttgctgtggcagttaagatgggggcaactaaggcggatttcgacaacactgtcgccatccacccaacaagctccgaagagctggtgaccctgagatag

SEQ ID NO: 224873 - DNA, 1410 bp, Artificial Sequence
  Description of Artificial Sequence: Synthetic coding sequence
atggcactcctgccaagggcactaagcgcaggagctgggccatcttggcgacgggctgcacgtgctttcagggggttcctcctcctgctgcccgagcctgccgcactgaccagggctctaagccgtgccatggcctgccggcaggaaccacagccgcaaggcccaccacctgctgcaggtgccgttgcatcctatgattatctggttatcggaggcggaagcggcggacttgctagcgccagacgcgctgccgaactcggcgcacgggctgccgtggtggaaagccacaagctgggtgggacttgtgttaacgtaggttgtgtgccgaaaaaggtcatgtggaacaccgcagtgcatagcgaattcatgcatgaccatgcggactacggctttccatcctgcgagggaaaatttaactggcgagtaatcaaggagaagcgcgatgcgtacgtctcacgcctcaacgccatttaccaaaataacttgaccaagtctcacatcgagattatccgtgggcacgctgctttcacctccgaccctaaaccaaccattgaagtctctggaaagaaatataccgcccctcacatcctcatcgctaccggaggcatgccaagcactcctcatgagtcacagatccctggagcaagtttggggatcaccagtgatggcttctttcagctcgaggaactgcccggtcggtccgtgatagtgggagccggttacatagctgtagagatggccggtatcctatcggctttgggatccaagaccagcctaatgattcgccatgataaggtgctgcgatcatttgactcgatgatctcgactaattgcacagaggaactggaaaatgcgggagttgaggtgctcaaattttcacaggggatccagaccgatgacaaagggcacattatagttgacgagttccagaacacaaacgtgaaggggatttacgcagtgggggatgtgtgcggcaaggcactgcttacacccgtggctatcgccgctgggcgaaagctggcacacagactatttgaatacaaagaagatagtaaactggactacaacaacatcccaaccgtggtcttcagccatccaccaatcggaacagtgggtttaacagaggatgaagcaatccacaagtatggcatcgaaaacgtgaagacttacagcacatcttttacgccaatgtaccacgccgtaacaaaaagaaagaccaagtgcgttatgaagatggtgtgtgccaataaagaagaaaaggtcgttggcatccacatgcaaggactgggttgcgatgaaatgctgcaggggttcgccgtcgccgttaagatgggagccaccaaagccgacttcgacaatacagtagccatccatcccactagttccgaagagttggtaacgctgagatag

SEQ ID NO: 224874 - DNA, 1482 bp, Artificial Sequence
  Description of Artificial Sequence: Synthetic coding sequence
atggccctgcttccccgtgcgcttagcgccggagccggaccctcctggcgtcgggcagctagggcatttagaggtttcctgctcttgctgcccgaaccagccgctcttacgagggccctctcacgcgcaatggcctgccgacaggagcctcaaccacaaggaccaccccctgcggctggggctgtcgctagctatgattatctcgtgattggaggaggatccggaggtttagcctctgcacggagggctgcagagttgggagcccgagcggcagtagtggaatcacataaactgggagggacatgtgtgaatgttggctgcgtgccgaaaaaagtgatgtggaataccgcagttcatagtgaatttatgcacgatcacgcagactacgggtttccgtcgtgcgagggaaagttcaactggcgggttatcaaggagaaaagggacgcctacgtttcccgattgaacgcgatttatcagaataacctcactaaaagccatattgagataattagaggccatgccgctttcacgagcgatcccaaaccaactattgaagtgtcgggtaagaagtacaccgctccacacattctcattgccacaggaggaatgccctcaactccgcacgaatcacagatcccaggagccagtttgggaatcaccagtgacggcttctttcagttggaagagcttcccggacggtcggtgatcgtcggcgctgggtatatcgccgtggaaatggctggaatcttgagcgccctcggcagcaaaacgtccctcatgattcggcacgacaaagtcaaagaggtcaaaaagacactcagcgggctggaggttagcatggtcacagcggtgccaggcagactgcctgtcatgaccatgatacccgatgtcgactgtctcctgtgggcaattggcagggtgccaaacacaaaggatctgagcctgaacaaactgggcattcagaccgacgacaaaggtcatatcattgtagacgagtttcagaatactaatgtgaagggaatttacgccgttggtgatgtgtgtggaaaagcactgttaacgcccgttgctatcgccgctggaaggaaactggcacaccgcctttttgaatacaaagaggacagcaaactggattacaacaacattcccaccgtagtgtttagccacccaccgattggcaccgtaggactgactgaggatgaagctattcataaatacggtattgagaacgtgaaaacatattctacatcgttcacacctatgtaccacgcagtgaccaaaaggaagaccaagtgcgtcatgaagatggtgtgtgctaataaagaagaaaaggtggtcggcatccacatgcaagggctgggttgcgatgagatgttgcaaggcttcgcagtggcagtcaagatgggtgcaacaaaagctgactttgataatacagtggccatccaccccacctcttcagaagagttggtcacattacggtag

SEQ ID NO: 224875 - DNA, 669 bp, Artificial Sequence
  Description of Artificial Sequence: Synthetic coding sequence
atggccgagaaaccgaagctgcactatttcaatgcaagggggaggatggaaagtacccggtggcttctggcagctgctggcgtagaatttgaagagaaattcataaagagcgcagaggacctcgataagcttcgaaacgatgggtacctaatgtttcaacaagtgcccatggtggagattgatgggatgaaattggtgcagaccagggcgatacttaattacattgcgtctaagtacaacctttatggcaaagacattaaggagcgggcactgatcgatatgtacattgaaggcattgcagatctgggagaaatgatattactattaccagtatgcccccctgaggagaaagatgccaagctggctcttatcaaagaaaagatcaaaaacaggtactttcccgcatttgagaaagttctcaagtcccatgggcaagactatctggtgggaaacaagttatcccgtgcagatattcaccttgttgagctgctgtattacgtggaggagttagactcttcactcatatcttcctttcccctactaaaggcactaaagaccagaatctccaatctgccaaccgtgaaaaaatttctgcaacctggctcgccaagaaagcctccgatggatgaaaagagcctggaagaggctcggaagattttcaggttttag

SEQ ID NO: 224876 - DNA, 669 bp, Artificial Sequence
  Description of Artificial Sequence: Synthetic coding sequence
atggctgaaaagcccaaactgcactattctaacatccgtggcagaatggaatccattcggtggctcctggcggctgcgggtgttgaattcgaggagaaatttataaaatctgccgaggatctcgataaactgaggaacgatgggtaccttatgttccagcaggtcccaatggtggagattgacggcatgaaactggtgcaaacaagagccattttgaactacatagcgtcaaagtataacctgtacggcaaagatataaaggaaaaagcactgatagacatgtatatagaaggaatcgcagacctcggggagatgattttgctcctgccgttctcccagcctgaggagcaggacgccaaactggcacttatccaggaaaagaccaagaaccgatattttccggctttcgaaaaagtactcaagtcccacggccaggactacctggtcgggaataagttgagtcgggctgacatccatctcgtcgaactactctattacgtggaagagctggatagctcgttgatcagctcttttcctctcctgaaggccctgaagacccggatatcgaacctcccaaccgtgaagaaattcctgcagccaggtagtccaaggaagcccccaatggacgaaaaatcactcgaagaatctcgaaagattttccggttttag

SEQ ID NO: 224877 - DNA, 729 bp, Artificial Sequence
  Description of Artificial Sequence: Synthetic coding sequence
atgctgctgttagctcctcagatgctgagtctgcttctcctggcattaccggtgctcgcttctcccgcttatgttgcgcctgccccaggccaggcgctgcagcagaccggtatcgttggtgggcaggaggcacctcgaagcaaatggccttggcaggtctccctccgcgtgagaggaccttattggatgcatttctgcggtgggagtttaatacacccacagtgggttctcactgcggctcactgtgtagagccagacattaaggatcttgccgcactgcgtgtgcagctgcgggaacagcatctctactaccaggaccagctgctgcctgtttcacggattatcgtacatccacagttctatatcatccagaccggggctgacatcgcactcctggagcttgaagaacccgtgaatattagttcgcacatccatactgtaacattgcccccagcctctgagaccttcccaccgggaatgccatgctgggtgaccggatggggggacgtcgataataacgttcatttacctccaccatatccgctcaaggaggttgaagtgcccgtcgtggagaatcatctgtgtaatgcagagtaccatactggtctgcatacaggacacagctttcagattgttcgtgatgacatgctgtgcgccggttccgagaaccatgatagctgccaaggggattcaggcggaccactggtctgtaaggtgaatggcacctag

SEQ ID NO: 224878 - DNA, 519 bp, Artificial Sequence
  Description of Artificial Sequence: Synthetic coding sequence
atgtttcaacaggtgcctatggtggaaatcgacgggatgaaactcgtacaaacacgcgctattctgaattatattgcatctaaatacaatctttatggcaaagatattaaagaaagagccctaatcgatatgtacacagaggggatggcagacctcaacgaaatgattctgctgctcccactgtgccgcccagaggagaaggatgccaaaatcgctcttataaaagaaaagaccaagtcgcgctatttccctgcctttgagaaagttctccagtcccacggacaggactaccttgtcggaaataaactgagcagagccgacatctccctagttgagcttttgtactacgtcgaggaattggacagctcgcttatctcaaattttcccttactaaaagccctgaaaactcgcataagtaatctgcctactgtgaaaaagttccttcagcccggatccccacgcaagccacccgcagacgctaaggccctcgaggaggctcgcaagatttttcggttttag

SEQ ID NO: 224879 - DNA, 327 bp, Artificial Sequence
  Description of Artificial Sequence: Synthetic coding sequence
atgttccaacaagttcctatggtggagatagacgggatgaaactggtgcagacaagagccattctgaactacatagccagcaaatacaatctgtacggcaaggatatcaaggagagagctctcattgatatgtacactgagggaatggcagacctcaacgagatgattttgctcctcccgctctgtaggccggaagagaaagacgcgaagatagcactcattaaagagaagacaaagtcacgctactttcccgctttcgaagccgatatctctctcgtagagctgctctactacgtcgaggagctggactcgagtcttatatcctag

SEQ ID NO: 224880 - DNA, 669 bp, Artificial Sequence
  Description of Artificial Sequence: Synthetic coding sequence
atggcagccagacccaagttacactacccaaacggaagaggacgtatggaatcagtacgctgggttttggcagctgcaggggtggagtttgacgaagagtttttggaaaccaaagaacagctgtataagcttcaggatggcaatcacctgctgtttcaacaagttcctatggttgaaatagacggaatgaaactggtgcaaacccggtctattctgcattacatagctgacaagcacaacctcttcgggaaaaatctcaaagagagaacactgatcgacatgtatgtcgaagggacgctggatttgctcgaactcctgataatgcatccatttcttaaacctgacgaccaacagaaagaggttgtcaacatggctcagaaagcaattataagatacttccctgttttcgagaagatactgagaggccacgggcagagtttccttgttggaaatcagcttagcctggcagacgtgatcctcctccaaactatccttgccctggaggaaaagattcccaatattctaagtgcctttcccttcctccaagagtacacagtcaaactgagtaacatccccactattaaacggttcctggagcccggatctaaaaagaagccacccccagacgagatctatgtacgcacagtctataacatctttcgcccatag

SEQ ID NO: 224881 - DNA, 390 bp, Artificial Sequence
  Description of Artificial Sequence: Synthetic coding sequence
atgtacgttgaggggacacttgacttgcttgagctgcttatcatgcatccattcctcaaaccagacgaccagcagaaggaggtcgttaatatggcccagaaggctataatcagatattttcccgtattcgagaagatcctgcgcggacatggacagtcctttctggttgggaatcaactaagccttgccgacgtgattctcctgcagactatactggccttagaggagaagattccaaatatccttagtgcattccccttcctccaggaatatacagtgaaattgtccaatattcccacaatcaagcggttcctggaacccggatcaaaaaagaagcctcccccagacgaaatctacgtcaggacagtatacaacattttccggccatag

SEQ ID NO: 224882 - DNA, 669 bp, Artificial Sequence
  Description of Artificial Sequence: Synthetic coding sequence
atggccgcaaggccaaagctgcattaccccaatgggcgaggcagaatggagtccgtgcgttgggtcttggctgcagccggtgtcgaatttgatgaggagttcctcgagacaaaggagcagctgtacaaacttcaggacggaaatcacttactgttccagcaggtgccgatggtggagattgacgggatgaaactcgtgcagactcgctctatcctgcactatatcgccgacaaacacaacctcttcggcaagaacctgaaggagcgcaccctgattgacatgtacgttgaaggcacactggacctgctggaactgctgatcatgcacccctttttgaaaccggacgaccaacagaaggaggtggttaacatggcccagaaagctattatccggtacttcccagttttcgagaaaatacttaggggccatggtcaaagctttcttgttggaaaccagttgtcactggcagatgttattctgctccagacaatcctggcgttggaggagaagatccctaatatcctgtctgccttcccatttctgcaggaatatacggtcaagttgagcaatatccctaccattaagagattcctggaaccgggatccaagaagaaacccccacccgatgaaatttacgtccggacagtgtacaacatcttcaggccttag

SEQ ID NO: 224883 - DNA, 270 bp, Artificial Sequence
  Description of Artificial Sequence: Synthetic coding sequence
atgtatgtggagggtaccctggacctgttggagttattgataatgcatccctttctgaagccagacgaccagcagaaggaggtggtgaatatggcacagaaggccatcatccgttacttccctgtatttgagaagatcctgaggggccacgggcagtcattccttgtgggtaatcaattgagcctggctgatgtcatcctacttcagaccatcttagcattggaggagaagattccaaatatcttatcagcattcccttttctgcaatag

SEQ ID NO: 224884 - DNA, 390 bp, Artificial Sequence
  Description of Artificial Sequence: Synthetic coding sequence
atgtacgttgaggggactctggacctgctggaactgttgatcatgcaccctttcctgaaaccagatgatcagcagaaggaagtcgtgaatatggcccaaaaggctattataaggtattttccagtgttcgaaaaaattctgcgcggacacggacagagtttcctagtgggcaatcagttgtccctggctgatgtgatcttacttcagaccatacttgctctggaggagaaaatcccaaatatcctgtctgcgttccctttcctccaagaatacaccgtaaaactcagcaatatcccgacaattaagaggttcctcgagcccggttctaagaaaaaaccacccccagacgaaatctacgttagaacagtatacaatatcttccgcccttag

SEQ ID NO: 224885 - DNA, 669 bp, Artificial Sequence
  Description of Artificial Sequence: Synthetic coding sequence
atggccgagaaaccaaagctgcattattccaatgcacgaggatcaatggagtctatcagatggctgctcgcagccgcaggcgtagagctcgaggagaaattcttggaaagcgccgaagacttagataaactcaggaatgatggctcactactatttcagcaggtgccgatggtggaaattgatggaatgaagctggtgcagacgcgagctatactgaactacatcgcatctaaatacaatttatacggtaaagatatgaaggagagggcgttgattgacatgtacactgagggtattgtggatctcactgagatgattttgctattactgatctgtcaacctgaagaaagagatgctaaaaccgcactggtcaaggaaaagattaagaaccggtactttcctgccttcgagaaggtgctcaagagccatcggcaggactaccttgtcggcaataagctttcctgggccgatatccatcttgtcgagctcttttactacgtcgaggaactggactcttctttgattagctcttttcccctgcttaaagccctcaagacgaggatttcaaacttgcctaccgtaaaaaaatttctgcaaccagggagtcagcggaagccccctatggacgaaaagtccctggaggaggcccgaaaaatttttcgtttctag

SEQ ID NO: 224886 - DNA, 669 bp, Artificial Sequence
  Description of Artificial Sequence: Synthetic coding sequence
atggcagaaaagcctaaactgcactacagtaacgctcggggaagcatggagtcgatcaggtggttgctggctgctgctggtgtggagctcgaggaaaagtttttagagagtgccgaggaccttgacaagctgcgtaacgacggctcactgctatttcagcaggtaccaatggtggagattgatgggatgaagttggtacaaacgagagccattcttaattatatcgcctctaaatacaatctgtatggcaaggacatgaaggagcgggcactgattgatatgtatacagaagggattgtggacctgacagaaatgatcctcctcctgttgatctgccagcctgaggagcgcgacgctaagacggccctggtaaaggagaaaatcaaaaaccgctacttccctgccttcgaaaaagttctcaaatctcataggcaggactatctagtcggaaacaaactgtcctgggccgacatccatctagtggagctgttctactatgtggaagagctcgactccagtctcatcagctcattcccactactgaaagctttgaagacccggatcagtaatctgccaactgtcaaaaagtttctgcaacccggaagccaacgtaagccccctatggacgagaaaagcttagaggaggcccgtaagatattcaggttttag

SEQ ID NO: 224887 - DNA, 657 bp, Artificial Sequence
  Description of Artificial Sequence: Synthetic coding sequence
atgcccatgatcctggggtattgggatattagggggctcgcccacgccatccggctgctcctcgaatacaccgactcatcttacgaagagaaaaaatataccatgggcgatgcccctgattacgacagaagtcaatggttgaacgagaagttcaaattggggctggacttccccaatctgccctatttgatcgatggcgcacacaaaatcacgcagtccaacgcaatcttgtgttatattgctcggaaacataacctgtgcggtgagacagaggaggagaaaattcgcgtcgatatcctggagaaccaaaccatggataaccacatgcagctcggtatgatttgctataaccccgaattcgagaagctcaagccgaagtacttagaggagctgccggaaaagctaaagctgtacagcgagtttctggggaagaggccttggtttgccggtaataaaattactttcgtcgactttctggtgtatgacgtcctggacctgcatcgcatcttcgagcctaagtgcctcgacgcattcccaaatctcaaggactttatatcaagattcgagggtctcgaaaaaatatctgcgtatatgaaatctagcaggtttcttcctcgaccagtattttcaaagatggctgtatgggggaataagtag

SEQ ID NO: 224888 - DNA, 546 bp, Artificial Sequence
  Description of Artificial Sequence: Synthetic coding sequence
atgcccatgatcctcgggtattgggatatccgaggtttagcccacgctatccgtctgctcttggagtacaccgactcaagctatgaggagaagaaatatacgatgggtgacgctcctgactatgatcgttcccaatggctcaacgagaagtttaagctcgggctggattttccaaacctcccttaccttatagatggagctcacaaaataacccagtctaacgcaatattgtgctatattgctagaaagcacaatctctgcggggagaccgaagaggaaaaaatcagggtggacatcctcgaaaatcagacgatggataaccacatgcagcttgggatgatctgctataaccctgaattcgaaaagctgaagcccaagtatctggaggaactgcccgaaaaactcaaactttactcagagtttctaggcaagcggccttggttcgcaggaaataagggcttagagaagatttctgcctatatgaaatcctctcggtttcttccacgacccgtattctctaaaatggctgtgtggggtaacaaatag

SEQ ID NO: 224889 - DNA, 450 bp, Artificial Sequence
  Description of Artificial Sequence: Synthetic coding sequence
atgcctatgatactgggatattgggacatacgcggactggcccacgccatccgcctgttattagaatacacagacagttcctacgaggagaagaagtacaccatgggagacgcacccgattatgacagatcacagtggctcaatgagaagttcaaactgggcctagacttcccaaacttaccatacttgatcgatggcgctcacaaaataacgcagtccaacgcgattctgtgctatatcgcacgcaagcataacctttgcggagagaccgaggaggaaaagatcagggttgacatcttagaaaaccagaccatggataaccacatgcagcttgggatgatttgttacaaccccgaatttggactggagaagatcagtgcttacatgaagagcagccggttcctgccccgtcccgtgtttagcaaaatggcagtgtggggtaacaagtag

SEQ ID NO: 224890 - DNA, 714 bp, Artificial Sequence
  Description of Artificial Sequence: Synthetic coding sequence
atgcccatgattttaggctattgggatattaggggccttgcccatgccataaggctactcctcgaatacacggatagcagttacgaagagaagaaatacacaatgggggatgcccctgactacgatagatcccagtggttgaatgaaaagttcaagctgggtctcgatttcccaaatggtatgctgggatctctggtggcacagctgagctttgcagggttcccctccattcagctgccctatctgattgacggcgctcacaagatcacgcaatccaacgcgattctgtgctacatagctcgtaaacacaacctgtgcggtgagactgaagaggagaagataagggtagacatcctggaaaatcaaaccatggacaaccacatgcagcttggaatgatttgctataacccagaattcgaaaagctgaagcctaagtaccttgaggaactgccagaaaagctgaagctatacagcgaattcctcggcaaacggccatggtttgccggaaacaagatcaccttcgtggacttcttagtgtatgacgtgctcgacctgcatcggatatttgagccaaaatgcctcgatgcattccctaacctcaaagatttcattagcaggtttgaaggactggagaaaatcagtgcatacatgaagtccagccggttcttgccacgacccgtgttcagcaagatggcagtgtgggggaataagtag

SEQ ID NO: 224891 - DNA, 657 bp, Artificial Sequence
  Description of Artificial Sequence: Synthetic coding sequence
atgcccatgacccttggctactggaatatcagaggcctggctcactcaatacgcctgctgttagagtacactgactccagttatgaagagaagaaatacactatgggggacgcaccggattatgacagatcccagtggctgaacgagaagttcaagttgggcctagactttcccaatctcccctacctgattgatgggacccataaaatcacccagtctaatgcaatcctccggtatatcgctcgtaagcacaacttatgcggcgagtcagagaaagagcagattcgggaagatatcctagagaaccagttcatggatagccggatgcaactggcaaaattgtgctacgatcctgacttcgagaaactcaagccagagtacctgcaggctctccctgagatgctgaaactgtactcacaattccttgggaaacagccttggttccttggtgataagatcacattcgttgacttcattgcatatgacgtgctcgagaggaaccaagtgttcgagccgtcatgtcttgacgctttccccaacctaaaggactttatcagtcgatttgaagggctggaaaagatatcagcctatatgaaatcgtctaggtttctgcccaggcccgtcttcacgaaaatggctgtctggggcaacaagtag

SEQ ID NO: 224892 - DNA, 540 bp, Artificial Sequence
  Description of Artificial Sequence: Synthetic coding sequence
atgacactagggtactggaatattagagggctggcccattcaatccgcctgcttctcgaatacacagactccagctatgaagaaaaaaagtatacgatgggcgatgcgcctgattacgaccgttcccaatggctgaacgagaaatttaagctgggcctggacttcccaaatctcccttacctgattgatggaacccataaaattactcagtccaatgctatcttgcgatatattgccaggaaacacaatctctgtggtgaaagcgagaaggaacaaattcgcgaggatatcctggagaatcagttcatggactcccgcatgcaactcgccaagctgtgctacgaccccgacttcgaaaaactaaaacccgagtacttacaggccctgccggagatgcttaaactgtatagtcaattcctgggcaagcagccttggtttttaggcgacaaggggttggaaaagataagtgcctacatgaagtcttcacggttcctgccccgaccggtgttcactaagatggccgtatggggaaacaagtag

SEQ ID NO: 224893 - DNA, 264 bp, Artificial Sequence
  Description of Artificial Sequence: Synthetic coding sequence
atggatagtagaatgcaactcgcaaagctgtgttacgatccagactttgagaaactgaagcccgaatacctccaggctttgccagagatgctgaaactctatagtcagtttcttggcaaacagccttggttcctcggtgataagattacctttgtggacttcattgcttatgatgtcttggagagaaatcaggtgttcgaaccctcatgcctcgatgcttttccaaacctcaaggatttcatatctaggttcgaacatagttag

SEQ ID NO: 224894 - DNA, 576 bp, Artificial Sequence
  Description of Artificial Sequence: Synthetic coding sequence
atgcctatgactctgggctactggaacatccggggactggcccactctattaggcttttactcgaatatacggattcaagctacgaagagaaaaagtataccatgggagacgccccagattatgatcgtagccaatggctgaacgaaaagttcaaactcggcctggattttcccaaccttccatacttgattgatgggacccacaagataacacaaagcaacgctattttaaggtacatcgccaggaaacataacttgtgtggagaaagtgagaaggagcaaatccgagaggatatcctagagaatcaattcatggactcccgcatgcagctcgctaagctgtgctatgatcctgactttgagaaacttaaacctgagtacctccaggccctccccgagatgcttaagctttattcccaattcctgggaaagcagccttggttcctcggagacaagattacttttgttgactttatcgcctatgacgtgctggaacggaatcaggtcttcgaacccagttgcttagacgcgtttccaaaccttaaagacttcatttcccgattcgaacactcatag

SEQ ID NO: 224895 - DNA, 576 bp, Artificial Sequence
  Description of Artificial Sequence: Synthetic coding sequence
atgcctatgacactgggctactggaatataagaggtctagcacatagtatacggttattgctggagtacacagatagtagctacgaggaaaagaaatacactatgggggacgctcctgactatgaccgttcccaatggctgaatgagaaattcaagttagggctggacttccccaaccttccatacctgatcgacgggacgcataagatcacccaaagtaacgcgatcctccgatatattgcccgaaagcacaatttgtgcggcgagagcgagaaagagcagatccgcgaggatatactggaaaaccagtttatggacagtcggatgcagctggcaaagttatgctacgaccccgattttgaaaagctcaagccagagtatttgcaggcgctaccagaaatgctcaaactgtatagtcagtttctcggcaaacagccatggtttcttggcgacaagattacatttgtggacttcattgcttacgacgtgttagaacgcaatcaagtgtttgagccttcttgcctcgatgcattcccgaacttgaaggattttatttcacggtttgagcattcctag

SEQ ID NO: 224896 - DNA, 678 bp, Artificial Sequence
  Description of Artificial Sequence: Synthetic coding sequence
atgagctgtgagtcttcaatggtccttggatattgggacattcgcggactggcccatgccattcggctgctactggagttcaccgatacttcatacgaggagaagcggtacacctgtggagaagcaccagactacgataggagccagtggctcgacgtgaagtttaagcttgatttagattttccaaacctcccatatctcctggatggcaagaacaagataacacagtccaacgccatcctgcggtacatcgctaggaagcataacatgtgcggagaaactgaggaagagaaaatccgcgttgatataattgagaatcaggtcatggatttccggactcagctgattcggctatgctatagtagcgatcatgagaagctcaagccccagtaccttgaggaactccccggacaactgaagcagttctcgatgttcctgggtaaattctcttggttcgccggtgagaagttgacgttcgtagatttcctaacgtacgacattctagaccagaaccgtatctttgatccaaagtgcctcgacgagttccccaacctgaaggccttcatgtgccggtttgaggccctggagaaaatcgcagcatacctgcagtccgatcagttctgtaaaatgccgatcaataacaaaatggctcagtggggtaacaagccagtgtgctag

SEQ ID NO: 224897 - DNA, 678 bp, Artificial Sequence
  Description of Artificial Sequence: Synthetic coding sequence
atgagctgcgaatcttctatggtgctcggctattgggatatacgtggactggctcacgctatcagactgctcctagagtttaccgatacatcctatgaagaaaaacggtatacctgcggcgaggccccagactacgacagatcacaatggttagatgtcaaatttaagcttgatttagacttccctaaccttccttacctcctggacggtaagaataaaattacacaatctaatgccatcctgcgttacatagcaagaaagcacaacatgtgcggggagacagaagaagaaaaaatccgtgtggatattatcgagaatcaggttatggattttagaactcagcttattagactctgctattcgtcggatcacgagaagcttaagcctcagtacctggaagagctgccgggtcaactgaaacagttttcaatgttcctaggcaaattcagttggttcgccggagagaagctcacattcgtggatttcctcacctatgacatcctcgaccagaatcgaatctttgaccccaaatgtctggacgaattcccaaatctgaaagcgtttatgtgtcgcttcgaggccttggaaaagatcgctgcttaccttcagagtgatcagttctgcaaaatgcccatcaacaacaaaatggcccagtgggggaacaagcccgtttgttag

SEQ ID NO: 224898 - DNA, 678 bp, Artificial Sequence
  Description of Artificial Sequence: Synthetic coding sequence
atgagttgcgagtctagcatggttctcgggtactgggacatccgtggactcgcccatgctatacgcctcttgctggaattcacggatacatcctatgaggaaaagcggtacacttgtggggaggctcctgactatgatcggtcgcagtggctagacgtaaaattcaagctggacctggacttccccaatctaccgtacctgttggacggcaagaacaagattacccagagcaacgcgatcctgaggtatatcgcccgaaaacacaacatgtgcggagaaacagaggaggagaagatcagggtcgacataatagaaaatcaggtcatggattttcgcacacagttgattagactttgttactctagtgaccacgagaagctgaagcctcagtacctggaagaacttcccggtcagctgaagcagttttcaatgttccttggaaagttttcatggttcgcgggagagaaactaactttcgtggattttctgacatatgacattcttgaccagaacagaattttcgatcccaagtgtttagacgagttcccgaatctgaaggccttcatgtgtcggtttgaagccctggagaagatcgcagcctatctgcagagcgatcagttctgcaagatgccaattaacaataagatggcacaatggggcaacaagccagtttgttag

SEQ ID NO: 224899 - DNA, 588 bp, Artificial Sequence
  Description of Artificial Sequence: Synthetic coding sequence
atgagcatgactttagggtattgggacattaggggcctcgcccacgccattagattactcctggagtacaccgacagtagctacgaggaaaagaagtacaccatgggagacgcgccagactacgatcgcagccagtggcttaatgagaagtttaagctggggctcgactttccaaacctgccatacctgatcgacggtgctcataagattacgcagagcaatgcaattctatgctacatagcccgtaagcacaatttatgcggtgagacagaagaggaaaaaatccgtgtggacatactggagaatcaggctatggatgtctcaaatcagctggctcgggtgtgttattcccccgattttgaaaaactcaagcccgagtatctcgaggaactcccgactatgatgcagcatttttcccaattcctggggaagagaccttggttcgttggggacaagataacatttgtggactttctggcttatgatgtgctggacctgcaccgcatctttgagccaaactgcctggacgcttttccaaatctgaaagacttcattagcagattcgaggtgagctgcggcattatgtag

SEQ ID NO: 224900 - DNA, 474 bp, Artificial Sequence
  Description of Artificial Sequence: Synthetic coding sequence
atgtctatgacgttaggttactgggatattaggggcctggcacatgcaattcgactgttactggaatacaccgatagtagctacgaagagaaaaaatatacaatgggcgacgcgccagattatgacaggtcacagtggctcaatgaaaagtttaagttgggccttgattttcccaatgaaaagctgaaaccggagtacctcgaggaattgccaaccatgatgcaacatttcagccagtttctcggaaaaaggccttggttcgttggcgataaaatcaccttcgtggacttcctggcctacgacgttctggatttgcatcgcatttttgaaccgaactgtctggatgccttccccaacctgaaagactttattagccggttcgagggcctggaaaaaatttccgcctacatgaaaagtagccggttcctccccaagcccctgtacactagagtcgccgtgtggggtaacaaatag

SEQ ID NO: 224901 - DNA, 609 bp, Artificial Sequence
  Description of Artificial Sequence: Synthetic coding sequence
atgctcggttctctgctcgcccagctctcctttccaggattcccctcaatacagctgccctacctgatcgatggagcccacaaaatcacccagtccaacgccatcttgtgttacatcgccaggaagcacaacctgtgcggcgagacagaggaagaaaagattcgggtagatatcctggagaaccaggctatggacgtatctaatcagttggccagggtgtgttattcccccgactttgagaaattaaagcctgagtatctcgaagaactaccgacaatgatgcagcatttcagtcaatttctggggaagcggccttggtttgtgggagataaaatcacgttcgttgatttcctcgcatacgatgtgctcgacttacatcgtatattcgagcctaattgcctggacgccttcccaaacctcaaagattttatttcacggttcgaagtgatgcctccctcatcgtttttgtttgacgctccctgtagcgtgacctcgtttcaaatgctgagccagtcttggtcatacattaagaataatctacatctgctgagcgccggatttatgcccggtaccctgccttcaacactttacctcagttgcggcatttag

SEQ ID NO: 224902 - DNA, 657 bp, Artificial Sequence
  Description of Artificial Sequence: Synthetic coding sequence
atgtcaatgacgctgggttattgggatatccgcggtctggcccacgccattcggctgcttttggagtatactgactcctcctatgaagagaagaaatacacaatgggcgacgcccctgattacgatcgaagtcagtggctgaacgagaaattcaaactcggcctggacttccctaaccttccctacctgattgatggcgcacacaagatcactcagtctaatgccatattgtgctacatcgccaggaaacataacctgtgtggcgagactgaagaggagaagatacgcgttgacatcctggaaaatcaggctatggacgtgagcaatcagctggccagagtttgctatagccccgactttgagaaattgaagcctgagtaccttgaagaacttcccaccatgatgcagcatttctcgcaattcttgggaaagaggccttggtttgtgggcgataagattacgttcgtcgactttttagcctacgatgtgttggacttacaccgaattttcgaaccgaattgtttagacgcctttcctaacctaaaagactttatatcacgctttgagggcttggaaaagatctccgcgtacatgaagagtagtcgtttcctgccaaagcctctgtatactcgggtggctgtgtggggcaacaagtag

SEQ ID NO: 224903 - DNA, 657 bp, Artificial Sequence
  Description of Artificial Sequence: Synthetic coding sequence
atgccaatgactttgggatactgggacattcgcggtctggcacatgctattcggctactcttagagtacactgacagctcatatgttgaaaaaaaatacaccttaggagacgctcccgattacgatcggtcgcaatggttgaatgaaaaatttaaactgggcctcgactttccaaatcttccttatctcatcgatggcgcacacaagatcactcagtctaatgcaatcctgcgctacatcgccaggaagcataatctctgcggtgaaaccgaagaggaaaaaataagggtggacatcctcgagaaccaggtgatggacaatcacatggagctggtgcgcctttgttacgacccagacttcgagaagcttaagccaaaatacctggaagaactcccagagaagctcaagctgtatagcgagtttctagggaaacggccatggtttgctggggataaaataacctttgtggacttccttgcttacgatgttctggatatgaaaagaatctttgagccaaaatgcctggatgcctttttgaatctgaaggactttatttccaggtttgaaggcttgaagaaaatctcagcatatatgaaaagtagccagttcctcagggggttgctgttcggaaaaagcgcaacgtggaatagcaaatag

SEQ ID NO: 224904 - DNA, 714 bp, Artificial Sequence
  Description of Artificial Sequence: Synthetic coding sequence
atgcccatgacattggggtactgggatatccgtggcctggcacatgctattcgcctgctgctggagtacaccgacagctcctacgtcgaaaagaaatatacgctaggtgatgccccagactatgatagaagccagtggctgaatgagaagttcaaactcggcctcgacttcccgaacggtatgcttggaagtctggtagctcagctctcctttcctggctttccaagtattcagcttccatacttgatcgatggtgcgcataaaattactcaatccaatgccatcctgaggtatatcgctcggaagcacaacctgtgcggcgaaaccgaagaggagaagattcgtgtggacattttagagaaccaggtgatggacaatcatatggagttagttagactgtgctatgatcccgattttgagaaactcaagcctaagtacctcgaggagttgcctgagaaattaaagctctattctgagtttctcgggaagcgaccctggttcgcaggggataagatcacgtttgttgactttctggcttacgatgtgctggacatgaaacgaatcttcgagcccaagtgtctggatgctttcctgaaccttaaagacttcatcagcagatttgagggattaaaaaagatctccgcctacatgaaatcctcacagtttcttcgcggactattgtttggaaaaagcgctacctggaatagtaaatag

SEQ ID NO: 224905 - DNA, 609 bp, Artificial Sequence
  Description of Artificial Sequence: Synthetic coding sequence
atgctgggcagtctcgtggctcagctgtcctttcctggttttcctagcatccaactcccctatctcattgacggtgctcacaagatcacccagtctaacgctatccttcggtacattgccagaaaacacaacctgtgtggtgagacggaagaagaaaagattagagtggatatccttgaaaaccaggtgatggataaccatatggagctcgtgcgcttgtgttatgatcccgatttcgagaagctgaagcccaaataccttgaggagctgcccgagaaactgaagttgtattctgagttcctgggcaagcgcccatggttcgccggtgataagattaccttcgttgatttcttagcctacgatgtgttagacatgaagagaattttcgagccaaaatgcttggacgccttcttgaatctaaaggacttcatcagtcgttttgaagtcatgcctccttcaagctttctgtttgacgctccttgttcatttctgagcttccagatgctgtctcaaagttggtcatacactaagaataattcttatgtgttgtcaaccggatttatgccaggtatcatgccctccactctgtatttgagctgcaggatctag

SEQ ID NO: 224906 - DNA, 627 bp, Artificial Sequence
  Description of Artificial Sequence: Synthetic coding sequence
atgtctggcgagagcgcgagatctctggggaaaggaagcgctcccccaggacccgtgcccgaaggaagcattaggatttactctatgaggttttgcccatttgcggagagaacccgcctggttttaaaggccaaaggaatcagacatgaagtcattaatattaacttgaagaacaagccagaatggttttttaagaaaaaccccttcggcctcgtgccagtgctagagaattcgcaaggtcagctgatttacgagtccgccatcacctgcgagtatcttgatgaggcctacccaggcaaaaagcttctccctgacgatccttacgagaaggcctgccagaagatgatacttgagctgttcagtaaagttctgaccaataagaagaccaccttctttggaggaaatagtattagcatgatagattaccttatctggccttggtttgagaggctcgaggcgatgaagcttaatgagtgtgttgatcacacccccaaactgaagctgtggatggcagccatgaaggaggacccgactgtgtctgcattactgacatcagaaaaagattggcagggattcctggaactgtatctccagaattcccctgaagcttgcgattatggactgtag

SEQ ID NO: 224907 - DNA, 726 bp, Artificial Sequence
  Description of Artificial Sequence: Synthetic coding sequence
atgagcggagagtctgctcgctcactcggaaaaggatccgccccaccaggccctgttcccgagggctccattagaatctactcaatgcgtttctgtccgtttgccgaacgaacaaggctggtgctgaaagcaaagggcatccggcacgaggtgattaatatcaacctgaagaacaaaccagagtggttctttaagaaaaacccattcgggcttgtgccagtattggagaactcacagggacaactgatctacgagagtgccatcacctgtgaatacctcgacgaggcatatccaggtaaaaagctcctgcccgacgacccttatgaaaaagcctgtcaaaagatgatcttggagctctttagcaaggtgccctcattagtggggtccttcatacgctcacagaacaaagaggactacgctggactcaaagaagagtttcggaaggaatttaccaagctggaagaggtgcttaccaacaaaaaaacaacattttttggagggaactctatcagcatgatcgattacttgatctggccctggttcgaaaggctcgaggccatgaagttgaacgaatgtgtcgatcatactcccaaattgaagctttggatggccgctatgaaggaggatccgactgtgagcgctttactcacttcagaaaaggattggcagggcttcttggaattgtatttgcaaaactcccccgaggcctgtgattatgggttgtag

SEQ ID NO: 224908 - DNA, 543 bp, Artificial Sequence
  Description of Artificial Sequence: Synthetic coding sequence
atgcggttttgtcctttcgccgaacgcacccgcctcgttctcaaagctaaaggcatccggcatgaagttatcaatattaaccttaagaacaaacccgaatggttttttaagaagaacccatttggcttggtcccagtcttagagaatagccaggggcagctgatttatgaatccgcaatcacctgcgagtatctcgatgaagcttatcctggtaagaagctgttgcctgatgatccttatgaaaaagcttgtcagaaaatgatcttggagctgttttcaaaggtgctgaccaataagaaaacaaccttctttgggggtaatagcatctcgatgatcgattacttgatatggccgtggttcgaacggcttgaagcgatgaagctcaacgagtgcgtagaccacacacccaagctgaagctttggatggcagcaatgaaggaggaccctaccgtctcggcattgctgacgagtgagaaggactggcagggatttctggaactttaccttcagaacagccctgaagcctgcgactatgggctctag

SEQ ID NO: 224909 - DNA, 603 bp, Artificial Sequence
  Description of Artificial Sequence: Synthetic coding sequence
atgcgtttttgtccatttgcggagaggactagactggttcttaaggctaaaggcattaggcacgaggtgatcaacatcaatctcaaaaacaagcctgaatggtttttcaagaaaaaccctttcgggcttgtccccgtgcttgagaacagccagggacagctcatctatgagtcagccatcacatgtgagtatctggatgaagcataccccggaaagaaactgctgccagacgatccatacgaaaaggcctgccagaaaatgattctggaactcttttctaaagtaccatcactggtgggatcattcataaggtcccagaacaaggaggactatgcaggacttaaagaagaatttaggaaagagtttacaaaactggaggaggtgctgacaaataagaagacgaccttctttggcggaaacagtataagcatgatagattacctgatttggccatggtttgaacgactagaagccatgaaacttaatgaatgtgttgaccacacccccaagctgaagctgtggatggccgcaatgaaagaggatccaacggtgagcgcgctgttgacttccgagaaagattggcaaggatttctggaactctag

SEQ ID NO: 224910 - DNA, 642 bp, Artificial Sequence
  Description of Artificial Sequence: Synthetic coding sequence
atgaggttctgtccatttgctgagagaactcgacttgttctcaaggctaaggggatcagacatgaggtaatcaatatcaatctgaaaaacaagcccgagtggtttttcaaaaagaatccctttggcctcgttcctgttctcgaaaatagccaagggcagctgatttacgagtccgcgatcacctgcgagtacctggacgaggcttacccgggtaaaaagttgctcccagatgatccttacgaaaaggcctgccagaagatgatacttgagctgtttagcaaggtgccttcgcttgtgggatctttcattaggagtcagaacaaagaagactacgctgggctgaaggaagaattccggaaagaatttacgaagctggaagaagtgttgaccaacaagaagacaaccttttttgggggaaactcgatcagcatgattgactatctcatctggccctggtttgagcgactcgaggccatgaaactgaacgagtgtgttgatcatacacctaaactcaaactgtggatggccgcaatgaaggaggacccgactgtcagtgccctgctgaccagcgagaaagattggcaaggctttctggaattatatcttcagaacagcccagaagcctgcgactacggcttgtag

SEQ ID NO: 224911 - DNA, 732 bp, Artificial Sequence
  Description of Artificial Sequence: Synthetic coding sequence
atgtccggcgatgccacccgcacattgggaaaggggagccaacctcccggtcccgtccctgaaggcctgatcaggatctactcaatgcgcttttgtccgtacagccatcggactcggctcgttctgaaagctaaggacatccggcacgaggtcgttaacattaatctcaggaacaaacccgagtggtattacaccaagcacccgtttggacacattcccgtcctggagacatctcagtgtcagttgatctacgaaagcgtgatcgcgtgtgagtatctcgacgatgcttacccgggtcggaagttatttccatacgatccatatgaacgcgctcgtcagaagatgctcttggagctgttctgcaaggtgccacatctcacaaaggagtgtctggtggcccttcgatgtgggagagaatgcacaaatcttaaagctgccctgcgccaggaattctccaatctggaagaaatactcgagtatcagaacactaccttcttcggcggaacatgcattagcatgatcgattatcttttgtggccctggtttgagaggctggatgtgtatggcattttggattgcgtgagccatactcctgcgttgaggctgtggatcagcgctatgaagtgggatccaaccgtgtgtgcgctgctcatggacaagtccatttttcaagggtttctcaatctgtactttcagaacaatccaaacgcgtttgacttcgggctgtgttag

SEQ ID NO: 224912 - DNA, 648 bp, Artificial Sequence
  Description of Artificial Sequence: Synthetic coding sequence
atgaggttctgcccgtatagtcacagaactagattagtcctcaaagctaaagacattaggcacgaagtcgtgaacatcaatctaagaaacaaacccgagtggtactacactaaacatcctttcggccacatacctgtcttggaaacgtcccaatgtcagcttatctacgagtccgtgattgcctgtgagtatttagatgatgcataccccggacgcaagctcttcccttacgacccatacgagcgcgctaggcagaagatgctgctggaactgttttgcaaggtgccccacctgacaaaagaatgcctcgtggcactacggtgcgggcgagagtgtactaacctgaaagcagcattacggcaggagttttcaaatctggaggaaatcttagagtaccagaacactactttctttgggggaacatgtatctctatgatcgattacctgctttggccatggtttgaaagactggacgtatacggaatcctcgattgcgtctcacatactccagccctcagattatggatcagcgccatgaagtgggaccccacggtttgcgctttgctgatggataagtccatcttccagggcttcctgaatctctactttcagaacaatccgaacgctttcgacttcggtctgtgctag

SEQ ID NO: 224913 - DNA, 732 bp, Artificial Sequence
  Description of Artificial Sequence: Synthetic coding sequence
atgagtggcgatgccactcgcactctcggtaagggaagccaaccaccgggacctgttccagaagggttaattcggatctatagcatgaggttttgtccttacagccaccggaccaggctcgttcttaaagctaaggatattaggcatgaagttgtcaatatcaacctgcgaaataagcctgaatggtactacactaagcatccctttgggcatattcccgtgcttgaaacatcacagtgtcagctcatttatgagagtgttatcgcctgtgaatatctcgacgatgcttacccaggcagaaagttattcccctacgatccgtatgagcgcgcaaggcagaagatgctcctggagctgttttgcaaagttccacacttaacaaaggagtgcctggttgccctccgctgcggccgagagtgcacgaatctgaaagccgctctgagacaagaattctctaatctggaggaaatattagaataccagaatactacattctttggcggaacttgtatctctatgatcgactaccttctgtggccatggttcgagcgactggacgtgtacgggatcctggattgcgttagccacacacccgcactgcgtctgtggatctcggcaatgaagtgggacccaaccgtgtgtgcactactgatggacaagtcaatttttcagggcttcttaaacctgtatttccagaataaccccaatgcgttcgattttgggctgtgctag

SEQ ID NO: 224914 - DNA, 501 bp, Artificial Sequence
  Description of Artificial Sequence: Synthetic coding sequence
atgtctggcgacgccacacgcacactcggtaaggggtcccagccgccaggccctgtcccagaggggctgatacggatttacagtatgaggttctgtccgtattctcacagaactcgtctggtgttaaaggctaaagacatcaggcacgaggtggttaacattaacctgagaaacaagcctgagtggtattataccaaacatccatttgggcatatcccagtcttagaaacctctcaatgccaactcatttacgaaagcgtgatcgcttgcgagtacctggacgatgcctaccctggcagaaagctgttcccctacgacccctacgaacgggcaagacagaagatgctcctggagctcttctgtaaagtcccacatctcaccaaagagtgcctcgttgccttgcgctgcggcagagagtgcaccaatctcaaggctgccttacgtcaggagttttctaacctcgaggaggatcggaagaaaagaaaatttattcctggctag

SEQ ID NO: 224915 - DNA, 366 bp, Artificial Sequence
  Description of Artificial Sequence: Synthetic coding sequence
atgcgcttttgcccctactctcatcgtactcgtctcgtgttgaaggctaaggacatcaggcacgaggttgttaacatcaacctaaggaacaaaccggaatggtattacacgaaacaccccttcggtcacatccctgtgctagaaacgtcgcagtgccagttgatctacgaatctgttatcgcctgtgaatacctggatgatgcataccccggaagaaaactgttcccatatgacccttatgaacgggctcgccagaaaatgctgctcgagctcttctgcaaactatgtgagcctcacgcgtctccagctgccctagacattagtcatgaggtgggtcctcactctctctgtagcagccatggctag

SEQ ID NO: 224916 - DNA, 630 bp, Artificial Sequence
  Description of Artificial Sequence: Synthetic coding sequence
atgtcaggtgacgcaaccagaaccttgggaaagggatcacaaccaccagggcctgtacccgaagggctgatcagaatctacagcatgcggttctgtccatattcccacagaaccaggctcgtcctgaaagcaaaggatattcgacacgaagtggtgaacatcaacttgagaaataaaccagagtggtactataccaagcatcccttcggccacatccctgtgctggaaacttcacaatgtcagctgatttatgaatccgtgatcgcctgcgagtatctcgatgacgcctaccccggtcggaaactgttcccgtatgatccctatgaaagggccagacagaaaatgctgcttgagctgttctgtaaaatcctggaatatcagaatactacttttttcggtggcacttgcatttctatgattgattacctcctttggccctggttcgaacgcctcgatgtgtacggcatcttggactgtgtttctcacaccccggctttgagattatggatatcagcaatgaagtgggaccctaccgtctgtgccctgcttatggataagtcgatctttcagggctttctgaacctgtatttccagaacaatcctaatgcgttcgatttcgggctctgctag

SEQ ID NO: 224917 - DNA, 723 bp, Artificial Sequence
  Description of Artificial Sequence: Synthetic coding sequence
atggggctggagctctacctggatctgctgagccaaccctgtcgcgctgtgtacattttcgccaaaaaaaacgacatcccgtttgaattaagaatcgtggatctgatcaagggtcagcacctgagcgatgcatttgcgcaagtcaatccattaaagaaggtgccggcactcaaagacggcgattttaccctgaccgagagtgttgcaatcctcctctacctgactaggaaatacaaggtgcccgattattggtatccacaagatctgcaggccagagcaagagtggatgagtatcttgcttggcagcacaccacactgaggaggagctgcctccgcgctctctggcacaaggtgatgtttcccgtgttcctgggggagccagtatccccccagaccctagctgccacacttgctgaactggatgttactctacagttactggaggataagtttttacagaataaagcatttctcacagggcctcacatatccctcgccgaccttgtcgcaattaccgagctgatgcaccccgtcggtgctggatgtcaagtgtttgaaggtcgacccaaactggcaacatggcggcaaagggttgaggcagccgtgggcgaggacctattccaggaggcccacgaagtgatcctcaaggccaaggacttcccaccagcagatcccactatcaagcaaaagctgatgccttgggttctggccatgattcggtag

SEQ ID NO: 224918 - DNA, 486 bp, Artificial Sequence
  Description of Artificial Sequence: Synthetic coding sequence
atgggtctggaattgtatctcgatcttctctcacagccttgccgggctgtgtatattttcgctaaaaagaatgacataccattcgagctcagaatcgtcgatttgatcaagggcgtcatgtttccggtttttctcggggaacctgtgtctccacaaactctcgccgctaccctggctgagttagacgtaaccctacagttactcgaggataaatttctgcagaataaggccttcttaactggcccacacatcagcttggccgacctggtggcaataacagagttgatgcatcccgttggtgctggttgccaggtcttcgaaggcaggccaaaactggcaacatggcgtcagcgggtggaagcagccgtcggtgaggatctcttccaggaagcccatgaagtgatattgaaagccaaggattttcctcctgccgatcccactattaaacagaaactcatgccctgggtcctggctatgatccgttag

SEQ ID NO: 224919 - DNA, 369 bp, Artificial Sequence
  Description of Artificial Sequence: Synthetic coding sequence
atgttccctgtcttccttggcgaaccagtttcgccacaaaccttggctgcgaccctagcagaacttgatgtcactctccagttgctggaggacaaattcctccagaacaaggcatttttgacgggccctcacatctctctggccgacctggtggcgatcacagaactgatgcatcccgtgggcgctggatgccaggtgttcgaaggcaggcccaagctggcgacgtggcggcagcgagtggaagctgcggtaggagaagatctattccaggaagctcacgaggtgattttgaaagcaaaagactttccgcctgctgaccctaccatcaagcaaaagctcatgccttgggtgctggccatgatcagatag

SEQ ID NO: 224920 - DNA, 198 bp, Artificial Sequence
  Description of Artificial Sequence: Synthetic coding sequence
atgggtcttgagctgtacctggatctcctgtcccagccctgtagggcggtttacatttttgccaagaaaaatgacatccctttcgaattacggattgtggacctaattaagggtcagcacttatccgatgcgttcgctcaggtgaatccactgaaaaaagtgcccgcattgaaggacggcgattttacattgacttag

SEQ ID NO: 224921 - DNA, 219 bp, Artificial Sequence
  Description of Artificial Sequence: Synthetic coding sequence
atgggcctggaactctacctggacctgttgagtcagccatgtagggccgtctatatttttgctaagaaaaatgatattccattcgagttgagaatagtggatctgatcaaggctcgcggttgctggctgccatctctcagacgcccaacccaggcgggacatatggccgctgctcgcggagggtcatcaggaggaggtccgctgccaggcggtccttag

SEQ ID NO: 224922 - DNA, 405 bp, Artificial Sequence
  Description of Artificial Sequence: Synthetic coding sequence
atgcctttcctagaactggatacgaatctccctgctaaccgcgtgcctgctgggctggagaaacggctatgtgcggcagccgctagcattctgggcaagccagctgaccgggtgaacgtcactgtgaggcctgggcttgcgatggcgctttcaggttcgaccgagccctgtgcccagctcagtatttcaagcattggagtcgtcggaaccgctgaggacaaccgcagccattccgctcatttctttgagttcttgaccaaagagctagcattgggacaagataggtttccaacggttcttagcacctctcccgctgcacacggagggcctagatgccctggggaaattattgaaggcaagaaaagttgcctgaacgaagaggctctgttcatttatttcatttag

SEQ ID NO: 224923 - DNA, 831 bp, Artificial Sequence
  Description of Artificial Sequence: Synthetic coding sequence
atgcctgtgccagcctcatggcctcatcccccaggccctttcctgcttctaacgctcctacttggcctgaccgaagtggccggtgaggaggagctccagatgatccagcctgagaaactcctcttggtgacagtcggcaagaccgccacattgcattgcaccgtaaccagtcttttacctgtcggacccgtcctgtggtttagaggcgtgggccctggcagagagctaatctacaaccagaaggagggccacttccccagggtgactaccgtaagtgacctaacaaaacggaacaatatggacttttctattagaatcagtagcatcacccccgcagatgtgggcacctactattgtgtgaagttccgaaaaggctctcctgagaacgtggaattcaaatccggacctggtacggagatggcactcggagccaagcctagcgctcctgtagtcttgggtccggctgccaggacgacaccggagcacactgtgagttttacctgcgagagccacgggttcagcccaagggacatcacgctaaagtggttcaagaacgggaacgagttgagtgatttccagacaaatgtggatcctacaggtcagtctgtggcctacagcattcggtcgaccgcccgtgtggtgctggatccatgggacgtgagaagccaggtcatctgtgaggttgcccacgtcacattgcaaggggatccactgaggggcactgccaatctttcagaggctatcagaggcccagctagctccttgacagcattgctcttaatagcagtactcctcgggccaatttatgtcccttggaagcagaagacatag

SEQ ID NO: 224924 - DNA, 1092 bp, Artificial Sequence
  Description of Artificial Sequence: Synthetic coding sequence
atggccacaaattggggaagcctgctccaggacaaacaacagctggaagagctggccaggcaggccgtcgacagggccctggctgaaggagtgctgctgaggactagccaggaaccaacaagctcagaggttgtaagttacgcccctttcaccctcttcccttccttagtgccctcagcccttctggagcaggcatatgctgtccaaatggatttcaacttattggttgacgctgttagccaaaacgctgcttttcttgagcagacactgtctagcgcactcgttctactgatagcccaggagaaggagcgaaatatatttgatcaacgcgcaattgagaatgagttactggctcgcaacatccacgtaattagaaggaccttcgaggacatttctgagaagggtagcctggatcaagaccgaagattattcgtggacggccaggaaattgctgtggtgtatttcagagacgggtatatgcccaggcaatattccctccagaactgggaggctcgtctacttctcgaacgttcgcatgccgcaaaatgtcctgacattgcaactcagctggctggcactaaaaaagtgcagcaggagctgtcacggcctggcatgctagagatgctgttgccaggccagccagaggctgtcgctcgccttagggccacatttgctggcctgtactctttagacgttggtgaggagggggatcaggcaatcgccgaagccctggctgccccatcccgtttcgttctcaaaccccagcgcgaaggaggcggtaataatttgtatggagaggagatggtgcaggctctaaagcagctgaaagactctgaagagagggcttcctacatcctcatggagaaaatagagcctgagccttttgagaactgccttctgcgacccggatcccctgcaagagtggttcagtgcattagcgagctcggaatattcggcgtatacgtgagacaagaaaagaccttagtgatgaataaacacgttggacatctcctgagaactaaagccatagaacatgctgacggtggtgtcgccgctggagtcgcagtgctcgataatccataccccgtttag

SEQ ID NO: 224925 - DNA, 1041 bp, Artificial Sequence
  Description of Artificial Sequence: Synthetic coding sequence
atgttccagcgatccgccgatggaagccccgctctgaagcagatagagatcaataccatatctgcttcgtttggcggacttgcatcaagaacaccagctgtgcacaggcacgtcctcagcgtcctgagcaagacaaaggaggccggtaagatcctgagcaacaatcccagcaaggggctagcacttggcatcgccaaggcctgggagctgtatggctcacctaacgctctggtgctcctaattgcacaggagaaggaaaggaacatattcgaccagagggctatcgaaaatgagcttcttgctagaaatattcacgttatccgcaggacattcgaggatattagtgagaagggaagcttggaccaggacaggcggctcttcgtggacgggcaagaaatcgccgtcgtctatttcagggatggctacatgcctagacagtattcattgcagaactgggaggctcggctcctattggaacgcagtcacgctgctaaatgcccagacatcgcaacccaactagccggaactaagaaggttcagcaagaactgagccggccagggatgttagagatgctcctgcctggccagccagaggcggtcgcgcgattgcgagcgacatttgcaggactttatagcttagatgtcggggaagagggggaccaggcaattgcagaagctctggctgccccatccagattcgtgctgaaacctcagagagaagggggtggcaacaacctctacggtgaggaaatggtgcaggcgcttaagcaactgaaggattccgaggaacgagcgtcatacatactgatggagaaaatagagccagagccttttgaaaactgcctcctcagaccaggatccccagccagggtggtccaatgcatttctgaacttgggatttttggcgtatacgtccggcaggaaaaaactctggtgatgaacaaacacgttggacaccttctgcgaaccaaggcaattgagcacgcggacggtggcgtagcggctggggtggcagtgttggacaatccttaccctgtgtag

SEQ ID NO: 224926 - DNA, 768 bp, Artificial Sequence
  Description of Artificial Sequence: Synthetic coding sequence
atgtcttctatcggtactggatacgatcttagtgccagtacattcagccccgacggtcgtgtgttccaggtagagtacgcaatgaaggctgtagaaaactcctctacggccatcggaatcagatgtaaagatggtgtggttttcggcgtagagaaattagtcctgagcaagttgtatgaggaaggctcgaataagcgcttgttcaacgtggaccgccacgtgggcatggccgtcgctgggctattagcagacgccagaagcctcgcggacatcgctcgtgaagaggcctccaacttcaggagcaactttggctacaacattccacttaagcaccttgcagatcgagtggccatgtatgtccatgcctatacactttactccgcggtcaggccctttggctgctcttttatgttgggcagctactcagtcaacgatggagcacagctctacatgatcgatccctccggcgtgtcttacggctattggggttgcgccatcggtaaggctaggcaagccgctaagacggaaatagaaaaactccagatgaaggagatgacatgcagagacatcgttaaagaagtggccaaaattatatacattgtccatgatgaagtgaaggataaagcttttgaactggaactgagctgggtcggcgagctgaccaatgggagacacgagattgtgccaaaggatattcgcgaagaggccgaaaaatacgctaaggagtcactcaaggaggaagacgagtccgacgatgataatatgtag

SEQ ID NO: 224927 - DNA, 525 bp, Artificial Sequence
  Description of Artificial Sequence: Synthetic coding sequence
atgcaagctggaaaaccaattctttattcctactttaggtcgagctgcagttggcgtgtgaggatcgccttggccctcaaagggattgattatgagacagttcctattaacttgatcaaagatgggggtcagcagtttagcaaggattttcaggcactcaatccaatgaaacaggtgcctaccttgaaaattgacgggataacaatccatcagtctaacctgtctgtattgaaacaggtgggagaagagatgcagctgacctgggctcaaaatgccatcacttgcggcttcaacgccttggagcaaattttgcaatctaccgccggaatttattgcgttggggatgaggttaccatggccgacctctgtttggtcccacaagtggcgaacgcagagcgttttaaagtggatctgaccccatacccgacaatctcatcgatcaataaaaggttgctggtgctggaggccttccaggtgagtcacccatgcagacagccagataccccgaccgaacttcgcgcttag

SEQ ID NO: 224928 - DNA, 486 bp, Artificial Sequence
  Description of Artificial Sequence: Synthetic coding sequence
atgaaacaagtgccaactcttaagatcgatggtattacaatccaccagtctttagcgatcattgaatatctggaggaaatgcgtcctacaccgaggctgctacctcaagatccgaagaagcgcgcttcggtgcgtatgatcagcgacttaattgccggaggcatacagccactgcagaatctgagcgtcctgaaacaggtcggtgaagagatgcagttaacatgggctcagaatgccatcacttgtggatttaatgcactcgaacaaatacttcaatccacggccggtatctattgcgtgggagatgaagtgaccatggccgatctttgtttagtaccccaggtggctaatgccgagaggtttaaggtcgacttaacgccgtatcctaccatctccagcataaacaagcggctgctagtgttggaagcatttcaggtgagtcatccctgcaggcagcccgatactcccacagaactacgcgcttag

SEQ ID NO: 224929 - DNA, 486 bp, Artificial Sequence
  Description of Artificial Sequence: Synthetic coding sequence
atgaaacaagtgcccactctgaaaatcgacggcatcactatccatcagtccctggctataatcgagtacttggaagaaatgcgcccaacccccagactgctgcctcaggaccctaagaagagagcttccgtccgcatgattagcgacctcattgccggtggcatccagcccctccagaatctctcagtgctgaagcaggtaggcgaagaaatgcaacttacctgggctcagaacgccatcacatgcggattcaacgccctagagcaaatcctccagtccaccgccggtatttattgcgttggggacgaagtgactatggccgatctgtgtctggtgccccaagtggccaacgctgagcggtttaaggtggatcttacaccctatccaaccatttcttccatcaacaaacggctgctcgtgctggaagcatttcaggtaagccacccgtgccggcagcccgacacgcctacggagctgagggcctag

SEQ ID NO: 224930 - DNA, 180 bp, Artificial Sequence
  Description of Artificial Sequence: Synthetic coding sequence
atgaaacaggtgcctacgctgaagattgacgggatcaccattcaccagagcctggctatcattgaatatttagaggagatgagacccacacctcggctcctcccacaggatcccaagaaacgggctagtgtgaggatgatttccgatctcatcgcaggaggaattcagcccctccaatag

SEQ ID NO: 224931 - DNA, 117 bp, Artificial Sequence
  Description of Artificial Sequence: Synthetic coding sequence
atgaagcaggtgcctacactgaaaattgatgggataactattcaccagtccctagctatcatcgaatacctcgaggaaatgagacctacacccagactgcttccccaggatccttag

SEQ ID NO: 224932 - DNA, 486 bp, Artificial Sequence
  Description of Artificial Sequence: Synthetic coding sequence
atgaaacaggttcctacactgaagatcgatgggatcacaatccatcagtcccttgccattatagaatatctagaggaaatgagacccactcctagactcctgcctcaagatcccaagaaaagggcatccgttcgaatgatatcggacctgattgcaggagggatacaacctctgcagaacctgtccgtgcttaaacaagtcggcgaggaaatgcagctaacatgggcccaaaatgccatcacctgtgggtttaatgcactcgaacagatcttacagagcacagctggtatctattgcgtgggggatgaagtcacaatggcagacctgtgtctagtgccccaagtggccaatgctgaacgcttcaaggttgacctgacaccctaccctaccatcagtagtattaataagagactgctggtccttgaagctttccaagtgagtcatccatgccgacagcccgacactccaacagagctacgcgcttag

SEQ ID NO: 224933 - DNA, 387 bp, Artificial Sequence
  Description of Artificial Sequence: Synthetic coding sequence
atggccggaaacttgttaagtggcgcaggtagaagactctgggattgggtccccctagcctgtcggagtttttcgctgggcgtcccccgtttgattggcatccgattgacattgcctccccctaaggtggtggaccgctggaatgagaaacgcgcaatgttcggtgtgtatgataacattgggattctcggcaactttgagaagcatcctaaagagttaatccggggtccaatttggctgcgcggatggaaaggaaatgagttacagcggtgtatccgcaaaaggaaaatggtgggaagcagaatgttcgcggacgatctgcataacttgaacaagaggatccggtatctgtacaagcattttaatcgacatgggaagtttaggtag

SEQ ID NO: 224934 - DNA, 783 bp, Artificial Sequence
  Description of Artificial Sequence: Synthetic coding sequence
atggaagaaatgcgcgatccaagtaaaatcaaatggggtgacgctggtgcagagtacgtggtcgagtcaaccggcgtctttaccacaatggagaaggctggcgctcacctccagggtggcgctaaaagagtcataatttccgcacctagcgccgatgccccaatgttcgtgatgggggtaaaccatgagaagtacgataatagcttgaagataatatctaatgcttcctgtactacgaactgcctcgcccctctggcgaaggtgatccacgacaatttcggcatagttgaaggactcatgacaaccgtacacgccattactgcgactcagaagaccgtggatggcccatccggaaagttgtggcgcgacgggagaggagctctgcagaacattattccagccagcacaggtgccgctaaggccgtggggaaggtcatcccagaactcaacggaaagctcaccggtatggcattccgcgtgcctactgccaacgtgtcagtggtcgaccttacatgtcgccttgagaaacccgctaagtacgacgatatcaaaaaagttgtgaagcaggcctccgaagggcctcttaagggcattctgggttacaccgaacatcaggtcgtgagttccgactttaactcagacactcattcgtccacgttcgacgccggagcaggtatcgctctgaacgaccacttcgtgaagctcattagctggtacgacaatgagtttggctattccaacagggtagtggacctgatggcccatatggcttctaaggagtag

SEQ ID NO: 224935 - DNA, 882 bp, Artificial Sequence
  Description of Artificial Sequence: Synthetic coding sequence
atggtgtacatgtttcaatacgattctacccacgggaagtttcacggcacagttaaggccgaaaacggaaagctggtaataaacggaaacccaattaccatattccaggaaagggacccatctaaaatcaagtggggggacgcaggcgcagagtacgttgtagagagcactggagtgttcacaacaatggagaaggctggcgcacacctccagggaggtgccaagcgggtgatcatctccgcacctagtgcggacgcacctatgtttgtgatgggtgttaatcacgagaagtatgataacagtctgaagatcatctctaacgctagttgcaccacgaattgcctggccccactggccaaagtgatccacgacaacttcggtatcgtggaagggttaatgactacggtgcacgctattactgcaacccagaagactgttgacggcccatcaggaaagttgtggagggatggacgaggcgctcttcaaaatatcatcccagcttccactggagccgcaaaggcggtagggaaggtgatcccggagctgaacggcaagctgacagggatggcttttcgcgtcccaaccgccaacgtgtccgtggtcgatctgacttgcaggttggaaaagcctgcgaaatatgacgatattaaaaaagtggtgaaacaggcatcggaagggccactcaagggcattctggggtacacggagcatcaggttgttagcagtgactttaatagcgatacacactccagcaccttcgatgccggtgctggtatcgcactcaacgatcacttcgtaaaattgatctcctggtacgacaacgagttcgggtacagtaatcgcgtagtggaccttatggcccacatggccagtaaagaatag

SEQ ID NO: 224936 - DNA, 1008 bp, Artificial Sequence
  Description of Artificial Sequence: Synthetic coding sequence
atgggtaaagtaaaggtcggggttaatggctttggtcggatcggccgattggtgacacgggcagcttttaactcaggaaaagtcgacatagtagccattaatgatcctttcattgatctaaattatatggtttacatgttccagtatgattcaacgcacggaaagttccatggcacggtgaaagccgagaacggcaaacttgtgatcaacggaaaccccattactatcttccaggaacgcgaccctagcaagatcaagtggggcgatgctggtgcggaatatgtcgtcgaaagcacaggtgtttttactactatggagaaagccggagcccacttacaaggcggagctaagagagtgatcatttccgctccttccgctgatgccccaatgttcgtaatgggagtgaaccatgaaaaatacgacaattccttgaaaatcatctcaaacgcctcttgtactacgaactgtctggcgcctttagctaaagtaatccatgacaatttcggtattgtggaaggcctcatgactaccgtccacgctatcaccgccacccagaagaccgtggatgggccttcaggcaaattatggcgagatggcagaggtgctctgcaaaatatcatccctgcgagtactggcgcagccaaagcggttggcaaagttattccagaattaaacgggaagctgaccgggatggccttcagagttcctaccgctaatgtgtctgtggttgacctgacatgccgcctcgaaaagccggcaaagtatgacgatattaagaaggtggtcaaacaggcctccgaaggcccactcaaggggatcctcggatatactgagcaccaggtggtgtcttcagacttcaactctgatacgcactcttcaaccttcgacgccggtgcaggcattgcgttgaatgaccattttgtgaagctgatctcatggtacgacaacgagttcggatatagcaatagggtggttgatctaatggcccacatggcctctaaagaatag

SEQ ID NO: 224937 - DNA, 1008 bp, Artificial Sequence
  Description of Artificial Sequence: Synthetic coding sequence
atgggaaaggtgaaagttggcgtgaatggtttcggcaggattggcaggctcgtaactagagcggctttcaacagcggcaaggtcgatatcgtagccatcaatgatccttttatcgatctgaactacatggtgtacatgttccaatacgactcaactcacggcaaatttcacgggaccgtgaaagccgagaacggaaagctggtgatcaacggtaatcctattacaatatttcaggagagggacccctcgaagatcaagtggggggacgctggggcagagtatgtggtcgagagtacaggggtattcaccactatggagaaagcaggcgctcacttgcagggaggagccaagagggtgatcatttcagccccatccgccgacgcacctatgtttgtaatgggcgtgaaccatgaaaaatatgataattccttgaagatcataagtaatgcgtcttgcactaccaactgtctggcccctttggccaaagtgatacacgataattttggtattgtggagggccttatgaccaccgtgcacgcaattaccgctacccagaaaacagtggacggtccgtcaggaaagttgtggagagacgggaggggagccttgcagaacatcatcccagcttcaaccggtgctgcaaaagcggtgggaaaagtgatccccgaattgaacggcaagctgactggaatggcattccgcgtgcccactgcaaatgtttccgtggtggatctgacttgtcggctggagaagcccgctaaatacgatgatatcaagaaagttgttaaacaggcatccgagggcccactaaaaggcatactggggtataccgaacaccaggtcgttagctctgacttcaattctgacacacattcaagcacttttgacgctggcgcaggtatagctctgaacgaccactttgtgaagctcatttcttggtatgataatgagtttggttactccaatagggttgtggacctgatggcgcacatggcctccaaggagtag

SEQ ID NO: 224938 - DNA, 648 bp, Artificial Sequence
  Description of Artificial Sequence: Synthetic coding sequence
atggggaaggtcaaagtaggcgtgaatggctttggcagaatcggaaggctcgtgactagggccgctttcaactctgggaaggtggatatcgttgcaattaacgacccttttatcgacttgaactacatggtatacatgttccagtacgactcaacccatggaaagttccacggaacggtgaaggcggaaaatggcaagctggtgattaatggtaaccccatcaccatcttccaggagcgagatccgagtaaaattaaatggggagatgcaggggctgagtatgtcgtggaatccaccggagtttttacaaccatggagaaggctggcgctcatttgcagggtggagccaaaagggttattattagtgctcctagcgctgacgccccaatgttcgtgatgggagtcaaccatgaaaagtacgacaactcactcaaaataatcagtaacgcgtcttgcacaacgaattgtttggccccacttgcaaaagttattcacgacaattttgggatcgttgaggggctgatgacgacggttcacgcgatcacagcaactcagagagaagcacattggcacggcctgccatgtccccattgccagagagtgtctggaggacccgacctgccaagccggaaaacctgtcaaatttag

SEQ ID NO: 224939 - DNA, 675 bp, Artificial Sequence
  Description of Artificial Sequence: Synthetic coding sequence
atgacactgttccacttcgggaattgcttcgcgctggcctatttcccatactttattacttacaagtgcagcggacttagcgagtataacgccttctggaagtgtgtccaagctggggtaacatatcttttcgttcagctgtgtaagatgttatttctggccacttttttcccaacctgggaggggggaatctacgacttcattggggagtttatgaaggcctctgtggatgttgccgatctgatcggtctcaacttagtgatgtctaggaatgcgggaaaaggtgagtataagataatggtcgctgcactaggctgggctacagcggaactgatcatgtcgaggtgtatcccactgtgggtcggggcaagggggatcgaatttgactggaagtatattcagatgagcattgatagcaacatttctctggtccactacatagtggcgtccgctcaggtgtggatgatcaccagatatgatctatatcatactttccggccagcagttctgttgctgatgtttttaagtgtgtataaagccttcgtaatggagacttttgtgcacctatgttctttgggaagctgggccgctttgctggcacgggcagtcgtgacaggacttctcgctcttagcactctcgctctttacgtggccgtcgttaacgttcactcctag

SEQ ID NO: 224940 - DNA, 1104 bp, Artificial Sequence
  Description of Artificial Sequence: Synthetic coding sequence
atggcagctgcccttcaggttctgcctagactcgctcgggctcctctacaccctctattgtggcgtggtagcgtggctaggcttgcatcaagcatggccctcgcggagcaagcaaggcagcttttcgaatctgcagttggagctgtcctccccggacccatgttgcaccgtgccctttcgctggaccccggaggcaggcagctaaaggtgagagatagaaactttcagctgaggcagaacctgtacttggtcggcttcggaaaagcagtgctggggatggcagctgcagcagaggaactgctcggccaacatctggtccagggagtgattagtgtcccgaagggcattagggcggcaatggaacgggctgggaagcaggagatgttactcaagcctcattcaagagtccaggtgtttgaaggcgctgaggataacttgccagaccgtgatgctctgagagccgctctcgcaatacaacaattggcggaaggcctcacggccgacgatctgctgttagtcctcatctcagggggaggcagcgccctattgcccgcacctattccccctgtgactctcgaagaaaagcagacattgacaagactactcgccgctaggggagccaccatacaggagttaaacactataagaaaggccctgtcccaattgaagggtggcggtctcgctcaggccgcatatcctgcgcaggtggtcagtctgatactgagtgacgtggtcggagatcctgtggaggtgatcgccagtggaccaacagttgcaagcagccataatgtgcaggattgcctccacatactgaaccgatacggtttacgcgcagcgttaccaaggagtgtcaagacagtgctctcgagagccgatagcgatccacacggccctcatacctgtggccacgtgctgaacgtaatcatcggttccaacgtactcgcattggctgaggcccagcgacaagccgaggccttgggatatcaagccgtggttctgtcagccgcaatgcagggctggggaacccctgccgctcacagagacgatcgataccaatgccatggccatcccccactggtgccagctgcctctgtgatggcctag

SEQ ID NO: 224941 - DNA, 705 bp, Artificial Sequence
  Description of Artificial Sequence: Synthetic coding sequence
atggcagccgcactgcaagtgttgcccaggcttgcaagagctcccctccatcccctcttatggcggggaagtgttgccagattagcctcaagcatggctcttgcagagcaagccagacagctgttcgaaagcgccgtgggagccgtgctccctggccctatgttacaccgcgctctgagtcttgacccaggagggagacagctgaaggtgagagatagaaactttcagctgcgccagaacttgtatttggttgggttcggaaaagccgtgttaggcatggccgcagccgcagaggaactgttaggccaacatcttgttcaaggcgtgatcagcgtacctaaaggaattcgagctgctatggagcgggctggaaaacaagaaatgctgctaaaaccccactctcgagtgcaggttttcgagggagccgaagacaacctcccagatcgggacgccctccgcgctgccctggcaattcagcaactggccgagggcctgacagctgatgacctcctgctggtcctgatcagcgggggagagccccatcctgtgcggtgcggcggaggtccatgcggcggagattgccagtggcctcaccggggtcagttcccacaatgcgccagactgcctgcatacccacagagtttgcgccctccttgctcacctgccactttttgcgaggattgtgcagtgtctggtcggctgtag

SEQ ID NO: 224942 - DNA, 1374 bp, Artificial Sequence
  Description of Artificial Sequence: Synthetic coding sequence
atggcagcagccctccaggtcctgccacgacttgcgcgagcccctctgcatcctctgttatggagaggctccgtggctcgcttggctagctctatggcgttagcagaacaggcgcgtcagctcttcgaatccgccgtaggcgcagtgctccctggcccaatgctacatcgcgcactctctctggatcctgggggaaggcaactgaaagttagagaccggaactttcaactgagacagaatctctacctggtaggattcggaaaggcggtgctggggatggcggcagctgctgaggagctgctgggacaacatctcgtccagggtgttatttcggtccctaaagggatccgggctgccccaattccgccagtgacgcttgaggagaagcagacccttacacggcttcttgctgcaaggggggctacaatccaagagctcaacactattcgcaaggcactttctcaactgaaagggggtggtctggcacaggccgcatatcccgcacaggtagtaagccttatcctgagcgatgtcgtaggcgacccagtggaagttattgcgagtggccctacagtggcttcctctcacaatgtacaagattgcctgcatatcttgaacagatacgggttgcgcgcagcccttcctcgtagtgtgaagaccgtgctgtcaagggcagactcagacccacatggccctcatacatgtgggcatgtactgaacgtgatcattggctccaatgtcctggctctggcagaggcccagcggcaggcagaagctctgggataccaagcagttgtgctgagcgccgctatgcagggagatgtcaagtcgatggcccagttttacggcctgcttgcccacgtggcccgaactagactcaccccctctatggccggtgcaagtgtggaggaagacgcccaactccacgaactcgcagccgagcttcaaattcctgatttgcagctggaggaagcactcgaaactatggcgtggggaagaggcccagtctgcctcctcgctgggggagagccgacagtgcaattgcaggggagcggcagaggcggaaggaatcaggagctggctctccgcgtcggcgcagaacttcgccgatggcctcttggccctatcgatgtcttattcctgtcgggaggcacggacggccaggacggccctactgaggctgccggagcttgggtgacacccgagctggctagccaagccgctgccgaaggcttagacatcgccacgtttctcgctcataatgatagccacacctttttctgttgccttcaaggcggagcgcatttattacatacaggcatgaccggaacaaatgtgatggacacacacctgctcttcctgcgaccacgatag

SEQ ID NO: 224943 - DNA, 1572 bp, Artificial Sequence
  Description of Artificial Sequence: Synthetic coding sequence
atggctgccgcactgcaggtcctgcccaggttggctagggcccctcttcatccactactctggagaggaagtgtggccagactggcgagctctatggcactggcagaacaggccaggcagctgtttgaatcagcggttggagcagtcctgccgggacccatgttgcaccgtgcattatctctggatccgggaggcaggcagttgaaagtacgcgaccgcaatttccagctgaggcaaaacctgtatctggtcggcttcggcaaagccgtgttaggtatggctgcagcggctgaagagctgcttggacagcacctggtgcaaggagtgatcagcgtgcccaaaggcatccgcgcagccatggagagggctgggaaacaggagatgctattaaagccacacagtcgggttcaggtgtttgagggtgctgaggataatctgcccgaccgcgatgccttgcgggctgccctggctattcaacagctagccgagggcctcacagcagatgatcttttgctagtgctgatttctggtggaggctctgctctactgccagcacccatcccaccagtcacactcgaggagaagcagaccctcacccggctgctggcagcgcgaggcgctactattcaggaattgaacaccattaggaaggcactgtcacagctcaagggtggcggtcttgcgcaggctgcgtacccagcccaggttgtaagtctgatccttagtgatgtagtgggcgacccggtcgaggttatcgccagtggtcccacggtcgcttcatctcacaatgtccaggattgtttgcacatcctcaaccggtatggactccgggcagccctgccccgatctgtgaaaaccgtgctgagtcgggctgactccgatccccatggcccacatacatgcggccatgtgctgaacgtaataataggctctaacgtcctggcccttgcagaggctcaaagacaggcagaggctctgggctaccaggccgttgtgctgtccgcagcaatgcagggggatgtgaagagcatggcccagttctacggactgctggcccatgttgctcgcactagacttaccccttctatggcaggggcatccgtggaagaagatgctcagttgcacgagttagcagcagaacttcagattcctgacctgcaactggaagaagccctcgaaactatggcttggggacgtggacctgtgtgtctgctcgccggaggcgagcccacggtccagttgcagggcagcggtaggggaggaagaaaccaagaactggccctgcgtgttggagcagagcttcgacgatggcctcttggccctattgatgtcctgttcctctcaggtggcaccgatggccaggatgggcctaccgaggcggctggggcatgggtgacgcccgagctcgccagtcaggccgcagccgagggcctggacattgctacgtttctggcccataacgactcccacacattcttctgctgcttgcaggggggagctcaccttctccacaccggcatgaccggaactaatgtcatggatacccatttactgttcttgagaccgaggtag

SEQ ID NO: 224944 - DNA, 852 bp, Artificial Sequence
  Description of Artificial Sequence: Synthetic coding sequence
atggaactattgcttagccagagctgtatctggtggccgatggtgggagaggggagaaccattatttcatgcggaataaaggccatggaacgatctggcaattacctgatttggctgcagaaaggagaaatgctactgaaaccccattcccgagtgcaggttttcgagggggcagaggacaacctgccggatagagatgcactaagggcagctctggctatacagcagcttgctgaaggcctcaccgcagacgaccttcttctcgtgctgattagtgggggtggctcagccctgcttcccgcacctatccccccagtgaccctggaggaaaaacaaacgcttactcgcctcttagccgcacgcggagccactatacaggaactgaacaccatccgcaaggcactgtcccaattgaaaggaggcggtctagcacaggcggcttaccccgcacaggtggtcagtctcattttgagtgacgtggttggtgacccagtcgaggtgatcgcctcagggcctaccgttgcgagttctcataatgttcaggattgcctacatatccttaacagatatgggctccgagccgctctcccgaggtccgtgaaaactgttctcagccgggctgactcagaccctcacgggcctcatacgtgcggccatgtacttaatgtgatcatcggatccaacgttcttgccctcgcagaggcccagaggcaggcagaagccctggggtaccaggccgtcgtgctgagtgcggcaatgcaaggatgggggactcctgcagcccaccgtgacgacaggtatcagtgtcatggtcatccacccttagtgcccgctgcgagcgtgatggcatag

SEQ ID NO: 224945 - DNA, 723 bp, Artificial Sequence
  Description of Artificial Sequence: Synthetic coding sequence
atgcttctgaagccccactcacgcgtgcaggtgttcgagggcgctgaagacaacctaccagacagagatgctttgagagccgcacttgcaatacagcagctcgctgagggacttacagcagatgatcttctgctggtgctgatttctgggggaggctctgctcttttgcccgctccgattcctcccgtgactctggaagagaagcagaccctgacacggctgctggcagctcggggagctaccattcaggagctgaatacgattcggaaggccctctcccagctgaaaggaggaggtctggcccaagccgcttaccctgcgcaggtggtttccctgatcctgtccgacgtggtgggggatccagtcgaggtcattgcttcaggcccaactgtggcttcttcccacaatgtgcaggattgcctccacattctgaatcggtacgggctccgggcagccctgcccagatctgtcaaaacagttctgtccagggccgatagcgatcctcacggtcctcatacctgtgggcacgtgctgaacgtgatcataggatccaacgttttggcgctcgcagaagcccagagacaagccgaggctctcgggtatcaagcagtggtcctgagcgcagccatgcagggatgggggaccccagcagcacacagagacgaccgctaccagtgccatggccacccgccacttgtgccagcggcatccgtaatggcctag

SEQ ID NO: 224946 - DNA, 618 bp, Artificial Sequence
  Description of Artificial Sequence: Synthetic coding sequence
atggctgcggcattgcaggttctgccacggctggcacgggctccactgcaccctttgctgtggcggggatctgttgccagacttgcctctagcatggccctcgcagaacaagccagacaactctttgaatcagcagttggcgctgtgttacctggtccaatgctacatcgagccctgagcctggatcctgggggaagacagctgaaagttagggataggaacttccaactaaggcagaacttgtacctggttggcttcggaaaagccgtgctggggatggcggctgctgccgaggagttactaggccagcaccttgtccaaggggtcatatccgttccaaaaggtattagggctgccatggagagagctggaaaacaggagatgctgctcaaaccccattctcgcgtccaggtttttgagggtgccgaggataacttaccagacagagatgccttgagggcagctctggccattcagcagctggctgaagggctgacagctgacgaccttctactcgtactgattagtggatggggaacccctgccgcacaccgcgacgaccggtatcagtgtcacggtcacccaccactggttccagccgcatctgtgatggcatag

SEQ ID NO: 224947 - DNA, 705 bp, Artificial Sequence
  Description of Artificial Sequence: Synthetic coding sequence
atggctgcagctctccaggtgctgcccaggctcgcccgagcccctctgcacccactgctttggcggggttctgtcgctcgcttggcatcttctatggccctggctgaacaggcgcgacagctgttcgagtccgccgttggcgcagttctccctggacccatgttacatagagctctgtccctagatcctggaggccgtcagcttaaagtgcgagaccgaaacttccagttgaggcagaacctctatcttgtggggttcggaaaggcagtccttggcatggcggcagccgctgaagagctcttgggacagcacctagtgcagggggtgatttccgtacctaagggcatccgcgctgccatggagagggcgggaaaacaagagatgttgttgaagccccattcacgggtccaggtgttcgagggtgcagaagataacctgcctgatagagacgcgttgcgcgcagcccttgccatccagcagctggctgaggggctgaccgcagacgaccttctcttggtgctgatctcagggggagaaccacacccagttcggtgtggtggaggcccttgcggcggagattgccagtggccccatcgcggacaatttccgcagtgtgcccgtttgcctgcttatccccagtccctgagaccgccatgtagccctgctacattctgtgaggattgcgctgtttccggacgtctgtag

SEQ ID NO: 224948 - DNA, 285 bp, Artificial Sequence
  Description of Artificial Sequence: Synthetic coding sequence
aagatcttagatgccatgaatcgggactgtggcatccccctatcccacctccaggtcgacggagggatgaccagcaataaaatccttatgcagttgcaggccgacattctgtacatcccagtggttaagccaagtatgccggagacgacagcccttggggcagcaatggctgcgggtgcggctgaaggggtgggtgtgtggagtttggaaccagaagatctgtctgccgtcactatggaaagattcgagccacagattaatgctgagggtacatttaaggaatag

SEQ ID NO: 224949 - DNA, 1662 bp, Artificial Sequence
  Description of Artificial Sequence: Synthetic coding sequence
atggccgcatctaagaaggctgtgctgggcccactcgttggggctgtggaccaaggaacctcctccacgcggttcctggtgttcaactcaaagaccgccgaattgctctcacatcatcaggtggagataaagcaggaattcccacgggagggatgggtggaacaggaccctaaagaaatcctacacagcgtgtacgagtgcatcgagaaaacatgcgaaaaacttgggcagttaaatatcgacatctccaacatcaaagcgatcggggtctctaaccagcgagaaaccaccgtggtttgggacaaaatcactggagagcccttatacaacgccgtcgtttggctggatctcagaacccagtcaaccgtggagtcactgtctaagaggatcccgggaaataataactttgtaaagagcaaaacgggccttccccttagcacttatttctcggcggtaaaattgcgctggctcctggacaatgtgcgtaaagtgcaaaaggccgtggaagagaaaagagccctatttggcacgatcgatagttggttgatctggagcctgactggtggagtcaacggcggagtgcactgcactgatgtaacaaacgcgtctcggacgatgctgttcaatattcattctctggagtgggacaaacagctgtgtgaattcttcggcattcctatggagattctccctaacgtcaggtccagttcagaaatctatgggctgatgaaggctggcgctctggagggcgttcctattagtggatgcctgggggatcagagtgcggcactagttggccagatgtgctttcagatcggccaagccaaaaacacctacgggacgggctgcttcctgctgtgtaacacgggacataagtgtgtgttcagcgaccacggcctactaacaaccgtggcttataaacttggcagggataagccagtctactacgctttagagggatcagtcgctattgccggagccgtgatcagatggctgcgcgacaatctgggcatcataaaaacatctgaagagatcgagaagctggcaaaagaagtcgggaccagttatggctgctacttcgtgcctgcgttcagcggtctgtacgccccatattgggaaccttcagccagaggtatcatctgcggactgacccagttcaccaataagtgccatatcgcttttgccgcattggaggctgtctgtttccaaacacgagaaatcttggacgccatgaatcgggactgtggcattcccctgagccacctgcaggtggacggcggtatgacttccaacaaaatactgatgcagctgcaggccgacattctgtacattccggttgtgaaaccaagcatgcccgaaacaacagcgttaggtgctgccatggctgctggggcagcagaaggagtcggtgtatggagtctggaacccgaggacctgtccgcggtgactatggaaagatttgagccacagattaatgctgaggaatcagagataagatatagcacttggaagaaggctgtgatgaagagcatgggctgggtaaccacccagtctcccgaaagcggtgatccttctatcttctgcagtttgccactgggattcttcattgtctcttctatggtgatgctcataggtgcacgttacatcagtggtatcccttag

SEQ ID NO: 224950 - DNA, 1575 bp, Artificial Sequence
  Description of Artificial Sequence: Synthetic coding sequence
atggccgcatcaaagaaggctgttctcggtcctctcgtaggggcagtcgaccaaggaactagcagcactcggttcctggtgttcaattcaaagaccgccgagttgttgtcccaccatcaagtggagattaagcaagagttcccccgagagggctgggtggaacaggaccccaaagaaatccttcactcagtctacgagtgtatcgaaaagacatgtgagaaactggggcagctgaatatcgacatatccaatatcaaggccattggtgtgagcaaccagcgtgagacaaccgtggtctgggacaagatcactggcgagcccctgtacaatgcagtggtttggctcgatttgcgaacacagagcactgtggagtctttatcaaagagaattcccggaaataacaacttcgtgaaatccaagactgggcttcctttgtccacatactttagcgccgttaagttgagatggcttctggacaatgtgaggaaagtgcagaaagcagtggaagagaagcgcgcactctttgggaccattgattcctggctcatctggagcctgaccgggggtgtcaacgggggagtgcactgtacggatgtgacaaacgcaagccgcacaatgctattcaatattcacagcctagagtgggacaagcaactgtgcgagttcttcgggattcctatggaaatcctgccaaatgtgaggtcttcaagtgaaatctacggcctcatgaaggcgggagctttagagggtgtcccgatttccggttgcctaggtgatcagtctgccgcattagtgggccaaatgtgtttccagatcggccaggccaagaatacctacggtaccggctgtttcttgctgtgcaacacgggccataagtgtgtgttctccgatcacggtctcttgactaccgtggcctacaaattgggccgagacaagcccgtttattatgctctggaaggctctgtggccatcgctggcgcagtgatccggtggttgcgggacaatttgggaatcattaagacctcagaagagatcgaaaagctcgccaaggaggtgggtaccagttatggatgttattttgtgcctgccttttcaggcttgtatgctccctactgggaaccgtctgctaggggtatcatctgtggcctcacacagttcactaacaaatgccacattgcttttgctgctctcgaggccgtttgttttcagacccgcgagatacttgacgctatgaatagggactgcgggattccactctcccatttgcaggtagacggcggtatgacaagtaacaaaatccttatgcagcttcaggcggacatcctttacattcctgtggtgaaaccgtctatgcccgagacgacagctctgggagctgccatggccgcaggagcggctgagggcgtgggagtgtggtctttagagcccgaggacttatctgccgtgaccatggagaggtttgaaccgcagattaacgcagaagaatctgaaatccgctacagcacatggaaaaaagccgtgatgaagtcaatgggatgggtgaccacccaaagtccagagagtgggatcccttag

SEQ ID NO: 224951 - DNA, 1593 bp, Artificial Sequence
  Description of Artificial Sequence: Synthetic coding sequence
atggccgcatctaaaaaggctgtcctgggacctctggtgggcgctgtcgatcagggcacctcctctacgcggtttttggtgtttaactctaagacagcagaactactctcccaccaccaggtcgagataaaacaagagtttcccagagaaggctgggttgagcaggatcccaaagaaatacttcattcggtgtacgagtgtattgagaaaacgtgcgagaaattaggacagttaaatatagacatttctaacataaaggcgattggcgtgagcaatcagagggagaccaccgtggtttgggataaaatcacaggcgaacccctgtataacgccgtggtctggctggacttgcggactcagtccaccgtggaaagcctcagcaagcgaattccagggaacaataactttgtcaaatctaagacgggcttacccttatcaacttatttttcagcagtcaagttgcgctggttactggataacgtgaggaaagtgcagaaggctgtggaagagaagagggccctgttcggcacgatcgatagttggctgatttggtcactaacaggaggcgtgaatgggggagtgcactgtaccgatgtgacaaacgcatcacgcaccatgctgttcaacattcacagtctggaatgggacaagcagctatgtgagttctttgggataccaatggagatcttacccaacgtccggtcttcctcagagatttatggcctgatgaagatttctcactcagtgaaggctggtgctctggagggagtcccaatcagcggttgcctgggcgatcagagcgccgcactagtcggacagatgtgcttccaaatcggtcaggctaagaatacctacggcacaggctgctttctgttatgcaacactgggcacaaatgtgtgttctcagaccacggactccttacaaccgttgcttacaagcttggacgtgacaagccagtatattatgcactggaaggcagcgttgccatcgccggagcagtgattagatggctgcgagacaacctgggtatcatcaagacctctgaggagatcgagaagctggcgaaagaggtcggaacatcctatgggtgttatttcgtgcccgcatttagcggtctgtacgccccttactgggaaccctccgcgagagggatcatttgcggccttactcagttcacaaacaagtgtcacatagcctttgctgccctggaggccgtgtgttttcagactcgcgaaatactggacgctatgaaccgtgattgcggcatccccttatcccatctgcaagtggatggtggaatgacctccaacaaaattcttatgcagctgcaggcggatattctgtatatcccggtcgtaaaaccatctatgcccgagaccacagcactcggcgcagccatggccgcaggggcagcggaaggcgttggagtttggtctttagagccggaggatctgtcagcagtgacaatggagcggtttgaaccacagattaacgctgaggagtccgaaattaggtatagcacatggaagaaggcagtgatgaaatcgatgggctgggtgactactcagagccccgaaagcgggataccctag

SEQ ID NO: 224952 - DNA, 1065 bp, Artificial Sequence
  Description of Artificial Sequence: Synthetic coding sequence
atgctgttcaacatccattcactggagtgggataaacagctgtgtgaattttttggaattccgatggagattctcccaaatgttagaagttctagcgagatctatggcctgatgaaaatctctcactcggtaaaagccggagcactagagggcgttccaatatccgggtgcctaggcgaccagtctgctgcactagttggccagatgtgcttccagattggacaggcgaaaaacacctacggaaccggatgtttcctgctctgcaataccggtcataagtgcgtgttttctgaccacggattacttactaccgtggcttataagttagggcgagataaacccgtgtactacgcccttgaggggagtgtggctatcgccggagcagtcatcaggtggctcagagataatctgggaatcattaaaactagcgaagagatcgagaaactggccaaagaagttggtacgtcatacgggtgctacttcgtgcccgctttctctgggctttatgcaccttattgggagccgtccgccaggggaataatatgtggactgactcagtttaccaacaagtgtcacattgccttcgccgctctggaggccgtgtgttttcagactcgagaaattttagatgctatgaatagggactgcgggattcccttatcccacctccaggttgacgggggaatgacctctaacaaaatacttatgcagcttcaggcagatatactgtacatcccagtggtgaagccaagtatgcctgagacgactgccctgggtgctgccatggctgctggcgcagccgagggcgtgggagtgtggagtttggagcccgaagacctgtctgccgtgaccatggaaagattcgagccccaaatcaatgctgaagaaagtgaaatacgatattcaacttggaagaaagccgtgatgaagtccatgggatgggtcacaactcagagtcccgagtctggcgatccgtcaatcttctgctcactgccgcttggattctttatcgtaagtagcatggtgatgctgatcggcgctaggtatattagcggaattccgtag

SEQ ID NO: 224953 - DNA, 1104 bp, Artificial Sequence
  Description of Artificial Sequence: Synthetic coding sequence
atggcctacctggacaactttaagacaaatgcaagacattttatcctgtttgttaatatctcgtcactaaccggcggagtaaatggcggagtccactgtaccgacgtgacaaacgcttcccgcaccatgctatttaacatccactccctagagtgggataagcagctctgcgagttcttcggaattcctatggaaatcctgcctaacgtcaggagcagtagtgagatctacgggctgatgaagatcagccattctgtcaaggcaggcgctctggaaggagtgccaattagtggatgtttgggtgatcaaagtgctgccctggtgggccaaatgtgtttccagattgggcaggcaaagaacacttatggtaccggttgcttcctgctgtgcaataccggccataaatgcgtgtttagcgaccacggcctgttgaccacagtagcttacaagctcggtcgcgataaacccgtgtactatgcgctggaaggatctgtggccattgcaggagctgtcatcaggtggttgcgggacaatttggggatcatcaaaaccagcgaggagatagagaaactagctaaggaggtagggaccagctacggatgctacttcgtgcccgcattctctggcctctatgctccctactgggaaccaagtgccagaggcatcatttgtggtcttacgcagtttacaaacaagtgccatatcgcattcgccgcactggaagccgtgtgttttcagacccgagaaatcctcgatgctatgaacagagactgcggaatcccgctctcccacttgcaggtggatggaggcatgactagcaataagatacttatgcaacttcaggccgacattctctatattcctgtggtcaagccaagcatgcccgagaccactgccctgggagcggctatggcagcgggtgccgctgagggggttggcgtctggtctctggagcccgaagacctctctgccgtgactatggaacgattcgaaccgcagatcaatgccgaggaaagcgagattagatactctacatggaagaaggcagtcatgaaatccatgggctgggtgaccacccagtcccctgagagcggcattccatag

SEQ ID NO: 224954 - DNA, 1680 bp, Artificial Sequence
  Description of Artificial Sequence: Synthetic coding sequence
atggccgcttcgaagaaggccgtactcgggccattggtgggggcagttgaccaggggacctcgtccacgagattccttgtgtttaatagtaaaacggcagagcttctgagccatcaccaagttgagattaagcaggagttcccacgggaaggatgggtcgaacaggatcctaaggaaatactgcatagtgtttacgagtgcattgaaaagacttgtgagaaactgggccagctgaatattgacatctctaatattaaggcaattggagtttctaaccagcgtgaaaccacagttgtctgggacaaaataaccggtgagccactgtacaatgctgtcgtctggttagatctgaggacccaatcaacggttgaaagcctttccaagcgtatccctggtaataataactttgtgaagtctaagacaggactacctctgagcacctatttctcagccgttaagctgagatggttgctggacaatgtgagaaaggtccaaaaagctgtcgaggagaaacgagctctgttcggcactattgactcttggctgatatggtctctcaccggcggagtcaatggcggtgtgcactgcaccgacgtcactaatgctagccggactatgctgttcaacattcacagccttgaatgggataagcagctgtgcgagtttttcggaattcccatggagattttgcccaacgtacgttccagttccgaaatctacggtcttatgacgatccacaactcaaagaaagccggtgctctggaaggagtccccatctccggctgtctgggtgatcagtccgcggctcttgttggccagatgtgtttccagatcgggcaggcaaagaacacttacggcacaggatgcttcttactttgcaacaccggccacaaatgcgtattttcagaccacggcctgctgacgacagtggcttataagctgggacgggacaagcccgtgtattacgccctggaggggtccgtggcaattgctggagctgtcattcggtggttgcgcgataacctggggattattaagacctctgaagaaattgagaagctggcaaaggaggttgggacctcatatggctgctactttgtacccgctttcagcggactgtatgcaccttattgggagccaagtgcacgtggaatcatatgtggactcacacagttcacaaacaaatgtcatatagcgttcgctgcactcgaagccgtctgcttccaaacccgggaaattttggatgccatgaatcgggactgtggcatacccctttcccaccttcaggtcgatggtgggatgaccagtaataaaatattaatgcaattacaggcggacattttgtacatacccgtagtgaaaccctccatgccggagactaccgccctgggggctgctatggctgccggtgccgcagagggagtgggagtctggtcacttgagccagaggatctgtccgctgtgactatggagcggtttgaaccacagattaacgccgaggaatccgaaattcgctacagcacctggaaaaaggctgttatgaagtcgatgggctgggttaccacgcagtcgccagagtcaggtgaccctagcattttttgttcactgccattaggcttttttatcgtgagcagcatggttatgctgatcggggcacgttacatctcagggataccctag

SEQ ID NO: 224955 - DNA, 1662 bp, Artificial Sequence
  Description of Artificial Sequence: Synthetic coding sequence
atggcagcccctaagacagccgctgtcggcccactcgttggcgcagttgttcagggtacaaactcgacacgctttttggtgttcaatagcaagacggccgaactgctaagccaccacaaagtagagctgacccaggagttcccgaaggaagggtgggtcgagcaggatcccaaagaaattctgcaaagcgtctacgaatgtatagccaggacctgcgagaaactcgacgagctcaacattgatatcagcaatattaaagccgtgggggtgtcgaatcaaagagagacgaccgtgatatgggataagctgacaggagagcccctttacaacgccgtggtctggctggatctcagaacacagactacagttgaggatctgtccaagaagattcctggcaatagcaatttcgtcaagtcaaaaacagggttaccactgtcaacatatttcagcgccgttaagttaaggtggatgttggataatgtgcgcaacgtgcaaaaggcggtagaggaaggcagagccctgttcggcactatcgactcttggctaatttggtccctgaccggcggtgtaaatggaggcgtgcactgtacagatgtaaccaatgcaagccgaaccatgctgttcaatatccactcacttgagtgggataaggaactatgcgatttcttcgagatccctatggatctgctgcccaacgtgtttagctcatccgaaatctacgggctaattaagactggcgctctggagggtgtgcccatctcaggctgtctcggggaccagtgcgcggctctggttggccagatgtgctttcaagaaggacaagccaagaatacttatggcacaggatgctttttgctgtgtaacaccgggaggaagtgtgtgttcagcgagcatgggctgttgactacggtcgcctacaagctgggcagagagaaaccagcatactatgccctggaaggctccgttgccattgccggtgcggtcattaggtggctgcgggacaacctgggcatcattgagactagtggagatattgagagactggctaaggaagttggaacaagctatggttgttacttcgtgcctgcattcagcggtctgtacgctccatactgggaaccaagcgccaggggaattctctgtggcttgactcagttcacaaataagtgccatatcgcatttgcggctctggaagcagtgtgctttcagactagggagatcctggaggcaatgaatagagattgtggcatccctctgcgacatctgcaagtcgacggagggatgacaaataacaaagtgctgatgcagttacaggctgacatactccatatcccggttatcaagccttttatgccagagacaaccgctttgggcgctgccatggccgcaggcgctgcagagggcgtttccgtctggtctctggagccccaggcactgtcagttcttcgtatggagagattcgagccccagatacaggccaccgagagtgagatcaggtacgctacatggaaaaaagccgttatgaagagcatgggctgggtcaccagccagtcccctgagggcggagaccctagcatctttagcagtcttccgcttggcttcttcatcgtgtccagcatggttatgcttattggcgctcggtacatttccggcgtgccttag

SEQ ID NO: 224956 - DNA, 1050 bp, Artificial Sequence
  Description of Artificial Sequence: Synthetic coding sequence
atggcctcaaagaaggtgtgcatcgtgggtagcggaaattggggttctgccattgctaaaattgtgggcggaaacgctgcgcagctcgcccagtttgacccccgagttactatgtgggtgttcgaggaagacataggaggtaaaaaactcaccgaaatcattaatactcagcatgagaatgtaaaatacctgccgggtcacaaattaccccctaacgttgtggccgtgcctgacgtggtgcaggctgcggaggacgccgatattttgatcttcgtggtaccgcaccagtttataggaaagatctgcgaccagctcaaaggccacctcaaggcaaacgcaactggtatctccctgatcaaaggggtggacgagggacccaacggcctaaaacttatttcagaagtcatcggtgagcggcttggaatacccatgtcagtgcttatgggcgcaaacattgcctccgaagtggcggatgaaaaattttgtgagacgaccatcggatgtaaagatccagctcaggggcagttgcttaaagagctcatgcagacacctaattttaggattacagtggtgcaggaagttgacactgtagagatttgcggagccctcaagaacgtggtggctgtcggcgctgggttttgtgacggactcggattcggcgataacaccaaagcagccgtcatcagattgggactgatggaaatgatcgcattcgcaaaactcttttgctcaggcccagtgagttcagctacgtttctggagagctgtggagttgccgatctgatcactacctgctacgggggacgcaatcgtaaggtcgccgaagctttcgccaggaccgggaaatcaatcgaacagctcgagaaggagctgctcaacgggcagaaactgcaaggcccagagaccgctcgggagctttactccattctgcagcataagggactcgtagacaagttccctctgtttatggccgtgtataaagtgtgttatgagggtcaaccagtgggtgagtttattcactgcctccagaatcatcctgagcacatgtag

SEQ ID NO: 224957 - DNA, 981 bp, Artificial Sequence
  Description of Artificial Sequence: Synthetic coding sequence
atgcagactcctaacttccggatcaccgttgtgcaggaggtggatacagtggagatttgtggggcactcaaggtgcgcggtgcgcagcggcaactgtggggcgaagagaaggccccaaaagaggtctggctgtcctcagcccgactgcaggtgctgcaggcgctgactatcgaacagtggtttccattccctacaatgtctcatgcctatagaagatcttgtcgttctaaggcaagggctatccaggccgactactcatcctccgatcgtggccctccatgcagctgtcctatcctggccccatgcgggacaccccaccccctggctcctggtggacagggggacaaagagatgcctcggttaatgggcgataagaccagcctgacaccacgccagaccaatgggcagaattacggttcttggaccgctgtggatgggttatataatggtatggttagatgggaggatcagcttgaacgccgagtagtgttccgcaaatgcccgaggggcggaagcatgggccaaggcctcaggaagggagttcagcagggtgggaaacctagaggcggatctcgcctgttgaagggccacaccctgtatctttccagcgccgtcggcgttactgcagacgagatgtccatgagggggctgcatatgggccctataggaggcggactgtttacatatgacctacacagcttcaagaacgtcgtggcggtcggagccggtttttgcgacggactgggctttggcgataacacaaaggctgcagtcatccggcttgggctgatggagatgatcgcgttcgctaagctgttctgctccggccctgtgagttcagccacattccttgagtcttgtggcgttgcagatctcatcacaacctgctatggaggaaggaacagaaaggtcgctgaggcattcgccaggaccggaaaggtgggccctgggagaagagagaaccgaggggcagctttatag

SEQ ID NO: 224958 - DNA, 1056 bp, Artificial Sequence
  Description of Artificial Sequence: Synthetic coding sequence
atggccgcagcccctctcaaggtgtgtatcgtcggatcgggtaattggggcagtgctgtggcaaagatcataggcaacaacgtaaagaagctgcagaagtttgctagcaccgtcaaaatgtgggtttttgaagagacagtcaacggacgaaagcttacggatatcatcaataacgatcacgagaatgtgaaatacctccctgggcacaaactccccgaaaatgtggtggccatgtccaacctaagtgaggcagtgcaggatgccgacctgcttgtgttcgttatccctcatcagtttatacaccgcatatgtgacgaaattacgggacgcgtgccgaagaaggcactgggtatcacccttataaagggcatcgatgaaggcccagaggggctcaagctaatcagtgacatcatccgtgaaaagatgggaattgatattagcgtactcatgggggcaaatattgctaatgaggtggctgccgagaagttctgtgagactactataggatcgaaagtaatggagaacggactactgtttaaggaattgctgcaaacacctaattttcggattaccgtggtagacgacgcggacactgtcgagctctgcggggctttgaagaacatcgtggcggtgggcgcaggcttttgtgacggactcagatgcggcgataacactaaagctgccgtgattcggcttggcttgatggagatgatagctttcgctcgcatattctgtaaaggacaggtttctacggccacatttctggagagttgtggcgtggcagacctgataactacgtgttacggcggacgaaatcgacgggtggctgaagcgtttgctcgcacgggcaagaccattgaggaacttgaaaaagagatgctgaatggccagaaactgcagggaccacaaaccagtgccgaggtatataggattttgaaacagaaggggttgcttgataaattcccattgttcaccgcagtgtatcagatatgctacgagtcacgccctgtacaggagatgctgagttgcctgcaatcccaccctgagcatacttag

SEQ ID NO: 224959 - DNA, 1860 bp, Artificial Sequence
  Description of Artificial Sequence: Synthetic coding sequence
atggagtcatcttcctcttcaaattcgtacttttccgtggggcctacttcaccaagcgcggtcgttttactgtactccttgtcaaaagaatcattgcagagcgtcgacgtactccgagaagaggtcagcgagattctggacgaaatgtctcacaagctcaggctaggcgcaatacgcttctgtgcatttacattatccaaggtttttaagcagattttttcaaaggtgtgtgtgaacgaagaaggcattcagaaactgcaaagagccattcaggagcatcccgtcgttctgctgccctctcacaggtcgtacattgatttcctcatgctctcatttttgctatataactatgacttacccgtccccgttatcgcagccggtatggacttcctgggcatgaaaatggtgggtgagctgctcaggatgtccggagcattctttatgcgccgaacatttggtggtaacaaactttactgggccgtctttagcgagtacgtgaaaacgatgctgaggaatggatatgctcctgtggagtttttcctcgagggcacgcgttcacgctccgctaagaccttaacaccaaagtttggtttgctgaacatcgtgatggaaccttttttcaagcgcgaagttttcgatacttacctggtgccaatatctatctcatatgataaaattctcgaggagacgctgtacgtttacgaactgttgggagtgccaaagcccaaagaaagcaccacagggcttctgaaggctcgaaaaattctgtccgaaaattttggaagcattcacgtttacttcggcgatcctgtgtcactcagaagtctcgcggcaggcaggatgtcgcgttcttcctataatttggtccctcgatatatccctcagaaacagagcgaggatatgcacgccttcgtgacagaggttgcctacaagatggaactcttgcagatcgagaatatggttttgtccccctggactctcattgtggctgtgttgctccaaaatcgtccctctatggacttcgacgcattagtcgagaaaacactgtggctgaaaggcctcacgcaggccttcggaggattcctgatctggcccgacaacaaacccgcagaggaagtggtgcccgcttcgattctacttcacagtaatatcgcgtcactggttaaggatcaagtgattttgaaagtagacagcggcgatagtgaggtggtcgatggtctgatgcttcagcacattacactgctcatgtgcagtgcttacagaaatcagctgctgaacatatttgttcggccatcgctggtggctgtcgcactgcagatgacaccaggcttccgaaaggaagacgtctatagctgcttcagattcctgagggacgtatttgccgatgagtttatattcctgcctggcaataccctcaaggactttgaggaggggtgttaccttctgtgcaaatctgaggcgatacaggtgaccactaaggacattttagtcaccgaaaaaggtaacacagtactggagttcttggttgggctgttcaaaccgtttgtggagtcctaccaaattatctgcaagtatttactgtcggaggaggaggaccacttttccgaagagcagtacctggccgctgtgaggaaatttacttctcagttgcttgaccagggtactagccagtgttatgacgtgctcagcagcgatgtccagaaaaacgctctggctgcctgcgtgagactgggggtagtcgagaaaaaaaaaatcaataacaattgtatctttaacgtaaacgaacctgccacaacgaaactcgaagagatgcttggctgtaagactcccatcggaaagcctgccaccgccaaactctag

SEQ ID NO: 224960 - DNA, 2043 bp, Artificial Sequence
  Description of Artificial Sequence: Synthetic coding sequence
atggagagcagtagcagtagcaactcctacttttcagtgggccctactagcccttctgccgtggttctcctgtattccaaggagctgaaaaagtgggacgagtttgaggatatcttggaagaacggagacacgtgagtgatctgaaatttgctatgaagtgctacacaccccttgtgtataagggaattacaccctgtaagcctatagatatcaagtgtagtgtcctgaacagcgaagaaattcattacgtaatcaagcaactatctaaagagtctctccaatctgttgatgtgcttagagaggaggtgtccgaaattctcgatgagatgtcccacaagttgcgcctgggagccattaggttttgcgcctttacattgagtaaagtgttcaaacagattttcagtaaggtgtgtgtgaacgaagaggggattcaaaaactccagcgagccatccaggaacaccccgtggtgttgctgccctcacaccggagctacatcgatttcttaatgctgtccttcctgctttataactatgacctgcctgtacccgtcatcgccgctggcatggacttccttggcatgaaaatggtgggtgagctactgcgcatgagcggcgctttcttcatgaggcgaacctttggtggcaataagctctattgggctgtgttttccgagtatgtgaagacaatgctccggaatggctatgctcccgtcgagttctttctcgagggtacaagatctcgttcagccaagacccttacacccaaatttggccttctgaatatcgtgatggaaccttttttcaagcgagaggtctttgatacatatctcgtgccaatctcgatttcctatgataaaattctcgaagaaactttgtacgtctatgagctgttgggagtgcccaaacctaaagagagcacaaccggtctgctcaaagctaggaaaatactctctgagaattttggctctattcatgtgtattttggtgacccagtatcccttcgtagtcttgctgcaggcaggatgtctagatctagctataatctggtgcctagatatatccctcagaaacagtcggaggatatgcacgcctttgtgacagaggtcgcctacaagatggagctcttgcagatcgaaaatatggtgctttccccgtggactctgatcgtagcagttcttctccagaataggccttcaatggactttgacgcattggtcgaaaagacactttggctaaaaggcctcactcaggccttcggtggcttcctgatttggccagacaataaacccgctgaagaggtggtgcccgcaagcattctgctccactccaacatcgctagcctggtgaaagatcaagtgattctcaaagtggatagcggcgattcagaagtcgtggatgggttgatgctgcagcacatcacgttgctgatgtgctcagcgtatcgaaatcagctcctcaacatctttgtccgcccatctcttgtggccgtggctttacaaatgactccaggctttagaaaagaagacgtgtacagctgttttcgcttcctgcgtgacgtgttcgctgacgaattcatttttctacctggcaacaccctcaaggacttcgaggaaggctgctacttgttatgtaaaagtgaggctattcaggtcactaccaaggatatcttggtgaccgaaaaaggaaatactgtgctcgagtttctggtcgggctgttcaagccattcgtggagagctaccagataatttgcaagtatcttctgtcggaggaagaagatcatttcagcgaggagcagtatctagctgctgtgcgcaagtttacttcccagctgttggaccagggtacaagtcagtgttacgacgtgctgtcctcagatgtccaaaaaaatgctctggcagcgtgtgtgaggctgggagttgtcgagaagaagaagattaataataattgcatcttcaatgtgaacgaacccgcaaccaccaaacttgaagaaatgcttggctgtaagacacccattggaaaaccagcgacagccaagctttag

SEQ ID NO: 224961 - DNA, 1764 bp, Artificial Sequence
  Description of Artificial Sequence: Synthetic coding sequence
atggagagttcctccagcagtaattcttacttcagtgtgggcccaacttctccatccgcagtggtgcttctgtattccaaggaattgaagaaatgggacgaattcgaagatattctggaggagagaaggcacgtaagcgacctgaaattcgcgatgaaatgctacacccccctggtttataaagggataactccctgcaagcccatcgacatcaaatgctctgtgctgaacagcgaagagatccactacgtgatcaaacagttgtctaaggagtccttacaatctgttgatgtgctccgcgaagaggtctccgagattctggatgagatgtcccataaactccgcctgggcgcaattagattctgcgcctttaccctgtccaaggtgttcaagcagatattctccaagctgcagagggctatccaggaacatccagtggtgttgctgcctagtcaccgcagctatatagacttcctcatgctcagctttcttctctacaactatgatttgcctgttcccgttatagcagcgggaatggattttttgggaatgaagatggttggggagttgcttagaatgtcaggggcatttttcatgcggcgaacattcggcggaaacaagctctactgggctgtgtttagtgaatatgtgaaaacaatgctgaggaatggatacgccccagtcgaattttttctggagggtaccaggtctcgttccgctaaaaccctgacccctaaattcggcctgttgaacattgtgatggagccattttttaaacgtgaagtgttcgacacttatctggtgcccattagtataagctacgacaaaattctggaagaaaccttatatgtttacgagttgttgggtgttcccaaaccaaaggaatctacaaccggcctcttaaaggctaggaagatactgtctgaaaatttcgggagtattcacgtgtactttggcgatccagtgagccttaggagccttgctgcaggacgaatgtcgaggagctcatataacttggtgcctcggtacatcccgcagaagcagtcggaagacatgcacgcattcgtgactgaggtggcctataagatggagttattgcaaatcgaaaatatggttttatcaccctggaccctgatagtagctgttttgcttcagaacagaccttccatggattttgatgcactggtcgagaaaaccttatggctgaagggtttgacccaggccttcgggggattcttaatatggccagataataagccagcagaggaagtcgtgccggcatcaatcctgctgcacagtaatattgcttcacttgtgaaggaccaagtgatcctaaaagttgactcgggggactctgaggtcgtggatggcctgatgctgcagcatatcactctgctgatgtgttcagcctaccgcaatcaactcctcaatattttcgtaagaccttccttagtggccgtggctctgcagatgacacccggatttcggaaggaagatgtctactcatgttttcgattcctgagggacgttttcgccgatgaattcatttttttacccggaaatactctcaaggatttcgaagaaggctgttatctgctttgcaagtctgaagccattcaggttactactaaagatatactcgttactgaaaaaggaaacacggtgctggagtttcttgtgggcctctttaagccattcgtcgaatcataccagatcatctgcaagtacctgttgtcagaagaggaggaccacttttccgagtag

SEQ ID NO: 224962 - DNA, 669 bp, Artificial Sequence
  Description of Artificial Sequence: Synthetic coding sequence
atggagtcttctagctcttcaaactcttacttcagcgttggcccaaccagcccatctgccgtggtgctgctgtattctctcagcaaggagtctctgcagagtgtagatgtccttcgcgaagaggtcagcgaaatattagacgaaatgtcacataagttacgacttggcgcaatccgcttctgtgcattcacactttctaaagtcttcaagcagattttcagtaaggtttgtgtcaacgaggaaggcatccaaaagctgcaacgggctatccaagagcaccccgttgtgctgctgccttcacaccgttcatacatcgatttcctcatgctctcttttctgctgtacaactacgacctacctgtgcctgtaatcgccgcaggcatggactttctgggaatgaagatggtgggagagttactccggatgtcaggagccttttttatgaggagaactttcggtggcaataagctgtattgggctgtgtttagcgagtatgtgaaaaccatgcttagaaacgggtacgcccctgtagaattcttcctggaggggactcgctcccgcagcgccaaaacacttacacctaagttcgggctccttaacatcgtgatggaacctttttttaaaagagaagtttttgacacttacttggttcctatctccatcagctag

SEQ ID NO: 224963 - DNA, 870 bp, Artificial Sequence
  Description of Artificial Sequence: Synthetic coding sequence
atgagtcgaaatagtaggaagacaattggtaaggtgcgtgtggattacataattatcaagcccctcccgggatactcatgcgatatgaaatcaagtttttccaagtattggaagcccagaatccccctagatgtggggcacagaggtgctggaaacagtaccactactgcccagctggctaaagtacaagagaatacaattgcttccctgcgcaatgccgctagtcacggagctgcgtttgtggaattcgatgtgcatctctctaaagattttgtacctgtagtctatcacgacttaacctgctgcctgactatgaaaaaaaacctatggttccgcaggaaaattccgttccagaagattagtcactttctcttgttgcggtgggtacgccagaagcagaacaagtatcccatcctgtttctgacccagggaaagagtgaaatttatcctgaacttatggatcttcgctcccgaaccacaccaattgcaatgagcttcgcgcagttcgaaaatctcctgggaatcaatgtgcacacagaggatctcctaaggaatccttcatatatccaagaagcgaaggccaagggactggtgattttctgttggggtgacgatactaatgaccctgaaaatcggaggaaactgaaagagctgggtgtaaacggtctcatctatgacaggatttacgactggatgcctgaacaacccaatattttccaggtggaacagctggagcgccttaagcaggaactaccggaacttaagagctgtctatgtccgaccgtgagtcgattcgtgccctctagcctatgcggcgagtctgatatccatgtcgacgccaacgggatcgataacgtggaaaatgcttag

SEQ ID NO: 224964 - DNA, 2019 bp, Artificial Sequence
  Description of Artificial Sequence: Synthetic coding sequence
atgaccccatcccaagtcgcattcgaaataagagggactctattaccaggcgaagtcttcgccatctgcggctcatgtgacgcactcggcaactggaatccacagaacgcagtggccctactcccagagaacgacacaggggaaagcatgttgtggaaggctaccatcgtactctcgaggggtgtgagtgtacaatatcggtactttaaaggatacttcttggagcctaaaactatagggggtccttgccaagtgatcgtccacaaatgggaaacccatctgcaaccgagatcaattacgcctctggagtctgaaatcatcatcgacgatgggcagttcggtattcataacggagttgagacgttggattccggatggctcacttgccagaccgagatccgcttgcgccttcattatagcgagaaaccacctgtgagtataacaaagaagaagttgaagaaatcgaggttccgagtgaaactgactctggagggcctggaagaggatgatgatgaccgggttagtcccacagtcttacataagatgagcaactctctggagatctctttgatttcagataacgaattcaagtgccgtcattctcaaccggagtgtggctatgggcttcagcctgatcggtggaccgaatacagcattcagactatggagccagacaatctcgagctgatctttgacttttttgaggaagacctgagcgaacacgtggtgcagggcgacgctctgcccggacatgtaggcacagcatgcctacttagttccacaatagccgagtccggcaaatccgccggaatattaacactccccattatgtcccgtaatagcagaaagaccatcggaaaagtcagggtagactacatcattatcaagccccttccgggttactcctgtgatatgaagtccagctttagcaaatactggaagcctcgcattccattagatgttggccatagaggggctggcaactctacgaccaccgcccaacttgccaaggttcaggagaacaccatagcctcgctccgaaacgcagctagccatggtgctgcttttgtcgagtttgatgtgcatttgtccaaggacttcgtgccggttgtgtaccacgacctaacgtgctgcctgacaatgaaaaaaaaattcgacgcagatcccgttgagctctttgagattcccgttaaggagctgacgttcgatcagctccagctgctcaagttaactcatgtgacagcgttgaagtctaaagaccggaaggaaagtgtggtacaggaggagaattcattctctgaaaaccaaccattcccttctctcaaaatggttctggagtctttaccagaagacgtgggatttaatatcgagatcaaatggatttgtcagcagcgagacgggatgtgggatggaaatctgtcgacctatttcgacatgaatctgtttctggatattattctgaagacagtgctggaaaactcaggaaagcgtcgaattgtgtttagctctttcgatgccgatatttgtactatggtgagacaaaagcagaacaaataccctatcttgtttcttacgcaggggaagagtgagatttatccagaacttatggacctgcggagtcgcacaacacccatcgcgatgagtttcgctcaattcgaaaatctgctggggattaatgttcacaccgaagacttgttacgtaaccccagttacatacaagaagctaaagccaaaggtctggtgatcttttgctggggcgacgacaccaacgaccccgagaatcggaggaagctcaaggaactgggtgttaatggactaatctatgacaggatttatgattggatgcccgagcaacccaatatcttccaggtagaacaactggaaaggttaaagcaagagttaccggagcttaagtcatgcctctgcccaactgtgtcccgctttgtacctagcagcttatgtggagagagcgatatccacgttgatgccaacggtatcgataatgtggagaatgcttag

SEQ ID NO: 224965 - DNA, 795 bp, Artificial Sequence
  Description of Artificial Sequence: Synthetic coding sequence
tgatgcgatatgaaatccagcttctctaaatactggaagcctcggatacccctcgacgtgggccacaggggcgcaggaaacagtactacaaccgcccagttggctaaagtccaggagaacactatcgccagcttaagaaacgccgcttcccatggcgctgcctttgtcgaatttgatgtccatctgtccaaagattttgtcccggtagtgtatcatgatctgacatgttgcctgactatgaagaagaacctttggttcagaaggaaaataccttttcagaagatatcccacttcctgttgctgagatgggtgcgccagaaacaaaacaaatatcccattttgttcctgacccagggaaagagtgagatctacccagagctcatggacttgagatcaagaacaaccccgatcgcgatgtcattcgctcagttcgagaatctcctgggaatcaacgtacacaccgaagatcttctgcgtaatccgagctacatccaggaagctaaagccaaaggcctcgttattttctgctggggcgacgacacaaacgacccagagaacaggcgtaagctgaaggagctcggcgtaaacggccttatctatgaccggatctatgactggatgcccgaacagccaaacatcttccaggtggaacagctggagagattgaaacaggaactgcctgaattaaagtcttgtctgtgccctacggtgtctaggttcgttccctcttcattgtgcggtgaatccgacattcacgtggatgcaaacggaattgacaatgtggaaaacgcgtag

SEQ ID NO: 224966 - DNA, 996 bp, Artificial Sequence
  Description of Artificial Sequence: Synthetic coding sequence
atgtggctctgggaggatcagggcggactcctcgggccattcagctttttactgctcgtgctgcttctggtcacccggtccccagtaaatgcatgtctgctgaccggatcattattcgtactcttgagggtcttcagctttgagccggtccctagttgcagggcactccaggtgctaaaacccagagatcggattagcgcaattgcgcatagggggggatcgcatgatgctcctgagaatacgctggccgctattagacaagctgccaagaacggtgctaccggggtggaactggacatcgagtttacatctgatggaatccccgttctcatgcacgacaatactgtcgatcgcacgactgacggaacaggacgactgtgcgatctgacatttgaacaaatacgcaaacttaatcctgcggcaaaccatcggctgaggaacgattttcccgatgagaaaatccctactctccgtgaggccgtggcggagtgtctaaaccataatctgaccattttttttgatgtgaagggacacgcccacaaggccaccgaagcattgaagaaaatgtacatggagttcccacagctgtataataacagtgtcgtgtgcagtttcctgccagaggtgatctataaaatgagacaaacagaccgtgatgtcatcacagctctgacgcacaggccctggtctctctcccatacaggagacggcaagccacgttacgataccttctggaagcactttatctttgtgatgatggacattttgttggactggagcatgcacaacatcctgtggtatctgtgtgggatatctgcttttctgatgcaaaaggacttcgtgagtcctgcttatctcaaaaagtggtctgctaagggaattcaggtggtgggctggaccgtgaatactttcgacgagaaaagttactatgagtctcatctggggagtagctacattaccgactccatggtagaggactgcgagccacatttctag

SEQ ID NO: 224967 - DNA, 1818 bp, Artificial Sequence
  Description of Artificial Sequence: Synthetic coding sequence
atggtgcgacaccagcccctacagtactatgagccccaactgtgcctgtcatgcctgacaggcatttatggatgccgctggaagcgttaccaaagaagtcacgacgacacaaccccgtgggagcgcctgtggtttctccttctgacattcaccttcggcttgacccttacatggctgtatttctggtgggaggttcataatgattacgatgagttcaactggtatctttacaatcgcatgggctactggagcgattggcccgtcccaattctggtgaccaccgcagctgcctttgcttacattgcaggattgctggtcctggcgctctgccatatcgctgtggggcaacagatgaaccttcactggctgcataagataggattggttgtcattctggcatccacagttgtggctatgtcggcagtcgcacaactctgggaagatgagtgggaagtgctactgatttccctgcagggaaccgcccctttcctgcacgtcggagccgtagccgcagtcacaatgctctcgtggattgtggccggtcagtttgccagagccgagaggacatcgtctcaagttaccatcttgtgtacctttttcactgtcgtattcgcactgtatctggcgccactgactataagttctccttgtatcatggaaaaaaaagacctgggacctaagcccgctcttatcggacaccggggtgcacctatgctggcacccgagcacacactgatgtctttcagaaaggccttggagcagaagctttacggtctgcaggccgacatcaccattagcttggacggcgtgcctttcctcatgcacgatacaacattacgacgtaccaccaacgtggaagaggaattccctgaactcgccaggcgtcctgcctcaatgctcaactggacaacattacagagactgaacgctggtcagtggttcctgaagactgatccgttctggacagcctctagcctcagcccaagtgatcaccgagaggcacagaatcagtcgatttgtagcctcgctgagttgctggaacttgctaagggtaatgccactctgctgctaaatctccgcgacccaccccgtgagcatccatatagatcctcctttataaatgtcaccctggaagcggtcttgcactctgggttcccgcagcaccaggtaatgtggcttccttctagacagcgacccctggtcagaaaggtggctccgggttttcagcagacttcgggttccaaagaggcagtagcttctttgcgtagagggcatattcaaagacttaatcttcgctacacccaggtgagccgacaggagctgcgggactatgccagttggaacctttccgtcaacctgtacacagtcaacgctccgtggttgttcagtctgctatggtgtgcaggcgtgccaagcgtgacttcagacaactcccacgccctgtcacaggtaccttctccactttggatcatgcctcctgacgaatattgcttgatgtgggttacagcggaccttgttagcttcaccttaatagtcgggatctttgtcctgcagaagtggcgcctcgggggaatccggtcatacaatccagaacagattatgttatccgcagccgtccggcgtacttcgagggacgtgagtataatgaaagaaaagctcattttttccgagataagtgatggggttgaggttagcgatgttctgtcagtctgttctgataactcatatgatacctatgctaactcaacagctacccctgttggtccgaggggaggcggaagtcataccaagacactcattgagcgctccggacgatag

SEQ ID NO: 224968 - DNA, 1461 bp, Artificial Sequence
  Description of Artificial Sequence: Synthetic coding sequence
atggtcagacaccaacccctccagtattatgaacctcagttgtgcctatcgtgtctgacaggaatatacggatgccgttggaagcgttaccagcggtcacatgatgataccacccccggaacggcccctttcctgcacgttggagcggtcgccgctgtgactatgctaagctggatcgtggccggacagtttgcaagggctgagcgtacttccagtcaggtaactattctgtgtaccttttttacggtggtattcgcactgtatttagccccactcactatcagcagtccttgtataatggagaaaaaagacttgggaccgaagcctgcgctaatcggtcatagaggcgctcccatgttggctcctgagcacactctgatgtccttcagaaaagctctcgagcaaaaactgtacggcctccaggcagatatcacaatcagcctagacggcgtacctttcctaatgcatgacacaactcttaggagaacgactaatgtagaagaagagtttcctgaactggcccgtaggcctgcaagcatgctgaattggacaactctccagaggttaaacgcgggtcagtggtttctcaaaaccgatcctttctggactgcatcatcactgtccccctcggatcaccgggaggcgcagaaccagtctatatgctctctggctgaactcctggagctcgcgaaagggaacgccacactgctgcttaacctccgggaccccccacgtgagcatccatacaggtcatctttcataaatgtcacactagaggccgtactacactctgggtttccgcagcatcaagttatgtggctcccgtccaggcagagaccgcttgttcggaaagtggccccaggctttcagcagacatcagggagtaaagaggccgtcgcctctttgagacgaggacatatccaacggctcaacctcaggtacacccaagtgagccgccaggaactgagagactatgcgagttggaatctgtcagtcaacctctacactgtgaatgcaccatggctcttctctctgctctggtgcgccggagtacctagcgtgaccagtgacaattcacacgctttgtcccaggtgcccagccccctctggattatgccgccagacgagtattgcctgatgtgggttaccgccgaccttgtttccttcacacttatagtgggaatttttgtgcttcagaaatggagactggggggtattcggtcctacaatccagaacagataatgttgagcgccgctgttagacgtacaagtcgagacgtttctatcatgaaagaaaagctgatcttcagcgagatttcagatggagtagaggtatctgacgttctgagtgtgtgtagtgacaactcatatgacacctatgctaatagcactgccacccccgtcggccctcggggagggggttctcatactaagacactgattgagcggagcggcaggtag

SEQ ID NO: 224969 - DNA, 408 bp, Artificial Sequence
  Description of Artificial Sequence: Synthetic coding sequence
atggtgcggcaccagccgctgcagtactatgaacctcagctatgtctgtcttgtttgacaggaatttatggttgtaggtggaagaggtatcaacggagccacgatgatactacaccgtgggagcgactctggttcctgctgctgaccttcactttcggattaactctgacatggctgtacttttggtgggaggttcataatgattatgatgaatttaactggtacctctataaccggatgggttactggtctgactggccagttcccatcctagtgaccacagcagcagcattcgcctatattgcgggactgttggtgctcgccctctgccacatcgcagttggacagcagatgaatctacattggctgcacaaggcttccagcgggcttccactgtcgcccctctag

SEQ ID NO: 224970 - DNA, 1404 bp, Artificial Sequence
  Description of Artificial Sequence: Synthetic coding sequence
atgtcagccgtggcccagttatgggaggacgagtgggaagtgctgctcataagtttgcagggcaccgccccatttctgcatgtgggagcagttgcagccgtaacaatgctttcatggatcgtggccggacaatttgcgcgtgcagaacgaacaagttcccaggtaacgatcctgtgcacattctttactgtggtgtttgcactgtaccttgcccctcttactatatccagcccctgtatcatggagaagaaggacctgggcccaaaaccagcactcattggtcacaggggggcacccatgctggctcctgagcatacattgatgagcttcagaaaagcgctggaacaaaaactgtacggcttgcaggctgatataactatttccctggacggggtacccttcctaatgcacgataccactctacgtagaacaactaatgtggaggaggaattccctgagctggcaagacggcctgcaagcatgctaaactggaccacccttcagcggctgaatgccggtcagtggtttctcaaaactgatcccttttggacagcctctagcctttctccctccgaccacagggaggcacagaatcagtccatctgctcattagccgaactcctggaactggccaaaggaaacgctacgctgctgctaaacctcagggaccccccacgcgaacatccttatcgatcatcttttataaatgtgactctcgaggcagtgctgcactctggctttccacagcaccaggtgatgtggcttccctcccggcaacgcccattggtcagaaaggtggcccctggcttccaacagacgagcgggagtaaagaagcagtggctagcctgcgccgtggacatattcagcggcttaacctccggtacactcaagtgagcaggcaggaactcagggattatgcctcttggaacttaagcgtaaatctgtataccgtgaatgcgccttggttgttctctcttttgtggtgtgccggagtgccttctgtcacctccgataatagtcacgcactgagccaggtgcccagtcccctgtggattatgccacccgatgagtactgccttatgtgggtgaccgccgacctcgtttcattcaccctgatcgtgggaatcttcgtgctccagaagtggagactgggaggcattcgttcttacaatccagagcagattatgctgagtgctgctgtcaggagaaccagtcgggatgtgtcaattatgaaggaaaagctgattttttctgaaatttccgacggagttgaggtcagcgacgtgctgtcagtgtgctccgataacagttacgacacctacgccaattctactgctaccccggtaggacccagaggtggaggatctcacacgaaaaccctgatagagcgctctggcagatag

SEQ ID NO: 224971 - DNA, 1818 bp, Artificial Sequence
  Description of Artificial Sequence: Synthetic coding sequence
atggtccgccaccagcccttacagtactatgagcctcagttgtgtctgtcctgtctcaccggtatctatgggtgtaggtggaagcgctaccagcggtcgcacgatgacaccacgccctgggagagactgtggttccttctactgaccttcaccttcggactgaccctgacatggctctacttttggtgggaggtacacaatgattacgatgagttcaactggtacctgtacaacaggatgggttactggtccgattggccagtcccgatcttggtgaccaccgctgctgcttttgcctacatcgcagggttacttgtactcgccttatgccatattgcggttgggcagcaaatgaacctgcactggttgcacaagattgggcttgtggtgatcttggctagcactgtcgtcgctatgtctgccgttgctcagctttgggaagacgagtgggaggttctgctgatatcgcttcaaggtaccgcacctttcttacacgtcggcgctgtggcagccgtcactatgttgtcttggatcgtcgctggccagttcgccagggcggagaggacgagtagccaggtgacgatcctgtgtaccttcttcactgtggtcttcgccttatatttagcacctctgaccatctcgtccccttgtatcatggagaaaaaagatctcggacccaaacccgcactgattggtcatcgtggagctcccatgctcgcccctgaacacacactgatgagctttaggaaggctttagaacaaaagctttacggacttcaggcagatatcacaatttcgctggatggagtgccctttctcatgcatgacacgacattgcgtcgtaccacaaacgtagaagaagaattccccgagcttgcaagacgccctgccagcatgctgaattggaccactctccagcgcctaaatgcagggcagtggtttctgaagaccgatccattttggaccgcttccagcctgagcccgtccgatcaccgtgaggctcagaaccaatcaatttgtagtcttgctgagctgctggagttggctaagggaaatgccactctgttgctgaacctgagggaccctccgcgagagcatccctatcgcagctccttcattaatgtgacactggaagccgtgttacattctggcttcccccagcaccaggtgatgtggctccctagtagacagcggcctttggtgagaaaagtagcaccagggttccaacagacgtcaggcagcaaagaggcagtagcatcactccgcagaggtcacattcagaggctaaatctgcgctacacccaggtatctcggcaggaactgcgtgactacgcttcttggaacctgtcagtaaatctctacaccgtgaatgcaccctggctgttctctcttctctggtgcgccggagttccttcggtgactagcgacaatagccacgctctgtcacaggtccccagccccctatggataatgcctcccgatgagtattgcctgatgtgggtcaccgccgaccttgttagcttcaccttgattgtaggaatatttgtgttacagaagtggcggctgggtgggattcggtcatacaacccggagcagataatgctcagcgctgctgttagacggacttctagggatgtctccattatgaaggaaaaactcatcttctctgagatttccgatggcgttgaagtgagtgacgttctgtccgtgtgcagcgataactcatacgacacgtacgctaactctaccgctacacccgtaggacccagaggaggcggttcccacaccaagaccctaatcgagagatctggccgatag

SEQ ID NO: 224972 - DNA, 222 bp, Artificial Sequence
  Description of Artificial Sequence: Synthetic coding sequence
atggtgcggcatcagccattacaatattatgaaccccagctctgcttgtcgtgcctcacgggcatatatggatgtaggtggaaaaggtaccagcgaagccatgacgacaccaccccgtgggaacgattatggttcctgcttctcacgttcacctttggactgaccctgacgtggctctatttctggtgggaagttcataatgattatgatgagttcaactag

SEQ ID NO: 224973 - DNA, 1461 bp, Artificial Sequence
  Description of Artificial Sequence: Synthetic coding sequence
atggtacgtcatcagcctctccaatattacgagccccagttgtgtctttcatgcttaaccggtatatacggatgtcgctggaagcgttatcaaaggtcccacgacgacaccaccccaggcaccgccccttttttacacgtgggcgcagtcgcagccgtgacaatgctgtcctggatcgtagctggccagttcgcacgcgcagaacggacttcttcacaggtgacaattctttgcactttctttaccgttgtttttgccctttatctcgctcctctgacgatcagttccccatgcattatggagaaaaaggatctgggacctaaaccggctcttatcggccaccgtggcgcaccaatgctcgcccctgagcataccctgatgtcctttaggaaagctctggaacagaagctttacggcctgcaagcggacattactatctccctcgatggtgtaccctttctgatgcatgacacaaccttaagaagaactaccaatgttgaggaggagtttcccgagctcgcgcgacggccagcttctatgctgaattggactacattgcaacgattgaacgccggtcagtggtttttgaaaaccgatccattctggacagcgagctcactgtcgccatctgatcatcgcgaagcccagaaccagtccatctgctccctcgctgaactcctcgaattggccaagggtaacgcaaccttgctcctaaaccttcgagacccgccacgcgagcatccttatagaagcagctttataaatgtgaccctcgaagccgtactgcatagcggattcccccagcaccaggttatgtggctcccaagtcggcaaagacccctagttagaaaggtagcccctggctttcagcagacatctggaagcaaagaggcagtggcgtcactgagaagaggccatatccagcgactcaatttgagatacacccaggtgagtaggcaagaactccgggactacgcatcatggaatctctcggtgaacctttataccgtgaatgcaccttggctctttagtcttctctggtgtgccggagtcccttcagttacttcagacaattcgcacgctctttctcaggtcccctctcccctttggattatgcctcccgacgaatactgcctgatgtgggtaactgccgatctggtgtcctttactctgattgtggggatattcgtactccagaaatggcgtttggggggaatccggtcctataatccggagcagatcatgctcagcgcagctgtgagacggacgtctagagacgtgtctattatgaaggagaagttgatcttctctgaaatctcggatggggtagaagtctcggatgtcctgtcagtgtgcagtgacaactcttacgatacatatgcaaactcaacggccacccctgtaggccctcggggaggagggagtcacactaagacgctgattgagcggtccgggaggtag

SEQ ID NO: 224974 - DNA, 1083 bp, Artificial Sequence
  Description of Artificial Sequence: Synthetic coding sequence
atgagcttcaggaaggccctggaacagaagctctacgggttgcaggctgatatcaccatctctctagacggcgtcccgtttttaatgcacgatactacgcttcggagaactacaaacgttgaggaggagtttcccgagctggccaggagacccgcatcaatgttgaactggacgactttgcagcgtttaaacgccggtcaatggtttcttaaaacagatcccttttggaccgcgtcctccctctcccctagcgatcatcgcgaagcccagaaccaaagcatttgctcactagcggagctcctggagctcgccaagggcaatgccactctgctcttgaacttgagagaccccccacgtgagcatccctatcgatcatcattcataaatgtcaccctcgaggccgtactgcactcagggtttccgcaacaccaggtcatgtggctgcctagcagacagcggcctcttgttcgcaaagtggctcctggattccagcagacttcaggttcaaaagaagctgtggcctccctgagacgcggacatatacagcgcctgaatcttcgctacacacaagtgtctcgacaggagctgcgcgattacgcatcttggaacctgtctgtgaacctgtacaccgtcaacgccccttggctattttcgcttttgtggtgcgctggagtcccgagcgtaacttccgataattcacatgcgctgtcccaggtaccatctcctctttggattatgcccccagacgagtactgcctgatgtgggtcactgccgatttggtgtctttcactcttatcgtgggtatctttgttctccagaaatggcgcctgggagggatcagatcttacaatcccgagcaaattatgttgagtgcagctgtcaggagaactagtagagacgtctcaatcatgaaggagaaattgattttctccgaaatttcggatggagtcgaagtctccgacgtcttaagtgtctgctctgacaactcctatgacacgtacgccaatagcacggctacacctgtggggccacgcggtgggggtagccataccaagaccctcatcgaaaggagcggacggtag

SEQ ID NO: 224975 - DNA, 1272 bp, Artificial Sequence
  Description of Artificial Sequence: Synthetic coding sequence
atgctgagggtgcgctgtctacggggtggatcaaggggtgcagaagctgttcactatattgggtcgcggctggggcgtactctgacaggatgggtgcagaggacttttcagagcacgcaagcagcgaccgctagttctagaaacagctgcgcagccgacgacaaggctacggagccgctgcccaaggattgcccagtaagtagctacaatgagtgggatcccctggaggaagtgatcgtgggtcgcgcagagaacgcctgcgtgccaccattcaccatcgaagtgaaggcaaatacctatgaaaaatactggccattctaccagaagcaaggcggacactattttcctaaggaccacttaaagaaggccgtggctgagatcgaagagatgtgcaacattcttaagacagagggggtgactgtgcgcagaccagaccccatcgactggagcttaaagtacaaaacgccagatttcgagtctaccgggctgtacagcgccatgcctagggatattctgatcgtcgtggggaacgagattattgaagcccctatggcatggaggtcaaggtttttcgagtaccgcgcttaccggtctatcataaaggattactttcaccgcggagccaagtggacaacggctccaaagcctacaatggcagatgagctttacaaccaggattacccaatccattccgtggaagaccggcacaagctggcggctcaaggcaaattcgtgaccacagaatttgagccttgctttgatgcagcggatttcatcagggctggcagggatatctttgcccagagaagccaggttactaattatcttgggatcgaatggatgcgccgacaccttgccccagactatcgcgttcacatcatctcctttaaggaccccaatcctatgcacattgacgccacttttaacataatcggtcccggaatagtactctcgaatccagaccgcccatgccaccaaatcgacctctttaaaaaggctggctggaccattataacccctcctaccccaatcattcctgacgaccaccctctgtggatgtcctccaagtggctgtctatgaatgtgcttatgctggatgagaagcgggtgatggtggatgccaacgaggtgccaatccagaaaatgtttgagaagctgggaatcacgactatcaaggtgaacataaggaacgcaaacagtttagggggaggctttcactgttggacttgtgacgttagacggaggggcacgctgcagagctatctcgattag

SEQ ID NO: 224976 - DNA, 1176 bp, Artificial Sequence
  Description of Artificial Sequence: Synthetic coding sequence
atgctgcgcgtgaggtgtctgaggggtggatcccgaggggctgaggcggtgcactatatcgggtcgagattgggacggaccctgactggatgggtgcaaagaacgttccaaagcactcaagccgcaacagcctcatcgcgcaactcatgcgctgctgacgataaagctaccgaaccattgcccaaagactgccccgtcagttcatacaacgaatgggatccactcgaagaagtaatcgtcggcagggccgaaaacgcttgtgtgcccccatttaccattgaggtaaaagcaaacacctatgagaaatactggccattctatcagaagcagggaggtcactattttcctaaagatcatctgaagaaagccgtcgccgagattgaagagatgtgcaatattctgaaaactgaaggagtaacggttaggcggccagaccctattgactggtcccttaagtataagacccccgacttcgagtctactggtctgtacagcgccatgcccagggacatcctaatcgtggtgggaaacgaaataatagaagccccaatggcatggagatctcgtttcttcgagtaccgggcatacagaagtattataaaggactatttccacagaggtgcgaagtggacaaccgcccctaaaccgactatggcggatgaactgtacaaccaagattatcccatccactctgtggaggatcgccacaagcttgccgcacaaggtaaatttgttacaacagagtttgaaccttgcttcgacgctgccgattttatccgagccggacgggatatctttgctcagagatcgcaggtaactaactatctcggaatagaatggatgcgtcgacacctggctcctgattatcgggtccacattataagttttaaggatcccaacccgatgcacattgacgccacctttaacattattggccctggaattgtgctctctaaccctgacaggccgtgccatcagatcgacctcttcaagaaagcaggatggacaattattactcctcccacgccgatcatcccggacgatcaccctctttggatgagtagcaagtggctgtcaatgaatgtgctgatgctggatgagaagcgagttatggtagatgcaaatgaggtgccaattcagaagatgtttgagaaattgggaatgtacaacaagtag

SEQ ID NO: 224977 - DNA, 1260 bp, Artificial Sequence
  Description of Artificial Sequence: Synthetic coding sequence
atgtggccaggcaatgcgtggcgggctgcactgttctgggttcctcgcggacgtagagcacagtctgcgctggcccagctcaggggcatcctcgagggcgagttggaaggcattcgaggagcagggacctggaaaagtgaacgggttattacatcaaggcaaggcccacacatcagggtggacggcgttagcggcggaatcttgaatttctgcgccaacaattatctcggcctctccagccaccccgaagtgattcaggcagggttgcaggctctggaggaattcggagccggactctcttcggtccggttcatctgtggaacacagagcattcacaaaaaccttgaggccaagattgcgaggttccatcagagagaggatgcaatcctctacccgtcatgctacgacgctaatgccggactcttcgaagctctcctaacgccagaggacgccgtgctttccgatgaattgaaccacgcatccattatcgatgggatccgcttgtgcaaagcgcataaatacaggtaccgccatctggacatggctgatctggaagcgaagcttcaggaggcgcagaaacatcgacttcggttggtcgcaaccgacggcgctttcagcatggatggcgatatagccccattgcaagagatttgctgcctggccagccgatatggagccctggtgtttatggacgagtgtcatgccaccggttttttggggcctaccggcagggggacagatgagcttttgggcgtgatggaccaagtgaccatcatcaactctactctaggtaaagcacttggaggggcttcgggaggctataccacaggacccggtcccctggtaagtttgctgagacagcgcgcaagaccatacctctttagtaactccctgccaccagccgtggtggggtgtgccagcaaggcgctcgatctgctcatggggtcgaatacaattgtgcaatctatggcagcgaaaacacagaggtttcgttcaaagatggaggccgctggcttcactatttccggcgcatcccatcctatctgcccagtgatgcttggggacgctaggttggccagccgaatggcagacgatatgcttaaacgagggatcttcgtcataggattctcttatccagtcgtgccaaagggcaaagcaaggattcgagttcagatcagcgcagtgcattctgaagaagacatcgaccggtgcgtggaagcctttgtagaggtggggagactgcacggggctctgccctag

SEQ ID NO: 224978 - DNA, 1338 bp, Artificial Sequence
  Description of Artificial Sequence: Synthetic coding sequence
atgtggccagggaacgcctggcgggcagcactcttttgggttcctcggggaagacgagcccagagtgcactggcacagctcagaggaattctagagggagaattggagggaatcagaggagcagggacatggaagtctgagcgcgtcataacttcgaggcagggccctcatatccgagttgacggggtgtcaggcggaccgggaactgtgatttttcctggcctgcctctaccgcatttgagctgttgtatacacctgctgagcttcacttcaggaatacttaatttctgcgccaataattaccttggccttagtagccatcccgaggtgattcaggcagggctgcaggctctggaagagtttggagccggactatccagcgtcagattcatctgcggcacgcaatctatccataagaatctggaagccaaaatcgccaggttccaccagcgggaggacgcaattttgtacccaagctgctacgacgccaatgcaggcttgttcgaggcccttcttacacccgaagatgccgttctaagtgatgaacttaatcatgcctcaattatcgacggcatacggctgtgcaaggcacacaaatatcgctaccggcatctggatatggcagacttagaagccaagctgcaggaagcacagaaacatcgcctgcgtctcgtagccactgacggtgccttctctatggacggcgatatcgccccactgcaggaaatctgctgtctggctagtcgatacggggctctggtgttcatggacgaatgccatgctacagggttcttgggtcccacggggcgaggtacggacgagttgctcggcgtaatggaccaagtgaccatcattaattctactctgggcaaggcactcgggggtgcttctgggggttataccaccggccctggtcccttagtttctctccttagacagcgtgccagaccctatctcttttccaatagcttgccacctgcagtcgtcgggtgtgctagtaaggcactcgaccttctcatggggtctaatacgatcgtgcagtctatggcggcaaagacccagcggttccggtctaaaatggaggccgctgggttcacaatctctggtgcatcccacccgatttgtcccgtaatgctaggcgatgcgagactggctagtcgaatggccgatgacatgcttaagaggggtatctttgtgataggcttctcctatcctgttgtgccgaaagggaaagcacgtattcgagtccagatcagtgcggtccactcagaagaagatatcgaccggtgcgtggaagctttcgtcgaggtgggacgtcttcacggcgcactcccatag

SEQ ID NO: 224979 - DNA, 744 bp, Artificial Sequence
  Description of Artificial Sequence: Synthetic coding sequence
atgtggccagggaacgcctggcgagccgcacttttctgggtgcccaggggccgacgggcacagagcgccctggcccagctgcggggaatattggaaggcgaacttgaggggatccggggagctggcacctggaagtccgagcgtgtgataaccagccgtcagggccctcatatccgggttgatggggtgagcggcggacccggaaccgtcatcttccctggactgcctctgccccatctatcgtgttgtatccacctcttatcttttacaagtggtatcctgaacttctgtgcaaataattatctgggactgtcttcccatccagaggttattcaagccggtcttcaggctttagaagaattcggcgctggcctctcttctgtgcgcttcatttgtggtacccaatccatccacaagaatttagaagctaagattgcaagattccatcagagagaggacgccatattgtacccaagctgttacgacgctaacgcagggttgttcgaggccttgttgacgccagaggatgctgtgctgtccgacgagctcaaccatgcctccatcattgacggaatccggttatgtaaggcacataaatatcgctaccgccacttagacatggcagacttggaggcgaagttgcaggaagcccaaaagcatcgacttcgcctagtggctaccgatggagcctttcacggctggagacaccgaaccccagccggagacctcctgccacgactttag

SEQ ID NO: 224980 - DNA, 522 bp, Artificial Sequence
  Description of Artificial Sequence: Synthetic coding sequence
atggcactgcgcgtggttcgatctgtcagagccctgctgtgtacattgagagctgtgccttcacccgcagcaccgtgtccacctcgcccttggcaactgggggtcggggctgtgcgtacattgcgcacgggacccgcactcctgtctgtgcgaaagttcaccgagaaacacgagtgggtgacgacggagaatggtattggaacggtcgggatctccaacttcgcgcaggaagccctcggagatgtggtctactgcagccttcctgaggtcgggaccaagcttaataagcaggacgagttcggagccctcgagtctgtcaaagcagcatcagaattatacagtccactgtcgggtgaggtcaccgagattaacgaagcactagccgaaaatccgggactagtgaataagtcgtgctacgaggacggttggcttatcaagatgaccctttccaacccaagcgagctggatgagctgatgtccgaagaagcatatgagaagtacatcaagtccattgaggaatag

SEQ ID NO: 224981 - DNA, 3063 bp, Artificial Sequence
  Description of Artificial Sequence: Synthetic coding sequence
atgcaaagctgcgccagagcgtggggtctgagactcggtcgaggagttgggggtggccgacggcttgccggtggcagtggcccttgttgggcccctagaagccgggactcatcttctgggggaggggattcagccgctgctggtgcctccaggctccttgaacgcctcctgcctcggcatgacgattttgcaaggcgccacatagggcctggggataaggaccagcgcgaaatgcttcaaaccttgggccttgcctctattgatgagctgattgaaaagaccgtgcccgcaaatatccggctgaagcggcctctcaagatggaggacccagtttgtgagaatgaaatcttggctacactgcacgcaatctcaagcaagaaccagatttggaggtcctatattggtatgggatactacaactgctccgtgccccaaaccatcctgcgcaacttgctggaaaattccggttggataacccaatacaccccgtatcaaccagaggtcagtcaaggcaggctggagtcactcctgaactaccagaccatggtgtgcgatattacaggcctcgatatggccaacgcatctcttttggatgagggcacggccgctgccgaggcactgcagctgtgttatcggcacaataaaaggagaaagtttctggtggatcctcgctgccatccacagacgatcgctgtggttcagacccgggcaaaatacactggtgtacttactgaactcaaactgccgtgtgagatggactttagcggtaaagacgtgtcaggcgttctttttcagtacccagatacagagggaaaagtggaggactttactgaactcgtggaacgtgcccaccagtcggggagcttggcctgctgcgcaaccgatttgcttgcattgtgcattctccgcccaccaggcgagtttggtgtggacatagctctgggctctagccaaagatttggagtccccctgggttatggtggacctcacgcggcattcttcgcagttcgtgaatcactcgtcaggatgatgcccggacggatggtgggggtgacaagagacgctaccggcaaagaggtctaccgcctggccttacaaactcgggagcagcacattcgacgagataaggccacatcaaacatctgtacagcccaagcgctgcttgcaaacatggcggctatgtttgccatctaccacggatcccacggccttgagcatatagcccgacgagtccacaacgccactctgatactcagcgagggccttaagagagctggacaccagctgcagcacgacctattctttgatacactaaaaatacagtgtgggtgtagcgtgaaagaggtgctcgggagagctgcccagagacagatcaactttcggctctttgaagacggtactcttggaatcagcttggacgagactgttaatgaaaaggacctggatgacctgctgtggatttttggatgtgaaagttcagctgaactggtcgccgagtccatgggagaagaatgtcgcggtattcccggttctgtgttcaaacggacgtctcccttcctaacacatcaggtgttcaattcttatcactcggaaactaacattgtccgatatatgaaaaagctagagaataaagacatcagcctggtgcattccatgatccctctagggtcgtgtactatgaagttgaatagtagtagcgagctggctcctataacttggaaggaatttgcaaacatacacccattcgtcccactcgaccaagcacagggctatcagcagctcttccgcgaactcgagaaggatctctgcgaactcactggctatgatcaagtttgcttccaacctaacagcggtgcccaaggagagtacgcgggattagctacgatcagggcctatctgaatcagaagggggagggccaccgaacagtgtgccttattcctaagtcagcacacggcacaaatccagcgagcgcccacatggcgggaatgaaaattcagcccgtagaggttgacaagtacggcaacatagatgccgtgcatctaaaagcgatggtcgataaacataaggagaacctagcagccatcatgataacctatccttctaccaatggggtttttgaagagaatatcagcgatgtctgcgacctgatacaccagcacgggggacaggtctacttagacggcgctaacatgaatgcgcaggtgggcatttgcagaccaggcgatttcggaagcgacgtgtcacacctcaacctccataagacattttgcatacctcacggtgggggagggcctggaatgggtcccatcggcgtgaaaaagcacctggccccattcctccccaatcacccggtgatttccctaaagcgtaatgaggatgcctgtcccgtaggaaccgtgagtgctgcaccgtggggctctagcagtattctgccaatttcttgggcctatattaaaatgatggggggaaagggccttaaacaggccaccgaaaccgctatccttaatgcgaattatatggccaaacgcctcgagacccattatagaattcttttccggggagcgcgtggatacgttggccacgaattcatactcgacacaagaccctttaaaaagtcagctaatatagaggccgtggacgttgccaagcgcctacaggattacgggtttcatgccccaacgatgagctggccagtggcgggaaccctgatggttgagcctaccgaaagcgaggacaaagcagagctggatagattctgtgacgcgatgatctccattaggcaggaaatagcagacattgaggaaggaagaatcgatcccagggttaatcccctgaaaatgagcccccactctctgacatgcgtaacgtcttcacactgggataggccgtactctcgggaggtcgcagcctttcccctgccttttgtaaaacctgagaataagttctggccaacaatcgctagaatcgacgacatctacggagaccagcacttggtgtgcacatgtcctcccatggaggtgtacgagtcaccattcagcgagcagaagcgagcctcgtcctag

SEQ ID NO: 224982 - DNA, 888 bp, Artificial Sequence
  Description of Artificial Sequence: Synthetic coding sequence
atggtggattcagtttacaggaccagatcactgggtgtggccgcagagggactgccagatcagtacgccgacggcgaggccgctagagtgtggcagttgtacattggagatacccgatcacggacagccgagtacaaagcttggctattgggactgctgcgccaacatggctgccagagggtgctggatgtcgcctgcgggaccggcgttgatagcattatgcttgtcgaagagggtttcagcgtaacatcagttgacgcgtcagataagatgctgaagtatgccctgaaagagcgctggaaccgcaggcacgaacccgcattcgacaagtgggtgatcgaagaggccaactggatgacattggataaggatgtcccccagtccgccgaaggcggatttgacgcagtgatttgcttgggaaattctttcgcccacctgcctgactgtaagggggatcaatctgagcatagattggccctcaaaaacattgcttctatggtaagagcaggtggcctgctggtcattgaccaccgcaattacgaccatatactatcaacgggttgcgcgcctcccggaaaaaatatctattacaagtcagacctgaccaaagacgtgacaacatctgtcttaatcgtcaacaataaggctcatatggtcactctggactataccgtgcaggtgccaggggctggacaggacgggtcccccggactgtctaagtttcgcctgagctattaccctcactgcttggctagcttcactgagctgctccaggccgcttttggcggaaaatgccaacactccgtcttgggcgatttcaagccttataagccaggtcagacttacataccttgctattttattcacgtgctgaagaggaccgattag

SEQ ID NO: 224983 - DNA, 1350 bp, Artificial Sequence
  Description of Artificial Sequence: Synthetic coding sequence
atgtatagcttcaatactctgagactgtacctatgggaaacaatagtattcttcagcctcgccgcaagcaaggaagctgaggcagctagaagtgcgcctaaacccatgagcccaagcgactttctggataagcttatgggcagaacatctgggtatgatgcccgtattcggcctaactttaaaggcccaccagtgaatgtcagttgtaatattttcattaattcctttggatctatcgcagaaacaacaatggattaccgggtcaatatctttctgaggcagcagtggaatgacccacgcctggcgtataatgaataccccgatgacagcctcgaccttgatcctagcatgctggattccatctggaagcctgatctgttcttcgctaatgagaaaggagcacattttcatgagataacaactgacaataagctgttgcggattagcaggaacgggaacgtgctctattcgatccgcatcactttgacattagcttgtcccatggatctgaagaactttcccatggatgtgcagacctgcattatgcagttagagtcgtttggatatacgatgaatgatctcatcttcgaatggcaggaacagggtgcggtgcaggtcgccgatggacttacactcccacaatttatcctgaaggaagagaaagatctcaggtattgcacaaaacactataatacaggtaagttcacctgtattgaggcacgcttccacctggagcggcagatgggttattatctcattcagatgtacatcccctcacttttgatcgtcatcctgtcttggataagcttctggatcaacatggatgcagcccctgctcgggtagggctcggaattacaaccgtgttgactatgacaactcagtcatcaggtagcagagcctccctccccaaggtctcttacgtgaaggccattgatatttggatggccgtatgcctgctattcgttttctccgcgctgcttgagtacgctgccgttaattttgtgtctcggcagcataaagagctcctgcgttttcgaagaaagaggcgccaccacaaagaggatgaagcaggcgaaggtaggtttaacttttccgcgtatggaatgggtccggcttgtctgcaggcaaaggatggaattagcgttaagggagccaacaattctaatacaactaatccacctccggcaccctcaaaatctccagaggaaatgaggaaactcttcatccagagggctaagaagatcgacaaaattagccggataggattccccatggcttttttaatatttaatatgttttactggatcatctataagattgtgaggagagaagacgtgcataatcaatag

SEQ ID NO: 224984 - DNA, 1374 bp, Artificial Sequence
  Description of Artificial Sequence: Synthetic coding sequence
atgtactctttcaacaccttaaggctctacctatgggaaactattgtgttcttttctctcgctgccagtaaggaggccgaggctgctcggtcagcccctaagcctatgagcccctctgacttcctcgacaagctcatgggccgaacgagcggctacgacgcacgcatacgacctaactttaaggggcctcctgtgaatgtgtcttgtaatatcttcatcaacagtttcggcagcattgccgagacaacgatggattatcgagtcaacatcttcctgagacaacagtggaatgacccgcgattggcttacaacgagtatccagacgactcgctcgatttagatccatctatgctggattctatttggaagcctgacctgttctttgccaatgaaaagggggcacacttccatgagatcacaaccgacaataagttattgaggataagcagaaacggtaatgttttgtactccatccgcattaccctcaccttggcgtgcccgatggatcttaagaatttcccaatggacgtgcaaacatgcataatgcagcttgagagctttgggtatacgatgaacgacttgatattcgaatggcaagagcagggtgcggtccaggtggccgacggactgacactgccccaatttattctgaaggaggagaaagacctccggtactgtacaaaacactacaataccggcaaatttacttgcattgaagctcgcttccaccttgagagacaaatgggatactacctgatccaaatgtatataccaagcctgctaattgtaatactaagctggatctctttttggattaatatggacgcagcccctgcgcgtgtaggattgggaatcacgacagtgctgacgatgaccacacagagtagcgggtcacgggcatcccttcccaaggttagttatgtgaaggccatagatatttggatggcagtgtgccttctcttcgtttttagtgcactgctcgagtatgcagcagtgaatttcgtgtcccgccagcacaaggagctgttgcgatttcgacgaaagcggcgacaccataaatctcccatgctgaatctattccaggaagacgaagccggagaagggcgtttcaacttctctgcatacggtatgggaccggcatgtctccaggccaaggatggcatctccgtcaagggagcgaacaactccaacaccacaaatccccctccggctccatccaagtccccagaggagatgcggaaactgttcattcagagggctaagaaaattgacaagattagtcggataggtttcccaatggcgtttctcattttcaacatgttttattggattatctacaagattgtgcgtcgggaagatgtacacaatcagtag

SEQ ID NO: 224985 - DNA, 1101 bp, Artificial Sequence
  Description of Artificial Sequence: Synthetic coding sequence
atggactacagagtcaacattttcctgaggcagcagtggaatgaccctcggttagcctacaacgaataccccgacgattcccttgacctcgacccctccatgctcgactctatctggaaacccgacctctttttcgccaatgaaaagggagcccactttcatgagatcacaactgacaataagctcctgcgcatctcccggaacggcaacgtgctttattctatccgtataactctcaccttagcttgtcctatggacttaaaaaatttccccatggacgtacagacctgtattatgcagttggagagtttcggctataccatgaatgatctgatctttgagtggcaagagcagggtgccgtccaagtggccgacggactcaccttgccgcaattcatcctgaaggaggagaaggaccttagatactgtactaaacactacaacactggaaagttcacatgcatcgaagcaagatttcacctggagagacaaatgggctattacctgatccagatgtacattccatctttattgatcgtgattctgtcttggattagcttttggattaatatggacgccgcaccagcccgagtggggctgggaatcacaactgtcctgaccatgaccacgcagtcaagcggttcaagagcgtcgcttcctaaggtgtcatacgtgaaagctatcgacatatggatggcagtgtgtctgctgtttgtgttttctgccctgctggagtacgctgctgttaacttcgtgagcagacagcacaaagaactcctgagatttcgaagaaaaagacggcatcacaaggaggatgaggcaggagaaggaaggttcaacttctcagcctatgggatgggccctgcctgcctccaggcaaaagacggaatttctgtcaagggcgcaaataatagtaatacgacaaaccctcctccggctcccagcaagtctccagaggagatgaggaagctcttcatccaacgcgctaagaagattgataagatcagcagaatcggcttccctatggccttccttatcttcaacatgttttactggataatatacaagattgtccggcgtgaggatgtgcacaaccagtag

SEQ ID NO: 224986 - DNA, 309 bp, Artificial Sequence
  Description of Artificial Sequence: Synthetic coding sequence
atgtcagcgcgagttcgctcacggtcgcgcggaaggggcgacggccaggaggctccagacgtggttgccttcgttgctcccggagagtcacagcaagaggaacccccaactgacaaccaggacatcgagccgggtcaggagagagagggaactcctcccatcgaagaacgtaaggtagaaggcgattgccaagaaatggatctggaaaagacccggtcagagcgcggagacggctcggatgtgaaggaaaagactcctccaaatcctaaacacgctaagaccaaagaagccggtgatggtcagccatag

SEQ ID NO: 224987 - DNA, 1359 bp, Artificial Sequence
  Description of Artificial Sequence: Synthetic coding sequence
atgaaccgtcaactcgttaacatactgacagccctcttcgcgttcttcctagagaccaaccactttagaacagccttctgtaaagaccatgactcaaggagcgggaagcagcctagtcagactttgagcccctctgactttctcgacaaactcatgggccgtacatccgggtacgatgcacgaatcaggccaaatttcaagggaccacccgtgaacgtgacatgcaatattttcatcaattcttttggaagtattgcagaaactaccatggattatcgtgtgaacatctttctccgtcaacagtggaatgattctcgactggcatactctgaatatcccgatgactccttggacttggatccgtcaatgctagacagcatttggaagcccgatctgtttttcgccaacgagaagggagctaacttccacgatgtgacgactgataataaactgctgcggatttcaaaaaacggaaaggttttgtatagcattaggttgactctcaccttgagctgcccaatggacctgaagaattttcccatggatgtgcagacttgtaccatgcaactcgaatcttttggatatacaatgaacgacctgatctttgagtggctctccgacggacccgtacaggtggccgagggcctgacgttgcctcaattcattcttaaagaggaaaaagagctcggctactgcacaaagcactacaacaccggaaagtttacttgtattgaagtgaaattccacctcgaaaggcagatggggtactatctgatccagatgtatatcccttctctccttatcgttatcctctcctgggtctcgttttggattaatatggacgccgctccagccagagtggcgttagggatcacaactgtcctcaccatgacgacacagagctcgggcagcagagcaagcttaccaaaagtatcctacgtcaaagccattgatatctggatggccgtttgtttactcttcgtctttgctgccctgctggaatatgccgctgtcaattttgtgtccagacaacataaagagtttctgcgactgcgacgacgccagaagcggcagaacaaagaagaggatgtgacaagagaatctaggttcaatttctcagggtatgggatgggccactgtctccaggttaaggatgggacagctgtgaaggccactccagcaaacccgttgcctcagccacccaaagacggcgacgcgatcaagaaaaagtttgtggatcgggcaaagaggatcgataccatctctagagccgctttccccctggccttcctgatctttaatatcttttattggataacatacaaaatcatacgccatgaagacgtccataagaaatag

SEQ ID NO: 224988 - DNA, 648 bp, Artificial Sequence
  Description of Artificial Sequence: Synthetic coding sequence
atgaacctgcatatgaggatgacagcattttgtaaggatcacgattcacggtccggcaaacagccttcccaaaccttaagccctagtgacttcctggacaaactgatgggcaggacatcaggctacgatgcccgaattaggcccaatttcaaaggcccacctgtcaatgtgacatgcaacatcttcataaatagctttggctctgtcaccgaaacaacaatggactacagagtgaacatctttctgcggcagcagtggaatgattctcgactcgcatactcagagtatccggatgattcccttgacctggatccttcaatgctggacagcatctggaagccagacctgttctttgctaacgagaaaggtgccaattttcacgatgttacgacagataacaagcttcttcgaataagcaaaaatggcaaagtactgtatagcattcgtctgaccctaacactttcctgtccgatggatttaaaaaacttccccatggacgtccagacttgtactatgcagctggagagctttggctacacaatgaacgacttaatctttgagtggctttccgatggccctgtccaggtcgcagaagggcttactcttccccaattcattctaaaagaggaaaaagagctagggtactag

SEQ ID NO: 224989 - DNA, 1092 bp, Artificial Sequence
  Description of Artificial Sequence: Synthetic coding sequence
atggactatcgtgtcaacattttcctgcgccaacaatggaatgactctaggctggcatacagcgagtaccccgacgactcacttgacctggaccccagcatgctcgatagtatctggaaaccggatctgttcttcgccaacgagaagggagccaattttcacgatgtcactacagataacaagctgctgcgtatctctaaaaatggaaaggtcttgtactcaattcgactgacactgacattgtcatgccctatggatctgaagaatttcccgatggatgtccagacatgcaccatgcagctcgagtcctttggctacaccatgaacgatctgatatttgaatggctaagcgacggacctgtgcaagtcgccgaggggctgaccctgccacagtttattttgaaggaggaaaaggagctggggtactgtacgaagcattacaacaccggaaagttcacgtgcatcgaagtgaagttccacctggagcgccagatgggctattacctgatccagatgtacattcccagccttctcattgttatcctcagctgggtctccttctggataaatatggatgcggctccggctagggtagccctcggaatcacaaccgtcctaactatgacaacccaatccagtggttcccgagccagtctgccaaaagtgagttatgtaaaagctattgacatttggatggcagtctgtcttctttttgtttttgccgcacttctggagtatgccgcagtgaactttgtctctcgccagcataaagaattccttagattacggagacgacagaaaagacaaaataaagaagaggacgtgactcgagagagcagattcaacttcagcgggtacggtatgggacactgcttgcaagttaaagacggcactgccgttaaagcaacacctgcaaaccctctgccacagcctcctaaagatggggacgcaatcaagaagaagtttgtggaccgcgctaagcggatagacaccatctcacgcgctgcctttcctctggcgttccttattttcaatatcttttattggataacctacaagatcatacggcatgaggatgtgcacaaaaaatag

SEQ ID NO: 224990 - DNA, 1395 bp, Artificial Sequence
  Description of Artificial Sequence: Synthetic coding sequence
atggcacacgtccgtcactttcggacactggtatccggcttctatttttgggaagctgccctgctgttgagcttggtcgcaacaaaggagaccgatagcgcacgcagccgtagtgcgcctatgagccccagcgactttctagacaaactgatgggtagaacatccggctatgacgcaaggataagacccaatttcaaaggcccacctgtaaatgtgacctgcaatatcttcattaactccttcggaagcatcgcagaaacgaccatggactatagggtgaatattttcctgaggcagaagtggaatgatcccaggctggcctacagcgaataccccgatgattctctggacctggacccgagcatgctggattctatttggaaacctgatctgttctttgctaacgaaaagggtgctaattttcacgaagtgactacagataataagctgctacgtattttcaaaaatggaaatgtcctttatagcatcaggttgacgctgaccctgtcatgtccaatggacttgaagaacttccccatggatgtgcagacatgtattatgcagctcgagtcctttggttataccatgaatgatctgatctttgaatggcaggacgaagcgccagtccaagttgctgagggcctgactttgccgcagtttttattgaaggaggaaaaggatctgagatattgtactaagcactacaacaccggaaagttcacctgcatcgaggtgcggtttcatctggagaggcaaatgggttattatttaatccagatgtatatccccagcctgctcattgtgattttatcctgggtgagcttctggatcaatatggatgcggctcccgctagagtggcccttggcatcaccacggtgctgaccatgacgacacaatcaagcgggagtagagccagtctgcctaaggtgtcctatgtcaaagcaatcgacatatggatggcggtgtgcctcttgttcgtgttctcggctctactggaatacgcggcagtcaactttgtaagcaggcagcataaggaactgcttagattccgacggaaaagaaaaaacaaaacagaggcctttgccctggagaaattttaccgattttctgacatggacgacgaggtgagggagagccgtttttcctttacggcctacgggatgggaccatgcctacaagctaaggacggcatgacaccaaaggggcctaatcatcctgtgcaggtaatgcctaaatccccagatgaaatgcgcaaagtgttcatcgatcgtgctaagaagatcgataccattagtagagcttgtttccctctggccttcctgatctttaatatcttctactgggtgatctataagattcttagacatgaagatatccatcaacagcaggattag

SEQ ID NO: 224991 - DNA, 1350 bp, Artificial Sequence
  Description of Artificial Sequence: Synthetic coding sequence
atggctcatgtgcgtcatttccggactcttgtgagtgggttctatttctgggaggcagcactgctgttatctttagtggcaacaaaagagacagattccgcccgttctaggagtgcccctatgagcccgagtgacttcttagacaagctgatggggcgtacatcaggatatgacgcgaggatacgacctaactttaaaggtcctccagtcaatgtcacctgcaacatctttatcaactccttcggttctatcgcagagaccaccatggactatagagtgaatatcttcctccgccagaaatggaatgatcccagactggcatacagtgagtatccggatgattcccttgatctcgacccatcaatgctggactccatctggaaaccagatctcttctttgccaatgagaaaggcgctaactttcatgaagtaacaactgataataagctgctgcgcattttcaagaacggcaacgtgctctactccatcagactcaccctcacgctgtcatgccccatggatttaaaaaactttccaatggacgtgcaaacgtgcatcatgcaactggagagcttcggctacacgatgaacgacttgatctttgaatggcaggacgaggcccctgtccaggtggcggaaggactcacgctgccacagttccttctgaaggaggagaaagatttgaggtactgcacaaaacattacaatactgggaaattcacttgcatcgaggtgagatttcatcttgaaagacagatggggtactaccttattcaaatgtatattcctagcctgctgattgtcatcttatcttgggtctctttttggatcaacatggacgcagctccggcacgggtggccctgggcattaccacagtgttgacgatgacaacacagtctagcggatctcgagctagtttgccaaaagtgtcctacgtgaaggccattgacatttggatggccgtttgccttctgttcgtctttagcgccctattggaatacgccgcagtgaactttgtatcccgccaacacaaagagttacttcggttcaggaggaagcgaaaaaacaaggatgacgaggttagggaaagtcgattttcttttacagcctatggaatggggccatgcctccaggctaaggacgggatgaccccgaaagggcctaaccaccctgtccaggtgatgcccaaaagtccggacgaaatgcgcaaggtattcattgaccgggcaaaaaaaatcgacacaatatcccgggcatgctttcccttggccttcctaatatttaacattttctactgggttatctataagatactccgccacgaggatatccatcaacaacaagattag

SEQ ID NO: 224992 - DNA, 1494 bp, Artificial Sequence
  Description of Artificial Sequence: Synthetic coding sequence
atgaagttccttctgactaccgcctttctgatccttatctcactctgggtcgaagaggcttacagtaaagaaaaaagcagcaagaaggggaagggaaaaaagaaacagtatctgtgcccttcacagcagtccgccgaagatttagccagagtgccagccaacagcacgtctaacatcctgaaccgtttgttagtcagctacgatcctagaattagaccgaattttaaaggcattcctgtcgacgtggttgtcaatatattcataaactcctttggctcaattcaagagactacaatggattatcgggtgaacatcttcttgcgacagaagtggaacgacccacggctgaaactgcccagcgatttccggggatcggacgccttgacagtcgatcctaccatgtataaatgcttgtggaaaccggatttattttttgctaatgagaagtctgcaaatttccacgacgttacccaggagaatattcttctctttatctttcgggacggcgatgttttggtaagtatgcggctctccatcactctgagctgtcctctcgacctgacgctctttcctatggatacccagcgctgtaagatgcagttagaatcattcggatatacaacagacgatctgaggtttatctggcaaagcggggatccagtccaattggaaaaaatcgcattgccccaattcgacattaagaaagaagacattgaatatggcaactgcacgaagtactacaagggcaccgggtattacacttgcgtggaagtgatctttactctgagaagacaagtaggattttatatgatgggcgtttatgcacccactttattgattgtagttctgtcctggctgtccttctggatcaacccagacgcctccgcggctcgggtgcctctgggaatctttagtgtattgtcactggcttcagagtgcacaactttagccgctgagttacccaaagtgtcctatgtgaaggccctcgacgtctggctaatcgcttgccttttgtttgggttcgcgagcctggtcgagtacgcagtcgtacaggttatgttgaacaaccccaaaagagtagaggctgaaaaagctaggatcgcaaaggcggagcaggcagacggcaaaggcggaaacgtggctaaaaaaaatacagtgaacggcacgggcacaccagtccacatttcgacacttcaagttggggaaactcgttgcaaaaaggtgtgcactagtaaatccgacctcagatccaacgacttcagtattgtgggctctcttcctagggactttgaactgagtaattacgactgctatgggaagcctatcgaggtaaacaatgggctggggaaaagccaggccaagaataacaagaagccccctccagcaaagccagtaatccccaccgctgcgaagcggatcgacctgtacgcaagggcccttttcccattctgcttcctcttctttaacgtaatttactggtccatctatctttag

SEQ ID NO: 224993 - DNA, 1494 bp, Artificial Sequence
  Description of Artificial Sequence: Synthetic coding sequence
atgaaatttctgctcactactgctttcttgatcctgatctctctctgggtcgaggaagcctattctaaagaaaagagttctaaaaaagggaaaggaaagaagaaacagtatctgtgcccgtcgcagcagagcgctgaggatctagcgcgagtgccagccaattcaacgagcaacatcttaaaccggctgcttgtctcctacgaccctagaatcagaccgaatttcaagggcataccagtagatgtggttgtcaatatatttattaattcgttcgggtctatacaagagactacaatggattaccgcgtcaacatttttctgcgccagaaatggaatgacccacgattaaagctgccatccgatttcaggggatctgacgcactcaccgtggaccccaccatgtacaaatgcttgtggaagcctgacctgttttttgcaaacgagaaatcggctaactttcacgatgtgactcaagaaaatattctcctattcatcttccgcgacggcgacgttctagtatccatgcgcctgagcattactctttcctgtcccctggacctgacgctcttcccgatggacacccagagatgcaaaatgcagctggaaagtttcggctatactacagatgacctacggttcatctggcagtccggcgacccagtgcagctggagaaaatcgctctcccacaattcgatattaagaaggaagacattgaatatggaaactgtactaagtattacaagggaacgggatattacacttgtgtggaggtgatctttaccctgcgaagacaagttggcttttacatgatgggggtctacgcacccacgctgttgattgtggttctgagctggctgagcttctggatcaaccccgacgcatccgcggcacgcgtgcctctgggtatcttctctgtgctctccctggcaagcgagtgcacaactttggcggctgaactacctaaagtgagttacgttaaagcacttgatgtgtggctgatagcttgcttgctatttggattcgcttccctagttgagtacgctgtcgtgcaggtcatgttgaataatcccaagcgtgttgaggcagaaaaggcccgtattgccaaggccgagcaagctgatgggaaaggaggtaatgtcgccaagaagaataccgtcaacggcacggggacaccggtccacataagtaccctgcaggtaggtgagactcggtgtaagaaggtgtgtacttctaaatctgacctacggagtaatgacttcagtatcgtgggtagcttgcctagagatttcgagttgtccaattacgactgctacggaaaacctatcgaagtgaacaatgggttgggaaaatcccaggctaagaacaacaagaagcctccgccagccaagcctgtcatcccaacagccgctaaacgcatcgatctctatgcgagagctctctttcccttttgtttcctgtttttcaacgtcatctactggagtatttacctctag

SEQ ID NO: 224994 - DNA, 912 bp, Artificial Sequence
  Description of Artificial Sequence: Synthetic coding sequence
atgaagttcctgttaactaccgcttttcttattctgatatccctgtgggtggaggaggcctactctaaggagaaatcttctaaaaaagggaagggcaaaaagaagcaatatctgtgccccagtcagcagtccgctgaagacctcgcgagagttccggcaaattcaacctcaaacatcctcaacagacttctagtaagttacgaccctagaatccggcctaatttcaaaggcataccagtcgatgtggtggtaaatattttcatcaactcattcgggtcaatccaggaaaccacaatggattatagagttaatattttcctccgccagaagtggaacgatcctcgcctgaaacttccctctgatttcagaggctcggacgctctgaccgtcgaccctacaatgtacaaatgcctctggaaacccgacctgttctttgccaatgagaagtccgcaaatttccacgacgtaacacaagagaatatccttctcttcatcttccgtgatggggatgtccttgtcagcatgagactcagcattacactctcctgccccctcgacttgaccctgtttccaatggatactcagaggtgtaagatgcaactggagtcatttggctatacaacagacgacctgaggttcatctggcagagcggcgatccagtccaactggagaaaattgccttaccacaattcgacattaagaaggaggacatcgagtacgggaattgtaccaaatattacaagggcacgggatactacacgtgcgtcgaggtaatcttcacactgcgacggcaggtgggcttttatatgatgggcgtctacgcaccaacgcttctgatcgtcgtcctgtcctggttatctttctggatcaatcctgacgccagcgctgcgagggttcccctcggctggtag

SEQ ID NO: 224995 - DNA, 492 bp, Artificial Sequence
  Description of Artificial Sequence: Synthetic coding sequence
atgatgttgccccttcagggagctcagatgctccaaatgctcgagaagagcctgcgtaaatctctcccagcgtcgctgaaggtgtacggcaccgtgttccatatcaatcacggcaaccccttcaatctcaaagccgttgtggacaagtggcccgacttcaatacggtggtggtgtgccctcaagagcaggatatgacagatgacctggaccactatactaacacttaccagatttacagcaaagatccgcaaaactgtcaagagtttctgggctcccccgagcttattaactggaagcagcatctgcagatacagagctctcagccaagcctcaacgaggccattcagaacctggcagcaatcaagtccttcaaggtcaagcagactcagcgcatcttatacatggcagccgagaccgctaaagagctgactccatttctgcttaagtccaaaatcttgagcccaaacgggggaaagcctaaagcaatgtag

SEQ ID NO: 224996 - DNA, 891 bp, Artificial Sequence
  Description of Artificial Sequence: Synthetic coding sequence
atgatgttgcccctgcaaggcgctcagatgcttcagatgctggaaaagtcacttcggaagtctctgcctgctagcctgaaagtttacgggactgtatttcatattaatcacggtaacccttttaatctcaaggctgtggtggataagtggcccgacttcaacacagtggttgtgtgcccacaggagcaggacatgacagacgatcttgatcactatacaaatacgtatcaaatctattcaaaagacccccagaactgtcaagaattcctgggatcccccgagctgatcaactggaagcagcaccttcagatccagtcttcacagccctctctgaatgaagcgatccagaatctggcagccatcaagagctttaaagtgaagcagacacagagaatattatatatggccgctgagaccgctaaggagctcactccttttttactgaaatccaagatcttatccccgaacgggggaaagcctaaagcaatcaatcaagaaatgtttaaactcagcagtatggacgtgacccacgcccacctggtgaacaagttttggcatttcggtggcaacgagcgtagccaaaggttcatagagcggtgtatccagacatttccgacctgttgtttactaggacccgaagggacgccagtctgctgggacctcatggatcagacaggtgagatgcgcatggcagggacattgcctgagtacaggctacatggcctggtgacctacgtcatctacagccacgcacaaaaactgggaaagctcggttttcccgtatactctcacgtggattatagcaacgaggccatgcaaaagatgtcgtacaccttacagcatgtgcccattcccagaagttggaaccagtggaattgtgtgcctctctag

SEQ ID NO: 224997 - DNA, 891 bp, Artificial Sequence
  Description of Artificial Sequence: Synthetic coding sequence
atgatgctgcctttacagggcgctcaaatgctccagatgttggaaaaaagcttgcgcaaatctttgcccgcaagcctaaaagtgtatggcacggtctttcacataaatcacggaaaccctttcaacttgaaggccgttgtggataagtggccggatttcaacactgtggtggtttgtcctcaggagcaagatatgacggacgatttagaccattatacaaacacatatcagatatattcaaaagacccacagaactgtcaggagtttctcggtagccccgaattgattaattggaagcaacatctccagattcagagtagccagcctagcctgaatgaggcaatccagaacttagccgctatcaaatcattcaaggtgaagcagacccagcgcatcctctatatggccgctgagaccgctaaggagttgacaccgttccttttgaagagtaaaattcttagtcctaacggaggcaagcctaaggctattaaccaagaaatgttcaagttaagctccatggatgtgacacatgcacacttagtcaacaagttctggcacttcgggggtaatgaaagaagccagaggtttattgaaaggtgtattcaaaccttcccaacatgttgcttgctgggacccgaggggacacccgtatgctgggatctgatggaccagacaggagagatgaggatggccggaacactgccagaatacagactgcatggtttagtgacctacgtgatctactcccatgcccagaaactcggcaagctggggtttcccgtctattcacatgtggactactcaaatgaggcaatgcagaaaatgagttacacactgcaacatgttcccattcccagatcctggaaccaatggaactgtgtgcccctatag

SEQ ID NO: 224998 - DNA, 2022 bp, Artificial Sequence
  Description of Artificial Sequence: Synthetic coding sequence
atgcctcttaacaggacacttagtatgagttccctcccgggtttggaggattgggaagacgagtttgacttggaaaatgccgtcctctttgaagtcgcctgggaggtcgctaacaaggtggggggaatttacacggtgcttcagacaaaagccaaggtaaccggcgacgagtggggtgacaattatttccttgtgggcccttataccgaacagggggtcagaacacaggtcgagctgctggaggcacccactcccgctctgaaacgcaccctggacagcatgaactcaaaaggttgcaagttcctcgcgcaaagcgaggagaagcctcatgttgtggcacattttcacgagtggttggccggtgtgggtctgtgtctttgtcgcgcacggcgtctccctgtggctaccattttcaccacacacgccacactactcgggcgatacctgtgtgctggcgcagtagatttctacaataatctggagaattttaacgttgataaagaggcgggagagagacagatttatcatagatactgtatggagcgggctgccgcacactgtgcgcacgtgttcacgacagtcagccagataaccgccattgaggcacagcatctgttaaagcgaaagccggacattgttaccccaaatgggctcaacgtgaagaaattctccgctatgcacgagtttcagaacctgcacgcccagtctaaagctaggatccaggagttcgtgcggggtcacttctacgggcatctggattttaatttggacaagaccctttactttttcattgctggacgctacgaattttcaaataagggagctgacgttttccttgaggctctcgctaggctgaattatctgctgcgcgtcaatggcagcgagcagacggtggtagcattttttatcatgcccgcacgcactaataacttcaacgtcgagactctcaaaggccaagcggtgcgcaagcagttatgggacaccgccaacaccgtcaaagagaagttcggacgtaagctctatgaaagcctgctggttggaagcctccctgacatgaataaaatgctggataaggaggatttcacaatgatgaaaagagctattttcgctactcagcgccagtcttttcctccagtttgcacgcataacatgctggacgacagctcggatcccatactgaccaccattcgcaggatcggtctgttcaactcttcagcagaccgcgtgaaggtgatatttcatccagaattcctctccagtacaagtcccttgctccctgtggattacgaggaatttgtgcgcggttgccaccttggagtttttccaagttattacgaaccctggggatatacgcctgccgagtgcacggtgatggggatcccgtcaatcagcactaatctgtcagggtttggctgttttatggaggaacacatagctgatccatctgcgtacgggatttatatcctggaccgacgatttaggtcgctggacgattcttgctctcagcttacctcatttctgtattcgttttgtcagcaatcacgcaggcagcgtattattcagcggaatcgcaccgagaggctgagcgacctcctcgattggaagtacctcggtcggtattatatgtctgcgagacacatggcacttagcaaggcttttcctgagcacttcacgtacgagcccaatgaagccgacgcggcacaggggtacaggtacccaagaccagctagtgtgccgccatctcccagcctgagccggcattcctccccacaccagtcagaggacgaggaggatccccgtaatggccctctggaggaggatggcgagaggtacgacgaagatgaggaagccgcaaaggaccgccgaaatatccgtgctcccgagtggccgcgtagggcatcttgcacaagttctacaagcggcagcaagcgcaacagtgttgacactgccacaagctcctcactctcaacccccagcgagccactttcgcccacttcctccctgggtgaagaacgcaattag

SEQ ID NO: 224999 - DNA, 2214 bp, Artificial Sequence
  Description of Artificial Sequence: Synthetic coding sequence
atgccattaaatcgtactctatcaatgagtagcttacctggcttagaagattgggaagatgagtttgatctggagaatgccgtgctgtttgaagtggcatgggaggtcgccaataaagtagggggaatttacactgtgcttcaaacaaaggccaaagtcaccggcgacgaatggggggacaattatttcctcgtgggaccatacactgagcagggagttcggacccaggtcgagctactggaagcacccacgcccgctcttaagagaaccttggacagcatgaactccaagggatgcaaggtatattttggacggtggctaattgagggtgggccactcgtcgtgttgctcgacgttggggctagcgcttgggcgttggagaggtggaaaggcgaactgtgggacacctgtaatatcggggttccctggtacgaccgagaagccaatgatgcggttctgtttggttttttaacaacttggttcctcggtgagttcctggcccaaagcgaagaaaaaccacacgtggtcgctcactttcatgaatggttggcaggcgtaggcctctgtctttgtagagctcgaaggctgccggtcgctactatctttacaacacacgcgactctgctcggaaggtacttgtgtgccggagctgtggatttctacaacaatctcgagaacttcaacgtcgacaaggaggccggtgagaggcagatctaccacagatattgtatggagagggctgcagcacattgcgcacacgtcttcactacagtttctcagatcacagccatcgaagcacagcacttgttgaagaggaagccagacatcgtcacaccaaacggccttaatgtgaagaagttctccgccatgcacgaattccagaacctccatgcccagagtaaagctcggatccaggaatttgtgcgtggccacttctacggtcacctggacttcaatctcgacaagacactgtacttctttatcgccggacgatacgaatttagcaataaaggtgctgatgtcttcttggaggctctcgctagactgaactacctcttacgcgtcaacgggtcagaacagactgtcgtcgcctttttcataatgccagctcggactaacaattttaacgtggagactctgaagggtcaggcagttcgcaagcagctctgggacaccgctaatactgtaaaagagaagttcggccgtaaactgtacgaaagccttctcgtgggttcgttacccgatatgaacaagatgttagataaggaggactttaccatgatgaagcgagctatcttcgctactcaacgccaatcattccctcctgtctgtacacacaacatgctggatgactcaagtgacccaatactgaccacaattcgaaggatcggactctttaatagctccgccgatagggtgaaagttatctttcatcctgaattcctatcaagcacttcaccgctgttacctgtggactacgaagagttcgtacgaggctgtcacctcggagtgtttccctcttactacgagccctgggggtacacacccgctgaatgtacagtgatgggcatcccgtccatcagtacgaacttgagcggctttggatgttttatggaagagcacatagccgatccatcagcctacggcatatacattctcgatcgtagattccgatctttggatgattcatgcagccaactcactagttttctctatagcttttgtcagcagtcccgacggcaacgcataatccagcgcaataggacagagcggctgagcgatttgctggattggaaatacttagggagatactatatgtctgcacggcacatggcactgagtaaagctttcccggaacattttacatacgagccgaacgaggctgacgcggcacaggggtaccggtaccctagaccagcctccgtccccccttctccttctctgagcaggcatagctcacctcaccagagcgaagatgaggaggatccacggaacggaccgctggaggaggatggcgaaagatacgacgaggacgaggaagctgctaaggaccgacgcaacattagggctccggagtggccacgccgagcctcttgtacaagcagcacaagcggttccaaacggaactccgtcgatacagcaacctccagtagcctctctacccctagcgaacccctgagccctacgtccagccttggagaagaaaggaattag

SEQ ID NO: 225000 - DNA, 708 bp, Artificial Sequence
  Description of Artificial Sequence: Synthetic coding sequence
atgaatagtacctggcggacgcagtgttcctccaagtggcctggcaggtggctcactagagtgtatttcggtagatggctgattgaaggaggcccattggtggtacttctggatgtcggcgcatctgcatgggcattagagaggtggaaaggcgaactgtgggatacctgcaacattggagtaccctggtacgatagagaggctaatgatgctgtcctgttcggttttttaaccacttggttcttaggagaatttctggcccagtcagaggaaaagccccacgtggtagctcactttcacgaatggcttgcaggagtggggctgtgtctgtgccgcgctagacgactgcccgtggccacgattttcactacgcacgccactctgctgggtcggtacctatgtgcaggtgccgtagatttctacaataacctggagaattttaatgtcgataaagaggccggagagcgccagatctaccatcgctactgtatggaaagagctgccgcacactgcgcccatgtctttaccactgtctcccaaatcaccgccattgaggcacaacacctgctgaaacggaaacctggtatctggaccagtacttggacaagaccatatacgagtcttagccctgcagccatgtcttctccaacccgggtacttacatcttcctggagacattggctcggatccacgatctgcagtgaatag

SEQ ID NO: 225001 - DNA, 1974 bp, Artificial Sequence
  Description of Artificial Sequence: Synthetic coding sequence
atgaactcaacgtggcggacgcagtgctcatctaaatggcctggtaggtggcttacgcgggtgtacttcgggcgatggctcatcgagggcggacccttggtagtgctcctggatgtcggggcttccgcttgggccttagagaggtggaaaggcgagctctgggacacatgcaacatcggcgtcccatggtatgaccgggaggccaacgatgccgtcctattcgggttcctcactacctggtttcttggggagttcctggctcagtctgaggaaaagcctcacgttgtcgcccactttcatgagtggctggcaggagtcggcctctgtctctgccgggcaaggcgtctgcccgtcgccaccatatttactacacacgccaccttattaggcaggtacctttgtgcaggcgctgtggatttttataataatttggaaaacttcaacgtggacaaagaagctggcgagcggcaaatttaccatagatactgcatggaaagggccgctgcccattgcgctcatgtgtttaccaccgtgtcccagattactgctattgaggcccaacacctcctgaagaggaagccagatattgtcacacccaacggcctcaatgttaagaagttctccgccatgcacgagttccagaatctgcatgctcaaagtaaagcacggatccaggagttcgtgcgcggtcatttctacggccatctggattttaatttagataagacgctctattttttcatagcaggcagatacgagttcagtaataaaggcgctgacgtgttcctagaggctttggcaaggctgaactatttgctgagagttaatggctcagagcagacagtagtagctttcttcattatgcctgctcgaaccaataacttcaacgtcgagactcttaaaggccaggctgtgcggaagcaattgtgggacacagcaaacaccgtgaaggagaaatttggaagaaagctttacgagagcctcttagttggatccctccctgatatgaacaagatgctggataaagaagatttcaccatgatgaaaagagccatcttcgccacacagcggcagtcattccccccagtgtgcacacataatatgctggacgactcaagtgatccaatcctgaccaccattcgacgcattgggctttttaactcgagcgcggatagggtcaaagtcattttccatcctgagtttctgagttcaacatctcctcttttacccgttgactatgaggaattcgtgcggggttgccatctgggcgtattcccgagctattacgagccatggggatatacaccggctgaatgcacagtgatgggtatccccagcatcagcacaaacctgtcaggcttcggttgttttatggaagaacacatcgctgacccctccgcgtacggaatctatatcctggatcggcgttttcggtccttggacgattcatgctcacagctcacctcatttctctactcattctgccagcagtcaagacgacaacgaattatccaacgtaatcgaacggagcgactgtctgacctgttggattggaagtacctaggacgctactacatgagcgctcggcacatggctctgtctaaagcttttcccgaacacttcacctacgagcccaatgaggcagatgcagcccagggctatcgctaccccagacctgcaagcgtgccacccagcccttcactttcaagacattcatctccacaccagtctgaggatgaggaggatccgcgaaatgggcctctggaagaagacggggagaggtacgatgaggatgaggaggccgcaaaggaccggcgtaacatccgtgctccagaatggcccaggagggccagttgcacctctagtactagcggaagtaagcgaaattctgtggacaccgctacgagctcctcactgtcaaccccatctgaacctctttccccaacttcaagtctcggagaggagcgaaattag

SEQ ID NO: 225002 - DNA, 1113 bp, Artificial Sequence
  Description of Artificial Sequence: Synthetic coding sequence
atgccagctcggacgaataacttcaatgttgagactctaaaaggccaggccgtacgtaaacagctatgggacaccgccaataccgttaaagagaaattcggcaggaaactgtacgagtccctgctggtaggctcactgccggacatgaataagatgctcgacaaggaagatttcacaatgatgaaacgcgcaatctttgccacacagcgtcagagctttccacccgtttgcactcataatatgctggacgacagcagcgatcctattctcacgaccatccgaaggatcggactgtttaatagcagcgctgatagggttaaagtaatcttccacccggaatttctcagctccacttcacctctgctgcctgtggactatgaagagttcgttaggggctgccatctgggggtcttccctagctattacgagccttgggggtatacacccgctgaatgcactgtcatggggatacctagtataagtactaacctttctgggtttggctgtttcatggaggagcacatcgccgacccgagtgcttacggcatttatatcttagataggcgcttcagatcactcgacgatagctgtagtcaattaacatccttcctgtactcgttctgtcagcaaagtcggcgacagagaatcatccagagaaacagaaccgaacggctcagcgaccttcttgactggaagtatctcgggcgttattacatgagtgcacggcatatggctttgtcaaaagcattcccagagcattttacatatgagcctaacgaggcagatgctgcccagggttacagatacccaaggcccgcttccgttcccccttctccgtcacttagcagacatagcagcccacaccagagcgaagacgaggaggaccccagaaacggaccactcgaggaagatggagagagatatgatgaggatgaggaagcggcaaaggacaggaggaacattagggccccagagtggcctaggcgcgcaagctgcacctccagtacttccgggagcaagagaaacagtgtcgacacagctacaagtagcagtctttcgaccccatccgaaccactatccccaaccagctctctcggtgaggaacggaactag

SEQ ID NO: 225003 - DNA, 1002 bp, Artificial Sequence
  Description of Artificial Sequence: Synthetic coding sequence
atgacagaccaagcttttgtcactttgaccacaaacgatgcctatgccaagggcgctctcgttctgggctcttccctcaagcagcaccgcacgacccgaagattggtggttctggcgacaccacaggtgagcgattcaatgcgcaaggtcctcgaaacagttttcgatgaggtaatcatggtcgacgtgctcgacagtggcgactctgcccacctgacacttatgaagcgcccagagctcggtgtgaccctcaccaagctgcactgctggtcgcttactcagtactctaaatgtgttttcatggatgccgacacccttgtgctcgccaatatagacgatttatttgaccgcgaagagctgtcagctgcgcctgatcctggatggccagactgctttaattccggcgtcttcgtgtatcaaccttcagtggagacttataatcagctcctgcatctagctagtgaacaagggagtttcgatggtggagaccagggcattttaaacactttcttctcatcctgggcaaccactgacatcagaaaacaccttccatttatctacaatctgtcctccataagcatttatagctatctgccagccttcaaggtgtttggggcatccgccaaagttgttcactttctcggcagggtgaaaccctggaactacacctacgatcccaagaccaaatcagtgaaatctgaggctcatgacccaaacatgacccatccggaatttctaatcctgtggtggaacatttttactacaaatgtcctccctcttttacagcagttcggccttgttaaggacacttgctcctatgttaacgttgaggacgtctcaggcgcaatctctcacctctctctcggtgagatccccgctatggcccagccatttgtgagtagtgaggaacggaaggagcggtgggaacagggtcaggcagactacatgggagctgacagctttgacaacatcaagcgcaagctggacacatatttgcagtag

SEQ ID NO: 225004 - DNA, 1053 bp, Artificial Sequence
  Description of Artificial Sequence: Synthetic coding sequence
atgactgaccaagcattcgtgaccctcacaacgaacgacgcctacgcaaagggtgctttggttctcgggagctctctgaagcagcacaggacgactaggcggctggtcgtgcttgccactccacaagtctccgactcaatgaggaaggtcctcgaaacggtgttcgatgaagtgatcatggtggacgttttggactctggggactcagcacaccttacattaatgaagcggccagagctcggcgtgacactgaccaagctgcactgttggtccttgacgcagtattctaaatgtgtgttcatggacgccgacaccctggtcctagctaatattgacgacctgttcgaccgggaagaactcagcgcagctcccgacccagggtggcctgactgcttcaatagcggagtcttcgtgtatcagccttcggtagagacctataaccaactcctccatctcgcatctgaacaaggctccttcgatggaggggatcaaggaatcctcaacacgttcttttcatcatgggctaccacggatattcggaagcatttgccgtttatctacaatctttcgagcatcagcatttactcatatctgccggcattcaaggtatttggcgcatctgcaaaagtagtgcatttcttgggccgagtgaagccctggaactacacctacgacccaaagacaaaaagtgtcaagtctgaggcgcacgatcctaacatgactcatcctgaattcctgatcctgtggtggaacatttttaccacaaacgtgctgcctttattacaacagtttggcctggttaaggacacctgtagttacgtgaatgtcctgagcgacctggtctatacactggccttttcatgtggcttctgccgcaaagaggatgtgtcaggagccataagccacctctcacttggagagatccccgcaatggcccagccattcgtgagttccgaggaacgtaaagaaagatgggaacaaggtcaggctgattacatgggagcggattcttttgacaacattaaacgaaagctggacacttatctgcagtag

SEQ ID NO: 225005 - DNA, 840 bp, Artificial Sequence
  Description of Artificial Sequence: Synthetic coding sequence
atgaccgatcaagcgtttgtgacactaaccactaatgatgcatacgccaaaggggcactggtccttggcagctcattgaagcagcaccggaccactagacggctggtggtcctcgccacgcctcaggtctccgatagcatgcgcaaagttctggagacggtttttgacgaggtgattatggtggacgtgcttgactctggcgactcagcacacttgacgctgatgaagagaccagaactgggggttacactaactaaattacattgctggagcctgactcaatatagcaagtgcgtgtttatggatgcagacacactggtcctggccaacattgatgatctcttcgaccgcgaggaactgtctgccgcacctgaccctggttggccagactgttttaattctggcgtctttgtctatcagccgagtgtggaaacatacaatcagcttctgcacctcgcaagtgagcagggcagcttcgacggcggagaccagggcatccttaacaccttcttctcttcttgggctacgaccgacattcgtaagcacctgccattcatctacaatttgagttctatcagcatctattcgtacctcccagccttcaaagttaagatgagtcaggaaccatatcacatctgtccattggggcgttcccagttgtggcatagcaggttgtatcccagaaagaacggaaggaacgatggcaatcgggctagacttatcatatgggagcagatccctctgactacatcccggggtaatctgacactgacatctagcagaaacaccgcctttttctgtgaacatatccacttcacaagcttagtgagcgacacatag

SEQ ID NO: 225006 - DNA, 1398 bp, Artificial Sequence
  Description of Artificial Sequence: Synthetic coding sequence
atgtctgaaacagagtttcaccatggagctcaggccggactggagttacttaggagttccaactcgccgacatctgctagccagtccgcaggcatgacagtgactgaccaagctttcgtaacactggcaaccaacgatatttactgtcaaggcgctcttgtcctgggccagtccctgcggcgacatcgcctaacacgtaaattagtggtgctcataactcctcaggtgtccagcctgcttagagtgatactgtcaaaggtcttcgatgaagtgattgaggtcaacctcatcgacagcgcagattacatccatctggccttcctgaagcggccagaattgggtctgacactgactaaactgcactgttggacccttacccactatagcaaatgcgtgttcctggatgcagataccttggttttgtcgaacgttgacgagttgttcgatagaggcgaattcagcgctgcgccagaccccggttggcccgactgttttaattctggcgtgtttgtgttccaaccctccctccatacccacaagcttctgctgcagcacgcgatggagcacggaagttttgacggcgctgatcagggactcttgaactccttcttccggaactggagtactaccgacattcataagcatctgccgttcatctataatcttagcagtaacaccatgtacacttattctcccgctttcaaacaattcggatcttcagctaaagtcgtgcacttccttggttccatgaaaccatggaattacaagtacaacccgcagtctggctcagtgctggagcagggcagtgccagtagcagtcagcatcaggccgcttttctccacctgtggtggaccgtctaccaaaacaatgtcctcccactctacaagtctgtacaagctggtgaggcaagagctagtcctggtcataccctgtgccacagcgacgtgggaggtccctgtgcagattccgcttcaggagtcggcgaaccctgcgagaactccactccctctgctggagtcccctgtgcaaactcccctcttggttctaatcagcctgcccagggcctgccagaacccacacagattgttgacgagactcttagtctgccggaaggtaggcggtccgaagatatgatcgcgtgtcccgagaccgaaactcctgcagtcataacctgcgatccgctctcccagccctcccctcagccagccgacttcacggagacagaaaccattctggtcgacctcgcagtgtccgtgtctcagatctcaattgaagagaaggtaaaagaattgagtcctgaagaggagagacggaaatgggaagaaggtaggatagattatatggggaaagatgcattcgcgaggatccaggagaagctggatcggttcctgcaatag

SEQ ID NO: 225007 - DNA, 1506 bp, Artificial Sequence
  Description of Artificial Sequence: Synthetic coding sequence
atgagtgaaaccgagtttcatcatggagcacaggctgggctagagctgcttagaagtagtaattcaccaacaagcgcaagccaaagtgcaggaatgaccgtaaccgaccaggccttcgtgactctggccacaaacgacatctactgtcaaggcgctctcgtgctgggccaatctttgcgccgtcataggttgacacgaaagctcgtcgtacttataacaccgcaagtgtcttctcttctgcgggtgattctatccaaggttttcgatgaggtgattgaagtgaacctaatcgactcagcagactatatacatctggccttcctgaaacgcccagaactgggcctcacactcacgaagctgcattgttggacgctcacccattactcaaagtgcgtgtttcttgatgccgacactctggttctctccaatgtcgatgagttattcgaccggggagagttctctgctgcacccgaccccggatggcccgattgcttcaacagtggcgtgttcgtgttccaaccctcactgcacacacataagctgctgctacagcatgcaatggagcatggttcgttcgacggcgctgaccagggactattgaacagtttctttcgaaattggtctacaacagatattcacaaacacctgcccttcatctataacctgtcatctaacacaatgtatacatactctcctgcattcaagcagttcggctcatccgcaaaggtggtccactttctgggcagtatgaaaccctggaattataaatataacccacaaagtggctcagtcctcgaacagggtagtgcttcaagttcccagcaccaggcagcctttctgcacctctggtggaccgtctaccagaacaatgtactgccactgtacaaatccgtgcaggcgggtgaagctcgggcaagccccggtcacaccctgtgccattccgatgtgggcggaccgtgtgctgattccgcttcaggcgtgggcgagccgtgcgagaatagcactccctccgccggagtgccgtgtgctaacagcccactgggcagtaatcagcctgctcagggccttccagaacccactcaaatcgtggatgaaactctgtctttgccagaaggccgaagaagcgaagatatgatagcctgtccagagactgagactccagccgttataacttgcgatccattgtctcagccttcacctcagcctgccgactttactgaaactgagacgattctgcagcccgcaaataaagtagagagtgtgagctctgaagagacgtttgagcctagccaggaactgcctgccgaggctctgagagatccctcgctccaggacgcactggaggtcgacctggccgtgtccgtgagtcaaatctccatagaagagaaggtaaaagaactcagccctgaagaagaaagaagaaagtgggaagaaggacgaattgattacatggggaaagacgccttcgccagaatacaagaaaaactagatagattccttcaatag

SEQ ID NO: 225008 - DNA, 1413 bp, Artificial Sequence
  Description of Artificial Sequence: Synthetic coding sequence
atgtctgtcactgaccaggctttcgtcactctggcaacaaatgacatatattgccaaggagccctcgtcctcggtcagagccttagacgacacagactgactaggaagctcgtagtgctaatcacacctcaggtctcttcactgctgcgtgtgattctatccaaggtgttcgacgaggtcatcgaagtgaatctgatcgacagcgctgactacatccatcttgcattcctcaaacgtcccgagctcggtctcaccctcactaagctgcactgctggacccttacccattacagcaagtgtgtctttctggatgcagatacactggtgctatccaacgtagacgagctctttgatcgaggagaattcagcgcagccccagatcccggatggcccgattgcttcaacagcggtgtcttcgtgtttcaaccttcactccatacccacaaattgcttctgcaacatgctatggagcatggctcatttgatggagctgaccaaggactgctaaactcattctttcgaaactggtccaccacggatatccacaagcacctcccattcatttacaacctgagttctaacacaatgtatacttattctccagcctttaagcagttcggctcgagcgcaaaggtcgtgcatttcctaggcagcatgaagccctggaattataagtataaccctcagtcaggatctgttttagagcaaggttctgcctcttccagtcagcatcaagcggcatttctacatctgtggtggaccgtgtaccagaataacgttctgcccctatacaaatcagtccaggcaggcgaagcaagagccagtcccggacatacactgtgtcattcagacgtaggcggaccatgtgccgattcggcctctggtgtgggcgagccctgcgaaaattccacccccagcgcaggagtgccttgcgcaaactcccccttgggaagcaatcagcccgctcagggcctgccagagcctacgcagatcgtggatgaaacattaagcctgcccgaggggaggagaagtgaggatatgatcgcgtgccccgaaaccgaaacccccgctgtcattacttgcgatccgctgagtcagccctcaccccagcctgcagactttactgagactgagaccatccttcagcccgcaaacaaagtagaatctgtttccagtgaggagacatttgagccgtctcaggagctccctgccgaggcgctgcgcgatccaagccttcaggacgccctggaggtcgacttggcagtgtctgtaagccagatctccatcgaggagaaggtaaaggagctttcacccgaagaagagaggagaaaatgggaggagggcaggatagattatatggggaaagacgccttcgcacggatccaggagaagttagatcgctttctgcagtag

SEQ ID NO: 225009 - DNA, 417 bp, Artificial Sequence
  Description of Artificial Sequence: Synthetic coding sequence
atgagtgtgactgaccaagcttttgtgacactagccaccaacgatatctattgtcaaggagcactggtcctagggcaaagcctccgtagacatcgactgacccgcaagctcgtggtgctgatcacgcctcaggtgagtagtctcctgcgggtcatcttgagtaaagtgtttgacgaagtgatagaggtgaatctcatcgattcagcagattatattcacctcgcgtttttgaagcgacctgagctgggcctgacactcactaagctgcactgctggactttgacgcactacagcaagtgtgtcttccttgacgccgatacacttgttctgtctaacgtcgatgagctgttcgatcgcggtgagttttccgccgcacccgatcctgggtggccagactgttttaattcgggggtgtag

SEQ ID NO: 225010 - DNA, 1293 bp, Artificial Sequence
  Description of Artificial Sequence: Synthetic coding sequence
atgtcagaaaccgaatttcatcacggtgcacaagcgggtctcgagttgctcagatccagcaacagccccaccagtgcatctcagtcagccggtatgaccgtgacagaccaggcttttgttaccctggctacaaatgacatttactgtcagggcgctctggtgctgggccagtcgcttcgacggcaccgtctgacaagaaagctggtcgtattgattactccacaggtttcatcactacttcgcgtgattctgtctaaggtgtttgatgaagtgattgaggtaaacctgattgacagtgctgactacatccacctagcattcctgaagcgacccgaactgggtctaacccttacaaagctgcactgctggaccttgacccactattccaaatgtgtgttcttggatgctgatacgcttgtactgtcaaacgtggatgagttgtttgatagaggggagtttagtgcagcgcctgacccaggctggcccgactgctttaattcgggtgtgtttgtattccagccctctttgcacactcataagcttctcttgcagcatgccatggagcatggctcttttgatggtgctgaccaaggcttactcaactctttctttcgaaattggtcaacaactgacatccataagcacctgccattcatatataacctaagctccaacacgatgtacacctacagccccgctttcaagcagtttggatcttctgcaaaagttgtgcactttctgggatccatgaaaccctggaactataagtacaatccccagagcggatccgtgttagaacagggtagcgcatcaagttcccagcatcaggcagctttccttcacctgtggtggacagtatatcaaaataacgtgctgccactgtacaagagcgtgcaggctggcgaagccagagcctctcctgggcatactctgtgtcacagtgacgtcggcggaccatgcgccgatagcgccagcggcgtcggggaaccttgtgagaattccaccccctctgccggtgtcccttgcgcaaattccccattaggcagtaatcaacccgctcagggactgcctgagcctacacagatagtggacgagacattatccctaccagaaggcagacgatccgaagatgtagatctggccgtctctgtaagccagatctccatcgaagaaaaagttaaggaactgagtccagaggaggaaagaaggaagtgggaggaggggaggattgattacatgggaaaggatgcctttgccaggatccaggaaaaacttgataggtttttgcaatag

SEQ ID NO: 225011 - DNA, 354 bp, Artificial Sequence
  Description of Artificial Sequence: Synthetic coding sequence
atgtatggcaaaatcattttcgtactattactctcggatacacataagcgcgatacatatgccgctacaccacgagctcatgaggtgagcgaaatctcggtgcgtacagtctatccccctgaagaagaaactggggaacgagtgcagcttgctcaccacttcagtgaacccgagataacccttatcatttttggcgtcatggccggagtgataggaacaattcttcttatctcttatggtattagacgtttaattaagaagtccccaagtgacgtcaaaccattgccttcacctgataccgatgtgcccctctcaagcgtcgagattgagaatccagagacaagcgatcagtag

SEQ ID NO: 225012 - DNA, 453 bp, Artificial Sequence
  Description of Artificial Sequence: Synthetic coding sequence
atgtacgggaagatcatctttgtactgttgctgagcgagattgtgagcatctctgccctaagcacaaccgaggtggcaatgcatacaagcacctcttcgtcagtgactaaaagctatatcagcagtcagaccaacgatacccataaacgcgatacatatgccgctacccccagggcacatgaggtatcggagatctcagtgaggaccgtgtaccctcctgaagaggaaacgggcgaaagagtacagctcgcgcaccacttcagcgagcctgagatcacactcattatctttggggtcatggccggtgtgataggcaccattcttctaataagttacggtatacgacggttaatcaaaaagagtccaagcgatgttaagccattgccaagtcccgacaccgatgtccctttaagtagcgtagagatcgagaacccagagacttctgaccagtag

SEQ ID NO: 225013 - DNA, 189 bp, Artificial Sequence
  Description of Artificial Sequence: Synthetic coding sequence
atgtatggaaaaattatctttgtgcttcttttgtctgagatagtgagcatctctgcgctgtcaaccaccgaggtagccatgcacaccagcacgtcaagctcagtaaccaaaagttatataagttcacagactaatggagaacgagtccagttagcgcaccacttttccgagccggatttccataattag

SEQ ID NO: 225014 - DNA, 357 bp, Artificial Sequence
  Description of Artificial Sequence: Synthetic coding sequence
atgtatgggaaaattatctttgttctgttgctctctgagatcgtttcaatctcagccttgtctacaacagaggtggcaatgcacacgtccacttcaagttcagtaacaaaaagctacatctcttcccagactaacggcgaaagggtgcaacttgcccatcatttctctgaacccgagatcaccttgattattttcggagtgatggccggtgtcatcgggacgatcctgttaatcagttatgggattcgacggctgattaaaaagtctccatccgatgtgaaacctctcccatcccccgatacggacgtgccactgagcagcgtggagattgagaaccctgagacctctgaccagtag

SEQ ID NO: 225015 - DNA, 414 bp, Artificial Sequence
  Description of Artificial Sequence: Synthetic coding sequence
atgtacggtaaaattatattcgtcctgctcctaagtgagatcgtgtctattagtgccctgagcacaacagaagtggccatgcatacctctacatcttcgagcgtgaccaagtcatacatcagcagccagactaacgacacacacaagagagatacgtatgctgcaacccctagggctcatgaagtgtctgagatttcggtcaggaccgtttatcctcccgaagaagaaactgaaattactcttattatctttggagtgatggcaggtgtgatcggcacaatcctgctgatctcctacggcattcggcgactcattaaaaaatctccaagtgacgtcaaacctcttccttcgccggacactgatgtccctcttagttccgtggaaattgagaaccctgagaccagtgaccagtag

SEQ ID NO: 225016 - DNA, 258 bp, Artificial Sequence
  Description of Artificial Sequence: Synthetic coding sequence
atgtacggcaagattatcttcgtgcttctcctaagtggcgagagggtacagctagctcatcacttttctgagcctgagatcacccttattattttcggggtgatggcaggtgtgattggtaccatcctcctgatttcctacgggattcgcaggctgatcaagaaatcaccatctgacgtgaaacctttgccttcccccgataccgatgtcccactgagctcggtcgagatcgagaacccggagacttccgatcaatag

SEQ ID NO: 225017 - DNA, 375 bp, Artificial Sequence
  Description of Artificial Sequence: Synthetic coding sequence
atgcacacgtctacgagttcaagcgttaccaagagctatatctcatctcaaacgaacgacacacacaagcgtgatacatatgccgctacacccagagctcatgaggtgagcgagatttcggtgcggactgtgtatccccctgaagaagaaacaggcgagagagtgcagctggcccaccattttagcgagcccgaaattacattaatcatctttggagtgatggccggagttatcggtactattctgctgatttcctacggaattagacgtctcatcaaaaagtcacctagtgacgtgaagcccctgccctccccggatacggatgtgccactttcctctgtagaaatcgagaatcccgaaacttccgaccagtag

SEQ ID NO: 225018 - DNA, 276 bp, Artificial Sequence
  Description of Artificial Sequence: Synthetic coding sequence
atgtacggaaaaatcatttttgtgttgctgcttagtgagatagtgtctatcagcgctctatcaacaaccgaagtagctatgcacacatctacctcaagcagtgtgaccaagtcctacatctcctctcagaccaatggagagaccggacaactggtgcataggttcaccgtccctgccccagtggtgataatattgattatcctttgtgtgatggcaggcatcattggaacaatcctgttaatttcttacagtattcggagactgatcaaggcttag

SEQ ID NO: 225019 - DNA, 276 bp, Artificial Sequence
  Description of Artificial Sequence: Synthetic coding sequence
atgtatggaaagataatatttgttttactattaagcgaaattgtatcaataagcgccttaagcaccaccgaggtggccatgcacaccagcacaagcagctctgttactaagtcctatatttcgtcccagacgaatggtgagacgggtcaactcgtgcaccgttttaccgtgcccgcaccagtggtaatcatcctgataatcctgtgcgtgatggcgggaatcatcggcactatcctccttattagctacagtattaggcgccttatcaaagcttag

SEQ ID NO: 225020 - DNA, 177 bp, Artificial Sequence
  Description of Artificial Sequence: Synthetic coding sequence
atgtacggtaagattatctttgttctgttattgtccggcgagacgggtcagcttgttcaccgattcaccgttcccgctcccgtagtgattatattaattattctgtgcgtgatggccggaattatcgggactattctcctgatttcttactcaatcaggaggctgatcaaggcttag

SEQ ID NO: 225021 - DNA, 387 bp, Artificial Sequence
  Description of Artificial Sequence: Synthetic coding sequence
atgtggtccacccgcagccccaatagcacagcatggcctctcagtttagaacctgacccagggatggctagtgcaagcactaccatgcatacgacgacgatcgcagagccagaccccggaatgtctgggtggccagatgggcgaatggagacatctactcccaccattatggacatcgtggtcatcgctggtgtcattgcggcagtggcaatcgttttggtatcgctcctgtttgtgatgctgcgatacatgtatagacataagggaacttatcacactaacgaggccaagggaaccgagtttgcagagagtgcagatgccgcactacagggcgatccggcattgcaggatgctggagattccagcaggaaagagtacttcatttag

SEQ ID NO: 225022 - DNA, 324 bp, Artificial Sequence
  Description of Artificial Sequence: Synthetic coding sequence
atggcttccgcatccactacaatgcacacgaccacgattgccgaaccagatcctggaatgagcggctggccagatgggcgtatggagaccagcaccccaacaatcatggatatagtggtcatcgccggtgtcattgccgctgtggcaattgtactagtgtcccttctatttgtaatgctaaggtacatgtacagacataaagggacatatcacactaatgaggcaaaggggacggagttcgctgagtccgccgacgcagccctccagggcgaccccgcactgcaggacgcaggagatagttctagaaaagaatattttatctag

SEQ ID NO: 225023 - DNA, 330 bp, Artificial Sequence
  Description of Artificial Sequence: Synthetic coding sequence
atgtggtctacaaggtcacccaatagtaccgcgtggccgttgtctctcgagcccgacccaggaatgtctggctggcccgatggaagaatggaaaccagcactccaacaatcatggacattgtcgtgatagcaggagtcatcgcagccgtcgcaatagttctcgtgagtctcctcttcgtgatgttgcggtatatgtacaggcataaggggacctatcacaccaacgaagccaagggaaccgagttcgccgagtccgccgatgccgctctgcagggcgacccggctcttcaggacgctggtgactccagccggaaagagtatttcatttag

SEQ ID NO: 225024 - DNA, 237 bp, Artificial Sequence
  Description of Artificial Sequence: Synthetic coding sequence
atgtacggcaagattattttcgtgctgctgctctcaggaatagtctcaataagcgcaagctcaacaaccggtgtggcgatgcatacaagcacttcttcatccgttactaagtcttatatctcctcacaaactaacggcatcacccttattaattggtgggctatggccagagtgattttcgaagtgatgttagtagttgtcggtatgatcatcctgatcagttactgtattaggtag

SEQ ID NO: 225025 - DNA, 168 bp, Artificial Sequence
  Description of Artificial Sequence: Synthetic coding sequence
atgtacggcaaaattatcttcgtgctgttgttatcgggcatagtctctatttccgcgtcgtcaaccactggcgtggcgatgcacacatccacatcaagcagcgtgacaaagtcttacatcagctcccagaccaacggagagcgcggtcagttggtccacagattttag

SEQ ID NO: 225026 - DNA, 237 bp, Artificial Sequence
  Description of Artificial Sequence: Synthetic coding sequence
atgtacggaaagatcatctttgtcctcttgctgtcaggaatagtatctatcagcgcctcctccactactggagtggcaatgcacaccagtacctcgagttcagtgaccaaatcatatattagctcccagaccaatggaattacactgataaactggtgggccatggccagggtgatattcgaggtgatgctcgtagtcgtggggatgataattttgatatcatattgcattaggtag

SEQ ID NO: 225027 - DNA, 180 bp, Artificial Sequence
  Description of Artificial Sequence: Synthetic coding sequence
atgtatgggaaaattatttttgtgctattactctccgggattgtttccatttccgcctcttcaaccaccggagttgccatgcacacctccacttcttctagcgtcaccaaatcttatatttcttctcagacgaacggatgtgtgattgggaatattatctgtagcgacaaatctaagtag

SEQ ID NO: 225028 - DNA, 1605 bp, Artificial Sequence
  Description of Artificial Sequence: Synthetic coding sequence
atgccccatctgatggagcggatggtcgggtctgggctgctttggctggctctcgtcagttgtattctgacacaggctagcgctgtccagaggggatacggcaaccctatcgaagcttcctcttatggacttgatttagattgcggcgcacctgggacgcccgaggctcacgtttgctttgatccatgtcagaattacacactgttagatgagccctttaggtctaccgagaattctgccggatcacagggatgcgataagaacatgagcgggtggtacaggtttgtgggagaaggcggagtgcgaatgtcggaaacttgtgttcaggtacaccggtgtcaaaccgatgcccctatgtggctgaatggtacacacccagcgcttggcgacggaataacaaaccacacagcttgcgcacactggagcggaaattgctgtttctggaaaaccgaagtgctcgttaaggcctgccccggaggctaccatgtttacaggttggaggggaccccatggtgtaatctgcggtactgtactgacccgagtaccgtcgaggacaaatgtgaaaaggcatgccgaccagaagaagagtgccttgctctcaattccacatggggctgcttctgccggcaggacctaaattcatccgacgtgcattcactccagcctcaactggactgtgggcctagggaaatcaaagtgaaggtggataaatgtcttcttggcggattgggtttgggtgaggaagtgattgcgtatctgagggatcccaactgctcgtccattctccagacagaggagcgcaactgggtcagcgttacaagtccagtccaggcctctgcatgtcgcaatatcctggaacgaaaccagacacatgctatttataaaaacacactcagccttgttaacgacttcattatcagggacacaattctgaatataaatttccagtgcgcctacccactggatatgaaagtgtctctgcaagccgcattacaacccatagtgtccagtcttaacgtctccgtcgacggtaacggggaattcatagtacggatggcccttttccaggatcagaattacactaatccctatgaaggagacgcagtcgaattgtctgtggagtctgtgttatatgttggagctatcctggagcagggggatacatcccgcttcaatttggtcctccggaactgctacgccacccccaccgaagacaaggcagatctggtaaagtacttcatcatcaggaacagttgctctaatcaacgggattcaactattcacgtggaggagaacggccagtcatctgagagtcgcttctctgttcagatgtttatgtttgccggacattacgacctcgtttttttacattgcgagatccacctatgcgactccctgaacgagcagtgtcagccgtcttgctctagatcacaggtccgctctgaggttccagcaatcgatctagccagggtgttggatctgggcccaattactcgcagaggcgcacaatctccgggtgtcatgaacgggacgcccagtacagccggatttctagtagcgtggcccatggtgctgctcacagtgttgttggcctggctgttctag

SEQ ID NO: 225029 - DNA, 1164 bp, Artificial Sequence
  Description of Artificial Sequence: Synthetic coding sequence
atgccacacctgatggagcgaatggtgggcagtggcttactatggctagctctggtgagctgcatcctgacccaagcatccgcggttcagagggacccttcaactgttgaggataagtgtgaaaaggcttgccgtcccgaagaggaatgcttggccttgaatagtacttggggatgcttctgtagacaagacctgaattctagcgacgttcactcactacaaccacaactggattgtgggcctcgcgaaatcaaggtaaaagtggacaaatgccttcttggaggcctaggcctgggcgaagaggtgatcgcatatctgagagacccaaactgctcttccattctgcagacagaagagcgtaactgggtgagcgtaacatcccccgtgcaggccagcgcttgtagaaatatcttggagcggaatcaaactcatgcaatctataagaacacattgtcactcgtgaacgatttcatcatccgtgacactattcttaacattaatttccaatgcgcatatccgctggacatgaaagtgtccctgcaggccgctttgcagcccattgtatcaagcctgaacgtgtctgtggatggaaatggcgaattcattgtccgaatggccctcttccaggaccagaattacacaaacccttacgaaggcgatgccgtggaactgtctgttgagagcgttctgtatgtgggggcaatcctcgagcaaggggatacttcacgcttcaatctggtattgaggaattgctacgcaactcctactgaggataaagctgacctggtaaagtactttatcattcgcaacagttgttcaaatcagcgcgactctaccattcacgttgaggaaaatgggcagagcagcgagtctcgattttcagtgcagatgttcatgttcgccggacattatgaccttgtattcctgcactgtgagattcatctgtgtgatagcctgaatgaacagtgtcagccttcctgcagcaggtctcaggtgagaagcgaggtgcccgcaatagatctcgcgcgagtccttgatctgggacctattaccaggcgcggagctcaaagtccaggagtcatgaacggaactccaagcacggctggcttcctggtggcatggccaatggtcctcttgaccgtgttgctggcttggctgttctag

SEQ ID NO: 225030 - DNA, 1173 bp, Artificial Sequence
  Description of Artificial Sequence: Synthetic coding sequence
atgccacatcttatggaacggatggtaggctccgggctgctttggctggcattggtctcatgcattctgacgcaggcttccgctgtccagagggtgcctcgcgacccatcaacggtggaagacaagtgcgaaaaggcctgtagacccgaggaggagtgcctggcactgaattctacttggggctgcttttgtagacaggacctgaattctagcgacgtgcactccctgcaaccacagttggactgtggacccagggagattaaggtcaaggtcgacaagtgcctcttaggagggctcggcttgggggaggaggtcatcgcctaccttagggatcccaattgctcgagcatcctccaaactgaggagcgaaattgggtgtcagtgacttcgccagtgcaggcgtcggcttgtcggaacatactcgagaggaaccaaacacacgcaatctacaaaaacacgctgtccctggtaaacgatttcataatcagggatacgatcttgaatatcaattttcagtgtgcttatcctctcgacatgaaagtgtccctgcaggccgctctacagcccattgtttcttccctgaacgtttctgtggatggcaatggggagttcatagtgcgaatggccctgttccaggaccagaattatactaacccgtacgagggcgatgctgtagagctctctgttgagtcggttctgtacgtcggggcaatcctcgaacagggcgacacatccaggttcaatctagtactgcggaattgctatgcaacaccaacagaggataaagctgacctcgttaaatatttcataatccgcaattcatgttcaaatcagagggactcgaccatacacgtggaagaaaacggtcagtcttctgagagcaggttttccgtccagatgttcatgtttgccggacactacgatctcgttttccttcattgcgagatacacttatgtgattctttgaacgagcagtgccagccttcatgctcccggtctcaggtgagaagtgaggtgcccgctatcgatctcgcaagagtattagatctgggaccaattacgcggagaggcgctcagtcacccggtgtcatgaacggcacaccaagcacagctgggtttctggttgcttggcccatggtgttgctgacagttctcttagcttggctcttctag

SEQ ID NO: 225031 - DNA, 1614 bp, Artificial Sequence
  Description of Artificial Sequence: Synthetic coding sequence
atgccgcacctgatggagcgaatggtgggatctggtctgctgtggctagctctggtttcctgcatccttacacaggcctccgctgtccagagagggtatggtaaccctattgaggccagcagttacgggctagacctcgattgtggagcacccggtaccccagaggcccatgtgtgctttgatccatgtcagaactataccctgctggatgagccattcagaagcaccgaaaactctgctggctcccagggatgcgataagaacatgagtggctggtaccgcttcgtaggggagggcggagtcagaatgtccgaaacttgcgtccaagtgcaccgctgccaaaccgacgcgcctatgtggctaaacgggacacatcctgccttgggcgacggtataacaaaccatacggcttgtgcacattggagcggcaattgctgcttttggaagaccgaggtcctcgtcaaagcatgccctggtggttaccacgtctatcgactggaggggactccgtggtgtaatctgcgatactgcactgtgcccagggatccgtccacggtggaagataaatgcgaaaaggcctgcagaccagaagaagagtgtctggcactaaattcaacctggggctgtttctgtaggcaggacctcaactctagcgatgttcactctctgcagccccagctggattgtgggcctagagaaattaaggttaaagtggataagtgtctgttagggggattaggactaggggaggaagttatcgcttacttaagagaccctaattgctccagtatcctccagaccgaggagagaaattgggtgtccgtaacatcccccgtgcaagcctctgcgtgtaggaacatactggaaagaaaccagacccatgccatttacaaaaacacgctgtccctcgtaaacgacttcattataagagataccattttaaatattaacttccagtgtgcctacccacttgacatgaaggtgagcctgcaggcagccctccaaccaattgtctccagcctgaatgtttccgtcgatgggaacggcgaattcatcgtgagaatggcactgtttcaagaccaaaactacaccaacccctatgagggtgacgcggtggagctgtctgtggaaagcgttctttatgtgggcgcaattctcgagcagggagacacctcaaggtttaacttggtcctgcgaaattgttacgccacacccaccgaggacaaggccgacctggtgaagtactttataatccgaaactcttgctcgaatcaacgagattccacgatccatgtcgaggagaatggccagagttcagagagccgattctcagtgcagatgtttatgttcgctgggcattacgaccttgtgttcctacattgtgagatccatctgtgtgacagcctcaacgagcagtgccagccaagctgcagccgatcccaggttcgttccgaggtgcccgctatagatttggcccgagttctcgacttgggacccattaccagacgaggtgctcagtctccaggcgtgatgaatggcactccttcgaccgcgggattcctggtggcctggcccatggtgctcctgaccgtcctattggcatggctgttctag

SEQ ID NO: 225032 - DNA, 1548 bp, Artificial Sequence
  Description of Artificial Sequence: Synthetic coding sequence
atgaagataaagtgtgagaagtcgcgaacacagagttcagctcaacatgtccagcacagcgcccattctaccatcgtgtgcagaaagcacagccataacgccgagaccgccggaagggtggatattgttaggggcggacctttctttcaccatcctctgcggaagtggctcatctccccacccctgaataagcccagcgtctggcctagaactcctattatcccagttcaccagctgcgacgggacacctgggtcgggaactgtaacaaaaagacagcacactcaaggctgcatagccacggctggcccgaggaagagcgcttcgttttctcctccgagctgcacggaaagtcagcttactccaaggtgacgtgtatgccccacctcatggaacgcatggtgggcagcggcctactttggctagcactcgtgtcatgcatcctcactcaagcaagcgccgtgcagagggatcacctcgacccttccaccgtcgaggacaaatgtgaaaaagcctgcaggcccgaagaagagtgtctcgcattgaactcaacatggggatgcttttgcagacaggaccttaactcttccgacgtccattctctgcagccgcagctggattgcggcccacgcgaaatcaaagtgaaggtcgataagtgcctgttaggtggtttgggattaggcgaggaagttattgcctatctgagggacccaaattgctctagcattcttcagacagaagaacgcaattgggtgtccgtgacatcacccgttcaagcatctgcttgtcgcaacatcttggaacgtaatcagacccacgcgatttacaaaaacactctttccctagtaaacgacttcatcattcgcgacacaatccttaacatcaacttccagtgcgcctatcccctggatatgaaggttagtctccaggccgctctgcagcccatagttagctctctgaatgtatccgtcgatggtaacggcgaattcatcgtcagaatggccttatttcaggaccaaaattataccaatccctacgaaggggacgccgtggagttgtctgtcgagtctgtgctgtatgttggtgcgattctggagcagggcgacacgagccgctttaatctagtcttgaggaactgctacgcgacccctacggaagacaaggcagacctggtgaaatatttcataatccgaaacagctgctccaatcagcgggattctactatacacgtggaagaaaacggccaatcctctgaatcgaggtttagtgttcagatgttcatgttcgctggccactacgacctggtttttctgcactgcgagatccacctgtgtgactcactaaatgaacagtgccaaccttcatgttcccgcagccaagtccgcagtgaggtgccggcaattgatctggctcgggtcctggacctgggaccaataacacgtcgtggagcccagtcgcctggagtcatgaacggcactccctctacagcgggattcttggttgcatggccgatggtactgctaactgtgctgcttgcatggctattctag

SEQ ID NO: 225033 - DNA, 1959 bp, Artificial Sequence
  Description of Artificial Sequence: Synthetic coding sequence
atgccccttctactcctcctgctcctgctgccgagcccactgcatccacatccaatatgtgaagttagtaaggtggccagtcatctagaggttaactgcgataaaaggaaccttactgctctgccccctgacctgccaaaggacacgaccattcttcaccttagcgaaaacttactctacacttttagcttggccacgctcatgccttacacccggctgacccagcttaacctagatagatgcgaactgaccaagctgcaggtcgacggaactctccccgtgctagggactctcgacctgtcacataaccagttgcaaagcttacccctcctggggcagacgctgcccgcattaactgtcttggacgtatcttttaatcgcctgacttcactgccccttggcgcacttcgtgggctcggagagctgcaggagctgtatctgaaagggaatgagctcaagaccctgcctccgggtctgctgactccgacacccaaacttgagaagctgagtctggccaacaacaacctaacagagttacccgctgggctgctcaacgggctcgagaatctcgatactcttctgctccaggagaatagcttatataccattcccaaggggtttttcgggagccacttgctaccatttgcctttctgcacggaaatccatggttgtgcaactgtgagattctgtatttcaggcgttggctccaggataatgccgagaacgtatacgtgtggaagcagggggtggatgtgaaagcaatgacatctaacgtcgcgagtgtccaatgtgataattctgataaattcccagtgtataagtatccgggaaaaggatgtccaaccctgggcgacgaaggcgacaccgacctgtatgactactatcctgaagaggatactgaaggagataaagtgagggccaccagaacagttgtgaagtttcctaccaaagctcatacaacaccctggggcctcttctactcgtggagcacagcgagcctggacagccagatgcctagctcacttcacccgacccaggaaagcactaaggagcagaccactttccccccaagatggactcctaactttactctgcacatggagtccatcactttcagcaaaactcctaaaagtaccacagagcccacaccttcccccaccacatcagagccagtgcctgaaccggctcctaacatgaccacactggaacccaccccctcgccgactacacccgaacctaccagtgaacccgctccatctccgacaacgccggagcccacgagcgagccagcaccatccccaaccactcccgagccaacttccgaacctgccccttccccaacaactcctgagccgacccccattccaactatcgcaactagtccaactattttggtgtcggctactagcctgattacgcctaagagtacttttctgaccacgactaaacccgtcagtctcctcgagtccacgaagaaaaccattcccgaacttgaccaaccaccgaagttacggggtgtcctgcagggtcatttggagtcctccaggaatgatccctttctacatcccgacttctgctgtctgctgccactaggattttatgtgctcggcctgttttggcttctgttcgccagcgtcgtcctgattctcctcctttcttgggtaggacacgttaagccgcaggccctggactcaggccaaggggcagccctcactaccgcaacgcagaccactcacttagagttgcagagaggcagacaggtgacggtccccagggcttggctgctcttccttcgtggctctctaccgacattcaggtcatctttattcctatgggtgagacccaatggccgagtgggaccactcgtagcgggacgtaggccttccgccttgtcccaggggaggggtcaagatctgttgagcacggtgtctatcagatatagcgggcatagcttatag

SEQ ID NO: 225034 - DNA, 1881 bp, Artificial Sequence
  Description of Artificial Sequence: Synthetic coding sequence
atgcccctgctcctcttgctgctgctgctgccctctccattacatccccacccaatctgtgaggtgagcaaggtagctagtcatttggaggtcaactgcgacaaacgcaacctcaccgccctgcccccagatctgcccaaagacacgacgatactccatctgagcgagaacctgctgtatacgttctccctcgccaccctaatgccatatacacggttaacccagctgaacctggatagatgcgagctgaccaaactgcaagtggatggtactctacccgtgttgggcacgcttgatctgagccacaatcagctgcagtctctgccgttgttgggtcagacgttgcctgctctaacagtgctggacgttagctttaatagactcacttctttgcctttgggagctctcaggggcttgggagaattacaagagctttatttgaaggggaacgaacttaagacattgcctcccggactgttgacaccgaccccgaagttagagaaactgtcactggccaacaacaacctgaccgagctgcccgctgggctgctgaacggcctcgagaatctggataccttgttattgcaggaaaacagcctctacacaattccaaaagggtttttcgggtcacatctactcccctttgcctttctccacggcaatccgtggctttgcaactgcgagattctgtattttaggcgttggttgcaggataatgccgaaaacgtgtatgtgtggaagcagggagtggacgttaaggccatgacgtctaacgttgcttccgtgcagtgcgacaattctgacaagtttcctgtctataaataccccggtaaagggtgtccaacactcggtgatgagggcgacaccgatttgtacgactactatcccgaggaggacacagagggagacaaggtcagggcaacaagaaccgtcgttaaattccccaccaaagcacacaccacgccttggggcctcttttatagctggagtacagctagtctggactctcagatgccctcttctctgcatccaacccaggaatcgactaaggaacagactacgttccctcccagatggacaccaaactttactctccacatggaaagcattacctttagcaagacccctaagagcaccactgagccgacgccaagccctactacgtcggaacccgtcccggagccagcccctaatatgactacccttgaaccaaccccctctcctaccacccccgagccgaccagcgaaccagctcccagtcccactacacccgagccgacaccaattcccactattgctacctcaccaacgattcttgtgtctgccaccagcctgattactccaaagtccacctttctgactacgaccaaacctgtctctttactggaatccacaaaaaagaccattcccgagctagaccagcctcccaagcttcgaggagtccttcaaggacatctggagtcttcccggaacgatcccttcctgcatcctgacttctgttgtcttctccctctgggattttatgtgctcgggttgttctggttactgttcgcttcagtcgtgttaatacttttgcttagttgggtgggccacgtcaaaccccaggcccttgactctgggcaaggggctgcgttgacaaccgccactcaaacaacacatcttgagttgcagagaggtcgccaagtgaccgtccccagagcctggctgctcttcctccgcggttcattgcctacatttcgctccagtctgttcctgtgggtcagacctaatggcagagtgggccctctggtcgcaggacgacggccatccgcgctgtcccagggccgtggccaggatctgctgtccacggtgagcattcgttattccggccattctctgtag

SEQ ID NO: 225035 - DNA, 621 bp, Artificial Sequence
  Description of Artificial Sequence: Synthetic coding sequence
atgggctcaggcccacggggagcactctcacttttgttgctgctccttgctcctccttcccggcctgccgctggctgcccggcaccttgtagttgcgcaggaacgctcgtggactgcggtcgcagagggctcacatgggcgagtctgccaacagcgttccccgtggatactaccgagttggttctgaccggcaataacctgaccgcgctccccccaggcctgctggacgccctcccagccctgcgcaccgcacacttgggtgcaaatccatggcggtgcgattgtcgattggtgcctctgcgcgcttggctggctgggcgacccgagcgtgctccttaccgagacctccgttgtgttgctccccctgctctgcgtggccgtctgctgccatatctcgcagaggacgaactgcgcgctgcctgtgccccagggcctctctgttggggagcactcgccgctcagctggcactgctgggcctgggcctgctccatgcgctcttgctggtcctgctgctctgccgtttaaggcgtctgcgcgcaagggcgagggctagagccgctgccaggctgagccttacagacccactggtggcagagagggcaggtaccgacgaatcatag

SEQ ID NO: 225036 - DNA, 1230 bp, Artificial Sequence
  Description of Artificial Sequence: Synthetic coding sequence
atgatcccgtctaggcatacgatgctccggtttcttccagtcaacgcagcgagctgtcctggagataggcggacaatgctggtgaacgtggctgccggtgtgcgggtgctgagggtccccctgagggccggaggaagtggctctctgtccggtctccggccacccgctattgtatgttacttaccactgcaacgcgcatccgcctccggtctctttctcgcaagaccccaacattgcgggaggtgcggacgcggaagaggaggagctgccctgagcctcggatccccagcgtatgccagtcggtgcagggtctcgcgggcagcagttttcagcccctgggcgcctgttagtctggaaagtgggagagccccaggatgcagcctgggaaggcccggacttaggggcgcattggttgtgtggctacagctgggggagacatgggttagacttcggggagatttccagcccgcatgcggcgtcgttcgcgtggaacgcctggctggataccgagacgccggtcatcagggcttggatggggctgggcctgcagtctgggtgctgagagatgtggctcaggtgcccgcagacaggagcgcttattgcggtgcttctcttgcagggcctagaggggctctgtcacttctcctgctgctgctcgccccaccttcgaggcccgcagccggatgccccgctccatgcagctgcgcgggaaccctagtggattgtgggcgacgcggtcttacttgggcttccctcccaactgcatttcccgtggataccaccgagttggtgctgacaggcaacaatttaactgcgctacctccaggcctcttagacgctctcccagcgcttcggacggcccatctcggagctaatccctggcgctgtgattgccgattggttccgctccgtgcctggctggccggaaggccggagagggcaccatacagggatctgcggtgcgttgctcccccagcactaaggggcaggctgctgccgtacctcgctgaggacgagctgcgggctgcatgcgcgccaggccctctgtgctggggcgcactagccgctcagctggcgcttttggggctgggattgctccacgctcttctgctggtccttctgctgtgtaggctgagacggttacgagccagggccagagcacgcgcagcagcccgtctaagtcttactgatcccttggtcgctgaaagagccggaacagacgaatcctag

SEQ ID NO: 225037 - DNA, 534 bp, Artificial Sequence
  Description of Artificial Sequence: Synthetic coding sequence
atgcccgcttggggcgctctgtttctcttgtgggccacggcagaggccacaaaagattgcccaagcccctgtacatgtcgggctctggagaccatggggctttgggtggattgccgagggcacggcttaaccgctctccctgctctaccggcacggacaaggcatctgctcttggcgaataattcattgcagtcagttccccctggtgcttttgatcatttgcctcagctccagaccctggacgtaacacagaacccctggcactgcgattgttctctcacttacctccgcctgtggctcgaggaccgtacaccggaagccttgctgcaggtcagatgtgcctctccatccttggctgctcacggccctctggggagattaactgggtatcagcttgggtcatgtggctggcagctgcaggcttcatgggttaggccaggcgtgctgtgggatgtagccttagtggctgtcgccgctctcggattagccctgctggcagggctgttatgcgcgaccaccgaagcgctggattag

SEQ ID NO: 225038 - DNA, 987 bp, Artificial Sequence
  Description of Artificial Sequence: Synthetic coding sequence
atgaagcctgcaatggaaaccgccgctgaagaaaacacggaacagtcccaggagagaaaggttaattcacgagctgagatggaaatcgggagataccactggatgtatcccggttctaaaaaccatcagtaccatcccgtaccaaccctcggcgaccgcgcttcaccattgagttcccctgggtgctttgagtgctgcatcaagtgtcttggcggagtgccatacgccagcttggttgcaacgattttatgttttagcggcgttgcccttttctgtggctgcggccatgtcgccctcgccggaactgtcgctatattggagcagcacttcagtactaacgccagcgatcacgctctgttaagtgaggtgattcaattaatgcaatatgtgatttacggcatcgcctcttttttttttctatacgggataatattgctcgccgagggattttacacgacctctgctgtgaaagaactccacggtgaatttaaaaccacagcctgcggaagatgcatcagcgggatgtttgttttcctgacttacgtcttgggcgtggcatggctgggtgtctttgggttctctgcagtaccagtgttcatgttttacaacatttggtccacctgcgaggtgattaagtccccccagaccaatggcacaaccggcgtcgagcaaatctgcgtcgatatacgccaatacggcatcatcccctggaatgccttcccaggcaagatatgtgggtccgctctggagaatatttgtaacaccaatgagttctatatgagttaccacttgtttattgtagcatgtgcgggtgccggagccaccgttatcgcactgatccactttcttatgattctctcttcaaattgggcctatctgaaggatgcatccaagatgcaggcgtaccaggatatcaaggcaaaagaagagcaagagctacaagacatccagagcaggtccaaagaacagctgaactcttacacctag

SEQ ID NO: 225039 - DNA, 918 bp, Artificial Sequence
  Description of Artificial Sequence: Synthetic coding sequence
atgaagcccgctatggagaccgctgctgaggagaatacagagcagagtcaggaacggaaggtgaacagcagggcggagatggagattgggaggtaccattggatgtacccgggatccaaaaaccaccagtatcacccagtgcccacactgggagaccgggcttctcccctatcctctcctggctgtttcgagtgctgcatcaagtgtctcggtggagtaccatacgcatccttggtcgcgacgattctgtgcttctcgggtgtcgctctgttttgtggttgtggacacgtcgcgctggccggaactgtggcaatcctagagcaacacttctccacaaatgcctccgaccatgccctgctgtcggaagttattcagctcatgcaatatgtaatttatggcatcgcatcattcttctttctatatggaattattctgctggcagaggggttttacaccacatctgccgtgaaggagctccacggtgagttcaagacaaccgcttgcggtcgctgcatctcgggaatgttcgtgttcctcacctatgtgctcggagtagcttggctgggcgtcttcggattcagtgccgtgcctgtctttatgttctacaatatctggtccacctgcgaagttatcaagagcccccagaccaacgggacaacaggagttgagcaaatctgtgtcgatattaggcagtacggtatcatcccttggaatgcttttcccggaaaaatttgcggaagcgccttagaaaacatctgcaataccaacgaattctacatgagctatcacctgtttatcgtggcctgtgccggagccggtgctaccgttatcgccctactgatatatatgatggccaccacttacaactacgctgtgctgaaattcaagtcgagagaagattgctgcaccaaattctag

SEQ ID NO: 225040 - DNA, 798 bp, Artificial Sequence
  Description of Artificial Sequence: Synthetic coding sequence
atgaaacccgctatggagactgcagcggaagaaaatacagagcaatcgcaggaaaggaagggctgctttgagtgttgtattaaatgcttaggaggtgtgccatatgcctcactcgttgcaaccattttatgttttagcggcgtagccctcttctgcggttgcggccatgtcgcactcgccggtactgtggctatcctagagcagcacttttcgactaacgcgtccgatcacgcgcttctgtctgaggtgatccagctgatgcaatatgtaatatacggcattgcctccttcttcttcctgtacggcataattttactggctgagggcttttataccacatccgctgtcaaggaacttcacggggagtttaaaacaactgcgtgcggaaggtgtatctctgggatgttcgtcttcctcacctacgtgttgggagtggcatggcttggtgtgttcggttttagcgctgtgccagtgttcatgttttataacatttggtcgacatgtgaagtgattaagagtccccagacaaacgggaccactggggtggaacagatatgtgtggatatcaggcagtatgggattatcccatggaatgcctttcctggcaagatctgtggtagcgcacttgagaatatctgcaatacaaacgaattttatatgagttaccatctctttatagtcgcttgcgccggagccggagcaactgttatagcgttactcatctacatgatggcaaccacatataattacgccgtgctgaaatttaagtcaagggaagattgttgtaccaaattttag

SEQ ID NO: 225041 - DNA, 540 bp, Artificial Sequence
  Description of Artificial Sequence: Synthetic coding sequence
atgcagtacgtgatttacggtattgccagtttcttcttcctgtatggtatcatcttgcttgctgaggggttttataccactagcgccgtgaaagagctgcatggagaatttaagacgaccgcatgtggccgatgcataagtggcatgtttgtgttcctgacctacgtgctgggcgtcgcttggttgggcgtattcggattcagtgccgtgccagtgttcatgttctacaacatctggtctacctgcgaagtcattaagagcccacagacgaatgggactaccggggtggagcaaatctgtgtcgacatccgacagtacggaattattccatggaacgccttccccggtaagatttgtggctccgcccttgagaatatctgcaacaccaacgagttctatatgtcctatcacctgtttattgtcgcttgtgctggcgctggtgctacagtgattgctctgctgatttacatgatggcaaccacgtataattatgcagtgctgaagtttaaaagcagagaagactgctgcacgaagttctag

SEQ ID NO: 225042 - DNA, 741 bp, Artificial Sequence
  Description of Artificial Sequence: Synthetic coding sequence
atgggctgttttgagtgttgcatcaagtgtctcggcggagttccttacgcctccctggtcgccacgatattgtgtttctcaggtgtggcactcttttgcgggtgtggccacgtcgccctagctggaacagtagccatcttggaacagcacttttctaccaatgcatcggatcacgcactgctatctgaggtcatccagctcatgcagtatgtaatctacggcattgcctccttcttttttctgtacgggataattctattggctgagggattctatactacatctgcagtgaaggaactgcacggcgaattcaagacgaccgcctgtgggaggtgcatctccgggatgttcgtgtttttgacttatgtgctgggcgtagcctggctgggcgtgtttggtttcagcgcagtcccagtcttcatgttctataacatctggtctacctgtgaggtgattaagtcaccccaaacaaatggcactactggcgtagagcagatttgtgtggacattcgccagtacggcatcattccctggaatgctttcccaggcaagatctgcgggtccgccttagagaacatctgtaacactaacgaattttacatgtcctaccatcttttcattgtggcctgcgcaggtgccggtgctaccgtcatcgccctgctaatttatatgatggccaccacttataactacgccgtcctcaagttcaagagtcgtgaagattgttgtactaagttctag

SEQ ID NO: 225043 - DNA, 324 bp, Artificial Sequence
  Description of Artificial Sequence: Synthetic coding sequence
atgaagcccgcaatggagaccgccgctgaggagaataccgagcagtcgcaggaacggaaaggatgctttgagtgctgcatcaagtgtctcggtggcgtaccatatgcctcccttgtcgctaccatcctgtgcttttccggtgtcgctctcttttgcggatgtggacacgtagccctcgccggtaccgtggcgattctggagcagcacttctcgactaacgcctccgatcacgccttgctatctgaggttatccagctgatgcagtatgtgatctacggaatcgcctcctttttcttcctctacggcatcattctgctcgcatag

SEQ ID NO: 225044 - DNA, 909 bp, Artificial Sequence
  Description of Artificial Sequence: Synthetic coding sequence
atggaaatcggacgataccactggatgtacccgggatctaagaatcaccaataccaccccgttccgaccctgggcgatagagcatcaccactgtcttcgcccggatgttttgaatgctgcatcaagtgcctgggaggagtgccctacgcaagcctggtcgccacaatcctctgcttcagcggcgtggccctgttttgcgggtgtggtcatgttgccctcgcaggcaccgtcgccatcctggaacagcacttcagtacgaatgcttctgatcacgctctgctttccgaagttatccaactcatgcaatatgttatttacggcattgcctccttcttctttctgtatggcattatactgctggccgaaggattttacactacaagcgctgttaaggaactgcatggcgagtttaagacaaccgcctgcggccgttgcatttccggaatgtttgtttttttaacttacgttttaggggttgcatggctgggggtgttcggtttctcagccgtgcccgtgtttatgttttacaacatctggtcaacatgtgaagttatcaagtcaccgcagaccaacggcaccacaggcgtggaacagatttgcgtggatattaggcaatacgggatcataccatggaatgcttttccaggcaagatctgcggaagtgctttggagaatatttgtaatacaaatgaattttacatgtcttaccacttgtttatagttgcatgcgcaggagcaggagccaccgtcatcgccttgattcactttttaatgatcttatcttccaactgggcctatctcaaggacgcttccaaaatgcaggcctaccaggacatcaaagccaaagaggagcaggagctgcaagacatccagtctcggtcgaaggaacagttgaactcctatacatag

SEQ ID NO: 225045 - DNA, 1863 bp, Artificial Sequence
  Description of Artificial Sequence: Synthetic coding sequence
atgtctccatctccaaccgccctgttctgcctgggtctgtgtctgggaagggtgccggctcaatctgggcctttgcctaaacctagcctccaggcgctgccgagttcactggtccccctagaaaaaccagtgaccttgcgttgtcagggacccccaggggtggatctatatcggctggaaaaactgtcaagtagtaggtatcaggaccaggctgtattattcatccctgctatgaagcgtagcctcgcaggtaggtaccgctgttcataccagaacggatccctgtggagcctaccaagtgaccagttggaactggttgccacaggagtgttcgcgaaaccttcactcagtgcccaacccggacctgcggtgtcttccggaggggacgttacccttcagtgccaaacaaggtacggatttgaccaattcgccctgtacaaggagggcgaccctgccccttacaaaaatccggaacgctggtatcgagcctccttccctatcattacagtgaccgcggcacattctggtacctaccggtgctactccttttctagcagagatccttacctgtggagcgcgcctagcgacccactcgaactcgtggtcaccggtaccagtgtgacaccctccagattacctacggagccccctagccccgtggcagaattttctgaggccaccgcggagctgacggtcagttttaccaatgaagtgttcacaaccgaaacgagtcggagcatcacggctagtcccaaggagtccgattctcccgctggtgaatcttgtccccctgtactgcaccagggacagccgggtccagacatgccccgtggttgcgatccgaacaaccctgggggtgtcagcggacgaggacttgcccagcccgaggaggccccagctgcgcaaggccaagggtgcgcggaggccgcatcagcccctcccgctccacccgcagatccggaaattaaacggggatccggttggcgcccaacgggctgctcccagcctcgcgttatgtttatgacagccgaacctcaggcccgttcttatcccagggaaggcagttggcacggccgaagactcaaggactggcgagtgtggagcgtggaggccggtggccagcgcctacaactctggaaacgcggtcatgccgcttccagctggtgctctattcgcgagccatttggacagtgtctgtctgtctgtctacccctctgtttgcgggcaccatccatttgggatggcaggaacctatggaggcctcaccctcccccttgcactctatggatgacatggtacccaggctggacgacctactggcctctctcctcgacgtccctgatctgggcacctgatggcagcctgcggttccccgctctccgggtggattctgtgccttcctccgtgcaaaacccgcctgtcctgccattcggaccattgtgctcatgtctagtgtttcccaggaacagccatcctcattccatatcccattgcggtctgactaacttgctgtccagcctgcggactggactagccggtagccttggcatgtcctttatttttctgtctgtcaagctggctagatgcccgctgccctttacccttgagaataagatttcactctgcaacatggtgaagccacacctgtaccagcagaataaaaagacacagaaactggccaggtgtgggggtgcatctctgtattctcaacagctcaggggccttaggtgggagaacgggctgtccctgggcggacgaggttgctccgagctgagatcacatcattgtacattagcccgtgtaacaaaacccgattttgtgtcaaaaaatacagggatgaacatgagcatcaccctcatttag

SEQ ID NO: 225046 - DNA, 966 bp, Artificial Sequence
  Description of Artificial Sequence: Synthetic coding sequence
atgtcaccaagccctactgccttattctgcctaggcctttgcctcgggagggtgccagcacaatccggtccactgcctaagccaagtttacaggctctgcctagtagcttggttcctttggaaaaaccggtgactctgcgttgtcagggacctcctggcgtcgatttgtatcgactggaaaagttgtcaagcagcagataccaggatcaggcagtgctgttcattcccgctatgaaaaggtcccttgccggtcgctacaggtgttcctaccagaatggctcgctttggtcactcccctctgaccaactggaacttgtggcaacgggagtctttgccaaaccttctctgagtgcccagccgggacctgccgtatcaagcggcggagacgtgacacttcagtgccagacaagatacggttttgatcagttcgccctctacaaggagggagatcctgctccttacaaaaatcccgaaaggtggtaccgcgcatcctttcctatcatcactgtcactgcggctcatagcgggacctatcggtgctattccttcagcagtagggacccgtatctttggagcgccccaagcgatcctctcgaactcgtggtaaccgaatttagtgaggccacagctgagctgaccgtgtcctttaccaacgaagtgttcaccacagagacctcccgaagtatcactgcgagccccaaggagagtgattcaccagccggtcccgctcgacagtactatactaaggggaacctcgtgaggatctgcctgggggcagtcatactcataatcctggcgggttttctggctgaagactggcatagtagaaggaagaggctacgtcaccgaggcagagccgtgcaacggccattgccaccccttcccccactcccattaacccggaaatcaaacggcggacaggacggcggtcgccaggacgtccacagtcgtggtctctgttcctag

SEQ ID NO: 225047 - DNA, 1020 bp, Artificial Sequence
  Description of Artificial Sequence: Synthetic coding sequence
atgtccccatcgcccacagctctgttctgcttaggcttgtgcctgggaagagtgcccgctcagagtggaccactcccaaaaccctccctgcaagcccttccctcctccttggtacccctggagaagcctgttactcttagatgtcaaggacccccaggcgtggatctgtatcgcctggagaaattatcaagcagtcgctatcaggaccaggccgtactctttatcccagctatgaagagatccctcgctggcagatatcggtgcagctaccagaatggctctctctggagcttaccttcggaccagctggagctagtggctacaggggtgttcgccaagccatcgttatctgcgcaacccggacccgctgtgagttcaggcggagacgtgacactgcagtgccaaacccggtacgggttcgaccaatttgccctgtataaagagggggatccagctccttataaaaaccctgaaaggtggtacagagcgtcatttcctataatcacggtgactgcagcacactctggcacctacagatgctactccttctccagcagggacccctacctatggagcgcccctagcgacccactggaactggtggtcaccggcactagtgtgaccccctcccgattacccacagagcctccttctcctgtggccgagttcagcgaggccacagccgaactgaccgtgagctttaccaatgaagtttttacgactgagactagccgctctattactgcgagccctaaagaaagcgattctcccgcagggcctgcacgccaatactacacaaagggcaacttagttaggatctgccttggtgcagtgatcttaattatcttggccggatttcttgccgaggactggcactcgaggagaaaaagacttcggcacagaggaagagccgtacagaggcctctcccgccactgccccctcttcccctgacgcgcaagtctaacggcggtcaggatgggggaaggcaggacgtgcactccaggggcctgtgttcctag

SEQ ID NO: 225048 - DNA, 1866 bp, Artificial Sequence
  Description of Artificial Sequence: Synthetic coding sequence
atgggtcttctttcagatccagtgagaagacgtgccctcgccagactggtcttacgactgaacgccccactgtgtgtacttagctatgtggccggaatagcgtggttcttagcgcttgtatttccccctctcacacagaggacatatatgagtgaaaatgctatgggatcaacaatggtggaagagcagtttgcaggcggagatagagcacgggcttttgctcgcgacttcgcagcacaccgcaaaaaatccggagcgctccctgtagcctggctcgagaggaccatgagatctgtgggattggaagtctatacccaaagtttctcgcggaagctgccattcccagatgaaactcacgagcgttacatggtgagcggcaccaatgtgtacggcatcttgagagcgccacgggcagctagtaccgaatccctggtgctcactgttccttgcggatccgactccacgaatagccaagccgtgggtctactacttgctctcgcagctcacttcaggggccagatctattgggctaaggacattgtcttcctggtaaccgaacacgacttgttgggtacagaagcatggctagaggcatatcacgatgtgaacgtaaccggtatgcagtcaagtcccctgcagggcagagctggcgctatccaggctgcggttgcattggaactctcctcggacgtggttacctccctggatgtagcggtagaggggttgaatggccaacttcctaatctggatttgctgaaccttttccagaccttttgccagaagggagggctgttatgcacacttcagggaaagttgcagcctgaggactggacctctctggatggcccactgcaggggctgcagacattactgctgatggtgctgaggcaagcatcaggtcgccctcatgggagccatgggctttttttaagatacagagtcgaggcgctcactctgaggggcatcaacagcttccgacagtacaagtacgacctggtcgctgtggggaaggctctggaaggaatgttcagaaagctcaatcacttgctcgagcgccttcaccagtctttttttctctacttgctgcctggattatcccgttttgtctctattggcttgtatatgcctgcagtcggttttctgctcctggtgttaggcctcaaagccctggagttatggatgcagctacacgaagcgggtatgggcctcgaagagcccggaggggctcccggtccatccgtgccattacccccatcacaaggcgtgggactggccagccttgtcgcacctctgctcatcagccaggctatgggattggccttgtacgtgctgcctgtgctgggccaacacgtggctacccaacactttccagttgccgaagcagaagccgtcgtcctgactttgttggcaatttatgcggctggcctagcactgccccacaatacgcaccgagtggtgtcaacgcaggcaccagacaggggctggatggctctgaaactggttgcgctcatctatctagctctgcagctcggatgcatcgctcttacaaacttctccttgggctttctgctggccaccacaatggtgccaacagcggcattggctaagcctcacgggcctcgaactctgtacgccgctctgctggtcctcacaagccctgcagcaaccctgttgggatcactgttcctgtggcgagagttacaggaggcccctttgtctctggccgagggatggcaactctttctggcagccctcgcgcaaggggtgctggagcaccacacctacggtgccctcctttttcctctactctctctcgggctgtatccatgttggctgttattctggaatgtactattttggaagtag

SEQ ID NO: 225049 - DNA, 1686 bp, Artificial Sequence
  Description of Artificial Sequence: Synthetic coding sequence
atgggcctgctttcggatccagtgaggcggagagcccttgcacgtctggtgctgcggttgaacgctcccctttgggccctgcccgtcgcttggcttgaaagaacaatgagaagtgttggcctcgaggtctacacccagtctttctctcgtaagctgcccttccctgacgagacccacgagcgctacatggtcagcgggactaacgtgtacgggatcttgcgagctccccgagccgcaagcaccgaaagcctcgtgctcaccgtgccgtgtggttcagactccaccaattctcaggcagttggccttctcttggcactcgctgcccacttcaggggccagatctattgggcaaaagacattgtcttcctggtcacagagcatgatctgctgggtacagaggcatggctggaggcctaccacgacgtaaatgtgaccggtatgcagagcagccctttacagggaagggccggagctatccaggccgctgttgccctcgagctgtctagcgatgtggtgacaagcctggatgtggcagtggaaggcttaaacggtcagttgcccaatttagacctgctgaatctctttcagaccttttgccaaaaaggtgggttgctgtgcaccctgcagggcaagctccagcccgaggattggacttctctcgacggcccactgcaggggctgcagaccttattgctgatggtgctgaggcaagcctccgggcgaccacatggatcccatgggctgttcctgcgctatcgagtcgaagccttaacgctcagagggattaactcttttaggcagtacaagtacgatttggtggctgtcggcaaagctctggagggaatgtttcggaagctcaaccacctcctcgagagactgcaccaaagctttttcctttatctgcttcccggactcagccgctttgtttctatcggactttacatgcctgctgtgggttttcttctgctggtgttgggccttaaggccctcgaactgtggatgcagctgcacgaagccggtatgggcctcgaagaacccggtggtgccccaggcccatctgttcctcttcctccatctcagggggtaggcctcgcctctttagtcgctccacttcttatatcacaggctatgggactggccctttatgttctgcctgtgttagggcagcatgttgctacacagcactttccagtggccgaggctgaggccgtagtgctcacactcctggccatatatgcagcaggtcttgccctgccgcacaatacacacagggtggtctcgacccaggccccagatagaggctggatggcccttaaactggttgctctgatctacctggctctacagttgggttgtattgcgctgactaacttctcgctcggcttcttgctggccaccaccatggtcccgactgccgctctggccaagccacacggcccacgaacactgtatgcagctctgttggttcttacctccccagcagcaaccctgctgggatcattatttctgtggcgagagctgcaggaggcaccactttctctcgccgaaggctggcaactgttcctcgcagccttagcacagggggtgctcgaacatcatacctacggagccctgctctttcctctcctgtcgctcggcttgtacccctgctggctgctgttctggaatgtcctgttctggaagtag

SEQ ID NO: 225050 - DNA, 555 bp, Artificial Sequence
  Description of Artificial Sequence: Synthetic coding sequence
atgaaggccctgggcgctgtcctgctcgcccttctgctctgcggcaggccgggaagggggcagacgcagcaggaggaggaagaggaagacgaggaccacggccctgacgattacgacgaggaagatgaggacgaagtcgaggaggaggagactaaccgattacccggagggagatcaagagttctcttacgatgctatacttgtaaaagtctaccccgtgacgaaagatgcaacctcacgcaaaactgcagtcacggtcaaacatgcaccacactgatcgcccacggtaacacagagtctggtctgctcacaacacattcaacctggtgcacagactcttgtcagcccatcacaaagactgtagaaggcacccaggtcactatgacgtgctgtcagagtagcctttgtaacgtccctccatggcagtcaagcagagtgcaagatccaacagggaaaggcgctggcggacctcgaggatctagtgagaccgttggcgctgcactgctcctgaacctgttggcagggctcggcgcaatgggggctaggcggccttag

SEQ ID NO: 225051 - DNA, 582 bp, Artificial Sequence
  Description of Artificial Sequence: Synthetic coding sequence
atgggtaagcagaattctaaattaagaccggaagtgatgcaggaccttctcgagagtactgacttcaccgaacatgaaatccaggagtggtataaaggcttccttcgtgattgcccttcagggcacctgtcaatggaagaatttaaaaagatctatggaaatttctttccatacggcgatgcttcgaagttcgccgagcatgtgtttcggacattcgatgccaatggtgacggaacaatagacttccgggaatttatcatcgccctgtcggttacttcacggggtaaactggaacagaagctcaagtgggcctttagtatgtatgatctggatgggaacggatacatctccaaggctgagatgctagaaatcgtgcaggccatatacaagatggtgtccagtgtgatgaaaatgcccgaggacgagagtactcccgagaaaagaacagaaaagatcttccggcagatggatacaaatagagacggaaagttgagcctggaagaatttatcaggggcgcaaaatccgatccatcaatcgtgcggttactacagtgcgacccttccagtgctggccagttctag

SEQ ID NO: 225052 - DNA, 756 bp, Artificial Sequence
  Description of Artificial Sequence: Synthetic coding sequence
atgtccgcatacgggatgcccatgtacaagtccggggatctggtcttcgccaaactgaagggatacgcccattggcccgctcgaatagaacatatgacccagccaaatcgctaccaggtcttttttttcggtacccacgagaccgcatttctttctccaaagcgcctgtttccttacaaggagtgcaaggagaagtttggcaagcctaataagaggcggggtttctccgcaggactctgggagatagaaaataatcctacggtccaggcgtccgactgtcctctcgcatccgagaagggctctggtgacggaccctggccagagccagaagccgctgagggtgacgaggacaaacccacacatgccggtgggggtggagatgaacttggaaagcccgacgacgacaagcccacagaagaagagaaggggccactgaaaaggtcagccggtgaccccccagaggatgcacctaagagaccaaaggaggcagctccagaccaggaggaagaggccgaggcagagcgggctgctgaagctgagcgtgctgctgctgcggcagccgctacagcagttgatgaggagtcgccgttcctggtggctgtcgagaacggtagcgcgccttctgaacctgggcttgtgtgtgaaccccctcagccggaggaggaagagctccgtgaagaggaggtggccgacgaggaggcatcccaagaatggcacgccgaagctccaggtggaggtgaccgggactctctctag

SEQ ID NO: 225053 - DNA, 531 bp, Artificial Sequence
  Description of Artificial Sequence: Synthetic coding sequence
atgtccgctttccggctgtggccaggcctactgatcatgctcgggtctctgtgccatcgcggaagcccatgcggcttgtccactcacgttgaaattggacatcgagcgcttgaatttttgcaactgcacaatggtagggtgaattatcgggaattgctgctggaacaccaggacgcctatcaggccggaatagtgtttccggactgcttctatccctccatctgcaagggcggaaaattccatgatgtttccgagagtacgcactggacaccttttcttaacgcgtctgtgcattacattcgggagaactatccgctgccatgggagaaagacaccgaaaagttagtggcattcctctttggcataacctctcatatggccgctgatgtttcctggcactctctcggattggaacagggattcctgaggactatgggcgctattgatttccacggttcatatagcgaggcccactccgctggtgactttgggacggtgtaccttcaccttctgaacttcctcgtcgtttag

SEQ ID NO: 225054 - DNA, 831 bp, Artificial Sequence
  Description of Artificial Sequence: Synthetic coding sequence
atgaacagcaagaggatgctgttactggtgctgttcgccttttcactaatgctggttgaacgctatttccgaaatcaccaggtggaggaacttcggctctctgattggtttcacccaagaaagagacccgatgtgattacgaaaactgactggttagcacccgttctttgggaaggcacattcgataggcgcgtgcttgagaagcactatcgaagaagaaacatcaccgtggggctagcagtctttgccaccggccgttttgccgaagaatacctgaggccctttctgcatagcgctaataagcactttatgactggatacagggtgatcttctacattatggtggacgccttcttcaaactcccagatatcgagccctcacctttaaggacttttaaagcctttaaggtcgggacagagagatggtggctggacggacccctggtgcatgtgaagagtctgggggaacatatcgccagccatatacaggacgaagtggatttcctgttctccatggctgccaatcaagtgttccagaacgagtttggtgtggaaaccttaggtccgttggtggcccaactccacgcttggtggtactttcgcaacacgaagaattttccttatgagcggcgaccgacttcggcagcctgcatcccttttggacagggcgatttctactatgggaacctaatggtggggggtacacctcacaatattctggatttcattaaggagtacctgaacggtgtgattcacgacatcaaaaatggtctcaattccacgtacgaaaagcatctgaacaaatacttttacctgaacaagcctacatag

SEQ ID NO: 225055 - DNA, 2166 bp, Artificial Sequence
  Description of Artificial Sequence: Synthetic coding sequence
atgctcccacgcggaagaccccgagctctgggggcagcggcactcctgctcttgttgctgctcctcggctttctgctcttcggcggtgacctcgggtgtgaacggagggagcccggaggcagggcaggagctccgggttgtttcccgggaccactgatgcccagagtgcctcctgacgggaggctccgcagggccgcagccctggatggggaccccggtgcaggcccaggagaccataataggagcgactgtggcccacagcctcccccaccaccaaagtgtgagctccttcacgtagccatagtgtgcgctggtcacaattcatcacgcgacgtgattacgctggttaaatccatgctgttctaccggaagaacccactccacctccaccttgtgacagacgctgtggctcggaacatacttgagactctgttccacacttggatggttccggctgttagagtgagtttctatcacgctgatcaattaaagccccaggtttcctggatccccaacaaacattatagtggtttatatggtttgatgaagcttgtactcccatcggctctgcctgctgagcttgcacgcgtgatcgtgcttgatacagatgtcaccttcgcatcagacatcagcgagctgtgggcacttttcgcccacttctctgatacgcaggccattggccttgttgaaaaccagagtgattggtatctgggcaatctgtggaaaaatcaccgaccctggccggctcttgggaggggcttcaacaccggagtcatactcctccgactggacagattgaggcaagccggatgggagcagatgtggcgattaactgccagacgtgaactcctctccttgccggcaacttctctcgctgaccaagatatatttaacgccgtgatcaaagaacatcccggacttgtacagcgattgccatgtgtgtggaacgttcagctctccgatcacacgctcgctgaacgctgttacagcgaagcttctgacctaaaggttatacactggaacagcccaaaaaaactccgtgtaaaaaataagcatgtggaattttttcggaatttttacctgacctttcttgaatacgacggtaatcttttgaggagagaattgttcgtctgtccgtctcagcccccacccggtgcggagcagctgcaacaggccctggcacaattagatgaagaggatccatgcttcgagttcagacagcagcagttgacagtgcaccgtgtccacgtaactttcctccctcacgagccccctcctccccgaccgcatgacgtcacactggttgcccaactgagtatggatcggcttcagatgctcgaggccctctgcaggcactggccaggccctatgagtctcgccctctacctaactgacgcagaggcccagcagttcctccatttcgtggaagcctctccagtgctagcagcgaggcaagacgtcgcctaccatgtcgtatatagagagggcccactgtatcccgttaaccagcttaggaacgtggctctggctcaggctctcactccttatgtgttcctgtcagatatcgattttttaccagcatatagtttgtacgattacttacgggctagcatcgagcagctaggcctaggcagcagaagaaaggccgcactggtggtgccagcttttgagacacttcgttacaggttcagcttcccccactcaaaagtcgagcttctggctctacttgatgcaggaaccctgtacacatttcgctaccatgaatggcccagggggcacgctccaacagactatgcccgttggcgagaagcacaggccccatacagagtacagtgggccgcaaactacgagccctatgtcgtcgtgcctcgtgattgcccgagatatgaccctcgctttgtaggtttcgggtggaataaagtggcccacatcgtggaactcgacgcacaggaatacgaattgttggtcctgcccgaggcattcacaatccatttaccacatgcacccagcctcgatatctccaggttcaggagttctccaacgtatagagattgcctgcaggcactgaaggatgagttccatcaagatcttagccgacaccatggtgccgcagctctgaaatatctccctgctctccagcagccccaaagtcccgctagggggtag

SEQ ID NO: 225056 - DNA, 870 bp, Artificial Sequence
  Description of Artificial Sequence: Synthetic coding sequence
atgtggcgactgactgcgaggcgcgagctcctcagcctgcccgctacttcactagcagaccaagacatctttaatgcagtcatcaaagaacacccagggctcgtccagagactcccatgtgtgtggaatgtacagctttccgaccacacgcttgccgagcgctgttatagcgaagcgtcagacctaaaagtcatccactggaactcccctaaaaagttaagggtcaagaacaaacacgtcgaattcttccgcaatttttatcttaccttcctagagtatgacggaaacttgctgagacgggaactgttcgtctgcccttcccagccaccccctggtgctgaacagttacagcaggctctggcccagctggatgaggaggacccatgttttgaattccgccaacagcagctcactgtccatagggtgcatgttacattcctgccacatgagcctccaccacctcgccctcatgacgtgacgctggtcgcacagctgtcaatggacaggctgcagatgttagaggcgctgtgcagacattggcccggaccaatgtcgctagccctttatttgacagatgccgaggcccagcagttcctgcatttcgttgaagcgagtcccgtactcgccgctaggcaggatgtcgcctatcacgtcgtatatcgggagggtccactatatcccgtcaatcaactgcgaaatgtcgcactggctcaggccctgactccctacgtgttcctctctgatatcgattttctccctgcttacagcctttacgactacctccgcgaagccagagcaggtttcaatagtagttccacctgtggttgcgcccatccatcccatcaggctcgctggccaatggttgtttag

SEQ ID NO: 225057 - DNA, 2166 bp, Artificial Sequence
  Description of Artificial Sequence: Synthetic coding sequence
atgttgccccgaggccgtcccagagccctgggggcagcagctttgctcttgctgttgctcctgctggggtttttgctcttcgggggagatcttggctgtgagcgtcgggaacctggcggtcgcgcaggtgcgcctggctgctttccaggaccactgatgcctagagtgcctccggatggcagattacgcagagctgccgcattagatggcgacccaggtgcaggtccaggggatcacaatcgttcagattgcggcccacagcctcctccccctcctaaatgtgagcttttgcatgttgcaattgtctgtgctggccacaatagctcacgggatgttatcacgttagtgaagtccatgctgttttaccggaaaaatcccctccacctgcaccttgtaaccgacgccgttgcccgaaatatcttggaaacgctgtttcacacctggatggtccctgctgtgcgcgtctccttctatcatgccgatcagctgaaacctcaggtgtcatggatccctaataagcactatagtggcctgtacggacttatgaagctggtgttgccttctgcccttcccgcagaactagccagggtgatcgtcctggacaccgatgttacattcgccagtgacatcagtgaactctgggctctctttgcacacttctctgacactcaggcgatcggcctggtggaaaaccagtctgactggtaccttggcaacctttggaaaaaccaccggccttggccagccctgggaagggggttcaataccggcgtcatcctgctgcgccttgatcgtttgcgtcaagccggatgggagcagatgtggaggctaacagcacgtagggaacttttgagtcttccggcaacatccctggccgatcaggatattttcaacgccgtcattaaggagcaccccggattggtccagcgtctgccatgtgtgtggaatgtgcagctcagtgaccacactctggcagagagatgctatagcgaggcctccgatttgaaggtgatccactggaattcccccaaaaagctgagagtgaagaacaaacatgtcgaattcttccgtaacttctacctcacatttctagaatatgatggaaatctcctgcgacgggaactgtttgtgtgtccctcgcagccaccccctggcgcagagcagctgcagcaggctctggcccagctggatgaagaagacccttgttttgaatttcggcagcagcagttgacagttcaccgggttcatgtcactttcctcccccatgagccaccccctccgagaccacacgacgtcactctcgttgcacaattatccatggaccgcttacagatgctcgaggctctgtgcagacactggcccggacctatgagcctggcactttacctgaccgatgctgaggcccagcaatttttgcacttcgtggaggcttcgccagtgctggctgctagacaggacgtcgcctaccatgtcgtgtatcgcgaagggcctttatacccagtgaaccagctgcggaacgttgcattagcacaggcacttaccccatacgtttttcttagtgacattgactttctccccgcttacagcctttatgattatctgcgagcctcaatcgaacagctcggtctgggatcgaggcggaaagctgccctcgtggtgccagctttcgaaactcttcgttatagattctcattccctcacagtaaagtagagctgttggccctgctggatgccggtactctctacactttccgttaccatgaatggcctagaggacacgctccgactgattatgccagatggcgcgaggctcaggcaccttacagagtccagtgggctgccaactacgagccatacgtggtggtgcccagggattgcccgagatacgatcctcgttttgtgggattcggctggaataaagtcgctcacatagttgaactggatgcccaggagtacgaattgctggttttaccagaagccttcactatccatcttccgcacgcaccttcgcttgacatatctaggttccgctcctctcctacatacagggattgtcttcaggccctcaaggacgaattccaccaggatttgtcaagacatcacggggctgccgctcttaaatatctgcccgctctgcagcagccccagtccccggcaaggggttag

SEQ ID NO: 225058 - DNA, 2166 bp, Artificial Sequence
  Description of Artificial Sequence: Synthetic coding sequence
atgctgccccgaggccgaccgagggccctaggggcagctgctctcctactgttgctcttgctgctaggattcctcctgttcggaggagatttaggatgcgaacgcagggaacctggtgggcgagctggggctccgggatgtttccccggaccactgatgcctagggtacccccagacggtcgcttgcgacgggctgccgcactggacggcgacccaggggcagggcctggtgatcacaacagaagtgattgcggccctcagccacctcctcccccaaaatgcgagctgttgcacgttgcaatcgtttgtgccggacacaattcctcccgcgacgtgatcacgctcgtgaaatctatgctgttctaccggaaaaatcctcttcacttgcaccttgtgactgacgcggtggctcgtaacatcctggaaacactgtttcacacatggatggtgccagctgtgagagtgagcttctaccacgccgaccaattgaagccacaggtgagctggattccaaataagcattatagcgggctttatggattgatgaaactggttttaccgtctgcgcttcctgctgagctggccagagtcatagtgctggacaccgacgtgacgtttgcctctgacatttctgaactctgggctctcttcgcccacttctccgatacccaggctataggtctggtggagaaccagtcagattggtacctggggaatctttggaaaaaccaccgaccctggcccgcactcggcagaggctttaacacaggtgtgatcctgttgcgcctcgacagactgcggcaggcgggatgggagcaaatgtggcgcctgaccgctaggcgggaactgctatccctaccagcaacttccctggccgaccaggatatttttaatgccgtcattaaggaacatcctgggttagtgcagagattgccctgtgtgtggaacgtgcagttgtcagaccatactcttgccgaacgctgctacagtgaggcaagtgatctcaaagtaatccactggaactcccctaaaaagctgcgagtaaaaaacaagcacgtggaatttttccgcaatttctacttaacgttcctcgaatatgatgggaatctactgcggagagagctgtttgtgtgtccctcgcagccgccacccggagctgaacagctgcagcaggcccttgcccagctcgacgaggaggacccctgcttcgagtttaggcagcagcaactcactgtgcatagagttcacgtgacattcctcccacacgaaccaccacccccacgcccacatgatgttactttagtggcacagttatccatggatcgtctgcaaatgctcgaagccctgtgccgccattggcctgggccaatgagtttggctctgtacttaaccgatgctgaggcccaacagtttctgcatttcgtggaagcaagccccgtactggcagccaggcaggatgtcgcttaccacgtcgtctaccgggagggaccactgtaccccgtgaatcagctgcggaacgtggctttggctcaggctctgactccttatgtgttcctgtcagacatcgacttcctccccgcatactcattatacgactatctccgcgctagcattgaacagttgggcttggggagtagacgaaaggccgctctggtagtccctgcattcgaaaccctccgctatcgcttctcatttccacattccaaggtggagctgttggccttgctggatgccggaacactctatacattcaggtaccatgagtggccgagaggacatgccccaaccgactatgccaggtggcgggaggctcaggctccttaccgcgtacaatgggccgcaaattatgagccgtatgtggtcgtgccacgggattgtcctcgatatgatccacgctttgttggctttgggtggaataaggtggctcacattgtcgagcttgatgctcaagagtatgaactcttggtcttgcccgaagcttttacgattcacctgccacacgccccaagcctagacatatcacggttcaggtcctcacccacctacagggactgtctccaggctctcaaggatgagttccaccaggacctgagtcgacatcatggcgcagccgctttaaaatatttaccagccttacagcagccccaaagtcccgcacgaggatag

SEQ ID NO: 225059 - DNA, 2073 bp, Artificial Sequence
  Description of Artificial Sequence: Synthetic coding sequence
atgctcccaagaggaagaccccgtgctcttggggctgctgctctgcttttactgctcctactcctggggtttctgctgttcgacggacggctacggagggcggctgcacttgatggtgatccaggggcagggccaggcgatcacaatcgctccgactgtggccctcagcctcccccaccaccaaagtgcgagctgctacatgtggctatcgtgtgtgctggtcataatagtagccgggacgttataacgttggtcaagtccatgcttttctacaggaaaaatcctttgcacctgcatttagtcacagatgccgtggcgagaaacattctcgagacgctgtttcatacatggatggttcctgccgtgcgggttagcttctatcatgccgaccaattgaaacctcaggtgtcctggatccccaataagcattactcagggctgtacggactaatgaagttggtgctgccgtcagccctgccagcggaactggcacgggtgatagtgctggatacggatgttacttttgcctccgacatctcagaactctgggccctgttcgcccatttctccgatactcaagctatcggtctagtggagaaccagtctgattggtatctgggaaatctgtggaagaaccatcgaccctggccagctctgggccgaggcttcaatacaggagtgatcctccttaggctggaccgcctacggcaagctggctgggagcagatgtggaggctgaccgctaggagagaactgctgtccctccccgctacatcactggcggaccaagacattttcaatgcagtcattaaagaacaccccggtttagtccagagactgccgtgcgtttggaatgtccaactaagtgatcacacattggctgagcgctgctactctgaagcctcagatcttaaagtcatccattggaacagtcctaagaagctaagagtcaaaaacaagcatgtggagttctttcggaatttttacttgacatttctggagtacgacggaaacttattacggagggagttatttgtgtgcccgtctcagcctcctccgggagcagagcagctccagcaggctctcgcccaactggatgaagaggacccttgcttcgagtttagacagcagcaactgaccgtgcacagagtgcatgtcaccttcctgccacacgaacctccacccccacgaccccatgacgttaccctggtcgcgcagctatcaatggaccgattgcagatgttagaggccttgtgtagacactggcctgggcctatgtctctggccttgtatctgacagatgccgaggcgcagcagtttcttcacttcgtggaggcctccccagtactggctgcaaggcaggacgttgcataccacgttgtttaccgcgagggtccactttatcctgtgaaccaactccggaacgtagccttagcccaagcccttactccatacgtgttcctcagtgatattgactttctgcccgcttatagcctgtacgattatttgagagcctcaatcgagcagctgggactggggtcacgaaggaaagctgcactggtggtgcctgcttttgaaacccttagataccgtttctcttttcctcatagtaaagtcgagctactggccctgctggacgccggaacactatataccttccgctatcacgagtggccaagaggccacgccccaaccgattatgctaggtggagagaggcccaagcaccctatcgggtgcagtgggccgctaactacgagccttacgtcgtcgtgcctcgggattgtccaagatatgatcctaggttcgtggggttcggatggaacaaggtggcccacatcgtcgaactggatgctcaagaatatgagctcctcgtgctccctgaggcgttcactatccatcttcctcacgccccaagtcttgacatctcccgctttcgctcaagccccacctaccgggattgtctgcaagcactgaaggatgagttccatcaggacttgagtcgccaccatggggcagccgctctgaaatatctacccgctctccagcagcctcagagcccagctcgtgggtag

SEQ ID NO: 225060 - DNA, 1122 bp, Artificial Sequence
  Description of Artificial Sequence: Synthetic coding sequence
atgtccatcctgatcatcgaggcattttacggtgggtctcacaagcagctggtggacctgttacaagaggagttaggagactgcgtagtgtacacactacctgcaaagaaatggcactggcgggctcggacaagcgccttatacttttctcagaccattcccatcagtgaacattatcgcaccctcttcgcttcttccgtgttgaatctgaccgagctggccgctctgagaccagacctggggaagctcaagaaaatactttacttccacgaaaaccagctgatttaccctgtcaaaaagtgccaggaacgggacttccagtacggatataaccaaatactgtcctgtttagtcgccgatgtggttgtgtttaactccgtgtttaacatggagtctttcctgactagcatgggtaaatttatgaagcttatccccgatcaccggcctaaagatctggagagcatcattaggccgaagtgtcaggtcatctacttcccaattcgttttcccgacgtatcccggttcatgcccaagcataagacaactcacttaaagaaaatgctcggactaaagggtaacggaggagctgtcctttccatggcactgccattccagcctgagcaaagggactccgaggatttgctcaaaaactttaattccgagtgtgacacccattgtggtctcgacaccgccagacaggagtacttggggaactctctccgacaagaatcagacctgaaaaagtctacttcttcagataactcctcatctcaccatggtgaaaacaagcagaatttgaccgtggacccttgtgacattctcggcggagtcgataaccagcaaagattgctgcacatagtgtggccacaccggtggctggaggccgtgtattgcgggtgttatcccctatgtccaaaagatttggtgtatccggagatttttccagctgagtacctctatagcactcccgagcaactctctaaacgcttgcaaaatttttgcaaacgcccagacataattcgcaagcacctctataaaggggagattgcccctttttcatgggccgcactgcatggaaagtttcgtagcctcctgacaactgagccccgtgaagatctgtag

SEQ ID NO: 225061 - DNA, 1377 bp, Artificial Sequence
  Description of Artificial Sequence: Synthetic coding sequence
atgtcaatcctgattatcgaggccttttacgggggttcacataagcaattagttgaccttctgcaggaggaattgggggactgcgtggtttatacattgcctgcaaagaagtggcactggcgggctagaacgagcgccttgtatttttcacaaaccatccctatttcggaacactatcggaccttgttcgcgtccagtgtactcaatttgactgagctggctgctctcaggcctgatctgggcaagctgaagaaaatcttatattttcacgaaaatcagttaatctaccccgtgaagaaatgtcaagaaagagattttcaatacggctataatcagattctcagctgtttggtagccgacgtggtggtgtttaactcagtgtttaatatggagagttttcttacatctatgggcaagttcatgaagttgattcccgatcaccgacccaaggacctggagagcatcatccgtcctaaatgtcaggtcatttactttccgattcgattcccagacgtttccagattcatgccaaaacataaaaccactcacctgaagaagatgctcggcctaaaggggaatgggggtgcagtgctgagtatggcgctgccctttcagccagagcagagagattccgaagacttattaaagaacttcaattccgagtgtgatacgcactgtgggcttgataccgcccgacaggagtacttggggaattctttacggcaggaaagtgacctaaagaaaagcacaagctccgacaattctagctctcaccacggcgagaacaagcagaacctcactgtggacccctgcgatattctcggcggagtggacaaccagcagagactgctccacatcgtctggccgcacaggtgggagcatgacaaagatcctgagtcattctttaaagtgctcatgcacctgaaggacttagggctcaatttccacgtaagcgttttgggagagactttcaccgatgttcccgacatcttttccgaagccaaaaaagcgctgggatcctctgtactccactggggataccttcccagtaaggatgattattttcaggtgctgtgtatggctgacgtcgtaataagcactgcaaaacatgaattttttggagtagctatgttggaagccgtgtattgcggatgttaccccctctgccccaaagacttagtttatccagaaattttcccagcagaatacttgtactcaactcccgagcaattgagtaagagactccagaatttctgtaaacgcccagacattatacggaaacacctgtataagggcgaaattgctccgttcagctgggccgcactacacggaaaatttaggagtcttctgacgactgaacctagggaggatctgtag

SEQ ID NO: 225062 - DNA, 1122 bp, Artificial Sequence
  Description of Artificial Sequence: Synthetic coding sequence
atgagcattcttatcatagaggccttctacggcggtagccataagcaattggtcgatctacttcaggaggagctgggcgattgcgtcgtttatacacttcccgctaagaagtggcactggcgcgctaggactagcgcactttatttctcccagaccatacccatcagtgagcattaccgcacattatttgcatcatccgtgctgaatctcactgagctggctgctcttcgtcccgacctcggcaagctcaagaagatactgtattttcacgaaaatcagctgatctatcccgtgaaaaaatgtcaggaacgcgactttcagtatggctacaaccagattctgtcatgtctggtggccgatgttgtagtgtttaattcagtgtttaacatggaaagttttctcaccagtatgggaaaatttatgaagttaattcccgaccaccgcccaaaggacctggaaagcattattcgccctaaatgtcaggtcatctattttcctattagattccccgatgtctcccgatttatgcccaaacacaaaacgacgcatcttaaaaagatgttaggattgaaagggaacggcggtgctgtgctttctatggcactgccattccaacctgagcaacgcgattcggaggatctactgaagaactttaacagtgaatgtgatacacattgcgggctcgacactgccagacaggagtatttggggaattctcttaggcaggagagcgatctcaaaaaatccacatccagcgataactcgtccagccatcacggtgaaaataagcaaaatctcacagttgatccttgtgatatcctgggaggggtcgacaatcagcagcgcctgctgcatattgtctggcctcaccgctggctcgaagcagtgtactgcggctgctacccactctgcccaaaggatctggtgtatcccgaaatattcccagctgagtacttgtacagcacacctgaacagcttagtaagcgactgcaaaatttttgtaagcgtcccgacattattcggaagcacctgtacaaaggcgagatcgcacccttttcctgggctgcactgcacggcaaatttcgatctctgctgaccaccgagccccgtgaggacctgtag

SEQ ID NO: 225063 - DNA, 1377 bp, Artificial Sequence
  Description of Artificial Sequence: Synthetic coding sequence
atgtctattctcattatcgaggctttctacgggggttcacacaaacagttagtggacctgctccaagaggagttgggcgactgcgtggtctatacgttgcccgcaaagaagtggcactggcgtgcaagaacctccgctctttattttagccagaccatccctatctccgagcactacagaactctgtttgcgtcatccgtgctcaatctgaccgagctggccgctctccgccctgacctggggaaactgaagaagatactttattttcatgaaaaccagctgatttatcctgttaagaaatgtcaagaaagggattttcagtacggctacaaccagatactttcatgcttagtcgccgacgtggttgtgttcaactccgttttcaatatggagagttttctgacttctatgggcaaattcatgaaactgatcccggatcatcggccaaaggatctggaatccattatcaggcccaagtgccaggtgatatactttcccattcgattccctgacgtttcccggtttatgcccaagcacaaaacgactcatctgaagaaaatgctcggcttgaagggcaatggcggtgcagttctttccatggccctcccgtttcagcccgagcagcgagattctgaagacctactgaaaaatttcaactctgagtgtgacacccactgcggcctggacacagctaggcaagagtacctgggcaatagtctgaggcaggagtcagaccttaaaaagagcacctcctccgataactcatcctcacaccatggcgagaacaagcagaatctgaccgttgacccgtgcgatattctgggaggtgtagacaatcagcagcgcctactgcatattgtgtggcctcacagatgggagcatgacaaggatccagagtccttcttcaaagtgctcatgcacctgaaagacctgggccttaacttccatgttagtgtgctgggcgaaacttttactgatgttccagatatttttagcgaggccaaaaaggctctcggatcctcggtgctgcattggggatacctgcccagcaaggacgactacttccaggttctttgcatggccgatgtggtgatttccaccgccaaacacgagttttttggggtggccatgctcgaggccgtctattgcgggtgctatcccctctgtcctaaagatctcgtctatccggagatttttcctgcagaatatttatactccacaccagagcaactatccaaaaggttgcaaaatttttgtaagaggccagatattatccgtaaacatctctataagggggagatcgccccattttcttgggcagcgctgcatggaaaattccggtccttgctcaccacggagccacgtgaggacctctag

SEQ ID NO: 225064 - DNA, 1377 bp, Artificial Sequence
  Description of Artificial Sequence: Synthetic coding sequence
atgtcaattcttataattgaggctttctacggaggttcccataagcagctagttgacctgctgcaggaggaattgggggactgcgtggtctatacgctacccgcaaagaaatggcattggcgagctcggaccagcgcgctatacttttcacagactatccctatctcagagcactatcgcacactcttcgctagctccgtgctgaacctaacagagctcgccgctctcaggccagatctaggcaaactaaagaaaatcttatatttccatgagaaccagctgatctaccctgtgaagaagtgccaggagagagattttcaatacgggtacaaccagatactctcttgtctggtcgccgacgtggtggtctttaattctgttttcaatatggagagcttcctgacttcgatggggaaatttatgaagctgatcccggaccaccggcctaaggacttagaatccattattaggcctaaatgccaagtcatatatttcccaatccgcttccccgacgtctcccgattcatgccgaagcataagaccactcacctgaagaaaatgctcggacttaagggtaacggtggggctgttctgtccatggctctgccctttcagcctgagcagagggattccgaagacctgctgaagaacttcaactccgagtgtgatacacattgcggactcgacacagcccgtcaggagtatctggggaattcccttagacaggaatccgacctgaaaaaatcaacctccagtgataattcttccagccaccatggggaaaataagcagaacctgaccgtcgacccttgcgacatcttggggggagtggacaaccagcaaagactacttcatatcgtgtggccacaccgctgggagcacgataaagacccggagagcttcttcaaggtccttatgcatctgaaagacctggggttgaatttccatgtaagcgtgctgggagagacttttaccgacgtgcccgatatttttagcgaggccaaaaaggctctgggctctagtgtgcttcactgggggtatctccctagtaaggatgactactttcaggtcctgtgtatggctgacgtagtgatctctactgctaagcacgagtttttcggtgtcgcgatgctggaagcggtgtattgcgggtgttaccccctgtgccctaaggacctcgtataccccgagatattccctgcagaatacctctacagtacccccgagcaactgagcaaacggctccagaacttttgtaaaagacccgatataatcagaaagcacctctacaaaggcgagattgcacccttctcatgggctgccctgcacggcaaatttcggagcctgcttaccaccgaaccccgtgaggacttgtag

SEQ ID NO: 225065 - DNA, 300 bp, Artificial Sequence
  Description of Artificial Sequence: Synthetic coding sequence
atgtctatactcataattgaagcattctatggcggtagtcacaagcaactcgtggatcttctacaggaggaattgggtgactgtgtagtatatacgctgcctgccaaaaagtggcattggcgggcaaggaccagcgcactgtacttcagtcagaccattcccatttccgaacattacaggactctcttcgcgtcctcagtgctgaacttaactgagctggctgccttgaggccagacttaggtaagttgaagaagatcttatatttccatgaaaatcagttgatttatcctgtgaaatag

SEQ ID NO: 225066 - DNA, 522 bp, Artificial Sequence
  Description of Artificial Sequence: Synthetic coding sequence
atgtcaattctgataattgaagctttctacggcggttcccataagcagctagtggatctgcttcaggaggaattgggcgactgcgtggtttacaccctgcctgctaagaagtggcactggcgtgcacgtacatccgccctgtacttcagccagaccattccaatctctgaacactacagaaccttgtttgcctctagcgtcttgaatctcaccgaactagccgcactgcgcccagaccttggaaagctgaagaagattctgtacttccacgagaaccaactaatttacccggtcaagaagtgtcaagaaagagacttccagtacggatacaaccagattctctcgtgccttgtagctgacgtcgtggtgttcaacagtgtcttcaatatggagtctttcttgacgtccatgggaaaattcatgaagctcattcccgaccatcgacccaaagacctggagtctatcattagaccgaaatgccaggtgatttattttccaataagattccctgatgtgagttag

SEQ ID NO: 225067 - DNA, 1377 bp, Artificial Sequence
  Description of Artificial Sequence: Synthetic coding sequence
atgtccatcctgatcattgaggctttttacgggggtagccacaaacagctggtagacttacttcaggaagagcttggagactgcgtggtgtacaccctgccggctaaaaagtggcactggcgggcacggacttctgccttgtattttagccagactatccccattagcgaacattatcgtacactgtttgcatcttccgtgctcaatcttactgagctggcagctcttcggccagacttaggcaagttgaagaagatcctatacttccatgagaatcagctgatctaccctgtcaaaaaatgtcaagagagagatttccagtacgggtataatcagattctttcgtgtctcgtggccgacgtcgtggtctttaacagcgtgttcaatatggagagcttcctgacctctatggggaagtttatgaagttgatccctgatcacagacccaaggatctcgagagcattatacggcctaagtgtcaggtcatctattttcctatacgtttcccagatgtctctagatttatgccaaagcacaaaactacccacctgaagaagatgttaggcctgaaggggaacgggggagccgtcctgtctatggcgttgccgtttcagccagaacagagggacagcgaggatctgttaaaaaacttcaatagcgaatgcgacacccactgcggtcttgacacagccaggcaggaatatctaggcaattctctgcgccaagaaagtgatttaaagaagagcacctcatctgataattcaagttcccaccacggcgaaaacaagcagaatctgactgtcgatccgtgtgatatactgggcggagtggacaaccaacagaggctcctgcatatcgtgtggcctcacaggtgggaacatgataaagatccggagtccttttttaaggtgttaatgcacctgaaggacctgggcttaaatttccatgtatccgtgctcggcgaaaccttcacagacgtgccagatattttctccgaggcaaagaaggcattaggctcctccgtcttacactggggttacctcccttccaaagatgattactttcaggtcctgtgtatggccgatgtggttatctctacagcaaagcatgaattcttcggtgtggcaatgttagaggcagtgtattgtggatgctaccctctgtgcccaaaggacctggtgtaccccgagatcttccccgcagagtatctctactcaactccagagcagctgtcaaagaggttgcaaaacttttgtaagcggccagatattattcgtaaacacttgtataaaggcgaaattgcccctttttcctgggccgctctacacggtaagtttcgttctttactcaccaccgagcctcgggaagatctgtag

SEQ ID NO: 225068 - DNA, 2220 bp, Artificial Sequence
  Description of Artificial Sequence: Synthetic coding sequence
atgccttcccctaggcctgtgttgctaagaggagccagagccgcactgctgctcctcctaccccctagattactggccagaccatctctgctcttgcgcaggtccttatcggctgcctcctgtccacccatttctctccctgcggctgctagccgttcctctatggatggcgcaggagccgaggaagtgcttgctcccctcagactggctgtgaggcaacaaggtgatttggtgcgcaagcttaaggaagacaaggcaccacaggtggacgttgacaaagctgtggccgagctgaaggcccgaaagagagtccttgaggccaaggaattggcccttcagcccaaggatgacatagttgacagagctaaaatggaagatacactgaaaagacgcttcttctatgaccaagcatttgcaatctacggcggagttagcggactttacgacttcggtcctgtgggctgcgctctcaagaataatatcatccagacatggcgacagcatttcattcaggaggagcagatcctggagattgattgcactatgcttaccccagagccagtactgaagacgtctgggcatgtggacaagttcgctgatttcatggtgaaagacgtaaaaaatggtgagtgtttcagagccgaccatctccttaaggcccatctgcagaaactcatgtctgacaagaagtgctccgtggagaaaaagtccgaaatggaatctgttcttgcacagctggacaattacggtcagcaagaactggcagatctatttgtgaactataatgttaaaagcccaatcactggcaacgatttatctcccccagtctctttcaatcttatgtttaaaacattcattggccctggcggtaatatgcctgggtacctgaggcctgagaccgctcagggcatttttctgaacttcaaacgcttgcttgagtttaaccagggaaagctgcctttcgctgccgcacagattggtaattcatttcgaaatgaaatcagtcccaggtctggcctcatacgggtccgcgaattcaccatggcagaaatcgagcactttgtggacccctccgaaaaggaccacccaaaattccagaacgtggccgaccttcacttatatctttactccgcgaaggcccaggtgtctggccagagcgccagaaagatgcgcctcggggatgctgtagaacagggagtgatcaataacacagtgctgggctattttatcggccgtatttatttgtacttaaccaaagttggtatcagccccgacaagttgagattccgtcaacacatggaaaacgagatggctcattacgcatgcgactgctgggacgcagaaagcaaaacttcatacggatggatagaaatagtaggctgtgctgataggtcctgctatgaccttagttgtcatgctcgggcaaccaaagtgccactggtggcagagaaaccccttaaagaacccaagaccgtgaacgtggtgcagtttgagccctccaagggagcgatcggcaaggcctacaagaaagacgccaagttagttatggagtatcttgctatctgcgacgagtgctatatcaccgagatggagatgttactgaatgagaaaggcgagttcacaattgaaaccgaaggcaagacattccagctgaccaaggatatgattaacgtgaagcgctttcagaagacgctttatgtggaggaggtcgtccctaatgtcatcgagccctccttcgggcttgggaggattatgtatacggtgttcgagcataccttccatgtgcgggagggcgatgaacagcgtacctttttctcttttcctgccgtggtggcgccattcaagtgttctgtgctgccgctctcacagaatcaggaattcatgccattcgtgaaagagctgtctgaggctcttacccgacacggggtctctcacaaagtggacgactcatcaggaagcatcggacggcgatacgcccgaaccgatgaaataggtgtggcttttggggtcacgattgattttgataccgtgaataagactccccacacagccaccctgcgggatagagatagtatgcgccagatacgtgccgagatctccgagctgcctagtattgttcaggatctagccaacggcaacataacgtgggctgacgtggaggcgagataccccctgtttgagggccaggagactggaaagaaggagactatagaggagtag

SEQ ID NO: 225069 - DNA, 555 bp, Artificial Sequence
  Description of Artificial Sequence: Synthetic coding sequence
atggcggagccccagccgccaagcggcggactgacagatgaggccgctttgtcatgttgttcggacgcggatcccagtaccaaggattttctcctccagcagacaatgttgcgcgtcaaggaccccaaaaaatcactggatttctacactcgcgtcctgggcatgaccctgatacagaagtgcgattttcccattatgaagttcagcttgtactttctggcctatgaggacaaaaacgatatccccaaggagaaggacgagaagatcgcttgggctttgtcacgcaaggctacacttgagctcacgcataattgggggaccgaagatgacgaaacgcagagttaccataatggcaactctgaccccagagggtttggtcacattggaatcgcagtcccagacgtctacagcgcctgcaagcgctttgaggagttgggagtgaaatttgtgaaaaagcccgacgacggtaaaatgaaggggctggcctttattcaggatcctgacggatactggatcgaaatcctcaacccgaataagatggccactctcatgtag

SEQ ID NO: 225070 - DNA, 987 bp, Artificial Sequence
  Description of Artificial Sequence: Synthetic coding sequence
atgcgacccgtgcgcttgatgaaagtttttgtgactcggcgtatccctgccgaagggagagtggccttggcaagggctgcggactgtgaagttgagcagtgggatagcgatgagcccatcccagccaaggagctcgaaaggggggtggcaggtgcacacgggcttctgtgcctgcttagcgaccatgtggacaaacgtatactcgacgccgctggagccaatcttaaggtcatatcaactatgtccgtgggcatcgatcatctcgcccttgacgaaatcaagaagcgtggaataagagtgggatacaccccagacgtcctcacagatacgactgccgagctggctgttagtctactgctcacaacctgtagaagactccctgaagccatcgaggaagtgaagaacgggggatggacctcctggaagccactgtggctatgtggctacggtctgacacagagtactgtaggcatcataggattgggacgtattggacaggccatcgccagacggctcaagcctttcggggtgcaaaggttcctatatacaggccgacagcctcgtccggaggaggcagccgagtttcaagccgagttcgtgtccacgcccgagctggccgcacagtctgattttattgtggttgcctgtagcttgacgcctgccactgagggactttgtaataaggacttttttcagaaaatgaaggagaccgcagttttcattaatatatctcgtggggacgtcgtgaaccaggatgatctgtaccaagcgctggcctctggtaagatcgccgcagccggacttgatgtcacgtcccccgaaccattgcctaccaaccaccccctgctcaccctgaaaaactgtgtgatcctaccccacatcgggtctgcaactcataggactaggaataccatgagcctactggcagcaaacaacctgttggccggtttaaggggtgagccgatgccctccgagctgaagctgtag

SEQ ID NO: 225071 - DNA, 1188 bp, Artificial Sequence
  Description of Artificial Sequence: Synthetic coding sequence
atgcgcccagtgcgcttgatgaaggtttttgtgacccgcaggatacccgctgagggaagggttgccctcgccagagcggcagactgtgaagtggagcagtgggactctgacgagccaattccggcaaaagagctggagcgcggagtggcaggagcccatggcttgttgtgcctcctaagcgatcatgtcgacaagcgtatcctcgacgccgcaggtgccaatctgaaagtcatctctactatgagtgtggggatcgaccatcttgctctggacgagattaagaagagaggcatcagggttggttataccccagacgtgctgaccgacaccacagccgaactcgccgtaagcttgctcttaactacctgccggcgattacctgaagccatagaagaagttaaaaacggtgggtggacgtcatggaaacctctctggttatgcggatatggcctgacccagtcgacggttggtattatcggtttgggtaggattggccaggccattgcgcgtcggctgaagcctttcggcgttcaacgctttctgtacacaggacgtcagcctaggccagaagaagctgcagagttccaggcagagttcgtatccacaccagaactggcagcacaatctgattttatcgtggtcgcctgctcacttacaccagccactgaggggctctgtaataaggacttcttccagaaaatgaaagagaccgctgtttttataaatatcagtcgttacccgagagccacactgcccagcaaacccggagaagagccgtctcctctgttgcccagtggagattttttgccaagaggactcctggtgagacctcaagcagaattagctggttttcataagccaaataatcagctaaggaacagctgggaatacaccaggccaccctatcgcgaggaagaacccagtgagtgggcctggcctgtctgcttttcagccgtggcacctacacgcagaggcctcgcccacagcagtgtggcatcagggagcgtgccacgcgaacctctacaggcccactatccacccccacagagagctggcctcgaggacctaaagggacccttggaggccgcatcacacaccgctgagccgggattcgtctggctttggtttagcgacacattgaacctaatgctcctgggcggacagacactcaagctgacatggtcatag

SEQ ID NO: 225072 - DNA, 759 bp, Artificial Sequence
  Description of Artificial Sequence: Synthetic coding sequence
atgctgggcggagtcccgacgttgtgcgggacaggcaatgagacctggaccctgctggccctcggtcaagctatcgcccgtcggttaaagccctttggggtgcagagattcctgtacactgggcgtcaaccccgtcccgaggaagcagcagaatttcaggccgaattcgtgagcacccccgaacttgccgcacagagcgattttattgttgtggcctgcagcttgaccccggcaaccgagggactttgcaataaggacttcttccaaaaaatgaaggaaacagccgtgtttattaatatcagtcggtatcccagagccacgttaccctcgaaacctggggaggaaccaagtcccctcctgccgtccggggacttcctgcctcggggtttgttagttcgtccacaggctgaattagcgggtttccacaaacctaataatcagctgaggaattcctgggaatacacacgccctccctatagggaggaggaaccgagcgaatgggcatggcctgtgtgtttctcagctgtagcccctacacgacgcggtctggcacactcgtctgtggcctccggttcagttccacgcgaaccgctgcaggcccactacccccctccccagcgcgctggactcgaagatctaaaagggcctctggaagctgcttcacacaccgccgaaccaggtttcgtgtggttatggtttagcgacaccctgaacctaatgctgctgggaggacagacccttaagctgacgtggtcctag

SEQ ID NO: 225073 - DNA, 1677 bp, Artificial Sequence
  Description of Artificial Sequence: Synthetic coding sequence
atggagctcagagcccgaggatggtggcttctctgtgcagcagccgctcttgtcgcgtgtgcgcgtggtgatcctgctagcaagagcaggtcttgcggagaggtgagacagatctatggggcaaaaggcttctctctttctgacgtgccccaggctgagatatccggtgagcacttgcgaatatgccctcaagggtacacctgttgcacttcagaaatggaagaaaatcttgccaaccgcagccacgccgaactcgagacggcgctgagggatagctcacgtgtccttcaggctatgctggccactcaattacgatcatttgacgaccacttccagcacctgctcaacgatagtgaacggaccttgcaggcaaccttcccaggagcatttggggagctctatacacagaacgctcgagctttcagagacctatattccgaattaagactgtactaccggggagctaacctacacctggaggagacactggcagagttttgggctcggttgcttgagcggctattcaaacagctgcatcctcaacttttattaccggacgattacctggattgcctgggaaagcaggccgaagccctgagaccgttcggagaggctcctagggagttacgcctgcgagcaacacgtgccttcgtggcagcacgatccttcgttcagggcctgggggttgcgtcagatgtcgtgaggaaggtggcccaagttcctctgggcccagaatgttcccgggcagtaatgaagctagtttactgcgcccattgcttgggcgtgcccggtgcgcgtccatgtcctgactactgccggaatgttcttaagggctgcctggccaaccaggccgatctggatgcggaatggagaaaccttctggatagtatggtgctcattacagataagttttggggaacttctggcgtagagtctgtaatcggtagcgtccacacctggcttgctgaagctatcaacgcactgcaggataaccgagacaccctaaccgcgaaggttattcaaggctgtggtaatcctaaagtgaaccctcagggaccaggaccagaggaaaaacgaaggaggggaaagctggcacccagagaacggccaccctcgggtaccctggagaaacttgtgagcgaagctaaggctcaactacgcgatgtgcaggatttttggatttcgttacccggaactctgtgctcagaaaaaatggctttgtccactgcatcggacgataggtgttggaacgggatggctaggggtcgttatttacctgaggtgatgggggatgggctcgccaaccaaatcaataacccagaggtagaagtagacattaccaagcctgacatgacgatccggcagcagattatgcagttgaaaataatgactaataggctgaggtccgcctataatgggaatgacgtcgatttccaggacgcctcggacgacggcagcggctccggaagcggagatggttgcctggatgacctgtgttctcgtaaagtgtcgagaaagtcttcctcctcaagaacccctctaacacatgctctgcctgggttatctgaacaggaggggcagaaaacttccgcggcatcttgcccgcagccgccaacgttcctcctaccgctccttctgtttctggctttgactgtggccagaccacgctggcgatag

SEQ ID NO: 225074 - DNA, 1743 bp, Artificial Sequence
  Description of Artificial Sequence: Synthetic coding sequence
atggctggcaccgtcaggacggcttgcctggttgtggctatgctgttgagtctcgattttccaggccaggctcagcccccaccgcctcccccagatgctacatgtcatcaggttcgatcattctttcagaggctgcagccagggctgaaatgggtgccagaaacacctgtgccgggatccgatctacaggtgtgcttgcccaaaggaccaacatgttgcagcaggaaaatggaggagaagtatcagctcaccgccagactcaacatggaacagctattgcagagcgcatctatggagttaaagttcttgatcattcagaacgccgctgtcttccaggaggctttcgagatcgtggtgcggcacgcgaaaaactatactaatgctatgttcaagaataactatccctcccttactccccaggcttttgagttcgtcggagagttcttcacagacgtgagtctttatatcctgggaagcgatatcaatgtcgacgacatggtgaacgaattatttgattcgctgtttccagtgatctacacgcagttaatgaacccagggctgccagactccgccctggacattaacgagtgcctgcggggagccaggagggatctgaaggtcttcggaaactttcccaaacttattatgacccaagtgtcaaagagtctccaggtgacacgcatattcctgcaggcactcaatctcgggattgaggtgattaacactacagaccatctgaagttcagtaaagattgcggtcgcatgctgactcggatgtggtattgttcctattgtcaaggcctcatgatggttaaaccttgcgggggatactgcaatgtggtcatgcagggatgcatggccggtgttgttgaaatagataagtattggcgcgaatacatcttaagtctcgaggagcttgtcaacggcatgtatcgaatttacgacatggagaatgtgttgctcggtctcttctctactattcatgactctatccaatatgtccagaagaacgcagggaagcttacaacaacgatcggcaagctctgcgcccacagtcagcaaaggcagtacaggtcagcttactaccctgaggatctgtttatcgataagaaagtgctcaaggtggcccacgtggagcacgaggaaaccttgagcagcaggagacgggagctcattcaaaaactgaagtcgtttatctccttttactccgccctccccggttacatctgttctcattcccctgtcgctgagaatgatacactctgttggaatgggcaagagctggttgaaagatatagccagaaggctgccagaaatggcatgaagaatcagtttaacctccatgagctgaagatgaagggaccagagcccgtggtatcacagatcatcgataagttgaagcatatcaaccaactcctgcgaacaatgagcatgccaaaaggcagggtcctcgacaagaatttggatgaggagggattcgagtctggggactgcggtgacgatgaagacgaatgcatcggagggtccggtgacggcatgatcaaggtcaaaaatcaacttcggttcctggccgaattagcctacgacctggatgtagacgacgcccctggcaacagccagcaggccacccctaaggacaacgagatatccacttttcacaacctcgggaatgtgcattctcccctaaagctccttaccagtatggctatatctgtagtctgtttcttcttccttgttcactag

SEQ ID NO: 225075 - DNA, 1812 bp, Artificial Sequence
  Description of Artificial Sequence: Synthetic coding sequence
atggccggtactgtgcggacagcatgcctcgtggtggctatgctcctatcacttgattttccgggtcaggcacagccccctccccctccacccgacgctacctgtcatcaggtcaggtccttcttccagcgcttgcagccgggactgaaatgggtgcccgagacgccagtcccgggttctgatttgcaggtgtgcctccctaaaggccctacttgctgcagtagaaagatggaggagaagtatcagctgactgctcgactgaacatggagcagctcctgcaatcagccagcatggagctaaaatttcttataatacagaatgccgctgtgtttcaggaagcctttgagatagttgttaggcatgcaaaaaattatactaacgctatgttcaagaataattatccctcactgacgcctcaagcatttgagtttgtgggcgaattctttactgatgtcagtctgtacatcctcggcagcgacatcaacgtggatgacatggttaacgagctgttcgactctctgtttcctgtgatctatactcagttgatgaatcctggccttcctgattccgctctcgatatcaatgagtgcctaaggggcgctcggagagatctcaaggtattcggcaatttccctaagctgatcatgacccaggtttcaaagtcacttcaggtcactagaattttcttacaagccctgaacctggggatagaggtgattaacacaaccgatcacctgaagttttccaaagattgtggccgtatgctcacaagaatgtggtactgcagctactgccaagggctgatgatggtcaagccctgtggcggttattgtaatgtggtgatgcagggttgtatggccggagtcgtggagatcgacaagtactggcgagagtatatcctgagcctggaggagctcgtgaacggtatgtaccgaatatatgacatggagaacgtccttctagggttattcagtacaattcacgactcaatccaatacgtacagaagaacgccggtaaattgactactaccgagaccgagaaaaaaatatggcactttaaataccctatcttttttctgtgtattggcttggatctgcaaatcggcaaactctgtgcgcattctcagcagcggcaataccgctccgcctactatccggaggatctgtttattgacaaaaaggtcctcaaggtggctcatgtggagcatgaagagacattatcttctagaaggagagaattgattcagaaactgaagtccttcatctctttttattcagctctacctggctacatatgcagccattccccagtggccgaaaacgacaccctgtgctggaacggtcaggaactggtggaaagatatagccagaaggccgctaggaacgggatgaagaatcaatttaaccttcatgagttaaagatgaaggggccagagcccgtggtatcgcagatcatagacaagctgaaacacattaaccagctcctcagaaccatgagcatgcccaagggaagagttctcgacaaaaacttggatgaagagggttttgagtctggggattgtggagacgatgaggatgagtgtataggaggcagcggcgatggaatgatcaaggtcaagaaccagttacgcttcctagctgagctggcctatgacttggacgtggacgatgccccagggaactcacagcaggctacccccaaggataacgagatcagtacatttcacaatctcggcaatgtccactcccctttgaagttactgacaagtatggctatctccgtggtctgttttttcttcttagtgcactag

SEQ ID NO: 225076 - DNA, 771 bp, Artificial Sequence
  Description of Artificial Sequence: Synthetic coding sequence
tgaaagccatgtggtggctactgcaatgtcgtcatgcagggttgtatggctggcgtggtcgaaatcgacaaatactggagagagtatattctttcattggaggagcttgtcaatggaatgtatagaatctatgatatggagaatgtgctgctcgggctgtttagtaccattcatgactcaattcaatacgtccaaaagaacgccggaaagctgaccaccacaatcggcaaactgtgcgcgcactcccagcagcgtcaatacaggagcgcttattacccagaggatctattcatcgacaagaaggtgctgaaagtagcgcacgtggagcacgaagagaccttatccagccgcaggagggagctcattcagaagctcaaaagcttcatttcattctacagcgcattgcctggttacatctgctcccacagtccggtggcagaaaacgacactctgtgttggaacgggcaggagttagtcgaacgatactcccagaaggccgcacggaacggcatgaaaaaccagttcaacctgcacgaattaaagatgaagggacctgaaccagtagtctcacagatcatcgataagcttaagcacattaaccagctccttcggactatgagcatgcctaagggtagggtcctggataagaacttagacgaagaaggcttcgagagtggcgactgtggtgatgacgaagacgaatgtattggagggtcgggagacggtatgatcaaagtgaaaaatcagcttagattcttggctgggaattag

SEQ ID NO: 225077 - DNA, 1581 bp, Artificial Sequence
  Description of Artificial Sequence: Synthetic coding sequence
atggcagggaccgttcggacagcatgcctggttgtcgcgatgctgcttagtctagattttcctggtcaggcacaacctccccctccccctcccgatgccacctgccatcaggttcggtcatttttccaacgcttacagccgggtctcaagtgggtcccagagacacccgtaccagaggcctttgagatagtggtcaggcacgctaaaaattacactaatgccatgttcaaaaacaattatccgagcttgactccgcaggccttcgagttcgtgggagaattctttacggacgtctccctttacattctgggatctgatattaacgtagacgacatggtgaacgagctattcgattcactcttccctgtgatttacacgcagctgatgaacccgggtctccctgattctgcattggacatcaatgaatgtctaagaggcgctaggcgcgaccttaaagtgttcggcaattttcctaagctgatcatgacccaggtgtctaaatctcttcaggtgacgagaatttttctgcaggccctgaatctgggaatcgaggtgataaatacaaccgatcacctgaagttttccaaggactgtgggaggatgcttaccagaatgtggtattgtagttactgccaaggactgatgatggtaaagccctgcggtggttactgcaacgttgttatgcaaggttgtatggcgggtgtggtcgagatcgataagtactggagggagtatatactgagcctggaggagctggtgaatggaatgtatcggatatacgacatggagaatgtgctgctaggcctcttcagcacaattcatgatagcatccagtacgtccaaaaaaatgctgggaaactgacgactacaattggcaaattgtgtgcacattcgcagcagcggcagtatcgttctgcatactaccctgaagatctgttcatagacaagaaagtcttaaaagtggctcatgtggaacacgaggagacactgtcaagccgtaggcgggagctcatccagaagctgaagtcctttatttcattctattccgctctgcctggctacatttgctctcactcgccagtagctgagaacgataccctgtgctggaatggacaggaacttgtcgaacgctacagccaaaaggcggctcggaatgggatgaaaaaccagtttaatctacacgaactgaagatgaaagggcctgaacccgtggtatctcagattatcgataagttaaagcacattaatcaactcctgagaactatgtccatgcccaaaggaagggttctggacaagaacttggacgaggaagggttcgaatctggagattgtggggatgacgaggacgagtgcattgggggaagcggcgatggcatgataaaagtgaaaaaccaacttcggttccttgcggagctggcttatgatttggacgttgacgacgcccctgggaactcccagcaggctacgcccaaggataacgaaatatcaacatttcataatctgggtaacgtgcattccccccttaaacttctaacctccatggcaatttccgtggtgtgctttttttttctcgtacactag

SEQ ID NO: 225078 - DNA, 1671 bp, Artificial Sequence
  Description of Artificial Sequence: Synthetic coding sequence
atggcacgtttcggtttaccagccctgctctgcaccctggcagtgctgtccgccgctttgctcgccgctgaactgaagagtaagagctgttctgaggtgcgacggctatacgtctccaagggctttaataagaacgacgccccactccacgagattaatggcgaccacctaaagatctgtccacagggcagcacatgctgttcacaggaaatggaagagaaatacagtttacaatcaaaagacgatttcaaatcagtggtgtccgaacagtgcaaccacctgcaggcggtcttcgccagtcggtacaagaagtttgatgaattcttcaaagaacttttggagaatgcggaaaaaagtctgaacgatatgttcgtcaaaacctatggccatctctatatgcagaacagtgaactcttcaaagacctattcgtcgaactcaagcgctactacgtcgtgggaaacgtgaacctcgaagagatgttgaacgatttttgggccaggcttctggagcgcatgtttcggcttgtgaactcccagtatcatttcacagatgagtacttagaatgtgtttcaaagtacacagaacagctgaagccattcggtgacgttcccagaaagctcaagctccaggtcactcgagcctttgtcgccgcacgcaccttcgcccagggtctggctgtggcgggtgatgtcgtctccaaggtcagcgtggtgaatcctacggcccagtgtacccacgcacttctcaaaatgatctactgcagccattgccggggtttagtcactgtgaagccttgctacaattattgtagtaatattatgcgcggatgccttgcaaaccagggagacttagatttcgaatggaacaactttatagatgccatgctgatggtcgccgaacgccttgaggggccatttaatatcgagtcggtgatggacccgatcgacgttaaaatctccgatgcaataatgaacatgcaggataattcggtccaggtttcccagaaggtgtttcaaggctgcggccctcccaaaccgctccccgcaggccgaatttcccggtcaatcagtgagtccgcgttttcagcacggttccggccacaccatccagaggaacgcccaactaccgcagctggaacatcgctggaccggttagtgaccgatgttaaagagaaattaaagcaggcaaaaaagttttggtcttccctgccctctaacgtgtgtaacgacgaaaggatggccgctggcaacggcaacgaggacgattgttggaacggcaagggcaaatctaggtacttgtttgctgtgactgggaatggcttagctaatcagggaaataacccagaggttcaggtcgacacttctaagcctgacatccttatactgcgacagatcatggcgcttagagtgatgactagcaaaatgaagaacgcctataatgggaacgatgtggacttcttcgacatctccgatgagtcatctggcgagggctcggggagtggatgtgaataccagcaatgcccatctgaattcgactacaatgccaccgaccacgccggaaagtctgccaatgagaaggcagactctgctggtgttcgccctggagcacaggcttatctcctaacagtcttttgcatcctgtttttagtcatgcaacgtgagtggagatag

SEQ ID NO: 225079 - DNA, 1461 bp, Artificial Sequence
  Description of Artificial Sequence: Synthetic coding sequence
atggaagagaaatacagtttgcagtcgaaggacgatttcaagtccgtggtgtcggaacaatgtaatcatctacaggccgtgttcgcctcgcggtataaaaagtttgacgaatttttcaaagaactgctggaaaacgctgagaagagtttgaacgatatgtttgtcaaaacatacggtcatctttatatgcagaactccgagctcttcaaagatctgtttgtggagttgaaaagatattacgtggtgggaaacgtgaatttggaggaaatgttgaacgatttttgggccaggcttctcgaaaggatgttccgccttgtgaattcccagtatcactttaccgatgagtacctggaatgcgtctctaagtacactgaacagctaaaaccgtttggtgacgtgcccagaaagctaaagctgcaggtgacccgggcttttgtcgcggcaaggaccttcgcccagggtctcgcagtggctggggatgtggtcagcaaagtttccgtggtgaacccgacggcccaatgtacgcatgcattgctcaagatgatctactgttcccattgtcgtgggctggtgactgtgaagccttgttataattactgttccaatataatgcggggatgtcttgcaaaccagggggatcttgactttgaatggaataacttcatcgatgctatgctgatggtggctgaacggctcgaagggcctttcaatatcgagtcagtgatggacccgattgacgtgaaaataagcgacgctattatgaacatgcaggacaatagtgtccaagtctctcaaaaagttttccagggctgcgggccaccaaaaccattgccagctggtcgcatttcccgatccatatccgagagtgctttcagcgccagatttcgccctcatcatcctgaggaacggccaaccacggccgctggaacatccctagaccggctggtcacggacgtgaaggagaagcttaagcaggccaaaaaattttggtcatctcttccgagcaatgtttgcaacgatgaacggatggccgctggcaacggaaacgaggatgactgctggaacggcaaaggtaaatctcgctatctctttgcagttacagggaacggtcttgcaaatcaaggtaataacccggaggtccaggtggacacctccaagccagacatccttatattgagacaaatcatggccctcagggttatgactagcaagatgaagaatgcatataatgggaacgatgtggattttttcgacattagtgatgagagtagcggcgagggttctggatccggatgcgagtaccagcagtgtccaagcgaatttgactacaacgccactgaccacgccggaaaatcagcaaatgaaaaagccgactcagctggtgtccgaccaggggcacaggcgtatctcctcaccgtcttctgcattctgttcctcgtcatgcagcgggaatggcgatag

SEQ ID NO: 225080 - DNA, 1653 bp, Artificial Sequence
  Description of Artificial Sequence: Synthetic coding sequence
atggcacgttttggactgcctgctttgttgtgcactctcgcggtgctttccgcagctctgttggctgccgaacttaagtctaagtcatgttctgaggttagacgcctttatgtgtctaagggattcaataaaaacgatgctccattgcacgagatcaatggggaccacgaagacttaagtccagggttttacctcctactgtctagagacggaggctactcccttcagtccaaagacgatttcaaaagtgtagttagtgagcagtgtaaccacctgcaggcagtgtttgcatcacggtacaaaaagttcgacgagttctttaaggagctgctggagaacgcagaaaaatccctgaacgatatgtttgtgaagacatacggccacctgtatatgcagaattcagagttattcaaagatctgttcgttgaactaaagcgctactatgtggtggggaacgtgaacctggaagagatgctgaacgacttctgggccaggctgctcgaacgcatgtttcgactcgtaaattctcagtatcacttcaccgacgaatatctcgagtgtgtgagcaagtacaccgagcaattgaaaccctttggggacgtgcctcgtaagcttaagctgcaggtgacaagagctttcgtcgcagctcgcacctttgcccaaggtttggcagtcgctggggatgttgtgagcaaggtgagcgttcctagttgcactcacgctctcttgaagatgatttattgtagccactgcagaggactagtgaccgtgaaaccctgctacaactattgtagcaacatcatgaggggatgtctcgcaaaccagggagacctcgatttcgagtggaacaattttatcgatgccatgcttatggtcgctgaacgcctagagggaccctttaatatcgagagtgttatggatcctatagacgtgaagatctcagatgctatcatgaacatgcaagataatagcgtccaagtgtcccaaaaggtttttcaggggtgtgggccaccaaaacctcttcctgctggcaggattagccgcagtatttccgagtcagccttttctgcaaggtttaggccgcaccacccggaggaaaggcccacaacagctgctgggactagtctggaccgcctcgtgaccgatgtgaaggagaagctcaagcaagccaagaagttttggagcagcctgcccagcaatgtttgtaacgacgagcggatggccgcaggcaacgggaatgaagacgattgttggaacggcaaaggcaaaagccgctacttattcgctgtaacggggaacggcctggctaatcaaggcaataatcccgaagtgcaggttgatacgagtaaacctgatattctaatcttgcgccagattatggccctgcgcgtgatgacctcaaagatgaagaatgcatataacggtaatgacgtagacttttttgatatatccgatgagtccagcggcgagggtagtggctccggctgtgaatatcagcagtgcccttccgagtttgactataatgccaccgaccacgcagggaaaagcgctaatgagaaggccgacagcgctggcgtccgccctggcgcacaggcttaccttcttacggtcttctgcattttgttcctcgtcatgcagcgggaatggcgttag

SEQ ID NO: 225081 - DNA, 1719 bp, Artificial Sequence
  Description of Artificial Sequence: Synthetic coding sequence
atggacgcccagacatggcctgttggcttccgctgcctgttattgcttgcgcttgtaggcagtgcccgttctgaaggtgttcagacttgtgaggaggttcgcaagttgttccagtggagactccttggggcagtccggggtttacccgatagccccagagcagggccagacctccaagtctgcatctctaagaaaccgacatgctgcacacggaagatggaagagaggtaccagatagcagcgcgacaggacatgcagcagtttttgcagacctcctcgtccaccctgaagtttctcatctctcgcaatgccgcagcctttcaagagacgttggagactcttattaagcaggctgaaaattacacaagcatcctgttttgcagtacataccggaacatggcattagaggcagcagctagcgtccaggagttctttacagacgtgggactctatctgtttggcgcagatgtgaatcctgaggagttcgtcaatcgtttctttgactcactgtttccacttgtgtacaatcacctgatcaatccaggtgttactgattcttctctggagtatagcgaatgcatccgcatggcacggagagatgtctcaccttttgggaatatcccgcagcgtgtaatgggccagatgggcaggtcactcctgccctctaggacattcttgcaagccttgaatctcgggatcgaagtgatcaatacaacagattatctgcacttttccaaagagtgtagccgagcattgttgaagatgcagtattgcccccactgccaaggcctggccctgactaagccttgtatgggctactgcttaaatgtcatgcgcggttgtctggctcatatggctgagctcaatccccactggcacgcctacattcggtccctcgaggaactcagtgatgcaatgcacgggacctacgatattggtcacgtcctcttgaattttcatcttcttgtgaatgacgccgtcctccaggctcaccttaacgggcagaaattactggaacaagtgaacagaatctgtggaaggcccgtcagaacccccacgcagagcccccgatgttcattcgatcagtccaaggagaagcatgggatgaagacaaccacgaggaattcagaagagacactggcaaacagacgcaaggaatttatcaacagtcttcgtttgtaccggagcttctacggcggtctggctgatcagctctgcgctaatgagctcgcggcagctgacggccttccttgttggaatggcgaggacattgtaaaaagctacacacagagagtcgtgggtaatggtatcaaggcccaatccggtaatcctgaagttaaggtgaaggggatcgatcctgtgataaatcaaattatagataaactcaagcatgttgtgcagctcctgcaggggcgatccccaaagcccgataagtgggagctgctccagctcggttctggaggtggaatggtcgaacaggtatctggggactgcgatgatgaagacgggtgcggaggatctggctctggcgaagtgaaacgcaccctgaagatcactgactggatgcctgatgacatgaacttctcagatgtaaagcaaattcatcaaaccgacactggtagcacgctggacaccactggtgccggatgtgccgtggctacagagagcatgacatttaccttgatctcagtggtgatgctcctaccaggcatctggtag

SEQ ID NO: 225082 - DNA, 1668 bp, Artificial Sequence
  Description of Artificial Sequence: Synthetic coding sequence
atgccctcatggattggtgccgtcatcttaccgctcttagggctgttgctgtcattacccgctggagctgatgtcaaagcccgatcctgtggcgaagtgcggcaggcgtatggagctaaggggttttcattggctgatatcccatatcaggaaatcgcaggtgagcatcttagaatctgtccccaagagtatacatgttgcacaacggaaatggaagataagctatcacagcaaagtaagctggagtttgaaaatctggtggaggaaacttctcacttcgtgcgcacaacattcgtcagcaggcataagaagtttgacgagttcttcagagaactactggagaacgccgagaaaagtttaaacgacatgtttgttaggacatacggaatgctgtacatgcagaatagtgaggtgttccaagatctatttactgagctgaaacggtattataccggcggaaatgtgaaccttgaggagatgctgaatgacttctgggctcgtctcctggagagaatgttccagttaataaaccctcagtaccacttttccgaagactatctggagtgtgtaagtaaatacacagaccagctaaaaccgtttggggatgtaccccgtaagcttaagattcaggtgacgagagccttcatcgctgcaagaacgtttgtgcagggtctgacagtgggcagggaagttgccaacagggtgtcaaaggtgtcacccactcctgggtgcatccgggctctgatgaaaatgctctactgtccttactgccgcggacttcccaccgtgcggccatgcaacaactactgcctcaatgtcatgaaaggatgcttggctaaccaggcggatttagataccgagtggaatctctttatcgatgcgatgctcctggtggctgaaaggttggaaggcccatttaacatcgaatcagtcatggaccctatcgatgtcaagatctcagaggcgataatgaacatgcaggagaatagcatgcaggtctccgccaaggtgtttcaaggatgcgggcagcctaagcctgctccagccctaaggtctgcgcgtagtgcacctgagaatttcaacactcgctttcggccttacaatcctgaagaaaggcccaccacagcagcgggtacctcactggataggcttgtgactgacattaaagagaagctcaagctgagcaaaaaagtgtggagcgcactcccatataccatttgtaaggatgaatctgtaaccgcgggaactagcaacgaagaggaatgttggaatggccattccaaagcacggtacctgcctgagatcatgaatgacggacttacaaatcagatcaataaccctgaggtggacgtcgacatcacacgaccagacaccttcatccgccagcagattatggccctgcgggtcatgacgaacaagcttaaaaacgcctacaacggaaacgatgtcaatttccaggacacgagcgatgagagctctggctccggcagtggatcaggctgcatggacgacgtctgtcctacagagtttgaattcgtgacaacagaggctcccgctgtggaccctgataggcgcgaggtggattccagcgcagcccagcgagggcatagcctgttaagctggtcattgacatgcatcgtgctggcgcttcagcggctgtgcaggtag

SEQ ID NO: 225083 - DNA, 582 bp, Artificial Sequence
  Description of Artificial Sequence: Synthetic coding sequence
atgcagtctctgatgcaggccccattactgatcgccctgggactgctcctggccgcacctgcccaggctcacctgaagaagcccagtcaattgtcttcattcagctgggacaactgtgacgagggaaaagaccctgcagtgattaggagcctgactctcgaacccgaccctataattgttccgggtaacgtgacactgtccgtcatggggagtaccagcgtgccattgagctctccactgaaggtagatctcgtgctggagaaggaagtagccggactgtggataaaaattccatgtactgattatatcggctcctgcacatttgagcatttctgcgatgtcctggacatgcttatccctaccggcgaaccgtgcccggaaccactgagaacttatggcctgccatgtcattgtccatttaaggaaggaacatactccctgccgaaaagtgagtttgttgtaccagaccttgagctcccctcatggctgaccacgggcaattaccgcatagagtctgttctttctagctcagggaagaggttgggatgcataaagatcgctgcatcattaaaggggatttag

SEQ ID NO: 225084 - DNA, 1140 bp, Artificial Sequence
  Description of Artificial Sequence: Synthetic coding sequence
atgggctgtctcggcaactccaagactgaagaccagcggaatgaggagaaagctcagcgtgaggcaaacaagaagattgagaagcagctgcagaaggacaaacaggtgtaccgggcaacgcataggctgctgctcctgggagcaggggagagcggcaaaagcactatagtgaaacagatgcgcatcctgcacgtaaatggattcaacggcgatgagaaggccactaaggtgcaggacattaaaaataacctgaaggaggccatcgaaaccatcgtggcggctatgtccaacctggttcctccagtagagctcgccaatcctgagaaccaatttagagtggactacatcctgagcgtgatgaacgtgcccgatttcgacttcccacctgagttttacgagcatgccaaggccttgtgggaggatgaaggtgtgagagcctgctacgagcgcagtaatgaataccaactcatcgactgtgcccagtatttccttgataaaatcgatgttatcaaacaggctgattacgtcccctccgaccaggatctactgcgatgtcgagtgctgacaagcgggatattcgagacgaaatttcaagtggacaaagttaattttcatatgttcgacgtaggcggtcagagagatgaaagacgaaaatggattcagtgcttcaatgacgtgacagccattatatttgtagtggctagttcctcctataatatggtgatccgggaggataatcagactaacaggctgcaggaagcacttaacctgtttaaatcaatttggaacaatagatggctccgcacgataagtgttatcctattcctcaataagcaggaccttctagcagaaaaagtgctcgctgggaagtctaagatcgaggactacttccctgaatttgcacgctacactacgccagaagatgcaacgccagagcctggggaagacccgcgtgtgacacgtgccaaatacttcatccgtgatgagtttctgcggatctctacggcctccggagacggacggcactattgctacccacatttcacctgtgcagtcgatacagagaacatacgcagggtgttcaacgactgtcgtgacatcatacagcggatgcacttgaggcaatatgagttactatag

SEQ ID NO: 225085 - DNA, 1143 bp, Artificial Sequence
  Description of Artificial Sequence: Synthetic coding sequence
atggggtgcttggggaatagcaagaccgaggatcaacgcaacgaggagaaggcccagcgggaggctaataagaaaattgagaagcagctgcagaaagataagcaagtgtaccgcgctacccaccgcctgctccttcttggcgcaggcgagagcgggaaaagcaccattgttaagcagatgcgaatcctccacgttaatgggttcaatggtgactctgaaaaagcaaccaaagtgcaggacatcaagaacaacctgaaggaggccatcgaaaccatcgtggcagccatgtctaacctggtgccgccagtggaactggcgaacccggaaaaccagtttcgagtagactacattctttctgtaatgaacgtgccagactttgactttccacccgagttctatgaacacgccaaagctctatgggaggacgaaggcgttcgggcttgctacgagcgctcaaacgaataccagctaatcgattgcgcccagtactttctcgacaaaattgacgtgattaaacaggctgattacgtaccatctgatcaggatcttctcagatgtcgggtgctgacgtcagggattttcgagacaaagtttcaagtagataaggtcaactttcacatgttcgacgtcggaggacaacgggatgagcgtagaaagtggatacagtgttttaatgatgtaaccgccatcatattcgtggttgccagttccagttataatatggtaatccgagaggacaatcagacaaacagattacaagaggcattgaacctcttcaagtccatttggaacaaccgttggctgcgcacgattagcgtaatcctgttcctgaacaaacaagaccttttagccgaaaaggttttggctggcaagtcaaagatcgaggactatttcccagagttcgccagatacaccactccggaagatgcaacaccagagcccggtgaggaccctagggtgacaagagcgaagtacttcatccgcgacgagtttcttaggatctctaccgcctccggagacggacgtcactactgttacccacacttcacatgtgccgtcgacacagagaatatccgccgagtatttaatgattgtcgcgacataattcagcgcatgcacctgagacagtatgagttgttgtag

SEQ ID NO: 225086 - DNA, 738 bp, Artificial Sequence
  Description of Artificial Sequence: Synthetic coding sequence
atggatcgcaggagtcgagcccagcagtggaggcgagccaggcacaattataacgacctgtgcccaccgatagggcgacgagctgcaaccgcattgctgtggctgtcctgctccatcgcactcctgagagctctggctacctctaacgcgcgtgcacaacaacgcgcagccgcacaacagaggcgatccttcctgaacgcacaccatcgctctggtgctcaggttttcccagaatccccagagtccgagagcgaccatgagcacgaagaagcagatctggagctgagtcttccggaatgtttggagtacgaagaggagtttgactacgagactgagtccgagacggagtcggagatcgaatctgaaaccgatttcgagacggagcccgagacagcccctactactgaacccgaaactgagcccgaggacgaccgagggccagtcgtccctaagcactccacgttcggccagtctctaactcaacggctccatgcactcaagctgagatcccccgacgccagcccaagcagagctcctccctcaacccaggaaccacagagccccagggagggcgaggagctcaaacctgaggataaggaccccagggaccctgaggaaagtaaggagcctaaggaagagaagcaaaggaggcgttgcaaacccaaaaagccgacaagaagagacgctagcccagagtcaccttcaaaaaaaggtccgatcccaattcgcaggcactag

SEQ ID NO: 225087 - DNA, 1188 bp, Artificial Sequence
  Description of Artificial Sequence: Synthetic coding sequence
atgggttgcctcggcaattcaaagaccgaggatcaacgcaacgaagagaaagcgcagcgggaggccaacaagaagatcgaaaagcaattgcagaaggacaaacaggtttaccgcgctacacacagactactgctcctaggcgcaggggagagtggaaagagtacaattgtaaaacagatgcggattctccatgtgaatggatttaacggagaaggcggtgaggaagatcctcaggccgctaggtccaattctgatggatctgagaaggcgacaaaagttcaggatatcaagaataacttaaaggaagcaatcgagactatcgtcgccgctatgtctaatctcgttccacctgttgaacttgccaaccctgaaaaccagtttagggtagactacattttgtcggtgatgaatgtacctgacttcgatttcccaccagaattctatgagcatgctaaggccctgtgggaggatgagggtgtgcgggcatgttacgagcggagcaacgagtatcagctgattgactgtgctcagtattttttggacaagatagacgtgatcaagcaggctgattatgtgcctagtgaccaggatctgctgcgatgtcgtgttctaacttctggcattttcgagactaagtttcaggtggacaaggtgaacttccatatgtttgatgtcggaggacaaagagacgaacgcagaaaatggatccaatgcttcaacgacgttactgcaattatttttgtcgtcgccagttcaagttataacatggttattagagaggataaccagacaaaccgccttcaagaagccttgaacctctttaagtcaatatggaataatcgctggttacgcacgatctcagttattctcttcctgaataaacaggatttgctggcagagaaggttcttgccggaaagagcaaaattgaggactactttccggaattcgcccgttacacaacacctgaagatgccaccccggagcccggagaggatcccagagttacgcgcgctaaatactttatccgggacgagttcctgcggatctctaccgccagcggagacgggaggcattattgttacccccacttcacctgcgcagtggatacagaaaacataagaagggtgtttaatgattgccgcgatattatccagaggatgcatctgagacagtacgagctgctttag

SEQ ID NO: 225088 - DNA, 738 bp, Artificial Sequence
  Description of Artificial Sequence: Synthetic coding sequence
atggacagacgatccagagcccagcagtggcgcagggcccgacacaactacaacgacctgtgccccccaatcgggagacgcgcagctacagctctcctctggctgtcgtgttcaatagctttactgagagctctggccacaagcaacgcgcgtgctcagcagagagctgctgcccagcagaggcgctcgtttttgaatgcccaccacaggtcaggcgcacaagtgttccccgagtcgccggaaagcgagagcgaccacgagcacgaggaggctgatctggagctatctttgcctgagtgcctcgaatacgaggaggaattcgattatgagacggagtcagaaactgaaagcgaaatcgaatcagaaaccgacttcgagactgaaccggaaacggccccaactacagaacccgaaaccgaacccgaggatgatcggggacctgtcgtgcccaagcactccaccttcggacagagcctgacccagaggctccacgccctgaagttacgctcccccgacgcctccccgagtcgcgcaccaccaagcactcaggaaccgcagagcccgagggaaggcgaggagcttaagcctgaggataaggacccacgcgatccagaagagagcaaggaaccaaaagaggaaaaacaacggcgaagatgcaagcccaaaaaacctaccagaagggatgcctctcccgagtcgccaagcaagaagggaccaatcccaatccggagacattag

SEQ ID NO: 225089 - DNA, 483 bp, Artificial Sequence
  Description of Artificial Sequence: Synthetic coding sequence
atgggctgccttgggaattctaagacagaagaccaaaggaacgaggaaaaagcacagcgcgaggcgaacaaagaggataaccagacaaataggctgcaagaggcgcttaacctttttaaatccatttggaataaccgttggctccgtactataagcgtcatcctttttcttaacaagcaagacttactggcagaaaaggtcctggctggcaagtcaaaaattgaagattacttcccagagtttgccaggtataccacaccagaggacgcgactccagagccaggagaagatcccagggtgacacgggcaaaatactttatccgtgacgaattcctgaggatatccacagcttccggggacggcagacattactgctatccacattttacttgtgcggtagacacagagaacatccgccgtgttttcaatgattgcagagatatcatccaacgaatgcaccttaggcagtacgagctcctatag

SEQ ID NO: 225090 - DNA, 1185 bp, Artificial Sequence
  Description of Artificial Sequence: Synthetic coding sequence
atggggtgccttgggaatagcaagaccgaggatcaaaggaatgaagaaaaggcccagcgcgaggcaaacaagaagatcgaaaaacagctgcagaaggataagcaggtgtacagggccacacacaggttactgctcctgggggcaggtgagtctggtaaaagcaccattgtgaagcagatgaggatcctccatgtgaacggcttcaacggtgaaggtggagaggaggatccacaggccgctaggtcgaactccgatggggaaaaggccacaaaggtccaagacatcaaaaataatctcaaggaagcgattgaaactatcgtggctgcaatgtccaatcttgtgccccctgtggagctagcaaaccctgagaaccagtttcgcgtagattacatcctgtccgttatgaatgttccggactttgatttccccccagagttctatgagcacgcaaaggctctgtgggaggatgaaggggtccgcgcatgctatgagagatccaacgagtaccaactgattgactgcgctcagtatttcttagataagattgacgtgattaaacaggcagattacgtacccagcgatcaggatctactgcggtgccgtgtgctcacttccggcatcttcgagactaagttccaggtggataaggttaacttccacatgttcgacgtgggtgggcagagggacgagagacggaaatggattcagtgttttaatgatgtgacagccatcattttcgtcgtcgcctccagttcttataatatggtgatccgggaagataaccagaccaatcgacttcaggaggcgctgaatttatttaagagcatctggaataacaggtggctacgcaccatcagtgtaattttgttcctcaacaaacaggatctcctggctgaaaaggtgctcgccggaaaaagcaagattgaagactacttcccagagttcgccagatacaccactccagaggacgctaccccggagccgggtgaggatccaagagtgacccgagctaaatactttattcgggacgagtttctgcggatatcgactgcctccggtgacgggaggcactactgctacccgcacttcacatgtgctgtggatactgaaaatatccgaagggtctttaatgattgcagagatatcatacagagaatgcatctgcgccagtacgaactcctgtag

SEQ ID NO: 225091 - DNA, 1143 bp, Artificial Sequence
  Description of Artificial Sequence: Synthetic coding sequence
atggggtgtctcgggaactcaaagactgaagaccaaagaaatgaagaaaaggcccagcgtgaagctaataagaagattgaaaagcagctgcagaaggataaacaggtgtaccgggctactcataggctgctgctgttgggcgctggagagtccgggaaatctactatcgtgaaacagatgaggatcctccatgtcaatggctttaacggggattctgaaaaagctacaaaagttcaagacatcaagaacaatctaaaagaggctattgagaccatcgtcgccgctatgtctaacctcgtcccacccgtggaattggcgaatcccgaaaaccagtttagggtagattacattcttagtgtgatgaacgttcccgatttcgacttcccccctgaattttacgagcacgctaaggccttatgggaggacgaaggagtgcgggcttgctacgagagatccaacgaatatcagctaatcgactgcgcccagtacttcttggataagattgacgtgattaaacaggctgattacgtcccatccgaccaggacctgctgcgatgtcgggtactgacctctggaatctttgagacaaagttccaggtggataaggtgaatttccacatgtttgacgtgggaggacagcgtgatgagcgaagaaagtggatccaatgtttcaacgatgtcacagcaataatctttgttgtagcctccagttcatataatatggtgatcagggaggacaatcagacaaaccgactgcaggaggctctcaaccttttcaagtcaatctggaacaaccggtggctgagaacaattagtgtgattctgtttttaaataaacaggatctgttagccgaaaaagtgcttgcaggaaagtccaaaatcgaggattattttccagagtttgctaggtatactactccggaggacgctacaccagaacccggtgaggaccccagagtgactcgggctaaatactttatccgtgatgagtttttaaggatcagtaccgcttctggtgatggacggcattactgctatccacatttcacctgtgctgttgataccgagaacatcagaagggtgttcaacgactgccgagacattatccagcgcatgcacctgcggcagtatgagctgctttag

SEQ ID NO: 225092 - DNA, 738 bp, Artificial Sequence
  Description of Artificial Sequence: Synthetic coding sequence
atggacaggcgtagcagggcacagcagtggcggcgagctcggcataactacaacgacctttgtcctcccattgggaggagagcagccacagccctcctgtggctctcttgttccattgcccttctcagggcgctggccacaagtaacgctagggctcagcagagggctgcagcccagcaacgcaggtctttccttaacgcccaccaccgctcaggagctcaggtgttcccagaatcccccgagtcggagagcgaccacgagcacgaagaagccgatctggaactgagtctgcctgagtgcctcgagtatgaggaagaattcgactacgaaactgagtctgaaacggaatccgagattgagtccgagactgatttcgagactgaaccagagactgccccaacgaccgagccagagacggagcccgaggacgatcggggacccgtcgtccccaaacacagtacctttgggcagtccctaactcagcgtttgcacgctctgaaactgcggtcccccgatgccagtccctctcgggcacctccttctacccaagaaccacagtctcccagagaaggcgaggaactgaagcctgaggacaaagacccgagggacccggaagaaagcaaggagcccaaggaggaaaagcagaggcgacgttgtaagcccaagaaacctacaaggcgcgacgcctccccagaaagccccagcaaaaaagggcctatcccaatcagacggcactag

SEQ ID NO: 225093 - DNA, 3114 bp, Artificial Sequence
  Description of Artificial Sequence: Synthetic coding sequence
atgggggttcgaaattgcctgtacgggaataatatgagcggtcaacgtgatatcccgccagagattggagagcagcccgagcagccacctctggaggcaccaggcgcagccgcacctggggcaggtccttcaccagccgaggaaatggaaaccgaaccaccccataacgaacccatcccggtggaaaacgatggggaggcctgtgggcctcccgaggtcagccgccctaatttccaggtcctcaatccggcatttcgggaggccggagcccacgggtcttattcacctccgcctgaggaggctatgccattcgaagcggaacaaccttctctgggaggattttggcctaccctcgagcagccaggcttccctagtggcgtgcatgccggtcttgaggcattcggccctgccttgatggaaccaggcgctttctcaggagccaggccagggttaggtggttacagccctcctcccgaagaagccatgccattcgagttcgatcagcctgcacagcggggttgtagtcagctgctgctccaggtacccgacctggcccctggtggcccaggagccgcaggtgttccgggtgcacccccagaagagccacaggccctccgcccagcgaaggccggaagccgcggagggtacagtcctcccccagaagaaacaatgcccttcgaactggacggcgagggcttcggtgatgattcacctccgcctggcctgtccagagtgatcgcccaggtggacggaagttcccagttcgccgctgtggctgctagctcagccgtgcgtctgacaccagccgctaacgccccaccactctgggtacctggagcaatcggctccccatcccaggaggcggtgcgaccaccatctaacttcactggctcaagcccttggatggagatctcgggtcccccattcgagatcgggagcgctcccgctggcgtcgacgacactccggtaaacatggacagtcctcccatcgctctggacggacccccaatcaaagtgagtggcgcacctgataagagggagcgagctgagagaccaccagtggaggaggaggccgcagagatggaaggcgcagccgatgcagctgaagggggaaaagtgccctctcctggttacggcagtcctgccgcaggcgctgccagcgctgacactgccgcaagagccgctcctgctgcacccgctgatcctgattcaggtgctaccccggaagacccggatagcggaactgcccctgccgatccagattccggtgcttttgccgcagaccctgatagcggtgccgcacctgctgcccctgccgatcctgactccggagcggcacccgacgcacctgccgaccccgatagcggggctgcccctgacgcaccagcagatccagacgcaggtgccgcacctgaagcgcctgccgctccggctgccgcagagactcgcgctgcccacgttgctccagccgctccggacgctggcgctcctaccgcgccagccgcttctgcaactcgggctgcccaggtgcgcagggccgcatcggcagcccctgcctccggcgctagacgtaaaattcacctgagaccaccatcccctgaaatccaggcggctgatccgcctacccccaggccaaccagggcctccgcgtggcgtgggaagtctgagtctagccgaggcagacgtgtctactacgatgagggcgtcgccagttccgacgacgatagcagtggggacgagtctgatgatggtacttccggctgcttgcggtggtttcagcatcgtcgtaacaggcgccgaaggaagccccaaaggaacctgcttcggaattttttggttcaggccttcggaggatgcttcggccgatccgagagcccccagcccaaagctagcagaagcctgaaggtgaagaaagtccctttggcagaaaagaggaggcagatgagaaaagaggcgttggaaaaacgcgcacaaaaacgagctgaaaaaaaaagatccaagttgatcgataagcagcttcaagatgagaagatggggtacatgtgtactcaccggttgttgctactgggcgcaggagagtctgggaaatccacgatcgttaagcagatgcgaatcttgcacgtaaatggttttaatggagagggcggagaagaagacccacaagcagctcgctccaattcggatggggagaaggcaaccaaagttcaggatattaaaaacaacttaaaggaggcaattgagactattgtagcagccatgagcaacctggttcccccagtagagctggcaaaccccgagaaccagttccgcgtcgattacattctcagcgtgatgaacgtgcctgattttgactttcctcctgaattttacgagcatgccaaagcgttatgggaggacgagggggttcgcgcatgctatgaaagatctaacgaataccagctcatcgactgtgcccaatatttccttgataaaattgacgtgattaagcaggcagattacgtgccatctgaccaggatctcctgagatgtagagtcttgacatctggtattttcgagacgaagtttcaggtggacaaggtgaatttccacatgttcgacgtggggggacagagggatgagcgcaggaagtggatccagtgttttaacgatgtaaccgctatcattttcgtcgtggctagctcatcctacaacatggtgattagggaggataatcaaacaaatcgcctgcaggaagctctgaacctcttcaagtctatatggaataatagatggctcaggactatatctgtgattctgttcctgaacaagcaggacctgctagcggagaaggtcctagccggaaaatccaagatagaggactatttccctgagttcgcaaggtacaccacgccagaagatgcaacaccagagccaggagaggaccctagggtgaccagagccaaatacttcattcgggatgaatttctacgcattagcactgcatccggcgacggacgccattattgttacccacactttacttgtgcagtagataccgagaacataagaagagtgtttaacgattgccgcgatattattcagagaatgcacttgagacagtatgagctgctgtag

SEQ ID NO: 225094 - DNA, 342 bp, Artificial Sequence
  Description of Artificial Sequence: Synthetic coding sequence
tgaacaactgaacctgaaaccgaaccagaggatgatcggggacctgttgtgccaaaacatagcactttcggccagagtctaactcaaaggctgcatgctttgaagctgcgttcccctgacgcaagcccatccagagctccaccttctacgcaggaaccacagtctcccagagagggtgaagagttgaagcctgaagataaagacccacgggacccggaggagtccaaggaaccaaaagaggagaagcaacggcgaaggtgcaagcccaaaaagccaaccaggagagacgcgtcccccgagtcaccatcaaaaaagggacctatcccaatcaggagacattag

SEQ ID NO: 225095 - DNA, 501 bp, Artificial Sequence
  Description of Artificial Sequence: Synthetic coding sequence
cccgaatcagagagcgaccatgagcacgaagaggcagatctggagctatccctgccggagtgtttagagtacgaggaggagtttgattacgaaaccgagtccgaaaccgaatccgagattgaatccgagaccgacttcgagactgagccggagacggcccctaccactgaaccagaaaccgagcctgaagacgatcgtggccctgtcgttcccaagcacagcacttttgggcagtctctgactcagagactacatgcattaaagcttcgttcccctgacgcttctcctagtcgggctcctccatccacccaggagccacaatcaccccgagaaggggaggaactgaagcccgaggataaggaccctcgcgaccctgaggaatcaaaagaaccaaaagaagagaagcagcgtagacgttgcaagcctaagaaaccaacaagaagagacgcctcacctgagagtccttcaaagaagggcccaattcccatccgccgtcactag

SEQ ID NO: 225096 - DNA, 5579 bp, Artificial Sequence
  Description of Artificial Sequence: Synthetic coding sequence
atggtggacaagaatatctatattattcagggtgagattaatattgtggtgggcgctatcaaaagaaatgcccgatggagtacccacactccactggacgaggagcgggatcctctcctccactcctttggacacctgaaagaggtgctgaacagcattaccgagctatccgaaatcgaaccaaacgtttttttgcgcccttttctcgaggtcattagaagcgaggacacaacaggacctatcaccggcttggctctaaccagtgtgaacaaattcctatcctacgctctcattgatccaacacatgagggtactgcagaaggcatggagaacatggccgacgctgtcacccatgcccgatttgtcggtactgaccctgcaagcgacgaggtcgtattgatgaagatcctgcaagttctgcggacactcctgctgacgcccgtcggcgcacacctcaccaatgaatccgtttgcgaaattatgcagagctgtttcagaatatgcttcgaaatgagactctctgaactactccgcaaatcagccgagcacacgctggtggacatggtgcagctcctttttaccaggctcccccagtttaaggaggagcctaaaaattacgtggggaccaacatgaaaaaactcaaaatgcgggctggaggcatgtctgatagctctaaatggaagaagcaaaagcgtagtcctcggcctcccaggcacatgacgaaggtgacccctggtagtgagttgcccaccccgaacgggacgaccctgtcatccaaccttactggaggaatgccatttatcgacgtgcccacccctatctccagcgcatcctccgaagccgcatccgccgtagtcagcccatccactgattcgggacttgaattctcatcacaaacgacctcgaaagaagacctgacagatctcgagcagccaggaagccccggatactccacagccactgagccgggatctagcgagctgggcgtgcccgaacagccggatctacaggaggggacccatgtagaaaagagccaatccgcatccgtggagagtatccccgaagtactggaagagtgtacctccccggcagaccactccgacagcgcatcggtgcatgatatggactatgtaaacccacgaggcgtccgtttcactcagtcctctcagaaggaggggacggctcttgtgccctatggcctgccctgtattcgcgaattgttcaggttcctgattagcctcaccaacccccacgatagacataactctgaagttatgatccacatgggcctccatctcttgacggtggctcttgaatccgcacctgttgcccagtgccagactctgctgggtcttatcaaggacgagatgtgtaggcacctgtttcagctcctgtcaattgagcggcttaacctctacgctgcatcattgcgtgtgtgcttccttctgtttgagtccatgcgagaacaccttaagttccagatggagatgtatatcaagaagctgatggagataattaccgtggaaaatccaaagatgccttatgaaatgaaagagatggctctggaggccatagtccagctgtggcggatcccatcattcgttactgaactctacataaattacgattgtgattactactgttctaatctctttgaagaactcaccaaactactgagcaagaacgcattccctgtttcaggacagctgtacaccactcacctcctgagtcttgacgcactcctcactgttatcgacagcacagaagcgcactgccaggccaaagtgctgaacagtctgacccaacaggagaagaaagagactgcgagaccatcatgtgagatcgttgacggtactcgcgaagcgtcaaatacggagagaacagcctctgatggcaaggcagttggaatggcatctgatatccccggacttcaccttcctggaggagggaggcttccccctgaacacggcaaatcggggtgtagcgacctggaagaggccgtcgactccggagctgacaagaagtttgctaggaaacctcccagatttagctgtcttctgcccgaccccagagaacttattgaaataaagaacaaaaaaaagctgctcataaccggaaccgagcagtttaaccaaaaacctaagaaagggatacaatttttacaggagaaaggcctgctgactattccgatggataataccgaggttgcccagtggctcagagaaaacccgcgactggataaaaaaatgatcggggagttcgtttctgatcgaaaaaacatcgacctcttagaaagctttgtaagtaccttcagtttccagggtctcagactcgacgaagccctacggttgtaccttgaagccttcagattgccaggcgaagcccctgtcattcaacgactgttagaggccttcactgagcgctggatgaactgcaatggttctccgttcgctaacagcgacgcctgcttcagccttgcctatgctgtaataatgctgaacacagatcagcacaaccacaatgtgaggaaacagaacgctccaatgacgcttgaggaatttaggaagaatctgaagggcgtaaatggtgggaaggacttcgagcaggatatcctcgaggatatgtaccatgcgataaagaacgaagagattgtaatgccggaagagcagaccggacttgttcgggagaattacgtgtggaacgtcctgctccacagaggggctacccctgagggaatatttctgagggtcccaaccgccagttatgacttagacttgtttaccatgacatggggacccactatcgctgccctctcttacgtattcgataaatccctggaagaaacaattatccagaaagcaatctccggctttcgcaagtgtgccatgattagtgcacactatgggctctctgatgtcttcgataacctgataatcagcctctgcaagtttactgctttatcaagcgagtcaattgaaaatctgccttccgtctttggtagcaaccccaaggcgcatattgccgctaaaactgtgttccacctggcgcacaggcatggagacattcttagagaagggtggaaaaatatcatggaggccatgctgcaactgtttcgggcacagcttcttccaaaggccatgatcgaagtggaggattttgttgatccaaatggcaagatttccttacagagagaggaaaccccatccaaccgcggtgaaagtacagtgttatcttttgtgagctggctcactttgagtggcccagaacagtcctcggtaaggggcccatcaaccgagaatcaggaggccaagagagtggcactagagtgcatcaagcagtgtgatcctgaaaagatgattactgagtctaaatttctccagttggaatccctgcaggaattgatgaaggcactggtgagcgtgacccctgatgaggaaacctatgatgaagaggatgcggcattctgcctggaaatgctactgcggatcgttcttgaaaatagggatcgcgtgggttgtgtctggcagactgtgcgcgaccatctgtaccacctatgcgtacaggcgcaggatttttgtttcttggtggaaagggccgtggtgggcctgctgcgtctggcaatcaggctgttgcggagagaagaaatcagcgcgcaggttcttctgagcttgcggattctgttactgatgaaacctagcgtgctatcccgggtatcgcatcaggtggcatacggactgcacgaactgctgaagaccaatgccgctaacattcactctggagacgactgggctacattattcacgttgttagaatgcataggatcgggcgtgaaaccaccagcggctctccaagccactgccagagctgacgctccagatgctggggctcagtcagattccgagttaccctcgtatcaccaaaatgatgtttctcttgaccgaggatatacatcagatagtgaggtttacacagatcacgggagacctggaaagattcatcggtccgcaacagacgccgatgtcgtgaatagtggttggcttgtagtgggtaaggacgatgtggacaactccaagcctgggccaagtagacccggtccttctcctctcatcaatcagtactctctgactgtcggcctggacttgggacctcacgatacaaaatctctgctgaagtgtgtagagtcactcagtttcattgtcagagatgcggcacatatcaccccggacaatttcgaattgtgcgtgaaaaccctgcgaatcttcgtagaagcaagtttaaacgggggttgcaagagtcaggagaaaagaggtaagtcccacaagtatgacagcaaagggaaccggttcaaaaaaaaatcaaaggaaggctctatgctgcgaaggccccgtacatccagtcagcacgccagcaggggcggacagtccgatgatgatgaagacgaaggggttcccgcatcttatcacactgtgtctcttcaggtgtcgcaagaccttctcgacctcatgcatacgttgcatacacgtgccgctagtatttactcttcctgggccgaggagcagaggcatctggagaccggcggacaaaagatagaagctgattctcgcactctgtgggctcattgttggtgccctctcttacaggggatcgcgtgcctatgctgtgacgcgcgaaggcaggttcgaatgcaagctctaacttacctgcagagagcactgttagtgcacgatctccagaagctcgacgcacttgaatgggagtcctgcttcaacaaggtactgtttcctcttttgaccaaactgttggagaacatttctcctgccgacgtgggtggcatggaggaaacacgtatgagggcatcaaccttgctgtccaaggtcttccttcagcacctgagccccctgctctccctctccacctttgctgctttgtggctgactattctcgatttcatggataaatacatgcacgctgggagctccgatctcctttctgaggccatacccgagtcgctgaagaacatgctgttggtcatggacactgctgaaatttttcattctgcagacgcccgtggaggaggaccttccgccctatgggaaattacctgggaaaggattgactgcttcctgccacacttgagagacgagctattcaagcagaccgtcatccaggaccctatgccaatggagccccagggtcagaagcccctggccagtgctcatctgacaagcgcggctggtgatacccgcacacctggacacccccctccacccgaaattccctctgaactaggtgcgtgtgatttcgagaaacctgaaagtcccagagcagccagcagctcatcacctggttctcccgttgcttctagtccttcgagacttagccccacacctgacggaccaccgccattagcacagccacccctgatcctgcagccgctggctagccctctgcaggttggtgtcccaccaatgactctccctatcatccttaaccccgcacttattgaagcaacttctccggtccctctcctcgccactcccaggcctacagacccaatccctactagcgaagtaaatta

SEQ ID NO: 225097 - DNA, 1749 bp, Artificial Sequence
  Description of Artificial Sequence: Synthetic coding sequence
atggggggtagcagccccgtgacctccaaggcgatcgtcgatgctgacggcaggatttatatccgcaattggcagggcggtattctttcgggcggtttcgagaaaaaccccaaacctattttcacagaggggaagaaccagctggagatccagaatctgcaggaagactgggaccacttcgaaccattattgagttctcttttacggcgaatgcctgagttagaaacccttgagattatgaagctggtcaactgtcctgagacattcacccctgatatgcggtgcataatgggagagtccccggcagtacaggggtatttcgtactcgccggtatgaattcagccggactttctttcgggggaggcgctggtaagtatctagcggaatggatggttcacggttatccttcggaaaatgtctgggaactggacttgaaacggttcggcgcattacagagctcccgtaccttcttacgccacagggtgatggaggtgatgccactgatgtatgatctcaaagttccacgttgggacttccagacaggcagacagctgaggacaagccccctctatgacaggctcgacgcacaaggcgcacgctggatggaaaagcacgggtttgagcggcctaaatactttgttcccccagataaggatttacttgcactcgagcagtcaaagactttttacaaacccgactggtttgatattgtggagtctgaagtcaaatgctgtaaagaggccgtgtgtgtcattgatatgtcctctttcacaaagttcgagatcacatcgacaggggaccaggctctggaagtcctgcaatacctcttctcaaatgatcttgacgtgccagtaggtcacattgttcacaccggcatgttgaatgaggggggaggctatgaaaacgattgttctatagctcgcctgaataaaagatcctttttcatgataagcccaacagaccagcaggtgcattgctgggcctggctcaaaaaacatatgccaaaggacagcaaccttctgttggaggacgtgacctggaaatataccgcacttaatctgatcgggccaagagctgtggatgtgctctccgaactgagctacgctccgatgacccctgaccactttccctcactgttttgtaaggaaatgagcgtaggctacgcaaatggtatccgggtaatgagcatgacccatacgggcgagccaggattcatgctttacatcccaatcgagggaatggatttcatcgggcgtgatgccttgttacagcagaagcagaatggcgtttacaaaagactgactatgttcatccttgatgatcacgatagcgatctagacctgtggccttggtggggcgagcctatctatcgtaacggccagtacgtcgggaaaaccacatcgtccgcgtatagctactccctggagagacatgtgtgtctgggcttcgtgcacaacttcagtgaggacacaggagaagagcaggtggtgactgctgatttcatcaatcgcggagagtacgagatcgacatagccggttacaggttccaggctaaggcaaaactttatccagttgcctctctctttacccaaaaaagacgtaaggacgacatggaacttagcgcctttctcgccctaccaccccctccacccaacatccactccggactgttcttcccatcacaccctagcctgtctttctcttggtggcaagaagtctgcctaacaggccagaagcaagcgccatag

SEQ ID NO: 225098 - DNA, 3540 bp, Artificial Sequence
  Description of Artificial Sequence: Synthetic coding sequence
atggccgcatgtggcagggtccgcagaatgtttcgcctgtctgctgccctacatctccttctcttgtttgcggctggagctgaaaagctaccaggtcagggtgtgcactcccaaggtcagggaccaggcgcaaattttgttagcttcgtgggccaggctggcggaggaggtccagcaggccagcagctaccacaactgcctcagagcagtcagctgcaacagcaacaacaacagcagcaacagcaacagcagccccagccaccccagcccccatttccagccggtggacccccagcccgaagagggggagcaggcgcagggggaggatggaaactggctgaggaagaaagctgccgggaggacgtgactagggtgtgccccaagcacacatggagcaacaatttagctgttttggagtgtctacaggatgtgcgtgaaccagaaaacgaaatcagctcagactgcaaccatttgctgtggaattacaagctgaatctaacgacagatccgaaattcgaatctgtagctagagaggtgtgcaaatctaccataacggaaataaaggagtgtgcagatgaacctgtgggtaagggctatatggtctcttgcctcgtagaccatcggggtaacataaccgaataccagtgccaccagtacatcactaaaatgaccgctatcatcttttccgactaccgcctcatatgtggtttcatggatgactgtaagaatgacattaatatactgaaatgtggttcaattaggcttggggagaaagatgctcactcccaaggggaagtagtgagctgcctagaaaaaggcttagtcaaggaggccgaggagcgcgagcccaagatccaagtgtctgagctgtgcaaaaaagcgatcctccgcgtggccgaacttagcagtgacgatttccatctcgacagacacctgtactttgcctgccgtgacgatcgagagcgattttgtgagaatacccaggcaggtgagggaagagtgtacaaatgtttatttaaccataagttcgaggaaagcatgtctgagaaatgtagagaggccctaacgacaaggcagaaactcattgctcaagactacaaggtcagctacagtctggcgaaatcctgtaaaagtgatctgaaaaaatataggtgtaacgtagaaaacctgccccgttctcgagaggctcgactgagttacctcctgatgtgcctggaatccgctgtgcatcgaggaagacaggtgagcagcgaatgccaaggtgagatgcttgattataggagaatgctcatggaagacttctctctaagccctgaaataatcttgtcttgccggggagagatagaacaccattgttcgggccttcatcgtaagggtcgcacactccattgtttgatgaaagtagtaagaggcgaaaaaggcaacctgggtatgaattgccagcaagctctacagacccttattcaagaaacagatccaggcgcagattatcgaattgacagagccctcaacgaagcctgcgaatccgtcattcagactgcatgtaaacatatccgtagcggagatccgatgattctaagctgccttatggaacatctgtacaccgaaaagatggtcgaggactgcgaacatcggttgttggagctgcagtacttcatatcgagggactggaaactggacccggtcctgtaccgcaaatgccagggggacgcctctagattgtgtcacactcacggctggaatgaaacaagcgagtttatgccacagggcgctgtcttttcatgcctgtatcgccacgcttaccgaacagaggaacaggggaggcgactgagccgtgagtgtcgggcagaggtccagagaatactgcaccagcgggcaatggatgtgaaacttgaccccgcactacaagataagtgtcttatcgacctgggaaagtggtgcagcgaaaaaacagaaactgggcaagaactggaatgcctgcaggatcacctggatgacctggtggtggagtgccgggacatagtcgggaatctgaccgaactagagagcgaagatatccaaatcgaggccctcctgatgagggcttgtgagccaataatacaaaatttctgtcacgatgtggccgataatcagatcgactccggcgacctgatggagtgtctcattcagaacaagcaccagaaggatatgaatgagaagtgtgctataggggtcacacacttccaactagtacagatgaaagacttcagattcagttacaaattcaaaatggcatgtaaggaggatgttctaaaactatgccctaatatcaaaaagaaagtggatgttgtcatctgcctgagtacaaccgtgcggaacgataccctgcaggaagctaaagaacatcgtgtgtctctgaaatgtaggaggcagctgagagtagaggagctcgaaatgactgaggacataagactggaacccgatctttacgaagcatgtaaaagtgatattaagaatttttgctctgctgtgcagtacggaaatgcccagatcatcgagtgccttaaagagaataaaaaacagctatctactagatgtcaccagaaagtcttcaaacttcaggagaccgaaatgatggacccagagcttgactatacactaatgagggtgtgcaaacagatgatcaaacgattttgcccagaagcggactccaagaccatgctacaatgccttaagcaaaacaagaattccgagctgatggatccgaaatgtaagcagatgatcacaaagaggcagatcacacaaaacactgattatcgattaaaccccatgcttagaaaagcctgcaaggcagacatccccaaattttgtcacggcatccttaccaaagctaaggatgactctgagttggagggtcaggtgatctcttgcctcaagctacggtacgcagaccaacggctcagttctgattgcgaggatcagatacggatcattatccaggaatcagccctggattacagactggatccacaactgcagctgcattgctcggacgagatcagttctttgtgcgctgaagaagctgctgcacaggagcaaaccggccaggtggaagaatgcttgaaggtaaaccttctaaaaatcaagaccgagctgtgcaagaaggaggtgttaaacatgctgaaagagagtaaggcggacattttcgtcgacccagtgctacacaccgcttgcgctcttgacatcaagcaccactgtgcggctatcacccctgggagagggaggcagatgagctgtctgatggaagctctagaagataagagggtgcgtctccagcccgagtgcaagaaacggctcaatgaccgaattgagatgtggtcctacgctgccaaagtcgccccagcagatggcttctccgacttggcaatgcaggtcatgacttctccgtcaaaaaattacatcctgtccgtgatcagcggttcaatctgcattcttttccttattggcctaatgtgcggcagaataaccaagcgagtgacacgggaattgaaggacagatag

SEQ ID NO: 225099 - DNA, 3579 bp, Artificial Sequence
  Description of Artificial Sequence: Synthetic coding sequence
atggccgcatgcggcagggtgcggcgtatgttccgcctgtccgctgccctacatttgcttctgttgttcgccgctggagccgagaagctccctggtcagggggtacatagtcaggggcagggccctggcgcaaactttgtgagctttgtgggtcaagccggtggtggaggaccggcaggacagcaattaccacaactcccacagagctcccaactgcaacagcagcaacagcagcaacagcaacagcagcagccgcaaccaccacagcctcctttccctgccggaggacctccagctaggcgaggcggagctggcgcaggcggagggtggaagctggcggaggaagagtcttgccgtgaggacgtgactcgagtgtgtcccaaacacacatggtctaataacttggcagtgctagagtgccttcaagacgttcgcgagttactatggaattacaaactgaatttaaccactgacccaaaattcgaatcagtcgctcgcgaggtctgcaagagcactataaccgagatcaaggagtgcgcagatgaaccagttgggaagggttacatggtatcctgcctcgttgatcaccgcggaaatataacagagtatcagtgccatcagtatatcactaaaatgacagcgatcatcttctcagattacagactgatctgcgggtttatggacgattgcaagaacgatatcaacatcctcaaatgtggcagcatccgcttaggggagaaggacgcccattctcaaggtgaagttgtgagttgtctagagaagggccttgtaaaggaagctgaggaacgcgagcctaagatccaggtttctgagctgtgtaagaaagcgatcctcagagtggccgagctgtcttccgacgactttcatctggaccgacacttatacttcgcttgcagagatgatcgggagcgtttttgtgagaatacacaggcgggagaagggcgtgtatacaagtgtctctttaaccacaagtttgaggagtccatgtcggaaaaatgtcgcgaagctttaacaactagacaaaagctcattgcccaggactataaagtctcatactccctggccaagagttgtaaatccgacctcaagaaatatcgttgtaatgtcgagaatcttcctagatcacgggaagcgaggctcagctaccttctgatgtgccttgaatccgccgtccacagaggcaggcaggtgtcatccgaatgtcagggggaaatgcttgattacagacgcatgctgatggaagattttagccttagtccagagattatacttagctgccggggagaaatcgagcatcattgttccggtctgcacaggaaagggcgaaccctccactgtctcatgaaagtcgtgcgcggagagaagggcaatctgggaatgaactgccagcaagctctgcagaccctcatccaggagaccgaccctggggcagattaccgcatcgacagggccctcaatgaggcatgcgaatccgtgattcagacagcctgtaagcatatacgtagcggggaccctatgatcttgtcttgtctgatggagcacctgtataccgaaaaaatggtggaagattgcgaacatcgacttctggaactgcaatatttcattagtcgtgattggaagcttgaccccgtgctgtatagaaagtgtcagggcgacgcatcgaggttatgccacactcacggttggaacgagacatcagagttcatgccgcagggagctgttttctcgtgtttgtatcgccacgcttacaggaccgaagagcagggccgtagactgtcaagagaatgccgggcagaggtccaaaggatcttgcatcaacgcgctatggacgtgaaattagatccagctctccaggataagtgcctgatcgatctcgggaaatggtgcagtgagaagacagaaacaggtcaagagctcgagtgtctccaagatcatctggacgatctggtggtggaatgtagggacatcgttgggaacctgacagaactcgaaagcgaggatatacaaatcgaggcgctgttgatgcgcgcttgtgagcctataatccagaatttttgccatgacgttgccgataatcaaattgattcaggagatcttatggaatgccttatacagaacaagcaccagaaggatatgaatgaaaaatgcgccatcggggtcacacactttcagctcgtgcagatgaaggattttcggtttagttacaagtttaagatggcatgtaaagaggacgtgctgaaactatgtccaaacattaagaagaaggtggacgtggtcatttgtctttcaacaacagttaggaatgacacactgcaagaggccaaggagcaccgcgtcagtttgaaatgtcgaagacagctgcgggtggaggagctggagatgaccgaggatattaggctcgaacctgatctctatgaggcctgcaaatccgatatcaaaaatttctgtagtgccgtccagtacggaaacgcgcagatcattgagtgtctaaaagagaacaaaaaacagctttcaactcgctgccaccaaaaagtcttcaagctgcaggagacagagatgatggatcctgagctcgactatacgctcatgcgggtctgtaaacagatgatcaaacgtttctgccccgaggccgacagcaagaccatgctacagtgtttgaaacagaacaaaaatagtgagctcatggacccaaagtgcaagcagatgattactaagaggcaaatcacacagaacactgactatcgactaaaccctatgctgagaaaagcatgcaaggctgacatccctaagttttgccacggaattcttaccaaagccaaggacgattctgagctggaggggcaggtcatctcctgcttgaaacttagatatgcagaccaaaggctcagctctgactgtgaagatcagatacggatcattatccaggagagtgctctggattacagactcgacccccagctacaactgcactgcagtgacgaaatcagttccctttgtgcagaggaagccgctgcccaagagcaaacaggacaagtcgaggagtgcctcaaggtcaatttgctgaagattaagacggagctttgtaagaaggaggttctgaatatgctgaaggaaagcaaggcagatatctttgtggacccggtgctgcacactgcatgcgccttggatattaaacaccactgtgctgccattacacctggcagaggcaggcagatgtcctgtctgatggaggccctagaggacaagagggttcgcctgcaaccagagtgcaagaagagactgaatgacaggatagagatgtggagctatgcagccaaagtggcaccggcagatgggttcagcgacttggccatgcaagtaatgacaagcccctcaaagaattacatactttcagtaataagcggatccatttgcatcctgtttttgatcggactcatgtgcgggagaattacgaagcgcgtaaccagggaactcaaggatcgactgcaatacagatccgagactatggcatataagggcctggtgtggagccaggacgtaacaggaagtcccgcatag

SEQ ID NO: 225100 - DNA, 2091 bp, Artificial Sequence
  Description of Artificial Sequence: Synthetic coding sequence
atgggcaatggaatgtgctctcgcaagcagaaaaggatttttcagaccctcttacttttaactgtggttttcggcttcctctacggtgccatgttgtattacgaactgcagacgcagctcagaaaagccgaggccgtcgccctaaaatatcagcaacaccaggaatcactttccgcgcagctgcaggtggtgtacgagcacaggagccgattggaaaagtctttgcagaaagaacgtctggagcacaagaaggccaaagaggatttcttggtttacaaactcgaggcacaggagacgctgaacaagggcagacaggattctaacagccgctattcagcactaaacgtccagcaccagatgcttaagagtcagcatgaggagttaaagaaacagcactctgaccttgaagaagagcaccgcaagcagggggaagacttttccaggacattcaacgaccacaagcagaaatatttacagctgcagcaggagaaagaacaggagctgtccaagctaaaagagacggtgtacaacttgagagaggaaaacaggcagctaaggaaagcccaccaagatatacacacccaactgcaggacgtgaagcagcagcacaagaacctgctcagcgagcatgagcagctagtggttactcttgaagaccacaagagcgctctagccgcagcccagacacaagtagcagagtataaacagcttaaagacactcttaacaggatccctagtcttaggaaaccagaccccgcagaacagcagaacgtaacccaggttgcccactctcctcagggatacaacaccgcacgcgaaaagccgacaagggaggtacaggaggtgtcaaggaataacgacgtatggcaaaaccatgaagctgtaccagggcgtgctgaagatacaaaactgtatgctccaacccataaagaagccgagttccaagctccaccagaacccattcagcaggaagttgaaagacgggagccagaggagcatcaggtggaagaagagcacagaaaggccctggaggaggaagagatggaacaagtaggccaggctgagcatctggaggaggaacacgacccaagccctgaagagcaggatagggaatggaaagagcaacacgagcaacgcgaagcagccaatttgctggaaggacatgcccgagcagaggtctatcctagcgccaagcccatgataaagtttcagtctccttacgaagagcagctagagcaacagaggctcgctgtgcagcaggtagaagaggcccagcaattgagagaacaccaagaagcgctgcaccagcagcgcctacaagggcacctgctgcgccaacaggaacagcagcagcagcaggtggcccgtgaaatggccctgcagcggcaagctgaactcgaggagggaagaccacaacaccaggaacaactgagacaacaggcccattacgacgcaatggataacgatattgtccagggggctgaagatcaaggcattcaaggagaggagggtgcatatgagagggataatcagcaccaggacgaggctgaaggcgatcccggaaatcggcacgagccaagggagcagggacccagagaggccgaccctgagtctgaggccgatcgggctgcggtggaggacatcaatcctgccgacgaccctaacaaccaaggggaagacgagttcgaggaagctgagcaggtgagagaggaaaacctgcccgacgagaacgaggagcaaaagcagtccaaccaaaaacaggaaaacaccgaggtagaagaacacttggtgatggccggtaacccagaccagcaggaagacaatgtcgacgaacagtatcaagaggaggcagaggaggaagtgcaggaggaccttacggaagagaagaaaagggagctggagcataatgccgaggagacatatggcgagaacgacgagaacactgatgacaagaacaacgatggggaagagcaggaggttagggatgacaatagacctaagggaagagaagagcactatgaggaggaggaagaagaggaggaggacggcgcagctgtggctgagaaatcgcaccgaagagcagagatgtag

SEQ ID NO: 225101 - DNA, 897 bp, Artificial Sequence
  Description of Artificial Sequence: Synthetic coding sequence
atgacaagcctcacccagaggagcagcggtctggtacagcgccgaacagaggcctcccgcaacgccgcagacaaggagcgagcggctggcggaggggcaggctcatccgaggatgacgctcaaagcaggcgagacgagcaggacgacgatgataagggagattcgaaggaaacacggttgacgctcatggaagaagtgctccttctgggtttgaaagaccgagaaggctacacatctttctggaacgattgtatctcctcaggcctacgaggatgcatgctaattgagctcgcgctgcggggtagactgcagctcgaggcttgtggaatgcgaaggaagtctttgttgactagaaaggtgatctgtaagtctgacgctccaacaggcgacgtactgcttgatgaagcgctgaagcacgtgaaagaaactcagcccccagagacagtgcaaaattggatagagctcctgtctggagagacctggaatcctctgaagctgcactatcagttgaggaacgtgcgtgaacgccttgcgaaaaatctcgtggagaagggcgttctaacgacagagaagcagaacttcctcctcttcgacatgacaacgcatccactgaccaataacaacatcaagcagaggctcataaaaaaggttcaggaggctgtgctagacaagtgggtcaatgacccacataggatggatcgaaggctgctggcactgatttacttagcgcacgcaagtgacgtcctcgaaaatgccttcgcacctctcttggatgagcagtatgaccttgcaaccaaacgcgtgcgtcagcttctggacctcgacccagaggtggaatgcctgaaagccaataccaatgaagtactttgggcagtggtcgccgcatttaccaagtag

SEQ ID NO: 225102 - DNA, 846 bp, Artificial Sequence
  Description of Artificial Sequence: Synthetic coding sequence
atgacttctctcactcaaaggtcgagcggtctagtgcaaagacgcaccgaggccagccgtaacgccgcagacagcaggcgcgatgagcaggatgatgacgacaaaggggactccaaggaaacccgtcttaccctgatggaagaagtcctgctgcttggcttgaaggacagggagggttatacatcgttctggaatgactgcatctcttccgggttacgtggctgcatgctgatagagctggccctccggggacgattgcagttggaggcctgcgggatgcgacggaagagtctgcttaccagaaaggttatctgtaagagtgatgcgcctaccggagatgtactgctggatgaggcactcaagcacgtaaaagaaactcaacctcctgagactgtccaaaactggatcgagcttctgagtggtgaaacttggaacccattaaagttgcattaccagctccggaacgtcagagagagactggccaaaaacttggtggaaaagggcgtcctcacgactgaaaaacaaaactttctgctttttgatatgactacacacccattgacaaataataatatcaagcagaggctcattaagaaagttcaagaagccgtcctggataagtgggtcaatgatccccacagaatggataggcgcctcctggcattgatctatcttgcccatgcatccgatgtcttagaaaatgccttcgcccctcttctggatgaacaatatgacctggctactaaaagggtacgacagctgctggacctggatcccgaggtggaatgcctgaaagccaatacaaatgaagtgctgtgggccgtcgtggccgctttcaccaagtag

SEQ ID NO: 225103 - DNA, 858 bp, Artificial Sequence
  Description of Artificial Sequence: Synthetic coding sequence
atgaccactctgacgcacagagctcgcagaaccgagatctctaagaattcagagaagaaaatggaatcggaagaagatagtaactgggaaaaaagtcctgacaatgaagatagtggtgacagtaaagatattagactcacattgatggaggaggtgttgctgctcggactgaaggacaaggagggctacacttcgttctggaacgattgcatcagctctggcctcaggggtggcatattgatcgaactagctatgcggggtaggatctatcttgagcctccaaccatgagaaagaagcgactcttagacaggaaagtcctgctaaaatctgactctcctaccggggatgtacttttagatgaaacgctgaagcacatcaaagccacagagcctactgagaccgtacagacttggatcgagttgctgacaggcgaaacctggaatccctttaaattgcagtaccagttgcgcaatgtgcgtgaaagaattgctaaaaacctggtggagaagggtatactgaccacagagaaacagaactttttgctgtttgatatgacaacccaccccgtgaccaacactacagaaaagcagagactggtaaagaagctgcaagatagcgtgctcgaacgttgggtaaatgaccctcagcgcatggataagcgcactcttgctctgctagtgctggcacactcttccgacgtattggagaacgttttctcttctctgactgatgacaagtacgacgttgccatgaaccgcgcaaaggatttagtggagttagatccagaagtggagggcaccaaaccatccgcgactgaaatgatctgggcggtgttggcagcctttaacaagagctag

SEQ ID NO: 225104 - DNA, 924 bp, Artificial Sequence
  Description of Artificial Sequence: Synthetic coding sequence
atgaccacactgacacatagggctaggaggacagaaatttctaagaattccgagaagaaaatggagtctgaggaagactcaaattgggagaagagcccagataacgaggatagcggtgactctaaggacattcgtcttactctcatggaagaagtgctgcttctggggctgaaggacaaagaggctaatattaatagctggatcactcgttggctgacccctgtaattcccgctctgtggggggcagagggctatacctctttttggaacgattgtatatcttctggtttgcgcggtggtatcttaattgaactggcgatgaggggcagaatctacctcgagcccccaacaatgcgaaaaaaacggctgctcgaccggaaggtactgttaaaaagtgactcaccaaccggcgatgtcctactggacgagaccctgaagcatatcaaagctaccgaaccgactgaaacagtgcaaacttggatcgaactgctgaccggagaaacctggaacccttttaagttgcaatatcagctcagaaatgtgcgcgaacggattgcgaagaatctggtggagaaggggatcctcactaccgagaaacagaacttcttactgtttgacatgactacccatcctgtgaccaatacaactgaaaagcaaaggctagtgaaaaagctgcaggactctgtgctcgagcggtgggtaaacgatcctcagcgaatggataagcgaaccttagccctcttggtgctggcacattcctccgatgtgctcgaaaacgtgttcagcagcctgactgacgataagtacgatgtggcaatgaaccgtgcgaaggatttggttgaattggatcccgaagtcgaaggaacaaaaccatcagcgacagaaatgatttgggctgtacttgctgcattcaacaagtcctag

SEQ ID NO: 225105 - DNA, 810 bp, Artificial Sequence
  Description of Artificial Sequence: Synthetic coding sequence
atgaccacactaacacacagagccaggcgtacggagatttccaaaaactccgagaaaaaaatggagagcgaagaagatagcaactgggagaagagccctgacaacgaggactctggggactccaaggacatcagactgaccctcatggaggaagttctgctgctcggcttaaaggataaggaggccaatatcaattcatggatcactcgctggctcaccccagttattcccgctctttggggcgcagagggatacactagcttctggaacgattgtatcagtagcggtctgcgagggggtatcttgattgaactggcgatgagaggcagaatctatctggagccccctacaatgagaaaaaaaaggttattagacaggaaggttttgttgaaatccgactcaccgacaggagatgtcttgctcgatgagacactcaagcacataaaagcgaccgagccaacagaaaccgttcaaacatggatcgaacttctgaccggcgagacatggaaccccttcaaacttcagtaccaactcagaaatgtgcgagaaagaattgctaagaacctggtggagaaggggattttgactaccgagaaacaaaatttcctcttgttcgacatgaccacccatcctgtgacaaatactaccgaaaaacaaagactggtcaagaaactacaggattccgttctcgagcgctgggtgaacgacccgcagcggatggataagcggactctggcgcttctcgtcttggctcatagttcggacgtgctggagaacgttttcagctccttgacggacgataaatactag

SEQ ID NO: 225106 - DNA, 726 bp, Artificial Sequence
  Description of Artificial Sequence: Synthetic coding sequence
atgactaccctcactcacagggctcgacgtacagagattagcaaaaactccgaaaaaaaaatggaaagcgaggaagattccaattgggaaaaatctcccgataacgaagattctggagacagcaaggacatcaggctcaccttaatggaagaggtgttactgctgggtttaaaagacaaagaggtgctgctcaaaagtgattcccccactggagacgtgttacttgatgaaacccttaaacacataaaagcaacagaacccacagagacggtgcagacatggatcgaactccttacaggcgagacctggaacccatttaagttgcaataccagttgagaaatgtgagagagcggatcgctaagaacctggtagaaaagggaatcttaaccacagagaaacagaatttcctgttgttcgatatgacaacgcaccccgtaactaacactactgagaagcagaggctcgtcaaaaagctgcaggactccgttctggaacgctgggtgaacgacccgcagcgaatggacaaacgcactttggccctgctggttctggctcatagctccgacgttctggaaaacgtctttagcagcttgacagacgacaagtacgatgtggccatgaatagggcaaaggacctggtcgaactagaccctgaggtggaaggaacaaagccttctgccaccgagatgatttgggccgtgcttgccgctttcaataagagttag

SEQ ID NO: 225107 - DNA, 1323 bp, Artificial Sequence
  Description of Artificial Sequence: Synthetic coding sequence
atggggctcggtgttagcgccgagcagcccgctgggggtgctgagggattccacctgcacggagtgcaggagaacagcccagcacagcaggccggactggagccatattttgattttattattactattggacactcgagactgaataaggagaacgataccctgaaggccctgttgaaggcaaacgtagagaaaccggttaagcttgaggtgtttaacatgaaaaccatgagggtgagggaagtcgaagtggtcccctccaacatgtggggaggccaaggcttactcggagctagtgtgaggttctgctcctttcgaagagcttccgaacaggtttggcatgtgcttgacgtcgagcctagcagccctgccgctctggcgggacttaggccgtacaccgattacgtggtgggctcagaccagatcctgcaggagtcagaagacttcttcacgcttatcgagagccacgaaggcaagccactgaagctgatggtttacaactcaaaaagcgactcttgtcgcgaagtgacagtgactccaaatgctgcttggggaggcgaggggagtctgggatgtggaatcgggtacggctacctgcatcgtattcctacccagccgcctagttatcacaaaaagcctccagggaccccaccaccttcagccctgcccctgggtgcacccccaccggacgctctgcccccaggccctactcccgaggactcaccctccctggagactggctcacgccagtcagactatatggaagccctactgcaggcccctggatctagtatggaagatcccctgccaggccctgggtctccctctcacagcgcccctgatcctgatgggctgccccacttcatggaaacgcccttgcaaccaccccctcccgttcagcgcgtgatggacccaggttttctggacgtttccggtatatcactgctggataattcaaatgcatccgtttggccgtccttgccctcttctacagaactgaccactacagcggtgtctacttctggacctgaggatatctgcagctctagcagttctcacgaaagaggaggagaggccacttggtcgggatcagaattcgaagtgagcttcctcgattcccccggtgcccaagctcaggcggatcatttgcctcaactcactttgccggactcactcacctccgccgcaagccctgaggatggcctgagcgccgagcttctggaggcacaggctgaagaggagccagcttcaactgagggtcttgacacgggcaccgaagctgaaggactagacagccaggcgcagattagtaccaccgaatag

SEQ ID NO: 225108 - DNA, 4143 bp, Artificial Sequence
  Description of Artificial Sequence: Synthetic coding sequence
atggcctccggcagagatgagcggcctccctggcgactcggacgactgttgctgctgatgtgccttcttctcctaggtagcagcgctcgagctgcacacattaaaaaggcggaggcaacaactaccactacctcggccggtgcagaggcagccgaagggcagttcgatcggtattatcacgaggaagagttagagagtgcactcagagaggccgcagcagctggacttcctggccttgccagactgttttctattgggaggagcgtcgaagggagaccattgtgggtcctgaggctaaccgccggacttggtagcctgattcccgaaggagacgcgggtcctgatgccgctggacccgatgctgccggacctctactccctggccgtccccaggtcaagttggtcgggaacatgcacggcgatgaaaccgtgtcacggcaggtgcttatttatctagcacgggaactggccgctggatacagaaggggagaccctaggttggtgcgactgttgaacacaacggacgtttacttactcccaagtctgaaccctgatgggttcgagcgggcacgcgaaggtgattgtggattcggagacggtggaccgtccggtgcatctgggagagataatagccgcggaagggacctcaaccggagtttccccgatcagttttcgacaggcgaaccccctgccttggatgaagttcctgaggtgagggccctgattgaatggatccgcaggaataaattcgtgctcagcggcaacttacacgggggttctgtggtggcctcttaccctttcgacgacagtcctgagcacaaggccaccggcatatatagcaagacaagtgacgatgaagtgttcaagtaccttgctaaggcgtacgcgtcaaaccatcccatcatgaagacaggtgagccccattgtccaggagacgaagacgaaacttttaaggacggcatcaccaatggcgcacattggtatgatgttgagggaggaatgcaggattataactatgtgtgggccaattgtttcgagattaccctggagctgagttgttgcaagtacccaccagcaagccaattgagacaggagtgggagaacaaccgcgagtccctgatcacactcattgagaaagtacatataggggttaaggggttcgtaaaagacagcataacggggtccggcctggagaacgctaccattagtgttgccggaatcaaccataacatcactaccggcaggttcggagacttctaccggctgctggtgccaggaacatacaacttgacggtggttctgacggggtacatgcccctgactgtgaccaatgttgtggttaaggaaggaccagcgaccgaagttgacttcagcctgagaccgacagtgacatctgtcatacctgacacaacggaggcagtgtccaccgcgagcacggtggcaattcctaacatcctgagcggaacctcttcttcatatcagcccattcagcccaaggactttcaccaccaccacttccctgatatggagatcttcttgcgccgtttcgctaatgaatatcccaatattacgcgattatactctctcgggaagtcagtggaatctagagaactgtacgtcatggagatcagcgataaccccggagtgcatgaacctggtgaacccgagtttaagtacattggaaatatgcacggcaacgaagtggtcggcagagagctgctgttaaaccttatcgaatacctgtgtaaaaattttggcactgatcccgaggtgacagacctagtgcacaataccaggattcacttgatgccttccatgaatccggacgggtatgaaaagtcccaggaaggcgactccataagcgtgattgggagaaacaatagtaacaatttcgatctgaacaggaatttcccagaccaattcgtgcagattaccgatcctactcaaccagaaaccattgctgtgatgtcgtggatgaaaagttatccttttgtgctttctgctaatctccatggtggaagcctcgttgtgaactacccctttgacgatgacgaacaggggcttgcgacttactctaagtcgcctgatgatgccgtgtttcaacagatcgctctttcctatagcaaagaaaattcgcagatgttccagggccgaccatgtaagaacatgtaccctaatgaatattttcctcacggaattacgaacggtgctagttggtacaacgtgccaggcggaatgcaggattggaactatctacagactaactgctttgaggtgactattgagctcggatgtgtgaagtacccactggagaaggaactgcctaatttttgggaacagaaccggaggtctcttatccagttcatgaaacaggtgcatcagggagtgcgaggttttgtattagacgccactgacgggcgaggcatcttaaacgccaccattagtgtagctgagatcaatcatccagtgacaacatacaagactggagattattggcgtctgttggtgcctggcacttacaaaataaccgctagtgctcgtggttacaatccagtgaccaagaatgttacagtaaagtccgagggcgcaatccaggttaatttcaccctggttcgctcatcaacagattccaacaatgagagcaagaaaggaaaaggtgctagctcttctacaaatgacgctagcgacccaaccactaaagagtttgaaacacttattaaggacctctctgctgaaaatggccttgaaagtcttatgctgagaagctcctcaaacttggctctcgccctctaccggtaccactcatataaagacctgagtgagttccttcgaggactggtgatgaactacccacatataaccaacctaacaaatctcggccagtctacagagtatcggcacatatggagtctggaaatctccaacaaaccgaatgtgagcgagcctgaggaaccaaagatacggttcgtcgcgggtattcacggaaatgctcccgtggggaccgaactcctgctggccctcgcagagttcctgtgccttaattacaaaaagaaccctgcggtgacacagctagtggacaggacccgcatcgtcatcgttccaagtctgaatcccgatgggagggaacgggctcaagagaaggactgtacctccaagatcgggcaaaccaatgccagaggcaaggacctggatactgacttcacgaataatgcttcccaacccgagacaaaagccattattgagaacctgatccagaaacaggatttctcattgagcgtcgccctggatggaggttccatgctggtgacatacccgtacgacaaaccagtacaaacagtcgagaataaggagacactgaaacaccttgcctctctatatgctaacaatcaccccagtatgcacatgggacagccttcatgccctaacaaaagcgatgaaaatattcctggaggcgttatgaggggagcagagtggcactcccacctcggctctatgaaggattacagtgtaacatatggacattgtcctgagattactgtttacacgtcttgctgctattttccgagcgccgctcggctcccatcgctgtgggcggataataagagatccttgttgtccatgctcgtggaagtccacaagggcgttcacggatttgtcaaggacaaaaccggcaaacctatttccaaggccgtcatagtgctgaacgagggtattaaagtgcagactaaggagggcggatatttccatgttcttcttgcccctggcgtgcacaacatcattgcgattgccgatggctatcagcagcagcattcccaagtgtttgttcaccatgacgccgcatcaagtgtggtaatcgtctttgatacagacaaccgcatattcgggttaccccgagaactggtggtgactgtttccggtgccaccatgtccgccttgatcctgactgcctgtatcatctggtgcatctgtagcataaagagcaaccgtcataaagatggtttccaccgactgcggcagcatcacgatgagtatgaggacgagattcggatgatgtctactggtagcaaaaaaagcttgttgtctcacgagttccaggatgagactgatacggaggaggagaccctgtactccagcaaacattag

SEQ ID NO: 225109 - DNA, 558 bp, Artificial Sequence
  Description of Artificial Sequence: Synthetic coding sequence
atgtttgagactatggccatcgagattgaacagctgcttgcccgtttgacaggggttaacgataagatggccgagtacacaaatagcgctggagtcccttcattgaacgctgcccttatgcacactctgcagcggcaccgggatattctccaggactacacacacgaatttcacaaaactaaggccaattttatggcaatcagggagcgggaaaacctgatggggagcgtgagaaaagatatcgaaagttataaatcaggaagcggtgtgaacaatcgaagaacagaactcttcctgaaggagcacgatcacttgcgcaacagcgatagactcattgaggagacaattagcatagctatggcgacaaaagaaaatatgacttcgcagagagggatgctgaagagtatccattctaaaatgaacactctggccaatcgattccctgctgtgaattccctgatccaacgtataaatcttcgcaaaaggcgggactccctgatcctggggggtgtgatagggatttgtacgatattgctgctgttgtacgcctttcactag

SEQ ID NO: 225110 - DNA, 525 bp, Artificial Sequence
  Description of Artificial Sequence: Synthetic coding sequence
atggctgcagggaccagctcgtactgggaagacctgcgaaaacaggctaggcagttggagaacgagctcgatttgaaactggtgtccttcagcaagctgtgtacatcgtattcccacagcagcacgagagatggaaggagggattctagtgatactactccccttctgaacgggtcttctcaggacagaatgttcgagacaatggccatcgaaatcgagcagttgctcgctcgcctgaccggcgtgaatgataaaatggcagaatataccaactctgccggagttccgagtctcaatgcggctttgatgcacaccctgcagaggcatagagatattttgcaggactatactcatgaatttcacaagacgaaagccaacttcatggccatccgggaaagagaaaacctcatggggtccgttagaaaggacatagagtcatacaaatctggctcgggggtcaacaaccgcagaaccgaattgtttctcaaggagcatgatcatcttcggaaagggtttcagtggtag

SEQ ID NO: 225111 - DNA, 747 bp, Artificial Sequence
  Description of Artificial Sequence: Synthetic coding sequence
atggccgctggcaccagctcatattgggaggacctgagaaagcaggctaggcaacttgaaaatgaactagacctgaagctcgtgagctttagtaagctctgcacctcttactcccacagttcaacgagagatgggaggcgggacagctctgacacaacgcctctgctgaatggtagctcacaagaccggatgttcgagacaatggctattgagatcgagcagttactggcccgactgacaggcgtgaacgacaagatggccgaatatacaaatagtgcaggcgtgcccagccttaacgccgcactgatgcacactctgcagagacaccgcgacattcttcaggattatacccatgagtttcacaagactaaggccaactttatggcaatcagggagagagaaaatttgatgggcagcgtcaggaaggacattgagtcatataaatcaggatctggagtgaataatagacgaacagagctctttctgaaagagcatgatcacctgcggaactctgaccgactgatcgaggagacaatcagtatagctatggctaccaaagaaaatatgacttctcagcgcggaatgcttaaaagcattcactctaagatgaataccctggccaaccgatttcccgctgtaaacagcctcatacagaggatcaatctgagaaagagacgagacagcttaattctagggggtgtgattggcatctgtacaatactgctgcttctgtatgcattccattag

SEQ ID NO: 225112 - DNA, 528 bp, Artificial Sequence
  Description of Artificial Sequence: Synthetic coding sequence
atggcggctggaactagctcctactgggaggacttaagaaagcaggccagacagctagagaacgaactggacctaaaactggtctcgttttccaaactttgtacctcttattctcattcaagcacaagggacggacgcagagataggtatagctctgacacaacacccctgctgaatggttccagtcaggatcgtatgttcgaaacgatggccatcgaaatcgaacagttacttgcccgtctcaccggcgtgaatgataagatggcggaatacaccaacagcgcgggtgtaccatcccttaatgccgcactgatgcacacactgcaaagacaccgagacatcctgcaggtcatctactgggcaagggatgtctttattattacaggcgtttgggtgttttttttcaatccttgcatcggttacgtgcacatctatttgaaaggccaacgcgaaaaaagtgagaaaataaatgcaatgctcaaagggctagtgctcctgtttttcggtgtcaccataattaaattctag

SEQ ID NO: 225113 - DNA, 558 bp, Artificial Sequence
  Description of Artificial Sequence: Synthetic coding sequence
atgtttgaaaccatggccattgaaatagagcaacttctggcccgtttgaccggcgtgaacgacaagatggcagagtatactaactctgcaggagtccccagcctgaacgcagcccttatgcacaccctccagaggcatcgcgatatcctgcaagattacacacatgagtttcataaaacaaaggccaactttatggcaatccgcgaaagggagaatctgatgggatcagtgagaaaagatattgaatcctacaagagcggctccggcgtgaacaacaggagaaccgagctgtttctgaaagaacatgatcacctacgcaatagcgatagactgattgaagaaactattagcatagcaatggcaaccaaggagaatatgacttcccaaagaggtatgctcaagagcatccactcgaagatgaacacattagctaatcgatttccagccgttaacagtctcattcaacgcattaatctgcggaagcgccgtgattctcttattctgggcggagtgattggcatctgcacgatcttgctgctgctttatgccttccactag

SEQ ID NO: 225114 - DNA, 1350 bp, Artificial Sequence
  Description of Artificial Sequence: Synthetic coding sequence
atgacaagcttctatagcacatcctcctgtccgctgggctgtactatggctccaggggctagaaatgtgttcgtgtccccaatagacgttggctgccagcctgtggccgaagccaatgctgcttccatgtgcctgctagccaatgtggcccacgccaacagggtcagggtaggctctactcccttgggcaggccttccttatgcttgcccccaacatcgcatactgcgtgcccgttaccgggaacctgccacattcccggtaacatcgggatctgcggcgcttatggtaagaacacactcaacggtcacgagaaggagactatgaaattccttaacgacaggcttgcaaattacctggaaaaggtgcgacaattggagcaggagaacgcagaattggagactaccctcctcgaacgctccaaatgtcacgagagtacagtctgcccagactatcagagttatttccgtactatcgaggagctgcagcagaaaatactgtgctcaaaagctgagaatgccagactcatcgtccagatagacaatgctaagctcgcagctgatgactttaggattaagctggaaagtgaaagaagcctgcaccagcttgtggaggctgacaaatgcggcacccaaaaacttttggacgatgccacattggccaaagctgacctggaagcccaacaggagtctttgaaagaggaacagctgtccttgaagtcaaatcatgagcaggaggtcaagatcctaagatcacagttaggcgaaaagtttcgtatcgaactcgatatcgagccaacaatcgatctgaatcgggtgttgggggagatgcgcgcacaatacgaagccatggtggagacaaaccatcaggacgtcgaacagtggttccaagcacagtcggaaggaatttcgcttcaggccatgtcttgcagtgaggagcttcagtgttgccagagcgagatccttgagttgcgatgcaccgttaatgctcttgaggttgagagacaggcacaacatacccttaaggattgtttacagaactccctttgtgaggctgaagacaggtatggcacagaattggcccagatgcagtctctgatcagcaacctggaggaacagttaagcgagatacgagccgacttggaaagacagaaccaggagtatcaggtccttctcgacgtgaaagctcgtttggagaatgagatagcaacataccggaatctactcgagtccgaagactgcaaactcccttgcaatccttgtagtacacctgcctcatgcacatcatgcccatcatgtggtcctgtcaccgggggatctccaagcgggcacggagcctctatgggtaggtag

SEQ ID NO: 225115 - DNA, 639 bp, Artificial Sequence
  Description of Artificial Sequence: Synthetic coding sequence
atggaccccctgtttcagcagacacacaaacaagtgcacgagattcagtcctgcatgggtaggctggagactgctgataagcaatctgtgcacattgtggaaaatgaaattcaagctagcattgatcaaattttcagtcggctcgaaaggttggaaatacttagcagcaaggaaccacctaataaacgacaaaacgctcgtttgagagtcgaccagttgaagtacgacgttcagcatcttcagactgctctgcgtaacttccagcaccggagacatgctagagaacaacaggaacgacaacgtgaggaattgctgagcagaacctttacaacgaacgatagtgataccaccatccccatggacgaatctcttcagtttaattccagcctacaaaaagttcacaacgggatggatgacttaatattagacggccataacattttggacggcctgagaacgcagcgcttaacccttaagggtacccaaaagaaaatcctggacatcgcaaatatgctgggcctgtctaataccgtgatgagactcattgaaaagagagctttccaggataaatactttatgattggcggaatgctcctcacctgtgtggttatgtttctggtcgttcaatatttgacttag

SEQ ID NO: 225116 - DNA, 588 bp, Artificial Sequence
  Description of Artificial Sequence: Synthetic coding sequence
atggaccccctcttccagcaaacacacaaacaggttcatgagattcaaagttgcatgggcagattggagaccgctgacaagcagagcgtacatatcgttgagaacgagattcaggccagcatcgatcaaatttttagtaggctcgaacggctggaaattctaagttctaaagaaccaccaaacaagcgtcagaatgctcgtctgcgcgtggaccagctcaaatacgacgttcagcatctccagacagccctgcggaattttcagcatcgcagacacgccagagaacagcaggaacgacagcgggaggaactcctttccaggacctttacaaccaatgactctgacacaactattccgatggacgagagcctgcagttcaactcgagccttcagaaggtacacaatggcatggatgaccttatacttgacggacacaatatactggacgggctgagaacccaacggttaacacttaaggttgggagtctgcttggagaccgtgagaaagcctcctgcttcagtttgattcagcagttcagcaactgtgtctacattctcattacctgtccacaaatcgttatcttctag

SEQ ID NO: 225117 - DNA, 699 bp, Artificial Sequence
  Description of Artificial Sequence: Synthetic coding sequence
atggatcccttatttcagcaaactcacaagcaggtgcatgaaatccagagctgtatgggccgtctggagacagctgacaagcaaagcgtccacatcgtggagaacgaaatacaggcctctatcgatcaaatcttcagcaggttggagcgcctggagattctctcctctaaggagccaccaaacaagcgtcagaacgctaggctgcgcgtggaccagctcaagtacgacgtgcagcatctccagaccgccctgagaaatttccagcatcggagacacgcacgcgagcagcaagagcggcagcgagaagagctgttgagccgcacctttacgacaaacgatagtgataccactattccaatggacgaatctctccagtttaacagtagtctgcagaaagtgcataacggaatggacgatctgattttagacggccacaatattctggacggactaagaacccagaggctcactctaaaggggacccagaaaaagattctagacatcgccaacatgctcggcctgtccaacactgttatgagactcatcgagaaacgtgcctttcaagataagtactttatgatcgaaacaaggagccatcatgttgctcagaacgggccagagctgctgtcaagtcgggatccccctgcgtctgcatcccgatccgcaggcatcattgagtttagtgagaagataacgtag

SEQ ID NO: 225118 - DNA, 984 bp, Artificial Sequence
  Description of Artificial Sequence: Synthetic coding sequence
atggctgcggctgccgctatggccgagcaggagtccgcgaggaacggagggagaaacaggggcggtgttcaacgagttgaagggaagctgcgtgctagtgttgagaagggagactactacgaagctcatcagatgtaccgtacactgtttttccgatacatgagtcagagtaaacacaccgaggctagagagttgatgtactccggtgctctgctgtttttctctcacggacagcagaattccgcagcggaccttagtatgctggtgctggaaagtctggagaaggctgaggtggaagtggctgacgaactgctggaaaatctggctaaggttttcagtctgatggatcctaacagtcctgagagagttacctttgtttcaagagccctgaaatggtcttcgggtggcagtggaaagttgggacatcctcgtttgcatcagctgctcgcactgactctatggaaggaacagaattactgcgaatctcgctaccactttctgcacagcgccgacggtgagggatgtgccaatatgttggtggaatattctacgagtagaggcttccgttctgaagtggacatgtttgtggcacaggcagtactgcagttcctgtgtcttaagaataagtcctctgccagtgtcgtttttacaacatacacccagaagcacccatcgatcgaggatggcccacccttcgtggagccactgctgaattttatctggttcctcctgttagccgtcgatggcggtaaactaacagtgtttaccgttctgtgtgagcagtaccagccaagccttagaagggatcctatgtataatgaatatctggatagaatcgggcagctgttcttcggggtccccccaaagcaaacttcgtcttatggcggactcctggggaacttacttacatctctcatgggcagctcggagcaagaggatggtgaagaatctccgtccgacggctcccctatagagctggactag

SEQ ID NO: 225119 - DNA, 1779 bp, Artificial Sequence
  Description of Artificial Sequence: Synthetic coding sequence
atggcattacccgaggaggctaaaattaaagatgcatatcacatgctgaagagacagggcatcgtgcaaagcgacccaccaatcccagtagatcgaacacttatcccatccccgcctcccaggccgaagaaccctgtttttgacgacgaggaaaagtccaagctgcttgctaaactccttaaaagtaagaatcccgatgaccttcaggaagccaacaagctgataaagagcatggttaaagaagacgaggcccgaattcagaaagtcacaaagagactgcacacactggaagaggtgaacaacaacgtgcgcctcctctccgaaatgctgctgcactattcccaagaggatagctccgacggtgatcgtgagctcatgaaggaacttttcgatcagtgtgagaacaagagacgtacactatttaagcttgcgagcgaaactgaagataatgacaacagcttaggggacattctgcaggcctccgataatctgtcccgtgtgatcaatagctacaaaacaattattgaaggccaggttataaatggggaggtagcaaccctcaccctgccagatagtgaaggcaactcccagtgcagcaaccagggaacccttattgatctcgccgagctcgatactactaacagtctcagctccgtgcttgcgcctgcccctacgcctcctagctccggtatccctatcctgccaccacctcctcaggcgagtggcccacccaggtctaggtcatcctcccaggctgaggccactctgggaccgagctccactagtaacgctctgtcttggttggatgaggagctgttgtgcctcggacttgccgatcccgctccgaatgttcccccaaaggaaagtgccggaaacagccagtggcacctgcttcagcgagagcagtctgatcttgacttcttctcacctagacctggaacagccgcatgtggcgcttcggacgccccactcttacagccgtctgccccttcatccagttcaagccaggcaccactgccacctccattccccgctccggtagtccctgcatccgtacctgcccctagtgctggatcaagcttattctccacaggtgtggcaccggcactagcccctaaagtggagcccgcagtccctggacaccacggtctggcactgggaaattccgcactgcaccatctggatgcgctggatcaactactcgaggaggccaaggtgaccagtggactagtcaaaccaaccacgtctccactcatccccactacaacaccagccaggccactgctgccattttctacaggcccaggctcccctctcttccaaccactgagcttccaaagccagggttcaccgccaaagggccctgaactttcactcgccagtattcacgtgcccctcgagagcattaaaccatccagtgccctacctgtcacagcttatgacaagaacggatttaggatcctgttccactttgccaaggaatgtcctcccggtagaccagacgtccttgtagttgtagtgagcatgctcaatactgccccacttcccgtgaagtcaatcgtgctgcaggcagccgtgcctaaatcaatgaaggtgaagctgcagcccccatccggaacagaactgagccctttttctccaattcaacccccagcggctatcacgcaagtaatgctgttggccaatcctttgaagaagcaggtgctatcattcttggggaaggcatgcctccagccatggggacaggcaatactgcttaccactagttgtctggcgtag

SEQ ID NO: 225120 - DNA, 1956 bp, Artificial Sequence
  Description of Artificial Sequence: Synthetic coding sequence
atgaagaactgtggcaggagatttcataacgaggtcggcaagtttcggtttcttaatgagttgatcaaggtcgtttctccaaagtacctgggcgatcgagtgtctgaaaaggttaagacaaaagtgatagaattgttatattcctggactatggctctgcccgaggaggcaaagatcaaagacgcctatcacatgttgaaaaggcagggtattgtacaatcagaccccccaatccccgtagatcggacccttattcctagcccacctcctcgtccaaaaaaccccgtgttcgatgatgaggaaaagagcaagctcctggcaaaactcttgaagagtaagaatcccgatgatctccaggaagccaacaaacttatcaagagcatggtgaaagaagacgaagcccgaatccagaaggtgacaaagcggctgcatactctagaagaagttaacaacaatgtccggcttttgagtgagatgctgctgcactactcccaggaggacagcagtgacggagatagggagcttatgaaagagctgttcgatcagtgcgagaacaaaagacggactctatttaaattggcgtctgaaacagaggataacgacaatagtttgggagatatactgcaagccagcgataatctcagccgagttatcaatagctacaagaccatcatagagggtcaagtcatcaacggcgaggtcgccaccttgactctccctgattcagaggggaacagtcagtgcagcaatcagggaaccctgatcgacctcgctgagctggacaccaccaattccctgtcctccgtcctggccccagcccctacacctccaagctcaggcatcccgatcctcccacctccgcctcaggctagcggaccaccgaggagcaggagctcctcccaagccgaggccacactgggcccttcttctacttctaatgcactgtcttggctcgacgaggagcttctctgccttggtctcgctgatcccgcaccaaatgtgcctcccaaagagagtgctggaaatagtcagtggcatctgctgcagcgggagcagagcgatttagacttcttctctccacggcctggtaccgccgcttgtggcgctagtgatgctccattgctgcaaccctccgccccttcttcctcttcctctcaagcgccactgcctcccccattccccgctcctgtggtcccagcttccgtccctgctccttctgcgggttcttcattattcagtactggtgtggctcccgctctggcaccgaaagtagagcctgcggtgccgggacatcacggcctcgctcttgggaatagtgcgctacaccaccttgatgccctcgaccagctgctcgaggaggcgaaagtcacttctggccttgttaagcccaccacatctcctctcattccaacaactacccccgcacggccattactccctttttctaccggacccggatcgcccctatttcagcctttatcctttcaatcccaggggtcccctcctaaaggccctgaactctccctcgcatctatccacgttcccctggaaagtattaagccgtcatcagctctgccagtgacagcctatgacaagaatgggttccgcatactgtttcacttcgcgaaggaatgtccacctggcagaccagacgtgctagtggttgtggtgtctatgctgaacacagccccactgcccgttaagagtatcgtcctccaagccgctgtgcccaagtccatgaaagtgaaactgcagcctccatccggtactgaactgagcccatttagcccgatccagccccctgccgcaatcactcaggtcatgcttctggcgaacccgctgaaggagaaggttcgccttcgatacaagctgactttcgccttgggggagcagctgtcaactgaggtgggcgaggtcgaccagttccctccggttgagcagtggggaaatctatag

SEQ ID NO: 225121 - DNA, 1365 bp, Artificial Sequence
  Description of Artificial Sequence: Synthetic coding sequence
atgagcgccggtgggccttgtccagccgctgcaggaggagggccaggcggtgcctcctgctctgtcggtgcgccaggcggtgtctctatgttccgatggctggaggttctagaaaaggaattcgacaaggcgtttgtggatgtggacttgctattgggggaaattgacccagatcaggctgatatcacgtacgagggcagacagaagatgactagtctctcctcttgtttcgcacagttgtgccacaaagctcagtctgtgagccaaataaaccataagttagaagcgcaactggtggatcttaagagcgagctgaccgagacacaggcagagaaggtagtgctggagaaggaggtccacgaccagctgctgcagcttcattcaatccagttgcagctgcacgccaaaacaggccagtcggccgactcgggaacaatcaaagctaaacttgaacgtgaactcgaagcgaacaagaaagagaaaatgaaggaagcacagctggaggcagaggtgaagctgctccggaaagaaaacgaggctctgagacggcatattgcagtactgcaggccgaagtctacggggctagactcgcagcgaaatacctggataaggaactagctgggagggtccaacagattcagctactagggagggatatgaagggacccgctcacgacaagctgtggaaccagctggaggctgagatccaccttcaccgccacaaaactgttatcagggcgtgtcgcggtagaaatgatctgaagcggccaatgcaggcaccccctggccatgaccaggacagtctcaaaaaaagccagggtgtcggacctattcgaaaagtgctgctgttaaaggaggatcacgagggcctcgggatttctatcaccggcggtaaggaacacggtgtgcccatactgatcagcgagatccaccccggtcaacctgccgatcgctgcggaggactccacgtgggcgacgccatcctggctgtcaacggtgtaaatctccgagatactaagcataaagaagcggtgacaatcttaagccagcagcggggagaaatcgagtttgaggtggtgtatgtggcccctgaagtggactcggatgatgaaaacgtcgaatatgaagatgaatccggtcaccgctatcgcctgtatctggatgaactcgaaggaggagggaaccccggagctagctgcaaggacacctccggggagatcaaagtcctccagggattcaataaaaaggcagtcacagacacacatgagaatggggacctcgggaccgcatcagaaacccccctagatgacggcgctagcaaactcgatgatctccacacactgtaccacaagaaatcatactag

SEQ ID NO: 225122 - DNA, 1389 bp, Artificial Sequence
  Description of Artificial Sequence: Synthetic coding sequence
atgtccgcagggggtccatgtcccgctgctgccggtgggggaccaggtggggcttcgtgtagtgtcggtgctcctggcggtgtgtccatgtttcgctggttggaagtgcttgaaaaggaatttgacaaagccttcgttgacgtggatcttcttttgggagaaatcgaccctgatcaggcggatatcacctatgagggaaggcaaaagatgacctcactctcttcatgtttcgcccagctctgtcacaaggcacagtccgtttcccagatcaatcacaaactggaagcacagctcgttgacctcaaatcagaactgaccgagacccaagccgaaaaagtcgttttggaaaaggaggtgcacgaccaacttctgcagctacatagcatacagctgcaactgcacgccaaaacaggacagagcgctgactccggaacaatcaaggccaagttgtcgggaccctcagtagaggaactcgagagggaattagaagccaataagaaggagaaaatgaaagaggcacagctggaagccgaagtcaagctgctgaggaaagaaaacgaggcactacggcgtcacattgccgtgctccaggcagaggtctatggggcaagactggctgcaaagtatctggacaaagagttggctgggagggttcaacagatccaactgctggggagagacatgaaggggccagcacacgacaaactttggaatcagttggaggccgagatccacctccaccgccacaagacagtgatacgcgcatgtcggggacgcaatgatcttaagcggccaatgcaagcaccacccggtcacgatcaggacagtctgaaaaagagccagggggtggggcctatccgaaaggtattgttactgaaagaagaccacgagggcttaggtatttccattacaggaggaaaggaacatggggtccccattctcatctcggaaatacatccgggtcagcccgcagacaggtgcggtgggctgcatgttggagatgccatcctggcagtcaatggagtgaacctgcgcgatacaaaacacaaagaagccgtgaccattttatctcagcagcgcggagaaattgagtttgaggtcgtatatgtggccccagaggtggactctgacgacgaaaatgtggaatacgaggatgaatcgggacaccgctatcgtctgtacctggacgaactcgaaggtggtggtaacccaggggcttcctgcaaggatacttccggggagatcaaggttctccaaggattcaataagaaggctgtaaccgatactcacgagaacggcgacttaggtaccgcttccgagacacccctggacgacggcgcttcgaagctagatgatcttcatacactgtaccataagaaaagttactag

SEQ ID NO: 225123 - DNA, 1389 bp, Artificial Sequence
  Description of Artificial Sequence: Synthetic coding sequence
atgagcgccggaggaccgtgtccagccgctgccggaggtggcccaggcggtgcttcctgctcagtgggagcaccgggtggagtctcaatgttcagatggctggaagttctcgaaaaggaattcgacaaggcattcgtggatgtcgatctgctcctgggcgagatcgaccctgaccaggccgatattacatatgaaggtcgccagaagatgacatctctgagctcttgcttcgcgcagctgtgtcacaaggcacaaagcgtctcccaaatcaaccataaactcgaggcccagctggttgatctgaaatctgaacttactgaaactcaggcagagaaagtcgtcctggagaaggaagtgcacgaccagctgttacagctgcactccatccagctccagctacatgctaagacgggacagtccgctgattcagggacgatcaaagcaaaattggtatctcgatcctccagtaagatggagagagagctagaagccaataaaaaagagaaaatgaaagaagcccagctcgaggcagaggttaaactgctcagaaaggagaacgaagctctgcgacggcacatcgctgtcctgcaggcagaggtgtatggggctaggctggcagctaagtatctggacaaagaactcgccggaagagtccagcaaatacagctgttaggcagggacatgaagggccctgcccacgacaagctgtggaatcaactggaagcggagattcaccttcatcgccacaaaaccgtaatccgcgcttgtcgtggacgaaatgacctgaagaggccaatgcaggctccgccagggcatgatcaggacagtttgaagaagagccagggagtgggaccaatcaggaaagtgctcctacttaaagaagatcacgagggcttgggtatctccattacaggaggaaaagaacacggagttcctatcttgatttccgagatccatccaggtcaacccgctgacaggtgtggcggactgcacgtgggagacgcgatcctcgcagtgaatggcgtgaacctacgtgataccaaacacaaggaagctgttacaattttgagccaacagaggggggagatcgagtttgaggtggtatatgtggcccctgaggttgattcagatgatgagaatgtcgagtatgaagacgaaagtggccatagatacagactgtatctggatgagcttgagggcggaggcaatcctggagcctcctgcaaggacacaagtggagaaatcaaggtacttcaaggatttaacaaaaaagccgtgaccgacacccacgagaacggcgatctgggcactgcctccgagacccccctggacgacggggcatcaaaacttgatgatctacatacattatatcacaaaaagtcttactag

SEQ ID NO: 225124 - DNA, 1659 bp, Artificial Sequence
  Description of Artificial Sequence: Synthetic coding sequence
atggagcctgccatggagccagaaacattagaagcacggattaatagagctacaaatcccctgaacaaggaacttgactgggcttccatcaatggattttgtgaacagttgaatgaagattttgagggacccccactggccactagattgcttgcccacaaaatccaatctccacaggagtgggaagctatacaggccctgaccgtgctcgagacttgcatgaagtcatgtggaaaaagattccacgacgaggtcggcaaattcagatttctgaacgaactgataaaggtggtcagccctaaatatttgggaagtaggacctctgagaaagttaaaaacaaaattttagagctgctctattcatggactgtcggtctccccgaggaagtgaagattgcggaggcctaccagatgctcaagaaacagggtattgtcaaaagtgatcccaagttacctgacgatacgacattcccactgccccctccccgtcccaaaaacgtcatcttcgaggacgaagaaaagtctaaaatgctggctcggctgttaaaaagctcccatcctgaggatctccgtgccgctaacaaactcattaaggaaatggttcaggaggaccaaaagaggatggagaagatcagtaagagggtcaacgctattgaagaagtcaacaataacgtgaagttattgaccgagatggttatgtcccacagccaggggggagcagccgctggttctagcgaagatctgatgaaagagctctaccaaagatgcgaacgcatgcggcctacattatttcggctggcttcagacactgaggacaatgacgaggcccttggactgagcgatcccacccctcccagcggaccaagtttagatggcactggctggaactcctttcagagctccgacgccacagagccacccgcaccagcactggcccaggctccatctatggagagtaggccaccggctcagacttccctgccagcctcctcaggacttgacgacttagacttgctgggaaaaacactgctccagcagtcactcccaccagagtctcagcaagttcgttgggagaagcagcagccaacacctcggctgactctgcgagatctacaaaataaatcttccagctgctcctccccttcttccagtgctacttcactgctgcacacagtgtcccctgagcctccgcgtccgcctcaacagcctgtacccactgaactgagtttggctagcatcactgtacctctggaaagtatcaagccgtccaacatcctgccagtgacagtttacgaccagcatgggttccggatactcttccactttgcgagggatccgcttcccggacgcagcgacgtgctggtcgtggtggtcagcatgttgagtaccgctcctcagccaatcagaaacattgtcttccagagcgctgttcccaaggtgatgaaagttaagctgcagcctccaagtggcaccgagctgcccgcattcaaccctatcgtgcaccccagcgcaatcactcaggtattgttacttgcaaatcctcagaaggaaaaggtccggttacgctataaattgaccttcacaatgggcgaccaaacttataatgagatgggtgatgtcgaccagttccctccccctgaaacatgggggagcctgtag

SEQ ID NO: 225125 - DNA, 117 bp, Artificial Sequence
  Description of Artificial Sequence: Synthetic coding sequence
atgaaatcatgcgggaagcgctttcatgacgaggttgggaaatttcgttttttaaatgagctcattaaagtggtgagccccaaatatttagggagccgcacttctgagaaggtgtag

SEQ ID NO: 225126 - DNA, 1821 bp, Artificial Sequence
  Description of Artificial Sequence: Synthetic coding sequence
atggagcctgctatggagcccgagacccttgaggccagaatcaatagagcgacaaacccactgaacaaggaactggactgggcctccattaatgggttctgcgaacaattaaatgaggacttcgagggccctcccctcgcaacccgtctgctggcgcataagatccagtcccctcaagaatgggaagcgatccaggccctcacttatctggggagtcgaaccagcgagaaagtgaagaacaaaattctcgagctactctatagctggacggtggggcttcctgaagaggtgaagattgccgaggcctaccagatgctcaaaaaacagggaatcgtgaaatccgatcccaaactgcccgacgacacaaccttccccttgccccctcctcggccaaagaatgtgatttttgaggatgaagagaagtctaagatgctggcgaggctgttgaagagtagtcatcctgaggacttgagggccgcaaacaaactaatcaaagaaatggtccaagaagaccagaagcggatggagaaaattagcaaacgggtgaatgcaatcgaagaagtgaacaataatgtaaaactgctcacggaaatggtgatgtcccactctcaggggggtgccgctgcaggaagttccgaggacctgatgaaagagctgtaccagaggtgtgagcggatgcgcccaacactattccggctggcctccgacactgaagacaatgacgaggctctcgccgaaatactgcaggcgaacgataacctaacgcaggtcattaacctgtataagcagctcgtcaggggggaggaggtgaatggcgatgccactgccggatccatccccggaagtacatccgccctcctggacctgagcgggctcgacttgccaccagccggaaccacctaccccgctatgccaaccaggcctggggaacaggcttcacccgagcaacccagcgcgtctgtgagcctgctggatgatgagctgatgtcgctagggctgagtgatccaacaccaccttcaggaccttcacttgatggcactggatggaattcattccagtcttcagatgctactgaacctcctgctccagctcttgcccaggcgccatcaatggaatcccggcctccggcacagacaagcctgccagcaagttccggtttggacgaccttgatctgctcggtaagactctcttacagcagtccctgccaccggagagccaacaagtgcgttgggagaagcaacagccgaccccgcgactgacactacgtgatctccaaaacaagtcaagctcttgttcttctccgtcgtcctctgcgacctccctgctgcacacagtaagcccggagccacctcgacctccccagcagccagttccaaccgagctgtcactcgccagcattacagtgccgcttgaaagtataaagcctagtaatattctgcctgtgaccgtttatgaccagcatgggtttcggattctgttccactttgcacgtgatccactacctggacgatccgacgtgcttgttgtagtagtatcaatgttatcaactgctccacagcccatacgaaatatcgtgtttcagagtgcagtgccaaaagtgatgaaggtgaagctccagccaccatctggcaccgaactgcctgcttttaatcccatcgtacacccttccgccatcacacaggtcctgctgctcgcaaaccctcagaaagagaaggtgcgtcttcggtataaactgacatttacaatgggggaccagacatacaacgagatgggcgacgtggaccagttccctcccccagaaacatggggaagtttgtag

SEQ ID NO: 225127 - DNA, 1920 bp, Artificial Sequence
  Description of Artificial Sequence: Synthetic coding sequence
atggagccagctatggagccggaaacactagaggcacggatcaatcgcgctacaaaccctctcaataaggagctcgactgggcttctataaacggattctgtgagcagcttaatgaggactttgaggggcctccgctggctactcgcctattggctcacaaaattcagtcaccacaggaatgggaggccatacaggcgctgactgtgttggaaacctgtatgaaatcctgcggcaagcggttccacgacgaagtgggaaagtttaggtttctgaacgagctgatcaaagtagtcagcccaaaatatctgggttccaggacctccgaaaaagtgaaaaataagattctagaactcttatatagttggacggtgggattgccggaggaagtgaaaattgccgaggcctaccaaatgttgaaaaaacagggaatcgtcaaatcagacccgaagctgccagatgataccacgtttccgctccccccaccgagacctaaaaacgtgatctttgaggacgaagaaaaaagtaaaatgctggccagactgctaaagtcatctcatccggaagacctacgtgccgcaaacaagctgatcaaggagatggtgcaggaggatcagaagcggatggaaaagattagcaaaagggtaaatgctattgaggaagtgaataacaatgttaaactgttgacagagatggtgatgtctcattcccagggaggcgctgccgctggctcgtcagaggacctcatgaaagaactctaccaacggtgcgagaggatgcggccaaccctattcaggctcgctagtgacactgaagacaacgatgaagcacttgccgagattcttcaggccaacgacaacttgacgcaagtcattaatctttacaaacagttagtcaggggggaagaggtgaacggcgacgcaactgctggaagtatccctgggtccacgagcgcactgctcgacctgagtggtctggacctgccgccagccggtaccacctatccggcaatgcccactagacctggcgagcaggctagcccagagcagccttcagcctcagtgagcttgctggatgatgaactcatgagtctgggtctgagtgatcccaccccaccttccggaccgtctttggacggcacaggatggaacagcttccaatcctctgatgcaactgaacctcccgctccagctctggcacaggcgcctagtatggagtctcgaccccctgcacagacttccctgcctgcgagctcgggcctcgatgacttggacctcctgggcaaaacactgcttcaacagtcgctaccacccgaaagccagcaggtcaggtgggagaagcaacagccaactccaagactcaccctgagggatcttcagaacaaatcatcctcctgcagctcaccttcgtcttctgccacttcccttcttcacacggtgagcccagaacctcccagacctccccagcaacccgtcccaacagaactttctcttgccagtatcaccgttccactcgaaagtatcaaaccctctaatatattgcctgtcactgtgtacgatcaacatgggtttcgcatcctttttcattttgcccgagacccgctgcccggaagatcagacgtcttagttgtggtcgtatcgatgctctcaactgctccccagccaattagaaacatcgtcttccaatctgccgtccccaaggtgatgaaggtaaaactgcagccaccttccggtaccgagttgcccgcatttaatcctatcgtccaccccagcgcaataacccaggtgctgcttttggccaatcctcagaaggaaaaagtcagactgagatacaagcttacattcaccatgggcgatcagacctataacgagatgggggatgtggatcaatttcctccaccagagacctggggctctctctag

SEQ ID NO: 225128 - DNA, 1971 bp, Artificial Sequence
  Description of Artificial Sequence: Synthetic coding sequence
atggaacctgccatggaaccagaaaccttggaagcacgaatcaatcgtgccactaaccctctaaacaaagagttggattgggccagcattaacggattctgcgagcaactgaacgaagactttgaagggcctcctctagcaacccgcctcctggcccacaaaatccagtctccccaggagtgggaggccatccaggccctcactgtaaggaggggcgaagctacaatacggcctcctccatgtgatgacaccaaagtgctcgagacttgtatgaaaagctgcggaaagagatttcacgatgaagtcgggaagtttaggtttcttaacgagttgatcaaggtggtctctcccaagtatctagggagtcggacctctgaaaaggtaaagaacaaaatcctggagctgctgtatagttggacagtggggctgcccgaggaagtgaagattgcagaggcttatcagatgctaaagaagcagggtattgttaaaagtgacccaaaactccctgacgacacaacctttccgctccccccacccaggcctaagaatgtgatctttgaagatgaagagaagagtaagatgttggcccgattgctgaagagtagtcacccggaagaccttcgggcagccaataagcttatcaaggagatggtgcaggaagatcagaagaggatggaaaaaattagcaagagagtgaatgcaatagaggaggttaacaacaacgttaaactgctcacggagatggtgatgtcccactcccaaggaggagctgcggcaggaagctcggaggatctgatgaaggaactctatcaacgctgcgaacgaatgcgaccgacactgttccggttggcctctgacacagaggacaacgacgaggcactagcggagatcctgcaggcgaacgacaacctcactcaggtgataaacctgtacaagcagctcgtgaggggggaagaggttaatggcgacgcaactgcgggttcgatccccggatccaccagcgctctgcttgatctgagcggcctcgacctgcctccagcgggtacaacttaccctgccatgccaactcggcctggcgaacaagcgagcccagagcagccatccgcttccgtctcactcctggacgatgaactcatgagtctgggactctccgatcctacccctccgagcgggccttctttggatggaacaggctggaactcattccagagctccgatgcaaccgagccaccagcgcctgctttagcccaggcaccttctatggagtctagaccacctgcccagacaagcctgccagcttcttccgggctcgacgatttggacctgctggggaagactctcctgcagcagtcactccctcccgaatcccagcaagtgcgctgggagaaacagcaaccaacacccaggctgacactaagggatctgcagaacaagagctcttcgtgctcatcaccctccagcagtgccacctccctactgcataccgtgagcccagagccacccagacctcctcagcagccagttccaaccgagctctctctggccagtatcaccgttcctcttgagagcataaagccatccaacattctgccggttaccgtgtacgaccaacacggattcagaattcttttccattttgcccgagatcccctgcctgggaggagcgatgttctggtcgtggtggtgagcatgctctccacagccccacagccaatccgcaatatcgtgtttcagagcgcagtccccaaggttatgaaagtcaaactgcagcctccctccggcaccgagctgcctgcatttaatcccatcgtccacccatctgcgatcacacaggtactgctgttagccaaccctcagaaagagaaagtacgcctccgttacaaactgactttcacgatgggtgatcagacctataacgagatgggcgacgtcgaccagttcccaccccctgagacttggggaagcttgtag

SEQ ID NO: 225129 - DNA, 1701 bp, Artificial Sequence
  Description of Artificial Sequence: Synthetic coding sequence
atgaaaagctgcggcaaacgtttccacgacgaagtgggaaagtttcgttttctaaatgagctgattaaagtcgtgagtccaaagtatctcggctcacgtacttccgagaaagttaagaacaaaattctggagctgctctatagctggaccgtggggctgccagaagaggtgaaaatcgccgaagcctaccagatgctgaaaaagcaaggcatcgtcaagagtgatcctaagctacccgacgatacgactttccccctgcctcccccacggccaaaaaacgtcattttcgaagacgaggaaaagagcaagatgctggcccgtctgctgaaatcctctcaccctgaggatcttcgggctgccaacaagcttattaaggaaatggtgcaggaagatcaaaaacggatggagaagatttccaagagagtcaatgccattgaggaggtgaacaacaatgtcaaactgttaactgagatggttatgtctcattcacaggggggagcggcagccggttcctcagaggatcttatgaaagaattgtatcaaagatgtgagaggatgaggccgacactgtttagactcgccagcgatactgaggataatgacgaggccctcgccgaaatcttgcaggccaatgataacttgacacaggtgatcaacctgtacaaacaactcgttaggggtgaggaggtgaacggcgatgctacagccggatccatcccaggctccacttcagctctgctcgacctcagcggtctggatctcccgccagcaggaacaacctacccagctatgccgactaggcctggcgagcaggcatctccggagcaaccctccgcttccgtgagtctgttggacgacgagttaatgagcctaggcttgtctgatccgactccgccaagcggcccatcccttgatgggactggatggaactcatttcagagttctgatgctacagagccgccagcaccggctctggcccaggctccttccatggaatcccggccacccgctcagacgagtctcccggcttcctcaggcctagatgatctggacttgctgggaaagactcttttgcaacagtccctgcccccagagtcacagcaggtaaggtgggaaaagcaacaacccacgccaaggctcactctgcgggacctgcagaacaagtcgtccagctgctcaagcccctcaagctcggccacttccctgctccataccgtatcccccgagccaccccgacctccacagcagccggttccgaccgagctgtccctggcgtccataaccgtgcccctcgaaagcattaaaccatcgaatatattgcccgtgacggtctacgatcagcacggcttccgaatccttttccactttgcgcgtgatcctctgcccggaagaagcgacgtactggttgtggttgtgtctatgctctcgacagccccacagccaattaggaatattgtgtttcagagtgccgtcccgaaggtgatgaaggtcaagcttcagcccccatcgggcactgagctcccagcttttaacccgatcgtgcacccatccgccatcactcaggttctgctgctggcaaatccccaaaaagaaaaagtgcgcctgcggtacaaactgacgttcactatgggtgatcaaacctataatgagatgggagacgttgatcagtttccacccccagaaacctggggcagcttatag

SEQ ID NO: 225130 - DNA, 123 bp, Artificial Sequence
  Description of Artificial Sequence: Synthetic coding sequence
atgaaatcttgcggtaagcgttttcacgatgaggttgggaagttcaggttcttgaacgagctaataaaagtagtgtctcctaaatacctgggcagcagaacttctgaaaaggtaaaaaactag

SEQ ID NO: 225131 - DNA, 330 bp, Artificial Sequence
  Description of Artificial Sequence: Synthetic coding sequence
atgaagtcctgtggcaagcggttccatgacgaagtcgggaaatttcgatttcttaacgagctaatcaaggtggtgtcccccaagtacttagggtctcgcacctctgagaaggtcaaaaacaagatcctcgaacttctatacagttggacggtaggactccctgaagaggttaaaatcgcagaggcctatcagatgctgaaaaaacagggtatcgtcaagagtgatcctaagctgccggatgatacaaccttcccactcccccctccaaggcccaagaatgtgatctttgaagacgaagagaagtctaagatgttggccagactgttatag

SEQ ID NO: 225132 - DNA, 270 bp, Artificial Sequence
  Description of Artificial Sequence: Synthetic coding sequence
atggaacctgctatggaaccagagactctagaagctcggatcaatagagctactaatccattgaataaagagctcgactgggcatccatcaatgggttttgtgagcagctgaacgaagatttcgagggccctcctcttgctactcgcctgctggctcataaaatccagagcccacaggaatgggaagctattcaagcattgaccgtcagacgcggtgaagccacaatccggccacctccttgtgatgatacaaaaggaggacaggattag

SEQ ID NO: 225133 - DNA, 330 bp, Artificial Sequence
  Description of Artificial Sequence: Synthetic coding sequence
atgaagagctgcggtaaacgattccatgatgaagtgggcaagtttagatttctaaatgaactgattaaggtggtatctcccaagtatctcggatcccgcacttcagaaaaggtcaagaataagatcctcgaactgttatattcttggacagtgggtttgcctgaagaagtgaagatagctgaggcataccaaatgctaaagaaacagggaattgtgaagtctgaccccaagttgcccgatgatacaaccttcccattaccccctccaaggccgaaaaacgtcatcttcgaggacgaggagaagagcaagatgctcgctagactgttgtag

SEQ ID NO: 225134 - DNA, 327 bp, Artificial Sequence
  Description of Artificial Sequence: Synthetic coding sequence
atgaagagctgtggcaaacggttccatgacgaagtaggaaaatttcgatttctcaacgaactcatcaaagtggtgtcccccaaatatctgggctcgaggacctcggagaaggtaaaaaacaagattctcgagcttttgtattcatggactgtgggcctcccagaagaggtgaaaatcgcagaggcctaccagatgctgaaaaaacagggtatcgttaaatccgatccaaaactgccagacgacaccacattcccactaccgccacctagaccaaaaaatgtgatcttcgaggacgaagaaaagtccaaaatgttagctcgcctctag

SEQ ID NO: 225135 - DNA, 57 bp, Artificial Sequence
  Description of Artificial Sequence: Synthetic coding sequence
atgaagtcatgtggtaagaggttccacgacgaggtggggaagttccgctttttgtag

SEQ ID NO: 225136 - DNA, 183 bp, Artificial Sequence
  Description of Artificial Sequence: Synthetic coding sequence
atgaaatcatgcggtaagagattccatgacgaagtaggtaagttccggttcctgaacgagttaatcaaagtagtgtcccctaagtacctgggatcgaggacctctgaaaaagtgaaaaataagatccttgaactgctctactcatggaccgtgggactgcccgaagaagtgaaaatcgcctag

SEQ ID NO: 225137 - DNA, 87 bp, Artificial Sequence
  Description of Artificial Sequence: Synthetic coding sequence
atgaaaagttgcgggaaacggttccacgacgaagttgggaagtttaggttcctgaatgagctgatcaaggtcgtaagcccaaagtag

SEQ ID NO: 225138 - DNA, 741 bp, Artificial Sequence
  Description of Artificial Sequence: Synthetic coding sequence
atgacccccggaacagcaaatcgtgcgaccaacccgctgaacaaagaacttgactgggcatcaattaatgggttttgtgaacaactgaatgaggacttcgaaggcccaccattagctacacgtctgctggcacataagatccaatctccgcaagagtgggaggccatccaggctctcacagttctggaaacctgtatgaagtcttgcgggaaaagatttcatgatgaagttggcaaatttagattcttgaatgagctgattaaggttgtctctccaaagtatcttggatcacgcaccagcgagaaagtcaagaataagatattagaactcctgtattcttggaccgtggggctgccagaagaggtgaaaatcgctgaagcttatcagatgttgaagaagcaggggatcgtgaaatcagacccgaaactgccagacgataccacttttcccctccctcctccacgcccaaaaaatgtcattttcgaagacgaagaaaagagtaaaatgctcgccagattactgaaatcatcccatccagaggacctccgagccgctaacaaactcatcaaagagatggtgcaggaggaccaaaagcgcatggagaaaatttcaaagcgcgtgaatgctattgaggaggtgaacaataatgttaagctgctcaccgagatggtgatgtctcactctcaggggggagcggcagcaggaagtagcgaggacctcatgaaggagctctaccagtag

SEQ ID NO: 225139 - DNA, 213 bp, Artificial Sequence
  Description of Artificial Sequence: Synthetic coding sequence
atgaaaagttgcggaaagagatttcatgatgaagttgggaaatttaggttcctgaacgagcttatcaaggtcgtgagtcctaaataccttgggagccggacttctgagaaggtaaagaacaagatcctggagcttctgtattcgtggacagtaggtctcccagaagaagtaaagatagcagaggcctaccaaatgttaaaaaagcagggatag

SEQ ID NO: 225140 - DNA, 2172 bp, Artificial Sequence
  Description of Artificial Sequence: Synthetic coding sequence
atggccgaggcagaaggcgagagcctggagagctggctgaataaagccactaatccttcaaacaggcaggaagattgggagtacatcatcggcttctgtgaccagatcaataaagaacttgagggtcctcagatcgccgtgcgcctcctcgcgcacaaaatccaatctccccaggagtgggaggctctgcaagctttaactgtgctcgaagcctgtatgaagaattgcggcaggaggttccataatgaagtggggaagtttcggtttctcaacgagcttataaaggtagtgtctcccaagtatctcggagatcgggtctcagagaaggtgaagacaaaggttatcgaacttttgtacagctggacaatggccttacccgaggaggccaagatcaaagatgcctatcacatgcttaaacgacagggcatcgtacagagtgaccctcctatcccagtggatcgcaccctgatcccctcgccacctcctcgacccaaaaaccctgtattcgatgatgaagagaagtccaagttgctggccaagcttctcaaaagtaaaaatccagacgaccttcaggaggcaaataagctcattaagagcatggttaaagaggacgaggcgagaatacagaaggtaacaaaaaggctgcacacgttggaagaagtgaataataacgtccgccttttatctgagatgctgctccactactcccaggaagactctagcgatggggaccgggagttaatgaaagagctgttcgaccaatgtgagaataaacgaaggaccctcttcaaactcgcctccgagaccgaggacaacgataatagcttgggagacatcctgcaagcctccgataacttaagcagagtgattaactcatacaagacaattatcgaagggcaggtgattaacggggaagtggccacactgaccctcccggacagcgagggaaactcacagtgtagtaaccagggtaccttgatagacctggccgaactggacacgaccaactcgctatcgagcgtccttgcgccagctcccaccccccctagttccggcattcctattctccctccacctccacaggcaagcggccctcccaggtctagaagtagctcacaggccgaggccacacttggtccatccagtacctcgaatgcactgtcttggctggatgaagaactgttgtgcctgggcctcgcagacccagcgccaaacgtccccccaaaggagtctgcgggaaattcacagtggcacctcctacagagggagcagtcagacctcgatttcttcagtccccgtccgggtactgctgcatgcggcgctagtgacgcacccctcctgcaaccctcagctccctctagctctagctcccaggctccgctgccccctccgtttcctgcgcctgtggttcctgcctctgtgcccgctcccagtgcgggatcctctttattcagcaccggggtggcaccagccctagcaccaaaggtggaacctgctgtccctggtcaccatggcctggccctcggcaattctgctctacatcacctcgatgccttggaccagctgctcgaagaggctaaggtgactagtggcttagtgaagccaaccacatcccccctcattcccactacaacacccgcacggccactgctgccattttccaccgggccagggtcgccattgttccagccactctcgtttcagtcacaggggtcacctccaaagggaccggaactttctttagcttccatacatgtgcctttggaatctatcaaaccctcttccgctctgcccgtgactgcttacgacaagaacggattccggatcctgtttcactttgctaaggagtgcccccctggaaggcctgacgttctcgtggtcgtggtctctatgctcaataccgctccgcttcccgtcaagtccatcgtgttacaggccgcagtgccaaaatcaatgaaggtgaaactgcagccaccatcagggacagagctcagccctttctctccaatccagcctccggctgcaatcacacaggtgatgttactcgcgaatcccttgaaggaaaaggttaggctgcggtataagctgacatttgcgctaggggagcaactcagtacagaagtgggtgaagtggaccagttccctccggtggaacagtggggaaatctttag

SEQ ID NO: 225141 - DNA, 2073 bp, Artificial Sequence
  Description of Artificial Sequence: Synthetic coding sequence
atggcagaggctgaaggcgagtctctggagtcatggttgaacaaggctactaatccttcaaaccggcaagaagactgggagtacatcattgggttctgtgaccagataaacaaggagttagagggccctcagatcgccgtcagactactggcccacaagatccagagtccccaagagtgggaagctttgcaggccctgacgtatctgggcgaccgggtcagtgagaaggtgaagaccaaagtaatcgagctgctgtactcttggactatggctcttccagaagaagccaagatcaaagacgcctatcatatgctaaaacggcaggggatcgtgcagagcgaccccccaattccagttgacaggaccctgatccctagcccacctccacgcccaaagaaccctgtgttcgatgatgaagaaaaatcgaagctactggcaaaactgctgaaatcaaaaaatccggatgacctgcaagaggcgaataaactcataaagtctatggtcaaagaagacgaggctaggatacagaaagtaaccaagcgcctccacacactcgaagaggttaacaataacgttagactcctttcagagatgctcctgcattactcacaggaagactcaagtgatggggatagagagctcatgaaagaactcttcgaccagtgcgaaaacaaaagaagaactttatttaaactggcctctgagacagaggacaacgataacagcttgggggatatactccaggctagcgataacctctcacgcgtcatcaattcatataagaccatcatagaaggtcaagtaatcaatggagaagtggccaccctaactctgccagacagcgagggaaattcacaatgtagcaatcaaggcacattgattgaccttgccgagctggataccacaaactcacttagtagcgtgctggcaccagcacctacgcctccctcttccggtatcccaatcctcccacctcctccacaagctagtggtcctccacgcagcagatcgagcagccaagctgaagccacactgggaccctcgtctacctcaaacgcattgagttggctggacgaagaactgctctgtctgggcctcgcggacccagcgccaaatgtcccgccaaaggaatccgctggaaattcccagtggcatttgcttcagagagaacaatcagacctcgattttttcagtcctcgccctggcactgctgcctgtggcgctagtgacgcccctctgctgcagccaagcgcccctagctctagttctagccaagcccctttgccccctccttttccagccccagtggttccagcgagcgtgcctgcaccttctgccggaagcagcctgttttcaaccggagtggctcctgcccttgctccaaaggtggaacccgcagtgccagggcaccatgggctagcccttggtaattctgcgctccaccatcttgacgccctagatcagctgttggaggaagctaaggtaacttctgggctagttaagcccactacctcccccctgatacctacaactactcccgcacgccctctgctgccattttctactggccctgggtctccactgtttcaacctttatctttccagagccagggttctccgccaaagggcccagagctttcactggctagcatccacgtacctctcgaatcgatcaagccaagctctgcacttccggttaccgcatacgacaaaaatggcttccgaatactctttcactttgccaaagagtgtcctcccggacgccctgacgtcctggtcgtggtggtgtccatgttgaacacagctcctctgccagttaaatccatcgtcctgcaggcagccgtgcccaagtccatgaaggtcaaattgcagcccccatcgggcaccgagctcagtcctttctcgccgatccagccaccggcagccatcactcaggtcatgctcctggcaaatcctttaaaggaaaaagtcagactgcgctacaaattaacctttgcccttggcgaacaactctctaccgaggtgggcgaggtggatcagtttcccccagtggagcagtgggggaatctgtag

SEQ ID NO: 225142 - DNA, 1956 bp, Artificial Sequence
  Description of Artificial Sequence: Synthetic coding sequence
atgaaaaactgtgggagaagattccacaatgaagtcggaaagtttaggttcctgaatgagttgataaaggtggtgtccccaaagtacttgggggaccgggtgtccgaaaaagtcaaaacaaaagtgattgaattgttgtactcgtggacaatggcgctacctgaagaagctaaaattaaagacgcgtaccatatgctgaaacgtcaaggcatagtacagtccgatccccctattcccgtggaccgcacccttattccctccccaccgccacggccaaagaacccagtgtttgatgacgaagaaaagtcaaagcttctcgccaaattactgaagtcaaagaaccccgacgacctccaggaggcgaataagctaatcaagagcatggtcaaagaagacgaggcccgtatccagaaggtcactaaacgccttcataccttggaggaagtgaacaacaatgtacggttactgagcgagatgttgctgcactacagtcaggaagactccagtgacggagatagagagcttatgaaggagctgttcgatcagtgtgagaataaacgccgaaccctgttcaagcttgcctctgagaccgaagacaatgacaattccttgggagatatacttcaggcctccgataatctgtctcgggtgatcaactcctacaagaccataatcgaggggcaggtcataaacggagaagtggcaaccctgacgctgcccgacagtgaaggcaactctcagtgttctaaccaagggaccctcatcgacttagccgagctggatacaaccaatagcctgagttcagttctggccccagcacccactccccctagctctgggatccctatcctgccacccccacctcaggcttctggacctccgaggtctaggtccagctcgcaagcagaggcaactctaggcccaagcagcacctcaaacgccttgagttggctggacgaggagctcttgtgcctggggttggccgatcccgcaccaaatgtccctcccaaagagtccgccggaaatagtcagtggcatctcttacagagggagcaaagtgatcttgacttttttagccctagacccggtacagccgcttgcggggctagtgatgcgcctctgctccaaccctctgccccttcatcgtcgtcctctcaggcacctctacccccaccatttcccgctcccgtggttcccgcaagcgtgcccgcaccatctgccggtagttcactctttagtaccggcgtggcacccgcactcgctcccaaggttgagcccgcagtgccaggtcaccacggcctggctttggggaattccgctctgcatcacctcgacgcgctggaccagttattagaagaggccaaagtgacttcaggcctggtcaagccaaccactagccccctgatccccacaactacacccgctcgtccactcctgcccttctccactggtccgggaagtcccctctttcagcccctgtctttccagagccaggggagtccgcctaagggaccagagctgtccctggcctccatccatgttccgcttgaatccattaagccctcgtccgccctgcctgtaacagcctacgataaaaacggctttcggattctgttccattttgccaaggagtgtccccctggtcgtccggacgtcctcgtggttgtagtaagtatgctgaacactgcgcctctaccagtaaagagtattgtgttgcaagcggcagtgcctaagtccatgaaagtcaaactgcagccccctagcggcacagaactttcccccttttcccctatccagccaccagccgctattacacaagtgatgctgctcgctaaccccctcaaagagaaggtgcgcctgcggtataagcttacctttgcgcttggcgagcagctgtcaacagaggtgggggaagtagatcaatttccgccagtcgaacaatgggggaatctttag

SEQ ID NO: 225143 - DNA, 462 bp, Artificial Sequence
  Description of Artificial Sequence: Synthetic coding sequence
atggctgaggccgaaggggaaagtttggagagttggcttaacaaggcaactaatccatccaatcgccaggaggactgggagtatatcattggcttttgcgatcagatcaacaaagaactagagggacctcaaattgctgttcggttgctggctcacaaaattcaaagtccccaagagtgggaagcccttcaggccttaacagtcctggaagcctgtatgaagaactgcggcagacgctttcacaatgaggtgggcaagtttcggttcttgaatgagctgattaaggtagtaagccctaagtacctgggcgatcgggtgtcagaaaaagtgaagacaaaggtgatcgaactcttatattcctggacaatggcactgcctgaagaagcaaagatcaaggacgcatatcacatgctgaaacggcaggcatttagccaggccgcagaaaagcagaagcccagatag

SEQ ID NO: 225144 - DNA, 1806 bp, Artificial Sequence
  Description of Artificial Sequence: Synthetic coding sequence
atggcgctgccagaggaagctaaaattaaggacgcctaccatatgctcaagaggcagggaatcgtgcaatctgatcctccaattcccgttgaccgaacactcatcccatcccctcctccccgtcctaagaatccagtgttcgacgacgaggagaaaagtaaacttcttgccaagctgctgaaatccaaaaaccctgacgatctgcaggaagccaacaaactcatcaagtcaatggtgaaggaggatgaggctcggatccaaaaagtcacaaagagactgcatacgctggaggaggtgaataataatgtaaggctactgtccgagatgctgcttcattatagccaagaggactcctccgacggagatagggagctgatgaaggagctgtttgaccagtgtgagaacaaacggaggacactcttcaagctcgccagcgaaactgaggataacgataacagtcttggggacatcctgcaggctagtgataatctcagccgagtgattaacagttacaaaacgattatcgagggtcaggtcatcaatggagaagtggctacccttacgctgcccgactcagaaggaaattcccagtgctcaaatcaggggaccctaattgatctcgccgaactcgacaccacaaattccctgagcagtgtgttggcacccgcacccaccccacctagctctggcatccccatactaccccctcccccacaggcctccggacctcctagatcaaggagttctagtcaggccgaggccaccctgggacctagtagtacctctaacgctctgagttggttagacgaggagctcctgtgtcttggattggccgatccggcaccaaatgtgcctcctaaggaatccgctggcaactcccagtggcacctattgcaaagggaacagtcagatctcgacttctttagccctcggccaggaaccgccgcttgcggagcatctgatgcccctctgctgcagccaagcgccccttccagttctagctctcaggctcctctcccccctccgttccccgcaccagtggttcccgcttctgtcccagcaccgtccgccggttcatcactgttttcaactggcgttgcgccagcccttgctccaaaagtggaaccggctgtgcccggacatcatggcctcgcactggggaacagcgcgctccatcatctagatgctttagaccaattgctggaggaagctaaggtcacctctggcctggtcaaaccgacaacatcccctttgatcccaacaaccacgccagcccgacctttgcttcccttttcaaccggccctggcagccctcttttccaaccactcagctttcaatcccaggggtcccccccaaaaggtccagagcttagcctggccagcattcacgtgcctctcgagtctattaagccctccagcgctctgcctgtcactgcttacgataagaatggctttcgtatacttttccactttgctaaagagtgcccaccaggacggccagatgtcttggtcgtggtggtgtccatgctgaacaccgcgccactgcccgtgaagagcatagtgctgcaggcggctgtgccaaaaagcatgaaggtaaaacttcagcctccgagcgggaccgaactttctccattctcacccattcagcccccagcagccatcacacaggtcatgttgctggcgaacccattgaaggagaaggtccggctgcggtacaagctgactttcgccctgggagaacagctgtctacagaagtgggcgaagtcgaccagtttccacctgttgagcaatggggcaatctttag

SEQ ID NO: 225145 - DNA, 918 bp, Artificial Sequence
  Description of Artificial Sequence: Synthetic coding sequence
atggccgcaggactagctcggctgctgctcctcctgggcctgtcagctggagggcctgctccagcgggagccgcaaagatgaaggtggtagaggagcctaatgcatttggagtcaataacccctttctgccgcaggccagtaggctgcaggcaaaacgagatcccagccccgtgtctggccctgtgcatctattccggctcagtggaaaatgctttagtcttgtcgagagcacatacaagtatgaattttgtcccttccacaatgtgacacagcatgagcagactttccgatggaatgcttacagcggaatcctgggcatctggcatgagtgggaaatcgccaataacaccttcaccgggatgtggatgcgcgacggcgacgcctgcaggagtagatccagacagtcaaaggtggaactggcctgcggaaagtcaaataggctggctcacgtgtcagaaccttcaacatgtgtgtacgcccttacctttgagacaccactggtttgtcatccccacgcactgctcgtttatcccacactaccggaggccctccaaaggcagtgggatcaggtcgagcaagacctcgcagatgaactgataacaccacagggacatgaaaaactgctccgcacactttttgaggatgccggttacctaaaaactccggaggagaatgaacccacccagttggaggggggacctgactctctcggcttcgaaactctcgagaattgcagaaaagcccacaaagagctgtccaaggagataaagcgcctgaagggcctcctgacccaacatggaatcccttacaccagacctactgagacaagtaaccttgagcacctcggccacgagaccccacgggctaagagtccggagcagctgaggggtgatcctggcctgcggggatctctctag

SEQ ID NO: 225146 - DNA, 4496 bp, Artificial Sequence
  Description of Artificial Sequence: Synthetic coding sequence
atggacggtgcctctgccgaacaggatggcctccaggaggatcgctctcattcaggtcccagctctctaccagaggcccctctgaaaccaccgggacccttagttccaccagaccaacaggataaggttcaatgtgccgaagtaaacagggcgagcaccgagggagagtcacccgacggtcctggtcaagggggattatgtcagaacgggcctaccccccctttcccggatcctccgtcttcactagatccaaccacaagccccgttggcccagatgctagcccgggagtcgccggattccacgacaatctgcggaagtcgcagggcacatcagcggagggtagcgtcagaaaggaggctctgcaatctttgcgactctcacttcccatgcaagagacccagctgtgcagcaccgatagccctctgcccctggaaaaagaagagcaagttcgcctgcaggccagaaagtggctggaggagcaactgaagcagtaccgcgtgaaacgccagcaggagcgtagtagccaacccgcaacgaagacccgcctattttccactctggatccagagttgatgctgaaccccgaaaatctcccacgggcaagcacgttggcaatgactaaggagtactcattcctgaggacatccgtcccacgtggccctaaggtcgggtccctgggccttccggctcatcccagggaaaagaagacttctaagtcatccaagatacgatcattggccgactatagaactgaagactcaaatgctgggaatagcggcggaaatgtccccgctccggacagcacgaaaggctctctgaaacaaaataggtcctcagctgccagtgttgtgtctgaaatcagcctttccccagacactgacgataggctggaaaacacatccctggccggagatagcgtgtccgaggtagatgggaatgattccgattcctccagctacagttcagcatcaacaagaggcacctatgggatcctgagcaagaccgttggcacgcaggatacaccctacatggtgaacggacaagaaatccccgctgacactcttggacagtttcctagcataaaagacgtcctacaggccgcagcagccgaacatcaggatcaggggcaggaggtcaatggggaagtgcgttcgagacgtgacagcatttgttcttcggtttcacttgagtcaagcgctgccgaaacgcaagaggaaatgctgcaggtgcttaaggaaaaaatgcggcttgaagggcagctcgaggcactttccctcgaagcatcacaggcactaaaagagaaggccgaactgcaggcgcagctagcggctctgtctactaaattacaggcacaggtggaatgcagccattctagtcaacagcggcaagacagtctttcttccgaggtcgacaccctgaagcaatcctgctgggacctggagcgcgcaatgactgatcttcagaacatgctggaggcgaagaatgcctccttagcctcctcaaacaacgatctccaagtggccgaggagcagtatcagagattaatggctaaagtggaagatatgcagcgctccatgctctccaaggataacaccgtccacgatcttcgacagcagatgacagcactgcaatcccaactgcagcaagtgcagctcgagcgcacaacactgacctcaaagctcaaagcgtcccaagctgagatcagctccctccagagtgttcgccagtggtatcagcaacaattggcattagcgcaggaggcacgggtgcggttacagggggaaatggcccacatccaggtgggccaaatgactcaggccggattgctggaacatctgaaattggaaaatgtgagcttgagccagcagttgaccgagacccagcaccgctcaatgaaagagaaaggtagaatcgccgctcagcttcaggggatcgaggcagacatgttagatcaagaagccgctttcatgcaaattcaggaagcaaaaactatggttgaggaagacttgcaacggcgtctggaggaattcgagggcgagcgagagaggctgcagaggatggccgatagcgcggcttctctcgaacagcagctggagcaagtcaagcttaccttgctgcagcgagaccagcagctcgaggctcttcaacaggagcacctggacctgatgaagcaactgacacttacacaggaggctcttcaatcaagagaacagtctttggacgctctgcagacccattacgacgagttacaggcgcgtcttggggagctgcaaggtgaggctgcctctcgggaggacaccatctgtttgcttcaaaacgaaaagattatcctggaggctgctttacaagctgctaagagcggaaaggaggaactggacagaggtgccaggaggctagaggagggaacggaggagacatccgaaacattggagaagctgcgagaggagctggcgatcaagtctggccaggtagagcacctgcaacaagaaacagccgctcttaagaaacagatgcagaaaatcaaggaacaatttttacagcagaaggtgatggtggaggcttatcgtagagacgctactagcaaagatcaactcatctccgagctcaaggccacacgcaaaagattggattcagagctgaaagaactgagacaggaacttatgcaggtgcatggcgagaagcgtactgccgaggctgaactgagccgcctccaccgtgaggtagcccaggtaagacaacatatggctgacctggaaggacaccttcaatcagcccagaaagagcgtgatgagatggaaacccatctgcagtcattgcagtttgacaaagagcaaatggtcgccgtgaccgaggccaatgaggcacttaaaaagcagatcgaggaactccagcaggaggcgagaaaggccattaccgagcagaagcagaagatgaggcggttaggatcagatctgacttcagcccaaaaggaaatgaagactaagcataaagcatatgagaacgcagtcggcatcctgagtcggagactgcaggaggcgctggcagccaaggaggcggcagatgccgagctagggcagctgagagcgcaggggggaagttcagattcaagtttggcactacacgaaaggatccaggccctagaggcggagctgcaagctgtctcacatagcaaaactttacttgagaaggaactccaggaggtcatagccctgaccagtcaggagctagaggaatcacgcgagaaagtcctggagcttgaggatgagttgcaagaaagccggggattccgcaagaagattaagagactggaagaatccaataagaaactggcgctcgagctggaacatgagaagggtaagttaacagggctcggccagagcaacgcggctctccgcgaacataactcgatcctggaaacagccctcgccaaaagagaggcagacttggtacagctgaaccttcaggtccaagcagtgctccaaagaaaagaagaggaggacaggcaaatgaagcacctcgttcaggccctgcaagcctcactggagaaggagaaggaaaaggtcaactcattgaaggaacaggtggccgctgccaaggtggaggcagggcataacagacggcacttcaaagctgcctcccttgagctgagtgaggttaaaaaggagctccaagccaaagagcacttggtgcagaagctgcaggcagaggcagatgacctccagattagagaaggcaaacactctcaggagatcgctcagttccaggccgaattggccgaagcacgcgcacagttacagttgctgcagaagcagctcgatgagcagctttccaagcagcccgtgggtaatcaggagatggaaaacctaaaatgggaggtggaccagaaagaaagagagatccaatccctgaagcagcagttggacctcacggaacaacagggaagaaaagagttggaaggccttcagcagctgctgcagaatgtcaagagtgagctggaaatggcccaagaagacctgagcatgacacagaaagataagttcatgttgcaggccaaggtgtctgaattgaagaataacatgaaaacgctcctgcagcagaatcagcaactcaagcttgatctgagaagaggagccgcaaagacaaggaaggagccaaaaggtgaggccagttcgtccaacccagcaacaccaattaagattccggattgccctgtccctgcctcactgctagaggagctgttgcggccacctcccgcagtctctaaggagccactgaaaaacctgaacagttgcttgcagcagctaaagcaggagatggactcgctgcaacgacagatggaagagcacgcactgacagtccacgaatccctgtccagctggactcccctcgaacccgctaccgccagccccgtgccacctggcggacacgccggaccccgtggcgacccccagaggcacagtcagagccgagccagcaaagaaggccctggtgagta

SEQ ID NO: 225147 - DNA, 4173 bp, Artificial Sequence
  Description of Artificial Sequence: Synthetic coding sequence
atggatggagcctccgccgagcaagatgggctacaagaggatcgctcacattccggcccttctagcctgcctgaagcgccactaaaaccgcctggtccccttgtgccccctgaccaacaggataaagttcagtgtgccgaagtgaatcgggcttcaactgagggggaaagccctgatgggccagggcaggggggactttgccaaaatggacctacccccccatttcccgaccccccatctagtcttgaccccacaacctcacccgtgggacctgacgcatctcccggtgtggccggatttcatgataatctcagaaagtctcagggaacgagtgccgaaggcagtgtgcgcaaggaggccctacagtctctgcgtctttcactgcctatgcaggaaacgcagttatgctctactgactcgccgctgcccctggagaaagaagagcaggtcagactgcaggcacggaagtggcttgaggaacaactgaaacagtatcgggtgaaacggcagcaagaacgctcctctcagccagccacaaagacccggcttttctcaactctggatcccgaactcatgctcaatcccgaaaacctgccaagagccagtacactcgctatgacaaaggagtactctttcctaagaaccagcgttccgaggggaccaaaagtcggcagcttggggctacctgcgcatcctcgggagaagaaaacttccaaaagttcgaaaatacgctctctggccgactacaggacagaagatagtaatgcaggcaactccggcggtaacgtccccgctcccgattcaaccaaggggagtctgaagcagaacaggagttccgccgcttccgtagtgtctgagatctccttgtctcccgataccgacgaccggctagagaacactagcttggcaggcgatagcgtgtccgaggttgatggcaacgactccgattcttcttcctacagcagcgcttctacacggggtacatatggtatcctttccaagacagtgggaactcaagatactccgtacatggtgaacggccaggaaatccctgccgacactctggggcagtttccctccatcaaggatgtgctgcaggccgctgccgcagaacatcaggaccagggacaggaggtgaacggagaggtcagatctaggcgagattctatctgtagctcagtaagcctggaatcttcggcagccgaaactcaggaagagatgcttcaagtcctgaaggagaaaatgcgcctggagggccaattggaagccttgtccctagaggcctctcaggccttaaaggagaaggcagaactacaggcccagctggccgcactgagcacaaaattacaggcccaagtcgaatgctcacattcgtcccaacagcgacaagacagcctgagcagcgaggtggacacactgaagcagtcctgctgggatctcgaacgggctatgaccgacctgcagaacatgctggaagccaaaaacgcctccctggccagttctaataacgatctgcaggtagcagaggagcaataccagcgtctgatggccaaagttgaagacatgcagcggtccatgctgagtaaagacaatactgtgcacgacttgcgacagcagatgactgccctgcagtctcaattacaacaagttcagctggagcgtactactctcacaagtaaactgaaagcttcccaggcagagatctcctctttgcaatccgtcagacagtggtaccagcaacagcttgccctcgctcaggaagctcgggttagactccagggcgagatggcacacattcaggttggacagatgactcaggccggtctgctggagcacctgaaactggagaacgtgagtctgtcccagcaactgaccgaaactcaacacagaagtatgaaagaaaagggtcggattgccgctcaactacagggcatcgaggctgatatgttagaccaggaggcggcttttatgcagatccaggaagccaaaacgatggtcgaggaggatctgcagcgcaggctcgaggaatttgaaggagaacgggagcgcctgcaaagaatggccgatagcgccgcttcattggaacagcagttggaacaagtgaaactgacactcctccagcgcgatcagcaactggaagccttgcagcaggagcacctcgacctgatgaagcagttaaccctgacacaagaggccttacaatctagagaacagtctctcgatgccttgcagacccattacgacgagctgcaggccaggttgggcgaactccagggcgaggccgcatctagggaggacaccatttgcctgctccagaacgaaaagatcatccttgaggccgctctgcaggcagccaaatctgggaaagaggagttggatagaggagccaggcggctggaggagggcaccgaggaaacatctgagacattggagaagctgcgggaagagctcgccattaagtcaggccaggtagaacacctccagcaggaaacggcagcactgaaaaagcaaatgcaaaaaatcaaggaacaatttcttcagcaaaaggtgatggttgaggcgtataggagggatgccacttcgaaggaccaattgatcagcgagctcaaagccacaaggaagcggttggactccgagctgaaggagttgagacaggagctcatgcaggttcacggagagaagaggaccgcagaggcagagctgtcgcggttgcaccgagaagttgctcaggtgagacagcatatggccgacctggaaggtcacctccagtcagctcagaaggagcgagatgagatggaaacccatctgcagtcgttacagtttgacaaggagcaaatggttgccgttactgaagctaatgaggccttaaagaagcaaattgaggagctccagcaggaggccagaaaagccattaccgagcagaagcagaagatgcggcgactcggctccgatttgacctccgcccagaaagaaatgaagacaaagcacaaggcttatgagaatgccgtgggcattctgagtaggcggctgcaagaagccctggccgctaaggaagctgctgatgccgaactgggccagctacgggcacagggtggatcaagcgatagtagtctcgcgctccacgaacgaattcaagccctggaggccgagctgcaggccgtgtcccactcaaagactctgctggagaaagagttgcaggaggttatcgcattaacctctcaggaattagaggagagccgggagaaggtgcttgaacttgaggacgagctgcaggagtctcgcggattccgcaagaaaatcaaaaggctggaagagtccaataagaaattggccctcgaactcgaacacgaaaaagggaagcttactgggctcgggcaatctaatgccgcactgagagagcacaattcaatacttgagacggcactggcaaagagagaggccgaccttgtgcagttgaatctgcaggtgcaggcagtgctgcagcgtaaggaagaggaagatcgccaaatgaagcaccttgttcaagccctgcaggcctccctcgaaaaggagaaggaaaaagtgaactcgctgaaggaacaggttgccgctgccaaggtcgaggccggacataatagaaggcactttaaggccgcttccctagaacttagcgaggtgaagaaggaattacaagccaaggagcacttggtgcagaagctccaggctgaagccgatgatctgcagatcagagagggaaagcacagtcaagaaatcgcacaatttcaggctgaactggcagaagctagagcgcagctacagttgttgcagaaacagcttgatgagcagctcagtaaacaacccgttggcaaccaggagatggaaaacctgaagtgggaggttgatcagaaggaacgggagatacaatccctgaaacaacagctagacctgactgaacagcagggacgcaaagaacttgaaggattacaacaactgcttcagaacgtcaagtccgaattagaaatggctcaagaggacttgtcaatgacacagaaggacaaatttatgctgcaggccaaggtctcagagctgaagaacaatatgaaaactttgctgcagcagaatcagcagcttaagctggacctccgcagaggtgcagcgaagactgtactacggccagcaagcctaccgggatag

SEQ ID NO: 225148 - DNA, 3405 bp, Artificial Sequence
  Description of Artificial Sequence: Synthetic coding sequence
atggatggggcatcagcggagcaagatggactgcaggaggatcggagtcactcaggcccatcttctctcccagaagctcctctgaagcctcctggccctctcgtacctccagatcagcaagataaagtacagtgcgccgaagtgaaccgggcttcaacggaaggcgagtcaccggacggacctggccaggggggtctgtgccagaacggcccaacacctccatttcccgatccacctagctcactggacccaaccacatcaccggttggacccgacgccagcccaggcgttgccggtttccacgataacctgcggaagagccagggtacgagcgccgaaggttccgtccgcaaggaggctttgcagagcctgcggttgtctttacctatgcaggaaacccaactttgcagcaccgactcacctctccctctcgagaaggaggagcaggtgcgtctgcaggcgaggaagtggctagaagagcagctcaaacagtatagggtcaagcggcaacaagagcgtagctcgcagcctgctactaaaacccggcttttttccactttggaccccgagctcatgctgaatccagaaaatctgccaagagcttctactctcgccatgactaaggaatatagttttctgagaaccagcgttcccagagggccaaaggtaggcagccttgggctccccgcacaccccagagaaaagaagacaagtaagagttctaagatacggagtctagccgattaccggacggaggatagtaacgcgggaaatagcgggggtaacgtcccggcacctgactcgactaagggctcccttaagcagaatcgcagttcggctgcttcagttgtgagtgagatctccctgagtcccgacacggatgacagattggagaatacaagccttgccggtgactcggtgtctgaggttgatgggaacgactcggactcgtcttcttattctagcgcctcaaccagagggacctacggaatcctcagtaagactgtcgggacacaggacacaccttatatggtgaacggccaggagatcccggctgataccctgggtcaatttccttcgataaaagacgtactacaggcagctgccgctgagcaccaagatcagggccaagaagtgaacggagaggtgcgaagcagaagggactccatttgcagttccgtgagcctcgaatcgtcggccgctgagacacaggaggaaatgttacaagtgctcaaggagaagatgcgacttgagggccagcttgaggcgttgagtcttgaagcctcccaggcccttaaggagaaggccgagctgcaagctcagttggctgctttgagcacaaagctgcaggcacaggtcgagtgttctcattcctcccagcaacgacaggacagtcttagcagcgaagttgacactttaaagcaatcttgctgggatctggagagggccatgactgacttgcagaatatgctcgaggccaagaacgcctccttagccagttctaacaacgatcttcaggttgcagaggaacagtaccagagactcatggccaaggttgaggacatgcaacggtccatgctttcaaaggataacacagtgcacgacctccgtcagcagatgactgccctgcagtcacaactacagcaggtacaactcgaacgcacaacacttacaagcaaactgaaggctagccaggccgaaatctcatcgctgcagtccgtccggcagtggtatcagcaacaactagcccttgcccaagaagccagagtgaggctgcagggagagatggcccatattcaggtgggccaaatgacccaggccggtctgctggaacacctgaagttggaaaacgtgtccctatcccagcaattgactgaaacacagcacagatccatgaaggagaaggggagaattgctgcccagctgcagggtatcgaagctgatatgctcgatcaggaagcggcattcatgcagattcaggaagctaaaaccatggtggaggaagacctgcagcgacggttggaggaatttgagggagaaagggagcggctacagaggatggctgactctgcggcttccctggagcagcaactagagcaggtgaagcttacgttactgcagcgggatcagcaattagaggctctacagcaagagcatctggatctgatgaaacaactcaccctaacccaggaagctttgcaatcccgtgaacaatcactcgatgctctgcagacgcattacgacgagctacaggccagacttggagagcttcagggagaagctgcgagccgggaagacaccatctgccttttgcaaaacgaaaagattatcctggaagctgccttgcaggccgcaaagagcgggaaggaggagctcgacaggggagcccgtcggttagaggaaggcactgaggagacaagcgaaactctagaaaaactgagggaagaattggccataaagagcggacaggtcgagcacttgcagcaggagacagcagcactcaaaaagcaaatgcagaaaatcaaggaacagtttcttcagcaaaaggttatggtagaagcgtacaggcgggacgccacgagcaaggaccagcttattagcgagctaaaggcgaccaggaaaaggttggactccgagctgaaagagctgcggcaggaactgatgcaggtgcatggagaaaagaggacagctgaggccgagttgtcaagacttcatagggaggtggcccaagtccgccaacatatggctgacctggaggggcacctgcagagcgcccagaaagaacgagacgaaatggaaacacacttgcagtcactacagttcgataaagagcagatggtggccgtgacagaggccaacgaggccctgaagaagcaaattgaagaactccaacaggaagcgagaaaagcaattacagaacagaaacaaaagatgcggagactaggctcagatctgacgtctgctcagaaggagatgaagaccaaacacaaagcctatgagaacgccgtcggaattctgagccggaggcttcaggaagcgctggcagctaaagaagcagccgacgccgaactcggtcagcttagggcacaaggcggaagctcagacagctctcttgcgctccatgagcggattcaggccttagaggccgaactccaggctgtctcacactcaaaaactctactggagaaggaactacaggaagtcattgcacttacttcacaggaacttgaggaatcaagggaaaaggttctggaactggaggatgaagtacgcccaggccacctactttggcgccagagaggtgctggccacgtaagtcctgggcatgccgctacgcgggagactcggcgtacgaagctgcaccgcgtacccagcgtggccacctttggggtggccacattctag

SEQ ID NO: 225149 - DNA, 6692 bp, Artificial Sequence
  Description of Artificial Sequence: Synthetic coding sequence
atgtttaagaaacttaagcaaaaaatttccgaggagcaacagcaacttcagcaagccctggcaccagcgcaggcctcctctaacagctccacaccaacgaggatgcgaagccggacatcatctttcaccgaacagctggacgagggaacgcccaatagagagtccggcgatactcagagtttcgcccagaagctccaactgcgcgtgccctctgttgagagtctcttccggtcaccaataaaggaatcgttgttcagaagctctagtaaggagtctcttgtccgaacatcttccagggagtctctgaaccggctggacctggactccagcaccgcaagttttgaccccccttctgatatggatagcgaagccgaggatctggtcggcaattcagatagtctcaataaggagcagctgattcagaggctgagacgcatggagagaagtctgtcttcttaccgcggtaaatacagcgaactagtgactgcctaccagatgctccaaagggagaagaaaaagttgcagggaattctcagtcagagccaggacaagtctctgcgccgtatcgccgagctcagagaggagctgcagatggaccaacaagcgaaaaagcatctgcaagaggaatttgacgcttccctggaggagaaagatcagtacatctcagttcttcaaacccaggtgtccctgctgaagcaaaggctgcggaatggaccaatgaacgttgatgtgctgaaacctctcccacaattggaaccacaggcagaggtcttcactaaggaggaaaatcctgaatctgacggcgagcccgtggttgaggatggaacgagtgtgaagaccctggagaccctccaacagcgggttaaacggcaagagaacctgctgaaacggtgtaaagagactatccaatcccataaggaacagtgcacactgttgaccagcgagaaagaagccctccaggaacagctggacgaaaggttgcaggagcttgaaaagatcaaggaccttcatatggccgaaaaaactaaattgatcacacagttgcgcgacgcaaaaaatctgattgaacagctggagcaagataaaggtatggtcatcgctgaaaccaagcgccagatgcatgaaactctggaaatgaaagaggaggagattgcccaactccgctcacgtatcaagcagatgacgacccagggagaggaactaagggaacagaaggagaaatctgaaagggccgcttttgaggagcttgaaaaagctctgagtactgcccagaaaaccgaggaggccagaagaaagctcaaggctgagatggacgagcagatcaaaactatcgagaagacgtccgaagaagagagaatatccctgcaacaggagctgagccgcgtcaaacaagaagtggtggacgttatgaagaagtctagcgaggagcaaattgccaagcttcagaaactccacgaaaaggagttggcccgtaaagaacaggagctgacgaagaaactccagactcgtgagcgggagttccaggaacagatgaaagttgcccttgaaaagagccagtccgaatatctcaagataagtcaggagaaagaacagcaggagagcctcgcccttgaggagctggaactgcagaagaaggcgattctaacagaatccgagaacaagctgagagacctacagcaagaagccgagacgtatcgcacccgcatcctggaactcgagagcagcctggaaaaatccctgcaggagaacaaaaatcagagcaaagacctcgcagtgcaccttgaggctgagaagaacaaacacaacaaggagattacagtgatggttgaaaagcataaaaccgagctggagtcactgaaacaccaacaggacgccctgtggacagagaagctgcaagtgttgaagcagcagtaccagacagaaatggaaaagctgcgtgagaaatgtgagcaggaaaaggagaccctactgaaagacaaagagataattttccaagcacacattgaggaaatgaacgagaaaacactggaaaagcttgacgttaaacagacagaactcgagagcctgtcctccgagctctccgaagtccttaaagcacggcataaactggaagaagaactgtccgtgctgaaagatcagaccgacaaaatgaagcaggagttagaagctaaaatggatgaacagaagaatcaccaccaacagcaggtggactcaataattaaagagcacgaagtaagcattcagagaaccgaaaaagccctaaaggaccagatcaaccagttggagctgctcctgaaagagagagacaagcacctgaaggaacaccaggcccacgtagagaatttagaggccgacataaagcgaagcgagggagagctgcagcaggctagtgcaaaactggacgtgtttcagtcctatcagagcgcaacccacgagcagaccaaagcatacgaagagcagctagctcagctgcagcagaaactgctcgatcttgagacggaaaggatcctgttaaccaaacaggttgcggaagttgaggcacagaaaaaggacgtgtgtacagagctggacgcccacaagatccaagtgcaggatttgatgcagcagctagaaaaacagaactctgaaatggaacagaaagtcaaatcactgacccaggtttatgagagtaaattagaggatggtaacaaggaacaggagcagacaaaacagattctcgtcgagaaagagaacatgatcctacagatgagggagggacaaaagaaggaaatcgaaatcctgacacaaaaactgtccgccaaggaggacagtatacacatcctcaacgaagaatacgagacaaaatttaaaaaccaggaaaagaagatggagaaggtgaagcaaaaggctaaagagatgcaagagacacttaaaaaaaaacttctggaccaggaggcaaaacttaaaaaggagctggagaacacagccctggagctcagccaaaaggagaaacagttcaatgcaaaaatgctggagatggctcaggcgaattcagccggaatctctgacgccgtgtcccgcctggagactaaccagaaggagcagatcgaatcactgaccgaggtgcaccgacgggaactgaacgacgtgattagcatctgggagaaaaaactgaaccaacaggccgaggaattacaggagatccacgagattcagctgcaggagaaggaacaggaggttgcagaactgaagcagaaaatcctcttgttcggctgcgagaaagaggaaatgaacaaagaaatcacgtggctgaaggaggagggtgtcaaacaagacaccactctcaacgaactccaggagcagctgaagcagaaatccgctcacgtcaactcactagcccaggatgagacaaaactaaaggcccatctcgaaaaactggaggtcgatctcaataaatcattgaaagaaaacacttttttgcaagaacagcttgttgagcttaaaatgctcgcagaggaggacaagcgcaaggttagcgaattaacatcaaaactgaaaactaccgatgaggaattccaatctctcaagtcgtctcacgagaaaagtaataaaagtctggaggacaagagcctggagttcaagaagttaagtgaggaactggcaattcagctggacatttgttgtaaaaaaaccgaagcgcttctggaggctaagactaatgagctgattaatataagtagctctaagactaatgccattctctcccggatcagccactgccagcaccggacaacaaaagtaaaagaagcactgcttattaaaacttgtacagtgtctgagctcgaagcacagctccgccagctgaccgaagagcaaaatactctcaacatttcctttcagcaagccacacaccaattggaagagaaggaaaaccagattaaatcgatgaaagcagatatcgagtcactggtgacagagaaggaggcactgcagaaagaaggcggtaatcaacagcaagccgcatctgagaaagaatcttgcatcacacagctgaagaaagagcttagtgaaaacataaatgcagttacgctgatgaaggaggaactgaaggagaaaaaagtggagattagctcactctctaagcaactgactgatctgaacgttcagcttcagaatagcatctccctcagcgagaaagaggctgctattagcagcctgagaaagcagtatgacgaggagaaatgcgaactgcttgaccaggtccaagatctctccttcaaggtggatacattgtcaaaagagaagatttccgccctggaacaggtggacgattggtccaacaagttctcggaatggaagaagaaagcccagagtcggtttacgcaacaccagaacacagtgaaggaactccagatccaattagagttgaagagtaaagaagcgtatgaaaaagatgagcagattaatttgttgaaggaagagctcgatcaacagaacaaacggttcgattgtcttaagggagagatggaagacgataaatctaagatggagaagaaggaaagtaacctggaaaccgagctgaaatcccagaccgctagaataatggagctggaggaccacatcactcagaaaactatcgaaattgaatctctgaacgaggtcctgaagaattacaatcagcagaaagatatcgagcacaaagagctcgttcagaaacttcagcacttccaggagttgggtgaggaaaaggataacagagtgaaggaggccgaggagaagatcctgacgcttgaaaaccaggtctacagtatgaaagctgagctcgaaaccaagaaaaaagaactggaacatgtaaacttaagtgttaagagtaaggaggaggaactgaaggctctcgaagaccggttggaaagcgaaagtgcagccaagctggctgagctgaaaagaaaggccgagcaaaaaatcgccgcaatcaaaaagcaattactttcacagatggaggaaaaagaggaacagtacaagaaggggacagaatcccacttaagcgaactgaacactaaattgcaagagcgggaacgcgaagtgcatatcctcgaggaaaagctgaagtccgtagagtccagccagtctgaaaccctgattgttccccgatcagcaaagaacgttgccgcatacaccgaacaggaggaagcggactctcaaggatgtgtacaaaagacgtacgaagagaaaatttccgtgctccagcgcaatttgactgagaaggagaagttgctgcaaagagttggacaggagaaggaggagaccgtgtcttcccactttgagatgcgctgccagtaccaggagaggctgattaaactggaacacgctgaagccaaacaacacgaagatcagtcgatgattggacaccttcaggaagaactggaggagaaaaataagaaatacagtctgattgttgcccaacatgtggagaaggagggaggaaaaaacaacatacaagcaaagcagaatctagagaacgttttcgatgacgtgcagaagaccctacaagaaaaagagctgacttgccagatcctggaacagaaaattaaagagctcgatagttgtctggtgaggcaaaaagaagtccatagagttgagatggaagagttaacatctaagtatgagaagctgcaagccctgcagcagatggacggacggaataagcccaccgaacttctggaggaaaatacagaggagaaatcaaagagtcatttagtgcagcccaagttgttgtccaatatggaggcacaacacaacgacttagaatttaagttggcgggagccgaaagagagaaacagaagttgggcaaagaaatcgtgcgcctgcagaaggacctccgtatgcttaggaaagaacatcagcaggagctggaaattctgaagaaagagtacgatcaagagcgcgaagagaaaatcaaacaggagcaggaggacctggagctaaagcacaactccactctcaaacaactcatgagagagttcaatacccaacttgcacagaaagagcaggagctggaaatgactattaaggaaacaatcaacaaggcccaggaggtggaggccgagctgttggagtcccaccaagaggagacgaatcagctcctaaagaagatagctgagaaggacgacgacctgaaaaggacagcaaagagatacgaagagattctcgatgccagggaagaagagatgaccgctaaagttagggacctgcagactcagctggaagagctccagaagaaataccagcagaaattggaacaggaagagaaccctgggaacgacaatgttactatcatggagttgcagacacagctagctcagaagaccaccttaatctccgattctaagctgaaggagcaggaatttcgggaacagattcacaatctggaagatcgcctgaagaagtatgagaaaaatgtttatgccactactgtggggacaccttacaaaggcggaaacctgtaccatacggacgttagcctgtttggagaacctacggaattcgagtacctgcgcaaagtgctgtttgagtacatgatgggccgagagactaagaccatggctaaggttattactacggtcctcaaatttccagatgaccagacacagaagatcttggagcgagaggatgcacggctgatgtttacatccccacgatccggcatatttta

SEQ ID NO: 225150 - DNA, 6731 bp, Artificial Sequence
  Description of Artificial Sequence: Synthetic coding sequence
atgtttaaaaagttaaagcagaaaatttccgaagagcagcagcagttgcagcaagccctggctcccgcacaagctagctctaacagctcgactcctaccaggatgcggtcccgcacatcttccttcaccgagcagctagacgaaggtacacctaaccgagagaatgcctcaactcatgcatctaaaagccctgattccgtgaatggtagcgaaccctcaattccccagtcaggcgatactcaatcatttgcccagaagttacagctgcgagtccctagtgtggagtccctgttcagaagccccattaaggagagtttgtttcggtcttcctcgaaagagtctctcgtgagaacatcctcccgagaatccctaaatcgacttgatctggattcaagtaccgcatccttcgaccccccaagcgacatggattcggaggctgaggatctggtgggtaattctgactctttaaacaaagagcagcttatacagaggctccggagaatggagaggtctctgagtagctacagagggaagtactctgaactggtcaccgcctaccagatgctgcagagagagaagaaaaagttacaggggattttatctcagagccaggacaagtccttaaggagaatagcagaactgagagaggagttgcaaatggatcagcaggcgaaaaagcacctccaggaagagttcgacgcatcgctggaggagaaagatcaatacatatctgtgctacaaacccaggtgtccctcctgaaacagaggctgcggaacgggcctatgaatgttgatgtgctgaaaccgctgccccaactggagccacaggctgaggtcttcaccaaggaggaaaatcctgaaagcgacggtgagccagtcgtagaggatggtacgtctgtcaagactctggaaaccctgcaacagagggtaaaacgtcaggaaaacctccttaaacgctgcaaagagaccatccagtcgcacaaggagcaatgtacgctcctgacgtcagaaaaggaggcactccaggagcaactggatgagcgcctgcaggaattggagaagatcaaagatctacacatggcagagaagacgaagctgatcacccagttaagagacgcaaagaatctgatcgaacagctcgagcaagacaaaggaatggtgatagccgaaactaagaggcagatgcacgaaactctggaaatgaaagaagaagaaatcgcccagctccggtccaggatcaagcagatgacgacacagggcgaggaactcagagagcaaaaggaaaagagtgagagagccgcatttgaggaattagaaaaggctttgtcaactgcccagaaaacggaggaggctagaagaaagctgaaggccgagatggacgagcagataaagacaattgaaaaaaccagcgaagaagaaagaataagtctacagcaggagctgtcacgcgtgaagcaggaggtggtggatgttatgaagaaatcaagtgaggaacagatcgcgaaactccagaagttgcatgagaaggaacttgccagaaaagagcaggagctgactaaaaaactgcagacacgtgagagggaatttcaggagcaaatgaaggtcgccctagagaagagccagtccgaatacctgaaaattagtcaagaaaaagaacagcaggaatctttggctctggaagaactcgaattgcagaaaaaagccattctaactgagagcgaaaataagctccgggatctgcagcaggaagctgagacatatagaacgcgtatcctggagctggagtcctccttggaaaagtcactacaggaaaataagaatcagtctaaggatctggctgtgcatttggaggccgagaaaaataaacacaataaggaaatcaccgtgatggtcgaaaaacataaaactgagctggaatccttgaaacaccaacaagatgctctctggaccgagaaactgcaggtgttgaaacagcagtaccagaccgagatggaaaagttgcgggaaaaatgcgaacaggaaaaagagactcttttgaaagacaaggagattattttccaggcacatatagaagaaatgaatgaaaagacgttggagaagctggacgtgaaacaaaccgagctggagtccctgagcagtgagctgtccgaagtgcttaaagcgaggcacaaactcgaagaagagctgtccgtgttgaaggaccagaccgacaagatgaaacaggagctagaggcgaagatggatgagcagaagaaccaccaccaacagcaggtggatagtatcataaaggaacacgaagtgtcaatccagcggactgagaaggccctcaaggaccagatcaatcaacttgaactgctcttgaaagaaagagataagcaccttaaggagcatcaggcgcatgtggaaaacctggaggcggacataaaacgatccgagggggaactgcaacaggcaagcgctaagctggacgtattccagagctatcaaagcgcaacccacgagcagaccaaggcctacgaagagcagttggcgcagctacagcaaaagctcctcgaccttgagaccgagcgcattctgcttaccaagcaggtcgccgaggttgaagcccagaagaaggacgtgtgcaccgagctcgatgcacacaaaatccaagtccaggatctgatgcagcagcttgagaagcaaaacagcgaaatggaacagaaagtgaaaagccttacccaggtctacgaatctaagctcgaggatggaaacaaggaacaggagcaaacgaaacagattctggtagaaaaggaaaacatgatcctgcagatgcgcgagggacagaagaaagagatcgaaatcctgactcagaagttatccgccaaggaagattccattcacattctcaatgaggagtacgagacaaagttcaagaatcaggagaagaaaatggagaaagttaaacagaaggcgaaagagatgcaggaaaccttgaaaaaaaaactgcttgaccaggaggctaagcttaaaaaggagctggaaaatacagctctggaactgtcccagaaggagaagcagtttaacgccaaaatgcttgagatggcccaggctaatagcgccggtatttcagatgctgtgtctcgactggagacaaaccagaaggagcagatcgagtccttaacagaggtgcatcggagagaactgaacgatgttataagcatctgggaaaagaaactaaaccagcaggctgaggaattgcaggagatccacgaaatccagttgcaggaaaaggagcaagaggtggccgaactaaaacagaaaattctgcttttcgggtgtgagaaagaagaaatgaataaggagataacctggttaaaggaagagggggttaagcaggacactaccctcaacgagctgcaggaacagctaaaacagaagagcgcccacgttaatagcttagcccaagacgagaccaagttgaaagcccacctggaaaagctagaggttgacctgaataaatctctgaaggaaaacacattcctacaggaacagctggtggagctgaagatgttggctgaagaagataagagaaaggtgtctgagctgacctcaaaattaaagacaaccgatgaagaatttcaaagccttaaaagttcccacgagaaatctaataagtccctggaagacaaaagcctcgagttcaagaagctgagcgaggagctggctatccagctcgatatttgctgcaagaagacagaagccctcctggaggccaaaactaacgagctgattaacatctcctccagcaagaccaatgccattctttctcggatctctcactgccagcaccgaacaacaaaggtgaaggaggccctccttattaagacctgtacagtttctgagctggaagcccagttgcgacagctgaccgaggaacaaaacacactaaatatctcattccagcaggcaacacatcagctagaagaaaaggaaaaccagattaagagcatgaaggcagatattgagtcgcttgtgacagaaaaggaggccctgcagaaggagggagggaaccagcagcaggccgctagcgaaaaggaatcttgcataacacagctcaagaaggaactgtcagaaaatataaatgccgtgactctgatgaaagaggagctgaaggagaaaaaagtggagatcagctcgctctccaaacagctgacagacctgaacgtgcaactgcaaaactccattagtctttcggagaaagaggctgcaatctctagtctacggaaacagtatgacgaggagaagtgtgaactgctggaccaggtgcaggacctgtcgtttaaggttgacactctcagtaaggagaagatcagcgctctggagcaagtggacgactggtcaaacaagttctccgagtggaagaagaaagcccagtctcgctttacccagcaccagaacacggtgaaggaattgcagatccagcttgaattgaagagtaaggaggcctatgaaaaggacgaacagatcaatctgctcaaagaggaattagatcagcaaaataaaagattcgattgtctgaaaggggagatggaggacgacaagagcaagatggagaagaaggagagcaatctggaaaccgagctcaagagccaaaccgcaagaattatggagctggaggaccacatcacacagaagaccattgagatcgagtctcttaacgaggtgctcaaaaactacaatcagcagaaagacatcgagcacaaagagttggtccagaagctgcaacactttcaggaactgggggaggaaaaggacaaccgcgtgaaggaagcagaagaaaagatcctcacattggagaaccaagtgtattctatgaaagccgagttagaaacaaagaagaaggagttggaacatgttaacctctccgtgaaatccaaagaggaagaactcaaagccctggaggaccgactcgagtctgagtccgcagctaagctggcagagctcaagcggaaggcagaacaaaagattgctgccataaagaaacagctcttatcccagatggaagagaaggaagagcagtacaagaaaggcactgaaagccatttatcggaactgaacactaaactgcaggaacgcgaacgggaagtgcatattttggaagaaaagctgaaaagtgtggagtccagccaaagcgaaacactcattgtacccagaagcgccaagaacgttgctgcttataccgagcaggaagaagcagacagccagggatgcgtgcagaagacctacgaagagaaaatctccgtgctacaacgcaatcttaccgaaaaggaaaaactgctgcagcgagtcggccaggaaaaagaggagacagtgagcagtcatttcgagatgagatgccagtaccaggaacgactcatcaagttggagcatgcggaggccaagcaacacgaggatcagtccatgataggccatctacaagaagagcttgaagaaaaaaataagaagtatagcttaattgtggctcaacatgtggaaaaggagggagggaagaacaatattcaggcgaagcagaacctcgaaaatgtgttcgacgacgtacagaaaaccctgcaggaaaaggaactgacttgccagatcttggaacagaaaatcaaggagttggatagttgtcttgtacggcagaaggaggtacacagggtggagatggaggaattgacttctaagtacgaaaagctgcaggccctgcagcagatggatggcaggaacaagccaaccgagttacttgaggaaaataccgaggagaagagcaaaagtcatttagtgcagcctaaactgctgtccaacatggaggctcaacacaacgatctcgagttcaaactggcaggggctgagcgggaaaagcagaaacttggaaaagagatagtcagactccagaaggatctaagaatgctgcgcaaagaacaccagcaggagctcgaaattttgaaaaaggagtacgaccaggagcgggaggaaaaaatcaagcaggaacaggaagacctggaactcaaacacaatagcactctcaagcagctaatgcgagagtttaatactcagctggcacagaaggagcaggaactagagatgacaatcaaggagacgattaacaaagcacaggaagtggaggcggagctgctggagagtcatcaagaagaaacaaaccaactgttgaaaaagattgctgagaaggacgacgatcttaaacggaccgccaaacgctacgaggagatccttgacgccagagaagaagagatgaccgcaaaagtgagggaccttcagacacaactggaggagctgcaaaagaaatatcagcagaaactcgagcaggaagagaatcccggaaatgacaatacccaactagcccagaaaacgaccttgatctccgactcaaaactgaaagagcaggagtttcgagagcagattcacaatcttgaggacagactgaagaagtatgaaaagaacgtttatgccactactgttggaacaccctataaaggaggcaatctgtatcacacagacgtgagtcttttcggcgaaccgaccgaattcgaatacctacgaaaggttttgttcgaatacatgatgggcagggagacaaaaactatggcaaaggtcatcactaccgttttgaagttccctgacgatcagacacagaagatcctggagcgcgaggacgccaggctgatgagctggcttcggagttcctccta

SEQ ID NO: 225151 - DNA, 2196 bp, Artificial Sequence
  Description of Artificial Sequence: Synthetic coding sequence
atgtcctggttcgtcgatctcgcaggtaaggccgaggatctgcttaacagagttgaccaaggcgctgcgactgcactgtcgagaaaagataatgcctccaatatttactctaagaatacagactatactgagctgcatcagcaaaataccgacctgatctatcagacaggacctaaatccacctatatctcctcagcagccgacaacattaggaatcaaaaagctactatcttggctggcactgccaatgttaaggtaggatcgcggacccccgtagaagcctcccaccccgttgagaatgcatccgtgcctcgcccaagttcccattttgtacggaggaagaagtctgaacccgacgatgaactcctcttcgacttcctgaacagttctcaaaaggaacccaccggccgtgtcgaaatcaggaaagaaaaaggaaagaccccggttttccagagcagccagacttcttccgttagcagcgtgaaccccagtgtgaccaccatcaaaaccatcgaggagaactcattcggcagccaaactcatgaggccgcaagtaatagcgacagttctcacgagggacaggaagagtccagtaaagagaacgtttcgagtaacgccgcttgcccggaccatacccctactccgaatgatgatggtaagtcacatgagctttctaatctgcgcttagagaaccagcttctacggaacgaagtccaatccctcaatcaggagatggccagcctgttacagaggagcaaggaaacgcaagaagaactcaataaagcgagggccagagtcgaaaagtggaatgcagaccattcaaagtcagatcggatgacccgcggtctgcgggctcaggtagacgatctcaccgaagctgtcgcagctaaggactcccaacttgccgtactgaaagtccgcctgcaagaagcagaccagctgctctcgaccaggacagaggccctggaggccttgcagagtgagaaatctcggatcatgcaggatcagtccgaagggaattctttgcagaaccaggctctgcaaacattccaagaacggctgcacgaggccgatgctactctcaaacgcgagcaggagtcttataaacagatgcagtctgagtttgcggctcggctaaataaagtggaaatggaacggcagaatctggccgaggctatcactttggctgagagaaagtatagcgatgagaaaaaacgcgtggatgagctgcagcagcaggtgaaactctacaagttaaatctcgagtcgagcaaacaggagcttattgactataagcagaaggccacgcggatattacaatctaaagaaaagctaatcaattcattaaaagagggcagtggctttgaggggctggactcttctacagcttcgtctatggagcttgaggaacttcgccatgagaaagagatgcagagggaagagattcagaaactcatgggccagatacaccagttgcgaagcgaactacaggacatggaggcacagcaagtgaacgaggcagaatccgcgagggagcagctgcaagatctgcacgaccaaattgcaggccaaaaggccagtaaacaggagctcgagactgagctggaacgcctgaagcaggaatttcactacatcgaagaagacttgtacaggactaagaatacactgcagtcacggattaaggatcgggacgaagagatccagaaacttagaaaccagctgacaaataagacgctgagcaactctagccagtcggaactggaaaaccggctgcaccagctgaccgagacactgatacaaaagcagacaatgctcgagtccttgtcaaccgagaaaaattccctagtctttcagttggagagattagagcagcagatgaactcagcctcagggagttcctccaatggttcttcaatcaatatgtcaggaatagacaatggggaagggacccgtcttaggaatgtcccggttcttttcaatgacactgagacaaatttggctggtatgtacggcaaagtgaggaaggctgcatcttccattgaccagttttccatcaggctaggcatcttcctgcgacgatatcctatcgccagagtgtttgtcataatttatatggcactcctacatctctgggtcatgatcgtgctccttacctacactcccgagatgcatcacgaccagccatacggcaagtag

SEQ ID NO: 225152 - DNA, 2076 bp, Artificial Sequence
  Description of Artificial Sequence: Synthetic coding sequence
atgagctggttcgtcgatctagccggaaaagcggaggaccttttgaatcgcgtggatcagggggcagcaaccgccctgagcaggaaggacaatgcttctaacatctattctaaaaacacggattacactgaactgcaccagcagaataccgatcttatctaccagacgggccctaagtctacttacatatcctcagccgctgataatattaggaatcaaaaagctactatcctagcaggcaccgctaatgtgaaggtggggagcaggacacctgtggaggcaagtcaccctgttgagaatgccagcgtaccacgtcccagctctcatttcgtgcgcaggaagaagtctgaacccgatgacgaactgttgtttgacttcttaaatagctcacagaaggagcctactgggagagtggagatccgcaaagagaaggggaaaacccccgtttttcagtcaagccaaacctcctctgtttcttccgtgaatcctagtgtcacaactatcaaaaccatcgaggagaacagtttcggatcacagacccacgaggctgcttccaactctgatagctctcacgaagggcaggaggagtcctcaaaagagaacgtgtcgtcaaatgctgcctgtcccgaccatacaccgacacccaacgatgatggcaaaagccatgagttgtcaaatctaagactggagaaccagctcttaagaaatgaagtccaatccttgaaccaagaaatggcatctctgctgcagcgcagcaaagaaactcaggaagagcttaataaagcacgagcgcgagtggaaaagtggaacgcggaccactccaagagcgatcgtatgacacgagggttaagagcccaggtcgatgatctaacagaggccgtagccgctaaggatagtcaactggctgtcctgaaagtgcggctgcaagaggccgatcaactgctcagtacccggacagaagccctcgaggccctgcagtccgagaagagcaggatcatgcaagatcagtccgagggaaattcacttcaaaaccaggccttgcagacttttcaagaacggctccatgaggccgacgccacgctgaagcgagaacaggaaagctataagcagatgcagtccgaattcgccgctcgccttaacaaagtggagatggagcgccagaaccttgctgaagctatcaccttggccgaaagaaagtattcggatgagaagaagagggtggacgaactccagcagcaagtcaagttgtacaagctaaatctggagagtagcaagcaagagttgatcgactacaagcagaaggctactcgcatcctgcaatctaaggagaagctgattaacagtttgaaagagggatctggcttcgaaggactcgatagcagtaccgcgagctccatggaactcgaggaacttcgccacgagaaggagatgcagcgagaagagatacagaagctgatgggccaaattcaccagctccgtagcgaacttcaggacatggaagcacagcaggtgaacgaggctgagagcgctagagaacagctgcaggaccttcatgaccagattgcaggccagaaggcaagcaagcaggagctcgagaccgagcttgagcggctgaagcaggagtttcattacatcgaggaagacctgtataggacaaaaaacactttacagagtcgaattaaggacagggacgaggagatccagaagttaaggaaccagttaacaaacaagacccttagcaattcctcacaatctgagctggaaaatcgtctgcatcagctcaccgagacgcttatccagaagcagacaatgctcgagagcctctccacagagaaaaattcattagtgttccagttagaacgtttggaacagcagatgaacagcgctagcggctcaagctccaatgggagttcaatcaacatgtctggcatcgataatggagaaggcacaaggctccggaatgtacccgtactgtttaatgatactgaaactaatctggccggaatgtacgggaaggttcggaaggcagcaagttccatagaccagttcagactgtgctttacatcaggaagctag

SEQ ID NO: 225153 - DNA, 1923 bp, Artificial Sequence
  Description of Artificial Sequence: Synthetic coding sequence
atgagctggttcgttgatcttgctggaaaggcggaagacctgctgaacagggtcgatcaaggcgctgcaaccgcattgtcaagaaaggacaatgcttcaaacatatattcaaagaacacagactacacagagctccatcagcaaaatacagaccttatctaccagacaggacctaagtctacctatatcagctctgctgctgataatattcggaaccagaaggccaccatcaaaactattgaagaaaatagcttcggcagccagacgcacgaagccgcatccaacagtgattcaagccacgagggccaggaggagtcatcgaaggaaaatgtgtccagtaacgctgcctgccctgaccacactcctactccgaatgatgacggcaaaagccatgaactgtctaatttaaggctagagaaccagctattgcgaaacgaagttcagagtcttaaccaggaaatggcatcccttttacagcgcagtaaggagacccaggaggaactgaacaaggcacgtgctagggtcgagaaatggaacgctgaccactctaaatcagatagaatgacacgcggtttgcgcgcacaggtagacgacttgacggaggcagtggcggctaaggactcccagctagccgttctaaaagtaaggctccaagaggctgaccagttgttaagtactaggactgaagcgctggaagcacttcagagtgaaaagtcacggataatgcaagatcaatccgaaggaaattcgctacagaatcaggccttgcagacctttcaggaacgattgcatgaagctgacgccaccctgaaaagagagcaggagtcgtataagcagatgcagtcagagttcgcggcacgcctgaacaaggtggagatggaaaggcagaacctggccgaggcaattacactcgccgagaggaagtacagcgacgaaaaaaagcgcgttgatgaactacagcaacaggtgaaactgtacaagctcaacctagagtcctcaaagcaggagttaatcgattataagcagaaggccaccaggattctccagagcaaggaaaagctcatcaatagtttaaaggaaggttcaggcttcgaaggtcttgactctagtactgccagcagcatggagctggaagaacttaggcatgagaaggagatgcagcgcgaggagatccaaaagctgatggggcagatccaccagctgagaagtgagctccaagatatggaagcccaacaggttaacgaagctgagagcgcccgagagcaactgcaggacctacatgaccagattgcaggccaaaaagcatctaaacaggagctggagaccgagctggagcggttgaagcaggagttccattatatcgaagaggacctgtaccgcaccaaaaatactctccagagccgtattaaagatagagatgaggagatacagaagctacgcaatcagctgactaacaagaccttgtccaatagctctcaaagcgagttggaaaacaggctgcaccagctgactgaaactctgatccaaaaacagactatgctcgagagtctgagtaccgagaagaactcacttgtgtttcaattagagaggctggaacagcaaatgaacagtgctagtggatcctcttcaaacggatccagtattaacatgagcggcatagataatggagaaggtactcgacttaggaacgtccccgtgttgttcaacgatactgaaacaaacctggctggcatgtacggcaaagtccgcaaggcggcttcatcaattgatcagttttccatcaggctggggatcttccttcggcgttacccgattgcccgtgtatttgtgataatttatatggccctgctacatctgtgggtgatgatagtactgcttacctacacgcccgagatgcaccacgaccagccatacggtaagtag

SEQ ID NO: 225154 - DNA, 504 bp, Artificial Sequence
  Description of Artificial Sequence: Synthetic coding sequence
atggccacggaagttcataacttacaagaacttcgaaggtctgcctctttagcgacaaaggtgtttattcaacgggactattctgatggtacaatatgtcagtttcagacaaagtttccaccagagctggactcccgaatcgaacgccagcttttcgaggagacggtcaaaaccctgaacggattctacgccgaggcagagaaaataggcggtagctcatatctcgaaggttgtcttgcttgtgccacagcctatttcatattcctatgcatggagactcactacgagaaagtcctgaagaaaatttcccgttacatacaggagcagaacgaaaaaatatttgcaccacgcggactgctattgactgatccagtcgaaaggggtatgcgtgtgattgagatttcaatttacgaagaccgctgcagcagcggatcttcctcctctggaagctcaagtgggtctggctcttcctctggcggtggcggaggagcgggagcgcgatag

SEQ ID NO: 225155 - DNA, 1812 bp, Artificial Sequence
  Description of Artificial Sequence: Synthetic coding sequence
atggctgaggaaaccggccaaagtaaactggcggctgccaagaaaaagtttaaagagtattggcagagaaatcgcccaggtgtccctgctgctgctaagcggaatacgaaggctaacgggagctcccctgaaactgctgcatccggagggtgtcactcctcagaggccagcagctccgccagctcttcacttcacgctcgccagtctccctgccaggagcaggcagcggtcctgaactctcgctcaataaagatcagccgacttaacgatacaattaaatccctcaagcaacagaagaaacaggtggaacaccaactcgaagaggagaagaaagcaaataacgagaaacaaaaagcagaaagggaattggaaggccaaatacaacgcctcaacaccgaaaagaaaaagctgaacacagacctctatcacatgaaacactctctccgctatttcgaagaggaaagtaaagatctcgctgggaggctgcagcgaagcagtcagcggatcggagaattggaatggtctctgtgtgccgtcgcagctacgcagaagaagaagcccgatgggttctcctctcgcagcaaagccttgctgaagcgacagcttgaacagtccattcgagagcagattctgctgaaaggacacgtcacacagctgaaagaatcactgaaggaagtgcagctggaacgtgaccagtatgccgaacagattaagggcgagcgagcgcagtggcagcagcgaatgcggaaaatgtcccaagaggtttgcaccttaaaagaggaaaagaagcacgatactcatagagtggaagaactggagcggagcctctcgaggctgaaaaaccagatggccgagccattacctccggatgccccagcagtatctagcgaagtggaactgcaggatctcaggaaggagctggaaagagtggccggagaacttcaagctcaggtggaaaataaccagtgtataagccttctgaacagggggcagaaagaacgacttagagaacaggaagaaaggctgcaggagcaacaggagcgcttgagagagagagaaaagaggctgcaacaattggctgagccgcagtctgatctggaggagctcaaacacgagaacaaatcagccctacagcttgaacagcaggtgaaggagctgcaggaaaagttaggtcaggttatggaaaccctgaccagcgcagagaaagaacccgaagcggctgtcccagcaagcggtacaggtggcgagtctagcggactcatggacctgttggaggagaaagccgacttgagagagcacgtggagaaactggaactgggttttattcagtacagacgtgagcgttgccatcagaaggttcaccggctgctgaccgagccaggcgactcagctaaggatgcttcaccaggaggcggacaccaccaagccggtcccggacagggtggcgaggagggcgaagcagccggagctgccggtgatggcgttgccgcatgcggaagctacagtgagggccatgggaagtttctggcggcagctcggaatccagctgcagagccatctccaggtgccccagccccacaagaactgggcgctgcagacaagcatggggacctgtgtgaggcatcacttaccaacagcgtcgaacccgctcaaggagaggccagggaggggtccagtcaggataatccgaccgctcagcccgtgcttcagcttttgggcgaaatgcaggatcatcaggagcatcccggtctgggcagcaactgttgcgtgccttgcttttgctgggcctggctcccgagaagaaggcggtag

SEQ ID NO: 225156 - DNA, 1485 bp, Artificial Sequence
  Description of Artificial Sequence: Synthetic coding sequence
gagaagaaggctaacaacgagaaacagaaggctgagcgggagcttgaaggccaaattcagcgcttaaacaccgagaagaaaaagctgaataccgacctgtatcatatgaagcactcgctccggtactttgaagaagagagtaaggacttggcgggacgcctgcagagatcctcacagagaatcggtgaattagagtggagcctatgtgctgtggcagccactcagaagaaaaaaccagatgggtttagttcccggagtaaagcgttgctgaagcggcagttagaacaatcaattcgagagcaaatcctcctaaagggtcacgtgacacagctgaaagagagccttaaggaagttcagcttgagagagaccaatatgccgagcaaattaagggagagagggcccaatggcagcagcgcatgaggaagatgagccaggaggtgtgcaccctcaaagaagaaaagaagcacgacactcacagagtcgaagagttggagcgatctctgagcaggctgaaaaaccagatggctgagcctctacctcctgatgctcccgcagttagctcagaggtggagctgcaggacttgcgtaaggaactggaaagagtggccggtgaactgcaagctcaagtggagaataatcagtgcatttcccttctgaaccgcggacagaaggagagactaagagaacaggaagagaggctccaagagcaacaagagcggttaagggaacgggagaagaggctgcagcaactggccgaacctcaatccgatttggaggaactgcatgagaacaagagcgccttgcagctggagcagcaggtcaaagagttacaggagaaactgggacaggtgatggagaccctgacctccgccgaaaaggagcctgaggcggctgtgcctgcaagcggcaccggcggagagagctccggtctgatggacctgctggaggaaaaggccgacctgagggaacacgtcgagaagcttgagctgggcttcatacagtacagacgagagagatgtcaccagaaagtccaccgactactcacagaacccggagacagcgccaaagacgccagccccggaggtggccatcaccaggcaggaccaggacaggggggtgaggaaggagaggcagccggtgccgctggcgatggggtggcagcatgcgggtcttactctgaggggcacgggaagtttctggctgctgctaggaatcccgcagcagaaccgagccccggagctcccgctcctcaggaattaggcgcagccgacaagcacggagatctgtgtgaagcatccctgaccaactccgtcgagccagcccagggcgaggctagagaggggtcgagccaggacaaccctactgcgcagccagtgctgcagctcctgggagaaatgcaagatcaccaagaacatcccggtttgggatcgaactgctgtgttccatgcttttgttgggcttggctccctaggcggcgaagatag

SEQ ID NO: 225157 - DNA, 1812 bp, Artificial Sequence
  Description of Artificial Sequence: Synthetic coding sequence
atggccgaagagacaggacagagcaagctcgccgctgcgaagaagaaattcaaggagtattggcagaggaacaggcccggtgtgcccgctgctgccaaaagaaacactaaagcaaatgggtcctcgcctgagacagcggcaagcggcggatgccactcctcagaagcaagttctagtgcttcatcttccttgcacgctaggcaatccccctgccaggaacaggccgctgttctgaactcgcggtcaattaagatcagcaggctcaatgataccattaagagtctcaaacagcaaaagaagcaggttgagcatcagctcgaagaagagaaaaaggccaataatgaaaagcagaaggccgagcgcgagctggagggccagatccaacgcctcaataccgagaagaagaagctgaacaccgatctctatcacatgaaacactcgctgcgttactttgaagaagagtcaaaagacttggctggacgtctgcagcgttcttctcagcgcataggcgagctggagtggagtttgtgcgctgtggctgccacacagaaaaagaagcctgacggctttagctctcgcagcaaggctctcctgaaacgtcagctggaacagagtattagggaacagattctgcttaaagggcatgttacgcagctgaaagaaagcctcaaggaagttcagttagaacgggatcagtacgccgagcagattaagggcgagagagctcagtggcagcagcgcatgcgaaagatgagccaggaagtttgtactctgaaagaagagaaaaaacatgacacacaccgggttgaggagctggaaaggagcttgagcagactgaaaaatcagatggctgagccacttcctcctgatgccccagcagtgtccagtgaggtagagttgcaagacctgcgaaaagaattggaaagagtggccggtgaattacaggctcaggtcgagaacaaccagtgcattagcttgcttaatcgcggacagaaggagcgtctccgggagcaggaagagagactgcaagagcaacaggaacggctccgtgagcgtgagaagcgtctgcaacagctggccgaacctcagtccgacctggaagagctcaaacatgaaaacaagagcgcgctgcagctggaacaacaggtgaaggagttacaggaaaagcttggccaggtcatggaaacgctgacctcagcagagaaggaacccgaggctgcagtcccagcgtctgggactggcggagagtcctcaggtctgatggatcttctggaggaaaaggccgatctgcgggagcatgttgagaagttggagcttggctttattcaataccggagagaacggtgtcatcagaaagtgcacaggctgctgaccgaaccaggagactccgcaaaagacgcatcgccgggtggcggacaccatcaggctggccctggtcagggcggagaggaaggagaggccgcaggtgctgccggtgacggcgtcgcggcatgtggatcatattccgaggggcatggtaaattcctggcagccgcaaggaatcctgccgcagaaccatcccccggtgccccagcccctcaagaattgggggctgcagataagcatggagatctctgcgaggccagcctcactaacagcgtggagcccgctcaaggggaagctcgagagggcagctctcaagacaatcccacagctcagcctgtgctacagctgctcggcgagatgcaggaccaccaggagcatccaggcctggggtccaactgctgcgtgccgtgtttttgttgggcgtggctgccccgacgacggagatag

SEQ ID NO: 225158 - DNA, 1902 bp, Artificial Sequence
  Description of Artificial Sequence: Synthetic coding sequence
atgctgccagtcgatggagaagagcgcaaatcagaaggctccgacacggagggggaccgcactagtccttgcgccggtcccacctcttccgcaaccctaaaggacctagaggtgggtgggtccggctggcgctgttccgaccccgcaggccagccgagcaacctgttgccccagcgcggattgggagccccactacctgctgaaacagcacatacccagccaagccctaacgatcggagcttgtatttgtcccccaagtcttctagcgctagtagtagcttgcatgcacgccaaagtccttgtcaggagcaggccgctgttctcaatagcagaagtattaaaatcagccgactcaacgataccattaagtccctcaaacaacagaagaagcaggtagaacaccagttagaggaagaaaagaaggccaacaacgagaaacagaaggctgagcgagagcttgaaggacagatccaacgactgaataccgagaagaagaagcttaacacggatttgtatcacatgaagcactccctgcgctatttcgaggaggaaagtaaagatttagccggaaggctgcaaaggtcctcacagagaatcggggagctggagtggagcctctgcgctgtggctgctacacagaagaagaagccggacggattcagcagtcgaagtaaagctctcctgaaacgacaattggagcaatcaatcagggagcagatcctcctgaaagggcatgtaacgcagttgaaagaaagtctaaaagaagtgcaacttgagagggaccagtatgctgagcagattaaaggagagagagcccagtggcagcagaggatgcgcaagatgtcacaggaggtttgtacgctgaaggaagaaaaaaagcatgacactcaccgcgttgaggagttggagcgtagtttatctcgcctgaaaaatcagatggctgaaccactgcctccagacgcccctgccgtctcttcggaggtggagctgcaggatctccgaaaagaactggagagggtggccggagagctccaggcccaggtggagaataatcaatgtatttccctgctaaaccggggacagaaggagagactgcgtgagcaggaggagaggctgcaggaacaacaggagaggctgcgagagcgcgagaaacgcctgcaacagctggcggaaccccagagcgatctcgaggaactgaaacatgaaaacaaatctgcccttcagttggagcagcaggttaaggagctgcaggaaaagctggggcaagtcatggagaccctgacctctgcagaaaaggagccggaagccgcagtcccagcctctgggactggcggtgaatcttcgggactgatggacttgctcgaggagaaggcagaccttcgagagcatgtggagaaactggaattgggctttattcagtacaggcgggaacggtgccaccaaaaagtgcacaggctactgacagagcccggagacagcgccaaggacgctagccctgggggaggccaccatcaggctggtcctggccaagggggtgaggagggagaggcggcaggcgctgctggcgatggcgtggccgcttgtgggtcctatagtgagggtcatggaaagtttcttgccgctgctaggaacccagccgctgaacccagtcctggcgcaccagccccacaggaactgggagccgcagacaagcacggcgacctgtgcgaagcatcactaaccaattccgttgagcccgctcagggtgaagctcgggagggcagttctcaggataaccccactgcccagcccgttctgcaattgctcggggagatgcaggatcaccaggaacatcctggattggggagtaattgctgcgtcccctgcttttgttgggcttggttgcctaggaggaggagatag

SEQ ID NO: 225159 - DNA, 9779 bp, Artificial Sequence
  Description of Artificial Sequence: Synthetic coding sequence
atgttgtcgcggcttagcggtttagcaaatgtcgtgttacatgagttgtcaggagatgatgatactgaccagaatatgcgagctccgcttgacccggagcttcatcaggagagcgacatggaattcaataacaccacccaggaggatgtccaggagaggctggcatatgctgagcaactcgttgttgagctcaaagatatcatccggcaaaaagacgtacagctccagcagaaagacgaggccttacaggaagaacgaaaagctgctgacaacaaaatcaaaaagttgaagttgcatgcgaaagctaagctgacaagcttaaacaaatacatcgaggagatgaaggcgcagggagggacagttttgcccaccgagccccagtccgaagagcaactttcgaagcacgacaaaagttctacagaagaagagatggagattgaaaagatcaagcacaagctgcaggagaaggaagagttgatcagcaccttacaggctcagctcacccaagcacaagccgaacaacctgctcaaagctccacagagatggaggagttcgtcatgatgaaacaacaactacaggaaaaggaagaattcatttcaacactgcaggcacaactctctcagacccaagccgagcaggctgcacagcaggtcgtaagggaaaaagacgcaagatttgagacacaagttaggctgcacgaggacgagctgcttcagctcgttacccaggctgatgtggaaacagaaatgcaacaaaaactgcgagtgctacagcgcaagttggaagaacacgaggagagcttggtggggagggcgcaggtagtggacctcctgcaacaggagttaaccgccgctgagcagcgcaaccagatcctgtcccagcagttacagcaaatggaagcagagcacaacacccttcggaacaccgtggaaacggagagagaagagtcgaagattctgctggaaaagatggagttggaagtggcagaacggaaactaagttttcacaatctgcaagaggaaatgcaccatctgcttgaacagttcgaacaggccggacaggcccaggctgaacttgagtctcggtatagcgctctcgaacagaaacataaggccgagatggaggaaaaaactagccacattttgagcttgcagaagactggccaggagttacagagcgcctgtgacgccctcaaggaccagaattctaagcttcttcaagataaaaatgaacaggccgtccagtctgcccagaccattcagcagctcgaggatcagcttcagcagaaatctaaagagatctctcagtttcttaatcgtctcccactccagcagcacgagactgcatcgcaaacatcctttcccgacgtgtacaatgaggggacgcaggccgtcaccgaggagaacattgcgtctctgcaaaaacgggtggtcgagctggaaaacgaaaagggggcactgctgctgagcagcattgagctggaggaactcaaagctgaaaacgaaaaactttccagtcagataaccctattggaggcacagaacagaaccggtgaggccgatcgcgaggtgtccgagatatcaatcgtggacatagcaaataaaaggagctcttctgcggaagagagtggacaggacgtcctcgagaatactttcagtcaaaaacacaaggagttgagtgtgcttctcctagagatgaaggaggctcaggaagagatagcctttctgaaactccagttgcagggcaaacgtgctgaggaggccgaccatgaggttctggaccagaaggaaatgaaacaaatggaaggggagggaattgctcctattaagatgaaggtttttctggaggatactggccaagattttcctctgatgcctaatgaagaatcttccctccctgcagtggagaaggagcaagcctccaccgaacatcagagtcgcacatccgaagagatttctctgaatgacgcaggggtcgaactgaaatcaacaaaacaggatggcgacaaaagcctgtctgctgttcctgatattgggcagtgtcaccaggacgagttggaaagactgaagtcccagatcctggaactcgaattgaactttcacaaagcccaagagatctatgaaaagaacctggacgagaaggcaaaagaaatttcgaatctgaaccaactgatcgaagagtttaaaaaaaatgccgacaacaatagttccgcgtttacagctttaagtgaggaacgggatcagctgctctctcaggtgaaggaattatcaatggtgacagagctgcgtgcacaggttaaacaactagagatgaatctagccgaagcagaacggcaacgccgactcgactacgagtctcaaacggcccatgacaacctactgactgaacagattcactccctcagtattgaggcaaagtcaaaagatgtcaagatcgaggtgctgcagaacgaattagatgacgtgcagctccaattcagcgaacagagcaccttgatacggtcccttcagtcccagctacagaacaaagaatccgaagtcctcgagggtgctgaaagggtccggcacatctcttcaaaggttgaagaacttagtcaggcactgagccagaaggagctcgagatcacgaagatggatcagcttctccttgagaaaaagcgagatgtggagaccttacagcagactattgaagagaaggaccagcaggttaccgagatttctttcagcatgacggagaagatggtacagctgaacgaggagaaattttcattaggtgttgagatcaagaccctcaaagagcaactgaacctgctctcccgcgcagaggaggctaagaaagagcaagtggaagaggataacgaggtaagctctggcctgaagcaaaactatgatgaaatgagccctgcaggacaaatttctaaggaagagctgcaacacgaattcgacctgctgaagaaggagaacgaacagcggaagcgaaagctgcaggccgcactgataaatcggaaggaattgctgcagcgtgtcagccggttggaagaggagctcgccaacctgaaggacgagtccaaaaaggaaatcccattgtccgagacagagcgcggtgaagtcgaagaggacaaagagaacaaagagtacagcgaaaagtgtgttacatcaaagtgtcaggagattgagatctacctgaagcagaccatcagtgaaaaggaagtcgaacttcagcatatcagaaaggatcttgaggagaaactggctgcggaagaacagttccaagcactggtgaagcagatgaatcagaccttgcaggataagactaaccagatcgaccttctccaggccgagatttcagaaaaccaggccatcatacagaagttaatcaccagcaacactgatgcgtccgacggtgatagtgttgctcttgtaaaagagaccgtggttatcagtcccccttgcactggcagttcagagcactggaagcccgagctggaagaaaagattctagcactggagaaagaaaaggagcaattacaaaagaagcttcaggaagccctgactagcaggaaagcaatcctgaaaaaggcccaagaaaaggaaaggcatctgcgggaagagcttaaacagcaaaaagatgattacaatcggttgcaggaacagtttgacgaacagtcaaaggagaacgagaatataggggaccagctgagacagctgcagattcaagttagggaatccattgacggtaaattgccatctactgatcagcaggagtcttgctcaagcacaccaggcctggaggagccgctgttcaaggctacagaacagcaccacacacagcccgttctggaatccaatctgtgccctgattggcctagccacagtgaagatgcttctgctctacaaggtggcaccagtgtcgcccagatcaaagcccagctgaaagagatcgaggctgaaaaggtcgaactggaactgaaagtgagctccacaacatctgaactcaccaaaaaaagcgaggaggtatttcaactgcaggagcagatcaacaagcaggggctggagatcgaaagcttgaagacagtgtcacatgaggctgaagttcacgcagagtctttacagcagaagctagagtcctcgcaactgcagattgcaggtctcgagcatcttagagagctgcagcccaaactcgatgagttgcagaaactgatcagtaagaaggaagaagacgtctcttacctctccggacagctctcagaaaaggaggcagccttgaccaagattcagaccgaaattatcgagcaggaggatctgatcaaggcactccatactcagctggagatgcaggcaaaagaacacgacgaaaggatcaaacagctgcaggttgagctgtgcgaaatgaagcagaagccagaagagatcggcgaggagtcacgggctaaacaacagatccagaggaaattgcaggcagctcttatatccaggaaagaggcactgaaagaaaataagtctctgcaagaggagctgagcctggccagaggcactatagagcggttgactaagtcactcgctgacgtagagagtcaagtttccgcccagaacaaagaaaaggacacggtcttaggccgtttagctctgttacaagaggagcgtgataagctgatcactgaaatggacaggtcccttctggaaaaccaatcgctctcgagctcgtgtgagtctctgaagctggcactggaagggttgactgaggacaaggaaaagttggttaaagagatagagtcgctcaaaagtagcaagattgccgagtccacagaatggcaggaaaaacacaaggagctgcagaaggaatacgagattctcctgcagagttatgaaaacgtctcgaacgaggccgagcgcattcaacacgtggtcgaagcagtcaggcaagaaaagcaagagctatatggaaaacttcggtcgacggaggcgaacaagaaagaaactgagaagcaactgcaggaagccgagcaggagatggaagagatgaaggagaagatgcggaaatttgcaaagtctaagcagcagaagatcctggaactggaggaggaaaacgacagactgagagctgaggtccaccctgcgggtgatactgctaaggagtgcatggagacactgttgagcagcaacgccagcatgaaggaggagttagaacgggttaagatggagtacgagacactgtccaaaaagtttcagtccctcatgagcgaaaaagactccctctcagaggaggtgcaagatttaaagcaccagatcgagggaaatgtttccaaacaggcaaatctggaagcaactgagaagcacgacaatcagactaatgtcaccgaggaagggactcaatcaataccaggagaaactgaagagcaggattcgctgagtatgagcaccagaccaacatgcagcgaatcggtgcctagcgccaagagcgccaacccggctgtgtccaaggacttcagcagtcacgatgaaataaataattacctgcaacagattgaccagttgaaggagaggattgctggtcttgaggaggaaaaacagaaaaacaaggagttttcccaaactctggaaaacgagaaaaacaccctgctctcccagatctctacgaaggatggggaactcaagatgctgcaggaagaggtaactaagatgaacctactgaatcagcagatccaagaggaactgagtagagtaaccaaactgaaagagaccgccgaagaagagaaagacgatcttgaggagagactcatgaaccagctggcagagcttaacgggtctatcggaaactactgccaagatgtgacggatgcccagatcaagaacgaactcctggagtccgagatgaaaaatctgaaaaaatgtgtctccgaactggaagaggagaaacaacaattggtgaaggaaaagacgaaggttgaaagcgaaatcaggaaggaatacctggaaaaaattcagggggctcagaaagagccgggtaataaaagccatgccaaggaattgcaggagctgctgaaagaaaagcagcaggaagtgaagcaattacagaaagattgcattagataccaagaaaaaatttccgcactggaacggacagtaaaagcgctagaatttgtgcagaccgagtcacagaaggatctggaaataactaaggagaatctggcccaggctgtggaacaccgcaaaaaagcccaggctgagttagcatcattcaaggtcctgctcgacgacacccagagcgaggccgcacgggtccttgcggacaacctgaagcttaagaaggagctccagagcaataaggaatctgtgaagagccagatgaaacaaaaagacgaagatctggagcgcagattggaacaagcagaagaaaaacacctgaaagagaagaagaacatgcaggagaagctggatgctctgagacgggaaaaggtccaccttgaagagacgattggcgaaatccaggtgactttgaataaaaaagacaaggaggtgcaacagctgcaggagaacctggactccactgttacacagctggctgcatttacaaagagcatgtcctctctccaggacgacagagacagggtaatcgatgaggccaagaagtgggagaggaagttctctgatgccattcaatctaaggaagaggagatacgcctcaaggaggacaactgctccgtgcttaaggatcagctcagacagatgagcattcatatggaggagttaaaaatcaacatctccaggctagaacatgataagcagatatgggaatcaaaggctcagactgaggttcagctgcagcagaaagtgtgcgacaccctacagggagagaataaagagctcctgagccagttggaagagactcggcacctgtaccatagcagccagaacgagctggctaaactcgaaagcgaactaaagtcccttaaggaccagctaactgacctcagcaactccctggagaagtgtaaggagcagaaaggtaacctggaaggaattatcagacaacaggaagcagacattcagaattctaaattctcatacgagcaactggaaaccgatttacaggcctctcgcgagctcacttctaggttacatgaagagattaatatgaaagagcagaaaattatttccctcctctctggtaaggaggaggccatacaagtggccatcgccgagttgaggcagcaacatgataaagaaatcaaggagctagaaaacctcctgtctcaagaggaggaggagaatatcgtccttgaagaggagaacaagaaggctgtggataagacaaaccagctaatggaaacactgaagaccattaaaaaggagaatatccagcaaaaggcgcagttagactctttcgttaaaagcatgtcatccctacagaatgaccgcgataggatcgtgggcgattatcaacagttagaggagcgacacctcagcataattctggagaaggatcagttgatacaggaggccgctgccgaaaacaacaagcttaaggaagagattagaggactgcggtcccacatggacgatctgaatagcgagaacgctaaactggatgcggagctgattcagtacagggaggatctgaaccaggtcataacaataaaggattcacaacagaagcaactgctggaggtgcagctgcagcagaacaaggaactggagaataaatatgcgaaactggaggagaagctgaaagagtcggaagaggctaacgaggacctcagaaggagcttcaatgccctccaggaagaaaaacaggacctgtccaaagaaatcgagagccttaaggtgagtatttctcagttgaccaggcaggtgacagccctacaagaagaggggactctaggactttatcacgcccagttgaaagttaaagaggaagaggtgcaccgactcagcgcactcttcagtagctcccagaaaagaatcgcggaactggaagaagaactggtttgcgtccagaaggaggcggcaaaaaaagtcggcgagattgaagataaacttaagaaggagctgaagcacctgcatcacgatgcaggaattatgcgtaatgaaacagaaactgccgaagagagggtagccgagttagccagggacctggtcgagatggagcagaagttgttgatggtgaccaaggaaaataaaggtttgacagcccagatacagtccttcggccgttccatgagcagcctacaaaattccagagaccatgcaaatgaggaactagatgagctgaagcgtaagtacgatgcctcccttaaagaactggctcaactgaaggaacagggattgttgaatagagagagggacgcgttattgtccgagactgcattttctatgaattcaacagaagagaactcacttagccatctagaaaaacttaaccaacagctgctttctaaggacgaacagttactacatctctccagtcagcttgaggacagctacaaccaggtccagagcttctcaaaggccatggcctccctgcagaacgagcgggatcacttatggaacgagctagagaaattccgaaaaagcgaggagggcaagcaaagatctgccgctcaaccaagcaccagcccagccgaggtgcagagccttaagaaagccatgtcatccttacagaatgacagagaccggcttctgaaggagctgaagaaccttcagcagcaatatttgcaaatcaatcaggagatcactgagcttcaccctttgaaagcccagctacaggaatatcaagataaaacaaaggcctttcaaattatgcaggaagagctgcgccaggaaaacttgagttggcaacatgagctccatcagctcaggatggagaaaagcagctgggagatacatgaaagacgtatgaaagaacagtatctcatggctattagcgataaagaccagcagctctcccacctccagaacttaattcgcgagttacggtctagctcaagtcagacccaaccactcaaggtacagtaccagcggcaggctagcccagagacctctgcctctcctgatggcagccagaatctcgtgtatgagaccgagttgttgcgcacacaactcaacgactcactgaaggagatccaccagaaagagctgaggattcagcagctgaacagcaatttcagtcagctcctggaagagaaaaatacattgtcgatccagctgtgtgatacttctcaatctctcagagaaaaccagcagcactacggggacttactcaatcattgcgctgtgctggaaaagcaggtccaggagctgcaagccggacccttgaacatcgacgtggcccctggagccccacaggagaaaaatggcgtgcacaggaaatcagaccccgaggaactgcgggagccacagcaaagcttttcagaggctcagcagcagctgtgcaatacacgccaggaggtcaacgaactaaggaagctgctagaggaagagagagaccagcgcgttgccgcagaaaatgctctgagcgttgctgaagagcaaattaggcggctcgagcactccgaatgggattcttctaggacacccataattggcagttgcggaacacaagagcaggccttactgatcgacctcacctcaaattcctgccggaggactagaagcggagtgggttggaagagggttctgagaagtctgtgtcacagccggacacgggtgcctctcttggctgctatttacttcctgatgatccatgtgctgctgatcctctgctttacaggtcatctcta

SEQ ID NO: 225160 - DNA, 2919 bp, Artificial Sequence
  Description of Artificial Sequence: Synthetic coding sequence
atgaaggcacaggggggtacagtgctgccaacagagccccaaagtgaggaacaactctccaagcatgacaagtctagcacagaagaggaaatggaaatcgagaagataaaacataagctgcaggagaaggaggagctgatctctaccctccaggctcagctgacgcaggcccaggcggagcagcccgctcaaaagctgcgcgtgcttcagcgtaagctggaagagcatgaggagagcctcgttggtcgggctcaggtcgtggatctcctgcagcaggaactgacagcagcagagcaacgtaatcagatcctgtctcagcagctacagcagatggaggcagagcataacactctccggaacaccgtcgagaccgaaagggaggaaagcaagattctactggagaaaatggaactggaggtagccgaaaggaagctgtcgttccacaatctgcaggaagagatgcatcatttactcgagcagtttgaacaagctggccaggcccaagcagagctggaatcacgctacagcgctctcgaacagaaacataaggccgagatggaggaaaagaccagccatatcctgtctctgcagaaaacaggccaagagctccaaagcgcctgcgatgccttgaaagatcagaactctaaactcttgcaggacaaaaatgagcaagctgtgcagagtgcccaaaccattcagcagctggaggatcagctgcagcagaagtccaaggagatttcacagttcttgaaccgcctgccactgcaacagcatgagacagcttcacaaactagcttcccagatgtctacaatgagggcacacaggccgtcaccgaggaaaacattgcgagtctgcagaagagggttgtggagctggagaacgaaaagggagctctgctgctgtcaagtattgagcttgaggagttaaaggctgaaaacgagaaactttcgagtcagatcacacttctggaagcacaaaacaggactggcgaagccgatcgggaagtgagcgaaatttccatcgtggacatcgccaacaagcggagctcatctgcggaagagtctggccaagacgtcctcgaaaataccttttcccagaagcacaaggagctaagcgtcctcctcctggaaatgaaggaggcccaagaagagattgccttcttgaaactgcaacttcagggtaaacgcgctgaagaggcagaccacgaggtgctggaccaaaaagaaatgaaacagatggagggggaggggatagccccaattaagatgaaggtgttcctcgaggacaccggtcaggattttcccctgatgcccaacgaggagtcctcacttccagctgtcgaaaaggaacaggcaagtaccgaacatcagtcacgaactagtgaagagatcagcctgaacgatgctggagtcgagctcaaatcaaccaagcaggacggtgacaagagcttatctgcggtcccagatattgggcagtgccaccaggacgaactagagcgccttaagtcgcagatcctggaactcgaactgaactttcataaagcacaggagatttatgagaaaaacctggatgaaaaagcaaaggaaatctccaacttaaaccagctcatcgaagagtttaaaaagaacgctgacaataacagctctgcttttactgcgttgtccgaggaacgtgaccagttactatctcaggtgaaggagctctctatggtgaccgagcttcgggcacaggtcaaacaactggaaatgaatctcgcagaggcagagaggcagcggcgtcttgattatgagtcgcaaaccgcccatgacaatttacttactgaacagatacattctctttcaatcgaggctaagtcaaaagatgtcaagatcgaagtcctccagaatgagttggatgatgtgcagctccagtttagtgaacagtcaacactgatccggagcctccaaagtcagctccagaacaaggagtcagaggtgcttgagggtgccgaacgtgtgcggcacattagtagcaaagtggaagagttaagccaggccctatctcagaaggagctcgaaattaccaagatggatcagctgttgttagaaaagaaacgggatgttgaaaccttgcagcagactatcgaggagaaggaccaacaggtcacggagatatccttcagcatgacggagaagatggtccagctgaacgaggagaagttttcactgggagtggagatcaagacacttaaggagcaactcaacttgctcagccgtgccgaagaggcaaaaaaggaacaggttgaggaggacaacgaagtcagcagtggactaaagcagaactacgacgagatgtcacctgccggacaaatctcgaaggaggagttacagcatgaatttgacctcttaaaaaaggagaacgagcaaagaaaaagaaagctgcaggccgctcttattaatcgcaaagagttgctccaacgtgtgtcaaggctggaggaggagttggcaaatctcaaggatgagtcaaaaaaagagataccactgtctgaaacggagcggggtgaggttgaagaagacaaagagaataaagaatacagcgagaagtgcgtgacaagtaagtgccaggaaatcgagatttatctgaagcaaaccatttctgagaaagaagtcgagctgcagcatattcggaaggacttggaggagaagcttgcagcggaagaacaattccaagcgctcgtgaagcagatgaatcagaccctccaggacaaaacgaaccagattgatctactgcaggccgagataagcgagaaccaagctattattcagaagctgataacctcaaacacagacgcctctgatggcgacagtgtggccctggtgaaggagactgtggtgattagccctccttgcactggtagctcagagcattggaagccatag

SEQ ID NO: 225161 - DNA, 126 bp, Artificial Sequence
  Description of Artificial Sequence: Synthetic coding sequence
atgctgtcaaggctcagcggcttggcgaatgtcgtgttgcatgagctttcgggagacgacgatactgatcaaaatatgagagcccctcttgatccggaacttcaccaggagtcagacatggagtag

SEQ ID NO: 225162 - DNA, 4923 bp, Artificial Sequence
  Description of Artificial Sequence: Synthetic coding sequence
atgctttcgcgtctgtccggtttagctaatgtcgtgctgcacgaactgtccggcgacgacgacactgaccagaatatgcgggctccgctggatccggagctgcaccaagagtctgacatggaatttaacaataccactcaggaggatgtgcaggagcggcttgcttacgccgagcagctggtcgtagagctgaaggacattatcaggcaaaaagacgttcaactccagcaaaaagacgaagcactacaagaggaaagaaaagcggcagataacaagataaaaaaactgaaactccatgccaaagcaaaactgacctcactcaacaaatatatcgaagagatgaaagcgcagggcggaactgtccttccgactgagccacagtccgaggagcaactgagtaaacacgacaaatcctccaccgaggaggagatggaaatcgagaagataaaacacaagcttcaggaaaaagaagagcttatttccactctgcaggcacaactcactcaggcccaggccgagcagccggcacagtcatcaacagagatggaggagttcgtcatgatgaagcagcagctccaggagaaagaggaattcatcagtactttgcaagcacagctcagccagactcaggcagagcaagcagcccagaagctaagggtcctgcagcgtaaactggaggagcacgaggagagcctagtgggacgagcacaggttgttgatctgcttcagcaggaactgaccgctgctgaacagagaaatcagatcctgtcacagcagctccagcagatggaggcagaacacaacactctgagaaacaccgtggagaccgagcgagaggagtctaaaattctgctggaaaaaatggaattagaggtggccgaaaggaaattatcatttcataatctccaggaggagatgcatcatttgttggagcagtttgagcaggctgggcaggcacaggctgaactggagtcacgttatagcgccttagagcaaaaacataaggcagaaatggaggagaagacgtctcatatcctctctctgcagaaaaccggtcaagagttacagtccgcctgcgatgcattaaaggaccaaaactctaagctgctccaggataagaatgagcaagccgtccaaagtgcccaaactatccagcagctggaggaccagctgcaacagaagtcaaaggaaatatcgcaatttctgaaccgtctacctctacagcagcacgaaaccgcatcccagacgtccttccctgatgtctataacgaagggacacaggctgtgacagaggaaaatatagcttcgctgcagaagagggtcgtcgagctggaaaacgaaaaaggagctctgcttttgagcagtattgagcttgaggaactgaaagccgaaaatgagaaactcagcagccaaataacccttctcgaggcgcagaaccgcactggagaggcagacagggaggtctcagagatctctattgtggacatcgcaaacaaacgaagcagttctgccgaagagtcagggcaggatgtgttggagaatacatttagccagaaacacaaggaattgagcgtgctgttacttgaaatgaaggaagcccaggaagagatcgctttcttgaaacttcagctacagggcaaaagagccgaagaggcagatcacgaagtgttagaccaaaaagaaatgaaacagatggagggcgaaggaatcgctcccattaaaatgaaggtcttcctggaggataccgggcaagacttccccttgatgccaaatgaggagtctagcctcccagccgtggaaaaggagcaagctagcacagagcaccagtctagaacctcagaggagatttccctgaatgacgccggagtggagttgaagtcgacgaagcaggatggagataaatcactgtctgctgttcctgatatcggccaatgccatcaagacgaattagagcgcttgaagagtcagatcctcgagcttgagctgaatttccataaggctcaggaaatttacgagaagaacttggacgaaaaagccaaggaaatctccaaccttaatcagctcatcgaggaatttaagaagaacgccgataataacagctcagcctttactgcactcagtgaagaacgtgatcaactcctcagtcaggttaaggagttaagcatggtgacggaactaagggcccaggtaaagcagctcgagatgaacctggccgaggccgaacgacagaggagactggattacgaatctcagacagcccacgataacctgctcacagagcagatccattctctgagcatcgaggccaaatccaaggacgtcaagatcgaggtgctccagaatgaactagacgacgtgcagctgcagttcagtgagcagagcacactgatcagaagtttgcaatctcaactccagaacaaggaatctgaagttctggaaggcgcagagcgagtgcggcacatatctagtaaagtggaagaactttctcaggcgctgagtcagaaggagcttgaaatcacaaagatggaccagctgctgctggaaaagaaacgggacgtcgagacattacagcaaacaattgaggagaaggatcagcaggtgaccgaaatctcctttagtatgacggagaaaatggtgcagttgaatgaagagaagtttagtctgggtgtggaaatcaaaacactgaaagagcaactgaacttgctgtcccgggctgaggaggccaaaaaagaacaagtggaagaggacaacgaagtatcttccggcctaaaacaaaactatgatgaaatgagcccagcagggcagatatcaaaggaggagcttcagcacgaatttgacctgcttaagaaagagaatgagcagaggaagcgaaaactgcaggccgcactgattaacagaaaggaactactgcagcgggtgtctagattagaagaagagctcgctaatttgaaggacgaaagcaaaaaagagatccccctcagtgaaacagagcggggagaggtggaagaagacaaagaaaataaagagtattctgagaagtgcgtcacctctaaatgccaggagatcgaaatctatctaaagcagaccatcagcgaaaaggaggtggaactgcagcacattcgaaaagatctggaagagaagttggccgctgaagaacagtttcaggctctggtgaaacaaatgaatcagacactgcaggataagaccaatcagattgatcttctgcaggctgagatctcagaaaaccaggccattatccagaagctcatcacttcaaatactgacgccagcgatggcgattctgtagcgttagtgaaagagacagtggtcatctcacccccatgtacaggctccagcgagcattggaagcctgaactggaggaaaagatactggcactcgaaaaggaaaaagagcagctccaaaaaaagctgcaggaagctcttacctcaagaaaggccatacttaagaaagcccaggagaaagagcgtcacctcagggaagaactgaagcagcagaaggacgactacaacaggttacaggagcaatttgacgagcagtctaaggaaaacgaaaacattggagaccagctccggcaattacagattcaggtgcgagaaagcatcgatggcaagctcccttctactgaccagcaggaatcttgcagcagcaccccagggctcgaggagcctctgttcaaagctaccgaacagcatcacacccagccagtgcttgaaagtaacctgtgcccggattggccatcccattctgaggacgccagcgccctgcagggaggaactagcgtcgcacagattaaggctcaactcaaggagattgaagccgaaaaggttgagctcgaactgaaggtctcttcgacaacgtccgagctcactaagaagtccgaggaggtctttcaactgcaggagcagatcaataagcagggcctcgagatcgagtctctcaaaaccgtttcccacgaagccgaagtgcacgccgagagcttacagcagaaattggagagttcacagctccagattgcaggccttgagcatctgcgcgaactccagcccaagctcgacgagctgcagaagctcatttctaagaaggaggaggacgtgtcatacctgtctggacaattgtcggaaaaggaggctgctttaactaagatccagactgagatcattgaacaagaagacttgattaaagctctgcacacccagctcgagatgcaagcaaaggaacatgacgaacgtatcaagcagttgcaggtggagctctgcgagatgaagcagaagccagaagagattggggaggagtcacgtgctaagcagcagattcaacgcaaactccaagccgcactgattagcagaaaggaagcacttaaagaaaacaagagcctgcaggaagagctttcactggcccgaggcacaattgagcgtttaaccaaaagcctcgccgatgtggagagtcaggtgagtgcacagaataaggagaaggataccgtcctgggcaggctggccctcctgcaggaggagagagataagttaataacagagatggacaggtccctgttggagaaccaaagcctgagctcgagttgcgaatctctcaagctggcattggaaggtctgactgaggataaagaaaagcttgttaaggaaatcgagtccctgaagtcctctaagatagccgaaagcactgagtggcaggagaaacataaagagttgcagaaggagtacgagattctgctccagagctacgagaacgtgagcaatgaggccgagcgaatccagcacgttgtggaagcggtacggcaggagaaacaggaattgtatggcaaactgagatctacagaagcaaacaaaaaagaaacagaaaagcagctgcaggaagccgaacaggaaatggaagaaatgaaagagtag

SEQ ID NO: 225163 - DNA, 9809 bp, Artificial Sequence
  Description of Artificial Sequence: Synthetic coding sequence
atgttatcgcgcctgagtggcctggcaaacgtggtgctgcacgaactcagtggcgacgacgataccgaccagaacatgcgggctccactggacccagaactgcaccaagagtcggatatggaattcaataatactacgcaggaggatgttcaagagcgtcttgcttacgccgagcaacttgttgtcgagctaaaagacatcatccgacaaaaggatgttcaactccaacagaaggatgaggcactacaggaagagagaaaagctgccgacaacaagataaagaagctgaaattgcacgcgaaagccaaattgactagcctgaacaaatacatagaggagatgaaggcccagggaggaacagtgttaccaaccgagccacagagcgaggagcagctatctaagcacgataagagcagcacggaagaggagatggaaatcgaaaagataaagcacaaattacaagagaaagaagagctcatcagcactctccaggctcaactgactcaagctcaggcagagcaacctgcgcagtcctccacagagatggaagaattcgtgatgatgaaacagcaactgcaagagaaggaagagtttatttccacacttcaggcccagctgagccaaacgcaggccgagcaggcagcccagctgtcctctatgcagcaggttgtgagggaaaaggatgcaaggttcgagacacaggtccgcctgcacgaggacgagctcttacagttagtcacacaggcggatgttgagactgagatgcagcaaaagctcagagtgctccaaaggaaacttgaagaacacgaggagtcccttgtaggcagagcccaggtggtggatctgctacaacaggagctgacagccgcagaacagaggaaccagattctctcacagcagctgcagcagatggaggcagaacataacaccctaaggaatacagtggagacagaaagggaagagagcaagatattgttggaaaagatggagttagaagtggcagagcgtaagctgtcgttccacaatctgcaggaggaaatgcatcacttgttagagcagtttgaacaggctggtcaggcgcaggccgaattagagtctcgctattccgcccttgagcagaagcacaaggccgagatggaggagaaaacttcacacatcctttccctgcagaagaccggtcaggagctgcagtccgcctgtgatgccctcaaagaccagaactctaagctgctccaggataagaatgagcaagcagtccagtcagcccaaacaatccaacaactcgaagatcagctccagcaaaaatccaaagagatctctcagtttttgaatcgtctgccattacagcaacacgaaactgcgagtcagaccagtttcccggatgtttacaacgagggcacgcaggccgtaacagaagagaacattgcctcactgcagaaacgggtggtcgaactggaaaacgagaaaggcgcactgcttctgtcctccatcgagctcgaggagctgaaagccgagaatgagaagctttccagtcagatcactctgctggaggcccaaaatcgcacgggcgaggctgatagggaggtatctgaaattagcattgttgatattgcaaataagcggtcctcctcagcagaggagagcgggcaagacgtgctggaaaacacgttttctcaaaaacataaggaactgtctgttcttctccttgagatgaaggaggcccaggaagaaattgcttttctgaaattgcagctgcaggggaagagggccgaagaggcagatcacgaggttctggaccagaaggaaatgaaacagatggagggggaagggatcgcccctattaagatgaaagtcttcctggaggacacaggccaggacttccccttaatgcccaatgaagaaagctcgctccccgcagttgagaaagagcaagccagtaccgagcatcaatcacgcacttctgaggaaatctctctgaacgatgcaggtgtggagcttaaatcaaccaagcaggacggcgataaatcactttccgccgtcccagatattgggcaatgccatcaagacgagctggagcgcctcaagagccagatcctagaattggagttaaattttcataaagctcaggaaatttatgagaagaatctcgacgagaaggcgaaggagataagtaacttgaatcagctgatcgaagagttcaaaaagaatgccgataacaactcctcagcgtttacagctctgagcgaagagagggaccagctcttgtcccaggtgaaggagctgtcaatggtgaccgagcttcgcgctcaggtgaagcaattagagatgaaccttgctgaggccgaacgccagagacgccttgactacgagtctcagaccgcccacgataacttgctgacggagcagattcactccctgagtattgaagccaagtctaaggacgttaagatagaggtcttgcaaaacgagctggatgacgtgcagctgcagttttctgaacagagcactctgatccggtccctgcagtctcaactgcagaacaaggagagcgaggtactggagggcgctgagagagtgaggcacattagttccaaagtggaagagttatcccaagccctgtcacagaaggaactggaaatcacaaagatggatcagctgctgctcgagaagaagcgcgacgtggagaccctgcaacagactatcgaagaaaaagatcagcaggtgacagagatctcttttagcatgacagagaaaatggtgcagctgaatgaggaaaagttttcattgggcgtggaaatcaaaaccctaaaagagcagctgaatctcctcagccgggctgaggaggcaaagaaggagcaggtagaagaggacaatgaagtaagctctggtctcaaacagaactatgatgaaatgagcccggctggtcagatctcaaaggaggagctgcagcacgagtttgatctgctgaagaaggagaatgagcagcggaagcggaaactgcaggctgcacttattaacaggaaggagcttctgcagcgagttagccgcttggaggaggagctggcaaatttgaaggatgaatcgaagaaggaaatccccctgagtgaaactgagaggggtgaagtggaggaggataaggagaacaaagaatactcagagaagtgcgttacctcaaagtgtcaggaaatcgagatttacctaaagcagacaatcagcgaaaaggaggttgagttgcagcatatccgaaaggatctggaggagaagttggcggctgaagaacaattccaggctctggtgaagcaaatgaaccagacactgcaggacaagaccaaccagattgatctcctccaggcagagatcagcgagaaccaggcgatcatccagaagctgatcaccagtaataccgacgcctcagacggcgatagcgttgccctcgtcaaggaaacagtcgttatcagcccaccttgcacaggctcatccgagcactggaagcccgagctcgaggagaagatcctggcactcgagaaagaaaaggaacagctgcaaaagaagcttcaggaagctttaacatcccgcaaggcaatacttaaaaaagctcaggaaaaagagaggcacctgagggaggagctaaaacaacagaaggatgactacaatcgcctgcaggaacagttcgatgagcagagcaaagaaaacgagaacattggtgatcagctcaggcaactacaaatccaagttcgagagtctatcgatggtaaactgccgtcaaccgatcagcaagagtcttgctccagtacaccaggattggaagaacctctattcaaagccaccgaacagcaccacactcaacccgttctcgagagcaacttgtgtcctgattggccatctcattcggaagatgcttcggccctgcagggcggaacatcagtggctcaaattaaggcgcagttgaaagaaatagaggctgaaaaggttgaattagagctcaaagtcagcagcacaacaagtgaactgactaaaaagtcagaggaggtatttcagttgcaggagcaaattaacaaacagggacttgagattgagagcctgaagaccgttagtcatgaagccgaggtgcacgctgaatctctgcagcagaagctcgaatcttcacagctccagatcgccggacttgagcatctgcgcgaactgcagcctaaactcgacgaactccagaaattgattagcaaaaaggaggaggacgtttcctatctcagtggacagctttcagaaaaggaggccgcactgaccaaaatccagaccgagatcatcgagcaggaggacctgatcaaagcactacacacgcaattggagatgcaagccaaagaacatgatgaacggattaagcaattacaggtcgaactgtgcgagatgaagcagaaaccggaggagatcggtgaggaatctagggccaagcaacagatccaacggaagctgcaagccgctttgatctcacggaaggaagcactcaaagaaaacaaatccttgcaagaggagctttcattggctagaggaacgatagagaggttgactaaatccctagctgacgtggagagtcaggtgtcagcacagaacaaggaaaaggatacagtcttaggccgtttggccctcctccaagaagagcgggataagttaataacagagatggataggtccttactcgagaatcaaagtttgtcctctagctgtgagagtctgaagctcgctctggaagggctgaccgaggataaagagaaactggttaaggagatagagagtttgaaatctagcaaaatagctgagtcgacggagtggcaggaaaaacacaaggagttgcagaaggagtatgagatactgctccagtcctacgaaaacgtttcaaatgaagcagagagaatccagcacgtcgtcgaggccgtgcggcaggaaaaacaggagctctacggcaaacttcgctcaacagaggccaacaagaaagaaactgaaaagcagctccaagaggccgagcaggagatggaagagatgaaagagaagatgcggaagtttgccaagtcaaagcagcaaaaaattctggaactcgaggaagagaatgatcgcctcagagccgaagtgcatcctgcaggagacactgccaaggagtgcatggaaacactgttgtcctccaacgcaagcatgaaagaggagctggagagggtgaagatggagtacgaaaccctgtcaaagaaattccagtcattaatgtcagagaaagacagtttaagcgaggaggttcaggatttaaaacaccagattgaaggaaacgtgtcaaagcaggccaacctcgaggcgacggagaaacatgacaaccaaaccaatgtgaccgaggaggggactcagtcaattcccggagagacggaggaacaggacagcctgtctatgagtacccggcctacgtgtagcgaatcagtgccatccgctaaatctgctaatcccgctgtgagtaaggacttctcaagccacgacgaaattaacaactacctccagcagatcgatcaactgaaagaacggattgcagggttagaagaggagaaacaaaagaacaaagaattcagtcagaccctggagaacgagaagaatacccttctgagccaaatatccaccaaagatggcgaattaaagatgcttcaggaagaggtcaccaaaatgaatcttctgaaccagcagatccaggaagagctcagtagggtcactaagctgaaagaaactgccgaagaggaaaaagatgatctcgaagagagactaatgaaccagttggccgaacttaacggatcaataggcaattactgtcaggatgtgacggatgcacagattaaaaatgagttactcgagtctgagatgaaaaatctgaaaaaatgtgtgtctgaactcgaagaagaaaagcaacaactggtgaaagaaaagactaaggtggaaagcgaaattagaaaagagtatctcgaaaagattcaaggcgctcagaaagaaccaggcaataaaagtcacgctaaagagctccaggagctgctgaaggaaaagcaacaagaggtgaagcagctgcaaaaggactgtatccgctaccaggaaaagatctcagctctggaacgcaccgtgaaggccctcgaatttgtccagaccgagtcgcagaaggatctggagatcacaaaggagaatctggcacaggccgttgagcacagaaagaaggcacaggccgagctcgccagttttaaagtgctacttgatgacacccagtcggaagccgcaagggttctggctgataaccttaaactgaagaaggagttgcagtctaataaggagagtgtaaagagccagatgaagcagaaagacgaagatttagagaggcgtttggagcaagctgaagaaaaacaccttaaggagaagaaaaacatgcaagagaaactcgatgctctgaggcgggagaaggtgcacctggaggagaccattggggaaatccaggtgacgctgaataagaaggataaggaagtccagcagctgcaggaaaatctcgactcaactgtcacccaactggcggcatttactaaaagtatgtctagcctgcaggacgaccgcgaccgcgtcatcgacgaggctaagaagtgggagaggaagttcagcgacgcaatacagagtaaagaggaagagattagattgaaagaagacaattgttccgtgctaaaggatcagctgcggcagatgagcatccacatggaagagctcaagattaacattagtcggttggagcacgataagcagatatgggagagtaaggcccagaccgaggtccagctgcaacagaaagtctgcgataccctacagggagagaacaaggagttgctgtctcagctagaggagactcggcatctgtaccatagtagccaaaatgagctggcaaaactggaatcagaactcaagtccctgaaagatcagctgactgatctgtcaaactcccttgagaagtgcaaggagcaaaaaggaaatctcgaaggtataatcagacagcaggaggccgatattcagaattctaagttcagttatgagcagctagagacagatcttcaggcttcccgggaactaacttcacggctgcacgaagaaattaatatgaaggagcaaaaaataatctctctgctttctggtaaagaagaggcaatccaggtcgctatcgccgaactcagacagcagcacgacaaggagatcaaggaattggagaacctcttgagtcaggaagaggaagagaatattgtcctggaggaagaaaataaaaaagcagtggataaaacaaaccagctgatggaaacccttaaaaccattaagaaggagaatatacagcagaaagctcagttggactcattcgtcaagtctatgtcatcgctgcagaacgatcgcgaccgcatcgtcggggattaccaacagctggaagaaaggcatctgtccattatactcgagaaggaccagctgatacaggaggccgctgccgagaataacaaactgaaagaggaaattaggggcctccgcagccacatggatgacctgaatagcgagaacgctaaattggatgcagagctgatccagtatcgcgaagatctgaatcaggttatcactatcaaggacagccagcagaagcagctgttggaagtccagctccaacagaataaagagctcgagaacaaatatgccaaactagaagagaaattgaaagagtccgaagaagccaatgaagatttaaggcgtagctttaacgctttgcaggaagaaaagcaggacctatccaaagagatcgaatctctgaaggtgtccatctcccagcttactcgacaggtaactgctctgcaagaagaggggaccctggggctctaccacgcccaactgaaagttaaagaggaggaagtgcacaggctgtccgcgctcttctctagcagtcagaagagaatcgcagaactggaggaagagttagtatgtgtgcagaaggaggctgccaagaaggtcggcgagatcgaagataagctgaagaaggagctcaagcatctgcaccacgacgccggaatcatgaggaacgagaccgagaccgctgaggagagagttgccgagctggcccgagatctggtagagatggagcagaagctgctgatggtgacgaaggagaataaaggactcactgcccaaatacaatcattcggacgcagcatgtcatcattgcagaatagccgggatcacgccaatgaggagttggatgaactgaagagaaagtacgatgcttctttgaaagagctggcccagctcaaggagcagggactcctcaatagagaacgtgatgcactcctatcagagaccgccttcagtatgaatagcacagaggagaattctctaagtcacctagaaaaactgaatcagcaattactgagcaaagatgagcagctgctgcatttgtcaagtcagttggaggattcgtacaatcaagtacaatccttcagcaaggccatggccagtctccagaacgaacgggaccacttgtggaatgaattggagaagtttagaaaaagcgaagaaggaaaacagaggtccgctgcccagcccagcacttcccctgcagaggtgcaaagtcttaagaaggctatgtcttctcttcaaaatgaccgtgacaggcttctgaaagaattaaagaatctccaacaacagtatctacagataaatcaggagataaccgaactgcatccgctcaaagcacagttgcaagaataccaagacaaaacaaaggcctttcagataatgcaggaagagctccgtcaggaaaacctgtcctggcagcatgagctccatcagctgagaatggagaagtcatcttgggagattcatgaacgtaggatgaaggagcaatatctgatggctatcagcgataaagatcagcagttatctcatctccagaatctgatccgggaactgcggtccagcagttcgcagacccagcccttaaaggtacagtatcaaagacaggcttccccagaaacgagtgcctcccccgacgggtcccagaatctcgtctatgaaactgaactcttaaggacccagttgaatgacagtttaaaagaaatccaccagaaagaactgcgcattcaacagctcaattctaattttagccagctcttggaggaaaaaaacacactgtccatccagctatgtgatacctctcaatcccttcgtgaaaatcagcaacactatggagatctgctgaatcactgtgccgtgctcgagaagcaggtacaagagctccaggccgtctctaaggagaaggggccactcaacatagatgtggctccaggggcaccgcaggaaaagaacggcgttcacagaaagagcgaccccgaggagctgcgcgagcctcagcaatccttcagtgaggctcagcagcagctgtgtaacacccgacaagaggtaaacgaacttaggaaactgctcgaagaggagcgtgatcagcgggtggccgcagagaatgccttgtccgttgccgaggagcagattcggagactcgaacattcagagtgggatagctcaagaactccaatcatcgggtcatgcggaactcaggaacaagccctccttattgatctgacttcaaacagttgtagaaggacaagaagtggggtgggttggaagcgagtactacggtccttatgccatagccgcacacgggttcctctgttggcagctatctattttcttatgatccatgttctcctaatactatgcttcaccgggcacctcta

SEQ ID NO: 225164 - DNA, 741 bp, Artificial Sequence
  Description of Artificial Sequence: Synthetic coding sequence
atgtcatgggccgctgtcctggctgtcgcagccgctcgctttgggcacttttgggggtgtaggtggcccggacctatggcacaaggatgggcgggattcagcgaagaagagttgcggagactcaagcagacgaaggacccgtttgaaccccaaaggaggttacctgctaagaaatctcgccagcaactgcagagagaaaaggctcttgtggaacaaagccaaaagctggggctgcaagatgggagtacgtctttactgcctgagcagctactcagtgcaccgaaacagcgggtaaacgtgcagaagcctccattctcgtccccgaccttgcctagccatttcaccttaacctctcctgtcggcgacggccagccacaaggcatagaatcccagcccaaggaactgggtctggaaaattcccatgatggacacaataacgtcgaaatactcccacccaaacccgactgcaagttggagaagaaaaaagtagagctacaggagaagagtcgttgggaggtcctccagcaggaacagcgactgatggaagagaaaaataagcggaagaaggcactattagcaaaggccattgctgagcgctcgaagcggacccaggccgagacgatgaagctgaagcggatccagaaggaacttcaggccctagacgatatggtcagcgctgacattggaatacttagaaatagaattgatcaggccagtctcgattattcttacgctcgatag

SEQ ID NO: 225165 - DNA, 1185 bp, Artificial Sequence
  Description of Artificial Sequence: Synthetic coding sequence
atgtcttgggctgccgtacttgcagttgctgctgctagattcggacatttctggggctgtcgctggcccggacccatggctcaaggttgggctggcttttcagaggaagaactccggcgacttaagcagaccaaggaccctttcgaaccccagagacgtcttcccgcaaaaaaatcccgccagcaacttcaaagggagaaggccctggttgaacagagccagaagttagggttgcaggacggaagcacaagcttgttgccagagcaactcctctccgcacccaagcaaagagtgaacgtgcagaagcctccgttttcgtctccgactctgccttcccactttaccctcacatcccctgtgggcgacgggcaaccacagggcattgagtctcagcccaaagagctgggactggaaaattctcatgacggccataataatgtcgagatcctacccccaaagccggattgtaagctggaaaagaagaaagtggagctacaagagaagagcagatgggaagtgctccagcaagaacagcgactgatggaggagaagaacaagagaaaaaaggctctgctggcgaaagcaatcgccgagcggtccaagagaacccaggccgaaacaatgaaactgaagcgcatccaaaaagagttgcaggccctagatgacatggtgtcagcagatataggtattctgcggaatcgaatagaccaggcgtcactcgactactcatacgcccgaaagagattcgacagagccgaggctgagtacatcgcagcaaagctggacattcagcgtaagactgaaatcaaagagcagctgacggaacacttatgtactattattcagcagaatgaactgcggaaagccaaaaaactcgaagaactgatgcagcagctcgatgtcgaggccgacgaagagacactggaactggaagtggaagtggagagactcctacacgagcaggaagtcgagtctcgcaggcccgtggtgcgtctcgagagaccctttcaacccgcagaagaatcagttactctcgagttcgctaaagagaatagaaagtgtcaggaacaggctgtcagtccaaaagtggacgaccagtgcgggaactctagtagtatcccgttcctgtcaccaaattgtcccaatcaggaagggaacgatatttccgcggcactggccacgtag

SEQ ID NO: 225166 - DNA, 861 bp, Artificial Sequence
  Description of Artificial Sequence: Synthetic coding sequence
  Description of Combined DNA/RNA Molecule: Synthetic coding sequence
atgcctctggatgccacatggaacatcactgtgcagtggttagctgtggacatcgcttgtcggacactgatgtttctgaaacttatggcaacctactccgcagccttcctcccggttgtgattgggttggaccggcaggccgctgtgctcaatcctctcggatcgagaagcggggtccgaaaactgctaggtgctgcttggggcttgtccttcctgctcgcgttccctcaactgttcctcttccacaccgttcacugagccggacccgttccatttactcagtgtgtcaccaaagggtcttttaaggcccagtggcaggagacgacctataatctgttcacattttgctgcctgttcctgttgccgttgacagcaatggccatttgttactccagaatcgtgttgtccgtgagcagaccacagacacggaagggttcgcatgcaccggcaggagagttcgcattacctaggtcattcgataactgcccgcgagtcaggctgcgtgcactgaggctggccctgctcattctcttgacattcattctgtgctggacaccatattacctgctgggaatgtggtattggttcagccccaccatgctgaccgaggtgcccccatcactgagccatatcctcttcctactgggcttattgaatgcccctctcgatcccctcctttacggggctttcaccctggggtgtaggcgtgggcatcaagagcttagcattgattcgtcaaaggaaggttctggccgaatgttgcaagaggaaatacatgccttccggcagctcgaagtccagaagacagtcacaagcagacgcgcaggggagacaaagggaatctccatcacctccatttag

SEQ ID NO: 225167 - DNA, 879 bp, Artificial Sequence
  Description of Artificial Sequence: Synthetic coding sequence
  Description of Combined DNA/RNA Molecule: Synthetic coding sequence
atgtccgctggtaacggtacaccgtgggacgctacttggaacattaccgtgcagtggttggctgtagacatcgcatgtcgaacactgatgtttctgaaactcatggccacctacagcgcagcctttcttccagtggtcatcggcctagatagacaggccgctgtgttgaatccgctgggctcccgttccggagtcagaaaactgctgggcgcagcgtgggggctgagcttcctactggcttttccccaactgttcctttttcacacagtccatugagccggtccagtgccctttacccagtgtgtgacgaaaggttcgttcaaggcccagtggcaggagactacctacaatttattcacattttgttgtctttttcttctgcccttgaccgccatggctatttgctactcccgcatagtcctgagcgtttcccggccacagacccgaaaaggttcccacgccccagcaggggagttcgctctgccgagaagcttcgataactgcccaagagtgcgcctaagggcgctccgcctagcgctgctgatcctcttaacttttatcttgtgttggacaccctattatctcctgggaatgtggtattggttcagccctacaatgctgacggaggtccctcccagcctgtctcatatcctcttcttgctgggcctcttaaacgccccactcgaccccctgctttatggtgcgtttacactgggatgtaggcgtggccaccaggaactgagcatagacagctccaaggaaggttccggtagaatgctgcaggaggagatacatgctttccggcagctggaagtgcagaagacagtgacttcgagacgggcaggggagacaaagggaatttccataacatctatttag

SEQ ID NO: 225168 - DNA, 363 bp, Artificial Sequence
  Description of Artificial Sequence: Synthetic coding sequence
atggctagttccagacggggacttctgcttttgctgcttctgaccgctcacctcggaccatcagaggcacagcactggagtcacggctggtaccccggtggcaagcgcgctttgagcagcgcccaggatccacaaaacgccctcaggcccccagggagggccctggacactgctgctggttctcccgtccaaacagcgcatgggctccctagcgatgcccttgcaccactcgacgattcaatgccttgggaaggccgtaccaccgcccagtggtctcttcatcggaagcgacatctggcacgcaccctgctaacagccgctcgtgagccacggcctgccccaccatcaagcaacaaggtctag

SEQ ID NO: 225169 - DNA, 342 bp, Artificial Sequence
  Description of Artificial Sequence: Synthetic coding sequence
atggcaagtagccggagggggcttttgttgttactgctgctgacagctcacctggggcctagtgaagcacagcattggagtcacggatggtatcctggcggtaagcgtgcactgagtagcgcccaggacccccagaacgcgcttaggccgccagcaggttctccagttcagactgcccacggacttccctccgatgctctcgctccccttgacgactctatgccatgggagggccgtactactgcacaatggtccctgcacaggaaacggcacttagccaggactttgcttaccgccgcaagggagcctcgcccagcccctccctccagtaacaaagtgtag

SEQ ID NO: 225170 - DNA, 339 bp, Artificial Sequence
  Description of Artificial Sequence: Synthetic coding sequence
atggccagttccaggcgcggtcttctgctactccttctcctgacagcccatctcggcccatcagaagcccagcactggagccacgggtggtaccccggaggaaaaagggccttgagctcagctcaggaccctcagaacgccctgcgcccaccaggcagcccagtgcagacggctcatggtctcccctccgacgccttagcccctctggacgattccatgccgtgggagggcagaactaccgcccagtggtcacttcatcgtaaaagacatctcgccaggaccctcctaaccgccgcacgcgaacccagacctgcccctcccagctcgaataaagtctag

SEQ ID NO: 225171 - DNA, 339 bp, Artificial Sequence
  Description of Artificial Sequence: Synthetic coding sequence
atggccagcagcagacgtggcttgctgctactgctgctgttgactgctcatctggggccatctgaggcacagcattggtctcatgggtggtaccctggcggtaaaagagcactgtccagcgctcaagatccccagaacgccctccgcccaccagggtcacctgttcagaccgcgcacggccttccttcagatgctttagcaccattggatgactcaatgccctgggaaggcagaacaactgctcaatggagccttcataggaaacgccatctggcaagaacgcttctaacagccgcacgcgagcctaggccagctcccccatcttcaaataaagtgtag

SEQ ID NO: 225172 - DNA, 342 bp, Artificial Sequence
  Description of Artificial Sequence: Synthetic coding sequence
atggccagctcgaggcggggacttctcctcctgctattactgacagcccatctgggtccatcggaagcacagcactggtcccatggctggtatcccggagggaagagggcgctttccagcgctcaggaccctcaaaacgcgctgcggccacccgcaggaagtccagtgcaaactgcccatggcctcccatcagatgccctggctccgctggatgatagtatgccctgggaaggccgaaccactgcccaatggtctttacaccgcaagaggcacctggccaggaccctgctgaccgcagcgcgagaaccacgtccagcacctccatcaagcaacaaggtgtag

SEQ ID NO: 225173 - DNA, 945 bp, Artificial Sequence
  Description of Artificial Sequence: Synthetic coding sequence
atgtataaaatggaatactcttaccttaattccagcgcttatgagtcttgcatggccggaatggacacgtcctcactggcctctgcatacgcggatttctccagctgctcccaggccagcggctttcaatacaatcctataaggactacgttcggggcaacaagtggatgcccgtcacttaccccaggctcttgctccctggggacactccgagatcaccaatccagtccgtatgccgctgtgccttataaactgttcaccgatcacgggggacttaacgagaagcgcaagcagcgccgtattcgcactacctttaccagtgctcagctgaaagaactggagcgggtgttcgccgaaacccattaccctgacatctatactcgagaggagctggccctgaaaatcgacctgactgaggcccgtgtgcaggtgtggttccaaaacagacgagccaagttcagaaaacaagaaagggccgctgctgctgccgcagccgcagctaagaacggaagctcaggaaagaaatccgactcctctagagatgatgagtctaaggaggccaaatctaccgaccctgattctactgggggtccaggccctaaccctaaccccactccctcctgtggcgcaaatgggggaggaggaggagggcctagtcccgctggagctcccggagcagcagggcctggcggtcctggtggtgaaccagggaaaggaggtgccgctgccgcagccgctgctgccgcagccgcagccgctgctgcagctgctgcagcggctggcggactggctgccgcagggggtcccggacagggttgggccccaggaccagggcctatcaccagcatcccagacagcctgggtggcccatttgcctctgtcctgtctagcctccagcgcccaaatggcgctaaggcggctctggtcaagtcctcaatgttttag

SEQ ID NO: 225174 - DNA, 750 bp, Artificial Sequence
  Description of Artificial Sequence: Synthetic coding sequence
atggccaacagcgcctcacccgaacaaaaccagaaccattgctcagccatcaacaatagcattcccctgatgcagggtaatctccccacacttacactaagtggtaaaatccgagttactgtgactttttttctgtttctcctatcagccacgtttaatgcaagctttctcctgaaactgcaaaagtggacccagaagaaagaaaaaggcaagaagctgtctaggatgaagctgctgcttaaacatttaacactggctaatctgctggagaccttgatcgtcatgccactagacggaatgtggaatatcacagtccaatggtacgctggcgaactcctgtgtaaagtgttgtcctacttaaagttgttctcaatgtacgcccctgccttcatgatggtggttatcagtctcgacaggtctcttgctattaccagaccactagcactcaagtcaaactccaaggtgggtcagtcgatggttggtctcgcctggatccttagtagcgtttttgcgggtccacagttacctctacaccatccgagcttccaccatgccgatctccagtgcaagaatcatctgcaccctgatacaggccctagttcgggcccaccacggacaacgacagaatccgtccaggagcaatatactaagagcacagccgaggacagcaaaaatgacggttgtatctgccacttcatttattgcttgctggattctctgttgtgtccgagaaacctggttctcgtctag

SEQ ID NO: 225175 - DNA, 2055 bp, Artificial Sequence
  Description of Artificial Sequence: Synthetic coding sequence
atggaagaaaatctcattagcatgcgagaggatcactctttccacgttagatatcggatggaggccagttgccttgagctggccctcgagggggagagactatgtaaatcaggcgattgtcgggcaggcgtgtccttctttgaggctgctgtgcaggttgggaccgaagacctcaaaaccctttcagctatttacagccaactgggaaacgcctacttttatctccacgactatgccaaggctcttgaataccatcatcacgatttaactcttgctcggacaatcggcgatcagctgggcgaggccaaagcatcgggcaatcttggaaatacactcaaggttctgggcaactttgatgaggcaatcgtgtgttgtcagaggcatcttgacatctcccgggagctgaatgacaaagtcggtgaggcacgagccctgtacaacctagggaacgtctatcacgcaaaaggtaaatcttttggctgccccggaccccaggatgttggagagttccccgaggaagtccgggacgcactgcaggctgctgtcgacttttacgaagagaatcttagtctcgttacagcgctgggggaccgggcagcgcagggacgagcatttggtaacctgggcaatactcactacttattagggaacttcagggatgcagtgatcgctcatgagcagcggctgctgatcgctaaggaattcggtgacaaggcggcagagcggagagcatatagtaatctgggtaacgcttacatcttcctaggcgagtttgaaaccgcaagtgagtactacaagaaaacgctgctgctcgcgagacagctcaaagatagggccgtggaagctcagagctgctatagcttaggtaatacttacaccctactgcaggactatgaaaaggcgatcgactaccatctgaaacatctggctattgcccaggagcttaacgaccggatcggcgaggggagggcttgctggtctctaggtaacgcctacaccgccttaggcaaccatgaccaggccatgcattttgccgaaaagcatctcgagatttctcgggaggtgggcgacaaatcaggcgagctgacagcaaggcttaatttatccgatctgcagatggtgttgggtctgagctatagtaccaataattctattatgtccgagaacaccgaaatcgattcaagcctcaacggagtgaggcctaaactcggaaggagacactcaatggaaaatatggagttgatgaaactcacacctgaaaaggttcagaactggaattctgaaattctcgccaaacagaaaccattaattgccaagcccagcgcaaagctacttttcgtcaacaggctcaagggcaaaaagtacaaaacgaactcttccactaaagtgctgcaagacgctagcaactccattgatcaccggatcccaaatagtcagcggaagatatctgcagatacaattggggatgaaggtttttttgatttactgagtcggtttcagagcaatcgcatggacgatcagcgttgctgcctgcaagaaaaaaactgccacaccgcatccactactacctcaagcactcccccaaaaatgatgctgaaaacctctagcgtgccagtcgtcagcccaaacactgatgagttcttggatctgctggccagttcccagagtagacgactggatgatcaacgggcatccttctcaaacttgcccggactgcgcctcacacagaacagtcagagtgtattgagccacttaatgactaatgataacaaggaggctgacgaagactttttcgacatattggtgaagtgccaagggtcacgactggacgaccaaaggtgtgcgcctcctccggcaaccaccaaaggccctactgtcccagatgaagacttcttctcgttgattctgagatcccaaggcaagcgcatggacgagcagcgcgttttgctccagagagaccaaaatagggacaccgactttgggctgaaagactttcttcagaacaatgctttgctcgaattcaagaatagtggaaaaaaaagcgcagatcattag

SEQ ID NO: 225176 - DNA, 2055 bp, Artificial Sequence
  Description of Artificial Sequence: Synthetic coding sequence
atggaggagaatctaatctccatgcgggaggaccactccttccatgtgcgatatcgcatggaggcttcctgtctggagttagcactagaaggggaacgcctatgcaaatctggagattgcagagccggagtctccttttttgaggcggctgtgcaggtcggaaccgaagatctaaagactttgtccgctatctatagtcagctggggaatgcatatttctatctacacgactatgctaaggctctggaataccatcaccatgacctgaccctggcgcgtactatcggtgaccagctgggagaagctaaggccagcggcaaccttggcaacacactgaaagtcctgggcaacttcgatgaggccatagtctgttgtcagcggcacctcgatatcagccgagaacttaacgataaagttggggaggcgcgtgcactgtacaacctcgggaatgtctatcatgccaaaggcaaaagtttcggatgtcctggaccgcaggacgtgggggaatttcccgaagaggtgcgagatgcccttcaggccgctgtggacttctacgaagaaaacctgagcctcgtgacagcactgggcgaccgggctgcacaagggagggcattcggtaaccttgggaatacacattacctgctcggaaatttccgggatgctgttattgcgcatgagcagcggctgttgatcgcaaaagagtttggggataaggctgcggaaagacgggcttacagtaatctggggaatgcctatatcttcttgggagaattcgaaaccgcttctgagtattacaaaaagacactcttactcgccagacagctgaaggatcgagccgtcgaagcccagtcatgttattcattgggaaacacatatactttgctccaggactacgaaaaggctatcgactatcaccttaaacacctagccatagcacaggagctcaatgatagaatcggagaaggaagagcttgttggagcctaggcaatgcttacaccgctctcggcaatcacgatcaggcaatgcattttgctgaaaagcatctcgagatttcaagagaagtaggggacaaaagcggagaactgacagctagactcaatctgtccgacttgcaaatggtactggggctatcatacagtacgaataattccatcatgagcgagaacaccgaaattgatagctctctgaatggtgttaggcctaagctgggacgcaggcacagcatggagaacatggagctgatgaaactgacaccagaaaaggtgcagaactggaacagcgaaatcctggccaaacaaaagccactaatcgccaaaccgagcgctaagctgttattcgtcaacaggcttaagggtaagaagtacaagacaaactcttcgacaaaggtcttgcaggacgcctctaactccattgaccataggattcctaacagccagcggaaaatctctgcagatacaatcggagacgaggggttcttcgacctgctgtccaggttccaatccaataggatggacgatcagcggtgctgcttgcaagagaagaattgtcatactgcctcaacaactacgagttctactccccctaagatgatgttgaaaacctccagcgtgccagttgttagcccaaataccgatgaatttctggacctcttggcttcatctcaatccagaagactggatgaccagcgtgcctccttcagcaacctccccggactcagactgacacagaactctcagtctgtcttgtctcatcttatgaccaacgataataaggaggctgacgaggacttctttgacattttggtaaagtgccaggggtctcgactggatgatcagcggtgcgctccccctcccgctaccaccaaaggacccacggtgccggatgaggatttcttcagccttatcttgaggagccagggcaagcgcatggacgagcaaagagtgttgctgcagcgagatcagaaccgcgatacggacttcggcctaaaggattttctgcaaaacaatgccctcctggagtttaagaactctggcaagaaatccgccgaccactag

SEQ ID NO: 225177 - DNA, 228 bp, Artificial Sequence
  Description of Artificial Sequence: Synthetic coding sequence
atggaggagaatttgatctctatgagggaggaccattctttccacgtaagataccggatggaggcgtcatgcttggaactcgcactggagggagaacgtctgtgtaagtccggcgactgtagagcaggcgtgtcgtttttcgaggccgcagttcaggtgggaaccgaagacctgaaaactctgagcgccatctatagccaactcgggaacgcttatttttacctgtag

SEQ ID NO: 225178 - DNA, 642 bp, Artificial Sequence
  Description of Artificial Sequence: Synthetic coding sequence
atggaagagaacttaatcagcatgcgagaggaccactctttccacgtgcggtatcgcatggaagcctcatgcctggaactcgctctggaaggggaaaggctgtgcaagtctggggattgtagagccggtgtgtccttttttgaggctgctgtacaggtgggcacagaggacttgaagactttaagcgctatctactcccagcttgggaacgcctacttttatctgcatgactacgcaaaggccctggagtatcatcaccatgaccttacactagcccgtacaattggggaccaacttggagaagcaaaggcttcgggaaacctgggcaatacactgaaagtactcggaaatttcgacgaggcgatagtatgctgtcagagacatctggatatctcccgcgaacttaatgataaagttggggaagccagggccctttataacctaggaaacgtctaccacgccaagggaaagtcattcggctgtccaggccctcaggacgtcggggaatttcccgaggaggttcgcgatgctctgcaggccgcagtcgacttttacgaggaaaacctgagccttgttaccgccctcggtgatagagcagctcagggtcgagcatttggcaatctgggcaacacgcattattag

SEQ ID NO: 225179 - DNA, 159 bp, Artificial Sequence
  Description of Artificial Sequence: Synthetic coding sequence
atggaagagaacctgatttctatgcgggaggaccactcttttcacgttagatacagaatggaggcatcctgcttagaacttgcactggagggagaaaggctgtgtaagtctggtgactgcagagccggtgtctccttctttgaggcggctgtccaatag

SEQ ID NO: 225180 - DNA, 1290 bp, Artificial Sequence
  Description of Artificial Sequence: Synthetic coding sequence
atggcaagcctctgggagagccctcagcagtgcatcatcctgtcccctctttcaggttggtggttttcaatcggaattagcatcttaacatcatccgcccttgtactgaaacctcaaatgctcaagggggagctgcagacgcgtccatcacagcggccatcgcggaaggcttttaggcggaataatttcgagtatactcttgaagccagtaaatccctgcgacagaagccaggggactcaaccatgacatacctcaataaaggccagttttatccaattactctaaaggaagtttcttcttctgaaggtatccaccatccaattagcaaggtgcgctctgtgatcatggtggtttttgccgaggacaaatcacgagaggatcaactgcgccactggaagtattggcactcccggcaacacactgcaaaacagcgctgcatcgatatcgccgactacaaggagtcctttaacaccatctcaaatatcgaggaaatcgcctacaacgctatttcttttacttgggacataaatgacgaggcaaaagtgttcatttctgttaactgtctcagcactgatttttcatcccagaagggtgtgaagggccttcccctgaatattcaggttgatacctattcctacaacaaccgatctaataagcctgtgcatagggcatactgccagatcaaggtgttctgcgacaagggagccgaacgtaagatccgggatgaggagcgaaagcagagtaagcgcaaggtgtccgatgtgaaggtgcctctgcttccgtctcacaagcggatggatattacggtctttaagccatttatcgatctggatacccagccagtgctgttcatacccgatgtgcattttgcaaaccttcaaagaggcactcatgtgctgcctattgccagcgaggagcttgagggtgagggcagcgtcctgaagagaggaccatatggcactgaggacgatttcgccgttccaccatccactaagttggcaaggattgaagagcccaagcgggtgctcctgtacgtgagaaaagagagcgaagaggtgtttgatgcacttatgcttaaaaccccctctctcaaggggctcatggaggccatttcagataaatatgacgtgccgcatgataagatcgggaaaatctttaaaaagtgtaagaaaggaattctcgtgaatatggacgacaatatcgtaaaacattattctaatgaggataccttccagttgcagatcgaggaggccggtggatcatataagcttacattgaccgaaatctag

SEQ ID NO: 225181 - DNA, 1857 bp, Artificial Sequence
  Description of Artificial Sequence: Synthetic coding sequence
atgacccaagaatatgataataagcgcccagtactcgtcctccaaaatgaggccctctacccccaaagacggagttacacctcagaggacgaggcttggaagtctttcctggagaatcctctgacggccgctactaaggcaatgatgagtataaatggcgacgaagacagtgcagctgctctgggcttactgtatgactactacaaggttccgagggaacgtcgctcctccaccgccaaacctgaagttgagcatcctgagccagatcattccaagcgaaactcgattccaattgtgaccgagcaaccactgatttcggccggtgaaaaccgggtgcaggttttgaagaatgtaccatttaatatcgtgctgccacatgggaatcagctaggaattgataagcgcggacatctgaccgcacctgacaccactgttaccgtgtctatagcgactatgcctactcatagcatcaagacagagacacagcctcacggctttgccgtcgggatcccccctgccgtgtatcatccagaaccgacagaacgggtggtagtgttcgataggaatctgaacacggatcagttttcaagcggcgctcaggcccctaatgcgcaacgtagaacacctgactctactttcagcgagacatttaaggaaggggttcaagaggtcttcttcccatccgatctatcccttagaatgcccggaatgaacagcgaggattacgtgttcgacagtgtgagtggcaataatttcgagtacacactggaggcctctaaatctttgaggcagaaaccaggcgactcaacaatgacctatctaaataagggacaattctatcccataacactgaaagaggtgtcttcctccgagggaatacatcaccccatcagcaaggtacgaagcgtgattatggttgtattcgccgaggacaaaagtcgggaagatcagcttaggcactggaaatattggcacagccgacagcacaccgcaaagcaaaggtgcattgatattgctgattataaagaatctttcaacactatcagcaatatcgaggagatcgcctacaacgctattagctttacttgggacattaatgacgaagccaaagtttttatctctgtgaactgcttgtcaacagacttctccagccaaaaaggggtcaagggcctgccgctgaacatacaagtggacacctatagttacaataatagatccaacaagccagtgcaccgcgcatattgccagatcaaggtgttttgcgacaagggtgccgagagaaagataagggatgaggaacgaaagcagagcaaacgcaaagtcagcgacgtcaaagtgccactgctcccgtctcacaagcgcatggacatcactgtattcaagccgtttatcgacctggacacccaacctgttctcttcatccctgatgtccactttgcgaacttgcaaagaggtactcatgtgctgcctattgctagtgaagagctggaaggtgaagggtctgtgttaaagcgcggaccttatgggaccgaggacgacttcgctgtgccacccagtacaaagctggcccgtatcgaggaacctaagagagtcctgctgtacgtccgtaaggagtccgaagaggttttcgatgccctgatgctgaaaactccttcgctcaagggactaatggaagctatctccgacaaatacgacgtgccgcacgataaaattggcaaaatctttaaaaaatgtaaaaaggggatcctggtgaatatggacgacaatatcgtcaagcattattcgaatgaagacaccttccagctgcagattgaagaagccggaggctcgtacaagttaactctgaccgagatttag

SEQ ID NO: 225182 - DNA, 1857 bp, Artificial Sequence
  Description of Artificial Sequence: Synthetic coding sequence
ctgccaaaggaagtggagaacaagcggccagtcctggtgttgcaaaatgaggcattgtacccacagagacgtagttataccagcgaggacgaggcctggaagtctttcctggagaatccattaactgccgctacaaaagcaatgatgtccatcaacggcgatgaggatagcgcagcagcccttggactgctgtatgactactacaaagtgcctagagaacgcaggagctccacagccaagccggaagtggagcacccagagcctgaccactccaagagaaattctatccccattgtaacggagcagcccctgatttcagccggagagaatagagtacaggtgttgaagaacgttcctttcaatattgtgcttccccacggaaaccagctaggtattgataaaagaggacatttgaccgctcccgacactaccgtgaccgtgagtatcgcaacaatgcccacacacagcatcaaaaccgagactcaaccacatggcttcgcagtgggcatccctcctgcagtgtatcaccccgagcctactgaacgagtggttgtgtttgaccggaaccttaataccgatcaattttcatctggggcacaggccccaaacgcacagaggaggacgcctgactccacgttttccgagacattcaaggagggagtccaggaggtgttttttcccagtgatctgagcctgcggatgcccggaatgaactctgaggactacgtcttcgatagcgttagcggcaacaacttcgaatacacactggaggccagcaaatctctgagacaaaaacccggtgactctacgatgacatatttgaataaaggtcaattctatccgattacgcttaaggaggtgtctagtagcgaaggcattcaccatcccatatcaaaggttcggagtgttatcatggtcgtctttgctgaagacaagtctcgagaggaccagctgcgtcactggaagtactggcactccaggcagcataccgctaaacaaagatgcatcgatatcgcagattacaaggagtccttcaacactatttccaacatagaggagatcgcttacaacgccatatctttcacgtgggacataaacgatgaggccaaggtctttatctcagtgaactgtctgagtacagatttttcatcccagaagggcgttaagggacttcctctgaatattcaggtcgatacgtactcatacaacaaccggagcaataaacctgttcatagggcatactgccagattaaagtgttctgtgacaagggggcagaaaggaaaatacgggacgaggagaggaagcagtcaaagcgtaaggttagtgatgtgaaagtgcctcttttacccagtcacaagcgcatggacatcaccgtcttcaagccatttatcgacctggacacacagcccgttctgtttataccagacgtgcacttcgctaacttacagagggggacacatgtactgcccatcgcatccgaggaactggaaggggagggatcagtgttgaaacgcggaccatacgggaccgaggatgactttgctgttccaccaagtacgaaactcgccagaattgaagaaccaaagcgcgtgcttctgtatgtgcgcaaagaaagtgaggaggtcttcgacgccctgatgctaaaaacccctagtctaaaaggattgatggaggccatcagtgataagtacgacgtcccacatgataaaatcggcaaaattttcaagaaatgcaaaaaaggcatactggttaacatggacgacaatatcgtcaaacattattccaacgaagataccttccagctgcagatcgaggaagccggaggcagttataagctgactcttactgaaatctag

SEQ ID NO: 225183 - DNA, 1878 bp, Artificial Sequence
  Description of Artificial Sequence: Synthetic coding sequence
atgtcccaggaatccgataataataaaaggctggtggcactggttcccatgccatccgaccctccgttcaacacccggagagcttacacgtctgaggatgaagcctggaagtcttacctggagaaccccctaactgccgcaaccaaggccatgatgagcatcaatggagacgaggattctgcagcagccctggggcttctttacgactattacaaggtccccagggataagcgattactttccgtgtctaaagcctctgacagtcaagaggatcaggaaaagcgcaattgtctgggcacctccgaggcgcaatctaacctgtcagggggtgagaatcgggtacaggtgctcaagacagtgcccgtcaacctctcgctcaaccaggaccaccttgaaaacagcaagagggagcaatacagtatctcatttcctgagagttcagcaataatccctgttagtggcattacagtggtgaaggccgaagactttactcctgtgttcatggcacccccagtgcactatcccagaggggatggcgaagagcagcgagtggtgatctttgagcagactcagtacgacgtcccaagtctggctacacacagcgcatatctgaaagacgaccagcgttccacaccggatagcacctatagtgaatcctttaaagacgccgctacggagaaatttcggtccgctagcgttggcgctgaagagtatatgtacgaccagacaagtagcgggactttccaatatacactggaggccacaaagtccctgaggcagaagcagggggagggtcctatgacttacttgaacaaaggacagttctacgccatcacgttaagtgagactggagataacaaatgctttcgtcatcccatctctaaagtgagatctgtcgtcatggtggtgtttagtgaagacaagaaccgcgatgagcagttgaagtattggaaatattggcactctaggcagcatacggcgaaacagcgggtcctggatatcgcagactataaagaatccttcaataccatcggaaatatcgaggaaatcgcctacaatgcagtgagttttacgtgggatgtgaatgaagaggccaagattttcatcactgtgaactgtctcagcactgacttttcatctcaaaaaggagttaaaggcctcccgctgatgattcagatcgacacatacagttataataatcggagcaacaagccaatccatagggcctattgccagattaaggtgttctgcgacaagggggctgagcgcaaaattagagacgaggaacgcaagcaaaaccgaaaaaagggcaagggccaggcgtctcaaacccagtgcaattccagctccgatgggaagctggctgccattcccctgcagaagaaatcagacatcacctacttcaagactatgccggacctgcattctcagccagtgttattcatccctgatgtgcatttcgctaatttgcaacggacaggccaggtttactacaataccgacgatgaaagagagggaggttctgtcctggtgaagaggatgtttagaccgatggaagaggaattcggaccggtgccaagcaagcaaatgaaggaagaggggactaaaagagtgctgctgtatgtccggaaagagaccgacgacgtgttcgacgctctgatgctcaagagtcccaccgtcaaaggcctgatggaagctatctcagagaagtacggactccctgtggagaagatcgccaagctgtataagaaatccaaaaaagggattctggtgaacatggatgataatatcatcgaacactacagtaacgaggacacatttattcttaacatggagagcatggtggaaggctttaaggtcactctgatggagatctag

SEQ ID NO: 225184 - DNA, 1830 bp, Artificial Sequence
  Description of Artificial Sequence: Synthetic coding sequence
atgccctccgaccccccatttaacacaagaagagcatacaccagcgaagatgaggcttggaagagttacttggaaaacccgctcacagccgcaacgaaggccatgatgtccatcaacggggacgaagacagtgcggcagcgttagggttactgtacgactactacaaggtccccagagacaagcgtttgctctccgtttctaaagcgagcgattctcaggaggaccaggagaaaagaaattgtctcggtacctcagaggcccagtccaacctctctggtggcgagaaccgcgtgcaagtgctaaaaaccgtgccagtcaatctgtctctgaatcaggatcacttggagaactcaaagcgcgaacaatactccatctccttcccagaatcctccgctatcattcctgtttcagggatcactgtcgtgaaggctgaggatttcaccccagtttttatggccccaccagtgcactacccccgtggcgacggagaagaacagcgcgtggtaatcttcgaacagacccaatatgatgttcctagtttagcaactcattcagcctacctgaaagatgaccagaggtcgacccctgattctacatatagcgaatccttcaaagacgctgccactgagaaatttcgttctgcctcagtgggcgcagaagaatatatgtacgatcagactagttcaggtaccttccagtatactcttgaggctacaaaatctctgaggcagaaacagggcgaaggacccatgacctacctgaataaaggccagttctacgctataacgctgagcgaaactggggataacaagtgcttcagacaccccatttccaaggtaagatccgtggtaatggtcgtcttctcagaagacaaaaatcgggacgaacagctgaaatactggaagtactggcattcaaggcaacacacggcgaagcagcgcgtgcttgacattgcagattataaagagtccttcaacactataggtaatatagaagagatcgcatataacgcggtctcatttacctgggacgtgaatgaagaagctaaaatctttatcaccgtgaactgccttagcactgacttctcttcgcagaagggagtaaaaggcctgcctctaatgatccagatagacacatacagttacaataatcgaagcaacaagcctatacaccgtgcttactgccaaattaaagtcttttgtgacaagggcgctgagcgcaaaatccgtgacgaagagcggaaacagaacaggaagaagggaaagggacaagcctcccagacccagtgtaatagttcaagtgacggaaagctggccgcaatccctttgcagaagaagtccgacatcacatatttcaagacgatgcctgatttgcactcccagcccgtgttgtttataccagatgttcatttcgccaacctacagcggacaggccaagtctactataataccgacgatgaaagggaaggaggtagcgtgctggtgaagcgcatgtttcgtcccatggaggaggaatttggcccagttccatctaaacagatgaaagaggagggtactaaacgggtgctcttatacgtgcgaaaggagactgacgacgtcttcgatgcactgatgctcaagagtcctaccgtcaagggattaatggaggctatctctgagaagtacgggcttcccgttgaaaaaattgcgaagctatacaagaaatccaagaaaggcatccttgtcaatatggacgacaatatcattgagcactatagcaatgaggacacctttatccttaatatggaatcaatggttgagggttttaaggtgacactgatggagatatag

SEQ ID NO: 225185 - DNA, 1878 bp, Artificial Sequence
  Description of Artificial Sequence: Synthetic coding sequence
atgggaaaggatggtaggagtaacaaaagacttgtggcccttgtccctatgccgagtgacccaccctttaacacgaggcgcgcatacacctcggaggatgaggcttggaaaagctacttagaaaaccccctaacagccgcaaccaaggccatgatgtccataaacggggatgaggactccgccgctgcactggggctgctgtacgactactataaggtgcccagggacaagagattactgtctgtcagcaaggcctccgacagtcaggaagatcaagaaaagcgcaattgtctgggcacgtcagaggcccagagtaacttgtcggggggagagaatcgtgtccaagtcctcaagactgtccccgtaaacctgtcactcaaccaggatcacctggagaacagcaagcgtgaacaatattccatttctttccccgagtccagcgccattatcccagttagcggaataaccgtggtaaaggccgaggacttcacccctgtttttatggctccccctgtgcactacccccgtggagacggagaggagcagagagtggtgatcttcgaacagactcagtacgacgtgccttctttggcaacacactcagcgtatttaaaagacgatcagcgcagtacccctgatagcacttatagtgaatctttcaaggatgcagcaactgagaaatttagaagtgcatccgtaggagctgaagaatacatgtacgatcagacatcttcaggaacattccagtacacgcttgaagcgaccaaatcccttaggcagaaacagggcgagggcccaatgacctacttaaacaaggggcagttctacgcaatcaccctgtctgaaaccggtgacaacaaatgtttcagacatccgatcagcaaggtgcgtagtgtggttatggtcgtattttccgaggacaaaaacagggatgagcagctgaagtattggaagtattggcattcaagacagcacaccgctaagcaaagagtgctggatatcgccgattataaggaaagtttcaacaccattggcaacatcgaagagatcgcctataacgctgtcagctttacatgggatgtcaatgaggaggccaagatcttcatcactgtgaattgcctgagcaccgactttagctcacagaagggggtgaagggcctgcccctcatgatccagatcgatacatactcatacaacaatcggagcaataaacccattcatcgggcttactgccagatcaaggtgttctgcgacaagggcgctgaacgcaaaatccgagacgaggaacggaaacagaatcggaaaaaaggaaagggccaggccagccagacccagtgtaattcatcctctgacggaaagctcgcggcaatccccttgcagaaaaagtcagatatcacctatttcaagactatgccagatctccactctcagccagtactgttcataccggatgttcactttgctaatctccagcggactgggcaggtatactacaatacagacgacgagcgggaaggtggctctgtgctggttaaacgcatgttccgccctatggaagaagaattcgggcctgtcccctctaaacagatgaaagaagagggtacaaagagggtacttctgtacgtgaggaaagaaaccgacgacgtgtttgacgcattaatgctgaaatctcctaccgtcaaagggctgatggaggccatttcagaaaaatatggcctcccagtggaaaaaatcgcaaaattatacaaaaaaagcaagaaggggatcttggtcaatatggacgacaatattatagaacactattcaaacgaggatacttttatcctgaatatggagagtatggtcgagggcttcaaggtgacactgatggagatctag

SEQ ID NO: 225186 - DNA, 21 bp, Artificial Sequence
  Description of Artificial Sequence: Synthetic coding sequence
atgtctcaggagtccgactag

SEQ ID NO: 225187 - DNA, 1737 bp, Artificial Sequence
  Description of Artificial Sequence: Synthetic coding sequence
atgcttaggcgcttggacaaaatccgattccggggtcataaacgggatgacttcctggacttagcggagagccccaacgcctcagacacagaatgttcagatgaaatcccactcaaagtcccccgaaccagtccccgagactccgaagaactgagggacccagccggacctggcaccctgataatggccaccggcgtccaggacttcaatcgcaccgagtttgaccggctgaatgaaatcaagggccatctggagatcgcccttcttgagaaacacttccttcaggaagagctgcgaaaactgcgcgaggagacaaacgcagaaatgctgcggcaggaactggaccgagaacggcagagacggatggagctggagcagaaagtacaggaggtgctcaaagcaagaacagaagaacaaatggcgcagcagcctcccaagggacaggctcaagcatccaatggagcggagagacggtcacaaggtctctcgtctagacttcaaaaatggttctatgagcgctttggtgaatacgtggaagacttcagattccagccggaagagaatacggtggagaccgaagagcccttaagtgccaggagactcaccgagaatatgcgcaggctgaagaggggggcaaaaccagtgacaaattttgtgaagaacctttcagcgctctctgactggtattctgtatacacatccgccattgcctttaccgtttacatgaacgcggtatggcacggctgggcaatcccactcttcttattcctggccatcctccgcctcagcctgaattatttgatagcacgaggatggcgaatccagtggagcattgtgccagaggtctctgaacctgtcgaacctcccaaggaagatcttactgtgtccgaaaaatttcaactagtgttggatgttgcacagaaagcacagaatctcttcgggaaaatggccgatattttagaaaagatcaaaaacctcttcatgtgggtgcagcccgagattacacagaagttgtatgtcgcgctttgggcggctttcctggcttcttgcttctttccttacaggctggttggattggccgttggcctgtatgccggaatcaaattcttcctgattgatttcatcttcaagcgctgccccaggctgcgagccaagtatgacaccccatatatcatttggaggtcactccctacggacccgcagctgaaggagcgaagttctgctgccgtttcccgtcggctccagactacatcctcgagatcctacgtgcccagcgcacccgcaggcctcgggaaggaggaggatgcgggtaggtttcattctaccaaaaaaggtaatttccacgagatctttaatctcaccgaaaatgagagaccactggccgtctgtgagaatggatggcgctgttgtttgatcaacagggaccgcaaaatgcctacggactacattaggaatggagtgctctacgtaaccgagaactacctctgtttcgaatcgtccaagagtggctccagcaaaagaaacaaggtcattaagttggttgatatcacggacattcagaagtataaggtactctcggtgctgccaggcagtgggatgggcatcgcagtctcaactccaagcactcagaagccactagtctttggggctatggtgcacagggacgaggcctttgagacaatactgagccagtacattaagatcacgtctgctgccgcttccggcggagattcttag

SEQ ID NO: 225188 - DNA, 1737 bp, Artificial Sequence
  Description of Artificial Sequence: Synthetic coding sequence
atgcttagacgcttggataagatccgcttcagaggccacaagcgggatgacttcctggacctcgccgagagtcctaatgcttccgacaccgagtgctcagacgagatccccctcaaggtgcctcgcacatcacctcgtgacagcgaagaactgcgcgacccggcagggcctgggactctgatcatggcaacaggggtgcaggattttaaccgaaccgagtttgaccgtcttaatgagattaaaggccacctggagattgcacttctggagaagcacttcctgcaggaagagctcagaaagctccgggaagaaaccaatgcggaaatgctacggcaagaactcgatcgggagcggcagagaagaatggagctggagcagaaggtgcaggaagttctgaaagctcgaaccgaggaacaaatggcgcagcaaccgcctaaggggcaggcacaggcctctaatggcgctgagagaaggagccaaggtttgagcagtcgactgcagaaatggttctacgagcgtttcggagagtacgtagaggatttccgcttccaacccgaagagaataccgtggagacggaggagcccctatccgctcgtagactaactgaaaatatgagaagattgaaacgcggagctaaacctgttacgaatttcgtgaagaacctaagcgcactcagtgactggtattcagtatatacaagcgctatagcttttaccgtgtatatgaacgccgtatggcacggttgggccatacccctgttcctgtttttggcaatcctgagactgtctctgaattatttgatagccagaggctggaggatacagtggagcattgttccggaggtctccgaacctgtggagccacccaaggaggacctgaccgtgtccgaaaagtttcagttagtcctggacgttgcacaaaaggcccagaatttgttcgggaagatggctgacatcttggaaaagattaaaaatctgttcatgtgggtccaaccggaaataacccaaaagttatacgtagcactctgggccgcttttttagctagttgtttcttcccatatcgactcgttgggttggcggtcggtctctatgccggaattaaattctttttgatcgatttcatttttaaaaggtgccctcggttgcgggcaaagtacgacaccccctatattatctggagaagcttacccactgatcctcagctgaaggagcgtagctccgcggctgtatccagaaggcttcagactaccagctcccggtcctatgtgcccagcgctcccgctggcctgggcaaggaagaagacgccggaaggtttcactccacaaaaaaagggaactttcatgaaatatttaacctgactgaaaacgagcgcccacttgccgtgtgtgaaaatggctggcggtgctgccttatcaaccgagatcgaaagatgccaacggactacatcagaaatggggtgctttacgtgaccgagaattatctttgcttcgagagcagcaagagtggatcatcgaagcgcaacaaggtgattaaactggtagacattactgacatacagaagtacaaggtactgtctgtgctgcctgggtctggaatggggattgccgtgtccacgccatccacacaaaagcccctggtctttggcgctatggtacatcgcgatgaggcgtttgagactattttgtcccaatatatcaaaatcacaagcgcggctgcttctggcggagacagctag

SEQ ID NO: 225189 - DNA, 102 bp, Artificial Sequence
  Description of Artificial Sequence: Synthetic coding sequence
atgctccgcagactcgataaaatcagattccgcggtcacaagagggatgactttcttgatttggctgaatcccccaatgcttctgacaccgaatgttcttag

SEQ ID NO: 225190 - DNA, 1782 bp, Artificial Sequence
  Description of Artificial Sequence: Synthetic coding sequence
atgtggactcttgtgtcatgggtggcgttgaccgcaggccttgtggccggaaccaggtgtccagatggacaattctgtcctgttgcttgttgccttgacccaggcggagcttcctattcgtgttgcagacccctgctcgacaagtggcctacaacactttcccggcatctgggaggcccttgtcaagtagatgctcattgttctgctggccactcttgtatctttaccgtttccgggacctcctcttgttgcccttttccagaggcggtcgcctgcggcgatgggcaccattgttgccctcggggatttcactgctcagctgacggaagatcctgctttcaacgctcaggaaacaactccgttggtgcaatccagtgtcccgattctcaattcgaatgtcccgacttttccacttgttgtgttatggttgacggttcgtggggatgttgtccgatgcctcaggcaagctgctgtgaggaccgcgttcactgttgtcctcatggagctttttgcgacctggtgcataccagatgcatcacacctactggaacgcatcccctggcgaaaaagctccccgctcagagaactaacagagctgttgccctgagttcctcagtgatgtgccccgatgcgagaagtcgttgccctgatggaagcacgtgttgtgaattgccctcaggcaagtatggatgttgccctatgccgaatgcaacttgttgttccgatcaccttcattgctgtccacaagatacagtatgcgatctcattcagtctaagtgtctcagcaaggaaaatgccacaaccgacctgctgacaaagctgcccgcacacacggtaggggatgttaaatgcgacatggaagtatcttgccctgacggttatacctgttgcagactgcagtccggcgcttgggggtgttgcccattcacccaggccgtctgctgtgaggatcacatccattgctgccctgctggattcacctgcgacacccaaaaggggacctgcgagcagggacctcaccaggtgccatggatggagaaagcaccagcccacctctcactgccagatccccaggccctgaagagagatgtcccatgcgacaacgtgagttcctgtccttcatctgatacatgctgtcaactgacctccggcgagtggggatgttgccccataccagaggccgtctgctgttccgaccaccagcactgttgtcctcagggctacacatgcgtggctgagggtcagtgtcagagaggtagtgagatcgtggctgggttagagaaaatgcctgcgcgtcgcgcaagcctctcccacccccgagatatcggatgtgaccagcacacatcgtgtccagtcggacagacatgctgtccatctctggggggatcttgggcgtgttgccaacttccccatgccgtatgctgcgaggaccgccagcactgttgccctgctggctacacatgtaatgtgaaagccaggagctgcgagaaggaggtggtctctgcccagccagccactttcctcgccagatccccacacgtgggcgttaaggacgtggaatgtggggaaggacatttttgtcacgataatcagacatgctgccgagacaacagacagggctgggcatgctgcccatacaggcagggcgtctgctgcgcagatcggaggcactgctgtccagcgggatttcggtgtgccgctcgcggaacaaaatgtttgcgcagagaggcaccacgatgggacgcccctctgcgcgacccagcccttagacagctcctgtag

SEQ ID NO: 225191 - DNA, 1317 bp, Artificial Sequence
  Description of Artificial Sequence: Synthetic coding sequence
atgtggacactcgtcagctgggttgcccttaccgctggcctggtggcgggaactcgctgccctgacggccaattctgcccagtggcttgttgcttggatccgggaggagctagttatagttgttgtcggcctcttttggataaatggcccacaaccttgtctcggcatctgggaggtccctgtcaggtggatgcacactgcagcgctggccattcatgtatttttaccgtctctgggacatctagttgctgcccgttccccgaggctgtggcatgcggcgatggacaccactgctgcccaagaggattccattgtagcgcagatgggcgaagttgtttccaacggtccggaaataactcagtgggggctatccagtgtccggactctcagtttgagtgtccggatttcagtacatgctgtgtgatggtggatgggtcttgggggtgctgccctatgccccaggcctcttgttgcgaggacagggtgcattgttgcccacacggcgctttctgtgacctagttcataccagatgcatcacacctaccggtacacatcctctcgctaagaaacttcccgctcagaggaccaacagggccgtggccctctcctcttcggttatgtgcccggacgccagaagtcggtgcccagatggcagcacttgctgtgagctcccaagcgggaagtatggctgttgcccaatgccgaacgcgacctgctgctctgatcacctgcactgctgtccccaggacaccgtttgcgacctgatccagagcaaatgcctgagcaaagagaatgcaacaacagatctcctcacaaagcttccagcccatactgtgggcgacgttaagtgtgatatggaagtgtcatgccctgatggatatacctgctgtcggctgcaatctggagcttggggctgctgcccatttacacaggcagtttgttgtgaagaccatatccattgttgtcccgctgggtttacctgtgacactcagaaaggtacatgcgagcagggcccacaccaagtaccttggatggagaaggctcctgctcacctgtcacttcctgacccgcaggctctgaaacgggacgtgccatgcgataacgtatccagctgcccttcctcagatacctgctgcagagataaccgtcaaggctgggcctgttgcccatatcgacaaggcgtgtgttgtgctgatcggcgacattgctgtcccgctgggtttagatgtgccgctagaggaacgaaatgcttgcgcagagaagcccctcgctgggacgctcccttgagagatcctgccttgagacagctgctgtag

SEQ ID NO: 225192 - DNA, 1242 bp, Artificial Sequence
  Description of Artificial Sequence: Synthetic coding sequence
atggcgattaccgccgcacacggcgcaagcaccgcagtccagaccggggatcccgcttcaaaggatcaggtcactaccccttgggtcccatcttcagcactgatagtgtcgagtaatgcaaggacttcccccagagccgtgctgtggagcatggcaccgggtggcgcagccccttgcccaaggctcccagcggtgaagacagggtgcacagctgtgtgtgatctgatacagagcaaatgcctatcaaaagagaacgctaccaccgacttgctcactaagctgccagctcacaccgtgggcgacgtgaagtgtgacatggaggtctcctgcccagacgggtacacttgctgccgccttcaatccggtgcctggggctgctgtccgtttacgcaggctgtctgttgtgaggaccatattcattgttgccctgccggtttcacttgcgatacccagaaagggacttgtgagcaggggcctcaccaggtcccatggatggagaaggcgccagcccatctgagtctaccggatcctcaggccctgaagagagatgtgccttgtgacaacgtctcttcctgcccttcatctgacacttgctgccagctgactagcggtgagtggggatgctgcccaatccctgaggctgtttgctgctctgatcaccagcattgctgtccacagggttacacttgcgtggctgagggccagtgccaaagggggagcgaaatcgtggccggactggagaagatgcctgccagaagggcctccctgagccaccctagggatatcggctgtgaccaacatacttcgtgtcccgtcggccagacctgctgcccatcccttggcggttcttgggcttgctgccagctacctcacgctgtgtgttgtgaggacaggcaacattgctgcccggcaggatacacatgtaacgtcaaggctagaagttgtgagaaggaagtcgtcagcgctcaacccgcaacctttctggctcgctccccccatgtgggggtaaaggacgtggagtgtggcgaaggccacttttgtcatgataatcaaacatgttgtcgagacaatagacaggggtgggcgtgctgcccctatcggcagggcgtgtgttgcgcagatcggaggcactgctgcccagctggctttcgctgcgccgcaagagggactaagtgtttgcgcagagaggccccacggtgggacgctcctttgagggatcccgcacttagacaactcctgtag

SEQ ID NO: 225193 - DNA, 789 bp, Artificial Sequence
  Description of Artificial Sequence: Synthetic coding sequence
atgcggaacagttatcggtttcttgctagcagcctgtccgtggtggtgtccctgctactaattcccgaggatgtctgcgagaagattatcggcggaaatgaagtcaccccccactcccgcccatatatggtcctcctctcgctagacagaaagacaatctgtgccggtgccctcattgccaaagattgggtgctgacggcagcccactgcaatttaaacaaacgctcacaagttatactgggggctcactctatcaccagggaagagcccaccaagcaaatcatgctcgtgaagaaagagttcccctacccttgctacgaccccgcaactcgcgagggtgacctcaaactcctgcagttaatggagaaggccaagatcaataaatacgtgacaattctccacttacctaaaaaaggagatgacgtcaaacctggaaccatgtgccaagtggctgggtgggggcgaacacataactccgcctcctggtccgataccctgcgggaggtaaacatcactatcatcgatcgcaaggtgtgtaacgatagaaatcactacaactttaatccagtgataggaatgaacatggtctgcgccggatcacttagaggcggtcgggactcatgcaacggggatagtggctctccactgctttgcgagggagtctttcgcggtgtgacctcgttcgggctagaaaacaaatgtggcgacccaaggggcccaggcgtctacatactattgtctaaaaagcacctaaactggattatcatgacaatcaagggagcagtgtag

SEQ ID NO: 225194 - DNA, 741 bp, Artificial Sequence
  Description of Artificial Sequence: Synthetic coding sequence
atgcagcctttcctgctgctgctggccttcctactgacacccggtgcaggtactgaggaaatcatcggtggccatgaagccaagccacatagcagaccttacatggccttcgtgcaatttctgcaggagaaatccaggaaaaggtgtgggggaatcctggtgaggaaggatttcgttctgacagctgctcattgtcagggatcaagtattaatgtgactctcggggcacacaacatcaaggagcaggagcgcacacagcagtttataccagtgaaaagacctataccacacccagcctacaatccaaaaaatttcagcaatgatatcatgctgctgcagctggaacggaaggccaaatggacaaccgctgtaaggcccttgcggctaccctcctctaaagctcaggtcaagccaggacagctctgctccgtcgctggctggggctacgttagtatgtctactctcgcgacgaccctgcaagaagttctactcacagtgcaaaaggattgccagtgcgaacggctattccacggcaactattctcgggcaactgagatctgtgtgggcgatcctaaaaagacccagaccggcttcaagggggattccggcggacctttagtgtgcaaagatgtggctcagggcattttatcctatggcaataagaagggaactccaccaggggtgtatatcaaggtgtcccatttcttaccatggatcaaacggacaatgaagcgtctgtag

SEQ ID NO: 225195 - DNA, 459 bp, Artificial Sequence
  Description of Artificial Sequence: Synthetic coding sequence
atgcaacccattctgctgttgctggcgtttttgttacttcctcgtgcggatcagctggaaagaaaagcaaagcgaacccgcgctgtccagcctctgagactgccctcgaacaaagcacaggttaaacctggccagacttgttctgtggcaggctggggccaaacagcccctctcggcaaacattctcacacattacaggaggtgaaaatgaccgtgcaagaggaccgaaaatgtgagtccgatcttcggcactactacgattccaccattgagctctgtgtgggtgatcccgaaatcaagaaaacctccttcaagggtgattcaggaggccctttggtgtgcaataaggtggcccaggggatcgtgtcttatggccgaaataatggtatgcccccacgcgcatgtacaaaagttagcagctttgtgcattggataaagaagaccatgaaacgttattag

SEQ ID NO: 225196 - DNA, 609 bp, Artificial Sequence
  Description of Artificial Sequence: Synthetic coding sequence
atgcagcccatcctgctcctgttagcattcctccttctgccgcgagccgatgcgggagaaatcatcggaggacatgaagcaaaaccacattcccggccatacatggcatatcttatgatatgggaccagaaaagtttaaaacgatgtggcggtttcctgatcagggacgatttcgtgctgacagcagcacattgctggggccgactggagagaaaagcaaaaaggacacgtgcggttcagccactgcgcctaccgtcaaacaaagcacaggtcaagcccggacagacttgttctgtggccggttggggccagactgcccctctggggaagcactcgcacacactgcaggaagtgaaaatgacagtgcaggaggacagaaaatgtgaaagcgacctgcgccactattacgacagcaccatcgaactgtgtgtgggcgacccggagatcaaaaagacctccttcaagggagactcaggcggaccgctggtttgcaacaaagtggcccagggcatcgtcagctacggcagaaacaatggcatgccgcctcgcgcttgcactaaggtcagtagctttgtgcactggatcaagaagactatgaaaaggtactag

SEQ ID NO: 225197 - DNA, 846 bp, Artificial Sequence
  Description of Artificial Sequence: Synthetic coding sequence
atgaaaagcctgagcctcctgcacctattccccctgccgcgagcaaagcgggagcagggcggtaacaattcatcctctaaccagggctccctgcccgaaaagatgcaacccatcttactcttacttgcattcctgttgctgcctagagcggacgccggtgagataataggtggacacgaagcaaagccacattctcgcccttatatggcctacttaatgatatgggatcagaagtctcttaagcgttgtggaggattcttaatcagagacgactttgtgctcaccgccgctcactgttggggaagcagtattaacgttacccttggggcacacaatatcaaagaacaggaacccacacagcagtttattccagtgaagcggcctatcccccaccctgcctataaccctaagaacttttctaacgatataatgctcctgcagctggaaaggaaggcaaaaagaacacgcgcagtccagccgttaaggctaccatccaacaaagcccaggtgaagcccggacaaacctgttccgtcgcaggctggggtcagacagcacccttggggaagcatagccacacccttcaggaggttaaaatgacagtgcaggaagacaggaagtgtgagtctgatctgcgacactattacgactctacaatagagttatgcgtcggtgatcccgagataaagaaaaccagctttaaaggagacagcggtgggcctcttgtctgtaacaaggtcgcccagggcatcgtgtcctacgggcgaaataatgggatgccaccgcgtgcctgtactaaggtatccagtttcgttcattggatcaagaagaccatgaagagatactag

SEQ ID NO: 225198 - DNA, 708 bp, Artificial Sequence
  Description of Artificial Sequence: Synthetic coding sequence
atgcagaccttccccagtggtgagatcattggaggccacgaggcaaagccacacagtaggccctatatggcctacctcatgatttgggaccaaaaaagccttaagcgctgcggcggatttctaattcgcgacgattttgtgttaaccgccgcacactgttggggaagttctatcaatgtcactctcggcgctcataacatcaaagagcaagaaccaacgcaacagtttatcccagtcaagcgcccaatcccccatcctgcttataaccctaagaacttttctaacgacattatgctcctgcaactggagcgcaaagctaaacggactcgtgccgtgcagccgctgcgattgccatccaataaggcacaggtcaagcctggccagacctgttctgtggctgggtggggccagaccgctccactgggcaagcatagccacactctacaggaagtaaagatgactgtccaggaggaccggaagtgtgagtccgacttgcggcactactacgattccactatcgagctctgcgtgggtgaccctgaaattaagaagacgtcctttaagggtgactccggaggccctctcgtttgcaataaggtggctcagggtatcgtatcttacgggagaaataatgggatgcctcctcgagcctgcacgaaggtcagttcattcgtccattggatcaagaaaacgatgaagagatattag

SEQ ID NO: 225199 - DNA, 483 bp, Artificial Sequence
  Description of Artificial Sequence: Synthetic coding sequence
atgcagccattcctgttgctgctcgcttttcttcttactcccggtgcgggtacagaggagataattggcggtcatgaggccaaaccgcatagtaggccctacatggctttcgtacagttcctgcaggaaaagagccgcaagcgttgtggaggaatcctggttaggaaagacttcgtgttaaccgctgcacattgtcaagggtcatctatcaatgtcacactgggcgctcataatatcaaagagcaggagcgcacacagcagttcatacccgtgaaaagacctatcccccatcccgcatacaatccaaaaaacttcagcaacgacataatgctcctgcaaggtgacagcggaggaccactggtgtgcaaagacgtagcacagggcatattgagttacggcaataaaaaaggcacaccgcctggcgtctatattaaggtgagccacttccttccatggatcaaacgtaccatgaaacgtttatag

SEQ ID NO: 225200 - DNA, 768 bp, Artificial Sequence
  Description of Artificial Sequence: Synthetic coding sequence
atgcagccgttgttactacttctggcatttttgttgcccacaggcgcagaagcaggggaaataatcggaggccgagaatcacgccctcatagcaggccgtatatggcctacctacaaatccagtctcccgcaggtcaatctagatgtgggggattcctggtgcgggaggactttgtgctaacagccgcacactgttggggcagcaacattaacgttacactgggtgcccacaatatccagaggagagagaatactcagcagcatattaccgctaggcgggctatccgtcatccccagtacaatcagcgtactattcagaatgacattatgttgctgcagttgtccaggcgcgtgcggagaaaccggaatgttaaccccgtcgcactccctcgcgctcaggaaggtctgagacctgggaccctgtgtacggtagccggttgggggagggtatcaatgagaagaggcacagacaccctgcgcgaggttcagttaagagtgcagcgcgaccgacaatgcttgcgcatcttcggtagctatgaccccagaagacagatttgtgtaggagaccggagagagcgcaaggccgcattcaaaggcgatagcgggggtcctcttctgtgcaacaatgtggcccacggcatcgtgagttatggcaaaagctcaggagtgccacccgaagtgttcacgcgtgtgtcatccttcttgccgtggatcagaactaccatgcgtagttttaagctgctagaccaaatggagacgcctctatag

SEQ ID NO: 225201 - DNA, 348 bp, Artificial Sequence
  Description of Artificial Sequence: Synthetic coding sequence
atgcagccattcttgctcctgcttgccttccttctgacccctggcgcaggtactgaggagatcatcggtgggcatgaagctaaacctcacagcagaccttatatggcgtttgttcagttcctccaggaaaaatccaggaagcgatgcgggggtatccttgtgcggaaggacttcgtgctgacagctgcacattgccagggtagaggggattctggcggaccccttgtgtgcaaagacgtcgcccaaggcatattaagttatgggaacaagaagggtacgccaccaggagtatacatcaaagtctcgcactttttgccatggataaaacgcaccatgaagcgcctttag

SEQ ID NO: 225202 - DNA, 774 bp, Artificial Sequence
  Description of Artificial Sequence: Synthetic coding sequence
atggaggcctgtgtgtccagcctactcgtgctggcccttggagccctctcagtcggcagttctttcggaactcagatcatcggaggcagggaggtgatcccacactctcgtccctacatggcttctctccagagaaatggctctcacttgtgtggaggagtgctcgtgcatccaaagtgggttctgactgccgctcattgtttggctcaaagaatggcccaactgagactggttctggggctgcatacgcttgacagtccaggcctaacatttcacattaaggcagccatccagcatccccgatataagccagttcccgctctcgagaacgatctagccttattgcagctggacgggaaggtgaaaccaagtagaacaatacgacccctggccttgccaagcaagcggcaggtcgtggcagctggaactcgatgttccatggcaggctggggactgacacaccaaggcggtaggttgagccgggtgttgagggagctcgacctacaggtgctggacacccggatgtgcaataactcgaggttctggaacggctcgctctcaccttccatggtgtgcctggctgccgattcaaaagatcaggccccatgcaaaggggactccgggggtcccctggtatgcggtaaaggaagggtgctggcgagggtactgagcttttcttcgagggtttgtactgatatattcaaaccaccagtggcaactgccgtcgccccttacgtgtcttggattcggaaagttacggggcgaagcgcatag

SEQ ID NO: 225203 - DNA, 3108 bp, Artificial Sequence
  Description of Artificial Sequence: Synthetic coding sequence
atggccgctgagacactgaatttcgggcctgaatggctgcgggctctgtccgggggaggatccgtcgcctcccctcctccaagtccagcaatgcctaagtacaaactggctgactataggtacgggagagaggagatgttggccctctacgtcaaggagaataaggtacccgaagagctgcaagacaaggaatttgccgctgtcttgcaggatgagccgttacaacctctcgctctggagcccctcactgaagaagagcagcggaactttagtctgtccgtgaatagcgtggccgtcctgcggctgatgggaaagggggctggccctcccttggctgggacctcacggggacgtggtagtacccgcagcaggggacgaggcagaggagattcttgtttctaccaacgatcgattgaagaaggtgatggcgcttttgggaggtctcctagagaaatccagcggtcacagagctgggatgacaggggtgagagacggtttgaaaagtccgcgcgtagagatggagcacgttgtgggttcgaagagggtggggctggtccacggaaggagcatgccagaagcgatagcgaaaattggagaagcctcagagaggagcaggaggaagaagaggaagggagctggagactgggcgcagggccaaggcgggatggagatcgatggcggagtgccagccccgacgggggacctcggtccgcagggtggagagaacatggtgagcgcaggcgaaaatttgagttcgatctgaggggggaccggggtggctgtggagaagaggagggcagagggggaggtgggagctctcatctccgacggtgtagggcccctgaagggtttgaggaagacaaggacgggctgccagagtggtgtctagacgatgaagatgaggagatgggaacttttgatgcttctggcgcttttctgccactgaaaaagggccctaaagaacccattcctgaagaacaggaactggattttcagggactcgaggaggaggaggaaccctccgaaggcctagaagaggaaggtcctgaggccggaggcaaagagcttactcctcttccccctcaggaagagaagtcttccagtccttcccccctgcccaccctgggaccactttggggcacgaacggagatggagatgaaacggccgagaaggagccaccagcagcggaggatgatatcagggggatacagttgtccccgggtgtgggttcaagtgcagggccacctggggacttggaggatgacgagggtttaaaacatctgcagcaggaggccgagaagcttgtcgctagcctgcaagattcctctctggaggaggagcagtttactgcggcaatgcaaacacaaggcttgcgccattcagccgcagcaaccgctctcccgctgagccatggtgccgctcgtaagtggttctacaaggatcctcagggtgagattcagggcccttttaccacgcaagaaatggctgaatggttccaggccggatatttctcaatgtcactcctggttaagcgcggttgcgacgaaggattccagccgttgggcgaggtgatcaaaatgtggggaagggtaccattcgccccaggtccctcccctccaccgctgctcgggaacatggaccaggaacggttgaaaaagcagcaagagctggccgctgctgccttatatcaacagctacagcaccagcaatttttacagctcgtgagcagccgccagctccctcagtgtgcattaagggagaaagcagcattaggggacctcacaccacctccgcctcctccgcctcagcagcaacaacagcagttgacagcattccttcagcagctccaggccctaaaacccccaagaggaggagatcaaaatctgttgcccacgatgagtaggtcactttctgtgcccgacagtggtcgcctttgggatgtgcatacatctgctagtagccagtccggaggcgaggcctccctctgggacatccccatcaattccagcacccaggggcctatcctggagcagctgcagctgcagcataaattccaggaaaggagagaagtggaactgcgggcaaaacgcgaggaggaagaacgtaagaggagggaggagaaacggaggcaacagcagcaggaggagcagaaacgtaggcaggaggaggaggagctcttccgcagaaagcacgtgcggcagcaggagttgctgctcaagctcctgcagcagcaacaggctgtccctgtccctccagcaccctcaagtcctcctcccttatgggccggactagccaagcaaggtctgtcaatgaagaccctcctggagctccagctggaaggagaaagacagctacataaacagccaccacctcgggagcctgccagggcacaggcccctaaccatagggtgcagctggggggtctgggaactgctcccctgaaccagtgggtttcagaagccggaccgttatggggcggtccggacaagtccggtggcggttccagtggtctggggctctgggaggatacacccaaatcaggaggttctctagttcgcggtctcgggctcaagaattcacggtcttctccttcgcttagtgatagttattcccatctgtcaggcagaccgatcaggaaaaagactgaggaagaggagaagctgctgaagctgctgcaagggatccccagaccacaggatggtttcacacagtggtgtgagcaaatgctacacactttatctgcgactggatctctggacgtccctatggcggtcgctattctgaaggaggtggagtcaccatacgatgtgcatgattacatccggagctgcctcggagatacgctggaagcgaaggagtttgccaaacagtttctagaaaggcgggcaaagcagaaggcttcgcaacagagacagcagcagcaggaggcctggctgagtagtgccagcctgcagacagcattccaggcaaaccatagcacaaagctggggcctggagaggggtcaaaagccaaaaggcgcgctctgatgctccattccgacccatcaatcctgggatacagcttgcatggatcttccggcgagatcgaatctgtggatgattattag

SEQ ID NO: 225204 - DNA, 2265 bp, Artificial Sequence
  Description of Artificial Sequence: Synthetic coding sequence
tcttcattccccagccccaggctgccccaggtgttccataggctagatgacgaggatgaggagatgggcactttcgatgcctctggcgcttttctgcctcttaaaaagggccctaaggagccaattcccgaagaacaggagctcgatttccagggactcgaggaggaagaagaaccgtccgaaggtctggaggaggagggccctgaggcgggtggcaaggaattaactcctctcccgcctcaggaggagaagtcgagcagcccgagtcccctacccactctcggcccactgtggggcactaatggggatggagacgaaaccgctgaaaaggaacctcccgctgcggaggatgatattcggggtattcagttatcacccggagtggggtcatccgcaggtccacctggcgacctagaagacgacgaaggactcaagcaccttcagcaagaagccgaaaaactggtcgcctccctgcaagacagctcccttgaagaggagcagtttacggctgctatgcagactcagggcctccgccactcagctgccgcaacagcattacccctctcccatggcgctgcacggaaatggttttacaaggatcctcagggagaaatccagggaccgtttaccacacaggagatggccgagtggttccaagcaggctatttctccatgagcctgttggtgaagcgaggctgcgacgagggattccagcccctcggggaggttatcaaaatgtggggtagggttccctttgcccctgggccatctccgccaccactgctgggaaatatggaccaggaacgacttaaaaagcagcaggaactggctgctgccgctctataccagcaactgcagcatcagcagtttttacaattggtgtcaagtcggcagctcccccagtgtgctctgagggagaaggccgcactgggcgatttaacaccgccaccaccgcctcctcctcagcagcagcagcaacagctgacggcatttcttcaacagctgcaggcactgaaaccacctcgcggaggcgatcaaaatctgcttcctacaatgtctcggtccctgagcgtcccggattctggacggctatgggatgtacacacgtcggcgtcttcacagtcagggggtgaggcatctctgtgggatatcccaatcaactctagcacacagggacccatactggagcagctgcaactccagcacaaattccaagaaaggcgcgaagtggagttgcgagctaagagagaggaggaggagaggaaaagacgcgaggaaaagagaaggcagcagcagcaggaagaacagaaacgcaggcaagaggaggaagaactttttcggcgtaaacatgttcggcagcaagagctgctcctcaagcttttacagcaacagcaagcggtgcctgtgcctccagcccctagcagcccacctccattatgggccggtttggcaaagcagggcttgtccatgaagaccctgctggagctgcagctcgagggagaacgccagttacataagcaaccgcctccacgcgaacctgcaagagcacaggcccctaatcaccgtgtgcagttaggcggactaggcaccgcccctctgaatcaatgggtgagcgaagctgggcctctttgggggggtcccgacaagtcagggggaggaagttccggcctgggactgtgggaggacaccccaaaatccggcggatcattagtgagggggctgggattaaaaaacagtcgctcatccccaagcctttctgattcttactctcacctgtctggcaggcccatcagaaagaagaccgaagaggaggagaaactgctcaagctgctgcaaggcatcccccgaccccaggatggatttactcagtggtgtgaacagatgctgcacacgcttagcgctactgggtcactggacgtgccgatggccgtggcaatcctgaaggaggtggaaagtccctacgacgtccacgactacattcggtcctgccttggagatactctggaagcgaaagagttcgctaagcaattcttggagaggagagctaagcagaaggcctcccagcagcggcagcagcagcaggaagcttggctgtcttccgcatcactccaaaccgccttccaggctaaccattccaccaagctgggacctggggagggaagtaaggcaaagaggcgcgctctcatgctgcatagcgatccgagcattctgggatattcactgcacggctcatcaggcgaaatcgaatcagtagatgactactag

SEQ ID NO: 225205 - DNA, 3900 bp, Artificial Sequence
  Description of Artificial Sequence: Synthetic coding sequence
atggccgctgagacacagacgctcaacttcgggccagagtggttgcgcgctctgtcctcaggaggctcaatcacatctccacccttgtctccagcattacccaagtacaagctcgcagattacagatatggcagggaagaaatgctcgctctctttttgaaagataacaagattccgagcgacctcctggacaaggaattcctgcctatcctgcaagaagaaccccttccccctctggcattggtcccctttaccgaagaagagcagcgaaacttctcgatgagcgttaactctgccgctgtgctgcgattgaccgggagaggaggagggggaaccgtggttggagcccctcggggtcgctcctctagccgcggtcgcggtcgaggcaggggcgagtgcggattttaccaaaggtccttcgatgaggtcgaaggtgtgttcgggaggggcggaggccgagagatgcacagatcacagtcttgggaggagcggggagaccgcagatttgagaaacctggccgaaaggacgtcggaagaccgaacttcgaggagggaggcccaacgagcgtgggtcgaaaacacgagttcattagaagcgaatcggagaactggcgcatctttcgggaggaacagaatggcgaagatgaggacggcggatggagattagctggtagtagaagagatggagaaagatggagacctcattcgccagacggaccacggagcgccggatggcgcgagcacatggagaggcggcgaagatttgaatttgattttcgggatagagacgatgagcgtggctacaggcgagtgcgctccggcagcggctcaatcgatgatgacagagactcacttcctgaatggtgtctggaggacgctgaggaagaaatgggtacctttgactcctcaggcgcatttttgtcgctcaagaaagtccagaaagagccgattcctgaagagcaggagatggatttccggcctgttgacgagggtgaagaatgctctgattcagagggctcacacaatgaagaggccaaagagccggataaaactaacaagaaggagggggaaaagaccgaccgcgtgggtgtggaagcaagcgaggaaacgccacagacaagcagcagctctgctagaccaggtacaccttctgatcatcaatctcaggaggcctcccagtttgagcgaaaagacgagccaaaaaccgaacagacagaaaaagctgaagaggagacacggatggaaaactccctgcccgcaaaagtgccatcacgcggtgatgaaatggtcgccgacgtgcagcagccattgtcccagattccctcggacactgcgtctccgctgctgatactgccccctccggtgcccaatccctccccgacactcagaccggtagaaacccctgtggttggggcacccggaatgggtagtgtgtccactgaacccgacgacgaagagggcctaaaacacttagaacaacaggccgagaagatggtggcttacctgcaggacagtgcgctggatgacgagcggctcgcctcgaagttacaggagcaccgcgctaagggagtgtctattccattaatgcacgaggccatgcagaaatggtattacaaagaccctcagggtgaaatacagggtcctttcaacaaccaggagatggctgaatggttccaggccggatatttcactatgagccttctggtgaagcgcgcttgcgatgaatcctttcagcctcttggtgacattatgaagatgtgggggcgtgtccctttttcacccggtcctgcgccaccgccacacatgggtgagctggatcaagaaaggttaacccgacaacaagagctcaccgctttgtatcagatgcagcacctacagtatcaacagtttttaatccagcagcaatacgcgcaggtgcttgcccagcagcagaaggctgccttatcgagtcagcagcagcaacagcttgctcttctacttcagcaatttcagacactgaagatgcgtatttccgatcagaacataatcccttcagtcaccagatccgtgagcgtgcccgatacaggcagcatctgggagctccaaccaacagcatcccagcccacagtatgggaaggaggatctgtctgggacttgccactggatactacaacaccaggcccagccttggagcagttgcagcagctcgagaaagcgaaggccgctaaattggagcaagaacgccgtgaggctgagatgagagccaagagagaggaggaggaacgcaaaagacaggaggaattgagacgccagcaggaggagatactgaggaggcagcaagaagaagagcgcaagaggagggaagaagaagaattagccagacggaagcaagaggaagctctgagacggcagcgggagcaggagatcgctctgcgtaggcaaagggaggaggaagagcgccagcaacaggaggaagctcttcgacgcctcgaggaaaggaggcgcgaggaggaagaacgacgaaagcaagaggagctactgagaaagcaggaggaggaagcagcaaagtgggccagagaggaagaagaagcgcagaggagactggaagagaaccgtctccggatggaggaggaagcagcccgactgaggcatgaggaagaggagcgaaagagaaaggaactagaggtgcaaagacaaaaggagctcatgagacagcggcagcagcagcaggaggcactgagaaggctgcagcaacagcagcaacaacagcaactggctcagatgaagctgcctagttcttcaacctggggccagcaatccaacactacagcctgtcagtcccaggccactttgtctttagctgagattcaaaaattggaggaagaacgcgagaggcagctgagagaagaacagaggcgccagcagagagagctgatgaaagctctccagcagcagcagcagcagcaacagcagaaattgagcggttggggcaacgttagcaaaccatctgggaccacaaagtcgctgttagaaattcaacaggaagaagcaagacagatgcagaagcagcaacaacagcagcagcagcatcaacagcctaaccgcgcaagaaataacacccactcgaatttgcacactagcatcggaaatagcgtgtgggggagcatcaataccggaccacctaaccaatgggcctctgatctcgtgtcgagcatctggagcaacgccgatacaaagaactctaatatgggcttttgggacgacgctgttaaagaagtcgggcctaggaactccactaacaagaataaaaacaatgcctcactaagcaagtccgtgggagtgtctaaccgtcagaacaagaaagtagaggaggaggaaaaactgttaaaattgtttcagggcgtgaacaaagcacaggatggcttcactcagtggtgtgagcagatgttacatgccctgaacaccgcaaataatctggatgtgcccacctttgtgagctttctgaaggaggtggagagcccttatgaagtccatgactatattagagcctatctgggcgatacttccgaggcaaaggagttcgcgaagcagtttctcgaacgcagggccaaacaaaaagcaaaccagcagagacaacagcagcagttaccacagcagcagcaacagcagcctccacagcagcccccacagcagccccagcagcaggactcagtgtggggcatgaatcattcgacacttcactcagtgtttcagaccaatcaaagcaacaatcagcagtcgaactttgaggccgtgcagagtggcaagaagaaaaagaagcagaaaatggtccgcgcagaccccagcttgctcgggttcagcgtgaatgccagcagcgaacggctcaatatgggcgagatagagaccctcgacgattactag

SEQ ID NO: 225206 - DNA, 3966 bp, Artificial Sequence
  Description of Artificial Sequence: Synthetic coding sequence
atggcagcggagacacagactcttaactttggccctgagtggctgcgtgctctgagtagtggaggcagtatcacttccccccctttgagccctgcgctcccaaagtacaagctggctgattatagatacggcagagaggaaatgctggccctgtttctgaaggacaataagattccgagcgatcttcttgacaaggagttcctccccatactccaggaggagccacttcccccactggctctggtgccttttacagaggaggagcagagaaactttagtatgtctgtcaacagcgccgcagtcctgcgccttactggaagaggcggaggcggaactgtagtaggagcaccgcgaggcagatcctcaagtcgcggacggggtagaggacgaggggaatgtggattttaccagagatcttttgacgaggtggagggggtgttcggaagaggaggcggacgcgagatgcatcgcagccagagctgggaggagagaggcgacagaaggttcgaaaagcctggcagaaaggatgtaggaaagaagaatggctattactgtatgtactctccagtgctcttgctggggcagccactctgtcaggggcgacctaattttgaggagggcggaccaacctcagtggggagaaaacacgaattcataagaagcgaatcggagaattggcgcatttttagagaagagcaaaacggggaggatgaagacgggggatggaggctggctggctctaggcgggacggggagaggtggcgccctcactcccctgacggccctcgatccgctggttggagggaacatatggagaggaggcgccgattcgagttcgacttccgcgaccgcgacgacgagagaggctatcgtcgtgtacgttccggctccggctccattgacgacgaccgggatagcttgccagagtggtgtctagaagatgcagaggaagaaatgggcaccttcgactcctcaggtgcctttctttcacttaaaaaggtgcagaaggaaccaattcccgaagagcaggagatggatttcaggcctgtggacgagggggaggaatgtagcgactcggaaggatcccacaatgaggaggcaaaggagcctgataaaacaaataagaaagaaggcgaaaagacagacagagtcggagtagaggcaagcgaggagacccctcagaccagttcctcttctgcccgtcctgggacgccgtccgatcaccagtcccaggaagcctcccagtttgaacggaaggatgagccaaaaaccgaacagaccgagaaggctgaggaggagactagaatggaaaattctttgcccgctaaggttccaagccgcggtgacgaaatggtggcagacgtccagcagcccttgtctcagataccaagtgatacagcttctcctctgctcatccttcccccaccagttccaaatccgagtccaacccttaggccagtcgagaccccagtcgtaggggcaccaggcatgggtagcgtttccaccgagcccgatgatgaagaaggcctgaagcacctagaacaacaggcagaaaaaatggttgcctatctgcaggacagcgcactggatgatgagcgattggccagcaaattgcaggagcaccgggcaaaaggcgtctcaatccccctcatgcacgaagccatgcagaaatggtactacaaggatcctcaaggcgaaatccagggtcctttcaataaccaggagatggccgagtggttccaggccggatacttcaccatgagtctgctcgtgaagcgagcatgtgatgaaagctttcagcctctcggcgatatcatgaagatgtggggacgtgtccccttctcacctggccctgctcctcctccacatatgggagaattggatcaggagcgcctcacacgccagcaggaactgacggccctttaccagatgcagcacttgcagtaccagcagttcctgatccagcagcagtatgcccaggtgctcgcccaacagcagaaagctgccttaagcagccagcagcagcagcagcttgcactgctgttgcagcagtttcaaaccctgaaaatgcggatcagcgatcaaaatattataccaagcgtgacgagaagcgtgtcagtccccgatactggctccatctgggagctgcagcccactgcttcacagcctaccgtgtgggagggaggcagcgtctgggacttgccattggacactacgactcctggccctgcacttgagcagctccagcagcttgagaaggctaaggctgccaagctggagcaggagcggcgagaagccgagatgcgagctaaaagggaggaagaagagagaaaacgccaggaagaactgcgtaggcagcaggaggagatcctcagacggcagcaggaagaagagcggaaaagacgcgaagaggaggagcttgccagacgaaagcaagaggaagcactgcggagacagagagaacaggagatcgcgctgcgacggcagcgggaggaggaagagaggcagcaacaagaggaggccttaagaaggcttgaagaacggaggcgcgaggaggaagagcggcgaaagcaggaggagctgctgcgaaaacaggaggaagaggcagccaaatgggcaagagaagaagaggaagcccaacgcaggctcgaagaaaacagactacgcatggaggaggaggcggcacggcttcggcacgaagaggaggagcggaagaggaaagagctggaggtgcagcggcagaaagagctgatgcggcagcgacagcagcaacaggaggcactgcggcgtcttcagcagcagcagcagcagcagcagcttgctcagatgaaacttccatcatcgagcacctgggggcagcaatcgaacaccactgcatgccaatctcaggctactctgagtctggccgagatccaaaagctggaagaagagcgcgagcggcaactgagagaggagcagcgccgacaacagcgggagcttatgaaagcccttcagcagcagcagcagcagcagcagcagaaactgtctggatggggaaatgtttcaaagccttccgggaccacaaagagcctgttggaaatccagcaagaggaagcccgacagatgcagaagcagcaacaacagcagcagcagcatcaacaacctaatagggccagaaacaacactcatagcaacctgcacacgtcgatcggcaattcagtctgggggtcaatcaacaccggtcccccaaaccaatgggcgtctgatctggttagcagcatttggtctaatgcagatacaaagaacagcaacatgggtttctgggatgatgcagtgaaggaagtcggacctcgcaacagcactaacaagaataagaacaatgcatccctttcaaagtcggtgggtgtgagcaataggcaaaataaaaaagtggaggaagaggaaaaacttctgaaactgtttcagggtgtcaacaaagcgcaagacgggtttactcaatggtgtgaacaaatgctacacgcgctgaataccgcgaataatctcgatgttccaacgttcgtttcgttcctcaaggaggtcgagagtccctacgaggttcacgattatataagagcctatctgggcgatacaagtgaggccaaggaatttgccaaacagttcctcgagcgaagagccaagcaaaaagctaaccagcagcggcaacaacagcagttgccacaacagcagcagcagcagccgccacagcagcctccacaacaaccacaacagcaggatagcgtgtggggtatgaaccacagtacacttcacagtgtttttcagaccaatcagtctaacaaccaacaaagtaacttcgaggccgttcaatcaggcaagaagaagaagaaacagaagatggtccgcgcagatccaagcctcctcggcttcagcgtaaacgcctcatccgagagactgaatatgggcgagattgagacactcgacgattattag

SEQ ID NO: 225207 - DNA, 3966 bp, Artificial Sequence
  Description of Artificial Sequence: Synthetic coding sequence
atggcggcagagacccagaccctgaactttgggccagagtggctccgcgctctgtcatcaggcggtagcataacttccccgccattgagccctgcgctcccaaagtataagctggccgattacaggtatgggcgagaggagatgctggcactgtttctgaaagacaataaaataccgtcagacttgctcgacaaggaattcctcccgatactacaggaagagcctctgcctcccctggcactggtaccttttaccgaagaggagcagcgaaatttctcaatgtccgtcaactccgcggcagtactgcgtttgaccgggagaggcggtggagggacagtggttggagctcctagaggcagatcctcttccaggggcaggggaagagggaggggcgaatgcgggttctatcaacgctcctttgatgaagtcgagggtgttttcggaagaggaggaggcagggagatgcataggtctcagtcttgggaagagcgcggtgatcgcagattcgagaaacctggcaggaaagacgtggggaaaaagaacggctactactgcatgtatagtccagtcctgctgctgggccagcctctctgtcaagggagacctaattttgaagagggaggccctacatctgtgggcagaaagcacgagttcatccggagcgaaagtgagaactggcgcatttttcgggaggaacagaatggtgaagatgaggatggaggttggagactagcaggtagccgccgagatggcgagcgttggagaccacactcaccagatggtccacgctccgcaggctggcgggaacatatggagaggaggagaaggtttgagtttgactttcgggaccgggacgatgagcgagggtacagacgcgtgagaagcggatccggttctatcgatgatgaccgcgactccctccctgagtggtgcctagaggacgccgaggaggaaatgggcaccttcgactcttccggtgctttcttgagcctcaagaaagtgcagaaagaacctattccggaagaacaggagatggactttagaccagtcgatgaaggcgaagagtgttcagacagcgagggatcacacaacgaggaagccaaggagccagataaaactaataagaaggaaggagagaaaaccgaccgcgttggagtggaagcatcagaagaaacccctcagactagctctagctccgcacgcccaggaacaccttccgaccatcagtcccaggaggccagtcagtttgaacgtaaagacgagcccaaaaccgagcagaccgagaaggctgaggaggaaaccagaatggaaaactccctgccagcaaaagtcccgtctagaggggatgaaatggtggcggatgtgcagcagccactgagtcagattccatccgacactgcctctcctctcctgattctccctcctcctgtgcccaatccaagcccaacactcaggcctgtcgagacgccagtagtcggcgctcctggaatgggaagtgtgagtacagagcctgacgacgaggagggtctaaagcacctggagcagcaggcggagaaaatggtcgcttatttgcaggacagcgccctggacgatgaaagattggcctctaaactgcaggaacatcgggctaaaggcgtctcgatccccctaatgcatgaggccatgcagaaatggtactataaggatcctcagggcgagatccaaggcccttttaataaccaggagatggcagaatggttccaggcaggttactttacgatgtcacttctggttaagcgtgcctgcgatgaaagcttccaaccgcttggagacataatgaaaatgtgggggagagtgccattctcgcccggacctgcccctccgcctcacatgggagaattggaccaggagagactcactcgtcaacaggagcttacggccctgtaccaaatgcaacacctgcaataccagcagtttttgatacagcagcagtatgcacaggtactcgcacagcaacagaaagcagccctgtcatctcagcagcagcagcagctggctttgctcttgcagcaattccagacgctaaaaatgaggatctccgatcagaacattatcccttccgtaacacgctcagtgtctgtgcccgataccggaagcatttgggagctgcagcctaccgctagccagcccaccgtttgggagggcggaagtgtatgggacctgcctttggacaccacgacccccggacccgcactggagcagctccagcaactggagaaggccaaagctgctaagctcgaacaggagaggagggaggccgagatgagggcaaaaagagaggaagaggaacgcaagcgccaggaagagctgcggcgacaacaggaggaaatacttcgaaggcaacaagaagaggaaaggaaacgcagagaagaagaggaactcgccaggcgtaagcaggaggaagcccttcgacgacagcgtgagcaggagattgcgctcagacgccagcgagaagaagaagaacgccagcaacaggaggaggcgctgcggaggttggaggagcggaggcgagaggaagaggagagaagaaagcaggaagaactccttcgtaagcaggaggaagaagctgcgaaatgggccagggaggaggaagaagctcaacgcagattggaagaaaatagactgcgcatggaggaggaggccgcaagactgcgacatgaagaggaggaacgaaaaaggaaggaacttgaagtccaacgacagaaagagctcatgcggcagagacagcagcagcaagaggcccttaggcgacttcagcaacagcaacagcagcagcagctggctcagatgaaattacccagtagtagtacctgggggcagcagtccaacactactgcctgccagtcacaggctacgctttctctcgctgagattcagaagctagaagaagagcgagaacgccagctgagggaagaacagcgtcgacaacagagggaattaatgaaggcactgcagcagcaacagcaacagcagcagcagaaattaagcggctggggaaatgtgagtaagccaagtgggaccaccaagtccttgctagagatacaacaggaggaagcccgacagatgcagaagcagcagcaacagcagcagcagcaccagcagcctaatagggcaaggaacaatacccatagcaatttgcatacatcaattgggaattctgtctggggcagcataaatacaggccctcccaaccagtgggctagtgatctggtgtcatctatttggtccaacgccgatactaaaaattcaaacatgggcttttgggacgatgccgtgaaggaggtaggtcctcggaatagtacaaacaagaacaaaaataatgcgagcctgtctaaatccgtgggcgtgagcaatcggcagaataagaaggtggaagaggaggaaaaactgctgaagctctttcagggagtgaacaaggcccaggacgggtttacccagtggtgtgaacagatgttgcatgctctcaatacagccaacaacctcgacgtgcccactttcgtgtctttcctaaaagaggtcgagagtccctatgaggtccacgattatattcgggcatacctaggggacacaagcgaggcgaaggaattcgccaagcagttcttggaacggagggcaaagcagaaggccaatcagcagcggcagcagcagcaattaccacagcagcagcagcagcagcctccacagcagccaccccagcaaccccaacagcaggatagcgtgtgggggatgaatcactctactctgcacagcgtgttccaaactaatcagtctaacaatcagcagagcaattttgaggcggtgcagtctgggaagaagaagaagaagcagaagatggtccgcgcagatccaagcctcctggggttctcggttaatgcctcctccgaacgcctcaacatgggtgagattgaaaccctggatgactattag

SEQ ID NO: 225208 - DNA, 3900 bp, Artificial Sequence
  Description of Artificial Sequence: Synthetic coding sequence
atggccgcagagacacagacattaaactttggcccagagtggctgcgcgctctctcaagcggcggatctattacttccccacccctctccccagcgctaccaaagtacaaacttgccgactacaggtacggcagggaggagatgctcgcacttttcctgaaggataacaaaataccctccgacttgttagacaaggaattcttacccattttgcaagaggaaccactgcctccgctagcactagtaccattcacagaggaggaacagagaaacttctcaatgtcagtcaactctgctgccgttttacgactgaccgggagaggaggagggggtactgtcgtgggggctcctcgcggaaggagcagcagccgcggacgtggcaggggcagaggcgagtgtgggttctaccaacggagcttcgatgaggttgaaggggtgtttggccgtgggggtgggcgtgagatgcataggtcacaatcgtgggaagagcggggagacagacgattcgagaagccagggaggaaagatgttggacgtcccaatttcgaggagggcggacccacatccgtgggcagaaagcacgaatttattcggagcgagtcagaaaattggagaatcttcagggaggagcagaacggggaggatgaggatggagggtggcggttagcgggatctcggagagacggagagaggtggaggcctcattctccggatgggcctagatctgccggatggagagagcatatggagcgcaggcgccgattcgagttcgactttcgggatagggacgatgaacggggataccgcagggttcggtcagggagcggttctattgatgacgatagagattcgctgccggaatggtgccttgaggatgctgaggaagagatgggaacattcgacagcagcggtgcctttctctccctgaaaaaggttcagaaggagcccatccctgaagagcaggagatggacttcaggcccgttgacgaaggcgaggagtgctctgatagtgagggctctcacaatgaagaggctaaggagccggacaaaactaataaaaaggagggtgagaagactgaccgcgtaggggtggaggcctcagaggaaacaccacagacaagcagtagtagcgccaggccgggaacccccagcgatcatcagagccaggaggcaagccaattcgagagaaaagacgaacctaagacagaacagacggaaaaggccgaggaggaaacacggatggagaactcccttccggctaaagtcccttcgaggggtgacgagatggtggccgacgtccagcaacctctaagccagatcccttccgacacggcgagcccacttcttatcctccccccacccgtgccaaaccctagtcccacactgaggccggtcgaaactccagtggttggcgcacccggaatgggctcggttagtactgaaccggatgatgaggagggccttaaacacttggagcaacaagccgagaaaatggttgcgtaccttcaggacagcgcattggatgacgaacggttggcctcgaaattgcaggagcatcgggcaaagggtgtgtcaataccgctgatgcacgaggccatgcaaaagtggtactataaggacccccagggggaaatccagggcccattcaataaccaagagatggctgagtggttccaggcaggctatttcaccatgtccctgctcgtaaagcgggcttgcgatgaatccttccagccgctcggagacattatgaagatgtggggtcgcgttccctttagcccgggtccagctccgcctccacatatgggcgagctggaccaggaaaggctgactaggcagcaggagcttactgctttataccagatgcagcacctacagtatcagcagttcctcattcagcagcagtacgcacaagtcctagcccaacagcaaaaagccgctttgagttctcagcagcagcagcagctggccctcctgctgcagcagttccagacactaaagatgaggatttccgatcaaaatataatcccctcagtgacaagaagtgtgagcgttccagatacaggcagcatttgggagctgcagcctaccgcttcccagccgaccgtgtgggaggggggtagtgtgtgggatctccccctcgataccacgactcccggtcctgcccttgagcagctgcagcagcttgagaaagcaaaggccgcaaagctggagcaggagaggcgggaggccgaaatgagggctaagagggaagaggaagagcggaaaaggcaggaggaactccggcgacaacaggaagaaattcttcgcaggcagcaagaagaagagcgcaagagaagagaggaggaagagctcgctaggcggaagcaagaggaggctctccggcgacagcgtgagcaagagatcgctctgagacgtcagcgagaagaagaggaacgccaacagcaggaggaagccctacgacgtttagaagaaagaaggcgagaagaggaagagagacgcaaacaggaagaactcctgcggaagcaagaggaggaagcagcaaagtgggctcgggaggaagaggaggcccagagacgccttgaggaaaataggctccggatggaggaggaggcagccagactcagacacgaggaggaggaaaggaaacggaaggaactggaagtacagcgccagaaagaattaatgaggcagcgacaacaacagcaagaggcccttcgtcgcctccagcagcagcaacaacagcagcagctggctcagatgaaattgcccagcagctcgacctggggccagcagagcaacaccacagcctgtcaatctcaagcgaccttaagtctggccgaaatccagaaacttgaggaggagcgggaaagacagctccgggaggagcagcgcagacagcaacgcgagctgatgaaggcactgcagcaacagcaacagcagcagcagcagaaactgtcgggatggggtaatgttagcaaacccagtggaactacgaagtctcttctcgaaattcaacaagaggaggccaggcagatgcaaaagcagcaacagcagcaacaacagcaccagcagccgaaccgggctcggaacaacacgcactctaacctgcatacttcaatcggaaacagcgtgtggggaagtatcaatactggacccccaaaccaatgggcatcagacttggtgagttccatatggagcaacgctgacacaaagaattcaaacatgggattttgggacgatgcagttaaagaggtaggcccaaggaattctaccaataagaataaaaataacgcttccttgtctaagtctgttggcgtttctaaccgccagaataaaaaggtggaagaagaagagaagctattgaagctttttcaaggtgtgaataaagcccaggacgggtttactcagtggtgcgagcagatgcttcacgctctgaataccgcaaataacctggatgtgcccacctttgtgtcctttcttaaggaggttgagagcccttatgaagtgcatgactatattcgggcttaccttggggacacatcggaagccaaagaattcgctaagcagtttctggagaggagagccaaacaaaaagctaaccagcaaaggcagcagcaacagctgccacaacagcagcaacaacagcctcctcagcagccaccacagcagccacagcagcaggattcggtgtggggcatgaatcactcaacactacattctgtcttccagactaatcaaagcaacaaccagcagtccaactttgaggcagtgcagtcaggaaagaagaaaaaaaaacaaaaaatggtgagggcggatcctagtcttctagggtttagcgtcaacgcttcctccgagcggctgaatatgggtgaaattgagaccctggatgactattag

SEQ ID NO: 225209 - DNA, 2163 bp, Artificial Sequence
  Description of Artificial Sequence: Synthetic coding sequence
atggccgcagaaactcagaccctcaactttggaccagagtggctgagggccctgagctctggaggctctatcacgtctccaccattgtcacccgcactccctaaatacaagctggctgactatcgctatgggcgagaggagatgctggccttgttcctcaaggataacaagataccatccgatctcttggataaagagttcctgccaatactgcaggaggagccactaccaccactcgccttggttccattcactgaggaggagcagcgaaatttctctatgagcgtgaactcggcagccgtactcaggctgaccggccgtggaggcggaggaacagtggtcggggcaccgaggggtcggtcgtccagccggggacgcggtcggcctaatttcgaagaggggggtccgactagtgtgggacgcaaacatgagtttatccgtagtgagagtgaaaactggcgaatcttcagggaagaacaaaacggggaagacgaggatggagggtggcggttggccggttctagaagggacggcgagaggtggaggcctcatagcccagggtggcgggaacacatggaacggcgtcggagattcgaatttgatttccgggatagagacgacgaacgcggataccgaagggtcagatccgggagtggaagcatcgacgacgacagggacagcctgccagagtggtgtttagaggacgctgaggaagaaatgggcacattcgatagctcaggtgcttttttatccctgaaaaaggtccagaaagaaccaattcccgaagaacaggaaatggattttaggccagtcgacgaaggagaggagtgcagtgatagcgagggtagccacaacgaggaggcaaaggagcctgataagaccaataagaaggaaggtgaaaagacagacagagtcggcgtcgaggccagcgaagaaacccctcagacttctagttcttctgctcgcccaggtacgccctcagatcatcagagccaggaagcttcccagtttgaacgcaaggatgaacccaaaactgaacagacggaaaaagcagaagaagagaccagaatggagaacagcctgcccgctaaggtgcctagcaggggagacgagatggtggctgatgttcagcaacctttatcccagattcccagcgacacagcctcccctctgctgatcttacctccccctgtccccaatccaagccctaccctgaggccagtcgagactccagtggtgggcgctcccggaatggggtcggtttccactgaaccggacgatgaggaaggcttaaaacatttggaacaacaggcagagaaaatggtggcatatttgcaagattcggccttggatgacgaaagacttgcctcaaaactgcaggaacaccgggctaaaggggtctcgatccccctgatgcacgaagccatgcaaaaatggtattacaaagaccctcagggtgagatccaagggccattcaacaaccaggagatggcggagtggttccaagcaggctacttcactatgtcactgttggtgaaacgagcctgtgatgagagtttccaacccctcggagacatcatgaagatgtgggggagagtcccctttagccccggaccagcaccgcctccgcatatgggcgagctggaccaggagagactgactagacagcaagagctaacagccctgtatcagatgcagcacttacaataccagcagtttctcatacagcagcagtacgcacaagtgctggcccagcaacagaaggctgcactgagttcacaacaacagcagcagctagcattgcttctccaacagttccagaccctgaagatgcgcatctctgatcagaatatcattccttctgttaccaggagcgtgagcgtccccgacaccgggtcaatctgggagctacagccaacagccagccagcccacagtctgggaaggaggttcagtgtgggatctccccctggatactaccactcctggccctgcactggagcagctgcagcaactggagaaggccaaggccgctaaattagaacaggaacggagagaggcagaaatgcgtgcaaagagggaggaagaggagcgaaagaggcaagaagagctccgtaggcagcaggaagaaatcttaaggcgccagcaggaggaggaaaggtag

SEQ ID NO: 225210 - DNA, 282 bp, Artificial Sequence
  Description of Artificial Sequence: Synthetic coding sequence
atggcagctgagactcagacactgaacttcggacccgaatggttgagggccctgtcatccgggggatcgattactagtccacccctgagccccgcactccctaagtataagctggctgattaccgctatgggagagaggagatgttggctcttttccttaaggataacaaaattccatcagatttactcgataaggagttcctgccaatacttcaagaggagccattgccccctcttgccctggtcccctttacagaagaagaacagaggaactttagctag

SEQ ID NO: 225211 - DNA, 303 bp, Artificial Sequence
  Description of Artificial Sequence: Synthetic coding sequence
atggccgcagagactcagaccctgaactttggccctgagtggctgcgcgctttgtcatcaggcggatcaatcacctccccgccattgagccccgcactcccaaagtacaagcttgccgattatcgctacggaagagaagagatgctagcactttttctgaaggataataaaatccctagcgatctgctggataaggagttcctgcccattctacaggaagagccattaccgcctctggccctggttccatttacagaggaagaacagaggaatttcagtatgagcgtgaactcagctgcttag

SEQ ID NO: 225212 - DNA, 42 bp, Artificial Sequence
  Description of Artificial Sequence: Synthetic coding sequence
atggccgcagaaactcagacgctcaacttcggtcctgagtag

SEQ ID NO: 225213 - DNA, 348 bp, Artificial Sequence
  Description of Artificial Sequence: Synthetic coding sequence
atggcggctgaaacccagacactgaattttgggccagagtggcttagggccctctcatctgggggaagcattacaagtcctccgctttcacctgccttgcccaagtacaaactagctgattatcgatatggaagagaggagatgctggccctatttctgaaggacaacaagatacccagcgatctcctcgataaagaatttctccctatcctgcaggaagaaccacttcctccactggcactggttccatttacggaggaggagcagcgcaacttcagcatgtcagtcaattccgcggcagtattacggttaacgggtagaggcggaggcggaaccgtcgtgggctag

SEQ ID NO: 225214 - DNA, 321 bp, Artificial Sequence
  Description of Artificial Sequence: Synthetic coding sequence
atggctgccgagacccagactttaaacttcgggccagaatggctgcgagccctgtcctctgggggatccataacgtctcctcccctctccccagctctgccaaaatacaagctcgccgattatagatatggccgtgaggaaatgctggcactgttcctaaaagataataagattcccagcgacctcctggacaaggaatttctacccatcctgcaagaggagcccctgcctcccctggcgctagtaccctttaccgaggaagaacagcggaatttctctatgagcgtcaattcagcagccgtgctgagattgaccggatag

SEQ ID NO: 225215 - DNA, 342 bp, Artificial Sequence
  Description of Artificial Sequence: Synthetic coding sequence
atggcagccgagacgcagacattgaactttggcccagagtggctgcgggctttatcatcgggcggatcgatcaccagcccccctctctctcctgcccttcctaagtacaaattggccgattaccgttatggcagggaggagatgcttgccttgtttctaaaagataacaaaatacccagtgatctgctggacaaggagttcctgccaatcctgcaggaagagcccttgccacccctggcgctcgtgcccttcaccgaagaagaacagcggaacttctcaatgagtgtgaattccgcggcagtgttgcgtctcactggtcggggagggggaggcaccgtgtag

SEQ ID NO: 225216 - DNA, 2619 bp, Artificial Sequence
  Description of Artificial Sequence: Synthetic coding sequence
atgacaaaactccctgatgaccccggaagaccaaattttgaggaaggtggccctacatcggtgggtcgcaagcacgagttcattcgttccgaatctgaaaattggcgcatcttccgagaggaacagaacggcgaagacgaagacggaggatggagactggccggatcccggagggacggggagagatggcgccctcactcaccagatggtcctcgctccgcgggttggcgcgagcatatggagcgtaggcgcaggttcgagttcgattttcgggaccgcgacgatgagcggggttatcggcgagtcaggtctggttctgggagcatagacgatgacagagattctctacctgagtggtgcctggaagatgcggaggaggagatgggtacattcgattccagcggcgctttcctttctctcaaaaaggtacagaaagaacctatccctgaagaacaggagatggactttagacctgtggacgagggcgaggagtgctcagactctgagggtagccacaatgaggaggctaaagaaccggacaaaacaaataaaaaagaaggcgagaaaaccgaccgagttggagttgaagcgagcgaggagacaccacagacttcatcaagcagcgccaggccagggaccccctccgaccatcaaagccaggaggcgtcccagttcgagagaaaggacgagcctaaaactgaacagacagaaaaagcagaggaggagacccgcatggagaattcactgcctgccaaggtgccctctcggggagacgagatggtggcagatgtgcagcagccattgagccagatcccgtctgacacagcaagtcctctcctgatcctaccaccgcctgtcccaaatccttccccaactctgagaccagttgagacacctgtggtgggcgcaccaggaatgggctcggtgtcgactgaacctgatgacgaagagggactgaagcacctggagcagcaggctgagaagatggtggcgtatcttcaggatagcgccctcgacgacgagcgcctggcttctaagctccaggagcacagagccaaaggagtctctatccctttaatgcacgaggcaatgcagaagtggtactataaggatccccagggcgaaatccaaggtccatttaacaatcaggaaatggcggagtggtttcaggccggatacttcacgatgagtctccttgtcaagcgcgcttgtgacgagagctttcagcccttaggtgacattatgaagatgtggggtcgcgtcccttttagtcctgggccagcccctcccccacacatgggagaactggaccaggagagactcactcgtcagcaagaactgactgccttataccagatgcagcatcttcagtaccagcagtttctaatccaacagcaatatgcacaggtcctcgcccaacagcagaaggccgctctcagttctcagcagcagcagcagttggccctgctcctccaacaatttcagacattgaagatgcgcatcagtgaccagaacataattccctctgttacgagatctgtgagcgtccccgacaccggaagcatttgggagctgcagcctacagcctcacagccaacagtgtgggaaggtggatctgtctgggacctgcctctggatacaaccacaccaggacctgcattggagcaactgcaacaactggagaaagcaaaggccgctaagctggagcaggagaggagagaggctgagatgagagccaaaagggaagaggaggaaaggaagaggcaggaggaactgcgcagacagcaagaggagatcctgaggcgccaacaggaggaggagaggaagcggagggaagaggaggaactggctagacggaagcaagaagaggcactaaggaggcagcgggagcaggaaatcgcattacggagacagcgggaagaggaggaaagacaacagcaggaggaagccctaagacggctcgaggaaaggaggcgggaagaggaggaacgcaggaaacaggaggaattgctgcgaaagcaggaggaggaagcagcaaaatgggccagggaggaggaggaggcccagcggaggctggaagagaacagactccggatggaagaggaagccgcaaggctccggcatgaggaggaagagcgcaagagaaaagaattagaggttcaaaggcagaaggaactgatgcgacagagacaacaacaacaagaagctctccgcagattgcagcagcagcaacagcagcagcagctcgctcagatgaaactcccatcttcttctacctggggccaacagagcaatacaaccgcttgtcagagccaagcgacgttgtcacttgctgagattcaaaagctcgaagaggagcgggagcgccagctgcgcgaggaagaatcttccgcctctttttgtttctacgccactgccaaggcacccgcagaaggggttgatgaatcatcctccgctgccgctgctacagcgactgcagagactctcagactgggagagtgccagcagaccttccgctaccacgaaatcagttctggcgatccagcagggcgtggtcaggcaaatgcaaaagctgccgctgcggctgctgcaacgcccgctaccaagcagagctcttag

SEQ ID NO: 225217 - DNA, 2364 bp, Artificial Sequence
  Description of Artificial Sequence: Synthetic coding sequence
atggcggcagagacccagactctaaacttcggcccagagtggctgcgtgcactgtctagtggaggctctatcacctctccccctctttctcctgccttgcctaagtataagttggctgactataggtatggacgcgaagaaatgcttgccctgtttctcaaagacaataagattccatctgatctgctggataaagaatttcttccaatcttacaggaagaacctctgcccccactagcacttgtcccgttcacagaagaggaacaaagaaacttcagcatgtcggtgaacagtgccgctgtgctccgtctgactgggcgaggcggtggcggaacggttgtgggcgcaccaagaggtcggtcctcttcaaggggcagggggaggggcaggggagagtgcgggttttatcagcgatcctttgatgaggtggagggcgtgtttgggcgaggcggaggtcgagaaatgcatcggtcgcaatcctgggaggagcgcggtgataggaggttcgagaagcctggcaggaaggatgtaggcaggccgaactttgaggagggcggaccaacctccgtgggcagaaagcacgagttcatccgaagcgaaagcgagaattggagaattttcagggaagagcaaaatggcgaggatgaggatggaggctggcgactcgccggatcgcggagagatggtgagcgctggcgcccacattcacctgacggacctaggtccgccggttggagggaacacatggagcggcgacggagattcgagttcgacttccgggatagggatgatgagcgaggttatagacgggtccggtctggctcaggcagtattgacgacgatcgcgactccttgcccgagtggtgccttgaagatgcggaggaagagatggggacgtttgactcaagtggggcttttctgtctctgaagaaagtgcagaaggagccgattccagaggaacaagagatggattttcgacccgttgatgagggtgaagagtgttccgattccgaaggctcacacaatgaggaagccaaggaacctgataagactaacaaaaaagaaggtgagaagacggacagggtgggtgtggaagccagcgaggagacccctcagacttccagctccagcgctcgtcctggtaccccttcagatcatcagagccaggaggccagccagttcgaacgcaaggacgagcctaagacggagcagacagagaaagcagaggaagagacgcgtatggaaaatagtctgcctgcgaaggtgccctctaggggagacgagatggtcgccgacgtacagcaacccctgtcacagatcccatcagatacagcgtctccactgcttatcttgcccccaccagtccccaacccaagcccaacactgcgcccagtagagactcccgtggtcggggctcctggaatggggagtgttagtacagagccggacgacgaggaggggctcaaacacctggaacagcaggccgagaagatggttgcatatctacaggattctgctttagacgatgagcggctggccagcaagctccaggagcatagagctaaaggcgttagtattccgctcatgcacgaggctatgcagaaatggtactacaaagacccacagggggagatccaggggccatttaataaccaggaaatggcagagtggttccaggccggatactttacaatgtcactgctggttaagagggcctgtgacgaatccttccagcccctgggcgatatcatgaaaatgtggggtagggtgccctttagccccggtccagcgccaccacctcacatgggggaactcgatcaagagaggctcaccaggcaacaggaactaaccgccctgtaccagatgcagcatctgcagtatcaacagttcctgatccaacagcagtacgcccaagtcttggcccaacaacagaaagccgcactctcctcccagcagcagcaacagttagctctccttttgcagcagttccagacactgaaaatgcgaataagtgaccaaaacatcattccctccgtcaccaggtcagtgagcgtccctgacactggctccatttgggagctacagcctaccgctagccagccaacggtgtgggagggtgggagcgtttgggacctgcccttggacaccaccactcctggcccagccctggagcagttgcagcagctggaaaaagctaaggccgcaaaacttgaacaagaacgcagagaggctgagatgcgggctaaacgggaagaggaagagcggaagaggcaggaagagctaagacggcagcaagaggaaattttgaggagacagcaggaagaggaaaggaaacggagggaggtcggcaagcgggactcgtag

SEQ ID NO: 225218 - DNA, 3882 bp, Artificial Sequence
  Description of Artificial Sequence: Synthetic coding sequence
atggccgctgagacgcagactcttaactttggtcccgaatggttgagggccctaagcagcggaggcagtattacctcacctccactgagccctgccctgcccaaatacaaactcgccgactatagatacgggagggaggaaatgcttgccctcttcttaaaagacaacaagatcccgagcgatttgctggataaggaattcctccctatattacaggaggagcctctccccccattagcactcgtgcccttcaccgaggaagagcagagaaactttagtatgtccgtgaactcagctgccgtgttacgactgacgggcaggggagggggaggtacagttgtgggagcccctcgaggtcgatcatcgagtagggggaggggacgaggacggggagagtgcggattctaccagagatctttcgacgaagttgagggagtctttggaagaggcggaggtcgggagatgcacaggagccagagttgggaggagaggggtgatcgaaggtttgaaaagcctgggagaaaggatgtcggccgacccaatttcgaggaggggggtccgaccagtgtcggcagaaagcatgagttcattcggagtgagagtgaaaattggcgcatatttagggaggaacagaatggcgaggacgaagacggtgggtggcgcctggccggttcaaggcgggacggagagaggtggaggccacattcccccggttggcgggagcatatggaaagacggagaagattcgagtttgactttagggacagggatgatgagagagggtataggcgggttcgctccggctctggatctatcgatgacgatcgcgattccttgcctgagtggtgcttggaagatgccgaggaggaaatgggcacgtttgatagctccggggcttttctgagcctcaaaaaggtgcagaaggagccaatcccagaggaacaggaaatggatttccgccctgtggacgagggggaggagtgctcagatagtgaaggttcccataatgaggaagccaaagaacccgacaagacgaacaaaaaagaaggtgagaaaactgaccgcgtgggagtggaagcctccgaggagacaccgcagactagctcctcaagtgccaggcccggaactccaagtgatcaccaatcacaagaagccagccagttcgagcggaaggatgaacctaagaccgagcagaccgaaaaagccgaggaagagacacgaatggagaactcccttccggctaaagtgccctcacgcggagacgagatggtggccgatgtgcagcaacccttgtcacagattccttccgacacagcttccccgttgctcattttgcccccaccagttccaaatcccagcccaacacttcgccctgttgagacccctgtggtgggggcacccggtatgggctccgtgagcaccgagccagacgatgaggagggccttaaacacctggagcaacaggcagagaagatggtggcctatctacaggactctgcccttgacgacgaaagactcgcctcaaaattacaggagcatcgagctaagggcgtctccattccattaatgcacgaggcgatgcagaaatggtactataaggatccacagggagagatccagggacccttcaacaatcaggaaatggccgaatggttccaagccggatattttaccatgagcctgctggttaagagagcctgcgacgagagcttccagccccttggggacatcatgaagatgtggggcagagtgcctttctctcccggacccgctccacctccgcatatgggggaactcgatcaggaacgattgacacgccaacaagagctaacagcactgtaccagatgcagcatctccaataccagcaattcctcatacagcagcaatatgctcaagtgctggctcagcaacagaaggccgctttatcttctcagcagcaacagcagctggcgctgttactgcagcagtttcagacactgaaaatgcggatttccgatcagaacatcatcccgagtgtgacccggtcagtgtccgtgcccgacaccgggtcaatttgggaactgcaacccacggcttctcagcctacagtgtgggagggcggttccgtgtgggatcttccgctggacacgactacacccggtccagcccttgagcagttgcagcagctggagaaagccaaagcggcaaaactcgaacaggagagaagagaggcagagatgcgagccaaaagagaagaagaagagcggaagaggcaggaggaactccggaggcagcaggaggaaatcttgcgcagacagcaggaagaagagcggaagcggcgagaagaggaagagctagccaggaggaaacaggaggaggccttacgccgtcagagggaacaggaaatcgctctgagaagacagcgggaggaagaagaacgacaacagcaggaagaggcacttcgcagactggaggagagacggagggaagaggaggagaggcgcaagcaagaggaacttcttaggaaacaggaggaagaggccgctaagtgggcacgcgaggaggaagaggcccagcgcaggctcgaggagaataggctgcggatggaggaggaagccgcaagactccgacacgaggaggaggagcgaaaacggaaggaactggaggtacagcggcagaaagaactgatgcgacagagacaacaacagcaggaggccttgcgccgtctccagcaacagcaacaacagcaacagttggctcagatgaagctgccaagcagctctacatgggggcagcaaagtaatacgaccgcgtgccagtcccaggctacactgagtctggccgaaattcaaaagctggaggaagaacgcgagaggcaactgcgcgaagaacagcggaggcagcagcgcgagttaatgaaggccctgcaacagcagcagcaacagcagcagcagaagttgtcaggctgggggaacgtttctaagcctagcggtactaccaaatctctgctggagattcagcaggaagaagccaggcaaatgcagaaacagcaacagcagcagcagcagcatcaacagcctaaccgcgctcgtaacaatacgcatagcaacttgcataccagcatcggcaacagcgtctggggatctattaacactggccctccaaatcagtgggccagcgatctggtaagctcgatttggtccaatgccgacacaaaaaattcaaacatgggattctgggatgacgctgtgaaggaagttggcccacggaactcaacaaacaagaacaaaaataacgcgtccctgtctaagtctgtgggagtctctaacagacagaacaagaaagtcgaagaagaagaaaagctgttgaaactgtttcagggcgtcaataaagcccaggatggattcacacaatggtgcgaacaaatgctgcacgcactcaacacagcaaacaacctggacgtgccgacttttgtgtctttcctcaaagaggtcgagagtccatatgaagtgcacgactacattcgcgcatatcttggtgacacctccgaagccaaggagtttgccaaacaatttctcgaaaggagggctaagcagaaggccaatcagcaacggcagcaacaacagctgccacaacagcagcagcagcagccacctcaacagccacctcagcaacctcagcagcaagacagtgtttggggtatgaaccattcgaccctccactcagtcttccagaccaatcagtctaataaccagcagagcaacttcgaggccgtgcagtcaggaaagaaaaagaagaagcaaaaaatggtgcgagccgacccttccctgctcggcttttctgtcaacgcctcttcagagcggcttaacatgggagaaattgagacactggatgactattag

SEQ ID NO: 225219 - DNA, 3963 bp, Artificial Sequence
  Description of Artificial Sequence: Synthetic coding sequence
atggccgcagaaacccaaacactgaatttcggcccagaatggttaagagctctgagtagcggaggtagcattacatccccccctctgagtcctgcgcttccgaaatacaagctggccgattaccgctacgggcgagaagaaatgctggctctctttctcaaggataacaaaatccccagcgaccttttggacaaagagttcctgcctatcctgcaggaagagcccctgcccccactcgctcttgtgccatttaccgaggaggagcagcgcaattttagcatgtccgttaactctgcagccgtcctcagattgaccgggaggggaggtggaggtaccgttgtcggggctcccagggggagaagctcatcccgcggacgagggcgagggcgaggcgaatgtggtttctaccagcgcagtttcgacgaagtcgaaggcgtatttggtcgaggaggaggacgggagatgcacaggtcccagtcctgggaggaaaggggcgaccggaggtttgaaaagccaggcaggaaggacgtgggcaaaaaaaatggatactattgcatgtattcccccgtgctgctactggggcagccactctgccagggtcggcctaactttgaagaggggggacctacgagcgtcggcaggaaacacgaattcattcgcagcgagtctgaaaactggcgcatttttagagaagaacaaaacggggaagacgaggacggtggatggaggctcgctggatcgcgccgagacggagagagatggcggccacacagtcccgatggtccccgaagcgccggatggcgcgagcacatggaaaggcggagacggttcgagtttgactttcgagaccgtgacgatgagaggggctatcgaagggtccggtctggatctggctctattgatgacgatcgggactcgctgcccgagtggtgcctggaggatgcagaggaggaaatgggtacgttcgatagttcaggcgcattcttgtccctgaaaaaggttcaaaaggagccaatcccggaggagcaggaaatggacttcagaccggtggatgaaggcgaggaatgcagcgactcagaagggtcccataatgaagaagccaaggagcccgataagaccaataagaaagaaggcgagaaaaccgacagagtgggtgtcgccagtgaagagacgcctcaaacctcgagcagttctgctcgaccgggaacgccctcagaccaccagtcccaagaagcatcacaattcgagagaaaagatgaacctaagactgagcaaactgagaaagctgaggaagagactcggatggaaaattcccttcctgctaaagtgcccagcagaggagacgaaatggtggcagacgtgcaacagcctctgtcccagatacccagcgacacggcatcacccctcctgattctgccccctcctgtgcccaacccttcccccaccctcagaccagttgagacgccagtcgttggcgctcccggtatgggatcagtgtcaaccgagcctgatgacgaagaagggctgaagcacctggagcagcaagctgagaagatggtggcatatcttcaggattccgccctggacgatgagaggctggcttcaaagttgcaggagcatagggcgaaaggagtcagtattccgctgatgcacgaagcaatgcagaagtggtactataaggacccccagggagaaatccagggcccatttaacaaccaggagatggctgagtggttccaggcaggctacttcactatgtctttactagtgaagcgagcttgtgacgagtccttccagcctctgggcgacattatgaagatgtgggggcgagtgccctttagcccaggcccagctcctccccctcacatgggcgagcttgaccaggagagactgacccggcagcaggagctgacggcactatatcagatgcagcatctgcagtatcagcagttcttgatccagcaacagtatgctcaggtcctcgcacagcaacagaaggctgctcttagttcccagcaacagcagcagcttgcactacttctccagcaattccaaaccctcaaaatgcggataagcgatcagaatataatcccatccgttacccgtagtgtttctgtgccagatactgggtcaatatgggaactccagccgacagcttcacagcccacagtctgggaggggggtagcgtgtgggaccttcctctggacaccacaactccaggtcctgcactggagcaactacaacagttagaaaaagcaaaagcggcaaaactagagcaagagcggagagaggcagagatgagagccaaacgggaggaggaagaacgtaagagacaggaggaactccggaggcagcaagaagaaatcctgcggaggcagcaggaggaggagcggaagcggagggaggaggaggagttggcccgtcgcaaacaggaggaagccttaagaaggcagcgggagcaggagatagccctgcgacggcaaagggaggaggaggagcggcagcaacaggaggaggcactgcgacgtttagaggaacgccgaagagaggaagaggaacggcgtaaacaagaggagctgctgcgtaagcaggaagaagaggccgcaaaatgggcccgagaagaggaggaggcccagagacgtctggaagaaaaccgtctgcgcatggaagaggaagcagcacgcctgcgccacgaagaagaggagaggaagagaaaggaattggaggtgcagcgtcagaaggaactgatgagacagcgccagcagcagcaggaggcgctgcgccgtctgcagcaacaacagcagcagcagcagctggcgcagatgaaactaccttccagcagtacttggggtcagcagagcaatactaccgcatgccagtcccaggccaccctgtcactggccgaaatccagaagttggaggaggaacgggagcgtcagctgagggaggagcaacgccgacagcagcgcgagctcatgaaggctctgcagcagcagcaacaacagcaacagcagaaattatccggctggggaaatgtgtccaagccttccggcacaaccaagtcccttctggagatccagcaggaggaagccagacagatgcaaaaacagcaacagcaacagcagcagcaccagcagcctaacagggcacgcaacaacacacattcaaatctgcatacgagcatcggcaatagcgtctggggtagtatcaacaccgggccaccaaatcagtgggccagcgacctagtgtcctctatttggagcaacgccgacacaaaaaactctaacatgggattctgggacgatgctgtgaaggaagtgggccctaggaatagcaccaacaaaaacaagaacaacgccagcctgagtaagagcgtgggagtttcgaatcggcagaacaagaaagtcgaagaagaggagaagctcctcaaactgttccagggggtgaacaaagcgcaggacggctttacacagtggtgcgagcaaatgcttcacgctttgaataccgcgaataatttagacgtgcccaccttcgtttcctttttgaaggaggtcgagtcgccatacgaggtgcacgattacatccgtgcatacctgggagatacttcagaggctaaggagtttgctaagcagtttctagaaaggcgagccaaacagaaggccaaccagcagcgtcaacagcaacagctcccccaacagcagcaacagcaacctccgcagcaacccccacagcagccgcagcagcaggactccgtctgggggatgaaccactcaacacttcatagcgtgttccagacaaaccagtcaaataaccagcagagcaatttcgaagcagtgcagagtgggaagaaaaagaaaaaacagaagatggttcgcgcagaccccagcttgttgggttttagtgtgaacgctagctctgagcggcttaatatgggggagatcgagacattagacgactattag

SEQ ID NO: 225220 - DNA, 2085 bp, Artificial Sequence
  Description of Artificial Sequence: Synthetic coding sequence
atgagtggtggcgaggtagtatgctctggctggttacgtaagagcccacctgaaaaaaaactcaagcgttatgcttggaaacgtcgctggtttgtcctcaggagcggcagactaaccggggatcctgatgtgctggaatactataaaaatgatcacgcaaaaaaacccatccgcattattgacctcaacctgtgccagcaggtcgatgccggacttaccttcaataaaaaagagtttgaaaattcttacatcttcgacatcaataccattgaccggattttctatcttgtggccgactctgaagaagagatgaataagtgggtaaggtgtatttgtgacatctgcggctttaatccaactgaggaggacccggttaaaccaccaggtagttcattacaagctcccgctgacctgcccctggccattaacaccgcaccaccttccactcaggccgactcttcaagtgccaccttgccaccaccctaccaacttatcaacgtaccaccccacctcgagactctgggtattcaggaggaccctcaggattatcttctgctcattaactgccagtccaaaaagcctgagcccacccgaactcacgccgatagcgcaaagtccacctccagcgaaactgattgcaacgacaacgtgccatctcacaagaaccccgcaagttcacagtctaagcatggtatgaatggattttttcagcagcagatgatctacgactctccacctagtagagccccatccgctagcgtcgattcatccctgtacaacctgccgagatcctattctcacgatgttttgcctaaggtgagcccaagctcaacggaggctgatggcgaattgtacgtcttcaatacacccagcggtacttcctccgtagagacacagatgagacatgtgagcatttcttacgacattccccctacccccggaaacacgtatcagattccacgtaccttccccgaaggcacccttggacagactagcaagttagataccatcccagacattccccctccacggcctcccaagccacaccctgcccatgaccgatctccggtggagacgtgtagcataccgagaaccgcgtccgacaccgactccagctactgcatcccgacagcgggtatgagcccctcaaggagcaataccatcagtaccgtggaccttaacaagctgcggaaggatgccagctcccaggattgttacgacatccccagagctttccccagtgataggagctcctctctggaaggctttcacaaccattttaaagtaaagaatgtgctcacagtcggttcagtctcctcggaagagctcgatgagaattatgttcctatgaaccccaattctcctccccgtcagcactcatcctcatttactgaaccaatccaagaggctaactacgtccccatgacgcccggaactttcgattttagtagttttggaatgcaggtgccccctcccgctcacatgggtttccggtcgtctcccaaaactccccctcgaaggcccgtcccagtggcagactgtgaaccaccaccggttgaccgcaacctgaagcctgatcgaaaggtgaagccagctccactggagatcaagcccttacctgagtgggaggagctgcaggctcctgttaggtcacctatcactcggagttttgcaagggatagcagccgttttccgatgtccccccgtcctgactctgtgcacagcaccaccagctctagtgactcgcacgactctgaagaaaactatgtcccaatgaaccctaacctgagctccgaggacccaaatctcttcggatccaattccctggacggaggctcgtcccccatgataaaacctaaaggcgacaaacaggtggagtatctggatctcgatctcgattccggcaaatcgactccccctagaaagcaaaagtctagtggatccggctcgagcgttgctgacgagagggtcgattacgtggtcgtggatcagcagaagacactcgcactgaagagtactcgtgaagcctggacggatggtagacagagcaccgagtccgagactccggctaaatccgttaaatag

SEQ ID NO: 225221 - DNA, 2175 bp, Artificial Sequence
  Description of Artificial Sequence: Synthetic coding sequence
atgagcggcggagaggtcgtttgttcaggctggcttcggaaaagccctcctgagaaaaagctgaaaagatacgcctggaaacgaagatggttcgtgctcaggtcaggccgactgacaggcgacccagacgttcttgagtactacaagaatgatcatgccaagaaacccatcaggatcattgatctcaacttgtgtcagcaagttgacgctggtcttacctttaacaaaaaagagtttgagaactcctacatatttgatatcaatactatcgatcggatattttatttggtggcagattccgaggaggagatgaacaagtgggtgcgctgcatttgtgatatttgtgggttcaatcccacggaagaagacccagtaaaaccacccggaagttctctccaggcgccagcagatctgccacttgccatcaacactgctcccccttccactcaggccgatagctcctctgctactcttcctcctccttaccaactgattaatgtgcctccacacttggaaacccttggaattcaggaggatccacaggattacctgctgcttatcaactgccagtcaaagaaacccgaaccaacccgcactcatgctgattctgcaaaatctacatctagcgagactgactgcaacgacaacgtcccctctcataagaatccagcgagcagccaaagcaaacacggaatgaatggcttttttcaacagcaaatgatctatgatagcccaccatcaagggcaccttccgcttctgtagactctagcctttacaacctgccccgaagttatagtcacgacgttctgccgaaggtgtcacctagttctaccgaagctgacggcgagctgtatgttttcaatacaccaagcgggacttcttccgtcgagacccagatgcgccatgtgtcgatctcatatgacattcctcctacgcccggaaacacttaccagatccctaggacatttcctgaggggacattgggacagacttccaaattggacacaatcccagacatcccgccacccaggccccctaagccccatcccgctcatgaccgctcacctgtggaaacatgctctattccccgaacggcgtctgatacagattcttcgtactgtatccccaccgcaggaatgagtccatctagatctaacaccatctctactgtggacctgaataaacttcgcaaagacgctagctcccaggattgctatgatatccctcgcgcattcccttccgaccggtcatcctccctggagggttttcataaccatttcaaagtgaaaaacgtccttacggttggcagtgtgtcaagcgaggagctcgatgagaactacgtcccaatgaaccccaacagcccccctcggcagcacagcagctcctttaccgaaccgattcaagaagctaattacgtgccaatgacccctgggacctttgatttctcctctttcggcatgcaagtgccaccacctgctcacatgggcttccggtcaagccctaagacccctccaaggagaccggttccagtggcagattgcgagccgcctcctgttgatagaaatttaaagcccgataggaaaggccagagccctaaaatcctgaggctcaaaccccacgggttggagagaaccgacagccagaccatcggagatttcgcaacgagacgcaaggtgaaacccgctccgcttgaaatcaagcctttgccagagtgggaggagctgcaagcgcctgtgagatcgccaatcaccaggtcattcgctcgggactcaagcagattcccgatgagcccgagaccggactccgtccactcgacaacctcctcttcagactcgcatgactctgaggaaaactacgtacccatgaacccgaacctctcttctgaggaccctaacctgtttggctctaactcattggacgggggatcctcccctatgattaagccaaaaggagacaagcaggtggagtatctggacttggatcttgactcaggcaaaagcacgcccccacgcaaacagaagtcaagcggctctggctccagcgtcgctgatgagcgagtggattatgtggtggtcgaccagcagaagacccttgctttaaaaagtaccagagaggcctggactgacggaaggcagtctaccgagtctgaaactcctgccaaatcagttaagtag

SEQ ID NO: 225222 - DNA, 1776 bp, Artificial Sequence
  Description of Artificial Sequence: Synthetic coding sequence
atgaataagtgggttaggtgtatatgtgatatctgcggctttaatccgacagaggaggatcctgtgaaacccccaggctcttccctccaagctcccgcagatttacctttagccattaacaccgccccaccatccacccaggctgatagctcctccgccacactgcctccgccataccagctgatcaacgtccctccacatctggagacactgggaattcaggaagacccacaggactacctacttctgataaactgtcagtctaaaaagccagagcccactcgcacccacgccgactcggctaaatcaacaagctctgaaaccgattgcaacgacaacgtaccaagtcacaaaaatcctgcttcatcccaaagcaaacacggtatgaacgggttttttcaacagcaaatgatttacgatagtccccctagtcgtgcaccatccgccagcgtggattccagcttatataatctgcccaggtcctactcccacgatgtgttaccaaaggtgagccccagttctaccgaggcagatggagagctgtacgtgttcaatacaccttccggtactagttccgtggagacacagatgcgacacgtgtccatcagctacgacatccctcctaccccaggtaacacttaccagattccaaggacgttcccagaaggcacactgggacagactagcaaactggacaccatccctgacattccaccgccaaggcctccaaagccccaccctgctcatgataggtcccctgtggaaacctgcagtattcctagaacggcctccgatacagacagttcttattgtatcccgaccgctggtatgtccccatctcgcagcaatactattagcactgtggacctgaataaactcagaaaagacgcatccagccaagactgttatgacattcccagagcttttccttctgatcgtagcagctccctggaaggctttcacaaccactttaaagtgaaaaatgtgctgactgtggggagcgtgagttctgaagaactcgacgagaactatgtgccaatgaacccaaactctccacctagacaacactcctccagcttcaccgagccaattcaggaagctaattacgtccccatgacccccggaacctttgacttcagcagctttggcatgcaggtgccgcctccagctcatatggggttccgaagcagccccaagacacccccaagacgcccagtgccggtggcagattgtgagcccccacccgtggaccgaaacctgaagcccgataggaaggtcaaaccagccccattagagatcaaaccgctgcccgaatgggaagagttgcaggccccagtccggtcacccatcacgcggtcttttgcaagagactcctcccgcttcccgatgagtccacgaccagattcagtgcatagtaccacctcttcctccgatagccacgacagcgaggagaattatgtcccaatgaatcctaacttgtcctccgaagacccgaacctgttcggtagcaatagcctggatgggggaagcagccccatgataaaaccaaagggcgataagcaggttgagtacctggatctcgatctcgatagcggtaaatcaaccccccctaggaagcagaagagctcggggtccggctcctccgtcgctgatgaacgagtcgactacgtggtggtggatcagcagaaaaccctcgcccttaaatctactagagaagcctggactgatggccgacagtctaccgagtctgaaacacccgctaagagcgtgaaatag

SEQ ID NO: 225223 - DNA, 1917 bp, Artificial Sequence
  Description of Artificial Sequence: Synthetic coding sequence
atgagtggggaccctgacgtcttggagtactacaagaacgaccattccaaaaagccccttagaatcataaacctgaatttctgcgagcaggtcgatgctgggctaaccttcaacaagaaggagctgcaggatagttttgtcttcgatataaagacgagtgaacgaacattctatctcgtcgccgagactgaagaagatatgaacaaatgggtgcaatcaatttgccagatttgtggatttaaccaggccgaagagtcaactgatagtttgagaaatgtgtcatccgccggtcatgggcctcgcagctctcccgctgaactgtcttctagtagtcagcacctgcttcgtgagcgcaaatcatcagcgccttctcacagcagtcagccgactttatttacgttcgaaccgccagtctccaaccacatgcaacctaccctctccacctcggcccctcaagaatacctgtatttgcatcagtgcattagccggagggccgagaatgcccgtagtgcaagtttttcgcagggcacgagggcctcctttttaatgagaagtgacactgctgtgcagaagttagctcagggcaatgggcattgcgtcaacggtataagtgggcaagtgcatggattttatagcctgcctaagccgtctcggcacaatactgagtttagagactctacatacgatctgcctcggtctttggcttcacatgggcacacaaaaggctcgttaacaggatccgagaccgacaatgaagatgtgtatacctttaaaacgccaagtaataccctctgtcgcgaattcggagatctcttagtggataacatggacgtgcccgctactccattgagcgcttatcagatacctcgaacttttacacttgataaaaaccacaacgctatgacagttgcaactcccggagacagcgccatagctccccctccccgacctcccaagcccagccaggcagaaacaccgcgatgggggtccccccagcagaggccaccaattagtgagaacagtaggtccgttgccgcaaccattcccagaagaaacacactacctgccatggataacagccgcctccaccgcgcatcctcctgtgagacttacgaatatccacagcgcggtggagagagcgctgggagatcagccgagtccatgtcagatggggtggggagctttctaccagggaagatgattgtggggaggagcgattcaacaaacagcgaggataactacgttccgatgaatcctggcagtagtactctgctcgcaatggagcgggctggagataacagccaatcggtgtatattcctatgtccccaggggctcatcacttcgatagtctggggtacccgtctactacactgccagtccaccgtggccctagtcgcggtagcgagattcagccccctcccgtcaacaggaatctaaagccagacagaaaagctaagccaacccctctggacctccggaacaacacagtcatcgacgagctaccgttcaagagcccaatcacaaaaagctggtcgcgggcaaatcacaccttcaattcatcctctagccagtattgtcggccaataagcacccagtcaattacctccacagactctggagatagcgaggaaaactacgttcccatgcagaatcctgtgagcgcctcacccgttccatccgggaccaactctccagcaccgaagaagagtaccggttcagtggactacctcgcactggattttcaaccatcgagtccttccccccatcggaaaccctcaacctccagcgtgacatctgatgaaaaggttgattacgtacaagtggataaggagaagacgcaagccctccagaacaccatgcaggaatggacagacgtgcggcagagtagcgaacccagcaaaggtgcgaagctttag

SEQ ID NO: 225224 - DNA, 2031 bp, Artificial Sequence
  Description of Artificial Sequence: Synthetic coding sequence
atgtctggcggaggagatgtcgtctgcaccggatggttacggaaatcaccacctgagaaaaaactcaggcggtacgcctggaagaaacgctggtttattctaaggtcaggcaggatgtcaggcgaccccgacgtgcttgagtactacaaaaacgatcactcaaaaaagcccttgcgcatcattaatttgaatttttgtgagcaagtggatgcgggtctgactttcaacaaaaaagagctgcaggatagctttgtgtttgatattaagacaagcgagcgtaccttctacttagtggctgaaaccgaggaagatatgaacaagtgggttcaaagcatctgccagatctgtggcttcaatcaggccgaagagagcacagattccttgaggaacgtctcctcagcaggccatggtccgagatccagccccgctgaactgagtagctcttctcagcatctgctccgcgagagaaagtcttctgccccaagtcactccagtcagccaactctgttcacattcgaaccgccagtctctaatcatatgcagccaaccctgagtacctctgcccctcaggaatacctttacctgcaccaatgtattagtcgcagagccgagaacgctagaagcgcgtcattctcccagggaactcgcgcttcgtttctaatgcgctcagacactgcggtacaaaagttggcccaaggaaacggacactgtgtcaatgggattagcggacaggtccacgggttttattctctccctaagcctagcaggcacaacactgagttcagagactccacgtatgatctgccccgaagtctcgctagccatggacatacgaagggttctctgactggatctgagaccgacaacgaggacgtttacacgtttaagactccaagcaataccctgtgtcgcgagtttggggatctgcttgtagacaatatggacgtaccagccacaccactgtccgcataccaaattcccagaacattcacactggacaagaaccacaatgctatgactgtggctacccccggagactccgcaatcgctccgccacctcgtcccccaaaaccttcccaggctgagaccccaaggtggggctccccgcaacaaagacctccgatcagcgagaacagtcgcagtgtggccgctactatccctagacggaacaccttaccggctatggacaatagcagactgcacagggccagcagctgcgaaacctacgagtacccccaaagagggggtgagagcgcgggtcgaagtgccgaaagcatgtctgacggggtgggatcgttcctgcccggaaagatgattgtaggccgatctgatagcacaaactctgaggacaactacgtgcctatgaatccagggagtagcacgctgctggcaatggaacgagcgggagacaactcccaaagcgtgtatatccccatgtcgccaggcgcacatcactttgattctttgggctacccgtcaacaacccttcctgtccatcgaggaccttctaggggttcggaaattcagccgccaccagtgaataggaacttaaagcccgatcgaaaagcaaaacccactcccctcgaccttagaaataatacggtcattgacgaactgcccttcaagagtccaatcacaaagtcgtggagccgggcaaatcacactttcaattcatcatcatcacagtattgtaggccaatatccactcagtcaattacttcaacggattctggcgattcggaagagaattatgtacctatgcagaatccggtgtcagcctcacctgtgccctctgggacaaactcacccgctcctaagaagtccaccgggagcgtagactacctggctctggacttccagccttccagtccgagccctcatagaaaaccatccacatctagtgttacctctgacgaaaaagtggattatgttcaggtggacaaggaaaagactcaggcactgcagaacaccatgcaggagtggacggacgttcgtcaatccagcgagccctccaaaggggctaagctgtag

SEQ ID NO: 225225 - DNA, 396 bp, Artificial Sequence
  Description of Artificial Sequence: Synthetic coding sequence
atgagcggggaccccgatgtgctggagtactacaaaaatgaccactccaagaagcccctgcgcattatcaacctcaacttttgtgagcaagtcgatgccggtctgacgttcaataaaaaggagcttcaggatagcttcgtttttgatattaaaacttctgagcgcacattttacttggtagcagagaccgaggaggatatgaacaagtgggtccagtcaatttgtcaaatttgtggctttaaccaggccgaggagagcacggactccctacggaacgtctcgagtgctggccacggaccaagaagtagtcccgcagagcttagctcgtcttcccagcacctcttgagagaacggaaatcctccgccccttcccactcctcccagcctaccctttag

SEQ ID NO: 225226 - DNA, 309 bp, Artificial Sequence
  Description of Artificial Sequence: Synthetic coding sequence
atgtccggcgaccctgatgtcctagagtattacaagaatgatcatagcaagaaacctctacgcatcatcaacctaaacttctgcgagcaggtggatgccggactgacattcaataaaaaagaacttcaggactctttcgtcttcgacatcaagacctcagagcggaccttttacctcgtggcggaaacagaggaagacatgaacaagtgggtccagagtatctgtcagatctgtggctttaatcaggctgaagagtctactgacagcctcagaaatgtcagttcggccggtcatggcccacgtagttag

SEQ ID NO: 225227 - DNA, 993 bp, Artificial Sequence
  Description of Artificial Sequence: Synthetic coding sequence
atggaggcggttgcgaagttcgatttcactgcctcaggcgaggatgagctctctttccacaccggtgatgtcctgaagatcctctctaatcaagaagaatggtttaaagccgagctgggcagccaagaaggttatgtgcctaaaaatttcatcgacattcagttcccaaagtggttccatgagggactgagccgtcaccaggccgaaaacctactgatgggcaaagaagtgggatttttcattatcagggcgtctcagagctctccaggcgatttttccatcagtgtgaggcatgaggatgatgtccaacacttcaaagtcatgcgggacaacaaaggcaattatttcctttggaccgaaaagtttccatcgttgaacaagctggtcgactactaccgcactaactccatcagccgccaaaaacagatatttcttcgggacagaacgcgggaggaccaggggcatcgcggtaactccttagatcggaggtctcagggaggcccacatctgagtggagccgtcggcgaagagattagacccagtatgaatcgcaaactctcagatcatccacccacacttccgttacagcagcaccagcaccagcctcaacctccacagtacgctcctgcgcctcagcagctacaacagccaccacaacagaggtatctccaacaccatcattttcaccaggagagacgcggaggttcactggacatcaatgacggacactgcggcaccggtcttggttcagaaatgaatgctgcactcatgcacaggcgtcataccgacccagtgcaactgcaagccgctggcagggtgagatgggctcgcgcattgtacgactttgaggcactggaggatgatgagctgggttttcattccggcgaggtggtggaggtcttagactcgagcaatccctcatggtggaccggacgcctccacaataaattgggcctgtttccagcgaactatgtggcgcctatgacaaggtag

SEQ ID NO: 225228 - DNA, 654 bp, Artificial Sequence
  Description of Artificial Sequence: Synthetic coding sequence
atggtttcccggagacccctgtctaccccgggacgcgagttgacacatggccaaggcggatggctgctccaccaccctgggcagccagagctgccgcgtgggctgctacatctgtgccagggccacagaggaaactctttggacaggcggtctcagggtggccctcacttgtccggggctgtcggggaagagatacgtccctctatgaacaggaagttgagtgatcacccacccacacttccgctccaacagcaccagcatcagccccaacctcctcaatacgccccagctccacagcagctccagcagcccccacagcagcgatacctccagcaccatcattttcaccaagaacgcaggggaggatctctagacattaacgacggccattgtggaacaggcctcggcagcgaaatgaacgccgcattgatgcaccggaggcacacagacccggtccagcttcaggccgctgggagggtgagatgggcccgtgcgttgtacgacttcgaggcacttgaggatgatgagttgggttttcactccggagaagtggtggaagtgttggacagttcaaacccgagctggtggactggcagactgcacaataagctcggtttgttcccagctaactacgtagctcccatgacccgctag

SEQ ID NO: 225229 - DNA, 993 bp, Artificial Sequence
  Description of Artificial Sequence: Synthetic coding sequence
atggaagccgtggctaaatttgacttcactgcaagtggtgaggatgaactatcttttcatacaggagatgtgctaaagattctctccaatcaagaggaatggttcaaggccgagctggggagccaggagggttacgttcccaagaattttattgatatccaattcccaaaatggtttcacgaaggactctcccgccatcaggccgagaatctgctcatgggaaaagaggtaggttttttcatcatacgcgcatcacaaagtagtccaggcgacttcagtatcagcgtccggcatgaagatgatgttcagcatttcaaggttatgcgggacaacaagggcaactacttcctttggaccgagaagttccccagcctgaataaacttgtcgattattatcgaacaaattccatctcccgccaaaagcaaatcttcctgagagatagaacccgcgaggatcaggggcacaggggcaactccctcgatcgcagatcacagggcggaccacacctttccggggctgtcggcgaggaaatacggcctagtatgaaccggaagctgtctgatcaccctcccaccctcccgctgcagcagcaccagcaccagccacagccaccccagtacgctcccgcacctcagcagctgcagcagcctccccagcaacgatatctccagcatcaccattttcatcaggagcgacgcggagggagccttgatatcaatgatgggcactgtggtacagggctgggctcggagatgaacgccgctttaatgcataggaggcacacagatcccgtgcaattacaggccgcaggcagagttcggtgggccagggctctgtacgacttcgaggcgcttgaagacgacgagctgggtttccacagcggcgaggtggtcgaggtgctggacagctctaacccctcatggtggactggacgactccacaacaaattgggcttattcccagcaaactatgttgcccctatgaccagatag

SEQ ID NO: 225230 - DNA, 294 bp, Artificial Sequence
  Description of Artificial Sequence: Synthetic coding sequence
atggaagccgtagccaaatttgatttcaccgctagcggtgaagatgagctgtccttccacacaggcgacgtgctgaagattctctccaaccaggaggagtggttcaaggcagaactgggcagccaggagggatacgtgcctaagaacttcatagacattcagttcccgaagtggttccacgagggattgagtcgtcaccaggccgagaatctcctcatggggaaagaggtaggatttttcatcataagagccagccagtccagccctggggacttctccataagcgtgaggtag

SEQ ID NO: 225231 - DNA, 795 bp, Artificial Sequence
  Description of Artificial Sequence: Synthetic coding sequence
atgctggagttcgtcagtttgcttgccaggaaggactcaaacaactcagtttctaagccacggcacaaactgaaccccttttcctccaaacgccatgaggacgacgttcagcattttaaggtcatgagagacaacaagggaaattactttctgtggacagagaagtttcccagtctcaataaactggttgactactacaggacaaactcaatctcccgacagaagcagattttcctgagggacagaaccagggaggatcagggacacagaggcaattcgcttgatcgcagatcacagggcggaccacacctgtctggcgctgtcggtgaggagattagaccatccatgaacaggaaactgtccgaccatccccctactttacctctgcaacaacatcagcaccaaccccagccgcctcagtacgcaccggctccacagcagcttcagcaaccaccacagcagagatatctccagcatcaccacttccaccaggaacggaggggcggatctctcgacatcaacgacggacattgcgggaccggactcggctccgagatgaacgccgctttgatgcacaggagacacactgatcctgtgcagctgcaggcagccggaagggtcaggtgggctcgggctttatacgacttcgaggctcttgaagatgacgaactaggatttcattccggggaggtggtggaagtcctggattcttccaacccatcctggtggactggccgactccacaacaagctgggcctgtttccagccaactatgtcgcccctatgacacgctag

SEQ ID NO: 225232 - DNA, 837 bp, Artificial Sequence
  Description of Artificial Sequence: Synthetic coding sequence
atggaagccgtcgcgaaattcgatttcactgccagtggagaggacgagttatcatttcacacaggcgatgtcttgaagattcttagtaaccaggaagaatggttcaaggccgagctgggctcacaagaggggtatgtgcccaaaaatttcattgatattcagtttcctaagcatgaagatgatgtgcagcacttcaaagtcatgagagacaacaaagggaactatttcctttggacggaaaagtttccctctctgaataaacttgtggactactatcgaactaactctattagccgccagaagcagatattcctgcgtgatcggacaagagaggaccagggacacaggggcaattctttggatcgaaggtcacaggggggacctcatctgagtggagctgtgggagaggagatccgacctagcatgaacaggaagctctcagatcatccacctaccctgcctcttcagcagcaccaacatcaaccccagcccccacagtacgccccagcaccacaacagctacagcagccacctcagcagcgatatttacagcaccatcactttcaccaggagcgcagggggggaagtctggatatcaacgacggtcattgcggcaccggactcggcagcgaaatgaatgccgcactgatgcaccgtaggcacacagatcctgtgcagctccaggctgccggtagagtgaggtgggcaagagccctgtacgacttcgaggctctggaggaggtgctggactccagcaatccctcatggtggacagggcgactgcacaacaagcttggactgtttccagccaactatgtggcccctatgactagatag

SEQ ID NO: 225233 - DNA, 915 bp, Artificial Sequence
  Description of Artificial Sequence: Synthetic coding sequence
atgctggagtttgtgtcactgctggcacgcaaagacagtaataattcagtatctaagccaagacataagctgaaccctttttcatcaaaaagatggtttcacgagggcttgagccgccaccaggcggaaaacttgctgatggggaaggaagtcggcttctttattatacgggctagccagtcatcacctggcgatttctccatctcggtccgccatgaagacgacgtgcagcacttcaaggtgatgcgggataacaaggggaattatttcctttggaccgagaagttcccctctttaaacaagctggtcgactattaccgtaccaacagtatctcccgtcagaagcagatcttcctgcgggatagaacacgcgaggaccaaggccatcggggaaactctctggataggagaagtcaagggggaccgcacctgtctggggcagtgggggaggagattagaccatccatgaatcggaagctgagcgatcacccaccaacgctgccattgcagcagcatcaacatcaacctcagccccctcagtacgccccagccccacaacagctgcaacagccaccccaacagaggtacttgcagcaccatcacttccaccaggagcggagaggtggatcactcgacattaacgacgggcactgcggcacgggcctaggctcagaaatgaatgcagcgcttatgcatcgtagacacactgaccctgtgcaattgcaggccgcaggacgtgtccgatgggcacgggctctgtacgatttcgaggccctggaggacgacgagctgggattccactccggcgaggtagttgaggtgcttgactcatcaaacccatcctggtggaccggacgtctgcataacaagctgggcctgttccctgccaattacgtggcccctatgactagatag

SEQ ID NO: 225234 - DNA, 777 bp, Artificial Sequence
  Description of Artificial Sequence: Synthetic coding sequence
atgggcaaagaagtggggttttttatcatccgggcttctcagtcctcacctggagatttctccatttcggtgagacatgaggacgacgttcagcactttaaagtaatgagggataacaaagggaattattttctgtggacagaaaagttccccagcctcaacaaactggttgactactaccgcaccaactcgatttccaggcaaaaacagatatttctacgggatcgaacacgggaagatcaggggcatcggggtaactccctggatcgtcgctcacaggggggtccccatctgagcggcgcagtgggcgaggaaatcaggccgtcaatgaatcggaagctgagtgaccacccacctacattgcctcttcagcagcaccagcatcaaccacaaccaccacagtatgctcccgctccccaacagctccagcagcctcctcaacagagatacctgcaacaccaccatttccatcaagaaaggcgcggtggctcgctcgatatcaatgacgggcactgcggtacaggcttgggtagtgaaatgaatgcggctctcatgcaccgccgtcatacggaccccgtacaacttcaggccgcaggccgtgtgagatgggccagggcgctgtatgactttgaggccctcgaagacgacgagctggggtttcatagcggcgaggtggtggaggtgttagatagcagcaacccctcttggtggaccggaaggctgcacaacaaactcggtctattccccgcaaattatgtcgcacctatgaccagatag

SEQ ID NO: 225235 - DNA, 507 bp, Artificial Sequence
  Description of Artificial Sequence: Synthetic coding sequence
atgttctggaagttgagtttgtcccttttcctggtagcagtgcttgtgaaagtcgccgaggccagaaaaaatagacctgcaggagctattccaagtccttataaagatggaagctctaacaactctgagcggtggcagcatcagatcaaagaagttcttgcatcaagccaggaggccctggtagtcaccgaacgcaaatatctgaagagcgattggtgcaaaacccaacccctcaggcaaacggtctctgaagaagggtgccggtcccggacgatactgaaccggttttgttatggtcagtgtaactccttttacataccaaggcacgtgaagaaggaagaagagtcctttcagtcatgtgcattctgtaaacctcagagggttaccagtgtgctggtggagttggagtgtcctggcctcgatccaccattccgcctcaagaaaatccagaaggtgaaacaatgtcggtgtatgagcgtcaacttatccgattctgataagcagtag

SEQ ID NO: 225236 - DNA, 1443 bp, Artificial Sequence
  Description of Artificial Sequence: Synthetic coding sequence
atggccggtacccggtgggtacttggtgctttactcagagggtgtggatgtaactgtagctcctgcagacgaactggagctgcatgtcttcccttctactccgccgctggctctatcccatccggtgtgtctggtcgcaggcgtctccttctgctgctgggcgctgcggcagctgccgcatcacagactagaggattacaaaccggtcctgttccacccggaagactggcaggaccgccagccgttgcaacatccgccgctgctgctgcagccgcaagttattccgctcttagagcaagccttctccctcagtctctcgctgctgctgccgctgtgcccacacgctcttattctcaggaaagtaaaactacctacctggaagacctaccccctcctcctgagtatgagttggctcccagcaagctggaagaagaggttgacgatgtgttcctgatccgcgctcagggtctcccttggtcgtgtaccatggaagatgtgttgaacttcttcagcgattgtcgcatccgtaatggagagaatgggattcattttctcctaaacagagatggcaagcggagaggcgacgcattgattgaaatggagagcgagcaggacgtgcaaaaagctctcgagaagcacagaatgtatatggggcagcgctatgtcgaagtttacgaaattaacaacgaagatgttgacgctctaatgaagtccctgcaggtgaagagctctccggtggtcaatgacggagtggtccggctgcgaggcctgccttacagctgcaatgaaaaagatatcgtggattttttcgcgggactgaacattgtggacattacatttgtgatggactacagaggacggagaaaaaccggcgaggcgtacgtgcagttcgaagagcctgaaatggccaaccaggccctcctgaaacaccgagaggagattggtaaccgatatattgagatcttcccctccagaaggaatgaagtgcgtacccacgtaggatcttacaaggggaagaaaattgcttctttccctaccgctaagtacatcacagagcctgaaatggtgttcgaggaacacgaagtgaatgaggacatacaacccatgaccgccttcgagtccgagaaagagattgagttgcccaaggaggtgccagagaagctgccagaagccgcagactttggcactacctcctcacttcattttgtgcatatgagggggctgccgttccaggcaaacgcccaggacataatcaattttttcgctcctctgaaacctgtaagaattacaatggaatacagcagctctggcaaggcaaccggtgaggcggatgtccactttgagacccacgaggacgccgtggctgctatgcttaaagataggtcgcatgtgcatcataggtacatcgagctctttctcaactcttgtcctaagggcaagtag

SEQ ID NO: 225237 - DNA, 957 bp, Artificial Sequence
  Description of Artificial Sequence: Synthetic coding sequence
atggaggacgtcttaaatttttttagtgactgccgaatcaggaatggtgagaacgggatccatttccttttaaacagagatgggaagaggagaggggatgctctgattgagatggaatctgaacaggacgtccaaaaagcacttgagaagcacaggatgtatatgggacaacgatatgtggaggtttacgagattaataatgaagatgtggacgccctgatgaaatctttgcaggtgaaaagcagtccagtggtcaatgacggcgtcgtgagacttaggggcctgccctactcctgcaacgagaaagatattgtagactttttcgctgggttgaacatcgtcgacatcacgtttgttatggactataggggacgtcgcaaaactggggaggcctacgttcagttcgaagagccggaaatggcgaatcaggccctgcttaagcaccgggaagagatcggtaatagatatatagagattttccctagccgtcgcaatgaggtacgtacacacgtcggatcatacaaaggaaagaagatcgcatcattccccactgcaaaatatattacagagcccgagatggtgtttgaagagcatgaggtcaatgaggacatccagcctatgacagcgttcgaaagtgagaaggagatcgaattgccaaaggaagtgcccgagaaactacctgaggcagctgattttggtacaaccagttcactccattttgtgcacatgcggggattacctttccaggcgaacgcccaggatatcatcaatttcttcgcccctcttaaacccgtcaggatcaccatggagtacagcagtagtggtaaagccacaggcgaagctgatgtccacttcgagacacacgaggatgcagtcgctgctatgctgaaagataggtctcatgtccatcaccggtatattgagttattcttgaatagttgtcccaaaggcaagtag

SEQ ID NO: 225238 - DNA, 1362 bp, Artificial Sequence
  Description of Artificial Sequence: Synthetic coding sequence
gcagctgccgtgcccactcgatcttattcccaggttcgaggtagacgggaaggccctggtgccaggtctctgccaggacgagttcacgcaccgcctcgcccaagcgtccccccttgcgcgccacggggtcatgctcgcggaagcgcaactttggctgcacacccccctccttcaacactgtgtagctattgggctttagaacaggggaaactgagtcaggcctctggattgctgctggtgctgtttagtccacgtgtgtcaggacggctcggctctgaaagcaagacgacgtatctggaagacctgcctcctccaccagagtatgaattggcaccttctaaactggaagaagaggtcgacgatgtgttcttaatacgagcccaaggactcccttggagctgcacaatggaggacgtactcaattttttcagcgactgccgaatcagaaatggcgaaaacggaattcacttccttctgaaccgtgatggaaaaagacgcggagacgctctgatcgaaatggagtccgaacaggatgtgcagaaggcgctagagaagcatcgcatgtatatgggtcagcgatatgtggaagtctacgaaataaataatgaagatgtggacgctcttatgaagtctctgcaggtgaagagttcccccgtggtgaatgatggtgtcgtgaggctcaggggtctgccatacagctgtaacgagaaagacatcgtggatttctttgccggattgaacattgtcgacattacctttgtcatggattatcgcggacggaggaaaacaggcgaggcttacgtgcagttcgaggaacctgagatggcaaaccaggctctcctcaagcaccgggaggaaattgggaatagatacatcgaaatattcccttcgaggaggaatgaggtccgcactcatgtgggctcctacaaggggaagaaaatcgcctccttcccaacggcaaaatacattactgaacctgagatggtgtttgaggaacacgaagtcaatgaggacatccagcccatgacagctttcgaatccgagaaagaaatagaacttcctaaagaagttcccgaaaagttaccagaagcagcagatttcggaacaactagcagcctgcacttcgtgcatatgcgcggactccctttccaggcaaacgcccaggatatcataaatttttttgcacctctgaagcccgttcggatcaccatggagtattcctcttctggaaaagctaccggtgaggcagatgtgcacttcgagacccacgaggacgccgttgcagcgatgcttaaagacagatcgcatgttcaccaccggtacatcgaactgttcctgaactcatgccccaagggcaaatag

SEQ ID NO: 225239 - DNA, 957 bp, Artificial Sequence
  Description of Artificial Sequence: Synthetic coding sequence
atggaggacgtgctcaatttcttttctgactgtaggatccggaacggcgagaacggaatccatttccttctcaatcgtgacggcaagcgacgaggggacgccttgatagagatggagtctgagcaagacgtacagaaggctctagaaaaacacaggatgtacatgggacaaaggtacgtggaagtgtatgaaattaataatgaggatgtcgacgcccttatgaaaagcctgcaggtgaagtcctcccccgtcgttaacgatggggtggtgcggcttagaggcctgccctacagctgcaatgagaaagacatcgttgatttttttgctggtctcaatatcgtggatatcacattcgtaatggattacagaggcaggagaaaaacaggcgaggcctatgtgcaattcgaggagccggagatggcaaaccaagccctgctcaagcatcgagaggagattggcaaccggtacatagaaatctttcccagtcgaagaaatgaggtgaggacccatgtgggatcttacaaggggaagaaaattgcctcttttcccactgccaagtatatcacggagccagagatggtgtttgaggagcacgaagtgaacgaggatattcagcctatgaccgcttttgaaagtgaaaaggagatagagcttccaaaggaggttcccgagaaactcccggaagcggcagacttcggtactacctcaagtttgcactttgtccacatgagaggacttccgtttcaggcaaacgcccaggacattataaactttttcgcaccgctgaaaccagtcaggatcacaatggagtacagtagttccggcaaggcaacgggagaagccgatgttcacttcgaaactcacgaagatgctgtggctgctatgctgaaagacaggagtcatgtgcaccaccggtatatcgagttattccttaatagctgccctaagggcaagtag

SEQ ID NO: 225240 - DNA, 1254 bp, Artificial Sequence
  Description of Artificial Sequence: Synthetic coding sequence
tgaccaccaccgtccaccctctgttcctattgggcattagaacaaggaaaactttctcaggcgtccgggctcttactagtgctattttccccacgtgtgagtggtaggctggggtccgtatcggttgccggtgtgaatgtcgaagctctgttccccgcttggcctatggagtctaagaccacgtaccttgaggacctgcctccaccccctgagtacgaattagccccaagtaaactggaggaggaggtggatgacgtatttctaattcgtgcacaagggctcccatggtcttgcactatggaagacgtgctgaattttttctccgattgccggattcggaacggagagaacggcatccattttttgctgaaccgggatggcaaacggagaggcgacgctctgatcgaaatggaatccgagcaggatgtgcaaaaggccctggagaagcaccgaatgtacatggggcagcgctatgtggaggtgtacgagatcaataacgaggatgtggacgccttaatgaaatcactgcaggttaaatcttctccggtggtaaatgacggcgtggtcagactgcgcggtttgccatatagctgtaatgaaaaggacatcgtagacttctttgctggtctcaacatcgtggacatcaccttcgtgatggattaccgtggtcgcagaaagacgggagaggcttatgtgcagttcgaggagcccgaaatggctaaccaggcgctgctgaaacaccgagaagagattgggaacaggtacattgagatcttccctagccgtagaaacgaggtgcggacccacgtaggctcttataagggcaaaaaaattgcttcgttccctaccgcaaagtacattacagaacccgagatggtttttgaagaacatgaagttaacgaggatatccagccgatgacagctttcgaaagcgagaaggagatagagctccccaaggaagtgcccgaaaaattaccggaagccgcagactttggtacaactagttcccttcactttgttcacatgcgcggactccctttccaggcaaacgctcaagacattataaacttttttgcccctttgaaaccagtccggatcacaatggagtacagtagttctgggaaggcaactggcgaagctgatgtgcacttcgagacacacgaggacgctgtcgccgcaatgctcaaggatcgatcacacgtccaccatcggtatatagaactgtttctgaactcgtgtcccaaagggaagtag

SEQ ID NO: 225241 - DNA, 1239 bp, Artificial Sequence
  Description of Artificial Sequence: Synthetic coding sequence
atggccggtacccgctgggtgctaggtgcactgcttcgaggctgtggatgcaactgttcctcatgccggcgtaccggagcagcatgcctgccgttctattccgccgctggctcaatacccgctgcagcggtgccgacccgatcttactcacaagagtcaaagacaacatatctggaagacctacctcctcccccagagtacgaactcgccccatctaaactagaggaagaagtggacgatgtctttctgatccgtgcgcaaggcctaccatggagctgtacgatggaagacgtgctgaatttcttttctgactgtcgcattagaaatggcgaaaatggtattcattttctgttgaacagggatggcaagagacgcggagatgcattgatcgaaatggaatcagaacaggatgtccaaaaggccctggagaaacaccgtatgtatatgggccagcgctatgtagaagtatacgaaataaacaatgaggatgttgatgcgctaatgaaatccctgcaggtcaagagtagcccagtggtgaatgatggcgttgtgagactaagaggattgccctactcctgtaacgagaaagacatcgtggacttttttgcaggccttaatatagtggacattacttttgtaatggactaccgcggaaggcggaagacaggcgaggcatacgtgcagtttgaagagcctgaaatggcaaatcaggctctgctgaaacaccgggaagagatcggcaaccgctatattgagatcttcccttccaggcgaaacgaggtccgcacccatgtgggatcctacaaagggaagaagattgccagttttcctaccgctaaatacattactgagcctgagatggtttttgaagaacacgaggtgaacgaggatattcagccaatgactgcctttgaatccgaaaaagaaattgagctcccaaaggaagtgcctgagaaactgcctgaggccgctgattttggcacaacaagttcactccattttgttcacatgcggggacttccgtttcaggccaatgcacaagatataattaatttctttgctcccctcaagccagtgcgtataactatggagtactcttcttcggggaaggcgaccggcgaggctgacgtccactttgaaacgcacgaggacgctgtggctgccatgctcaaagatagaagccacgtgcaccatcggtatatagaacttttccttaattcctgtccaaagggcaagtag

SEQ ID NO: 225242 - DNA, 1089 bp, Artificial Sequence
  Description of Artificial Sequence: Synthetic coding sequence
atggagtccaaaactacatatctcgaagatctgccaccccctcctgagtatgagctcgctccatccaagctggaggaggaggtggatgacgtgtttttgatcagagcccaaggcctcccctggtcttgcaccatggaggacgtgctgaacttttttagtgactgccgtatacgcaacggtgagaacggaatacacttcttgcttaatagagacgggaaaaggcggggagatgccctgatcgagatggaatccgaacaggatgtccaaaaagcactggaaaaacacagaatgtatatggggcagcggtatgtagaagtctatgagatcaacaatgaggacgtggatgccctgatgaaatccctgcaagtcaagtcctcccctgtagtgaatgacggagtggttagactgcggggattaccatatagctgtaacgagaaggacatcgttgactttttcgctggacttaatattgtggatatcacttttgttatggactataggggtcgaaggaagacgggggaggcttatgtacagtttgaagagcctgagatggccaaccaggcgttacttaaacacagagaggagatcggcaacagatatatagagattttcccctcgagacgcaatgaagttagaacccatgtaggttcatataaaggaaaaaaaatcgcatcatttcctacagccaagtatatcaccgaacctgagatggtgttcgaagagcatgaagtgaatgaggacattcaaccgatgaccgccttcgaatccgaaaaagagatcgaactgcccaaagaggtgcctgagaaattgcctgaggccgcagattttggaacaacttcaagtctgcatttcgtgcacatgcgcggtcttccattccaggccaatgctcaggacattatcaattttttcgcccctctgaagcccgttaggatcactatggagtattcttcttccggcaaggctacaggcgaagcagacgttcacttcgagacgcacgaagatgccgtggctgctatgctgaaagatcggagccacgttcaccatcgctatatcgaattattcttaaactcttgcccgaaaggcaagtag

SEQ ID NO: 225243 - DNA, 1401 bp, Artificial Sequence
  Description of Artificial Sequence: Synthetic coding sequence
atgctgcgctctacatcaaccgtgaccctgttgagcggaggggctgcacggacgccgggagcaccatctcgtcgagcaaatgtgtgtcgtcttagattgacagtacctcctgaatcccctgttccagagcagtgtgagaaaaagatcgaaaggaaagagcagctgcttgatctctctaacggagaacctacccgaaagctccctcaaggggtcgtgtacggcgtggtgaggaggtcagaccaaaatcaacagaaggaaatggtggtgtatggttggtctacatctcagctgaaagaggaaatgaactacataaaagacgtacgagccaccctcgagaaggtaagaaaacggatgtacggggattatgatgaaatgcgccagaaaataagacagctcacacaggaactgtccgtgtcccatgcgcagcaggaatatttggagaatcatattcaaacccagagcagtgccctggaccggtttaacgcgatgaactcagctctggcgtccgactctataggcctgcaaaaaacactcgtggacgtcaccctcgaaaattccaacattaaagatcagatccgcaatttacagcagacgtacgaggcctcaatggataaactacgggaaaaacaacgacagttggaggttgcccaggttgagaatcagctgttgaaaatgaaggtcgagtcctctcaagaggcaaacgcagaggtgatgagggaaatgactaaaaagctgtacagccagtacgaggaaaagctgcaagaggaacaaaggaagcactccgccgaaaaggaggccttactcgaggaaactaatagtttcctgaaggctatcgaagaggccaacaaaaagatgcaggccgcagagatttcacttgaagaaaaagaccagcgcatcggagagcttgaccggttaattgagaggatggagaaagagagacatcagctgcagcttcagctcctcgagcatgagaccgaaatgtcaggcgagctgaccgactccgataaggaaagataccagcagctggaggaggcctctgcatccctcagggagagaatccggcatttggacgacatggttcactgtcagcagaagaaggtcaaacagatggttgaggaaatagagtcacttaaaaaaaagctccaacagaagcagttgcttatcctgcagctgcttgaaaaaattagcttcctggagggtgagaacaatgagctgcaatccaggttggactatctgacagaaacacaggcaaagaccgaagtcgagacccgggagatcggtgtaggatgcgatctcctcccctctcagactggtcgcactcgcgagatcgtgatgcccagtcggaactacaccccatacacacgggtgctggaactcactatgaaaaagactcttacttag

SEQ ID NO: 225244 - DNA, 1194 bp, Artificial Sequence
  Description of Artificial Sequence: Synthetic coding sequence
atgctgcgcagcacctcgaccgtgacactgctgtcaggcggagccgctaggaccccaggcgcacccagtaggcgtgctaacgtttgccgtctgcgtctgacagtgccaccagagtcacccgtgcccgagcaatgcgagaagaagattgaaaggaaggaacagctgctcgatctctctaacggtgagcccacacggaaactgccccagggcgtcgtgtatggagtagtgagacgtagtgatcagaatcaacaaaaggagatggtggtttatggatggtccacttcacaactcaaagaagaaatgaattacattaaggacaagacactggtagacgtgactctagagaactcaaacatcaaagaccaaatacgcaatctgcagcagacctacgaagcctctatggacaagctgcgagagaagcagcggcaactggaggtcgcacaggtagagaatcagctgttaaaaatgaaggtcgagagcagccaggaagctaatgcagaggttatgcgtgaaatgaccaaaaagctgtacagccaatacgaagagaaattgcaggaagagcaaagaaaacacagcgccgagaaagaggcactgctcgaggaaaccaattcatttttgaaggccatcgaggaagctaataagaaaatgcaggcggcagagatcagtcttgaagaaaaagatcagcgcattggcgaattggaccggcttattgagcgcatggagaaggagaggcaccagctccaactgcagctgctcgagcacgagacagagatgtctggcgaattgactgactccgataaggaacggtaccaacagttagaagaggccagtgcaagtctccgcgaacgcattaggcatctggacgatatggtgcactgtcagcaaaaaaaagttaagcagatggttgaggaaatagagagtctcaagaagaaactgcagcagaagcagctgctaattttacagctgctcgagaagatcagttttttagagggggagaataatgagctccagtcaagactcgactacctcacggaaacccaggcaaagacagaggtggagactcgcgagattggagttggctgcgacctactgcccagccagacagggcgaactcgggaaatagtaatgccgtccagaaattatactccctatacaagagtgttggagttgacgatgaagaagactctcacttag

SEQ ID NO: 225245 - DNA, 1248 bp, Artificial Sequence
  Description of Artificial Sequence: Synthetic coding sequence
atgctgagaagcacgtctaccgtcactctgctgtccggcggtgccgctcggacacccggagctccatcaaggagagctaacgtgtgccgtctgcggttgacagtccctcctgaaagccctgtccctgaacagtgcgagaagaaaattgagcgcaaggagcagctgctggatctcagcaacggagagcctactagaaagcttccacagggcgtggtgtacggggttgtgcgcagatccgaccagaaccagcagaaagagatggtcgtgtacgggtggtcaacttcccagttaaaggaagagatgaattacattaaagacgtgagccatgcccagcaggagtacttggagaaccacattcaaactcagagcagtgccctcgacaggtttaatgccatgaatagcgcattagcctcagactctatcggccttcaaaaaaccctggtggacgttacactggaaaatagcaacataaaagaccaaatccggaatctccagcagacctatgaggcctcaatggataagcttagggagaagcaacggcagcttgaagttgcacaggtagagaaccagttactcaagatgaaggttgaatccagtcaggaggccaatgcagaggtcatgagggaaatgacaaagaagctttattcgcaatacgaggagaagttacaggaggaacagcgcaagcattctgctgagaaagaggcgctgttggaggaaactaactctttcctgaaggcaatcgaggaagccaacaaaaagatgcaagccgcagagatctcacttgaggagaaagaccaacgcatcggtgagctggatcgtctgatcgaaaggatggagaaagagcgccatcaactacagctacaactgctcgagcacgagacggagatgagcggtgagcttactgactcagataaggagcggtaccagcagctggaagaggccagcgcttcactgagggagaggatccggcatctcgatgacatggtccattgccagcaaaagaaggtgaagcagatggtcgaagaaaacaatgaactgcagtcacgtctagattacctaaccgaaactcaagccaagacagaagtcgaaacaagagaaatcggggtcggatgcgacctgctcccgcgacagtctaggaaatttgagaaggtcctgaatgagtttgtgcagttgttgccactgcctcaccacctgttgtgggctttcggcaatgtgtgttggcgtcggcatttcgggctgctacaatag

SEQ ID NO: 225246 - DNA, 1317 bp, Artificial Sequence
  Description of Artificial Sequence: Synthetic coding sequence
atgctgcgctctacctccacagtgacccttctctccggaggtgccgcacggacccctggagcaccctcgcggcgtgcgaatgtgtgtaggctgcgtttgacagtcccacccgaatccccggtgccagaacagtgtgaaaaaaagatcgagcgcaaagagcagctcttagatctcagcaatggagagcccactcgcaagctgccgcagggagttgtctacggtgtggtcaggcggtcggatcaaaaccagcagaaggagatggtcgtctatggttggtctacatcacaactgaaggaggaaatgaattatatcaaggatgttcgcgcaaccttagagaaagtccgaaaacgcatgtacggcgactatgacgagatgcggcaaaaaatccgtcagctaactcaagagctcagtgtctcacacgcccagcaggagtacctggaaaaccacattcaaacacagtctagcgcactcgacaggtttaacgcaatgaattctgcgctcgcatcggattcaatagggcttcaaaaaactctggtcgatgtcactttggagaactccaacatcaaagaccaaattcgaaatctacagcagacctacgaggcctcaatggacaaactgagagagaaacaaaggcaactagaggttgcacaggtggagaatcagctgctcaaaatgaaggtagaatcctctcaagaggcaaacgccgaagttatgagggagatgacaaagaagctgtattctcagtacgaagagaaattgcaggaggagcagagaaaacattccgctgagaaggaggcactcctggaggagacaaactccttcctgaaggccatcgaagaggccaataaaaaaatgcaagcagccgaaatctccctagaggagaaagatcaaaggattggtgaattggataggcttattgagcggatggaaaaggagcgacaccagctgcagttacaacttctcgagcatgagacagaaatgtcaggggaactgacagattcggacaaggaaaggtatcagcagctggaggaggcaagcgcatcacttagggagagaattcgccacctcgatgatatggtacattgccaacagaagaaggtgaaacagatggtcgaggaaaataatgagcttcagtctcgactggattacttgacagagacgcaggcaaaaactgaggtggaaaccagggagatcggagtgggttgcgatttactgccaagtcagaccggcaggacgagggagatcgtgatgccatcaaggaactacaccccatacacgcgggtgctggagctcacgatgaaaaagaccctaacctag

SEQ ID NO: 225247 - DNA, 1338 bp, Artificial Sequence
  Description of Artificial Sequence: Synthetic coding sequence
atgctgcgcagcactagcactgttactctgctaagcgggggagccgcacgcacacccggagccccatctcgccgagcaaatgtttgtcggttgcgcctgacagttcccccagaaagcccagttcctgaacagtgtgaaaaaaaaattgaacgaaaagagcagcttctcgatctgtcaaatggtgagcctacccgcaagctgccacagggggtcgtgtacggggttgttaggcgatcagatcagaatcaacagaaggagatggtcgtttacggatggtctacctctcagctgaaggaagagatgaattacatcaaggacgtgcgagccactctagagaaggtgagaaaacgtatgtacggggattacgacgaaatgcggcagaaaatcaggcaacttacccaggaactgagcgtgagtcacgcccagcaggagtaccttgaaaaccatatccagactcagtctagcgcgctcgacagatttaatgccatgaacagcgcactagccagtgacagcatcgggttgcaaaagacactggtcgatgtgactttagaaaactcaaacataaaggaccaaatccggaacctacagcaaacctatgaggcgagcatggataagctccgggaaaaacagcgccagctggaggtcgcacaggtagagaaccagctgctgaagatgaaagttgagtcaagccaggaggcaaatgctgaagtaatgcgcgagatgacgaaaaagctgtactcccaatacgaagagaagctgcaggaggagcagagaaagcactcagcagagaaagaagcattgctcgaggagacaaattcctttttgaaagctatcgaagaggccaacaagaaaatgcaggccgcagaaatcagcctcgaagagaaagatcagcgcattggtgaactggacagattaattgaacgcatggagaaagagaggcaccagctgcagttgcagctgcttgagcacgagacagagatgagcggggagctgaccgactcagacaaggaaagatatcaacaactcgaggaggcttcagcctctctgagggaacgaattcggcacctggacgatatggtccattgtcagcagaaaaaggtgaaacagatggtcgaagaaatagagtctctgaagaagaagctccagcaaaagcagctgttgatcttgcagctattggaaaagatatcgttccttgagggggagaacaacgaactacagagccggttagattatctgacagagacccaggcaaaaacagaggtggaaacccgcgagataggcgtgggttgcgacctgctcccacgccgatgtaagcagtcttcccaaagaaaaaattag

SEQ ID NO: 225248 - DNA, 1653 bp, Artificial Sequence
  Description of Artificial Sequence: Synthetic coding sequence
atgcttcgcagcacctccactgtcacacttctatccggcggtgccgctcggacacctggagcaccgtcaagaagagctaacgtctgccgactgagactgaccgtacccccagagtccccggtgccagagcaatgtgagaagaaaattgaacggaaggagcagctcctcgacctttcaaacggagagccgactcggaaactgccccagggcgtagtatacggagtggtaagaagatccgatcaaaaccagcagaaagagatggtcgtatacggctggtcaacgagtcagctgaaggaagagatgaattatataaaggacgtgcgagccaccctggaaaaggtaaggaaacgcatgtacggtgactacgatgagatgagacagaagatcaggcaactgacccaggagcttagcgtctcacacgcccagcaggaataccttgagaaccatatacagacccagagctccgcccttgatcgcttcaatgcaatgaacagcgctctcgcatccgactcaattggcttgcagaagacactagtggacgtgactctagagaactctaacatcaaggatcagattaggaatcttcagcaaacttacgaagcctccatggataaactgcgcgaaaagcaacgacagctcgaggtggcccaggttgagaaccagctgctcaaaatgaaagttgagtcctcgcaggaagctaatgctgaggtgatgcgggaaatgaccaaaaagctgtactcacagtatgaggaaaaactgcaggaagagcagcgcaagcattctgccgaaaaagaggccctgctggaggagactaacagtttcctgaaggcaattgaagaggctaataagaaaatgcaggctgcagaaatttcactcgaagagaaggaccagcgcatcggggagttagacaggttgattgaaagaatggaaaaggagaggcatcagctgcagcttcagttacttgagcatgaaacagaaatgagtggcgagctgaccgactcagataaggaacgctatcagcagctcgaggaagcctccgcctcactccgagaacggattcggcaccttgacgacatggtacactgccagcaaaaaaaggtcaaacaaatggttgaagagattgaatccttaaaaaaaaaactgcaacagaagcagctgttgatattgcagctcctcgagaagatcagctttctagaaggggaaaataacgagctgcaatctcgacttgactatctgacagagacccaggctaagacagaagtcgagacacgggaaatcggggttggctgtgacctgttgccaagactgcccttccgccagaatgattccagctctcattgccagaagagtgggtcaccgatctcctccgaggaaagacgcagacgcgataaacaacaccttgacgatatcaccgccgcaaggctgttaccacttcatcacatgccaacacagctcttgtctatcgaagagagtctcgcgctacagaaacaacagaagcagaattacgaagagatgcaggccaagttagcagcccaaaaattggctgagaggcttaatattaagatgagaagttacaaccctgagggcgaatcgagcgggaggtaccgagaggtgcgcgatgaggacgatgactggtcttctgacgagttttag

SEQ ID NO: 225249 - DNA, 1308 bp, Artificial Sequence
  Description of Artificial Sequence: Synthetic coding sequence
atgttacgatccacaagtaccgtgacccttctcagtgggggagctgccaggacccctggcgcaccctctaggcgggcaaatgtctgtagactgcgcctgaccgtacccccagagtctccagtacccgagcagtgcgagaagaaaattgaacgcaaggagcagctgttggacctgagcaatggcgagccaacgaggaaactgcctcagggcgtagtctacggcgtcgtcaggaggagtgaccagaatcagcagaaagagatggtggtgtatggctggtctacaagtcagctgaaggaggagatgaactatatcaaggacgtctctcatgcccagcaggaatacttagaaaaccacatccagacgcaatcttcagccttagaccgattcaatgctatgaactcagccctggcctccgattccatcggcctgcagaaaacactggtggacgtgacgctcgagaacagcaacattaaggaccaaatccggaatctgcagcagacgtacgaagcatccatggacaaattgcgtgagaaacagcgtcaacttgaagttgcacaggtggagaatcagctgctaaagatgaaagtcgaaagtagccaagaagctaatgccgaagtcatgcgtgaaatgacgaaaaaattatacagtcagtacgaagagaagctccaggaggaacagagaaagcacagtgctgaaaaggaagccctactagaggaaacaaattcattcttgaaggctattgaggaagccaataagaagatgcaggcagcagaaatctcactggaggagaaagatcagaggatcggggagctggatagactcatcgaacgcatggagaaagaaagacaccagctgcagctgcagctgctggagcatgaaaccgaaatgtcaggcgagctgaccgattcagacaaagagagataccagcagttggaggaagctagcgccagcctgagagaacggatccgacaccttgacgatatggtgcattgccagcaaaagaaggtaaagcagatggtagaggaaatcgaatcgctgaagaagaaattgcagcaaaagcagttgttgatcctccagcttctggaaaaaatatccttcctggaaggcgagaataatgaactgcagagccgtctggattatcttacagagactcaggcaaagactgaagtggagactagggaaatcggagttggctgtgaccttctgccgtcacaaaccggaagaacacgtgagattgtgatgccctcacggaattatactccctacactcgggtcctggagctaactatgaaaaaaactctgacttag

SEQ ID NO: 225250 - DNA, 1401 bp, Artificial Sequence
  Description of Artificial Sequence: Synthetic coding sequence
atgcttaggtccacctcaacagtaacattgctctctggtggagcagctcgcacccctggagcgccaagccgccgagccaatgtgtgtcggctgagactgacagttcccccagagagccctgtgcctgagcaatgcgagaagaagattgaacgtaaagagcagctgctggatttatccaacggcgagccgacaaggaagctccctcaaggcgtcgtctacggcgtggtcagacgctcagaccagaatcagcaaaaggaaatggttgtttacggctggtctactagccagctcaaagaggaaatgaactatatcaaggatgtacgcgcaactcttgaaaaggtccgcaaaagaatgtatggagattatgatgagatgcgacaaaagattcgccagctcacgcaagaattgagcgtgtcacatgctcagcaggagtacctggagaaccacatccagactcagtcttctgccttggatcgcttcaacgccatgaacagcgcactggcttcagattccatagggctgcagaaaacacttgtggatgttacactggagaatagtaacataaaggaccagatcaggaaccttcagcagacctacgaagccagtatggataagcttagggagaagcagaggcagttggaagtcgctcaagtagaaaaccagttgctgaaaatgaaggtagaatcaagccaagaggcaaatgccgaggtgatgagagaaatgaccaagaaactgtacagccagtacgaagagaagctgcaggaggaacagcggaagcatagcgccgagaaagaggcccttctcgaggagacaaattctttcctgaaggcaatcgaagaggcgaacaaaaaaatgcaggccgctgagatctccttagaggagaaagaccaacggatcggggaactcgataggctaatcgaaagaatggagaaggaaagacaccagctgcaattgcagctgctggaacatgaaaccgagatgtctggcgaattgacggactcagacaaggagcggtatcaacagttggaagaagctagcgccagcttgagggagcgtattaggcacctcgatgacatggtacattgtcaacaaaagaaagtgaaacagatggttgaggagatcgaaagcctaaaaaagaaattacagcagaagcagctcttgatcctgcaactgctggagaagatcagctttctagaaggagagaataatgaactgcagtctaggttggattatctgacagagacacaggctaaaaccgaagtggaaactcgtgagatcggtgtggggtgtgatctcctccctagccagaccgggcgaacacgagaaattgtcatgccctccaggaactatacaccatacacccgggtgcttgagctcacaatgaaaaagacactcacatag

SEQ ID NO: 225251 - DNA, 1317 bp, Artificial Sequence
  Description of Artificial Sequence: Synthetic coding sequence
atgctgaggtctacttccaccgtcactcttttgtccggtggagcagctcggacgcctggagcccctagccggagagctaatgtctgcaggctgcggcttaccgtgccgccagaatctcctgtacccgaacagtgtgagaaaaagattgagcggaaagaacagctattggacttgtctaacggcgagccgactcggaaattgcctcagggcgtggtgtatggtgtggttcggaggtcggaccagaaccagcagaaggaaatggtggtgtatggatggtcaacctcccagctgaaggaggagatgaattacattaaggacgtgcgagctaccctggaaaaagtgaggaagcggatgtatggagactatgacgagatgagacagaagatcagacagctcacccaggaattatctgtctcacatgcgcaacaggaataccttgagaatcatatccagactcagtcaagcgctctagaccggtttaatgctatgaactcggccctggcgtccgatagtattggcctgcagaaaacccttgtggacgtgaccctcgaaaactctaacattaaggatcaaatcagaaatttgcagcagacctatgaggcatcgatggataagctgcgcgagaagcagcgacagctcgaggtggcgcaagttgagaatcaacttctgaagatgaaagtggaatctagccaggaggccaatgccgaagtcatgcgggaaatgaccaagaaactttactcccagtatgaagaaaagcttcaagaggaacagaggaagcacagcgcagagaaggaggcactcctcgaggagactaattcctttctgaaagcaattgaggaagcaaataagaagatgcaagcagcagaaatttcgctcgaagagaaggatcaacgaatcggagagctggaccgtctcatagaacggatggagaaggaaaggcaccagttgcagttacaattacttgaacacgagactgagatgagcggggagttgactgactctgacaaagaaaggtatcagcagcttgaggaggccagcgccagccttcgtgagcggattcggcacttagacgacatggtgcattgccaacagaagaaggttaaacagatggtggaggaaaataacgaactgcagagccgattagactatctaaccgagacccaggctaagacagaggtggagacaagagaaattggggtcgggtgtgatctgctcccctcccagacggggcgaacaagagagatagtcatgccaagccggaattacacaccttacacacgcgtgctggagttgaccatgaaaaagacactgacttag

SEQ ID NO: 225252 - DNA, 1401 bp, Artificial Sequence
  Description of Artificial Sequence: Synthetic coding sequence
atgctcagaagtacttcaacagtgacattgttgagcggcggagccgctaggacccccggagctcctagtcgcagggccaacgtctgccgactacggctgaccgtgcctcctgaaagtcccgtgcccgagcaatgtgaaaagaaaattgagcgcaaagaacaactgctcgacctgagcaatggtgaacctacccgcaagcttccccagggggtcgtctatggagtggtgcggaggagcgatcagaatcagcagaaagaaatggtggtctatggctggagcactagccagctcaaagaggaaatgaactacatcaaagacgtccgagcaacgttagagaaggtccgcaaacgcatgtacggagactatgacgagatgcgccagaaaataaggcaactgactcaagagctcagcgtcagccatgcccagcaagaatatttggagaaccacatacaaacgcagtcctccgccctggaccgcttcaatgctatgaattctgctttagcttccgatagcatcggtcttcagaagacactagttgatgtgaccctggaaaactccaatattaaagaccagatcaggaacctccaacagacgtatgaagcttcaatggacaaacttagggaaaaacagcgccagctcgaggtcgcacaagtcgagaatcagcttctgaagatgaaggttgaatcctcccaggaggccaacgccgaggtcatgagagaaatgacaaagaaactatactctcagtacgaggagaagctccaggaggaacagcgcaaacacagtgctgagaaggaggcgctcctcgaagaaacaaactccttcctgaaggcaatagaagaggccaacaagaagatgcaggcagccgagatttcactggaggagaaagatcaacgcatcggagaactggatagactcatcgagcgcatggaaaaggagcggcatcagctacagctgcagctgctggagcacgagacagaaatgtcgggggaattaactgactccgataaggaacggtatcaacaactggaagaggcctctgccagtctgagagagaggattcgacatctggacgacatggtgcactgccagcaaaagaaggtcaaacaaatggtagaagaaattgaatccttaaagaagaagctgcagcagaaacagctcctcatcctgcagctcctggaaaaaatttcgtttctggagggcgagaacaacgagcttcagagccgtcttgactacctgacggagactcaggcaaaaaccgaggtcgagacacgcgaaattggagtaggctgtgatcttctgccctctcagacagggaggacacgcgagatcgtaatgccatcccggaactataccccttacacccgtgtactggagttaaccatgaagaagacattgacatag

SEQ ID NO: 225253 - DNA, 2328 bp, Artificial Sequence
  Description of Artificial Sequence: Synthetic coding sequence
atggagaaattcggtatgaacttcggcggtggaccctctaaaaaagatctgctagagaccattgaaacgcagaagaaacagctgctacagtatcaggctcgcctgaaagacgtcgtacgggcttataaaagcctgctgaaggagaaggaggcgctagaggcatctataaaggtgctgagcgtctcgcacgaagctgatgtgggcctcgctggtgtacagctgcccggactcacattccctgactccgtggacgatcgctgcagcacccacagtgaagacagtacaggcaccgccacatcattggacaccgctgcttccctgactagtacgaaaggagagttcggcgttgaggatgatagacctgcacggggtcctccaccacccaagagtgaggaggccagctggagtgaatcaggcgtctcttcgtcaagcggcgacggtcctttcgctggcggagaagtggacaagagacttcaccagctgaagacgcagctcgctactcttacctcatcactggcaacagttacccaagagaagtctcgtatggaggcctcatatttggccgacaaaaagaaaatgaagcaggatctggaagacgcttctaataaagctgaggaggagcgcgctcgcttggaaggggagttgaaaggccttcaggagcagatcgctgagaccaaggcaaggctcatcacgcagcagcatgacagggctcaggaacaaagcgaccacgccctcatgctccgtgaactgcaaaaattgcttcaagaggaaaggactcagagacaggacctggaactgcgtctggaggaaaccagggaggctctggctggacgcgcatacgccgcagaacagatggaaggctttgaactgcagaccaaacagctcacacgtgaagtcgaagaactcaaaagtgagttgcaggccataagggacgagaagaatcagccggacccaagacttcaagagctgcaggaggaagcagccaggttaaagagccattttcaggcacaacttcagcaggagatgagaaaaaccgcgctcgctgaagaccaactcaggcagcaatcccaggtggaggaacagcgtgtcgcagctttggagaatcaaatctccgaagtcagcgagcttttgggcacatatgaaaaagctaaacagaaagaccagctggccatacagaagttgaaggagcggattctgcaattagatctcgaaaacaagaccttagccctagcggcatcctcaagaagtcctctggatagtcatggcgaagagtcaagcctggatgtgaatgtgctcaaggataagatggaaaaactcaagaggctgctgcaggttgcagcccgtaaatcccaagtaacactggatgtcgagaagctgtgtgacctggaaataatgccctcttctgaggcagcagatggggaaaaggctaccgcactatactatcagcaggaacttaaacagctcaaagaggagtttgagagatataagatgcgtgctcaggtagtacttaagtctaagaacactaaggacggtaatctggggaaagaacttgaggctgcacaggaacagttagcggaactaaaggagaaatatatctccctgagactgagttgtgaagagctggagcatcaacaccaacaggaggccgacgattggaaacaagaactcgcccgactccagcagctgcatcgccaggaacttgagcggtgtcaactagattttagagaccgcacgttgaagctcgaagaggagctccataaacagagggaccgcgcactggctgtgttgactgagaaggatttggaactggagcaacttcgctctgtcgcattggcctccggcctgcctggccgtcgctcacccgtcggagggggtggtcctggtgaccctgcagataccagctcaagcgacagtctaacccaggccctacagctggctgctgccaacgaaccaacctttttcctttatgctgaacaactggccaggaaggaagtagagattacctcactcagaaaacagaaacaccgcctcgaggtggaggtgcaccagctccaagaccgcctgctggaggagggcgagcgccatagggaggaagtggccgctttgcagtctcacatcgagaaaaacatacgggatcagtctcgcgagggagccaacctggagtatctgaagaacatcatctatcggttcctcactctgccagactctctcggcaggcaacaaacactaaccgccatcctgacaattttgcatttttctcctgaggaaaagcaggtgatcatgcggctaccgacctctgcgtcatggtggcccagcgggaaacgttag

SEQ ID NO: 225254 - DNA, 5054 bp, Artificial Sequence
  Description of Artificial Sequence: Synthetic coding sequence
atggaggacctggtgcaggatggcgttgctagtccagccactccgggaactggcaaatcgaagctagaaacgcttcctaaggaggatttgatcaagttcgctaagaaacagatgatgctcattcagaaggcaaaatcccgctgtaccgagctggagaaggaaatcgaggaactccggtccaagcctgttacggaaggcactggagacatcatcaaggctttgacagaaaggttggatgctctcctgctcgaaaaggcggaaaccgagcagcagtgcttaagcttgaagaaggaaaacatcaagatgaaacaggaggtggaagattccgtgacaaaaatgggggacgctcataaggaactagaacaatctcatattaattatgtaaaggagattgaaaatctcaagaacgagctgatggccgtgagatctaagtacagcgaagataaggccaacttgcagaaacagctagaagaggccatgaacacccagctggagttgtccgaacaattgaagttccagaataactccgaagacaatgttaaaaagctgcaggaggagattgaaaagatccggccagggttcgaggaacagatcctatatctccagaaacagctggatgccacgactgatgagaagaaggagacggtgacgcaactccagaacataatcgaagccaacagccagcactaccagaagaatatcaattctctgcaggaggagctcttacagcttaaagcaatccaccaggaggaagtgaaggaattgatgtgccagatcgaggccagcgctaaggagcatgaagcagagattaataaacttaatgagctcaaagagaatctcgtgaaacagtgcgaggcaagtgagaaaaacatccagaagaagtacgagtgcgaacttgagaacctgcgaaaggcaactagtaacgctaatcaagacaatcagatctgttctatattactacaagagaatacatttgtcgagcaggtggtcaatgaaaaagtcaaacatttggaggacactctcaaggaacttgagtctcagcattctatcctgaaggacgaagtgacatacatgaataatctcaagctgaaactggaaatggacgcccagcacatcaaggatgagttctttcatgagcgggaggacttggagtttaagatcaatgagctgttactggcaaaagaagagcagggctgtgtgatcgaaaaactcaaaagtgaactggccggtctgaataaacagttttgttatactgtcgaacaacataaccgagaggtgcagtccttgaaggagcagcaccagaaggagattagtgaactgaacgagacattcttgagtgattctgagaaagagaaactaacactcatgtttgagatccagggcctgaaagaacagtgcgaaaatcttcaacaggagaagcaggaggccatactgaactacgagtcactgcgcgaaattatggagattcttcaaactgagcttggtgagtctgcaggaaagatcagccaggagtttgaatcaatgaagcaacaacaagcgtccgacgtgcacgaactccagcaaaaactgagaactgcttttacagaaaaagatgctcttctggaaactgtcaataggctgcaaggagaaaatgagaaactcctgtctcagcaggagttggtccccgaattggagaacacgataaagaatctgcaggaaaagaacggcgtgtatttgctgtccctaagccaaagagacaccatgttgaaggaactcgagggaaaaattaactctttgaccgaagaaaaggatgactttatcaacaaactcaagaattcgcacgaagaaatggacaatttccacaagaaatgcgagcgggaagagaggctgattttagagctagggaaaaaggtggagcagaccatccagtacaactcagagctagagcaaaaagtgaacgagcttacgggcggtctggaggagactttgaaggaaaaagatcagaatgaccagaaacttgagaagcttatggtacagatgaaggtgcttagcgaagataaggaggtacttagtgcagaggtcaaatccctctatgaggagaacaacaaactgtccagtgagaagaagcagctttcaagagatctggaggtcttcttgagtcagaaagaggacgtcatcctgaaggagcacattacccagcttgagaagaagctgcaactgatggtggaagagcaggacaacttaaataagcttctcgaaaacgagcaggttcagaaattgtttgtcaagacgcagctttatggattcttaaaggaaatggggagcgaagtgagtgaggattccgaggaaaaagacgttgtcaatgttctccaggcagttggtgagtctctcgcaaagatcaatgaggaaaagtgtaatctcgctttccagcgggacgaaaaggttctggaattggagaaggaaattaaatgcctgcaggaggaatcagtggttcagtgtgaggaattgaaatcactcctgcgagattacgaacaggagaaagtgctgttaaggaaggagctcgaggagatacaatccgagaaagaggctctccagagcgaccttctggagatgaaaaatgccaatgagaagactagactcgaaaaccagaacttgctcattcaggtggaggaagtgtctcagacctgctccaagtccgagattcacaacgagaaagaaaagtgcttcattaaagagcatgagaacttaaaacccctcctagagcaaaaagagctgcgagatcgtagggccgagctgatcctcctgaaagattcgctagccaagtccccatctgtgaaaaacgatccgcttagcagtgtcaaggaattagaagaaaagattgagaacctggagaaagagtgtaaggaaaaagaagagaaaatcaacaaaattaagttggttgccgtaaaggctaaaaaagagcttgattcaagccggaaggagacacagaccgttaaagaagagttggagtctctgaggagcgagaaggatcagttgtccgcctcgatgcgggacctcattcagggagctgagtcttataagaatctgctcctggagtacgaaaagcagtctgaacagctggacgttgaaaaagaaagggctaataactttgaacatcgtatcgaagacctaaccagacagctgcggaattccaccctccaatgcgagactattaactccgataatgaagacctactcgccagaatagagacactgcagagtaatgccaaacttctggaagtacagatcctcgaagtccagagagctaaggccatggtggacaaagaattagaggccgaaaaactgcagaaagaacaaaaaatcaaggaacatgcaaccactgttaacgaattagaagaactccaggtccaactccaaaaacagaagaaacagctacaaaaaactatgcaggagctggagcttgtgaagaaagatgcacagcagacgactctcatgaatatggaaatagctgattacgaaagacttatgaaagaactgaaccagaagctgaccaataagaataataaaatagaagatcttgaacaggagatcaagatccagaaacagaaacaagagaccttgcaggaggagatcaccagcctgcagtccagcgtgcagcagtatgaggaaaagaatacaaaaataaaacagctgctggttaagactaaaaaggagctcgctgactctaaacaagccgagacagatcatctcattctgcaggcaagcctaaagggcgaactggaagcaagtcaacagcaggtggaggtgtacaagatccaacttgcagaaatcacatcagagaaacacaaaatccatgaacacctgaaaacgagcgccgaacagcatcagcggaccctgagcgcctatcagcaaagggtaacagcactgcaggaagaatgcagggccgcaaaagctgaacaagcaactgtcacaagtgagtttgagagttataaggtgagagtccacaacgtgttaaagcaacagaagaacaaatcaatgagtcaggctgaaacggagggcgcaaagcaggagagggagcaccttgaaatgctgatcgatcagctgaagatcaaactgcaagattctcagaacaatctccaaatcaatgtctccgaactccaaactctgcaaagtgagcacgacactctgctggagagacataataagatgctgcaagagacggttagcaaggaagcagagttgcgagaaaagttatgctccatacagtctgagaacatgatgatgaaatctgagcacacccagaccgttagccagctgacatctcaaaacgaggtgctgagaaattcgtttcgggatcaggtgaggcacctgcaggaagaacatagaaaaacagtagagacactccagcagcaactatctaaaatggaagcacaactgtttcagctgaaaaacgagcccaccacccggtcccctgtgtcatcccagcagagcctcaagaacttgcgcgagcgaagaaatactgacctccctctgttggatatgcacacagttaccagagaggagggagaaggaatggaaacaaccgacaccgaaagcgtaagcagcgctagcacctatacccaatccttggaacagctgcttaatagccccgagacaaaattagaaccacccctctggcacgctgaattcacgaaggaagagctcgttcagaagctttccagtaccaccaaatctgccgaccatcttaacgggctactgcgagaaactgaagccaccaatgctatccttatggaacaaatcaaattgctcaaatcagaaattcggagacttgaacgcaatcaggagcgcgagaagtccgctgctaacctagagtatctgaagaacgtcctgctccagttcatctttctgaagcctggctcagagcgcgaacggctgctgcctgtcatcaacacgatgctacagctgtctccggaagaaaaggggaaattggcagctgtggcccagggagaagaggaaaacgcctctaggtcaagtggctgggcgagctatcttcactcttggtcagggttgcggta

SEQ ID NO: 225255 - DNA, 2052 bp, Artificial Sequence
  Description of Artificial Sequence: Synthetic coding sequence
atgtgtcagatagaggcaagcgcaaaagaacacgaagctgagattaataagcttaatgaactaaaagaaaatttggtgaaacagtgtgaagcctctgagaaaaatattcagaagaaatacgagtgcgagctggagaacctgcggaaagccacctctaatgccaaccaagataaccaaatctgctctatcttgctgcaggaaaacacgtttgtggaacaagtcgtgaacgaaaaagtgaaacacctggaagacaccttaaaagaactcgagtctcagcattccattttgaaagacgaagttacatacatgaataatttgaagctcaagctcgagatggatgcccagcacattaaggatgaattctttcacgagcgggaggatttggagttcaagatcaacgagctgctgctagcgaaggaggagcaaggctgcgtaatagagaaactgaagtcggaactagcaggtctcaataaacaattttgttataccgtcgaacagcacaatcgggaagtccaaagcctcaaagaacaacatcaaaaggagatttctgagcttaacgaaacctttctgtcagactctgagaaagagaagctaaccctgatgttcgagatacagggcctgaaagagcaatgtgagaatctgcaacaggagaaacaggaggctatactaaactatgagtcactccgcgagattatggagatcctccagaccgaactgggtgaatctgccggtaaaatttctcaggagtttgaatccatgaaacagcagcaggctagcgacgtgcatgaactgcagcagaagttgcgcaccgcatttaccgaaaaagatgcattattggaaaccgtgaatcgcctccagggagagaatgaaaagctgctctctcaacaggagctggtgcccgaactcgaaaataccattaaaaatcttcaagagaagaatggagtatatctgctgagcctctctcagagggacacgatgctcaaagagcttgagggtaaaatcaacagcttaaccgaggagaaggacgactttattaataagcttaaaaatagtcatgaagaaatggacaatttccacaagaaatgtgagagagaagaacggctgatcttggaactcggaaagaaggtcgaacagacaatccagtacaattcagaactcgaacagaaagtgaatgagttgacaggaggactggaagagacattaaaagagaaggaccagaatgatcagaagctggagaagttgatggtgcagatgaaagttctgagcgaagacaaagaggtgctaagcgcagaggtgaaaagcctctacgaagaaacaattaattcagtgcagaagaagcagctgagcagggatttggaggtgttcttgagccagaaagaagatgtcatactgaaggagcacattacccaattagagaagaagctccagcttatggtggaagagcaagacaacctgaataagctgctcgaaaacgagcaagtgcaaaaattgttcgtgaagacacaactgtacggcttcctaaaagaaatgggaagtgaagtttctgaggattccgaagaaaaggacgtcgtcaacgtgcttcaggccgtcggagaaagtctggccaaaataaatgaagaaaaatgtaacctggcctttcaacgtgatgagaaggtgttggagcttgaaaaagaaattaagtgtctgcaggaggagtcagtggtgcaatgtgaagaactaaagagcttactgcgcgattacgagcaggagaaggttctgcttcgcaaggagctcgaggagattcaatccgagaaagaggccctccagagcgatctactagagatgaagaatgccaatgagaagacacgacttgagaaccaaaacttgctgatccaggttgaggaagtttcccagacatgctctaagagcgagatccacaacgagaaagagaaatgttttatcaaagagcacgagaacctaaagccactgctggagcagaaggagcttagagacagaagagcggaactgattttgctcaaggacagcttggcaaaaagcccctctaaaaagtag

SEQ ID NO: 225256 - DNA, 1347 bp, Artificial Sequence
  Description of Artificial Sequence: Synthetic coding sequence
atggaagacctggttcaagatggcgttgcctcaccagctacgccaggaactggcaagagtaagctggaaacactgcctaaggaggatctgatcaagttcgccaaaaagcaaatgatgctgatccagaaggcaaagagccgttgtaccgaactggagaaggagatcgaggagcttcgtagcaaacctgtgaccgaaggtacgggggatattattaaagcccttaccgagcggcttgacgccctgctcttggagaaggctgagacggaacagcaatgtttgagtcttaaaaaggagaacattaagatgaaacaggaggtcgaagacagtgtcaccaaaatgggcgacgcacataaagagttggaacagtcccacattaactatgttaaggagatcgaaaacctgaaaaacgagctaatggccgtaaggtccaaatactctgaggataaagccaacctccaaaagcaactggaggaggctatgaacacacagctggagctgagcgaacagctgaaattccagaataactcggaggacaacgtgaaaaagttgcaggaggagatagagaaaatccgccctggctttgaagaacagatcctgtacctccagaaacaactagacgctacaaccgatgaaaagaaggaaaccgtgacacagctgcagaacatcatcgaggcaaactcacagcactaccagaaaaacatcaatagcttgcaggaagaactcctgcaattgaaggctatccatcaagaggaagtgaaagaactgatgtgtcaaatcgaagcctctgcgaaagaacatgaagcggaaattaataaactgaatgagttaaaggaaaatctggtgaagcaatgtgaagcctcagagaagaatattcaaaaaaagtatgagtgcgagctggagaatttgagaaaagcgacaagtaatgctaaccaggacaaccaaatttgttcaatactcctgcaggaaaatacgtttgtagaacaggttgtgaacgaaaaagtgaaacacctggaagacacgctcaaggagcttgaaagccagcattcaatcctcaaagacgaggtcacttacatgaataaccttaaattgaaattggagatggatgcccagcacatcaaggatgagttcttccacgaacgggaggatctcgagtttaagataaacgagctgctacttgctaaagaggagcaaggttgcgttattgagaagctgaaatctgaactggcagggttgaataagcagttctgttatactgtcgagcagcacaacagggaggtgcagagcttaaaagagcagcatcagaaggagatctctgagttaaacgagacattcctgtcggatagttag

SEQ ID NO: 225257 - DNA, 1878 bp, Artificial Sequence
  Description of Artificial Sequence: Synthetic coding sequence
atggctcaggcccttagtgaggaggagttccaaaggatgcaggcacagctcctggagctgcgcactaataactaccaactgtccgatgagctgcgcaaaaatggcgtggagctgacctccctcaggcaaaaggttgcgtatctggacaaggaattcagcaaggctcagaaagcacttagtaagtctaagaaagcgcaggaggtcgaagtgctgctgtcggagaatgaaatgctgcaggctaagctgcatagtcaggaggaggacttcagactgcagaattctaccctgatggccgaattcagcaaggagaggtacggcaaagaggcaggaaagttttcggcagtatcagaaggccagggcgacccacctggtggtcccgctccaacagtattggcgcctatgccactggcagaagtggagctcaagtgggagatggaaaaggaggaaaagcggttgttatgggagcagcttcaaggtttagagagctcaaagcaggcagagactagccgcctccaagaagagttggcgaaactgtccgagaaactcaaaaaaaagcaagaatccttctgtaggctccagacagagaaggaaactctatttaatgacagtaggaataaaattgaagaactccagcaacgcaaggaagccgaccacaaagctcagttggctcgaactcagaagctgcagcaggagctcgaagccgctaaccagtcactagcagagcttcgggaccagaggcaaggagagagactcgagcacgcggctgccctgagagcactccaggaccaggtatctatccagagcgccgatgctcaggagcaggttgaaggattgctggccgagaataatgcactgagaacctcgctggctgcgctggaacaaattcagactgcaaagacccaagagctaaacatgctgcgcgaacaaacgacgggtttagctgccgaactccaacagcagcaagctgagtacgaggatctcatgggacaaaaagacgatctcaacagccagcttcaggagagcctgcgagctaactccaggctcctggagcaacttcaggaaattggccaggaaaaagaacaactcactcaggagcttcaggaagcccgtaagagcgccgagaagaggaaagctatgctagacgaacttgcaatggagacactacaggaaaaaagtcagcacaaggaggaactcggagctgtccgactgcgccatgaaaaggaagtgctgggcgtcagggccagatacgagcgcgagctgcgtgaactccatgaagataagaagcgccaggaggaggagctccggggacagataagggaggagaaagcccgtacccgagagttagaaaccctgcagcagactgtggaagagctccaggctcaggtccatagcatggatggtgccaaaggctggtttgaaaggagattgaaggaggcagaggggaaggaggaagagctgcaagatgtgcgagatcagctcgaacaggcccaggaggagagggattgccacttaaagactatttctagtctaaagcaggaggttaaagatactgtagatggacagcgaatactcgagaaaaaggggtcggctgccctgaaagacctgaaacggcagttgcacttggaaagaaaacgagcagataaactgcaggaaaggctgcaagacatccttaccaacagcaaaagccggagcggtttggaggagcttgtgcttagcgaaatgaactcaccaagtaggacgcagacaggtgattcctcttccatctcttcttttagctaccgagagattttgcgcgagaaggaatcttcagcagttccagccagggtgcggggtaaagaagaacccactgctccagcatcactgaaccctaaaatatag

SEQ ID NO: 225258 - DNA, 2433 bp, Artificial Sequence
  Description of Artificial Sequence: Synthetic coding sequence
atggcccaagcactctccgaagaggagttccagaggatgcaggcgcagctgttagagctgaggaccaacaattaccagctgagcgacgaactgcgtaaaaacggcgttgagctcacatctctccgccaaaaagtcgcttaccttgacaaggaatttagtaaggcacagaaggctcttagcaaatcgaaaaaagctcaggaggttgaggtccttctgtccgagaacgagatgctacaagcaaaactgcactctcaggaggaggactttcgccttcagaatagcacactgatggcagagtttagcaaactctgctcacagatggagcaacttgaacaggagaaccagcagcttaaggaaggcgctgcaggagcgggagtggctcaggcagggcctcttgttgatggagagcttctgcggcttcaggccgaaaacactgctctgcagaaaaacgtagccgctctgcaggagaggtacggcaaagaggccggaaaattctccgctgtatctgaaggtcagggcgatcctcccggaggaccggcaccaaccgtcctggcacccatgcctttagcggaagtggagttgaagtgggaaatggagaaagaggagaagcgtctcctttgggaacagttacagggtctcgaaagttctaagcaggccgaaacctcccgcttgcaggaagagctcgccaagctttccgagaagcttaagaagaaacaggagtctttctgcaggcttcagaccgaaaaggaaaccttgtttaatgactcacggaataagatcgaggagctccagcagcgtaaagaggcagaccataaggcccagttagccagaacccaaaagctgcagcaggagctggaggctgctaaccagtccctggctgagctcagagaccagcggcagggggagcgtttagagcatgccgctgccctccgagctttgcaggaccagattcagacggccaaaacacaggagctgaatatgttacgggagcagaccactggtttggcagcagaactccaacagcagcaggcagaatatgaggatttgatggggcagaaggacgatttaaacagccagttgcaggaaagtttgagagccaactcaagactgctggaacaacttcaggaaataggtcaagagaaggaacagctgacccaggaacttcaggaggcaaggaagagtgcggagaagcggaaagcgatgttagatgaactcgcaatggagacgttacaggaaaagagccagcacaaagaggaattaggggctgttcggctaagacatgagaaagaggtactgggcgtccgtgccagatatgaacgcgagctgagagagttgcacgaagacaagaaaaggcaggaggaggaattgaggggacagattagagaggagaaagccagaacgcgagagctggagacactgcagcagaccgttgaggagctccaggctcaagtgcatagtatggacggtgcgaaaggttggtttgaacgcaggttaaaagaggctgaggaatcccttcagcagcagcagcaggagcaggaagaggcccttaagcagtgtcgggagcagcacgccgcagaactcaagggcaaagaggaggaactacaagatgtcagggatcagctcgagcaggcacaagaggaacgggactgtcatcttaagaccatcagctctctcaagcaggaagtcaaagacacagtagatggccagaggatactcgaaaagaaaggatcagcagcgctgaaagatcttaagagacagttacatctggagagaaaaagggctgataagcttcaggaacggctccaggacatcctgaccaacagcaaaagtcggagcggactggaggagctcgtgctgtctgaaatgaatagccccagtaggacccaaactggggactcatcctctatcagttcattctcctaccgcgaaatcctgcgcgaaaaggaatcttcagcagtaccagctagatctctttccagctcaccacaggcccagcccccacgcccagccgagctgagtgacgaggaagtagccgaactgttccagaggttggccgaaacccagcaggagaagtggatgctggaagagaaagtgaagcacctggaagtgtccagcgctagcatggctgaagatctgtgccgcaaatctgctatcatcgaaacctatgtgatggacagtcgcattgatgtatctgtggcagcaggccataccgacaggtctgggctcggctctgtccttagagacctggtcaaacccggagacgaaaaccttagggaaatgaacaaaaagttgcagaacatgcttgaggagcagctgacaaagaacatgcatctacacaaagacatggaagtgctttcacaggaaattgtgcggttgtcaaaagaatgcgtgggacccccagatcctgatctcgagccaggtgaaacatcctag
